United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 29

SEQ ID NO: 1057677 - RNA, 18 nt, Mycobacterium bovis subsp bovis AF2122/97
cccgaccacaccgggaug

SEQ ID NO: 1057678 - RNA, 16 nt, Mycobacterium bovis subsp bovis AF2122/97
cccgacaucgugaucc

SEQ ID NO: 1057679 - RNA, 14 nt, Mycobacterium bovis subsp bovis AF2122/97
cccgacaugcgccg

SEQ ID NO: 1057680 - RNA, 20 nt, Mycobacterium bovis subsp bovis AF2122/97
cccgacaugguccgaccagc

SEQ ID NO: 1057681 - RNA, 16 nt, Mycobacterium bovis subsp bovis AF2122/97
cccgacccgccgacgc

SEQ ID NO: 1057682 - RNA, 17 nt, Mycobacterium bovis subsp bovis AF2122/97
cccgacccugcugcagg

SEQ ID NO: 1057683 - RNA, 14 nt, Mycobacterium bovis subsp bovis AF2122/97
cccgacccaucacc

SEQ ID NO: 1057684 - RNA, 18 nt, Mycobacterium bovis subsp bovis AF2122/97
cccgacccaucaccagcg

SEQ ID NO: 1057685 - RNA, 18 nt, Mycobacterium bovis subsp bovis AF2122/97
cccgaacugggcgaucga

SEQ ID NO: 1057686 - RNA, 19 nt, Mycobacterium bovis subsp bovis AF2122/97
cccgaagaugaccucggcg

SEQ ID NO: 1057687 - RNA, 22 nt, Mycobacterium bovis subsp bovis AF2122/97
cccgaagaugaccucggcgacg

SEQ ID NO: 1057688 - RNA, 14 nt, Mycobacterium bovis subsp bovis AF2122/97
cccgaagccgaccg

SEQ ID NO: 1057689 - RNA, 12 nt, Mycobacterium bovis subsp bovis AF2122/97
cccgaaccgcgc

SEQ ID NO: 1057690 - RNA, 13 nt, Mycobacterium bovis subsp bovis AF2122/97
cccgaaccgcgcu

SEQ ID NO: 1057691 - RNA, 13 nt, Mycobacterium bovis subsp bovis AF2122/97
cccgaaccaccac

SEQ ID NO: 1057692 - RNA, 20 nt, Mycobacterium bovis subsp bovis AF2122/97
cccgaaccgcaaggcccaca

SEQ ID NO: 1057693 - RNA, 21 nt, Mycobacterium bovis subsp bovis AF2122/97
cccgaaaugccgggcccgacg

SEQ ID NO: 1057694 - RNA, 17 nt, Mycobacterium bovis subsp bovis AF2122/97
cccgaaauucucgcccu

SEQ ID NO: 1057695 - RNA, 17 nt, Mycobacterium bovis subsp bovis AF2122/97
cccgaacaauucacgca

SEQ ID NO: 1057696 - RNA, 18 nt, Mycobacterium bovis subsp bovis AF2122/97
cccgaacauccgccgccc

SEQ ID NO: 1057697 - RNA, 22 nt, Mycobacterium bovis subsp bovis AF2122/97
cccgaaacgccggguucgccgg

SEQ ID NO: 1057698 - RNA, 13 nt, Mycobacterium bovis subsp bovis AF2122/97
cccgaaacccgau

SEQ ID NO: 1057699 - RNA, 16 nt, Mycobacterium bovis subsp bovis AF2122/97
cccgaauggcaucagu

SEQ ID NO: 1057700 - RNA, 13 nt, Mycobacterium bovis subsp bovis AF2122/97
cccgaagucucgg

SEQ ID NO: 1057701 - RNA, 12 nt, Mycobacterium bovis subsp bovis AF2122/97
cccgaaucgugc

SEQ ID NO: 1057702 - RNA, 14 nt, Mycobacterium bovis subsp bovis AF2122/97
cccgaaucgugcgg

SEQ ID NO: 1057703 - RNA, 17 nt, Mycobacterium bovis subsp bovis AF2122/97
cccgaaguggugaccga

SEQ ID NO: 1057704 - RNA, 12 nt, Mycobacterium bovis subsp bovis AF2122/97
cccgaagguggg

SEQ ID NO: 1057705 - RNA, 14 nt, Mycobacterium bovis subsp bovis AF2122/97
cccgaaggcggcuc

SEQ ID NO: 1057706 - RNA, 15 nt, Mycobacterium bovis subsp bovis AF2122/97
cccgaagacggggug

SEQ ID NO: 1057707 - RNA, 16 nt, Mycobacterium bovis subsp bovis AF2122/97
cccgaagccggugccg

SEQ ID NO: 1057708 - RNA, 17 nt, Mycobacterium bovis subsp bovis AF2122/97
cccgaagcgggcggaaa

SEQ ID NO: 1057709 - RNA, 22 nt, Mycobacterium bovis subsp bovis AF2122/97
cccacuuuucgguggcggcagc

SEQ ID NO: 1057710 - RNA, 20 nt, Mycobacterium bovis subsp bovis AF2122/97
cccacuggugcagcgccgac

SEQ ID NO: 1057711 - RNA, 23 nt, Mycobacterium bovis subsp bovis AF2122/97
cccacuggugcagcgccgacagc

SEQ ID NO: 1057712 - RNA, 22 nt, Mycobacterium bovis subsp bovis AF2122/97
cccacuugauuuggggcagucc

SEQ ID NO: 1057713 - RNA, 16 nt, Mycobacterium bovis subsp bovis AF2122/97
cccacucggacccgca

SEQ ID NO: 1057714 - RNA, 17 nt, Mycobacterium bovis subsp bovis AF2122/97
cccacucggggacggcg

SEQ ID NO: 1057715 - RNA, 17 nt, Mycobacterium bovis subsp bovis AF2122/97
cccacucucgccacgcc

SEQ ID NO: 1057716 - RNA, 14 nt, Mycobacterium bovis subsp bovis AF2122/97
cccacugccacucc

SEQ ID NO: 1057717 - RNA, 13 nt, Mycobacterium bovis subsp bovis AF2122/97
cccacugggccgg

SEQ ID NO: 1057718 - RNA, 13 nt, Mycobacterium bovis subsp bovis AF2122/97
cccacuggcggac

SEQ ID NO: 1057719 - RNA, 16 nt, Mycobacterium bovis subsp bovis AF2122/97
cccacugccggugcug

SEQ ID NO: 1057720 - RNA, 13 nt, Mycobacterium bovis subsp bovis AF2122/97
cccacugccgugc

SEQ ID NO: 1057721 - RNA, 15 nt, Mycobacterium bovis subsp bovis AF2122/97
cccacugcccgccga

SEQ ID NO: 1057722 - RNA, 17 nt, Mycobacterium bovis subsp bovis AF2122/97
cccacugcccgccgacg

SEQ ID NO: 1057723 - RNA, 18 nt, Mycobacterium bovis subsp bovis AF2122/97
cccacuggcacacgguca

SEQ ID NO: 1057724 - RNA, 14 nt, Mycobacterium bovis subsp bovis AF2122/97
cccaccacgcgacg

SEQ ID NO: 1057725 - RNA, 23 nt, Mycobacterium bovis subsp bovis AF2122/97
cccaccacuagcuucgcuugccg

SEQ ID NO: 1057726 - RNA, 22 nt, Mycobacterium bovis subsp bovis AF2122/97
cccaccaccaccgccggugccg

SEQ ID NO: 1057727 - RNA, 20 nt, Mycobacterium bovis subsp bovis AF2122/97
cccacauuccguagccggcg

SEQ ID NO: 1057728 - RNA, 22 nt, Mycobacterium bovis subsp bovis AF2122/97
cccaccacgaacucggccgggc

SEQ ID NO: 1057729 - RNA, 20 nt, Mycobacterium bovis subsp bovis AF2122/97
cccacguugaugaugccggc

SEQ ID NO: 1057730 - RNA, 14 nt, Mycobacterium bovis subsp bovis AF2122/97
cccacguugacggc

SEQ ID NO: 1057731 - RNA, 14 nt, Mycobacterium bovis subsp bovis AF2122/97
cccacguggggccg

SEQ ID NO: 1057732 - RNA, 22 nt, Mycobacterium bovis subsp bovis AF2122/97
cccaccacaccaaggccgagcg

SEQ ID NO: 1057733 - RNA, 15 nt, Mycobacterium bovis subsp bovis AF2122/97
cccacagcuugcccg

SEQ ID NO: 1057734 - RNA, 22 nt, Mycobacterium bovis subsp bovis AF2122/97
cccacagcugacgagccggugg

SEQ ID NO: 1057735 - RNA, 22 nt, Mycobacterium bovis subsp bovis AF2122/97
cccacaggggcagcgcggccac

SEQ ID NO: 1057736 - RNA, 13 nt, Mycobacterium bovis subsp bovis AF2122/97
cccacaggcggcg

SEQ ID NO: 1057737 - RNA, 14 nt, Mycobacterium bovis subsp bovis AF2122/97
cccacaggcggcgc

SEQ ID NO: 1057738 - RNA, 16 nt, Mycobacterium bovis subsp bovis AF2122/97
cccacaugcgcucgcg

SEQ ID NO: 1057739 - RNA, 18 nt, Mycobacterium bovis subsp bovis AF2122/97
cccacaugcgcucgcgga

SEQ ID NO: 1057740 - RNA, 17 nt, Mycobacterium bovis subsp bovis AF2122/97
cccacaucaggucggcg

SEQ ID NO: 1057741 - RNA, 15 nt, Mycobacterium bovis subsp bovis AF2122/97
cccacaucgucggcg

SEQ ID NO: 1057742 - RNA, 17 nt, Mycobacterium bovis subsp bovis AF2122/97
cccacaguuaucagccg

SEQ ID NO: 1057743 - RNA, 16 nt, Mycobacterium bovis subsp bovis AF2122/97
cccacaguggcucgcg

SEQ ID NO: 1057744 - RNA, 15 nt, Mycobacterium bovis subsp bovis AF2122/97
cccagcccuuggcgc

SEQ ID NO: 1057745 - RNA, 14 nt, Mycobacterium bovis subsp bovis AF2122/97
cccagcccaugucg

SEQ ID NO: 1057746 - RNA, 16 nt, Mycobacterium bovis subsp bovis AF2122/97
cccagccccacccgcc

SEQ ID NO: 1057747 - RNA, 13 nt, Mycobacterium bovis subsp bovis AF2122/97
cccagccgccagc

SEQ ID NO: 1057748 - RNA, 18 nt, Mycobacterium bovis subsp bovis AF2122/97
cccagcccuuggcgcgca

SEQ ID NO: 1057749 - RNA, 17 nt, Mycobacterium bovis subsp bovis AF2122/97
cccagccgagcggcggc

SEQ ID NO: 1057750 - RNA, 12 nt, Mycobacterium bovis subsp bovis AF2122/97
cccagccgcgcc

SEQ ID NO: 1057751 - RNA, 15 nt, Mycobacterium bovis subsp bovis AF2122/97
cccagccgcgggccg

SEQ ID NO: 1057752 - RNA, 18 nt, Mycobacterium bovis subsp bovis AF2122/97
cccagcgacgcggccagc

SEQ ID NO: 1057753 - RNA, 20 nt, Mycobacterium bovis subsp bovis AF2122/97
cccagcgacgcggccagcgg

SEQ ID NO: 1057754 - RNA, 20 nt, Mycobacterium bovis subsp bovis AF2122/97
cccagcgaaucacccgcgag

SEQ ID NO: 1057755 - RNA, 16 nt, Mycobacterium bovis subsp bovis AF2122/97
cccagcgaccgcugca

SEQ ID NO: 1057756 - RNA, 20 nt, Mycobacterium bovis subsp bovis AF2122/97
cccagcgaccgcugcagauu

SEQ ID NO: 1057757 - RNA, 17 nt, Mycobacterium bovis subsp bovis AF2122/97
cccagccggcagcagcg

SEQ ID NO: 1057758 - RNA, 16 nt, Mycobacterium bovis subsp bovis AF2122/97
cccagccguucgucgc

SEQ ID NO: 1057759 - RNA, 14 nt, Mycobacterium bovis subsp bovis AF2122/97
cccagaccgccaca

SEQ ID NO: 1057760 - RNA, 15 nt, Mycobacterium bovis subsp bovis AF2122/97
cccagaccgccgacg

SEQ ID NO: 1057761 - RNA, 18 nt, Mycobacterium bovis subsp bovis AF2122/97
cccagacaauccgccgcc

SEQ ID NO: 1057762 - RNA, 13 nt, Mycobacterium bovis subsp bovis AF2122/97
cccagaacgccgu

SEQ ID NO: 1057763 - RNA, 16 nt, Mycobacterium bovis subsp bovis AF2122/97
cccagccaacucaggc

SEQ ID NO: 1057764 - RNA, 15 nt, Mycobacterium bovis subsp bovis AF2122/97
cccagcaucucggcg

SEQ ID NO: 1057765 - RNA, 21 nt, Mycobacterium bovis subsp bovis AF2122/97
cccagcaucucggcggccaac

SEQ ID NO: 1057766 - RNA, 21 nt, Mycobacterium bovis subsp bovis AF2122/97
cccagcaucuuuggcggccgc

SEQ ID NO: 1057767 - RNA, 18 nt, Mycobacterium bovis subsp bovis AF2122/97
cccagcaugaagucccgg

SEQ ID NO: 1057768 - RNA, 17 nt, Mycobacterium bovis subsp bovis AF2122/97
cccauacuugcgccgac

SEQ ID NO: 1057769 - RNA, 15 nt, Mycobacterium bovis subsp bovis AF2122/97
cccauacgccggccg

SEQ ID NO: 1057770 - RNA, 22 nt, Mycobacterium bovis subsp bovis AF2122/97
cccauacgugccgccgaugucg

SEQ ID NO: 1057771 - RNA, 19 nt, Mycobacterium bovis subsp bovis AF2122/97
cccaucgccuggaugccga

SEQ ID NO: 1057772 - RNA, 18 nt, Mycobacterium bovis subsp bovis AF2122/97
cccaucgcgacggcccga

SEQ ID NO: 1057773 - RNA, 15 nt, Mycobacterium bovis subsp bovis AF2122/97
cccauagccagccga

SEQ ID NO: 1057774 - RNA, 14 nt, Mycobacterium bovis subsp bovis AF2122/97
cccauagccggugg

SEQ ID NO: 1057775 - RNA, 16 nt, Mycobacterium bovis subsp bovis AF2122/97
cccauagcugccggcc

SEQ ID NO: 1057776 - RNA, 16 nt, Mycobacterium bovis subsp bovis AF2122/97
cccaugaccggccgcc

SEQ ID NO: 1057777 - RNA, 23 nt, Mycobacterium bovis subsp bovis AF2122/97
cccaucggggcuacaacugccga

SEQ ID NO: 1057778 - RNA, 17 nt, Mycobacterium bovis subsp bovis AF2122/97
cccagguuccgcugucg

SEQ ID NO: 1057779 - RNA, 20 nt, Mycobacterium bovis subsp bovis AF2122/97
cccagguuccgcugucgagc

SEQ ID NO: 1057780 - RNA, 15 nt, Mycobacterium bovis subsp bovis AF2122/97
cccaguuccacccgg

SEQ ID NO: 1057781 - RNA, 22 nt, Mycobacterium bovis subsp bovis AF2122/97
cccaggugguucaaccggacga

SEQ ID NO: 1057782 - RNA, 14 nt, Mycobacterium bovis subsp bovis AF2122/97
cccaggugggcagc

SEQ ID NO: 1057783 - RNA, 17 nt, Mycobacterium bovis subsp bovis AF2122/97
cccagggcucggcggcc

SEQ ID NO: 1057784 - RNA, 19 nt, Mycobacterium bovis subsp bovis AF2122/97
cccagggggcgugccgccg

SEQ ID NO: 1057785 - RNA, 14 nt, Mycobacterium bovis subsp bovis AF2122/97
cccaggguggcgac

SEQ ID NO: 1057786 - RNA, 15 nt, Mycobacterium bovis subsp bovis AF2122/97
cccaggugcaagcgg

SEQ ID NO: 1057787 - RNA, 15 nt, Mycobacterium bovis subsp bovis AF2122/97
cccagguccgcgugc

SEQ ID NO: 1057788 - RNA, 13 nt, Mycobacterium bovis subsp bovis AF2122/97
cccaggucaacga

SEQ ID NO: 1057789 - RNA, 23 nt, Mycobacterium bovis subsp bovis AF2122/97
cccagcgaggugggcgucaucga

SEQ ID NO: 1057790 - RNA, 13 nt, Mycobacterium bovis subsp bovis AF2122/97
cccagcgagcgcc

SEQ ID NO: 1057791 - RNA, 16 nt, Mycobacterium bovis subsp bovis AF2122/97
cccagcgcagcggacg

SEQ ID NO: 1057792 - RNA, 15 nt, Mycobacterium bovis subsp bovis AF2122/97
cccagcgcagcagcg

SEQ ID NO: 1057793 - RNA, 18 nt, Mycobacterium bovis subsp bovis AF2122/97
cccagcgacucggccagg

SEQ ID NO: 1057794 - RNA, 20 nt, Mycobacterium bovis subsp bovis AF2122/97
cccagcgcccgcgcggccac

SEQ ID NO: 1057795 - RNA, 21 nt, Mycobacterium bovis subsp bovis AF2122/97
cccagcgcccgcgcggccacu

SEQ ID NO: 1057796 - RNA, 13 nt, Mycobacterium bovis subsp bovis AF2122/97
cccagcgccgccg

SEQ ID NO: 1057797 - RNA, 22 nt, Mycobacterium bovis subsp bovis AF2122/97
cccagcugcggucgcggcugac

SEQ ID NO: 1057798 - RNA, 15 nt, Mycobacterium bovis subsp bovis AF2122/97
cccagcgccgaccca

SEQ ID NO: 1057799 - RNA, 21 nt, Mycobacterium bovis subsp bovis AF2122/97
cccagcuuucgcgucacccgg

SEQ ID NO: 1057800 - RNA, 14 nt, Mycobacterium bovis subsp bovis AF2122/97
cccaggacuccggc

SEQ ID NO: 1057801 - RNA, 16 nt, Mycobacterium bovis subsp bovis AF2122/97
cccaggacuccggccg

SEQ ID NO: 1057802 - RNA, 17 nt, Mycobacterium bovis subsp bovis AF2122/97
cccaggacuccggccgc

SEQ ID NO: 1057803 - RNA, 15 nt, Mycobacterium bovis subsp bovis AF2122/97
cccaggaacgggacg

SEQ ID NO: 1057804 - RNA, 15 nt, Mycobacterium bovis subsp bovis AF2122/97
cccagcuuggcgucg

SEQ ID NO: 1057805 - RNA, 18 nt, Mycobacterium bovis subsp bovis AF2122/97
cccaggcgcucagcgcgg

SEQ ID NO: 1057806 - RNA, 22 nt, Mycobacterium bovis subsp bovis AF2122/97
cccaggcgcucaucacccagcg

SEQ ID NO: 1057807 - RNA, 16 nt, Mycobacterium bovis subsp bovis AF2122/97
cccagggagugccgca

SEQ ID NO: 1057808 - RNA, 18 nt, Mycobacterium bovis subsp bovis AF2122/97
cccagggagugccgcacg

SEQ ID NO: 1057809 - RNA, 23 nt, Mycobacterium bovis subsp bovis AF2122/97
cccaggcguuuggcgugccgucg

SEQ ID NO: 1057810 - RNA, 13 nt, Mycobacterium bovis subsp bovis AF2122/97
cccaggcucgcac

SEQ ID NO: 1057811 - RNA, 18 nt, Mycobacterium bovis subsp bovis AF2122/97
cccaggaaggcgacgccg

SEQ ID NO: 1057812 - RNA, 12 nt, Mycobacterium bovis subsp bovis AF2122/97
cccaggaucgga

SEQ ID NO: 1057813 - RNA, 16 nt, Mycobacterium bovis subsp bovis AF2122/97
ccaucucaccgggccc

SEQ ID NO: 1057814 - RNA, 21 nt, Mycobacterium bovis subsp bovis AF2122/97
ccaucguugccggugccgccg

SEQ ID NO: 1057815 - RNA, 19 nt, Mycobacterium bovis subsp bovis AF2122/97
ccaucgucgagccgccaga

SEQ ID NO: 1057816 - RNA, 14 nt, Mycobacterium bovis subsp bovis AF2122/97
ccaucuccgccguc

SEQ ID NO: 1057817 - RNA, 22 nt, Mycobacterium bovis subsp bovis AF2122/97
ccaucuccggugugaucggcgg

SEQ ID NO: 1057818 - RNA, 16 nt, Mycobacterium bovis subsp bovis AF2122/97
ccaucucgggcaggcc

SEQ ID NO: 1057819 - RNA, 19 nt, Mycobacterium bovis subsp bovis AF2122/97
ccaucucgggcaggccguc

SEQ ID NO: 1057820 - RNA, 12 nt, Mycobacterium bovis subsp bovis AF2122/97
ccaucuggcgcg

SEQ ID NO: 1057821 - RNA, 16 nt, Mycobacterium bovis subsp bovis AF2122/97
ccaucuggcgcgccgu

SEQ ID NO: 1057822 - RNA, 14 nt, Mycobacterium bovis subsp bovis AF2122/97
ccauggcgcgcaac

SEQ ID NO: 1057823 - RNA, 22 nt, Mycobacterium bovis subsp bovis AF2122/97
ccaugcgguuuggaucacccgc

SEQ ID NO: 1057824 - RNA, 16 nt, Mycobacterium bovis subsp bovis AF2122/97
ccauggcgccgcgccg

SEQ ID NO: 1057825 - RNA, 22 nt, Mycobacterium bovis subsp bovis AF2122/97
ccaugggacacaauccacgucg

SEQ ID NO: 1057826 - RNA, 20 nt, Mycobacterium bovis subsp bovis AF2122/97
ccaugggaguucaucgcacg

SEQ ID NO: 1057827 - RNA, 21 nt, Mycobacterium bovis subsp bovis AF2122/97
ccaugggaguucaucgcacga

SEQ ID NO: 1057828 - RNA, 20 nt, Mycobacterium bovis subsp bovis AF2122/97
ccauggcugugcccacgcgc

SEQ ID NO: 1057829 - RNA, 16 nt, Mycobacterium bovis subsp bovis AF2122/97
ccaugggauucggcca

SEQ ID NO: 1057830 - RNA, 20 nt, Mycobacterium bovis subsp bovis AF2122/97
ccaugcgggugucgggcagc

SEQ ID NO: 1057831 - RNA, 22 nt, Mycobacterium bovis subsp bovis AF2122/97
ccaugcgggugucgggcagcaa

SEQ ID NO: 1057832 - RNA, 22 nt, Mycobacterium bovis subsp bovis AF2122/97
ccaugcgcaccaguccagcggg

SEQ ID NO: 1057833 - RNA, 15 nt, Mycobacterium bovis subsp bovis AF2122/97
ccaugcgcaccaguc

SEQ ID NO: 1057834 - RNA, 17 nt, Mycobacterium bovis subsp bovis AF2122/97
ccaugcgccaacccggc

SEQ ID NO: 1057835 - RNA, 20 nt, Mycobacterium bovis subsp bovis AF2122/97
ccaucggggccgucggggag

SEQ ID NO: 1057836 - RNA, 12 nt, Mycobacterium bovis subsp bovis AF2122/97
ccaucggugcgc

SEQ ID NO: 1057837 - RNA, 16 nt, Mycobacterium bovis subsp bovis AF2122/97
ccaucggugguggcgu

SEQ ID NO: 1057838 - RNA, 20 nt, Mycobacterium bovis subsp bovis AF2122/97
ccaucggugguggcgucgau

SEQ ID NO: 1057839 - RNA, 19 nt, Mycobacterium bovis subsp bovis AF2122/97
ccaucggcuaggccggccg

SEQ ID NO: 1057840 - RNA, 12 nt, Mycobacterium bovis subsp bovis AF2122/97
ccaucgggcgcg

SEQ ID NO: 1057841 - RNA, 16 nt, Mycobacterium bovis subsp bovis AF2122/97
ccaucggggaaggggc

SEQ ID NO: 1057842 - RNA, 21 nt, Mycobacterium bovis subsp bovis AF2122/97
ccaucggggaaggggcucagc

SEQ ID NO: 1057843 - RNA, 16 nt, Mycobacterium bovis subsp bovis AF2122/97
ccaucgucgagccgcc

SEQ ID NO: 1057844 - RNA, 13 nt, Mycobacterium bovis subsp bovis AF2122/97
ccaucgguugacc

SEQ ID NO: 1057845 - RNA, 13 nt, Mycobacterium bovis subsp bovis AF2122/97
ccaucgucgcgcc

SEQ ID NO: 1057846 - RNA, 14 nt, Mycobacterium bovis subsp bovis AF2122/97
ccaucgucgcgccg

SEQ ID NO: 1057847 - RNA, 15 nt, Mycobacterium bovis subsp bovis AF2122/97
ccaucgucgcgccgc

SEQ ID NO: 1057848 - RNA, 14 nt, Mycobacterium bovis subsp bovis AF2122/97
ccaucgucggcaac

SEQ ID NO: 1057849 - RNA, 16 nt, Mycobacterium bovis subsp bovis AF2122/97
ccaucggcaccagcgc

SEQ ID NO: 1057850 - RNA, 14 nt, Mycobacterium bovis subsp bovis AF2122/97
ccaucagcgucgac

SEQ ID NO: 1057851 - RNA, 14 nt, Mycobacterium bovis subsp bovis AF2122/97
ccaucagcgcgacc

SEQ ID NO: 1057852 - RNA, 13 nt, Mycobacterium bovis subsp bovis AF2122/97
ccaucaccgcaag

SEQ ID NO: 1057853 - RNA, 19 nt, Mycobacterium bovis subsp bovis AF2122/97
ccaucaccgccagccccgc

SEQ ID NO: 1057854 - RNA, 17 nt, Mycobacterium bovis subsp bovis AF2122/97
ccaucaacgccggcgac

SEQ ID NO: 1057855 - RNA, 16 nt, Mycobacterium bovis subsp bovis AF2122/97
ccaucacauccacgca

SEQ ID NO: 1057856 - RNA, 18 nt, Mycobacterium bovis subsp bovis AF2122/97
ccaucaccacggccgccg

SEQ ID NO: 1057857 - RNA, 12 nt, Mycobacterium bovis subsp bovis AF2122/97
ccaucacggugg

SEQ ID NO: 1057858 - RNA, 17 nt, Mycobacterium bovis subsp bovis AF2122/97
ccaucacggucagcucg

SEQ ID NO: 1057859 - RNA, 14 nt, Mycobacterium bovis subsp bovis AF2122/97
ccaucaccggcggc

SEQ ID NO: 1057860 - RNA, 12 nt, Mycobacterium bovis subsp bovis AF2122/97
ccaucaccgccg

SEQ ID NO: 1057861 - RNA, 12 nt, Mycobacterium bovis subsp bovis AF2122/97
ccaucaccgcgc

SEQ ID NO: 1057862 - RNA, 14 nt, Mycobacterium bovis subsp bovis AF2122/97
ccaucacgguggcc

SEQ ID NO: 1057863 - RNA, 14 nt, Mycobacterium bovis subsp bovis AF2122/97
ccaucagcccggcg

SEQ ID NO: 1057864 - RNA, 14 nt, Mycobacterium bovis subsp bovis AF2122/97
ccaugucggugacc

SEQ ID NO: 1057865 - RNA, 20 nt, Mycobacterium bovis subsp bovis AF2122/97
ccaugucggugaccguucgg

SEQ ID NO: 1057866 - RNA, 21 nt, Mycobacterium bovis subsp bovis AF2122/97
ccaugucggugaccguucggc

SEQ ID NO: 1057867 - RNA, 23 nt, Mycobacterium bovis subsp bovis AF2122/97
ccaugucggugaggaagcggccg

SEQ ID NO: 1057868 - RNA, 13 nt, Mycobacterium bovis subsp bovis AF2122/97
ccaugucggccag

SEQ ID NO: 1057869 - RNA, 14 nt, Mycobacterium bovis subsp bovis AF2122/97
ccaugucggccagg

SEQ ID NO: 1057870 - RNA, 16 nt, Mycobacterium bovis subsp bovis AF2122/97
ccaugucggcgcgccg

SEQ ID NO: 1057871 - RNA, 22 nt, Mycobacterium bovis subsp bovis AF2122/97
ccaugucggcgcgccgcacacg

SEQ ID NO: 1057872 - RNA, 23 nt, Mycobacterium bovis subsp bovis AF2122/97
ccaugucuccgacauuggccguc

SEQ ID NO: 1057873 - RNA, 19 nt, Mycobacterium bovis subsp bovis AF2122/97
ccauguugaagcgaagcca

SEQ ID NO: 1057874 - RNA, 15 nt, Mycobacterium bovis subsp bovis AF2122/97
ccaugugucccggac

SEQ ID NO: 1057875 - RNA, 19 nt, Mycobacterium bovis subsp bovis AF2122/97
ccauguggcgucgcucguc

SEQ ID NO: 1057876 - RNA, 22 nt, Mycobacterium bovis subsp bovis AF2122/97
ccauguggcgucgcucgucguc

SEQ ID NO: 1057877 - RNA, 17 nt, Mycobacterium bovis subsp bovis AF2122/97
ccaugguguucggcagc

SEQ ID NO: 1057878 - RNA, 21 nt, Mycobacterium bovis subsp bovis AF2122/97
ccaugguguucggcagcgcgg

SEQ ID NO: 1057879 - RNA, 22 nt, Mycobacterium bovis subsp bovis AF2122/97
ccaugguugaugugcaggacgu

SEQ ID NO: 1057880 - RNA, 21 nt, Mycobacterium bovis subsp bovis AF2122/97
ccaugguggcgccgacguaca

SEQ ID NO: 1057881 - RNA, 22 nt, Mycobacterium bovis subsp bovis AF2122/97
ccaugguggcgccgacguacag

SEQ ID NO: 1057882 - RNA, 21 nt, Mycobacterium bovis subsp bovis AF2122/97
ccaugguccaagugggccggc

SEQ ID NO: 1057883 - RNA, 21 nt, Mycobacterium bovis subsp bovis AF2122/97
ccauguagccguugccgccga

SEQ ID NO: 1057884 - RNA, 21 nt, Mycobacterium bovis subsp bovis AF2122/97
ccaugucagcggccugcucgg

SEQ ID NO: 1057885 - RNA, 22 nt, Mycobacterium bovis subsp bovis AF2122/97
ccauugcgggcucaacaccagc

SEQ ID NO: 1057886 - RNA, 22 nt, Mycobacterium bovis subsp bovis AF2122/97
ccaugugcgacauuggucaccu

SEQ ID NO: 1057887 - RNA, 19 nt, Mycobacterium bovis subsp bovis AF2122/97
ccauuggccaagucagccc

SEQ ID NO: 1057888 - RNA, 21 nt, Mycobacterium bovis subsp bovis AF2122/97
ccauuggccaagucagcccga

SEQ ID NO: 1057889 - RNA, 15 nt, Mycobacterium bovis subsp bovis AF2122/97
ccauuggcgccgccg

SEQ ID NO: 1057890 - RNA, 15 nt, Mycobacterium bovis subsp bovis AF2122/97
cccaaaaacggcagc

SEQ ID NO: 1057891 - RNA, 15 nt, Mycobacterium bovis subsp bovis AF2122/97
cccaaaaagaccgcc

SEQ ID NO: 1057892 - RNA, 16 nt, Mycobacterium bovis subsp bovis AF2122/97
cccaacgaccaccacc

SEQ ID NO: 1057893 - RNA, 13 nt, Mycobacterium bovis subsp bovis AF2122/97
cccaaccgcgcca

SEQ ID NO: 1057894 - RNA, 14 nt, Mycobacterium bovis subsp bovis AF2122/97
cccaaccgguggcc

SEQ ID NO: 1057895 - RNA, 15 nt, Mycobacterium bovis subsp bovis AF2122/97
cccaaccgguggccg

SEQ ID NO: 1057896 - RNA, 16 nt, Mycobacterium bovis subsp bovis AF2122/97
cccaacgcgggugccg

SEQ ID NO: 1057897 - RNA, 21 nt, Mycobacterium bovis subsp bovis AF2122/97
cccaacgcgguaaagccccgc

SEQ ID NO: 1057898 - RNA, 16 nt, Mycobacterium bovis subsp bovis AF2122/97
cccaacggaagaccgc

SEQ ID NO: 1057899 - RNA, 15 nt, Mycobacterium bovis subsp bovis AF2122/97
cccaacaggcgggac

SEQ ID NO: 1057900 - RNA, 16 nt, Mycobacterium bovis subsp bovis AF2122/97
cccaacagggcggcag

SEQ ID NO: 1057901 - RNA, 18 nt, Mycobacterium bovis subsp bovis AF2122/97
cccaacagggcggcaggg

SEQ ID NO: 1057902 - RNA, 16 nt, Mycobacterium bovis subsp bovis AF2122/97
cccaaccccgccggcc

SEQ ID NO: 1057903 - RNA, 17 nt, Mycobacterium bovis subsp bovis AF2122/97
cccaaccccgccggccg

SEQ ID NO: 1057904 - RNA, 16 nt, Mycobacterium bovis subsp bovis AF2122/97
cccaacccggcggcag

SEQ ID NO: 1057905 - RNA, 12 nt, Mycobacterium bovis subsp bovis AF2122/97
cccaacacagcc

SEQ ID NO: 1057906 - RNA, 13 nt, Mycobacterium bovis subsp bovis AF2122/97
cccaacaccagca

SEQ ID NO: 1057907 - RNA, 14 nt, Mycobacterium bovis subsp bovis AF2122/97
cccaacaccagcag

SEQ ID NO: 1057908 - RNA, 17 nt, Mycobacterium bovis subsp bovis AF2122/97
cccaacaccagcagcac

SEQ ID NO: 1057909 - RNA, 14 nt, Mycobacterium bovis subsp bovis AF2122/97
cccaaagcgccagc

SEQ ID NO: 1057910 - RNA, 19 nt, Mycobacterium bovis subsp bovis AF2122/97
cccaaguccagcagcgacg

SEQ ID NO: 1057911 - RNA, 18 nt, Mycobacterium bovis subsp bovis AF2122/97
cccaagcucggucaacgc

SEQ ID NO: 1057912 - RNA, 15 nt, Mycobacterium bovis subsp bovis AF2122/97
cccaaggccaggauc

SEQ ID NO: 1057913 - RNA, 14 nt, Mycobacterium bovis subsp bovis AF2122/97
cccaacgccacugc

SEQ ID NO: 1057914 - RNA, 19 nt, Mycobacterium bovis subsp bovis AF2122/97
cccaacuccaucagcgcga

SEQ ID NO: 1057915 - RNA, 15 nt, Mycobacterium bovis subsp bovis AF2122/97
cccaacucggccagc

SEQ ID NO: 1057916 - RNA, 21 nt, Mycobacterium bovis subsp bovis AF2122/97
cccaagaccaagugucgccgc

SEQ ID NO: 1057917 - RNA, 16 nt, Mycobacterium bovis subsp bovis AF2122/97
cccacaccagcgcagc

SEQ ID NO: 1057918 - RNA, 13 nt, Mycobacterium bovis subsp bovis AF2122/97
cccacacccggga

SEQ ID NO: 1057919 - RNA, 21 nt, Mycobacterium bovis subsp bovis AF2122/97
cccacacggucgucgcgagcg

SEQ ID NO: 1057920 - RNA, 12 nt, Mycobacterium bovis subsp bovis AF2122/97
cccacagcagga

SEQ ID NO: 1057921 - RNA, 14 nt, Mycobacterium bovis subsp bovis AF2122/97
cccacacggugcga

SEQ ID NO: 1057922 - RNA, 21 nt, Mycobacterium bovis subsp bovis AF2122/97
cccacagcgugcgggucuuug

SEQ ID NO: 1057923 - RNA, 14 nt, Mycobacterium bovis subsp bovis AF2122/97
cccaaucgaccgcc

SEQ ID NO: 1057924 - RNA, 22 nt, Mycobacterium bovis subsp bovis AF2122/97
cccaaucgaccgcccgccaacu

SEQ ID NO: 1057925 - RNA, 17 nt, Mycobacterium bovis subsp bovis AF2122/97
cccaaucgucggccagc

SEQ ID NO: 1057926 - RNA, 21 nt, Mycobacterium bovis subsp bovis AF2122/97
cccaauccaccgauucggcga

SEQ ID NO: 1057927 - RNA, 22 nt, Mycobacterium bovis subsp bovis AF2122/97
cccaauccaccgauucggcgac

SEQ ID NO: 1057928 - RNA, 22 nt, Mycobacterium bovis subsp bovis AF2122/97
cccaauccgcaacagcucggcc

SEQ ID NO: 1057929 - RNA, 14 nt, Mycobacterium bovis subsp bovis AF2122/97
cccacaacucggca

SEQ ID NO: 1057930 - RNA, 17 nt, Mycobacterium bovis subsp bovis AF2122/97
cccacacacccgacacg

SEQ ID NO: 1057931 - RNA, 22 nt, Mycobacterium bovis subsp bovis AF2122/97
ccaggauuaagguguggucggc

SEQ ID NO: 1057932 - RNA, 23 nt, Mycobacterium bovis subsp bovis AF2122/97
ccagcguggagaucacgugccgg

SEQ ID NO: 1057933 - RNA, 16 nt, Mycobacterium bovis subsp bovis AF2122/97
ccagcgugcugccgga

SEQ ID NO: 1057934 - RNA, 21 nt, Mycobacterium bovis subsp bovis AF2122/97
ccagcgucucgaucaccucgc

SEQ ID NO: 1057935 - RNA, 19 nt, Mycobacterium bovis subsp bovis AF2122/97
ccagcgugcccgccaccgg

SEQ ID NO: 1057936 - RNA, 14 nt, Mycobacterium bovis subsp bovis AF2122/97
ccaggccaacggcg

SEQ ID NO: 1057937 - RNA, 23 nt, Mycobacterium bovis subsp bovis AF2122/97
ccaggccaacggcgcugccggga

SEQ ID NO: 1057938 - RNA, 20 nt, Mycobacterium bovis subsp bovis AF2122/97
ccaggccaagguggccacca

SEQ ID NO: 1057939 - RNA, 13 nt, Mycobacterium bovis subsp bovis AF2122/97
ccaggccaccggc

SEQ ID NO: 1057940 - RNA, 14 nt, Mycobacterium bovis subsp bovis AF2122/97
ccaggccaccggcu

SEQ ID NO: 1057941 - RNA, 13 nt, Mycobacterium bovis subsp bovis AF2122/97
ccaggcagcuugc

SEQ ID NO: 1057942 - RNA, 21 nt, Mycobacterium bovis subsp bovis AF2122/97
ccaggcacguccgaucggcgc

SEQ ID NO: 1057943 - RNA, 18 nt, Mycobacterium bovis subsp bovis AF2122/97
ccaggcacaacaucgccg

SEQ ID NO: 1057944 - RNA, 20 nt, Mycobacterium bovis subsp bovis AF2122/97
ccaggcacaacaucgccgca

SEQ ID NO: 1057945 - RNA, 14 nt, Mycobacterium bovis subsp bovis AF2122/97
ccaggcaccacgac

SEQ ID NO: 1057946 - RNA, 17 nt, Mycobacterium bovis subsp bovis AF2122/97
ccaggcaccacgaccga

SEQ ID NO: 1057947 - RNA, 12 nt, Mycobacterium bovis subsp bovis AF2122/97
ccaggcaccacg

SEQ ID NO: 1057948 - RNA, 18 nt, Mycobacterium bovis subsp bovis AF2122/97
ccaggcacccuguacgaa

SEQ ID NO: 1057949 - RNA, 16 nt, Mycobacterium bovis subsp bovis AF2122/97
ccaggcccuggccagc

SEQ ID NO: 1057950 - RNA, 16 nt, Mycobacterium bovis subsp bovis AF2122/97
ccaggcccucgacggc

SEQ ID NO: 1057951 - RNA, 19 nt, Mycobacterium bovis subsp bovis AF2122/97
ccaggcccucgacggcguc

SEQ ID NO: 1057952 - RNA, 23 nt, Mycobacterium bovis subsp bovis AF2122/97
ccaggcccucgacggcgucgacu

SEQ ID NO: 1057953 - RNA, 14 nt, Mycobacterium bovis subsp bovis AF2122/97
ccaggccgagccgc

SEQ ID NO: 1057954 - RNA, 16 nt, Mycobacterium bovis subsp bovis AF2122/97
ccaggccgaccgcgca

SEQ ID NO: 1057955 - RNA, 18 nt, Mycobacterium bovis subsp bovis AF2122/97
ccaggcccccucggcgug

SEQ ID NO: 1057956 - RNA, 14 nt, Mycobacterium bovis subsp bovis AF2122/97
ccaggccgccgcca

SEQ ID NO: 1057957 - RNA, 17 nt, Mycobacterium bovis subsp bovis AF2122/97
ccaggccgaucagcgcg

SEQ ID NO: 1057958 - RNA, 21 nt, Mycobacterium bovis subsp bovis AF2122/97
ccaggccgaucagcgcggcgc

SEQ ID NO: 1057959 - RNA, 13 nt, Mycobacterium bovis subsp bovis AF2122/97
ccaggccgcgcgc

SEQ ID NO: 1057960 - RNA, 14 nt, Mycobacterium bovis subsp bovis AF2122/97
ccaggccgcgcgca

SEQ ID NO: 1057961 - RNA, 17 nt, Mycobacterium bovis subsp bovis AF2122/97
ccaggcccgacacggcg

SEQ ID NO: 1057962 - RNA, 19 nt, Mycobacterium bovis subsp bovis AF2122/97
ccaggcccauacgugccgc

SEQ ID NO: 1057963 - RNA, 18 nt, Mycobacterium bovis subsp bovis AF2122/97
ccaggcccagccgagcgg

SEQ ID NO: 1057964 - RNA, 19 nt, Mycobacterium bovis subsp bovis AF2122/97
ccaggcccagccgagcggc

SEQ ID NO: 1057965 - RNA, 23 nt, Mycobacterium bovis subsp bovis AF2122/97
ccaggcccagccgagcggcggca

SEQ ID NO: 1057966 - RNA, 14 nt, Mycobacterium bovis subsp bovis AF2122/97
ccaggccacugccg

SEQ ID NO: 1057967 - RNA, 15 nt, Mycobacterium bovis subsp bovis AF2122/97
ccaggccacugccga

SEQ ID NO: 1057968 - RNA, 15 nt, Mycobacterium bovis subsp bovis AF2122/97
ccaggccagggcggu

SEQ ID NO: 1057969 - RNA, 15 nt, Mycobacterium bovis subsp bovis AF2122/97
ccaggccggcccgca

SEQ ID NO: 1057970 - RNA, 20 nt, Mycobacterium bovis subsp bovis AF2122/97
ccaggccguccucggucagc

SEQ ID NO: 1057971 - RNA, 13 nt, Mycobacterium bovis subsp bovis AF2122/97
ccaggccggcacc

SEQ ID NO: 1057972 - RNA, 21 nt, Mycobacterium bovis subsp bovis AF2122/97
ccaggccgucaggcgugccgg

SEQ ID NO: 1057973 - RNA, 16 nt, Mycobacterium bovis subsp bovis AF2122/97
ccaggccguacucgau

SEQ ID NO: 1057974 - RNA, 14 nt, Mycobacterium bovis subsp bovis AF2122/97
ccaggccggugacg

SEQ ID NO: 1057975 - RNA, 21 nt, Mycobacterium bovis subsp bovis AF2122/97
ccaggccguagcccacgacga

SEQ ID NO: 1057976 - RNA, 22 nt, Mycobacterium bovis subsp bovis AF2122/97
ccaggccguugcuauucgccag

SEQ ID NO: 1057977 - RNA, 15 nt, Mycobacterium bovis subsp bovis AF2122/97
ccaggccuaguccgg

SEQ ID NO: 1057978 - RNA, 23 nt, Mycobacterium bovis subsp bovis AF2122/97
ccaggccuaguccggcacugcgg

SEQ ID NO: 1057979 - RNA, 19 nt, Mycobacterium bovis subsp bovis AF2122/97
ccaggcgagccgccaccgu

SEQ ID NO: 1057980 - RNA, 18 nt, Mycobacterium bovis subsp bovis AF2122/97
ccaggcgagccggcgcgc

SEQ ID NO: 1057981 - RNA, 15 nt, Mycobacterium bovis subsp bovis AF2122/97
ccaggcgaccgcuga

SEQ ID NO: 1057982 - RNA, 18 nt, Mycobacterium bovis subsp bovis AF2122/97
ccaggcgaaguacccggc

SEQ ID NO: 1057983 - RNA, 22 nt, Mycobacterium bovis subsp bovis AF2122/97
ccaggcgaagucgacucgccac

SEQ ID NO: 1057984 - RNA, 22 nt, Mycobacterium bovis subsp bovis AF2122/97
ccaggcgcauagggccaccgcc

SEQ ID NO: 1057985 - RNA, 23 nt, Mycobacterium bovis subsp bovis AF2122/97
ccaggcgcauagggccaccgccg

SEQ ID NO: 1057986 - RNA, 18 nt, Mycobacterium bovis subsp bovis AF2122/97
ccaggcgcgaucgcgccc

SEQ ID NO: 1057987 - RNA, 17 nt, Mycobacterium bovis subsp bovis AF2122/97
ccaggcgcgcaccaccg

SEQ ID NO: 1057988 - RNA, 19 nt, Mycobacterium bovis subsp bovis AF2122/97
ccaggcgcgcaccaccgcg

SEQ ID NO: 1057989 - RNA, 23 nt, Mycobacterium bovis subsp bovis AF2122/97
ccaggcgcgcaccaccgcggcgg

SEQ ID NO: 1057990 - RNA, 14 nt, Mycobacterium bovis subsp bovis AF2122/97
ccaggcgcgccgca

SEQ ID NO: 1057991 - RNA, 19 nt, Mycobacterium bovis subsp bovis AF2122/97
ccaggcgcgccgcacccgg

SEQ ID NO: 1057992 - RNA, 12 nt, Mycobacterium bovis subsp bovis AF2122/97
ccaggcgcgccg

SEQ ID NO: 1057993 - RNA, 16 nt, Mycobacterium bovis subsp bovis AF2122/97
ccaggcgcucagcgcg

SEQ ID NO: 1057994 - RNA, 23 nt, Mycobacterium bovis subsp bovis AF2122/97
ccaggcgcucagcgcggccacgc

SEQ ID NO: 1057995 - RNA, 14 nt, Mycobacterium bovis subsp bovis AF2122/97
ccaggcgcggccca

SEQ ID NO: 1057996 - RNA, 17 nt, Mycobacterium bovis subsp bovis AF2122/97
ccaggcggacgccgcgc

SEQ ID NO: 1057997 - RNA, 13 nt, Mycobacterium bovis subsp bovis AF2122/97
ccaggcgcugcag

SEQ ID NO: 1057998 - RNA, 15 nt, Mycobacterium bovis subsp bovis AF2122/97
ccaggcggcgcgggu

SEQ ID NO: 1057999 - RNA, 12 nt, Mycobacterium bovis subsp bovis AF2122/97
ccaggcggccgc

SEQ ID NO: 1058000 - RNA, 22 nt, Mycobacterium bovis subsp bovis AF2122/97
ccaggcucgauguccucgagcc

SEQ ID NO: 1058001 - RNA, 20 nt, Mycobacterium bovis subsp bovis AF2122/97
ccaggcugaucccgaugcug

SEQ ID NO: 1058002 - RNA, 22 nt, Mycobacterium bovis subsp bovis AF2122/97
ccaggcucgagguguagcccuc

SEQ ID NO: 1058003 - RNA, 20 nt, Mycobacterium bovis subsp bovis AF2122/97
ccaggcuccggccggccagc

SEQ ID NO: 1058004 - RNA, 20 nt, Mycobacterium bovis subsp bovis AF2122/97
ccaggcguuuggcgugccgu

SEQ ID NO: 1058005 - RNA, 21 nt, Mycobacterium bovis subsp bovis AF2122/97
ccaggcguuuggcgugccguc

SEQ ID NO: 1058006 - RNA, 18 nt, Mycobacterium bovis subsp bovis AF2122/97
ccaggcgguacgggucgc

SEQ ID NO: 1058007 - RNA, 15 nt, Mycobacterium bovis subsp bovis AF2122/97
ccaggcgggcggcac

SEQ ID NO: 1058008 - RNA, 15 nt, Mycobacterium bovis subsp bovis AF2122/97
ccaggcgugcaucgc

SEQ ID NO: 1058009 - RNA, 12 nt, Mycobacterium bovis subsp bovis AF2122/97
ccagggagugcc

SEQ ID NO: 1058010 - RNA, 16 nt, Mycobacterium bovis subsp bovis AF2122/97
ccagggcaacggccgc

SEQ ID NO: 1058011 - RNA, 17 nt, Mycobacterium bovis subsp bovis AF2122/97
ccagggcacaucgggcg

SEQ ID NO: 1058012 - RNA, 20 nt, Mycobacterium bovis subsp bovis AF2122/97
ccagggcacguggcgguaca

SEQ ID NO: 1058013 - RNA, 22 nt, Mycobacterium bovis subsp bovis AF2122/97
ccaggguggucaguccgucggc

SEQ ID NO: 1058014 - RNA, 17 nt, Mycobacterium bovis subsp bovis AF2122/97
ccaggguguauggccac

SEQ ID NO: 1058015 - RNA, 22 nt, Mycobacterium bovis subsp bovis AF2122/97
ccaggcugcgcagugacgccuc

SEQ ID NO: 1058016 - RNA, 16 nt, Mycobacterium bovis subsp bovis AF2122/97
ccaggcuguggccagc

SEQ ID NO: 1058017 - RNA, 15 nt, Mycobacterium bovis subsp bovis AF2122/97
ccaggcuguggccag

SEQ ID NO: 1058018 - RNA, 22 nt, Mycobacterium bovis subsp bovis AF2122/97
ccaggcugguccgggugccggu

SEQ ID NO: 1058019 - RNA, 19 nt, Mycobacterium bovis subsp bovis AF2122/97
ccaggcuggcgucaccgcg

SEQ ID NO: 1058020 - RNA, 20 nt, Mycobacterium bovis subsp bovis AF2122/97
ccaggcuggcgucaccgcgg

SEQ ID NO: 1058021 - RNA, 20 nt, Mycobacterium bovis subsp bovis AF2122/97
ccaggucgagcaccggcugc

SEQ ID NO: 1058022 - RNA, 18 nt, Mycobacterium bovis subsp bovis AF2122/97
ccaggucgauaccggcgu

SEQ ID NO: 1058023 - RNA, 20 nt, Mycobacterium bovis subsp bovis AF2122/97
ccaggucgccagcucggcac

SEQ ID NO: 1058024 - RNA, 21 nt, Mycobacterium bovis subsp bovis AF2122/97
ccaggucgccagcucggcacc

SEQ ID NO: 1058025 - RNA, 20 nt, Mycobacterium bovis subsp bovis AF2122/97
ccaggguuggcaccgucaga

SEQ ID NO: 1058026 - RNA, 14 nt, Mycobacterium bovis subsp bovis AF2122/97
ccagguacucagug

SEQ ID NO: 1058027 - RNA, 19 nt, Mycobacterium bovis subsp bovis AF2122/97
ccagguacgcgaucagcgc

SEQ ID NO: 1058028 - RNA, 21 nt, Mycobacterium bovis subsp bovis AF2122/97
ccagguacgcgaucagcgcgc

SEQ ID NO: 1058029 - RNA, 22 nt, Mycobacterium bovis subsp bovis AF2122/97
ccagguacgcgaucagcgcgca

SEQ ID NO: 1058030 - RNA, 16 nt, Mycobacterium bovis subsp bovis AF2122/97
ccagguaaccccgcac

SEQ ID NO: 1058031 - RNA, 17 nt, Mycobacterium bovis subsp bovis AF2122/97
ccagguaaugguggcgu

SEQ ID NO: 1058032 - RNA, 19 nt, Mycobacterium bovis subsp bovis AF2122/97
ccaggugucgucgaucgcg

SEQ ID NO: 1058033 - RNA, 14 nt, Mycobacterium bovis subsp bovis AF2122/97
ccaggugggcagca

SEQ ID NO: 1058034 - RNA, 12 nt, Mycobacterium bovis subsp bovis AF2122/97
ccagguggccgc

SEQ ID NO: 1058035 - RNA, 16 nt, Mycobacterium bovis subsp bovis AF2122/97
ccagguguguggcggc

SEQ ID NO: 1058036 - RNA, 22 nt, Mycobacterium bovis subsp bovis AF2122/97
ccagguguucgccggagacccg

SEQ ID NO: 1058037 - RNA, 20 nt, Mycobacterium bovis subsp bovis AF2122/97
ccaggugggugaacgccugc

SEQ ID NO: 1058038 - RNA, 12 nt, Mycobacterium bovis subsp bovis AF2122/97
ccaggucggcca

SEQ ID NO: 1058039 - RNA, 16 nt, Mycobacterium bovis subsp bovis AF2122/97
ccaggugcccaagcag

SEQ ID NO: 1058040 - RNA, 12 nt, Mycobacterium bovis subsp bovis AF2122/97
ccaguagccggu

SEQ ID NO: 1058041 - RNA, 20 nt, Mycobacterium bovis subsp bovis AF2122/97
ccaguagccggugccggcgc

SEQ ID NO: 1058042 - RNA, 21 nt, Mycobacterium bovis subsp bovis AF2122/97
ccaguagccggugccggcgca

SEQ ID NO: 1058043 - RNA, 23 nt, Mycobacterium bovis subsp bovis AF2122/97
ccaguaggcaagcauuuccgcga

SEQ ID NO: 1058044 - RNA, 16 nt, Mycobacterium bovis subsp bovis AF2122/97
ccaguaccaccggcac

SEQ ID NO: 1058045 - RNA, 19 nt, Mycobacterium bovis subsp bovis AF2122/97
ccaguaccaccggcaccgg

SEQ ID NO: 1058046 - RNA, 17 nt, Mycobacterium bovis subsp bovis AF2122/97
ccagugcaucggucagc

SEQ ID NO: 1058047 - RNA, 15 nt, Mycobacterium bovis subsp bovis AF2122/97
ccaguauggccgcca

SEQ ID NO: 1058048 - RNA, 18 nt, Mycobacterium bovis subsp bovis AF2122/97
ccagugcccgcacugccg

SEQ ID NO: 1058049 - RNA, 14 nt, Mycobacterium bovis subsp bovis AF2122/97
ccagugccacgccu

SEQ ID NO: 1058050 - RNA, 19 nt, Mycobacterium bovis subsp bovis AF2122/97
ccagugccagaacccggac

SEQ ID NO: 1058051 - RNA, 16 nt, Mycobacterium bovis subsp bovis AF2122/97
ccaguccaugugccca

SEQ ID NO: 1058052 - RNA, 20 nt, Mycobacterium bovis subsp bovis AF2122/97
ccagugcgcaacccagccgc

SEQ ID NO: 1058053 - RNA, 22 nt, Mycobacterium bovis subsp bovis AF2122/97
ccagugcgcaacccagccgcgc

SEQ ID NO: 1058054 - RNA, 23 nt, Mycobacterium bovis subsp bovis AF2122/97
ccagugcgcagaacaccaccgcc

SEQ ID NO: 1058055 - RNA, 13 nt, Mycobacterium bovis subsp bovis AF2122/97
ccagugcgcagcc

SEQ ID NO: 1058056 - RNA, 16 nt, Mycobacterium bovis subsp bovis AF2122/97
ccaguucgcgccacgc

SEQ ID NO: 1058057 - RNA, 21 nt, Mycobacterium bovis subsp bovis AF2122/97
ccaguucggugagccgggcgg

SEQ ID NO: 1058058 - RNA, 17 nt, Mycobacterium bovis subsp bovis AF2122/97
ccaguucggcggccgcc

SEQ ID NO: 1058059 - RNA, 13 nt, Mycobacterium bovis subsp bovis AF2122/97
ccaguucggcguc

SEQ ID NO: 1058060 - RNA, 12 nt, Mycobacterium bovis subsp bovis AF2122/97
ccagucacgccc

SEQ ID NO: 1058061 - RNA, 22 nt, Mycobacterium bovis subsp bovis AF2122/97
ccagugcggccuuggcgacguc

SEQ ID NO: 1058062 - RNA, 14 nt, Mycobacterium bovis subsp bovis AF2122/97
ccagugcugcaccg

SEQ ID NO: 1058063 - RNA, 20 nt, Mycobacterium bovis subsp bovis AF2122/97
ccaucaacauugugcucgcc

SEQ ID NO: 1058064 - RNA, 13 nt, Mycobacterium bovis subsp bovis AF2122/97
ccauauuggcgcg

SEQ ID NO: 1058065 - RNA, 21 nt, Mycobacterium bovis subsp bovis AF2122/97
ccauaucgaucggaucggcac

SEQ ID NO: 1058066 - RNA, 21 nt, Mycobacterium bovis subsp bovis AF2122/97
ccauaucgcagcguuggccgc

SEQ ID NO: 1058067 - RNA, 13 nt, Mycobacterium bovis subsp bovis AF2122/97
ccauaucgcccac

SEQ ID NO: 1058068 - RNA, 17 nt, Mycobacterium bovis subsp bovis AF2122/97
ccauaauauugccgccu

SEQ ID NO: 1058069 - RNA, 16 nt, Mycobacterium bovis subsp bovis AF2122/97
ccauagccgcgacccg

SEQ ID NO: 1058070 - RNA, 19 nt, Mycobacterium bovis subsp bovis AF2122/97
ccauagccgcgacccgcgc

SEQ ID NO: 1058071 - RNA, 17 nt, Mycobacterium bovis subsp bovis AF2122/97
ccauagccugcgccgac

SEQ ID NO: 1058072 - RNA, 12 nt, Mycobacterium bovis subsp bovis AF2122/97
aucccccggcug

SEQ ID NO: 1058073 - RNA, 14 nt, Mycobacterium bovis subsp bovis AF2122/97
aucccagaucggcg

SEQ ID NO: 1058074 - RNA, 15 nt, Mycobacterium bovis subsp bovis AF2122/97
auccauucggcggcg

SEQ ID NO: 1058075 - RNA, 19 nt, Mycobacterium bovis subsp bovis AF2122/97
auccauucggcggcggcgu

SEQ ID NO: 1058076 - RNA, 18 nt, Mycobacterium bovis subsp bovis AF2122/97
aucccaacccaugaugug

SEQ ID NO: 1058077 - RNA, 16 nt, Mycobacterium bovis subsp bovis AF2122/97
auccaguaaccguccg

SEQ ID NO: 1058078 - RNA, 17 nt, Mycobacterium bovis subsp bovis AF2122/97
auccaguaaccguccgc

SEQ ID NO: 1058079 - RNA, 19 nt, Mycobacterium bovis subsp bovis AF2122/97
auccagugcgguggccagu

SEQ ID NO: 1058080 - RNA, 15 nt, Mycobacterium bovis subsp bovis AF2122/97
auccaguucaccgcg

SEQ ID NO: 1058081 - RNA, 13 nt, Mycobacterium bovis subsp bovis AF2122/97
auccaugucgcgc

SEQ ID NO: 1058082 - RNA, 20 nt, Mycobacterium bovis subsp bovis AF2122/97
auccauccgggccgcggcca

SEQ ID NO: 1058083 - RNA, 23 nt, Mycobacterium bovis subsp bovis AF2122/97
auccaugauggccgucagccagg

SEQ ID NO: 1058084 - RNA, 17 nt, Mycobacterium bovis subsp bovis AF2122/97
auccaggccaguuuggc

SEQ ID NO: 1058085 - RNA, 19 nt, Mycobacterium bovis subsp bovis AF2122/97
auccaggcgugcaucgcga

SEQ ID NO: 1058086 - RNA, 20 nt, Mycobacterium bovis subsp bovis AF2122/97
auccaggcgugcaucgcgau

SEQ ID NO: 1058087 - RNA, 15 nt, Mycobacterium bovis subsp bovis AF2122/97
auccaggcuguggcc

SEQ ID NO: 1058088 - RNA, 16 nt, Mycobacterium bovis subsp bovis AF2122/97
auccagguagaccgga

SEQ ID NO: 1058089 - RNA, 14 nt, Mycobacterium bovis subsp bovis AF2122/97
auccagggugccgg

SEQ ID NO: 1058090 - RNA, 19 nt, Mycobacterium bovis subsp bovis AF2122/97
auccagggugccggucacg

SEQ ID NO: 1058091 - RNA, 17 nt, Mycobacterium bovis subsp bovis AF2122/97
auccagcgcugaccggc

SEQ ID NO: 1058092 - RNA, 13 nt, Mycobacterium bovis subsp bovis AF2122/97
auccagccgucgg

SEQ ID NO: 1058093 - RNA, 15 nt, Mycobacterium bovis subsp bovis AF2122/97
auccagccgucggcg

SEQ ID NO: 1058094 - RNA, 14 nt, Mycobacterium bovis subsp bovis AF2122/97
auccagccgugcgg

SEQ ID NO: 1058095 - RNA, 16 nt, Mycobacterium bovis subsp bovis AF2122/97
auccagccgugcggcg

SEQ ID NO: 1058096 - RNA, 15 nt, Mycobacterium bovis subsp bovis AF2122/97
auccagccaugcggu

SEQ ID NO: 1058097 - RNA, 16 nt, Mycobacterium bovis subsp bovis AF2122/97
auccagcccgacgccc

SEQ ID NO: 1058098 - RNA, 20 nt, Mycobacterium bovis subsp bovis AF2122/97
auccagcagccaggagccga

SEQ ID NO: 1058099 - RNA, 18 nt, Mycobacterium bovis subsp bovis AF2122/97
auccagcaggccgucgau

SEQ ID NO: 1058100 - RNA, 15 nt, Mycobacterium bovis subsp bovis AF2122/97
auccagagacauguc

SEQ ID NO: 1058101 - RNA, 21 nt, Mycobacterium bovis subsp bovis AF2122/97
auccacgacaucguaggccgg

SEQ ID NO: 1058102 - RNA, 20 nt, Mycobacterium bovis subsp bovis AF2122/97
auccagagacaugucgcugc

SEQ ID NO: 1058103 - RNA, 17 nt, Mycobacterium bovis subsp bovis AF2122/97
auccacggcgaugcagc

SEQ ID NO: 1058104 - RNA, 19 nt, Mycobacterium bovis subsp bovis AF2122/97
auccacggucgaccaggac

SEQ ID NO: 1058105 - RNA, 15 nt, Mycobacterium bovis subsp bovis AF2122/97
auccacgguugccgg

SEQ ID NO: 1058106 - RNA, 17 nt, Mycobacterium bovis subsp bovis AF2122/97
auccacgguugccggcg

SEQ ID NO: 1058107 - RNA, 20 nt, Mycobacterium bovis subsp bovis AF2122/97
auccacgguugccggcggcg

SEQ ID NO: 1058108 - RNA, 23 nt, Mycobacterium bovis subsp bovis AF2122/97
auccacgguugccggcggcgacg

SEQ ID NO: 1058109 - RNA, 15 nt, Mycobacterium bovis subsp bovis AF2122/97
auccacuccgccaac

SEQ ID NO: 1058110 - RNA, 22 nt, Mycobacterium bovis subsp bovis AF2122/97
auccacuuccgggcgaccaaca

SEQ ID NO: 1058111 - RNA, 16 nt, Mycobacterium bovis subsp bovis AF2122/97
auccacgucgcggcgu

SEQ ID NO: 1058112 - RNA, 18 nt, Mycobacterium bovis subsp bovis AF2122/97
auccagaacaacggcgcg

SEQ ID NO: 1058113 - RNA, 13 nt, Mycobacterium bovis subsp bovis AF2122/97
auccccgcggcgg

SEQ ID NO: 1058114 - RNA, 13 nt, Mycobacterium bovis subsp bovis AF2122/97
auccccgccggcg

SEQ ID NO: 1058115 - RNA, 14 nt, Mycobacterium bovis subsp bovis AF2122/97
auccccgccggcgc

SEQ ID NO: 1058116 - RNA, 16 nt, Mycobacterium bovis subsp bovis AF2122/97
auccccuugguggcca

SEQ ID NO: 1058117 - RNA, 20 nt, Mycobacterium bovis subsp bovis AF2122/97
aucccgccacaccaacgucg

SEQ ID NO: 1058118 - RNA, 11 nt, Mycobacterium bovis subsp bovis AF2122/97
aucccgccacc

SEQ ID NO: 1058119 - RNA, 13 nt, Mycobacterium bovis subsp bovis AF2122/97
aucccgccaccga

SEQ ID NO: 1058120 - RNA, 18 nt, Mycobacterium bovis subsp bovis AF2122/97
aucccgcaaaccgguccg

SEQ ID NO: 1058121 - RNA, 15 nt, Mycobacterium bovis subsp bovis AF2122/97
aucccgccgcccgca

SEQ ID NO: 1058122 - RNA, 14 nt, Mycobacterium bovis subsp bovis AF2122/97
aucccgccgcugcc

SEQ ID NO: 1058123 - RNA, 19 nt, Mycobacterium bovis subsp bovis AF2122/97
aucccgccgcugccgccgg

SEQ ID NO: 1058124 - RNA, 14 nt, Mycobacterium bovis subsp bovis AF2122/97
aucccggccagcuc

SEQ ID NO: 1058125 - RNA, 12 nt, Mycobacterium bovis subsp bovis AF2122/97
aucccggccagg

SEQ ID NO: 1058126 - RNA, 14 nt, Mycobacterium bovis subsp bovis AF2122/97
aucccggccaggcc

SEQ ID NO: 1058127 - RNA, 18 nt, Mycobacterium bovis subsp bovis AF2122/97
aucccggccaggggcgca

SEQ ID NO: 1058128 - RNA, 20 nt, Mycobacterium bovis subsp bovis AF2122/97
aucccggccaggggcgcagc

SEQ ID NO: 1058129 - RNA, 20 nt, Mycobacterium bovis subsp bovis AF2122/97
aucccggccuccauaucgca

SEQ ID NO: 1058130 - RNA, 17 nt, Mycobacterium bovis subsp bovis AF2122/97
aucccggaacgccgcca

SEQ ID NO: 1058131 - RNA, 18 nt, Mycobacterium bovis subsp bovis AF2122/97
aucccgcucccccgccaa

SEQ ID NO: 1058132 - RNA, 18 nt, Mycobacterium bovis subsp bovis AF2122/97
aucccgggcaguccaggc

SEQ ID NO: 1058133 - RNA, 13 nt, Mycobacterium bovis subsp bovis AF2122/97
aucccggaccgau

SEQ ID NO: 1058134 - RNA, 14 nt, Mycobacterium bovis subsp bovis AF2122/97
aucccggagccgcu

SEQ ID NO: 1058135 - RNA, 18 nt, Mycobacterium bovis subsp bovis AF2122/97
aucccgugauccgccgac

SEQ ID NO: 1058136 - RNA, 18 nt, Mycobacterium bovis subsp bovis AF2122/97
aucccguauucgaugccg

SEQ ID NO: 1058137 - RNA, 14 nt, Mycobacterium bovis subsp bovis AF2122/97
aucccgguggcagc

SEQ ID NO: 1058138 - RNA, 21 nt, Mycobacterium bovis subsp bovis AF2122/97
aucccggugucgaugcgcagc

SEQ ID NO: 1058139 - RNA, 22 nt, Mycobacterium bovis subsp bovis AF2122/97
aucccgguuccggcgaucaacg

SEQ ID NO: 1058140 - RNA, 11 nt, Mycobacterium bovis subsp bovis AF2122/97
auccgccgccg

SEQ ID NO: 1058141 - RNA, 16 nt, Mycobacterium bovis subsp bovis AF2122/97
auccggucucggccga

SEQ ID NO: 1058142 - RNA, 20 nt, Mycobacterium bovis subsp bovis AF2122/97
auccggucgaugucagccac

SEQ ID NO: 1058143 - RNA, 18 nt, Mycobacterium bovis subsp bovis AF2122/97
auccggugccgcgaucgc

SEQ ID NO: 1058144 - RNA, 19 nt, Mycobacterium bovis subsp bovis AF2122/97
auccgguggcuggccgcca

SEQ ID NO: 1058145 - RNA, 15 nt, Mycobacterium bovis subsp bovis AF2122/97
auccggucgaugacc

SEQ ID NO: 1058146 - RNA, 14 nt, Mycobacterium bovis subsp bovis AF2122/97
auccggccgagccg

SEQ ID NO: 1058147 - RNA, 17 nt, Mycobacterium bovis subsp bovis AF2122/97
auccggcauacaucgcc

SEQ ID NO: 1058148 - RNA, 21 nt, Mycobacterium bovis subsp bovis AF2122/97
auccggccagaguuaccaggu

SEQ ID NO: 1058149 - RNA, 17 nt, Mycobacterium bovis subsp bovis AF2122/97
auccggcccaccggucg

SEQ ID NO: 1058150 - RNA, 18 nt, Mycobacterium bovis subsp bovis AF2122/97
auccggcccaccggucgc

SEQ ID NO: 1058151 - RNA, 19 nt, Mycobacterium bovis subsp bovis AF2122/97
auccgcgcgcauauccgca

SEQ ID NO: 1058152 - RNA, 22 nt, Mycobacterium bovis subsp bovis AF2122/97
auccgcgcgcuggaccugauga

SEQ ID NO: 1058153 - RNA, 19 nt, Mycobacterium bovis subsp bovis AF2122/97
auccggcagaccggugcug

SEQ ID NO: 1058154 - RNA, 19 nt, Mycobacterium bovis subsp bovis AF2122/97
auccggcagcagccggcgg

SEQ ID NO: 1058155 - RNA, 14 nt, Mycobacterium bovis subsp bovis AF2122/97
auccgcgacggcgc

SEQ ID NO: 1058156 - RNA, 18 nt, Mycobacterium bovis subsp bovis AF2122/97
auccgcgauucgaccggu

SEQ ID NO: 1058157 - RNA, 20 nt, Mycobacterium bovis subsp bovis AF2122/97
auccgccgggcgccgugccc

SEQ ID NO: 1058158 - RNA, 19 nt, Mycobacterium bovis subsp bovis AF2122/97
aucaggccgacgucgacca

SEQ ID NO: 1058159 - RNA, 24 nt, Mycobacterium bovis subsp bovis AF2122/97
aucaggccgacgucgaccacugcc

SEQ ID NO: 1058160 - RNA, 16 nt, Mycobacterium bovis subsp bovis AF2122/97
aucaggccgaugacga

SEQ ID NO: 1058161 - RNA, 21 nt, Mycobacterium bovis subsp bovis AF2122/97
aucaggccgaugacgaugccg

SEQ ID NO: 1058162 - RNA, 21 nt, Mycobacterium bovis subsp bovis AF2122/97
aucaggacgcgaucggcguca

SEQ ID NO: 1058163 - RNA, 19 nt, Mycobacterium bovis subsp bovis AF2122/97
aucaggcucgccgaugcug

SEQ ID NO: 1058164 - RNA, 19 nt, Mycobacterium bovis subsp bovis AF2122/97
aucagcucgcgcacgucga

SEQ ID NO: 1058165 - RNA, 18 nt, Mycobacterium bovis subsp bovis AF2122/97
aucagcucgaugccgugu

SEQ ID NO: 1058166 - RNA, 18 nt, Mycobacterium bovis subsp bovis AF2122/97
aucaggaaccgcucguca

SEQ ID NO: 1058167 - RNA, 18 nt, Mycobacterium bovis subsp bovis AF2122/97
aucagcuugugggcgacg

SEQ ID NO: 1058168 - RNA, 22 nt, Mycobacterium bovis subsp bovis AF2122/97
aucagcucagugaugcgccccg

SEQ ID NO: 1058169 - RNA, 15 nt, Mycobacterium bovis subsp bovis AF2122/97
aucagcucgaugccg

SEQ ID NO: 1058170 - RNA, 13 nt, Mycobacterium bovis subsp bovis AF2122/97
aucaggucggcga

SEQ ID NO: 1058171 - RNA, 22 nt, Mycobacterium bovis subsp bovis AF2122/97
aucaguagcagcggcucggcgg

SEQ ID NO: 1058172 - RNA, 22 nt, Mycobacterium bovis subsp bovis AF2122/97
aucagguuggugcucagcggcu

SEQ ID NO: 1058173 - RNA, 20 nt, Mycobacterium bovis subsp bovis AF2122/97
aucagggccccaccgagcgg

SEQ ID NO: 1058174 - RNA, 16 nt, Mycobacterium bovis subsp bovis AF2122/97
aucagggugucgaaga

SEQ ID NO: 1058175 - RNA, 23 nt, Mycobacterium bovis subsp bovis AF2122/97
aucagggucugcgccgccggcgg

SEQ ID NO: 1058176 - RNA, 23 nt, Mycobacterium bovis subsp bovis AF2122/97
aucagguccuaggugugcgacga

SEQ ID NO: 1058177 - RNA, 14 nt, Mycobacterium bovis subsp bovis AF2122/97
aucaggguggcgcg

SEQ ID NO: 1058178 - RNA, 21 nt, Mycobacterium bovis subsp bovis AF2122/97
aucaggucgccgagaccggcc

SEQ ID NO: 1058179 - RNA, 22 nt, Mycobacterium bovis subsp bovis AF2122/97
aucagugcgugauggcggcgca

SEQ ID NO: 1058180 - RNA, 20 nt, Mycobacterium bovis subsp bovis AF2122/97
aucagugaagacaccaggcc

SEQ ID NO: 1058181 - RNA, 21 nt, Mycobacterium bovis subsp bovis AF2122/97
aucagucugggcgaucgcuuc

SEQ ID NO: 1058182 - RNA, 20 nt, Mycobacterium bovis subsp bovis AF2122/97
aucaguugcacaccgaucgg

SEQ ID NO: 1058183 - RNA, 21 nt, Mycobacterium bovis subsp bovis AF2122/97
aucauagacagggccgcucgc

SEQ ID NO: 1058184 - RNA, 21 nt, Mycobacterium bovis subsp bovis AF2122/97
aucaucccguauucgaugccg

SEQ ID NO: 1058185 - RNA, 16 nt, Mycobacterium bovis subsp bovis AF2122/97
aucauccacaccggau

SEQ ID NO: 1058186 - RNA, 21 nt, Mycobacterium bovis subsp bovis AF2122/97
aucaugaacgcaagcagcgcg

SEQ ID NO: 1058187 - RNA, 22 nt, Mycobacterium bovis subsp bovis AF2122/97
aucaucucgguggacggcaggc

SEQ ID NO: 1058188 - RNA, 20 nt, Mycobacterium bovis subsp bovis AF2122/97
aucauguccaucgcgcggcu

SEQ ID NO: 1058189 - RNA, 20 nt, Mycobacterium bovis subsp bovis AF2122/97
aucauguucuuuugcgucug

SEQ ID NO: 1058190 - RNA, 21 nt, Mycobacterium bovis subsp bovis AF2122/97
aucauguggucaacggccgac

SEQ ID NO: 1058191 - RNA, 23 nt, Mycobacterium bovis subsp bovis AF2122/97
aucauguucuuuugcgucugcug

SEQ ID NO: 1058192 - RNA, 20 nt, Mycobacterium bovis subsp bovis AF2122/97
auccaagaaagugcacacaa

SEQ ID NO: 1058193 - RNA, 18 nt, Mycobacterium bovis subsp bovis AF2122/97
auccacacacagccggug

SEQ ID NO: 1058194 - RNA, 15 nt, Mycobacterium bovis subsp bovis AF2122/97
auccacaccgcggcg

SEQ ID NO: 1058195 - RNA, 23 nt, Mycobacterium bovis subsp bovis AF2122/97
auccaauccacgguugccggcgg

SEQ ID NO: 1058196 - RNA, 13 nt, Mycobacterium bovis subsp bovis AF2122/97
auccaacgcacgc

SEQ ID NO: 1058197 - RNA, 14 nt, Mycobacterium bovis subsp bovis AF2122/97
auccaacgcggcgc

SEQ ID NO: 1058198 - RNA, 19 nt, Mycobacterium bovis subsp bovis AF2122/97
auccacggagaccggccgg

SEQ ID NO: 1058199 - RNA, 14 nt, Mycobacterium bovis subsp bovis AF2122/97
auccacgccgggca

SEQ ID NO: 1058200 - RNA, 14 nt, Mycobacterium bovis subsp bovis AF2122/97
auccacccgacgac

SEQ ID NO: 1058201 - RNA, 19 nt, Mycobacterium bovis subsp bovis AF2122/97
aucgucgccaugcugcccu

SEQ ID NO: 1058202 - RNA, 14 nt, Mycobacterium bovis subsp bovis AF2122/97
aucgucgccgauca

SEQ ID NO: 1058203 - RNA, 16 nt, Mycobacterium bovis subsp bovis AF2122/97
aucgucgccaagccca

SEQ ID NO: 1058204 - RNA, 14 nt, Mycobacterium bovis subsp bovis AF2122/97
aucgucgccacgau

SEQ ID NO: 1058205 - RNA, 12 nt, Mycobacterium bovis subsp bovis AF2122/97
aucgucgccaug

SEQ ID NO: 1058206 - RNA, 15 nt, Mycobacterium bovis subsp bovis AF2122/97
aucgucgucgcugcc

SEQ ID NO: 1058207 - RNA, 16 nt, Mycobacterium bovis subsp bovis AF2122/97
aucgucgugcacggcg

SEQ ID NO: 1058208 - RNA, 19 nt, Mycobacterium bovis subsp bovis AF2122/97
aucgucgugcacggcggcc

SEQ ID NO: 1058209 - RNA, 12 nt, Mycobacterium bovis subsp bovis AF2122/97
aucgucggguca

SEQ ID NO: 1058210 - RNA, 13 nt, Mycobacterium bovis subsp bovis AF2122/97
aucgucggccagc

SEQ ID NO: 1058211 - RNA, 17 nt, Mycobacterium bovis subsp bovis AF2122/97
aucguggcgaccacgau

SEQ ID NO: 1058212 - RNA, 15 nt, Mycobacterium bovis subsp bovis AF2122/97
aucguggcgcccguc

SEQ ID NO: 1058213 - RNA, 14 nt, Mycobacterium bovis subsp bovis AF2122/97
aucgucgugucgcc

SEQ ID NO: 1058214 - RNA, 16 nt, Mycobacterium bovis subsp bovis AF2122/97
aucgucgugucgccgc

SEQ ID NO: 1058215 - RNA, 19 nt, Mycobacterium bovis subsp bovis AF2122/97
aucgucggguugucgcggu

SEQ ID NO: 1058216 - RNA, 18 nt, Mycobacterium bovis subsp bovis AF2122/97
aucguggcggcgucgaca

SEQ ID NO: 1058217 - RNA, 21 nt, Mycobacterium bovis subsp bovis AF2122/97
aucguguacauugccgacccg

SEQ ID NO: 1058218 - RNA, 15 nt, Mycobacterium bovis subsp bovis AF2122/97
aucgucaguuacgca

SEQ ID NO: 1058219 - RNA, 22 nt, Mycobacterium bovis subsp bovis AF2122/97
aucgucaguuacgcaucgucag

SEQ ID NO: 1058220 - RNA, 13 nt, Mycobacterium bovis subsp bovis AF2122/97
aucgucacgcggg

SEQ ID NO: 1058221 - RNA, 19 nt, Mycobacterium bovis subsp bovis AF2122/97
aucgucacgcggguugcgc

SEQ ID NO: 1058222 - RNA, 17 nt, Mycobacterium bovis subsp bovis AF2122/97
aucgucaacgacgacga

SEQ ID NO: 1058223 - RNA, 18 nt, Mycobacterium bovis subsp bovis AF2122/97
aucgucaagaacgccacg

SEQ ID NO: 1058224 - RNA, 20 nt, Mycobacterium bovis subsp bovis AF2122/97
aucgucaagccgggcacggg

SEQ ID NO: 1058225 - RNA, 18 nt, Mycobacterium bovis subsp bovis AF2122/97
aucgucgacgccgaucgc

SEQ ID NO: 1058226 - RNA, 19 nt, Mycobacterium bovis subsp bovis AF2122/97
aucgucgaaccggaugcgg

SEQ ID NO: 1058227 - RNA, 20 nt, Mycobacterium bovis subsp bovis AF2122/97
aucgucgaaccggaugcggu

SEQ ID NO: 1058228 - RNA, 16 nt, Mycobacterium bovis subsp bovis AF2122/97
aucgucgacgcgucgu

SEQ ID NO: 1058229 - RNA, 19 nt, Mycobacterium bovis subsp bovis AF2122/97
aucgucgagccgaucgccc

SEQ ID NO: 1058230 - RNA, 14 nt, Mycobacterium bovis subsp bovis AF2122/97
aucgucgagccgcc

SEQ ID NO: 1058231 - RNA, 15 nt, Mycobacterium bovis subsp bovis AF2122/97
aucgucgagcgcggu

SEQ ID NO: 1058232 - RNA, 18 nt, Mycobacterium bovis subsp bovis AF2122/97
aucgucaucccgagcucu

SEQ ID NO: 1058233 - RNA, 14 nt, Mycobacterium bovis subsp bovis AF2122/97
aucgucacugccac

SEQ ID NO: 1058234 - RNA, 16 nt, Mycobacterium bovis subsp bovis AF2122/97
aucgucacugccaccu

SEQ ID NO: 1058235 - RNA, 13 nt, Mycobacterium bovis subsp bovis AF2122/97
aucguccggccgg

SEQ ID NO: 1058236 - RNA, 14 nt, Mycobacterium bovis subsp bovis AF2122/97
aucgucccgcggcg

SEQ ID NO: 1058237 - RNA, 16 nt, Mycobacterium bovis subsp bovis AF2122/97
aucucgucgucgcggc

SEQ ID NO: 1058238 - RNA, 15 nt, Mycobacterium bovis subsp bovis AF2122/97
aucucgucgaucucg

SEQ ID NO: 1058239 - RNA, 16 nt, Mycobacterium bovis subsp bovis AF2122/97
aucuccagcgguucgg

SEQ ID NO: 1058240 - RNA, 16 nt, Mycobacterium bovis subsp bovis AF2122/97
aucucguagccgccgu

SEQ ID NO: 1058241 - RNA, 16 nt, Mycobacterium bovis subsp bovis AF2122/97
aucucuccggcggcga

SEQ ID NO: 1058242 - RNA, 14 nt, Mycobacterium bovis subsp bovis AF2122/97
aucguuccgauccg

SEQ ID NO: 1058243 - RNA, 16 nt, Mycobacterium bovis subsp bovis AF2122/97
aucguuccaggccgcg

SEQ ID NO: 1058244 - RNA, 14 nt, Mycobacterium bovis subsp bovis AF2122/97
aucuccaccggcga

SEQ ID NO: 1058245 - RNA, 16 nt, Mycobacterium bovis subsp bovis AF2122/97
aucuccaccgucgccg

SEQ ID NO: 1058246 - RNA, 18 nt, Mycobacterium bovis subsp bovis AF2122/97
aucuccaccgucgccgcc

SEQ ID NO: 1058247 - RNA, 23 nt, Mycobacterium bovis subsp bovis AF2122/97
aucuccaaguagcacuucagcuu

SEQ ID NO: 1058248 - RNA, 19 nt, Mycobacterium bovis subsp bovis AF2122/97
aucuccaccgucgccgccg

SEQ ID NO: 1058249 - RNA, 19 nt, Mycobacterium bovis subsp bovis AF2122/97
aucuccacccgccggccgu

SEQ ID NO: 1058250 - RNA, 16 nt, Mycobacterium bovis subsp bovis AF2122/97
aucgggaagccgccgg

SEQ ID NO: 1058251 - RNA, 13 nt, Mycobacterium bovis subsp bovis AF2122/97
aucgggaaugacc

SEQ ID NO: 1058252 - RNA, 21 nt, Mycobacterium bovis subsp bovis AF2122/97
aucggcuuggcugugauguug

SEQ ID NO: 1058253 - RNA, 14 nt, Mycobacterium bovis subsp bovis AF2122/97
aucggccagcuuga

SEQ ID NO: 1058254 - RNA, 18 nt, Mycobacterium bovis subsp bovis AF2122/97
aucggcuggccgcgccuc

SEQ ID NO: 1058255 - RNA, 19 nt, Mycobacterium bovis subsp bovis AF2122/97
aucggcaucgacugccagc

SEQ ID NO: 1058256 - RNA, 20 nt, Mycobacterium bovis subsp bovis AF2122/97
aucggccagccguucucgcc

SEQ ID NO: 1058257 - RNA, 20 nt, Mycobacterium bovis subsp bovis AF2122/97
aucggccacgucccagagaa

SEQ ID NO: 1058258 - RNA, 15 nt, Mycobacterium bovis subsp bovis AF2122/97
aucgggcggcaccgc

SEQ ID NO: 1058259 - RNA, 18 nt, Mycobacterium bovis subsp bovis AF2122/97
aucgggccacagcaacgu

SEQ ID NO: 1058260 - RNA, 15 nt, Mycobacterium bovis subsp bovis AF2122/97
aucgggcccguccug

SEQ ID NO: 1058261 - RNA, 19 nt, Mycobacterium bovis subsp bovis AF2122/97
aucgggccgaauaccacac

SEQ ID NO: 1058262 - RNA, 22 nt, Mycobacterium bovis subsp bovis AF2122/97
aucgggccgaucucuccggcgg

SEQ ID NO: 1058263 - RNA, 14 nt, Mycobacterium bovis subsp bovis AF2122/97
aucgggccggcgcg

SEQ ID NO: 1058264 - RNA, 14 nt, Mycobacterium bovis subsp bovis AF2122/97
aucgggaucgcugc

SEQ ID NO: 1058265 - RNA, 17 nt, Mycobacterium bovis subsp bovis AF2122/97
aucgggaucgcugccag

SEQ ID NO: 1058266 - RNA, 13 nt, Mycobacterium bovis subsp bovis AF2122/97
aucgggagccgca

SEQ ID NO: 1058267 - RNA, 19 nt, Mycobacterium bovis subsp bovis AF2122/97
aucggcuugggaaacccgg

SEQ ID NO: 1058268 - RNA, 23 nt, Mycobacterium bovis subsp bovis AF2122/97
aucgggaaugucuuuggucgccg

SEQ ID NO: 1058269 - RNA, 13 nt, Mycobacterium bovis subsp bovis AF2122/97
aucggcaucggcg

SEQ ID NO: 1058270 - RNA, 16 nt, Mycobacterium bovis subsp bovis AF2122/97
aucggcaucggcgacg

SEQ ID NO: 1058271 - RNA, 17 nt, Mycobacterium bovis subsp bovis AF2122/97
aucggcaucggcgacga

SEQ ID NO: 1058272 - RNA, 15 nt, Mycobacterium bovis subsp bovis AF2122/97
aucggccaacaccac

SEQ ID NO: 1058273 - RNA, 19 nt, Mycobacterium bovis subsp bovis AF2122/97
aucggcaggguggccagca

SEQ ID NO: 1058274 - RNA, 22 nt, Mycobacterium bovis subsp bovis AF2122/97
aucggcagucccagcgccgcac

SEQ ID NO: 1058275 - RNA, 23 nt, Mycobacterium bovis subsp bovis AF2122/97
aucggcagucccagcgccgcaca

SEQ ID NO: 1058276 - RNA, 22 nt, Mycobacterium bovis subsp bovis AF2122/97
aucggcagccccugccgauccc

SEQ ID NO: 1058277 - RNA, 15 nt, Mycobacterium bovis subsp bovis AF2122/97
aucggaccgaccggc

SEQ ID NO: 1058278 - RNA, 16 nt, Mycobacterium bovis subsp bovis AF2122/97
aucggaccgaccggcu

SEQ ID NO: 1058279 - RNA, 18 nt, Mycobacterium bovis subsp bovis AF2122/97
aucggaaucgcgagcuug

SEQ ID NO: 1058280 - RNA, 15 nt, Mycobacterium bovis subsp bovis AF2122/97
aucggacaacacggc

SEQ ID NO: 1058281 - RNA, 19 nt, Mycobacterium bovis subsp bovis AF2122/97
aucggacagguaacgcggu

SEQ ID NO: 1058282 - RNA, 14 nt, Mycobacterium bovis subsp bovis AF2122/97
aucggagccgucga

SEQ ID NO: 1058283 - RNA, 19 nt, Mycobacterium bovis subsp bovis AF2122/97
aucggaggaaccccgcgcg

SEQ ID NO: 1058284 - RNA, 23 nt, Mycobacterium bovis subsp bovis AF2122/97
aucggugccacguucgcgggcgu

SEQ ID NO: 1058285 - RNA, 15 nt, Mycobacterium bovis subsp bovis AF2122/97
aucggugaucgaggu

SEQ ID NO: 1058286 - RNA, 19 nt, Mycobacterium bovis subsp bovis AF2122/97
aucggugcgcacggcggcc

SEQ ID NO: 1058287 - RNA, 20 nt, Mycobacterium bovis subsp bovis AF2122/97
aucggugcgguucgcugcgg

SEQ ID NO: 1058288 - RNA, 17 nt, Mycobacterium bovis subsp bovis AF2122/97
aucggugcuggucgccg

SEQ ID NO: 1058289 - RNA, 18 nt, Mycobacterium bovis subsp bovis AF2122/97
aucggugcuggucgccgc

SEQ ID NO: 1058290 - RNA, 22 nt, Mycobacterium bovis subsp bovis AF2122/97
aucggugcuggucgccgcggca

SEQ ID NO: 1058291 - RNA, 14 nt, Mycobacterium bovis subsp bovis AF2122/97
aucggucggcacca

SEQ ID NO: 1058292 - RNA, 13 nt, Mycobacterium bovis subsp bovis AF2122/97
aucggucguccgg

SEQ ID NO: 1058293 - RNA, 22 nt, Mycobacterium bovis subsp bovis AF2122/97
aucggugaauguugccgccgcg

SEQ ID NO: 1058294 - RNA, 17 nt, Mycobacterium bovis subsp bovis AF2122/97
aucggugaucaaaccgg

SEQ ID NO: 1058295 - RNA, 24 nt, Mycobacterium bovis subsp bovis AF2122/97
aucggugagcccguugaccugcgc

SEQ ID NO: 1058296 - RNA, 20 nt, Mycobacterium bovis subsp bovis AF2122/97
aucggugcacaacgcccacc

SEQ ID NO: 1058297 - RNA, 20 nt, Mycobacterium bovis subsp bovis AF2122/97
aucgguugaccggucgacca

SEQ ID NO: 1058298 - RNA, 16 nt, Mycobacterium bovis subsp bovis AF2122/97
aucguaggacucggcg

SEQ ID NO: 1058299 - RNA, 21 nt, Mycobacterium bovis subsp bovis AF2122/97
aucggugguuagguggcuggc

SEQ ID NO: 1058300 - RNA, 21 nt, Mycobacterium bovis subsp bovis AF2122/97
aucgguuccauugcgaacucg

SEQ ID NO: 1058301 - RNA, 12 nt, Mycobacterium bovis subsp bovis AF2122/97
aucgguucggcc

SEQ ID NO: 1058302 - RNA, 15 nt, Mycobacterium bovis subsp bovis AF2122/97
aucgguucggccaga

SEQ ID NO: 1058303 - RNA, 22 nt, Mycobacterium bovis subsp bovis AF2122/97
aucgguugaucugucagcgcgg

SEQ ID NO: 1058304 - RNA, 16 nt, Mycobacterium bovis subsp bovis AF2122/97
aucgguugcacccgcg

SEQ ID NO: 1058305 - RNA, 17 nt, Mycobacterium bovis subsp bovis AF2122/97
aucgggucgcugccggc

SEQ ID NO: 1058306 - RNA, 17 nt, Mycobacterium bovis subsp bovis AF2122/97
aucggguccacgucucc

SEQ ID NO: 1058307 - RNA, 20 nt, Mycobacterium bovis subsp bovis AF2122/97
aucggggcgacgauccgcac

SEQ ID NO: 1058308 - RNA, 17 nt, Mycobacterium bovis subsp bovis AF2122/97
aucgggcuucggccaga

SEQ ID NO: 1058309 - RNA, 21 nt, Mycobacterium bovis subsp bovis AF2122/97
aucgggcuucggccagaucac

SEQ ID NO: 1058310 - RNA, 16 nt, Mycobacterium bovis subsp bovis AF2122/97
aucgggcucacucgcc

SEQ ID NO: 1058311 - RNA, 14 nt, Mycobacterium bovis subsp bovis AF2122/97
aucgggcucagcgg

SEQ ID NO: 1058312 - RNA, 15 nt, Mycobacterium bovis subsp bovis AF2122/97
aucgggcucagcggc

SEQ ID NO: 1058313 - RNA, 14 nt, Mycobacterium bovis subsp bovis AF2122/97
aucgguccggcgaa

SEQ ID NO: 1058314 - RNA, 13 nt, Mycobacterium bovis subsp bovis AF2122/97
aucggucaugucc

SEQ ID NO: 1058315 - RNA, 14 nt, Mycobacterium bovis subsp bovis AF2122/97
aucggucagcgggc

SEQ ID NO: 1058316 - RNA, 16 nt, Mycobacterium bovis subsp bovis AF2122/97
aucggucaccgcggca

SEQ ID NO: 1058317 - RNA, 17 nt, Mycobacterium bovis subsp bovis AF2122/97
aucgguauaacgacucg

SEQ ID NO: 1058318 - RNA, 13 nt, Mycobacterium bovis subsp bovis AF2122/97
aucgccaccggua

SEQ ID NO: 1058319 - RNA, 15 nt, Mycobacterium bovis subsp bovis AF2122/97
aucgccaccgcguca

SEQ ID NO: 1058320 - RNA, 13 nt, Mycobacterium bovis subsp bovis AF2122/97
aucgccagcggca

SEQ ID NO: 1058321 - RNA, 17 nt, Mycobacterium bovis subsp bovis AF2122/97
aucgccagcgccggcca

SEQ ID NO: 1058322 - RNA, 13 nt, Mycobacterium bovis subsp bovis AF2122/97
aucgccaggccga

SEQ ID NO: 1058323 - RNA, 20 nt, Mycobacterium bovis subsp bovis AF2122/97
aucgccauaccggccgccau

SEQ ID NO: 1058324 - RNA, 23 nt, Mycobacterium bovis subsp bovis AF2122/97
aucgccauaggagaacuccggga

SEQ ID NO: 1058325 - RNA, 21 nt, Mycobacterium bovis subsp bovis AF2122/97
aucgccaucgguugacccggc

SEQ ID NO: 1058326 - RNA, 22 nt, Mycobacterium bovis subsp bovis AF2122/97
aucgccaucguuucacccgggc

SEQ ID NO: 1058327 - RNA, 15 nt, Mycobacterium bovis subsp bovis AF2122/97
aucgccaaugcccag

SEQ ID NO: 1058328 - RNA, 13 nt, Mycobacterium bovis subsp bovis AF2122/97
aucgccaaugcgg

SEQ ID NO: 1058329 - RNA, 18 nt, Mycobacterium bovis subsp bovis AF2122/97
aucgccaaugcgggaaac

SEQ ID NO: 1058330 - RNA, 14 nt, Mycobacterium bovis subsp bovis AF2122/97
aucgcauccgcggu

SEQ ID NO: 1058331 - RNA, 14 nt, Mycobacterium bovis subsp bovis AF2122/97
aucgcaucggcggg

SEQ ID NO: 1058332 - RNA, 16 nt, Mycobacterium bovis subsp bovis AF2122/97
aucgcaggcaccccga

SEQ ID NO: 1058333 - RNA, 20 nt, Mycobacterium bovis subsp bovis AF2122/97
aucgcagaacggaccucggc

SEQ ID NO: 1058334 - RNA, 19 nt, Mycobacterium bovis subsp bovis AF2122/97
aucgcagacggcugccacg

SEQ ID NO: 1058335 - RNA, 19 nt, Mycobacterium bovis subsp bovis AF2122/97
aucgcacggaugaugccgg

SEQ ID NO: 1058336 - RNA, 15 nt, Mycobacterium bovis subsp bovis AF2122/97
aucgcagaacggacc

SEQ ID NO: 1058337 - RNA, 21 nt, Mycobacterium bovis subsp bovis AF2122/97
aucgcaccgugugggccccgc

SEQ ID NO: 1058338 - RNA, 13 nt, Mycobacterium bovis subsp bovis AF2122/97
aucgcacugguca

SEQ ID NO: 1058339 - RNA, 20 nt, Mycobacterium bovis subsp bovis AF2122/97
aucgauuuggaucggcugcg

SEQ ID NO: 1058340 - RNA, 16 nt, Mycobacterium bovis subsp bovis AF2122/97
aucgcacccaccacac

SEQ ID NO: 1058341 - RNA, 15 nt, Mycobacterium bovis subsp bovis AF2122/97
aucgaugaccgucgc

SEQ ID NO: 1058342 - RNA, 17 nt, Mycobacterium bovis subsp bovis AF2122/97
aucgaucugcggaggcg

SEQ ID NO: 1058343 - RNA, 19 nt, Mycobacterium bovis subsp bovis AF2122/97
aucgaucggaucgaugccu

SEQ ID NO: 1058344 - RNA, 16 nt, Mycobacterium bovis subsp bovis AF2122/97
aucgcaagcgcggcga

SEQ ID NO: 1058345 - RNA, 20 nt, Mycobacterium bovis subsp bovis AF2122/97
aucgcacaccaacaccgcgg

SEQ ID NO: 1058346 - RNA, 12 nt, Mycobacterium bovis subsp bovis AF2122/97
aucgcacagcgc

SEQ ID NO: 1058347 - RNA, 19 nt, Mycobacterium bovis subsp bovis AF2122/97
aucgaugcggugaauccgu

SEQ ID NO: 1058348 - RNA, 18 nt, Mycobacterium bovis subsp bovis AF2122/97
aucgauugcguagcgggu

SEQ ID NO: 1058349 - RNA, 11 nt, Mycobacterium bovis subsp bovis AF2122/97
aucgauuugga

SEQ ID NO: 1058350 - RNA, 18 nt, Mycobacterium bovis subsp bovis AF2122/97
aucgaggugacggugacg

SEQ ID NO: 1058351 - RNA, 14 nt, Mycobacterium bovis subsp bovis AF2122/97
auccgucggcggag

SEQ ID NO: 1058352 - RNA, 18 nt, Mycobacterium bovis subsp bovis AF2122/97
aucgaggagaugccgacg

SEQ ID NO: 1058353 - RNA, 14 nt, Mycobacterium bovis subsp bovis AF2122/97
aucgaggccgacga

SEQ ID NO: 1058354 - RNA, 19 nt, Mycobacterium bovis subsp bovis AF2122/97
aucgaguagcugaccgagc

SEQ ID NO: 1058355 - RNA, 16 nt, Mycobacterium bovis subsp bovis AF2122/97
aucgaguggccgugaa

SEQ ID NO: 1058356 - RNA, 19 nt, Mycobacterium bovis subsp bovis AF2122/97
aucgaguuccgcaucggcc

SEQ ID NO: 1058357 - RNA, 23 nt, Mycobacterium bovis subsp bovis AF2122/97
aucgagucgcgaacucaugcccg

SEQ ID NO: 1058358 - RNA, 17 nt, Mycobacterium bovis subsp bovis AF2122/97
aucgaguugcucggccg

SEQ ID NO: 1058359 - RNA, 12 nt, Mycobacterium bovis subsp bovis AF2122/97
aucgaguucggc

SEQ ID NO: 1058360 - RNA, 14 nt, Mycobacterium bovis subsp bovis AF2122/97
aucgaguucggccc

SEQ ID NO: 1058361 - RNA, 20 nt, Mycobacterium bovis subsp bovis AF2122/97
aucgccucggcguaggcgau

SEQ ID NO: 1058362 - RNA, 17 nt, Mycobacterium bovis subsp bovis AF2122/97
aucgccucgacgcggca

SEQ ID NO: 1058363 - RNA, 20 nt, Mycobacterium bovis subsp bovis AF2122/97
aucgccucgacgcggcaggc

SEQ ID NO: 1058364 - RNA, 20 nt, Mycobacterium bovis subsp bovis AF2122/97
aucgccucgaggaccaccac

SEQ ID NO: 1058365 - RNA, 20 nt, Mycobacterium bovis subsp bovis AF2122/97
aucgccuccaggcgccaccc

SEQ ID NO: 1058366 - RNA, 18 nt, Mycobacterium bovis subsp bovis AF2122/97
aucgccuccagccggcga

SEQ ID NO: 1058367 - RNA, 22 nt, Mycobacterium bovis subsp bovis AF2122/97
aucgccgaggcagcgucgucga

SEQ ID NO: 1058368 - RNA, 15 nt, Mycobacterium bovis subsp bovis AF2122/97
aucgccgacgcccag

SEQ ID NO: 1058369 - RNA, 20 nt, Mycobacterium bovis subsp bovis AF2122/97
aucgccgaggccucggccag

SEQ ID NO: 1058370 - RNA, 22 nt, Mycobacterium bovis subsp bovis AF2122/97
aucgccgaggccucggccagcg

SEQ ID NO: 1058371 - RNA, 13 nt, Mycobacterium bovis subsp bovis AF2122/97
aucgccgacgccc

SEQ ID NO: 1058372 - RNA, 16 nt, Mycobacterium bovis subsp bovis AF2122/97
aucgccgagaccgcgu

SEQ ID NO: 1058373 - RNA, 20 nt, Mycobacterium bovis subsp bovis AF2122/97
aucgccgacgccagaacgug

SEQ ID NO: 1058374 - RNA, 14 nt, Mycobacterium bovis subsp bovis AF2122/97
aucgccgacagcgc

SEQ ID NO: 1058375 - RNA, 13 nt, Mycobacterium bovis subsp bovis AF2122/97
aucgccgacccgc

SEQ ID NO: 1058376 - RNA, 14 nt, Mycobacterium bovis subsp bovis AF2122/97
aucgccgaaucggc

SEQ ID NO: 1058377 - RNA, 18 nt, Mycobacterium bovis subsp bovis AF2122/97
aucgcccugacacccauc

SEQ ID NO: 1058378 - RNA, 23 nt, Mycobacterium bovis subsp bovis AF2122/97
aucgcccugacccggagccgcca

SEQ ID NO: 1058379 - RNA, 17 nt, Mycobacterium bovis subsp bovis AF2122/97
aucgccugagcgccgcg

SEQ ID NO: 1058380 - RNA, 18 nt, Mycobacterium bovis subsp bovis AF2122/97
aucgccugagcgccgcgg

SEQ ID NO: 1058381 - RNA, 21 nt, Mycobacterium bovis subsp bovis AF2122/97
aucgccucggacacggcagcc

SEQ ID NO: 1058382 - RNA, 13 nt, Mycobacterium bovis subsp bovis AF2122/97
aucgccugcgccu

SEQ ID NO: 1058383 - RNA, 23 nt, Mycobacterium bovis subsp bovis AF2122/97
aucgccugcgccuuggucgccgg

SEQ ID NO: 1058384 - RNA, 20 nt, Mycobacterium bovis subsp bovis AF2122/97
aucgcgaaacagcacgcccg

SEQ ID NO: 1058385 - RNA, 21 nt, Mycobacterium bovis subsp bovis AF2122/97
aucgccuccucgacgucggcg

SEQ ID NO: 1058386 - RNA, 16 nt, Mycobacterium bovis subsp bovis AF2122/97
aucgccuggaugccga

SEQ ID NO: 1058387 - RNA, 22 nt, Mycobacterium bovis subsp bovis AF2122/97
aucgcgaagcggaccgagccga

SEQ ID NO: 1058388 - RNA, 18 nt, Mycobacterium bovis subsp bovis AF2122/97
aucgcgaauauagcggcg

SEQ ID NO: 1058389 - RNA, 18 nt, Mycobacterium bovis subsp bovis AF2122/97
aucgcgaacucgggcaau

SEQ ID NO: 1058390 - RNA, 13 nt, Mycobacterium bovis subsp bovis AF2122/97
aucgcgaacaucg

SEQ ID NO: 1058391 - RNA, 20 nt, Mycobacterium bovis subsp bovis AF2122/97
aucgcgaacgaagucgacga

SEQ ID NO: 1058392 - RNA, 20 nt, Mycobacterium bovis subsp bovis AF2122/97
aucgcgagaaggugcugcgc

SEQ ID NO: 1058393 - RNA, 15 nt, Mycobacterium bovis subsp bovis AF2122/97
aucgcgagccagcug

SEQ ID NO: 1058394 - RNA, 18 nt, Mycobacterium bovis subsp bovis AF2122/97
aucgcgacccgaucgcgc

SEQ ID NO: 1058395 - RNA, 15 nt, Mycobacterium bovis subsp bovis AF2122/97
aucgcgacgaugccc

SEQ ID NO: 1058396 - RNA, 13 nt, Mycobacterium bovis subsp bovis AF2122/97
aucgcgacggccc

SEQ ID NO: 1058397 - RNA, 17 nt, Mycobacterium bovis subsp bovis AF2122/97
aucgcgacgaugccccg

SEQ ID NO: 1058398 - RNA, 15 nt, Mycobacterium bovis subsp bovis AF2122/97
aucgcggugaccggc

SEQ ID NO: 1058399 - RNA, 16 nt, Mycobacterium bovis subsp bovis AF2122/97
aucgcggugaccggcu

SEQ ID NO: 1058400 - RNA, 12 nt, Mycobacterium bovis subsp bovis AF2122/97
aucgcgucauca

SEQ ID NO: 1058401 - RNA, 15 nt, Mycobacterium bovis subsp bovis AF2122/97
aucgcguccaugcgg

SEQ ID NO: 1058402 - RNA, 21 nt, Mycobacterium bovis subsp bovis AF2122/97
aucgcgucgagcgccggccgc

SEQ ID NO: 1058403 - RNA, 13 nt, Mycobacterium bovis subsp bovis AF2122/97
aucgcgugcgacg

SEQ ID NO: 1058404 - RNA, 14 nt, Mycobacterium bovis subsp bovis AF2122/97
aucgcgucggcgau

SEQ ID NO: 1058405 - RNA, 14 nt, Mycobacterium bovis subsp bovis AF2122/97
aucgcguggaucgc

SEQ ID NO: 1058406 - RNA, 17 nt, Mycobacterium bovis subsp bovis AF2122/97
aucgcguggaucgcgcu

SEQ ID NO: 1058407 - RNA, 23 nt, Mycobacterium bovis subsp bovis AF2122/97
aucgcguuguaggcuuccagcuc

SEQ ID NO: 1058408 - RNA, 19 nt, Mycobacterium bovis subsp bovis AF2122/97
aucgcguggcgcaccaccg

SEQ ID NO: 1058409 - RNA, 17 nt, Mycobacterium bovis subsp bovis AF2122/97
aucgcgagcgccgcuau

SEQ ID NO: 1058410 - RNA, 15 nt, Mycobacterium bovis subsp bovis AF2122/97
aucgcgagcugcgac

SEQ ID NO: 1058411 - RNA, 17 nt, Mycobacterium bovis subsp bovis AF2122/97
aucgcgagcugcgacga

SEQ ID NO: 1058412 - RNA, 18 nt, Mycobacterium bovis subsp bovis AF2122/97
aucgcgagcuuggccggc

SEQ ID NO: 1058413 - RNA, 20 nt, Mycobacterium bovis subsp bovis AF2122/97
aucgcgagcuuggccggcag

SEQ ID NO: 1058414 - RNA, 21 nt, Mycobacterium bovis subsp bovis AF2122/97
aucgcgaggcuguccgaaccg

SEQ ID NO: 1058415 - RNA, 14 nt, Mycobacterium bovis subsp bovis AF2122/97
aucgcggcgaacau

SEQ ID NO: 1058416 - RNA, 22 nt, Mycobacterium bovis subsp bovis AF2122/97
aucgcggcggcgauccggucgg

SEQ ID NO: 1058417 - RNA, 22 nt, Mycobacterium bovis subsp bovis AF2122/97
aucgcgagaaggugcugcgcgg

SEQ ID NO: 1058418 - RNA, 23 nt, Mycobacterium bovis subsp bovis AF2122/97
aucgcggcggccuccaccacguc

SEQ ID NO: 1058419 - RNA, 22 nt, Mycobacterium bovis subsp bovis AF2122/97
aucgcgguggcuucuagcccgu

SEQ ID NO: 1058420 - RNA, 18 nt, Mycobacterium bovis subsp bovis AF2122/97
aucgcggugggccccgau

SEQ ID NO: 1058421 - RNA, 21 nt, Mycobacterium bovis subsp bovis AF2122/97
aucgcggugggccccgauccc

SEQ ID NO: 1058422 - RNA, 14 nt, Mycobacterium bovis subsp bovis AF2122/97
aucgcggucgccac

SEQ ID NO: 1058423 - RNA, 17 nt, Mycobacterium bovis subsp bovis AF2122/97
aucgcggcgggcccgau

SEQ ID NO: 1058424 - RNA, 21 nt, Mycobacterium bovis subsp bovis AF2122/97
aucgcggcguugugaccgccg

SEQ ID NO: 1058425 - RNA, 22 nt, Mycobacterium bovis subsp bovis AF2122/97
aucgcggucaaauccagcagcc

SEQ ID NO: 1058426 - RNA, 14 nt, Mycobacterium bovis subsp bovis AF2122/97
aucgcggucagcgg

SEQ ID NO: 1058427 - RNA, 23 nt, Mycobacterium bovis subsp bovis AF2122/97
aucgcgggcgugcuacacccgua

SEQ ID NO: 1058428 - RNA, 19 nt, Mycobacterium bovis subsp bovis AF2122/97
augcccuccucgaccgcgg

SEQ ID NO: 1058429 - RNA, 20 nt, Mycobacterium bovis subsp bovis AF2122/97
augcccguagacgccgagca

SEQ ID NO: 1058430 - RNA, 15 nt, Mycobacterium bovis subsp bovis AF2122/97
augcccgaccggucu

SEQ ID NO: 1058431 - RNA, 20 nt, Mycobacterium bovis subsp bovis AF2122/97
augcccagcgaauccaggcc

SEQ ID NO: 1058432 - RNA, 22 nt, Mycobacterium bovis subsp bovis AF2122/97
augcccagcgcacggaccaucg

SEQ ID NO: 1058433 - RNA, 16 nt, Mycobacterium bovis subsp bovis AF2122/97
augcccauccggccgu

SEQ ID NO: 1058434 - RNA, 19 nt, Mycobacterium bovis subsp bovis AF2122/97
augccauuucgucgucgcu

SEQ ID NO: 1058435 - RNA, 21 nt, Mycobacterium bovis subsp bovis AF2122/97
augccauaggacaggaacggc

SEQ ID NO: 1058436 - RNA, 20 nt, Mycobacterium bovis subsp bovis AF2122/97
augccauguugaaaaggcgc

SEQ ID NO: 1058437 - RNA, 14 nt, Mycobacterium bovis subsp bovis AF2122/97
augccaccgagcaa

SEQ ID NO: 1058438 - RNA, 22 nt, Mycobacterium bovis subsp bovis AF2122/97
augccaccgcuugaccccuggc

SEQ ID NO: 1058439 - RNA, 23 nt, Mycobacterium bovis subsp bovis AF2122/97
augccacgucccaggacuccggc

SEQ ID NO: 1058440 - RNA, 14 nt, Mycobacterium bovis subsp bovis AF2122/97
augccagucgccga

SEQ ID NO: 1058441 - RNA, 16 nt, Mycobacterium bovis subsp bovis AF2122/97
augccagcggcacacc

SEQ ID NO: 1058442 - RNA, 19 nt, Mycobacterium bovis subsp bovis AF2122/97
augccagugcaucggucag

SEQ ID NO: 1058443 - RNA, 21 nt, Mycobacterium bovis subsp bovis AF2122/97
augcacgcccaggcgaccgcu

SEQ ID NO: 1058444 - RNA, 18 nt, Mycobacterium bovis subsp bovis AF2122/97
augcacgucaucggcugg

SEQ ID NO: 1058445 - RNA, 22 nt, Mycobacterium bovis subsp bovis AF2122/97
augccacacacugccggacagc

SEQ ID NO: 1058446 - RNA, 15 nt, Mycobacterium bovis subsp bovis AF2122/97
augcaacccggugau

SEQ ID NO: 1058447 - RNA, 17 nt, Mycobacterium bovis subsp bovis AF2122/97
augcaacaccgcaccgg

SEQ ID NO: 1058448 - RNA, 14 nt, Mycobacterium bovis subsp bovis AF2122/97
augcaacaccgcac

SEQ ID NO: 1058449 - RNA, 19 nt, Mycobacterium bovis subsp bovis AF2122/97
augcacaaccgcugcugcu

SEQ ID NO: 1058450 - RNA, 17 nt, Mycobacterium bovis subsp bovis AF2122/97
augcaagccgacaucgg

SEQ ID NO: 1058451 - RNA, 12 nt, Mycobacterium bovis subsp bovis AF2122/97
augcaaucggau

SEQ ID NO: 1058452 - RNA, 22 nt, Mycobacterium bovis subsp bovis AF2122/97
augacgguguggaaaccgcgga

SEQ ID NO: 1058453 - RNA, 16 nt, Mycobacterium bovis subsp bovis AF2122/97
augacgguuugcagcg

SEQ ID NO: 1058454 - RNA, 22 nt, Mycobacterium bovis subsp bovis AF2122/97
augacgucgacaacgaucgcgc

SEQ ID NO: 1058455 - RNA, 16 nt, Mycobacterium bovis subsp bovis AF2122/97
augacguuuggauggc

SEQ ID NO: 1058456 - RNA, 18 nt, Mycobacterium bovis subsp bovis AF2122/97
aucugcgcaaccgagcgg

SEQ ID NO: 1058457 - RNA, 15 nt, Mycobacterium bovis subsp bovis AF2122/97
aucugccggccggcg

SEQ ID NO: 1058458 - RNA, 18 nt, Mycobacterium bovis subsp bovis AF2122/97
aucugccggccggcgggc

SEQ ID NO: 1058459 - RNA, 17 nt, Mycobacterium bovis subsp bovis AF2122/97
aucugcccccgccggcc

SEQ ID NO: 1058460 - RNA, 22 nt, Mycobacterium bovis subsp bovis AF2122/97
aucugcccccgccggccgucga

SEQ ID NO: 1058461 - RNA, 14 nt, Mycobacterium bovis subsp bovis AF2122/97
aucugccgccgcgg

SEQ ID NO: 1058462 - RNA, 16 nt, Mycobacterium bovis subsp bovis AF2122/97
aucugccgccgcggcc

SEQ ID NO: 1058463 - RNA, 17 nt, Mycobacterium bovis subsp bovis AF2122/97
aucugccgccgcggcca

SEQ ID NO: 1058464 - RNA, 16 nt, Mycobacterium bovis subsp bovis AF2122/97
aucugccaccgcgggc

SEQ ID NO: 1058465 - RNA, 14 nt, Mycobacterium bovis subsp bovis AF2122/97
aucugccacguuga

SEQ ID NO: 1058466 - RNA, 14 nt, Mycobacterium bovis subsp bovis AF2122/97
aucugaucggcgcg

SEQ ID NO: 1058467 - RNA, 19 nt, Mycobacterium bovis subsp bovis AF2122/97
aucugaggcuuccagcucg

SEQ ID NO: 1058468 - RNA, 17 nt, Mycobacterium bovis subsp bovis AF2122/97
aucugaguggacggccg

SEQ ID NO: 1058469 - RNA, 13 nt, Mycobacterium bovis subsp bovis AF2122/97
augaggucaacgc

SEQ ID NO: 1058470 - RNA, 18 nt, Mycobacterium bovis subsp bovis AF2122/97
augagcgccacgccgagg

SEQ ID NO: 1058471 - RNA, 14 nt, Mycobacterium bovis subsp bovis AF2122/97
augagcgcgaagua

SEQ ID NO: 1058472 - RNA, 15 nt, Mycobacterium bovis subsp bovis AF2122/97
augagcgcgaaguac

SEQ ID NO: 1058473 - RNA, 21 nt, Mycobacterium bovis subsp bovis AF2122/97
augagccgggugcgagcgaca

SEQ ID NO: 1058474 - RNA, 13 nt, Mycobacterium bovis subsp bovis AF2122/97
augacuugcgcgc

SEQ ID NO: 1058475 - RNA, 15 nt, Mycobacterium bovis subsp bovis AF2122/97
augaucuggugcgcg

SEQ ID NO: 1058476 - RNA, 15 nt, Mycobacterium bovis subsp bovis AF2122/97
augaugaacagacgc

SEQ ID NO: 1058477 - RNA, 13 nt, Mycobacterium bovis subsp bovis AF2122/97
augaugccggugu

SEQ ID NO: 1058478 - RNA, 19 nt, Mycobacterium bovis subsp bovis AF2122/97
augaugccacccucggugu

SEQ ID NO: 1058479 - RNA, 18 nt, Mycobacterium bovis subsp bovis AF2122/97
augauucacgcucggcgu

SEQ ID NO: 1058480 - RNA, 17 nt, Mycobacterium bovis subsp bovis AF2122/97
augccgggcccgacguu

SEQ ID NO: 1058481 - RNA, 19 nt, Mycobacterium bovis subsp bovis AF2122/97
augccggcauaaaccgcgu

SEQ ID NO: 1058482 - RNA, 12 nt, Mycobacterium bovis subsp bovis AF2122/97
augccgucgccg

SEQ ID NO: 1058483 - RNA, 13 nt, Mycobacterium bovis subsp bovis AF2122/97
augccgucgccgg

SEQ ID NO: 1058484 - RNA, 18 nt, Mycobacterium bovis subsp bovis AF2122/97
augccgucgccggucagg

SEQ ID NO: 1058485 - RNA, 18 nt, Mycobacterium bovis subsp bovis AF2122/97
augccgugugugcgaucc

SEQ ID NO: 1058486 - RNA, 17 nt, Mycobacterium bovis subsp bovis AF2122/97
augccgugcugggccga

SEQ ID NO: 1058487 - RNA, 17 nt, Mycobacterium bovis subsp bovis AF2122/97
augccguggccgccaug

SEQ ID NO: 1058488 - RNA, 14 nt, Mycobacterium bovis subsp bovis AF2122/97
augccgugccgggc

SEQ ID NO: 1058489 - RNA, 24 nt, Mycobacterium bovis subsp bovis AF2122/97
augccguaguaaggagccgggccg

SEQ ID NO: 1058490 - RNA, 15 nt, Mycobacterium bovis subsp bovis AF2122/97
augccguauagcgca

SEQ ID NO: 1058491 - RNA, 21 nt, Mycobacterium bovis subsp bovis AF2122/97
augccgguguugccgaagccc

SEQ ID NO: 1058492 - RNA, 19 nt, Mycobacterium bovis subsp bovis AF2122/97
augccggugccgggcacca

SEQ ID NO: 1058493 - RNA, 17 nt, Mycobacterium bovis subsp bovis AF2122/97
augccgaacuccgcgga

SEQ ID NO: 1058494 - RNA, 18 nt, Mycobacterium bovis subsp bovis AF2122/97
augccgagaagugggcgg

SEQ ID NO: 1058495 - RNA, 17 nt, Mycobacterium bovis subsp bovis AF2122/97
augccgaccggcacccg

SEQ ID NO: 1058496 - RNA, 18 nt, Mycobacterium bovis subsp bovis AF2122/97
augccgacgacggguugg

SEQ ID NO: 1058497 - RNA, 23 nt, Mycobacterium bovis subsp bovis AF2122/97
augccgaucggccugcagcgaug

SEQ ID NO: 1058498 - RNA, 15 nt, Mycobacterium bovis subsp bovis AF2122/97
augccgaugcgacgc

SEQ ID NO: 1058499 - RNA, 20 nt, Mycobacterium bovis subsp bovis AF2122/97
augccgaugucgggcacggu

SEQ ID NO: 1058500 - RNA, 16 nt, Mycobacterium bovis subsp bovis AF2122/97
augccgcggaggcggc

SEQ ID NO: 1058501 - RNA, 21 nt, Mycobacterium bovis subsp bovis AF2122/97
augccgcggaggcggccagcc

SEQ ID NO: 1058502 - RNA, 11 nt, Mycobacterium bovis subsp bovis AF2122/97
augccgcggcc

SEQ ID NO: 1058503 - RNA, 14 nt, Mycobacterium bovis subsp bovis AF2122/97
augccgcggccagu

SEQ ID NO: 1058504 - RNA, 22 nt, Mycobacterium bovis subsp bovis AF2122/97
augccgcggccaguacgucgau

SEQ ID NO: 1058505 - RNA, 18 nt, Mycobacterium bovis subsp bovis AF2122/97
augccgccggugccgccg

SEQ ID NO: 1058506 - RNA, 12 nt, Mycobacterium bovis subsp bovis AF2122/97
augccgcgggga

SEQ ID NO: 1058507 - RNA, 21 nt, Mycobacterium bovis subsp bovis AF2122/97
augccgcgguggaugcgaugc

SEQ ID NO: 1058508 - RNA, 19 nt, Mycobacterium bovis subsp bovis AF2122/97
augccgccgaagccgcgca

SEQ ID NO: 1058509 - RNA, 19 nt, Mycobacterium bovis subsp bovis AF2122/97
augccgcccaucaccccga

SEQ ID NO: 1058510 - RNA, 18 nt, Mycobacterium bovis subsp bovis AF2122/97
augccgcccgcgccgccg

SEQ ID NO: 1058511 - RNA, 21 nt, Mycobacterium bovis subsp bovis AF2122/97
augccgcccgcgccgccggac

SEQ ID NO: 1058512 - RNA, 17 nt, Mycobacterium bovis subsp bovis AF2122/97
augccgccaugcgcacc

SEQ ID NO: 1058513 - RNA, 23 nt, Mycobacterium bovis subsp bovis AF2122/97
augccgccaugcgcaccagucca

SEQ ID NO: 1058514 - RNA, 15 nt, Mycobacterium bovis subsp bovis AF2122/97
augcgcugccgccgu

SEQ ID NO: 1058515 - RNA, 19 nt, Mycobacterium bovis subsp bovis AF2122/97
augcgcucacugcagcgcc

SEQ ID NO: 1058516 - RNA, 18 nt, Mycobacterium bovis subsp bovis AF2122/97
augcgcuugaugccggcc

SEQ ID NO: 1058517 - RNA, 18 nt, Mycobacterium bovis subsp bovis AF2122/97
augcgcuuccaucgccac

SEQ ID NO: 1058518 - RNA, 22 nt, Mycobacterium bovis subsp bovis AF2122/97
augcgcugucgcccucgaucgc

SEQ ID NO: 1058519 - RNA, 11 nt, Mycobacterium bovis subsp bovis AF2122/97
augcgcggcgg

SEQ ID NO: 1058520 - RNA, 17 nt, Mycobacterium bovis subsp bovis AF2122/97
augcgcggugaccgggu

SEQ ID NO: 1058521 - RNA, 18 nt, Mycobacterium bovis subsp bovis AF2122/97
augcgcucacugcagcgc

SEQ ID NO: 1058522 - RNA, 12 nt, Mycobacterium bovis subsp bovis AF2122/97
augcgucugcuc

SEQ ID NO: 1058523 - RNA, 19 nt, Mycobacterium bovis subsp bovis AF2122/97
augcgucugcucgccgggg

SEQ ID NO: 1058524 - RNA, 19 nt, Mycobacterium bovis subsp bovis AF2122/97
augcggaugucgucgacca

SEQ ID NO: 1058525 - RNA, 18 nt, Mycobacterium bovis subsp bovis AF2122/97
augcggaccacaccguca

SEQ ID NO: 1058526 - RNA, 12 nt, Mycobacterium bovis subsp bovis AF2122/97
augcggaacgcc

SEQ ID NO: 1058527 - RNA, 21 nt, Mycobacterium bovis subsp bovis AF2122/97
augcgugaccagucgcggcgu

SEQ ID NO: 1058528 - RNA, 20 nt, Mycobacterium bovis subsp bovis AF2122/97
augcgugaccagucgcggcg

SEQ ID NO: 1058529 - RNA, 19 nt, Mycobacterium bovis subsp bovis AF2122/97
augcguuggggcacgacgc

SEQ ID NO: 1058530 - RNA, 17 nt, Mycobacterium bovis subsp bovis AF2122/97
augccuggaaucgcgga

SEQ ID NO: 1058531 - RNA, 22 nt, Mycobacterium bovis subsp bovis AF2122/97
augccugacacgaugcccggca

SEQ ID NO: 1058532 - RNA, 16 nt, Mycobacterium bovis subsp bovis AF2122/97
augccguugcgaucgc

SEQ ID NO: 1058533 - RNA, 20 nt, Mycobacterium bovis subsp bovis AF2122/97
augccucggcggccucgcug

SEQ ID NO: 1058534 - RNA, 23 nt, Mycobacterium bovis subsp bovis AF2122/97
augccuuugggcuguggccgcgu

SEQ ID NO: 1058535 - RNA, 16 nt, Mycobacterium bovis subsp bovis AF2122/97
augccuuggcagccca

SEQ ID NO: 1058536 - RNA, 15 nt, Mycobacterium bovis subsp bovis AF2122/97
augccuucggccaac

SEQ ID NO: 1058537 - RNA, 19 nt, Mycobacterium bovis subsp bovis AF2122/97
augccuucguagcggccgc

SEQ ID NO: 1058538 - RNA, 20 nt, Mycobacterium bovis subsp bovis AF2122/97
augccuucguagcggccgca

SEQ ID NO: 1058539 - RNA, 15 nt, Mycobacterium bovis subsp bovis AF2122/97
augccuugaccgcgg

SEQ ID NO: 1058540 - RNA, 18 nt, Mycobacterium bovis subsp bovis AF2122/97
augccuugaccgcggucu

SEQ ID NO: 1058541 - RNA, 12 nt, Mycobacterium bovis subsp bovis AF2122/97
augcgcgaucgu

SEQ ID NO: 1058542 - RNA, 13 nt, Mycobacterium bovis subsp bovis AF2122/97
augcgcgccggcu

SEQ ID NO: 1058543 - RNA, 15 nt, Mycobacterium bovis subsp bovis AF2122/97
augcgaugcgcgccg

SEQ ID NO: 1058544 - RNA, 16 nt, Mycobacterium bovis subsp bovis AF2122/97
augcgauggccgacgc

SEQ ID NO: 1058545 - RNA, 15 nt, Mycobacterium bovis subsp bovis AF2122/97
augcgaccgccggac

SEQ ID NO: 1058546 - RNA, 14 nt, Mycobacterium bovis subsp bovis AF2122/97
augcgauaggcccg

SEQ ID NO: 1058547 - RNA, 14 nt, Mycobacterium bovis subsp bovis AF2122/97
augcgagaacgucg

SEQ ID NO: 1058548 - RNA, 14 nt, Mycobacterium bovis subsp bovis AF2122/97
auguccgacgcacc

SEQ ID NO: 1058549 - RNA, 20 nt, Mycobacterium bovis subsp bovis AF2122/97
auguccgacgccaccgccac

SEQ ID NO: 1058550 - RNA, 22 nt, Mycobacterium bovis subsp bovis AF2122/97
auguccgacgccaccgccacca

SEQ ID NO: 1058551 - RNA, 15 nt, Mycobacterium bovis subsp bovis AF2122/97
auguccgcggccacc

SEQ ID NO: 1058552 - RNA, 16 nt, Mycobacterium bovis subsp bovis AF2122/97
auguccgcggccacca

SEQ ID NO: 1058553 - RNA, 17 nt, Mycobacterium bovis subsp bovis AF2122/97
auguccgcagcaccguc

SEQ ID NO: 1058554 - RNA, 21 nt, Mycobacterium bovis subsp bovis AF2122/97
auguccauguuuugcugcaug

SEQ ID NO: 1058555 - RNA, 23 nt, Mycobacterium bovis subsp bovis AF2122/97
auguccauguuuugcugcaugcc

SEQ ID NO: 1058556 - RNA, 12 nt, Mycobacterium bovis subsp bovis AF2122/97
auguaccccggc

SEQ ID NO: 1058557 - RNA, 12 nt, Mycobacterium bovis subsp bovis AF2122/97
augguggccgcg

SEQ ID NO: 1058558 - RNA, 16 nt, Mycobacterium bovis subsp bovis AF2122/97
augguggccgcgcggu

SEQ ID NO: 1058559 - RNA, 18 nt, Mycobacterium bovis subsp bovis AF2122/97
augguggggaccgcgaug

SEQ ID NO: 1058560 - RNA, 21 nt, Mycobacterium bovis subsp bovis AF2122/97
auguacugugccgcccccggc

SEQ ID NO: 1058561 - RNA, 15 nt, Mycobacterium bovis subsp bovis AF2122/97
augucgaugccgugu

SEQ ID NO: 1058562 - RNA, 19 nt, Mycobacterium bovis subsp bovis AF2122/97
augucgagcacgccaacgu

SEQ ID NO: 1058563 - RNA, 20 nt, Mycobacterium bovis subsp bovis AF2122/97
augucgacgagcaccgcgcc

SEQ ID NO: 1058564 - RNA, 15 nt, Mycobacterium bovis subsp bovis AF2122/97
augucgacgucgcgu

SEQ ID NO: 1058565 - RNA, 18 nt, Mycobacterium bovis subsp bovis AF2122/97
augucgaacaggaucagc

SEQ ID NO: 1058566 - RNA, 11 nt, Mycobacterium bovis subsp bovis AF2122/97
augucgacgag

SEQ ID NO: 1058567 - RNA, 17 nt, Mycobacterium bovis subsp bovis AF2122/97
augucgacgagcaccgc

SEQ ID NO: 1058568 - RNA, 17 nt, Mycobacterium bovis subsp bovis AF2122/97
auguccucgaugcgggc

SEQ ID NO: 1058569 - RNA, 22 nt, Mycobacterium bovis subsp bovis AF2122/97
auguccuugcgguccaggccgg

SEQ ID NO: 1058570 - RNA, 17 nt, Mycobacterium bovis subsp bovis AF2122/97
auguccgguccgccagc

SEQ ID NO: 1058571 - RNA, 21 nt, Mycobacterium bovis subsp bovis AF2122/97
auguccgguccgccagcgcga

SEQ ID NO: 1058572 - RNA, 22 nt, Mycobacterium bovis subsp bovis AF2122/97
auggucacccacguugaugaug

SEQ ID NO: 1058573 - RNA, 14 nt, Mycobacterium bovis subsp bovis AF2122/97
auggucaggcggcc

SEQ ID NO: 1058574 - RNA, 22 nt, Mycobacterium bovis subsp bovis AF2122/97
auggucccgcucuggucgucga

SEQ ID NO: 1058575 - RNA, 18 nt, Mycobacterium bovis subsp bovis AF2122/97
augguccgaccagcggcc

SEQ ID NO: 1058576 - RNA, 22 nt, Mycobacterium bovis subsp bovis AF2122/97
auggcucacccaggcgccgaug

SEQ ID NO: 1058577 - RNA, 17 nt, Mycobacterium bovis subsp bovis AF2122/97
auggcucacgcuccgcc

SEQ ID NO: 1058578 - RNA, 15 nt, Mycobacterium bovis subsp bovis AF2122/97
auggcugagcccgcc

SEQ ID NO: 1058579 - RNA, 20 nt, Mycobacterium bovis subsp bovis AF2122/97
auggcugagcccgccgcgac

SEQ ID NO: 1058580 - RNA, 18 nt, Mycobacterium bovis subsp bovis AF2122/97
auggcuggccagcacgcc

SEQ ID NO: 1058581 - RNA, 23 nt, Mycobacterium bovis subsp bovis AF2122/97
auggcuucgaagcgaucgccggc

SEQ ID NO: 1058582 - RNA, 17 nt, Mycobacterium bovis subsp bovis AF2122/97
auggucaaugccggccg

SEQ ID NO: 1058583 - RNA, 22 nt, Mycobacterium bovis subsp bovis AF2122/97
auggucaccaagacaccggccu

SEQ ID NO: 1058584 - RNA, 20 nt, Mycobacterium bovis subsp bovis AF2122/97
auggucucccggcugaugcc

SEQ ID NO: 1058585 - RNA, 22 nt, Mycobacterium bovis subsp bovis AF2122/97
auggucguucccgccggcacga

SEQ ID NO: 1058586 - RNA, 12 nt, Mycobacterium bovis subsp bovis AF2122/97
augguggcaacg

SEQ ID NO: 1058587 - RNA, 15 nt, Mycobacterium bovis subsp bovis AF2122/97
auggugccguccggc

SEQ ID NO: 1058588 - RNA, 15 nt, Mycobacterium bovis subsp bovis AF2122/97
auggugcgcccgccg

SEQ ID NO: 1058589 - RNA, 18 nt, Mycobacterium bovis subsp bovis AF2122/97
auggugcggccgcggcga

SEQ ID NO: 1058590 - RNA, 20 nt, Mycobacterium bovis subsp bovis AF2122/97
auggugccgacccgccgcgc

SEQ ID NO: 1058591 - RNA, 15 nt, Mycobacterium bovis subsp bovis AF2122/97
auggcgucaagcaca

SEQ ID NO: 1058592 - RNA, 20 nt, Mycobacterium bovis subsp bovis AF2122/97
auggcgucgaaccagucgaa

SEQ ID NO: 1058593 - RNA, 16 nt, Mycobacterium bovis subsp bovis AF2122/97
auggcgucgccggcac

SEQ ID NO: 1058594 - RNA, 17 nt, Mycobacterium bovis subsp bovis AF2122/97
auggcgucgccggcacc

SEQ ID NO: 1058595 - RNA, 20 nt, Mycobacterium bovis subsp bovis AF2122/97
auggcgucgccggcaccggc

SEQ ID NO: 1058596 - RNA, 15 nt, Mycobacterium bovis subsp bovis AF2122/97
auggcgucgccggcc

SEQ ID NO: 1058597 - RNA, 16 nt, Mycobacterium bovis subsp bovis AF2122/97
auggcgucgccggccc

SEQ ID NO: 1058598 - RNA, 17 nt, Mycobacterium bovis subsp bovis AF2122/97
auggcgucgccggcccc

SEQ ID NO: 1058599 - RNA, 14 nt, Mycobacterium bovis subsp bovis AF2122/97
auggcguucugcgc

SEQ ID NO: 1058600 - RNA, 17 nt, Mycobacterium bovis subsp bovis AF2122/97
auggcguuugccggccg

SEQ ID NO: 1058601 - RNA, 18 nt, Mycobacterium bovis subsp bovis AF2122/97
auggcguuugccggccga

SEQ ID NO: 1058602 - RNA, 12 nt, Mycobacterium bovis subsp bovis AF2122/97
auggcgggugcg

SEQ ID NO: 1058603 - RNA, 20 nt, Mycobacterium bovis subsp bovis AF2122/97
auggcguagggcuguccgac

SEQ ID NO: 1058604 - RNA, 18 nt, Mycobacterium bovis subsp bovis AF2122/97
auggcgucaugaacgauc

SEQ ID NO: 1058605 - RNA, 22 nt, Mycobacterium bovis subsp bovis AF2122/97
auggcggcuucgacgucggcga

SEQ ID NO: 1058606 - RNA, 16 nt, Mycobacterium bovis subsp bovis AF2122/97
auggcgccagccgacc

SEQ ID NO: 1058607 - RNA, 18 nt, Mycobacterium bovis subsp bovis AF2122/97
auggcggccaccgucagc

SEQ ID NO: 1058608 - RNA, 21 nt, Mycobacterium bovis subsp bovis AF2122/97
auggcggccaccgucagcgcg

SEQ ID NO: 1058609 - RNA, 17 nt, Mycobacterium bovis subsp bovis AF2122/97
auggcggcauagccgaa

SEQ ID NO: 1058610 - RNA, 19 nt, Mycobacterium bovis subsp bovis AF2122/97
auggcggcauagccgaaca

SEQ ID NO: 1058611 - RNA, 23 nt, Mycobacterium bovis subsp bovis AF2122/97
auggcggcauagccgaacagcgg

SEQ ID NO: 1058612 - RNA, 17 nt, Mycobacterium bovis subsp bovis AF2122/97
auggcgccguugccggc

SEQ ID NO: 1058613 - RNA, 19 nt, Mycobacterium bovis subsp bovis AF2122/97
auggcgcggguccagccac

SEQ ID NO: 1058614 - RNA, 14 nt, Mycobacterium bovis subsp bovis AF2122/97
auggcgcaccggcg

SEQ ID NO: 1058615 - RNA, 16 nt, Mycobacterium bovis subsp bovis AF2122/97
auggcgcaccggcguc

SEQ ID NO: 1058616 - RNA, 16 nt, Mycobacterium bovis subsp bovis AF2122/97
auggcgccaccggccg

SEQ ID NO: 1058617 - RNA, 14 nt, Mycobacterium bovis subsp bovis AF2122/97
auggcgccggccgg

SEQ ID NO: 1058618 - RNA, 14 nt, Mycobacterium bovis subsp bovis AF2122/97
auggcgccgcggcu

SEQ ID NO: 1058619 - RNA, 15 nt, Mycobacterium bovis subsp bovis AF2122/97
auggccgcgcccgcc

SEQ ID NO: 1058620 - RNA, 17 nt, Mycobacterium bovis subsp bovis AF2122/97
auggccgaaccguucgg

SEQ ID NO: 1058621 - RNA, 11 nt, Mycobacterium bovis subsp bovis AF2122/97
auggccggcca

SEQ ID NO: 1058622 - RNA, 15 nt, Mycobacterium bovis subsp bovis AF2122/97
auggccgccgcagcu

SEQ ID NO: 1058623 - RNA, 16 nt, Mycobacterium bovis subsp bovis AF2122/97
auggccgccgcagcuc

SEQ ID NO: 1058624 - RNA, 12 nt, Mycobacterium bovis subsp bovis AF2122/97
auggccgccgcg

SEQ ID NO: 1058625 - RNA, 16 nt, Mycobacterium bovis subsp bovis AF2122/97
auggccgccgcgagga

SEQ ID NO: 1058626 - RNA, 14 nt, Mycobacterium bovis subsp bovis AF2122/97
auggccgccaccgc

SEQ ID NO: 1058627 - RNA, 18 nt, Mycobacterium bovis subsp bovis AF2122/97
augcucgucuugggccgg

SEQ ID NO: 1058628 - RNA, 17 nt, Mycobacterium bovis subsp bovis AF2122/97
auggccgaccagccgau

SEQ ID NO: 1058629 - RNA, 15 nt, Mycobacterium bovis subsp bovis AF2122/97
auggcccuggcgacc

SEQ ID NO: 1058630 - RNA, 20 nt, Mycobacterium bovis subsp bovis AF2122/97
auggcccuuccggccgacac

SEQ ID NO: 1058631 - RNA, 16 nt, Mycobacterium bovis subsp bovis AF2122/97
auggccgauuccgcgc

SEQ ID NO: 1058632 - RNA, 21 nt, Mycobacterium bovis subsp bovis AF2122/97
auggccgcauuggcgaccgcu

SEQ ID NO: 1058633 - RNA, 20 nt, Mycobacterium bovis subsp bovis AF2122/97
augcucaggucaccggccgc

SEQ ID NO: 1058634 - RNA, 18 nt, Mycobacterium bovis subsp bovis AF2122/97
augcucaaugugccgccg

SEQ ID NO: 1058635 - RNA, 13 nt, Mycobacterium bovis subsp bovis AF2122/97
augcucaccggga

SEQ ID NO: 1058636 - RNA, 21 nt, Mycobacterium bovis subsp bovis AF2122/97
augcucgauccacugccgcgc

SEQ ID NO: 1058637 - RNA, 16 nt, Mycobacterium bovis subsp bovis AF2122/97
augucgcggucgaggu

SEQ ID NO: 1058638 - RNA, 15 nt, Mycobacterium bovis subsp bovis AF2122/97
augucgcgccaggcu

SEQ ID NO: 1058639 - RNA, 18 nt, Mycobacterium bovis subsp bovis AF2122/97
augucgcggacccgcgcg

SEQ ID NO: 1058640 - RNA, 19 nt, Mycobacterium bovis subsp bovis AF2122/97
auguugugccgaucggcca

SEQ ID NO: 1058641 - RNA, 18 nt, Mycobacterium bovis subsp bovis AF2122/97
auguugguuugccggcgg

SEQ ID NO: 1058642 - RNA, 18 nt, Mycobacterium bovis subsp bovis AF2122/97
auguuuuccgguccggcg

SEQ ID NO: 1058643 - RNA, 19 nt, Mycobacterium bovis subsp bovis AF2122/97
auguuuguguucgccggca

SEQ ID NO: 1058644 - RNA, 17 nt, Mycobacterium bovis subsp bovis AF2122/97
auguuuuuggccgcggu

SEQ ID NO: 1058645 - RNA, 21 nt, Mycobacterium bovis subsp bovis AF2122/97
auuaccagcggcaccgcgccg

SEQ ID NO: 1058646 - RNA, 16 nt, Mycobacterium bovis subsp bovis AF2122/97
auuccagccagccgcc

SEQ ID NO: 1058647 - RNA, 13 nt, Mycobacterium bovis subsp bovis AF2122/97
auuccagccggug

SEQ ID NO: 1058648 - RNA, 17 nt, Mycobacterium bovis subsp bovis AF2122/97
auuccaccuuggccaga

SEQ ID NO: 1058649 - RNA, 23 nt, Mycobacterium bovis subsp bovis AF2122/97
auuccaccgccgagaugcugguc

SEQ ID NO: 1058650 - RNA, 17 nt, Mycobacterium bovis subsp bovis AF2122/97
auuccacaaauccaaac

SEQ ID NO: 1058651 - RNA, 13 nt, Mycobacterium bovis subsp bovis AF2122/97
auuccaccgccga

SEQ ID NO: 1058652 - RNA, 14 nt, Mycobacterium bovis subsp bovis AF2122/97
auuacuucggccac

SEQ ID NO: 1058653 - RNA, 16 nt, Mycobacterium bovis subsp bovis AF2122/97
auuagccaggcccggc

SEQ ID NO: 1058654 - RNA, 20 nt, Mycobacterium bovis subsp bovis AF2122/97
auuaggggcuuuugcgucug

SEQ ID NO: 1058655 - RNA, 14 nt, Mycobacterium bovis subsp bovis AF2122/97
auuuccaccacgcg

SEQ ID NO: 1058656 - RNA, 16 nt, Mycobacterium bovis subsp bovis AF2122/97
auuuauugagucggcu

SEQ ID NO: 1058657 - RNA, 14 nt, Mycobacterium bovis subsp bovis AF2122/97
auucccaucggccu

SEQ ID NO: 1058658 - RNA, 14 nt, Mycobacterium bovis subsp bovis AF2122/97
auucccaggaacgg

SEQ ID NO: 1058659 - RNA, 21 nt, Mycobacterium bovis subsp bovis AF2122/97
auucccgcggcaacgcggucu

SEQ ID NO: 1058660 - RNA, 12 nt, Mycobacterium bovis subsp bovis AF2122/97
auuucggcggcg

SEQ ID NO: 1058661 - RNA, 15 nt, Mycobacterium bovis subsp bovis AF2122/97
auuucgucgaucggc

SEQ ID NO: 1058662 - RNA, 13 nt, Mycobacterium bovis subsp bovis AF2122/97
auuucgucggcca

SEQ ID NO: 1058663 - RNA, 15 nt, Mycobacterium bovis subsp bovis AF2122/97
auuucgucgucgcag

SEQ ID NO: 1058664 - RNA, 18 nt, Mycobacterium bovis subsp bovis AF2122/97
auuucgacgagacgaacc

SEQ ID NO: 1058665 - RNA, 14 nt, Mycobacterium bovis subsp bovis AF2122/97
auuucgaucgcggc

SEQ ID NO: 1058666 - RNA, 18 nt, Mycobacterium bovis subsp bovis AF2122/97
auuucguggcacgggucg

SEQ ID NO: 1058667 - RNA, 20 nt, Mycobacterium bovis subsp bovis AF2122/97
auuucuagguggacgugcag

SEQ ID NO: 1058668 - RNA, 19 nt, Mycobacterium bovis subsp bovis AF2122/97
auuucugggccgcuccacc

SEQ ID NO: 1058669 - RNA, 23 nt, Mycobacterium bovis subsp bovis AF2122/97
auuuguccggcggacccucgccg

SEQ ID NO: 1058670 - RNA, 17 nt, Mycobacterium bovis subsp bovis AF2122/97
auuugccgugcucaccg

SEQ ID NO: 1058671 - RNA, 23 nt, Mycobacterium bovis subsp bovis AF2122/97
auuugccgugcucaccggcgccc

SEQ ID NO: 1058672 - RNA, 14 nt, Mycobacterium bovis subsp bovis AF2122/97
auuugggcgagucg

SEQ ID NO: 1058673 - RNA, 16 nt, Mycobacterium bovis subsp bovis AF2122/97
caaagccgucgacgcg

SEQ ID NO: 1058674 - RNA, 17 nt, Mycobacterium bovis subsp bovis AF2122/97
caaagccgucgacgcgg

SEQ ID NO: 1058675 - RNA, 16 nt, Mycobacterium bovis subsp bovis AF2122/97
caaagccgucgcgacg

SEQ ID NO: 1058676 - RNA, 14 nt, Mycobacterium bovis subsp bovis AF2122/97
caaagccgucagcu

SEQ ID NO: 1058677 - RNA, 15 nt, Mycobacterium bovis subsp bovis AF2122/97
caaagccgucgacgc

SEQ ID NO: 1058678 - RNA, 15 nt, Mycobacterium bovis subsp bovis AF2122/97
caaagcacgucccgg

SEQ ID NO: 1058679 - RNA, 14 nt, Mycobacterium bovis subsp bovis AF2122/97
caaacggaacagcc

SEQ ID NO: 1058680 - RNA, 16 nt, Mycobacterium bovis subsp bovis AF2122/97
caaagacccgacgcca

SEQ ID NO: 1058681 - RNA, 14 nt, Mycobacterium bovis subsp bovis AF2122/97
caaagacgccgucg

SEQ ID NO: 1058682 - RNA, 19 nt, Mycobacterium bovis subsp bovis AF2122/97
caaagacgccgucggcgcc

SEQ ID NO: 1058683 - RNA, 22 nt, Mycobacterium bovis subsp bovis AF2122/97
caaagcacuucacgaguagcgg

SEQ ID NO: 1058684 - RNA, 16 nt, Mycobacterium bovis subsp bovis AF2122/97
caaacgcugcgcccgg

SEQ ID NO: 1058685 - RNA, 22 nt, Mycobacterium bovis subsp bovis AF2122/97
caaacgaacccccccgugcggu

SEQ ID NO: 1058686 - RNA, 17 nt, Mycobacterium bovis subsp bovis AF2122/97
caaacgcgcgcgccauu

SEQ ID NO: 1058687 - RNA, 12 nt, Mycobacterium bovis subsp bovis AF2122/97
caaacgcggcgu

SEQ ID NO: 1058688 - RNA, 15 nt, Mycobacterium bovis subsp bovis AF2122/97
caaacgcggcgucga

SEQ ID NO: 1058689 - RNA, 14 nt, Mycobacterium bovis subsp bovis AF2122/97
caaacgccgucacg

SEQ ID NO: 1058690 - RNA, 16 nt, Mycobacterium bovis subsp bovis AF2122/97
caaacgacucgcggug

SEQ ID NO: 1058691 - RNA, 21 nt, Mycobacterium bovis subsp bovis AF2122/97
caaacgaggauucauggcggc

SEQ ID NO: 1058692 - RNA, 19 nt, Mycobacterium bovis subsp bovis AF2122/97
caaacgcaaagacagcgcg

SEQ ID NO: 1058693 - RNA, 20 nt, Mycobacterium bovis subsp bovis AF2122/97
caaacgcaaagacagcgcgg

SEQ ID NO: 1058694 - RNA, 20 nt, Mycobacterium bovis subsp bovis AF2122/97
caaacaucuugucgaucugc

SEQ ID NO: 1058695 - RNA, 14 nt, Mycobacterium bovis subsp bovis AF2122/97
caaacaucgcaccc

SEQ ID NO: 1058696 - RNA, 16 nt, Mycobacterium bovis subsp bovis AF2122/97
caaaccaagcgcgcca

SEQ ID NO: 1058697 - RNA, 19 nt, Mycobacterium bovis subsp bovis AF2122/97
caaaaccucgugcgcaucg

SEQ ID NO: 1058698 - RNA, 19 nt, Mycobacterium bovis subsp bovis AF2122/97
caaaagcccgguacgccgc

SEQ ID NO: 1058699 - RNA, 15 nt, Mycobacterium bovis subsp bovis AF2122/97
caaaauacuccgcga

SEQ ID NO: 1058700 - RNA, 15 nt, Mycobacterium bovis subsp bovis AF2122/97
caaaaucagcagccc

SEQ ID NO: 1058701 - RNA, 15 nt, Mycobacterium bovis subsp bovis AF2122/97
auuuucggcacggau

SEQ ID NO: 1058702 - RNA, 17 nt, Mycobacterium bovis subsp bovis AF2122/97
caaaaacccggugacca

SEQ ID NO: 1058703 - RNA, 19 nt, Mycobacterium bovis subsp bovis AF2122/97
caaaaacgcugccgccguu

SEQ ID NO: 1058704 - RNA, 13 nt, Mycobacterium bovis subsp bovis AF2122/97
caacgccgcgacg

SEQ ID NO: 1058705 - RNA, 23 nt, Mycobacterium bovis subsp bovis AF2122/97
caacgcccgggcgaauccggcgg

SEQ ID NO: 1058706 - RNA, 12 nt, Mycobacterium bovis subsp bovis AF2122/97
caacgccggcga

SEQ ID NO: 1058707 - RNA, 23 nt, Mycobacterium bovis subsp bovis AF2122/97
caacgccgggcuguucggccaug

SEQ ID NO: 1058708 - RNA, 20 nt, Mycobacterium bovis subsp bovis AF2122/97
caacgccucgccauccauga

SEQ ID NO: 1058709 - RNA, 17 nt, Mycobacterium bovis subsp bovis AF2122/97
caacgccucgauggcgg

SEQ ID NO: 1058710 - RNA, 23 nt, Mycobacterium bovis subsp bovis AF2122/97
caacgccucgauggcgguggcga

SEQ ID NO: 1058711 - RNA, 15 nt, Mycobacterium bovis subsp bovis AF2122/97
caacgcgaaccggcc

SEQ ID NO: 1058712 - RNA, 19 nt, Mycobacterium bovis subsp bovis AF2122/97
caacgcgaaccggccaucg

SEQ ID NO: 1058713 - RNA, 17 nt, Mycobacterium bovis subsp bovis AF2122/97
caacgcgaaccgucucg

SEQ ID NO: 1058714 - RNA, 17 nt, Mycobacterium bovis subsp bovis AF2122/97
caacggcacccgaaaac

SEQ ID NO: 1058715 - RNA, 12 nt, Mycobacterium bovis subsp bovis AF2122/97
caacggcacccu

SEQ ID NO: 1058716 - RNA, 21 nt, Mycobacterium bovis subsp bovis AF2122/97
caacggaaucucuucggcggu

SEQ ID NO: 1058717 - RNA, 18 nt, Mycobacterium bovis subsp bovis AF2122/97
caacggagcgagcucagc

SEQ ID NO: 1058718 - RNA, 15 nt, Mycobacterium bovis subsp bovis AF2122/97
caacggaggugccgg

SEQ ID NO: 1058719 - RNA, 17 nt, Mycobacterium bovis subsp bovis AF2122/97
caacggaggugccggcg

SEQ ID NO: 1058720 - RNA, 16 nt, Mycobacterium bovis subsp bovis AF2122/97
caacggagugucgaug

SEQ ID NO: 1058721 - RNA, 16 nt, Mycobacterium bovis subsp bovis AF2122/97
caacggaagaccgcgg

SEQ ID NO: 1058722 - RNA, 11 nt, Mycobacterium bovis subsp bovis AF2122/97
caacggaaucu

SEQ ID NO: 1058723 - RNA, 20 nt, Mycobacterium bovis subsp bovis AF2122/97
caacggaaucucuucggcgg

SEQ ID NO: 1058724 - RNA, 21 nt, Mycobacterium bovis subsp bovis AF2122/97
caacgcgggaacgaugccgcc

SEQ ID NO: 1058725 - RNA, 22 nt, Mycobacterium bovis subsp bovis AF2122/97
caacgcgggaacgaugccgccg

SEQ ID NO: 1058726 - RNA, 16 nt, Mycobacterium bovis subsp bovis AF2122/97
caacgcgcacgcgugc

SEQ ID NO: 1058727 - RNA, 13 nt, Mycobacterium bovis subsp bovis AF2122/97
caacgcgaugccg

SEQ ID NO: 1058728 - RNA, 19 nt, Mycobacterium bovis subsp bovis AF2122/97
caacgcccccauccggucg

SEQ ID NO: 1058729 - RNA, 23 nt, Mycobacterium bovis subsp bovis AF2122/97
caacgcccccauccggucgaugu

SEQ ID NO: 1058730 - RNA, 19 nt, Mycobacterium bovis subsp bovis AF2122/97
caacgcccaccacgcgacg

SEQ ID NO: 1058731 - RNA, 15 nt, Mycobacterium bovis subsp bovis AF2122/97
caacgccaccgucgc

SEQ ID NO: 1058732 - RNA, 14 nt, Mycobacterium bovis subsp bovis AF2122/97
caacgccacgccga

SEQ ID NO: 1058733 - RNA, 16 nt, Mycobacterium bovis subsp bovis AF2122/97
caacgccagcaccagc

SEQ ID NO: 1058734 - RNA, 17 nt, Mycobacterium bovis subsp bovis AF2122/97
caacgccagcaccagcg

SEQ ID NO: 1058735 - RNA, 21 nt, Mycobacterium bovis subsp bovis AF2122/97
caacgccagcaccagcgucgc

SEQ ID NO: 1058736 - RNA, 23 nt, Mycobacterium bovis subsp bovis AF2122/97
caacgccagcaccagcgucgcgg

SEQ ID NO: 1058737 - RNA, 18 nt, Mycobacterium bovis subsp bovis AF2122/97
caacgacccgaagccgac

SEQ ID NO: 1058738 - RNA, 15 nt, Mycobacterium bovis subsp bovis AF2122/97
caacgacccgccgcc

SEQ ID NO: 1058739 - RNA, 16 nt, Mycobacterium bovis subsp bovis AF2122/97
caacgacccgccgccc

SEQ ID NO: 1058740 - RNA, 17 nt, Mycobacterium bovis subsp bovis AF2122/97
caacgcaacacgggcgc

SEQ ID NO: 1058741 - RNA, 18 nt, Mycobacterium bovis subsp bovis AF2122/97
caacgcaacacgggcgcc

SEQ ID NO: 1058742 - RNA, 17 nt, Mycobacterium bovis subsp bovis AF2122/97
caacgacgucgccgacc

SEQ ID NO: 1058743 - RNA, 16 nt, Mycobacterium bovis subsp bovis AF2122/97
caacgacggcaacagc

SEQ ID NO: 1058744 - RNA, 15 nt, Mycobacterium bovis subsp bovis AF2122/97
caacgcacgccacau

SEQ ID NO: 1058745 - RNA, 21 nt, Mycobacterium bovis subsp bovis AF2122/97
caacccgucuuaucggcgucg

SEQ ID NO: 1058746 - RNA, 19 nt, Mycobacterium bovis subsp bovis AF2122/97
caacccgucgagccgugcc

SEQ ID NO: 1058747 - RNA, 13 nt, Mycobacterium bovis subsp bovis AF2122/97
caacccggugaug

SEQ ID NO: 1058748 - RNA, 23 nt, Mycobacterium bovis subsp bovis AF2122/97
caacccggugauggugugcagca

SEQ ID NO: 1058749 - RNA, 17 nt, Mycobacterium bovis subsp bovis AF2122/97
caacccugcccggcccg

SEQ ID NO: 1058750 - RNA, 16 nt, Mycobacterium bovis subsp bovis AF2122/97
caacccugcggcgucg

SEQ ID NO: 1058751 - RNA, 17 nt, Mycobacterium bovis subsp bovis AF2122/97
caacccugcggcgucgu

SEQ ID NO: 1058752 - RNA, 15 nt, Mycobacterium bovis subsp bovis AF2122/97
caacccugcggugca

SEQ ID NO: 1058753 - RNA, 22 nt, Mycobacterium bovis subsp bovis AF2122/97
caacccuucggcauucgcacca

SEQ ID NO: 1058754 - RNA, 14 nt, Mycobacterium bovis subsp bovis AF2122/97
caaccgaaccgcgu

SEQ ID NO: 1058755 - RNA, 14 nt, Mycobacterium bovis subsp bovis AF2122/97
caaccgagcggucg

SEQ ID NO: 1058756 - RNA, 22 nt, Mycobacterium bovis subsp bovis AF2122/97
caacccgucgagccgugccucg

SEQ ID NO: 1058757 - RNA, 14 nt, Mycobacterium bovis subsp bovis AF2122/97
caaccgacgggucg

SEQ ID NO: 1058758 - RNA, 19 nt, Mycobacterium bovis subsp bovis AF2122/97
caaccuguuccagcgugcc

SEQ ID NO: 1058759 - RNA, 14 nt, Mycobacterium bovis subsp bovis AF2122/97
caacgaaccgcuca

SEQ ID NO: 1058760 - RNA, 19 nt, Mycobacterium bovis subsp bovis AF2122/97
caacgaaccgcucagcgca

SEQ ID NO: 1058761 - RNA, 23 nt, Mycobacterium bovis subsp bovis AF2122/97
caacgaaaccgaccuacugcggu

SEQ ID NO: 1058762 - RNA, 15 nt, Mycobacterium bovis subsp bovis AF2122/97
caacgaacgaugggg

SEQ ID NO: 1058763 - RNA, 19 nt, Mycobacterium bovis subsp bovis AF2122/97
caacgaagagggcgccgcg

SEQ ID NO: 1058764 - RNA, 17 nt, Mycobacterium bovis subsp bovis AF2122/97
caacgaagccggcgccg

SEQ ID NO: 1058765 - RNA, 18 nt, Mycobacterium bovis subsp bovis AF2122/97
caacgaagccggcgccgg

SEQ ID NO: 1058766 - RNA, 16 nt, Mycobacterium bovis subsp bovis AF2122/97
caacgaaugguaucga

SEQ ID NO: 1058767 - RNA, 17 nt, Mycobacterium bovis subsp bovis AF2122/97
caacgacaacacccacg

SEQ ID NO: 1058768 - RNA, 19 nt, Mycobacterium bovis subsp bovis AF2122/97
caacccgguccagccggua

SEQ ID NO: 1058769 - RNA, 16 nt, Mycobacterium bovis subsp bovis AF2122/97
caacccggcgucgacg

SEQ ID NO: 1058770 - RNA, 12 nt, Mycobacterium bovis subsp bovis AF2122/97
caacccggcucg

SEQ ID NO: 1058771 - RNA, 13 nt, Mycobacterium bovis subsp bovis AF2122/97
caacccgggcagc

SEQ ID NO: 1058772 - RNA, 14 nt, Mycobacterium bovis subsp bovis AF2122/97
caacccgggccgcc

SEQ ID NO: 1058773 - RNA, 15 nt, Mycobacterium bovis subsp bovis AF2122/97
caacccgggccgcca

SEQ ID NO: 1058774 - RNA, 17 nt, Mycobacterium bovis subsp bovis AF2122/97
caacccgggccgccagg

SEQ ID NO: 1058775 - RNA, 21 nt, Mycobacterium bovis subsp bovis AF2122/97
caaccagccuuuccggccgcc

SEQ ID NO: 1058776 - RNA, 14 nt, Mycobacterium bovis subsp bovis AF2122/97
caaccaggccgcga

SEQ ID NO: 1058777 - RNA, 18 nt, Mycobacterium bovis subsp bovis AF2122/97
caaccaggccgcgacaau

SEQ ID NO: 1058778 - RNA, 16 nt, Mycobacterium bovis subsp bovis AF2122/97
caaccacuuuccggcc

SEQ ID NO: 1058779 - RNA, 14 nt, Mycobacterium bovis subsp bovis AF2122/97
caaccacggccgcc

SEQ ID NO: 1058780 - RNA, 17 nt, Mycobacterium bovis subsp bovis AF2122/97
caaccacggccgccgcg

SEQ ID NO: 1058781 - RNA, 18 nt, Mycobacterium bovis subsp bovis AF2122/97
caaccacggccgccgcgu

SEQ ID NO: 1058782 - RNA, 16 nt, Mycobacterium bovis subsp bovis AF2122/97
caacaucuccgcgucg

SEQ ID NO: 1058783 - RNA, 22 nt, Mycobacterium bovis subsp bovis AF2122/97
caacaucuccgcgucggucagc

SEQ ID NO: 1058784 - RNA, 23 nt, Mycobacterium bovis subsp bovis AF2122/97
caacaucuugccgucggccggca

SEQ ID NO: 1058785 - RNA, 14 nt, Mycobacterium bovis subsp bovis AF2122/97
caacagcggcaaga

SEQ ID NO: 1058786 - RNA, 12 nt, Mycobacterium bovis subsp bovis AF2122/97
caacaggccggu

SEQ ID NO: 1058787 - RNA, 11 nt, Mycobacterium bovis subsp bovis AF2122/97
caacaggccgu

SEQ ID NO: 1058788 - RNA, 16 nt, Mycobacterium bovis subsp bovis AF2122/97
caacaggccgucgaug

SEQ ID NO: 1058789 - RNA, 23 nt, Mycobacterium bovis subsp bovis AF2122/97
caacaggccuaggucgacgccga

SEQ ID NO: 1058790 - RNA, 12 nt, Mycobacterium bovis subsp bovis AF2122/97
caacaggcgcgu

SEQ ID NO: 1058791 - RNA, 15 nt, Mycobacterium bovis subsp bovis AF2122/97
caacaggcgcgucgg

SEQ ID NO: 1058792 - RNA, 17 nt, Mycobacterium bovis subsp bovis AF2122/97
caacaggcgcgucggug

SEQ ID NO: 1058793 - RNA, 19 nt, Mycobacterium bovis subsp bovis AF2122/97
caacaggcgucccgcccgg

SEQ ID NO: 1058794 - RNA, 22 nt, Mycobacterium bovis subsp bovis AF2122/97
caacagggcgccgacgacuccg

SEQ ID NO: 1058795 - RNA, 14 nt, Mycobacterium bovis subsp bovis AF2122/97
caacaggaacaggc

SEQ ID NO: 1058796 - RNA, 19 nt, Mycobacterium bovis subsp bovis AF2122/97
caacagggcggcagggugu

SEQ ID NO: 1058797 - RNA, 15 nt, Mycobacterium bovis subsp bovis AF2122/97
caacagggugggcuu

SEQ ID NO: 1058798 - RNA, 16 nt, Mycobacterium bovis subsp bovis AF2122/97
caacagguccaccggc

SEQ ID NO: 1058799 - RNA, 15 nt, Mycobacterium bovis subsp bovis AF2122/97
caacauccuccgggc

SEQ ID NO: 1058800 - RNA, 15 nt, Mycobacterium bovis subsp bovis AF2122/97
caacaucggcccgcu

SEQ ID NO: 1058801 - RNA, 16 nt, Mycobacterium bovis subsp bovis AF2122/97
caacaucggcccgcug

SEQ ID NO: 1058802 - RNA, 22 nt, Mycobacterium bovis subsp bovis AF2122/97
caacaucgggucgcugccggcu

SEQ ID NO: 1058803 - RNA, 15 nt, Mycobacterium bovis subsp bovis AF2122/97
caaaguaucgcagca

SEQ ID NO: 1058804 - RNA, 14 nt, Mycobacterium bovis subsp bovis AF2122/97
caaaggugccgacc

SEQ ID NO: 1058805 - RNA, 18 nt, Mycobacterium bovis subsp bovis AF2122/97
caaagguuuccgcggucu

SEQ ID NO: 1058806 - RNA, 17 nt, Mycobacterium bovis subsp bovis AF2122/97
caacagccgcucgcaca

SEQ ID NO: 1058807 - RNA, 20 nt, Mycobacterium bovis subsp bovis AF2122/97
caacagcccguagcacaccg

SEQ ID NO: 1058808 - RNA, 23 nt, Mycobacterium bovis subsp bovis AF2122/97
caacagcgcuacaaacgauccga

SEQ ID NO: 1058809 - RNA, 22 nt, Mycobacterium bovis subsp bovis AF2122/97
caacagcacccgggccacgucg

SEQ ID NO: 1058810 - RNA, 18 nt, Mycobacterium bovis subsp bovis AF2122/97
caacagcaccgcgacgac

SEQ ID NO: 1058811 - RNA, 20 nt, Mycobacterium bovis subsp bovis AF2122/97
caacagcaggugccaaccgc

SEQ ID NO: 1058812 - RNA, 15 nt, Mycobacterium bovis subsp bovis AF2122/97
caacagcccaccggu

SEQ ID NO: 1058813 - RNA, 17 nt, Mycobacterium bovis subsp bovis AF2122/97
caacagcccaccggugc

SEQ ID NO: 1058814 - RNA, 16 nt, Mycobacterium bovis subsp bovis AF2122/97
caacagaugccaccca

SEQ ID NO: 1058815 - RNA, 20 nt, Mycobacterium bovis subsp bovis AF2122/97
caacagacauuugucaacca

SEQ ID NO: 1058816 - RNA, 21 nt, Mycobacterium bovis subsp bovis AF2122/97
caacagaccuagcaccgcgcc

SEQ ID NO: 1058817 - RNA, 18 nt, Mycobacterium bovis subsp bovis AF2122/97
caacuuggcggccagccg

SEQ ID NO: 1058818 - RNA, 15 nt, Mycobacterium bovis subsp bovis AF2122/97
caacuugggcccgcu

SEQ ID NO: 1058819 - RNA, 16 nt, Mycobacterium bovis subsp bovis AF2122/97
caacuugggcccgcug

SEQ ID NO: 1058820 - RNA, 22 nt, Mycobacterium bovis subsp bovis AF2122/97
caacugucuugggggccaaccg

SEQ ID NO: 1058821 - RNA, 22 nt, Mycobacterium bovis subsp bovis AF2122/97
caacuggugggccaucgucagg

SEQ ID NO: 1058822 - RNA, 15 nt, Mycobacterium bovis subsp bovis AF2122/97
caacuggucgccaac

SEQ ID NO: 1058823 - RNA, 20 nt, Mycobacterium bovis subsp bovis AF2122/97
caacugggccgagcgcgccg

SEQ ID NO: 1058824 - RNA, 23 nt, Mycobacterium bovis subsp bovis AF2122/97
caacuggccgcgucgcugagcaa

SEQ ID NO: 1058825 - RNA, 16 nt, Mycobacterium bovis subsp bovis AF2122/97
caagacguugcgcucg

SEQ ID NO: 1058826 - RNA, 15 nt, Mycobacterium bovis subsp bovis AF2122/97
caagaccgcgccaac

SEQ ID NO: 1058827 - RNA, 18 nt, Mycobacterium bovis subsp bovis AF2122/97
caagacgaugcuggcggc

SEQ ID NO: 1058828 - RNA, 21 nt, Mycobacterium bovis subsp bovis AF2122/97
caagaccaagugucgccgcuc

SEQ ID NO: 1058829 - RNA, 17 nt, Mycobacterium bovis subsp bovis AF2122/97
caagaaugccgccgacg

SEQ ID NO: 1058830 - RNA, 15 nt, Mycobacterium bovis subsp bovis AF2122/97
caagaaggccagcgc

SEQ ID NO: 1058831 - RNA, 15 nt, Mycobacterium bovis subsp bovis AF2122/97
caacgggccgcaucg

SEQ ID NO: 1058832 - RNA, 22 nt, Mycobacterium bovis subsp bovis AF2122/97
caacgggcugccccuccgggcg

SEQ ID NO: 1058833 - RNA, 18 nt, Mycobacterium bovis subsp bovis AF2122/97
caacgguaguugcgcggc

SEQ ID NO: 1058834 - RNA, 16 nt, Mycobacterium bovis subsp bovis AF2122/97
caacgggaugccggcg

SEQ ID NO: 1058835 - RNA, 17 nt, Mycobacterium bovis subsp bovis AF2122/97
caacggguccgacggug

SEQ ID NO: 1058836 - RNA, 16 nt, Mycobacterium bovis subsp bovis AF2122/97
caacgggucggcauug

SEQ ID NO: 1058837 - RNA, 23 nt, Mycobacterium bovis subsp bovis AF2122/97
caacggcagaucccacgccagga

SEQ ID NO: 1058838 - RNA, 19 nt, Mycobacterium bovis subsp bovis AF2122/97
caacggcagcccguggucg

SEQ ID NO: 1058839 - RNA, 22 nt, Mycobacterium bovis subsp bovis AF2122/97
caacgggccuucagcucaccac

SEQ ID NO: 1058840 - RNA, 14 nt, Mycobacterium bovis subsp bovis AF2122/97
caacggcgcgccga

SEQ ID NO: 1058841 - RNA, 16 nt, Mycobacterium bovis subsp bovis AF2122/97
caacggcgcgccgacc

SEQ ID NO: 1058842 - RNA, 19 nt, Mycobacterium bovis subsp bovis AF2122/97
caacugccgcacccggucg

SEQ ID NO: 1058843 - RNA, 18 nt, Mycobacterium bovis subsp bovis AF2122/97
caacugauggcgcgcaac

SEQ ID NO: 1058844 - RNA, 23 nt, Mycobacterium bovis subsp bovis AF2122/97
caacgguggcaacggaggugccg

SEQ ID NO: 1058845 - RNA, 21 nt, Mycobacterium bovis subsp bovis AF2122/97
caacggugggugggcgccgca

SEQ ID NO: 1058846 - RNA, 23 nt, Mycobacterium bovis subsp bovis AF2122/97
caacggugggugggcgccgcaac

SEQ ID NO: 1058847 - RNA, 19 nt, Mycobacterium bovis subsp bovis AF2122/97
caacucgggcagcgcggcc

SEQ ID NO: 1058848 - RNA, 16 nt, Mycobacterium bovis subsp bovis AF2122/97
caacucgggcagcuuc

SEQ ID NO: 1058849 - RNA, 17 nt, Mycobacterium bovis subsp bovis AF2122/97
caacguacgcacgcagc

SEQ ID NO: 1058850 - RNA, 23 nt, Mycobacterium bovis subsp bovis AF2122/97
caacucggcgaugacaucaccga

SEQ ID NO: 1058851 - RNA, 22 nt, Mycobacterium bovis subsp bovis AF2122/97
caacucuucagcaagccaaccc

SEQ ID NO: 1058852 - RNA, 20 nt, Mycobacterium bovis subsp bovis AF2122/97
caacucuucccauuucggca

SEQ ID NO: 1058853 - RNA, 22 nt, Mycobacterium bovis subsp bovis AF2122/97
caacucuucccauuucggcaaa

SEQ ID NO: 1058854 - RNA, 14 nt, Mycobacterium bovis subsp bovis AF2122/97
caaggaugucgggg

SEQ ID NO: 1058855 - RNA, 22 nt, Mycobacterium bovis subsp bovis AF2122/97
caaggagaucucugagcgggcg

SEQ ID NO: 1058856 - RNA, 17 nt, Mycobacterium bovis subsp bovis AF2122/97
caaggagcccguccagg

SEQ ID NO: 1058857 - RNA, 14 nt, Mycobacterium bovis subsp bovis AF2122/97
caagcuaacucgac

SEQ ID NO: 1058858 - RNA, 17 nt, Mycobacterium bovis subsp bovis AF2122/97
caagcuaagcgccugau

SEQ ID NO: 1058859 - RNA, 18 nt, Mycobacterium bovis subsp bovis AF2122/97
caagcguccgcugcaggu

SEQ ID NO: 1058860 - RNA, 23 nt, Mycobacterium bovis subsp bovis AF2122/97
caagcguccgcugcagguccagg

SEQ ID NO: 1058861 - RNA, 17 nt, Mycobacterium bovis subsp bovis AF2122/97
caaggccaagcgccaac

SEQ ID NO: 1058862 - RNA, 18 nt, Mycobacterium bovis subsp bovis AF2122/97
caaggcauccaacgcggc

SEQ ID NO: 1058863 - RNA, 20 nt, Mycobacterium bovis subsp bovis AF2122/97
caaggcauccaacgcggcgc

SEQ ID NO: 1058864 - RNA, 12 nt, Mycobacterium bovis subsp bovis AF2122/97
caagccggcgag

SEQ ID NO: 1058865 - RNA, 14 nt, Mycobacterium bovis subsp bovis AF2122/97
caagccgccggcgc

SEQ ID NO: 1058866 - RNA, 15 nt, Mycobacterium bovis subsp bovis AF2122/97
caagccgccggcgcc

SEQ ID NO: 1058867 - RNA, 14 nt, Mycobacterium bovis subsp bovis AF2122/97
caagccgacaucgg

SEQ ID NO: 1058868 - RNA, 18 nt, Mycobacterium bovis subsp bovis AF2122/97
caagccgacaucggcggc

SEQ ID NO: 1058869 - RNA, 19 nt, Mycobacterium bovis subsp bovis AF2122/97
caagccgacaucggcggcc

SEQ ID NO: 1058870 - RNA, 13 nt, Mycobacterium bovis subsp bovis AF2122/97
caagccgaccugc

SEQ ID NO: 1058871 - RNA, 22 nt, Mycobacterium bovis subsp bovis AF2122/97
caagccgauugcuucuucgggc

SEQ ID NO: 1058872 - RNA, 14 nt, Mycobacterium bovis subsp bovis AF2122/97
caagcacgcgacgg

SEQ ID NO: 1058873 - RNA, 15 nt, Mycobacterium bovis subsp bovis AF2122/97
caagcaaguccaccg

SEQ ID NO: 1058874 - RNA, 20 nt, Mycobacterium bovis subsp bovis AF2122/97
caagcaaguccaccggaucg

SEQ ID NO: 1058875 - RNA, 12 nt, Mycobacterium bovis subsp bovis AF2122/97
caagcaaccggu

SEQ ID NO: 1058876 - RNA, 23 nt, Mycobacterium bovis subsp bovis AF2122/97
caagcaaccggugcgcauccguc

SEQ ID NO: 1058877 - RNA, 22 nt, Mycobacterium bovis subsp bovis AF2122/97
caagcacagcccggcgacgacc

SEQ ID NO: 1058878 - RNA, 12 nt, Mycobacterium bovis subsp bovis AF2122/97
caagcacaaucc

SEQ ID NO: 1058879 - RNA, 14 nt, Mycobacterium bovis subsp bovis AF2122/97
caagcacaccgcca

SEQ ID NO: 1058880 - RNA, 19 nt, Mycobacterium bovis subsp bovis AF2122/97
caagcacagcccggcgacg

SEQ ID NO: 1058881 - RNA, 15 nt, Mycobacterium bovis subsp bovis AF2122/97
caagagugcucagcg

SEQ ID NO: 1058882 - RNA, 24 nt, Mycobacterium bovis subsp bovis AF2122/97
caagaucaccuucgucgcggccgc

SEQ ID NO: 1058883 - RNA, 20 nt, Mycobacterium bovis subsp bovis AF2122/97
caagaucagacccagcgcgg

SEQ ID NO: 1058884 - RNA, 18 nt, Mycobacterium bovis subsp bovis AF2122/97
caagaucucgcgggcccg

SEQ ID NO: 1058885 - RNA, 18 nt, Mycobacterium bovis subsp bovis AF2122/97
caagauuaccgaagcccg

SEQ ID NO: 1058886 - RNA, 16 nt, Mycobacterium bovis subsp bovis AF2122/97
caagccagcguuggcg

SEQ ID NO: 1058887 - RNA, 18 nt, Mycobacterium bovis subsp bovis AF2122/97
caagccagcguuggcggc

SEQ ID NO: 1058888 - RNA, 18 nt, Mycobacterium bovis subsp bovis AF2122/97
caagccauguggcgucgc

SEQ ID NO: 1058889 - RNA, 21 nt, Mycobacterium bovis subsp bovis AF2122/97
caagccauguggcgucgcucg

SEQ ID NO: 1058890 - RNA, 18 nt, Mycobacterium bovis subsp bovis AF2122/97
caagccauucacgagccg

SEQ ID NO: 1058891 - RNA, 21 nt, Mycobacterium bovis subsp bovis AF2122/97
caagccaaccagcccggccgc

SEQ ID NO: 1058892 - RNA, 16 nt, Mycobacterium bovis subsp bovis AF2122/97
caagccacgucgucgc

SEQ ID NO: 1058893 - RNA, 14 nt, Mycobacterium bovis subsp bovis AF2122/97
caagccagcacugc

SEQ ID NO: 1058894 - RNA, 19 nt, Mycobacterium bovis subsp bovis AF2122/97
caagcaguccacgagcacg

SEQ ID NO: 1058895 - RNA, 14 nt, Mycobacterium bovis subsp bovis AF2122/97
caagcagcguggcg

SEQ ID NO: 1058896 - RNA, 13 nt, Mycobacterium bovis subsp bovis AF2122/97
caagcagcgacca

SEQ ID NO: 1058897 - RNA, 16 nt, Mycobacterium bovis subsp bovis AF2122/97
caagcagcgaccagca

SEQ ID NO: 1058898 - RNA, 16 nt, Mycobacterium bovis subsp bovis AF2122/97
caagcauuggcgucga

SEQ ID NO: 1058899 - RNA, 12 nt, Mycobacterium bovis subsp bovis AF2122/97
caccgcccgacc

SEQ ID NO: 1058900 - RNA, 13 nt, Mycobacterium bovis subsp bovis AF2122/97
caccgcccgaccc

SEQ ID NO: 1058901 - RNA, 15 nt, Mycobacterium bovis subsp bovis AF2122/97
caccgcccgacccau

SEQ ID NO: 1058902 - RNA, 17 nt, Mycobacterium bovis subsp bovis AF2122/97
caccgcccgcaagucgg

SEQ ID NO: 1058903 - RNA, 18 nt, Mycobacterium bovis subsp bovis AF2122/97
caccgccccgcgcccaac

SEQ ID NO: 1058904 - RNA, 12 nt, Mycobacterium bovis subsp bovis AF2122/97
caccgcccccgu

SEQ ID NO: 1058905 - RNA, 20 nt, Mycobacterium bovis subsp bovis AF2122/97
caccgcccccgucggccuug

SEQ ID NO: 1058906 - RNA, 13 nt, Mycobacterium bovis subsp bovis AF2122/97
caccgccccgccg

SEQ ID NO: 1058907 - RNA, 15 nt, Mycobacterium bovis subsp bovis AF2122/97
caccgccccggcggc

SEQ ID NO: 1058908 - RNA, 22 nt, Mycobacterium bovis subsp bovis AF2122/97
caccgccccggcggcggcggcc

SEQ ID NO: 1058909 - RNA, 13 nt, Mycobacterium bovis subsp bovis AF2122/97
caccgcccgcacg

SEQ ID NO: 1058910 - RNA, 16 nt, Mycobacterium bovis subsp bovis AF2122/97
caccgcccgccgaacg

SEQ ID NO: 1058911 - RNA, 12 nt, Mycobacterium bovis subsp bovis AF2122/97
caccgcccggcc

SEQ ID NO: 1058912 - RNA, 15 nt, Mycobacterium bovis subsp bovis AF2122/97
caccgcccuugccgc

SEQ ID NO: 1058913 - RNA, 13 nt, Mycobacterium bovis subsp bovis AF2122/97
caccgccagccac

SEQ ID NO: 1058914 - RNA, 18 nt, Mycobacterium bovis subsp bovis AF2122/97
caccgccagccaccacau

SEQ ID NO: 1058915 - RNA, 13 nt, Mycobacterium bovis subsp bovis AF2122/97
caccgccagcggc

SEQ ID NO: 1058916 - RNA, 19 nt, Mycobacterium bovis subsp bovis AF2122/97
caccgccagcucacggacg

SEQ ID NO: 1058917 - RNA, 14 nt, Mycobacterium bovis subsp bovis AF2122/97
caccgccaggucga

SEQ ID NO: 1058918 - RNA, 16 nt, Mycobacterium bovis subsp bovis AF2122/97
caccgccaggucgagg

SEQ ID NO: 1058919 - RNA, 15 nt, Mycobacterium bovis subsp bovis AF2122/97
caccgcccacagcaa

SEQ ID NO: 1058920 - RNA, 13 nt, Mycobacterium bovis subsp bovis AF2122/97
caccgccgccgcc

SEQ ID NO: 1058921 - RNA, 15 nt, Mycobacterium bovis subsp bovis AF2122/97
caccgccgccgccac

SEQ ID NO: 1058922 - RNA, 19 nt, Mycobacterium bovis subsp bovis AF2122/97
caccgccgccggcaccgcc

SEQ ID NO: 1058923 - RNA, 23 nt, Mycobacterium bovis subsp bovis AF2122/97
caccgccgccggcaccgccggcg

SEQ ID NO: 1058924 - RNA, 17 nt, Mycobacterium bovis subsp bovis AF2122/97
caccgccgccugcccgg

SEQ ID NO: 1058925 - RNA, 21 nt, Mycobacterium bovis subsp bovis AF2122/97
caccgccgccugcccggcccg

SEQ ID NO: 1058926 - RNA, 13 nt, Mycobacterium bovis subsp bovis AF2122/97
caccgccgcgacc

SEQ ID NO: 1058927 - RNA, 14 nt, Mycobacterium bovis subsp bovis AF2122/97
caccgccgcgaccg

SEQ ID NO: 1058928 - RNA, 17 nt, Mycobacterium bovis subsp bovis AF2122/97
caccgccgcgaccgccu

SEQ ID NO: 1058929 - RNA, 19 nt, Mycobacterium bovis subsp bovis AF2122/97
caccgccgcgccggcggcc

SEQ ID NO: 1058930 - RNA, 13 nt, Mycobacterium bovis subsp bovis AF2122/97
caccgccgcgcgg

SEQ ID NO: 1058931 - RNA, 15 nt, Mycobacterium bovis subsp bovis AF2122/97
caccgccgccgccga

SEQ ID NO: 1058932 - RNA, 17 nt, Mycobacterium bovis subsp bovis AF2122/97
caccgccgccgccgacg

SEQ ID NO: 1058933 - RNA, 12 nt, Mycobacterium bovis subsp bovis AF2122/97
caccgccgccgg

SEQ ID NO: 1058934 - RNA, 13 nt, Mycobacterium bovis subsp bovis AF2122/97
caccgccgcgccg

SEQ ID NO: 1058935 - RNA, 15 nt, Mycobacterium bovis subsp bovis AF2122/97
caccgccgcggccgc

SEQ ID NO: 1058936 - RNA, 12 nt, Mycobacterium bovis subsp bovis AF2122/97
caccgccgcggc

SEQ ID NO: 1058937 - RNA, 19 nt, Mycobacterium bovis subsp bovis AF2122/97
caccgccgccgccaccggc

SEQ ID NO: 1058938 - RNA, 12 nt, Mycobacterium bovis subsp bovis AF2122/97
caccgccgaccc

SEQ ID NO: 1058939 - RNA, 13 nt, Mycobacterium bovis subsp bovis AF2122/97
caccgccgacccu

SEQ ID NO: 1058940 - RNA, 13 nt, Mycobacterium bovis subsp bovis AF2122/97
caccgccgacgcc

SEQ ID NO: 1058941 - RNA, 16 nt, Mycobacterium bovis subsp bovis AF2122/97
caccgccgacgcccga

SEQ ID NO: 1058942 - RNA, 18 nt, Mycobacterium bovis subsp bovis AF2122/97
caccgccgacgcccgacg

SEQ ID NO: 1058943 - RNA, 16 nt, Mycobacterium bovis subsp bovis AF2122/97
caccgccgagcagacg

SEQ ID NO: 1058944 - RNA, 18 nt, Mycobacterium bovis subsp bovis AF2122/97
caccgcccuugccgccgg

SEQ ID NO: 1058945 - RNA, 21 nt, Mycobacterium bovis subsp bovis AF2122/97
caccgcccuugccgccggccc

SEQ ID NO: 1058946 - RNA, 23 nt, Mycobacterium bovis subsp bovis AF2122/97
caccgcccuugccgccggccccg

SEQ ID NO: 1058947 - RNA, 16 nt, Mycobacterium bovis subsp bovis AF2122/97
caccgccgaacagugu

SEQ ID NO: 1058948 - RNA, 17 nt, Mycobacterium bovis subsp bovis AF2122/97
caccgcccuugccgccg

SEQ ID NO: 1058949 - RNA, 21 nt, Mycobacterium bovis subsp bovis AF2122/97
caccgccgacaggccggccac

SEQ ID NO: 1058950 - RNA, 22 nt, Mycobacterium bovis subsp bovis AF2122/97
caccgccgacaggccggccacc

SEQ ID NO: 1058951 - RNA, 13 nt, Mycobacterium bovis subsp bovis AF2122/97
caccgccgcacgc

SEQ ID NO: 1058952 - RNA, 15 nt, Mycobacterium bovis subsp bovis AF2122/97
caccgccgcccccgc

SEQ ID NO: 1058953 - RNA, 23 nt, Mycobacterium bovis subsp bovis AF2122/97
caccgccgcccccgccggccgcg

SEQ ID NO: 1058954 - RNA, 19 nt, Mycobacterium bovis subsp bovis AF2122/97
caccgcgauuagcaaaccg

SEQ ID NO: 1058955 - RNA, 22 nt, Mycobacterium bovis subsp bovis AF2122/97
caccgcgauuagcaaaccgacc

SEQ ID NO: 1058956 - RNA, 13 nt, Mycobacterium bovis subsp bovis AF2122/97
caccgcgaucacc

SEQ ID NO: 1058957 - RNA, 18 nt, Mycobacterium bovis subsp bovis AF2122/97
caccgcgaucaccaccgg

SEQ ID NO: 1058958 - RNA, 15 nt, Mycobacterium bovis subsp bovis AF2122/97
caccgcgaucaccac

SEQ ID NO: 1058959 - RNA, 14 nt, Mycobacterium bovis subsp bovis AF2122/97
caccgcgacgacga

SEQ ID NO: 1058960 - RNA, 14 nt, Mycobacterium bovis subsp bovis AF2122/97
caccgcgcagcgaa

SEQ ID NO: 1058961 - RNA, 21 nt, Mycobacterium bovis subsp bovis AF2122/97
caccgcggauaggccgcgcgg

SEQ ID NO: 1058962 - RNA, 15 nt, Mycobacterium bovis subsp bovis AF2122/97
caccgcggacccgca

SEQ ID NO: 1058963 - RNA, 15 nt, Mycobacterium bovis subsp bovis AF2122/97
caccgcgacgacgag

SEQ ID NO: 1058964 - RNA, 18 nt, Mycobacterium bovis subsp bovis AF2122/97
caccgcgcuggucagccg

SEQ ID NO: 1058965 - RNA, 15 nt, Mycobacterium bovis subsp bovis AF2122/97
caccgccgcgucgag

SEQ ID NO: 1058966 - RNA, 16 nt, Mycobacterium bovis subsp bovis AF2122/97
caccgccgcgucgagc

SEQ ID NO: 1058967 - RNA, 18 nt, Mycobacterium bovis subsp bovis AF2122/97
caccgccgcuaccgcccg

SEQ ID NO: 1058968 - RNA, 19 nt, Mycobacterium bovis subsp bovis AF2122/97
caccgccgcuaccgcccgc

SEQ ID NO: 1058969 - RNA, 22 nt, Mycobacterium bovis subsp bovis AF2122/97
caccgccggcaauaccgccagc

SEQ ID NO: 1058970 - RNA, 17 nt, Mycobacterium bovis subsp bovis AF2122/97
caccgccggcaccgcca

SEQ ID NO: 1058971 - RNA, 17 nt, Mycobacterium bovis subsp bovis AF2122/97
caccgccggcaccgccg

SEQ ID NO: 1058972 - RNA, 17 nt, Mycobacterium bovis subsp bovis AF2122/97
caccgccugcucggcga

SEQ ID NO: 1058973 - RNA, 18 nt, Mycobacterium bovis subsp bovis AF2122/97
caccgccggcaccgccgg

SEQ ID NO: 1058974 - RNA, 20 nt, Mycobacterium bovis subsp bovis AF2122/97
caccgccggcaccgccggcg

SEQ ID NO: 1058975 - RNA, 22 nt, Mycobacterium bovis subsp bovis AF2122/97
caccgccggcaccgccggcgcc

SEQ ID NO: 1058976 - RNA, 13 nt, Mycobacterium bovis subsp bovis AF2122/97
caccgccggcagc

SEQ ID NO: 1058977 - RNA, 15 nt, Mycobacterium bovis subsp bovis AF2122/97
caccgccugggcggc

SEQ ID NO: 1058978 - RNA, 18 nt, Mycobacterium bovis subsp bovis AF2122/97
caccgccugggcggccag

SEQ ID NO: 1058979 - RNA, 19 nt, Mycobacterium bovis subsp bovis AF2122/97
caccgccugggcggccagc

SEQ ID NO: 1058980 - RNA, 22 nt, Mycobacterium bovis subsp bovis AF2122/97
caccgcgaccaucgcgacggca

SEQ ID NO: 1058981 - RNA, 13 nt, Mycobacterium bovis subsp bovis AF2122/97
caccgcgacaccc

SEQ ID NO: 1058982 - RNA, 23 nt, Mycobacterium bovis subsp bovis AF2122/97
caccgcgaccucgcggcgcuggu

SEQ ID NO: 1058983 - RNA, 15 nt, Mycobacterium bovis subsp bovis AF2122/97
caccgcgaccgcgca

SEQ ID NO: 1058984 - RNA, 17 nt, Mycobacterium bovis subsp bovis AF2122/97
caccgcgaaagcaccga

SEQ ID NO: 1058985 - RNA, 20 nt, Mycobacterium bovis subsp bovis AF2122/97
caccgccugugccgccggcg

SEQ ID NO: 1058986 - RNA, 17 nt, Mycobacterium bovis subsp bovis AF2122/97
cacccgguagacgucgu

SEQ ID NO: 1058987 - RNA, 18 nt, Mycobacterium bovis subsp bovis AF2122/97
cacccgggccucggcgcc

SEQ ID NO: 1058988 - RNA, 22 nt, Mycobacterium bovis subsp bovis AF2122/97
cacccgggccucggcgccgucg

SEQ ID NO: 1058989 - RNA, 16 nt, Mycobacterium bovis subsp bovis AF2122/97
cacccgggcagccugc

SEQ ID NO: 1058990 - RNA, 21 nt, Mycobacterium bovis subsp bovis AF2122/97
cacccggggugcccggccgcc

SEQ ID NO: 1058991 - RNA, 22 nt, Mycobacterium bovis subsp bovis AF2122/97
cacccggggugcccggccgcca

SEQ ID NO: 1058992 - RNA, 18 nt, Mycobacterium bovis subsp bovis AF2122/97
cacccgggcugcuugcgc

SEQ ID NO: 1058993 - RNA, 22 nt, Mycobacterium bovis subsp bovis AF2122/97
cacccgggcugcuugcgcccgg

SEQ ID NO: 1058994 - RNA, 17 nt, Mycobacterium bovis subsp bovis AF2122/97
cacccgggccacgucga

SEQ ID NO: 1058995 - RNA, 15 nt, Mycobacterium bovis subsp bovis AF2122/97
cacccucaggcaauc

SEQ ID NO: 1058996 - RNA, 16 nt, Mycobacterium bovis subsp bovis AF2122/97
cacccuccacagcggc

SEQ ID NO: 1058997 - RNA, 22 nt, Mycobacterium bovis subsp bovis AF2122/97
cacccugaugugaguccagccg

SEQ ID NO: 1058998 - RNA, 15 nt, Mycobacterium bovis subsp bovis AF2122/97
cacccugcggcaccu

SEQ ID NO: 1058999 - RNA, 21 nt, Mycobacterium bovis subsp bovis AF2122/97
cacccugcggcaccucauugc

SEQ ID NO: 1059000 - RNA, 13 nt, Mycobacterium bovis subsp bovis AF2122/97
cacccuugcccac

SEQ ID NO: 1059001 - RNA, 13 nt, Mycobacterium bovis subsp bovis AF2122/97
cacccuggucgaa

SEQ ID NO: 1059002 - RNA, 13 nt, Mycobacterium bovis subsp bovis AF2122/97
cacccuugccgcc

SEQ ID NO: 1059003 - RNA, 14 nt, Mycobacterium bovis subsp bovis AF2122/97
cacccuugccgccg

SEQ ID NO: 1059004 - RNA, 14 nt, Mycobacterium bovis subsp bovis AF2122/97
cacccugggcaaac

SEQ ID NO: 1059005 - RNA, 18 nt, Mycobacterium bovis subsp bovis AF2122/97
caccgaggucgagcgacc

SEQ ID NO: 1059006 - RNA, 13 nt, Mycobacterium bovis subsp bovis AF2122/97
caccgaggccgcc

SEQ ID NO: 1059007 - RNA, 16 nt, Mycobacterium bovis subsp bovis AF2122/97
caccgaggccgccgag

SEQ ID NO: 1059008 - RNA, 18 nt, Mycobacterium bovis subsp bovis AF2122/97
caccgaugcugacgaugc

SEQ ID NO: 1059009 - RNA, 23 nt, Mycobacterium bovis subsp bovis AF2122/97
caccgaugcugacgaugcggucg

SEQ ID NO: 1059010 - RNA, 21 nt, Mycobacterium bovis subsp bovis AF2122/97
caccgagcugagcggccagca

SEQ ID NO: 1059011 - RNA, 19 nt, Mycobacterium bovis subsp bovis AF2122/97
caccgaggucgagcgaccc

SEQ ID NO: 1059012 - RNA, 14 nt, Mycobacterium bovis subsp bovis AF2122/97
caccgaggucggcc

SEQ ID NO: 1059013 - RNA, 21 nt, Mycobacterium bovis subsp bovis AF2122/97
caccgagcgcaaucgaccacg

SEQ ID NO: 1059014 - RNA, 16 nt, Mycobacterium bovis subsp bovis AF2122/97
caccgagccacgaccc

SEQ ID NO: 1059015 - RNA, 20 nt, Mycobacterium bovis subsp bovis AF2122/97
caccgagccacgacccagca

SEQ ID NO: 1059016 - RNA, 12 nt, Mycobacterium bovis subsp bovis AF2122/97
caccgagccgau

SEQ ID NO: 1059017 - RNA, 19 nt, Mycobacterium bovis subsp bovis AF2122/97
caccgaggaccucgucacc

SEQ ID NO: 1059018 - RNA, 18 nt, Mycobacterium bovis subsp bovis AF2122/97
caccgccagauaggcacc

SEQ ID NO: 1059019 - RNA, 19 nt, Mycobacterium bovis subsp bovis AF2122/97
caccgccaccacgccgucg

SEQ ID NO: 1059020 - RNA, 23 nt, Mycobacterium bovis subsp bovis AF2122/97
caccgcaucgggcuugcgcagca

SEQ ID NO: 1059021 - RNA, 19 nt, Mycobacterium bovis subsp bovis AF2122/97
caccgcauaaggcccaugc

SEQ ID NO: 1059022 - RNA, 20 nt, Mycobacterium bovis subsp bovis AF2122/97
caccgcauaacgccaguccc

SEQ ID NO: 1059023 - RNA, 16 nt, Mycobacterium bovis subsp bovis AF2122/97
caccgauggcgcgcuc

SEQ ID NO: 1059024 - RNA, 22 nt, Mycobacterium bovis subsp bovis AF2122/97
caccgauggcgguggugccgcg

SEQ ID NO: 1059025 - RNA, 16 nt, Mycobacterium bovis subsp bovis AF2122/97
caccgauuccagcgga

SEQ ID NO: 1059026 - RNA, 16 nt, Mycobacterium bovis subsp bovis AF2122/97
caccgauucggcgacg

SEQ ID NO: 1059027 - RNA, 18 nt, Mycobacterium bovis subsp bovis AF2122/97
caccgauucggcgacgaa

SEQ ID NO: 1059028 - RNA, 18 nt, Mycobacterium bovis subsp bovis AF2122/97
caccgauucggccagcgc

SEQ ID NO: 1059029 - RNA, 15 nt, Mycobacterium bovis subsp bovis AF2122/97
caccgauucggcgac

SEQ ID NO: 1059030 - RNA, 19 nt, Mycobacterium bovis subsp bovis AF2122/97
caccgcaaaguagacgugc

SEQ ID NO: 1059031 - RNA, 19 nt, Mycobacterium bovis subsp bovis AF2122/97
caccgcaacgcgugcgcau

SEQ ID NO: 1059032 - RNA, 18 nt, Mycobacterium bovis subsp bovis AF2122/97
caccgcaagaaucagcag

SEQ ID NO: 1059033 - RNA, 15 nt, Mycobacterium bovis subsp bovis AF2122/97
caccgcaacgcgugc

SEQ ID NO: 1059034 - RNA, 13 nt, Mycobacterium bovis subsp bovis AF2122/97
caccgcaccggca

SEQ ID NO: 1059035 - RNA, 19 nt, Mycobacterium bovis subsp bovis AF2122/97
caccgauucggcgacgaac

SEQ ID NO: 1059036 - RNA, 19 nt, Mycobacterium bovis subsp bovis AF2122/97
caccgcacaccugcgcggc

SEQ ID NO: 1059037 - RNA, 17 nt, Mycobacterium bovis subsp bovis AF2122/97
caccgcacguucggcgu

SEQ ID NO: 1059038 - RNA, 16 nt, Mycobacterium bovis subsp bovis AF2122/97
caccgcacgcacgcca

SEQ ID NO: 1059039 - RNA, 14 nt, Mycobacterium bovis subsp bovis AF2122/97
caccgcacgcuggc

SEQ ID NO: 1059040 - RNA, 15 nt, Mycobacterium bovis subsp bovis AF2122/97
caccgcacgcuggcg

SEQ ID NO: 1059041 - RNA, 17 nt, Mycobacterium bovis subsp bovis AF2122/97
caccgcacgcuggcggg

SEQ ID NO: 1059042 - RNA, 23 nt, Mycobacterium bovis subsp bovis AF2122/97
caccgcacggaggcggaccaggc

SEQ ID NO: 1059043 - RNA, 22 nt, Mycobacterium bovis subsp bovis AF2122/97
caccgcacggaugucgcccaac

SEQ ID NO: 1059044 - RNA, 14 nt, Mycobacterium bovis subsp bovis AF2122/97
caccgcagacgccg

SEQ ID NO: 1059045 - RNA, 18 nt, Mycobacterium bovis subsp bovis AF2122/97
caccgcagauccccgcca

SEQ ID NO: 1059046 - RNA, 20 nt, Mycobacterium bovis subsp bovis AF2122/97
caccgcagauccccgccacc

SEQ ID NO: 1059047 - RNA, 21 nt, Mycobacterium bovis subsp bovis AF2122/97
caccgcagauccccgccaccg

SEQ ID NO: 1059048 - RNA, 23 nt, Mycobacterium bovis subsp bovis AF2122/97
caccgcagauccccgccaccgaa

SEQ ID NO: 1059049 - RNA, 14 nt, Mycobacterium bovis subsp bovis AF2122/97
caccgcagcgacca

SEQ ID NO: 1059050 - RNA, 12 nt, Mycobacterium bovis subsp bovis AF2122/97
caccccggccgc

SEQ ID NO: 1059051 - RNA, 20 nt, Mycobacterium bovis subsp bovis AF2122/97
caccccggccuugccaccgg

SEQ ID NO: 1059052 - RNA, 18 nt, Mycobacterium bovis subsp bovis AF2122/97
caccccggcucggccacc

SEQ ID NO: 1059053 - RNA, 19 nt, Mycobacterium bovis subsp bovis AF2122/97
caccccggcucggccaccg

SEQ ID NO: 1059054 - RNA, 20 nt, Mycobacterium bovis subsp bovis AF2122/97
caccccggcucggccaccga

SEQ ID NO: 1059055 - RNA, 13 nt, Mycobacterium bovis subsp bovis AF2122/97
caccccggccacu

SEQ ID NO: 1059056 - RNA, 14 nt, Mycobacterium bovis subsp bovis AF2122/97
caccccgcgcgcca

SEQ ID NO: 1059057 - RNA, 14 nt, Mycobacterium bovis subsp bovis AF2122/97
caccccgcccgacg

SEQ ID NO: 1059058 - RNA, 21 nt, Mycobacterium bovis subsp bovis AF2122/97
caccccgcgaaccucacagcu

SEQ ID NO: 1059059 - RNA, 18 nt, Mycobacterium bovis subsp bovis AF2122/97
caccccauacucggcggc

SEQ ID NO: 1059060 - RNA, 12 nt, Mycobacterium bovis subsp bovis AF2122/97
caccccgggcgc

SEQ ID NO: 1059061 - RNA, 19 nt, Mycobacterium bovis subsp bovis AF2122/97
caccccggucccgccgacc

SEQ ID NO: 1059062 - RNA, 22 nt, Mycobacterium bovis subsp bovis AF2122/97
caccccggguacgccgggcacg

SEQ ID NO: 1059063 - RNA, 17 nt, Mycobacterium bovis subsp bovis AF2122/97
caccccguagcggucuc

SEQ ID NO: 1059064 - RNA, 22 nt, Mycobacterium bovis subsp bovis AF2122/97
caccccggucgaggucggcgau

SEQ ID NO: 1059065 - RNA, 16 nt, Mycobacterium bovis subsp bovis AF2122/97
caccccggucggagcg

SEQ ID NO: 1059066 - RNA, 18 nt, Mycobacterium bovis subsp bovis AF2122/97
caccccggucggagcggu

SEQ ID NO: 1059067 - RNA, 15 nt, Mycobacterium bovis subsp bovis AF2122/97
cacccgaaccgggga

SEQ ID NO: 1059068 - RNA, 15 nt, Mycobacterium bovis subsp bovis AF2122/97
cacccgaagccggcg

SEQ ID NO: 1059069 - RNA, 22 nt, Mycobacterium bovis subsp bovis AF2122/97
caccccugagcucccgccggga

SEQ ID NO: 1059070 - RNA, 19 nt, Mycobacterium bovis subsp bovis AF2122/97
caccccggugcccgcggug

SEQ ID NO: 1059071 - RNA, 19 nt, Mycobacterium bovis subsp bovis AF2122/97
caccccacagucgugagcc

SEQ ID NO: 1059072 - RNA, 18 nt, Mycobacterium bovis subsp bovis AF2122/97
caccccagcggccaccga

SEQ ID NO: 1059073 - RNA, 12 nt, Mycobacterium bovis subsp bovis AF2122/97
caccccagcggc

SEQ ID NO: 1059074 - RNA, 15 nt, Mycobacterium bovis subsp bovis AF2122/97
caccccagcggccac

SEQ ID NO: 1059075 - RNA, 14 nt, Mycobacterium bovis subsp bovis AF2122/97
caccccacggccag

SEQ ID NO: 1059076 - RNA, 21 nt, Mycobacterium bovis subsp bovis AF2122/97
cacccaacucaugggccaacu

SEQ ID NO: 1059077 - RNA, 18 nt, Mycobacterium bovis subsp bovis AF2122/97
cacccaucgugcugaagc

SEQ ID NO: 1059078 - RNA, 24 nt, Mycobacterium bovis subsp bovis AF2122/97
cacccauucgucgguaccguccuc

SEQ ID NO: 1059079 - RNA, 17 nt, Mycobacterium bovis subsp bovis AF2122/97
caccauucccggaccca

SEQ ID NO: 1059080 - RNA, 17 nt, Mycobacterium bovis subsp bovis AF2122/97
caccauucgcgggccga

SEQ ID NO: 1059081 - RNA, 20 nt, Mycobacterium bovis subsp bovis AF2122/97
cacccaaaccggcccgcagc

SEQ ID NO: 1059082 - RNA, 23 nt, Mycobacterium bovis subsp bovis AF2122/97
cacccaaaccggcccgcagcagc

SEQ ID NO: 1059083 - RNA, 16 nt, Mycobacterium bovis subsp bovis AF2122/97
cacccaaugccaccgc

SEQ ID NO: 1059084 - RNA, 18 nt, Mycobacterium bovis subsp bovis AF2122/97
cacccaucaacgccggcg

SEQ ID NO: 1059085 - RNA, 18 nt, Mycobacterium bovis subsp bovis AF2122/97
cacccaucaccgccagcc

SEQ ID NO: 1059086 - RNA, 20 nt, Mycobacterium bovis subsp bovis AF2122/97
cacccaacagcccaccggug

SEQ ID NO: 1059087 - RNA, 19 nt, Mycobacterium bovis subsp bovis AF2122/97
cacccaaccccgccggccg

SEQ ID NO: 1059088 - RNA, 19 nt, Mycobacterium bovis subsp bovis AF2122/97
cacccaucaucgccaccac

SEQ ID NO: 1059089 - RNA, 17 nt, Mycobacterium bovis subsp bovis AF2122/97
cacccauccucgcggug

SEQ ID NO: 1059090 - RNA, 21 nt, Mycobacterium bovis subsp bovis AF2122/97
cacccauccucgcggugcgcc

SEQ ID NO: 1059091 - RNA, 15 nt, Mycobacterium bovis subsp bovis AF2122/97
cacccaucgaccgcc

SEQ ID NO: 1059092 - RNA, 16 nt, Mycobacterium bovis subsp bovis AF2122/97
cacccaucgaccgccc

SEQ ID NO: 1059093 - RNA, 22 nt, Mycobacterium bovis subsp bovis AF2122/97
cacccaucgaccgcccgccagc

SEQ ID NO: 1059094 - RNA, 18 nt, Mycobacterium bovis subsp bovis AF2122/97
cacccaucgcacggauga

SEQ ID NO: 1059095 - RNA, 20 nt, Mycobacterium bovis subsp bovis AF2122/97
cacccgcaccucaccggguu

SEQ ID NO: 1059096 - RNA, 15 nt, Mycobacterium bovis subsp bovis AF2122/97
cacccgcaccgcggu

SEQ ID NO: 1059097 - RNA, 18 nt, Mycobacterium bovis subsp bovis AF2122/97
cacccgcaccgcgguacg

SEQ ID NO: 1059098 - RNA, 12 nt, Mycobacterium bovis subsp bovis AF2122/97
cacccgcaccgg

SEQ ID NO: 1059099 - RNA, 17 nt, Mycobacterium bovis subsp bovis AF2122/97
cacccgcaccggugacg

SEQ ID NO: 1059100 - RNA, 18 nt, Mycobacterium bovis subsp bovis AF2122/97
cacccgagcaacggcggc

SEQ ID NO: 1059101 - RNA, 14 nt, Mycobacterium bovis subsp bovis AF2122/97
cacccgagccgcac

SEQ ID NO: 1059102 - RNA, 14 nt, Mycobacterium bovis subsp bovis AF2122/97
cacccgagggccug

SEQ ID NO: 1059103 - RNA, 21 nt, Mycobacterium bovis subsp bovis AF2122/97
cacccgauaguucuggcccgc

SEQ ID NO: 1059104 - RNA, 12 nt, Mycobacterium bovis subsp bovis AF2122/97
cacccgauuggc

SEQ ID NO: 1059105 - RNA, 20 nt, Mycobacterium bovis subsp bovis AF2122/97
cacccgcaaugcgcgcgaug

SEQ ID NO: 1059106 - RNA, 18 nt, Mycobacterium bovis subsp bovis AF2122/97
cacccgauuggccaaccc

SEQ ID NO: 1059107 - RNA, 14 nt, Mycobacterium bovis subsp bovis AF2122/97
cacccgcaccaccg

SEQ ID NO: 1059108 - RNA, 20 nt, Mycobacterium bovis subsp bovis AF2122/97
cacccgcaccaccggcccca

SEQ ID NO: 1059109 - RNA, 14 nt, Mycobacterium bovis subsp bovis AF2122/97
cacccggcgggcgg

SEQ ID NO: 1059110 - RNA, 21 nt, Mycobacterium bovis subsp bovis AF2122/97
cacccggcuguucucgccgaa

SEQ ID NO: 1059111 - RNA, 18 nt, Mycobacterium bovis subsp bovis AF2122/97
cacccgggacgaaccggc

SEQ ID NO: 1059112 - RNA, 20 nt, Mycobacterium bovis subsp bovis AF2122/97
cacccgggacgaaccggccg

SEQ ID NO: 1059113 - RNA, 21 nt, Mycobacterium bovis subsp bovis AF2122/97
cacccgggacgaaccggccga

SEQ ID NO: 1059114 - RNA, 23 nt, Mycobacterium bovis subsp bovis AF2122/97
cacccgggacgaaccggccgacg

SEQ ID NO: 1059115 - RNA, 20 nt, Mycobacterium bovis subsp bovis AF2122/97
cacccggccucaacacccgg

SEQ ID NO: 1059116 - RNA, 21 nt, Mycobacterium bovis subsp bovis AF2122/97
cacccggccucaacacccggc

SEQ ID NO: 1059117 - RNA, 23 nt, Mycobacterium bovis subsp bovis AF2122/97
cacccggccucaacacccggccg

SEQ ID NO: 1059118 - RNA, 20 nt, Mycobacterium bovis subsp bovis AF2122/97
cacccggcgauuggaccgcc

SEQ ID NO: 1059119 - RNA, 23 nt, Mycobacterium bovis subsp bovis AF2122/97
cacccggccguugggccaccggc

SEQ ID NO: 1059120 - RNA, 20 nt, Mycobacterium bovis subsp bovis AF2122/97
cacccgcaggucgaucugcg

SEQ ID NO: 1059121 - RNA, 18 nt, Mycobacterium bovis subsp bovis AF2122/97
cacccgcaggucgcacca

SEQ ID NO: 1059122 - RNA, 20 nt, Mycobacterium bovis subsp bovis AF2122/97
cacccgcaggucgcuggccg

SEQ ID NO: 1059123 - RNA, 17 nt, Mycobacterium bovis subsp bovis AF2122/97
cacccggccaccggacg

SEQ ID NO: 1059124 - RNA, 18 nt, Mycobacterium bovis subsp bovis AF2122/97
cacccggccaccggacga

SEQ ID NO: 1059125 - RNA, 13 nt, Mycobacterium bovis subsp bovis AF2122/97
cacccggccgacc

SEQ ID NO: 1059126 - RNA, 12 nt, Mycobacterium bovis subsp bovis AF2122/97
cacccggccgcc

SEQ ID NO: 1059127 - RNA, 15 nt, Mycobacterium bovis subsp bovis AF2122/97
cacccggccgccgaa

SEQ ID NO: 1059128 - RNA, 13 nt, Mycobacterium bovis subsp bovis AF2122/97
caccaugucggug

SEQ ID NO: 1059129 - RNA, 18 nt, Mycobacterium bovis subsp bovis AF2122/97
caccaugucggccacccg

SEQ ID NO: 1059130 - RNA, 17 nt, Mycobacterium bovis subsp bovis AF2122/97
caccauguacaggcugu

SEQ ID NO: 1059131 - RNA, 21 nt, Mycobacterium bovis subsp bovis AF2122/97
caccaugggucuggcaggcca

SEQ ID NO: 1059132 - RNA, 13 nt, Mycobacterium bovis subsp bovis AF2122/97
caccauggcgccg

SEQ ID NO: 1059133 - RNA, 17 nt, Mycobacterium bovis subsp bovis AF2122/97
caccauggcgccgcgcc

SEQ ID NO: 1059134 - RNA, 13 nt, Mycobacterium bovis subsp bovis AF2122/97
caccaugaucagc

SEQ ID NO: 1059135 - RNA, 14 nt, Mycobacterium bovis subsp bovis AF2122/97
caccaugaucaggc

SEQ ID NO: 1059136 - RNA, 18 nt, Mycobacterium bovis subsp bovis AF2122/97
caccaucuccgccgucgc

SEQ ID NO: 1059137 - RNA, 21 nt, Mycobacterium bovis subsp bovis AF2122/97
caccaucuccgccgucgccac

SEQ ID NO: 1059138 - RNA, 17 nt, Mycobacterium bovis subsp bovis AF2122/97
caccaucuccgccgucg

SEQ ID NO: 1059139 - RNA, 21 nt, Mycobacterium bovis subsp bovis AF2122/97
caccaucgccucggcgcugcg

SEQ ID NO: 1059140 - RNA, 14 nt, Mycobacterium bovis subsp bovis AF2122/97
caccaucgccgccg

SEQ ID NO: 1059141 - RNA, 16 nt, Mycobacterium bovis subsp bovis AF2122/97
caccaucgccgccgcg

SEQ ID NO: 1059142 - RNA, 19 nt, Mycobacterium bovis subsp bovis AF2122/97
caccaucgccgccgcgcgu

SEQ ID NO: 1059143 - RNA, 16 nt, Mycobacterium bovis subsp bovis AF2122/97
caccaucgcggccgcu

SEQ ID NO: 1059144 - RNA, 22 nt, Mycobacterium bovis subsp bovis AF2122/97
caccaucgccgccguugccgcc

SEQ ID NO: 1059145 - RNA, 23 nt, Mycobacterium bovis subsp bovis AF2122/97
caccaucgccgccguugccgccg

SEQ ID NO: 1059146 - RNA, 14 nt, Mycobacterium bovis subsp bovis AF2122/97
caccaucaccgccu

SEQ ID NO: 1059147 - RNA, 18 nt, Mycobacterium bovis subsp bovis AF2122/97
caccaucaccgccuuugc

SEQ ID NO: 1059148 - RNA, 14 nt, Mycobacterium bovis subsp bovis AF2122/97
caccaucaccggug

SEQ ID NO: 1059149 - RNA, 15 nt, Mycobacterium bovis subsp bovis AF2122/97
caccaucacgguggc

SEQ ID NO: 1059150 - RNA, 14 nt, Mycobacterium bovis subsp bovis AF2122/97
caccauccagccca

SEQ ID NO: 1059151 - RNA, 13 nt, Mycobacterium bovis subsp bovis AF2122/97
caccaguggcgcg

SEQ ID NO: 1059152 - RNA, 19 nt, Mycobacterium bovis subsp bovis AF2122/97
caccaguggcgcgugcagc

SEQ ID NO: 1059153 - RNA, 21 nt, Mycobacterium bovis subsp bovis AF2122/97
caccaguuugugccgccgcgg

SEQ ID NO: 1059154 - RNA, 23 nt, Mycobacterium bovis subsp bovis AF2122/97
caccaguuugugccgccgcggca

SEQ ID NO: 1059155 - RNA, 17 nt, Mycobacterium bovis subsp bovis AF2122/97
caccauacucaccgacg

SEQ ID NO: 1059156 - RNA, 16 nt, Mycobacterium bovis subsp bovis AF2122/97
caccauaggccgacgg

SEQ ID NO: 1059157 - RNA, 19 nt, Mycobacterium bovis subsp bovis AF2122/97
caccaggucuucgaccacg

SEQ ID NO: 1059158 - RNA, 22 nt, Mycobacterium bovis subsp bovis AF2122/97
caccaggucuucgaccacgguc

SEQ ID NO: 1059159 - RNA, 16 nt, Mycobacterium bovis subsp bovis AF2122/97
caccagggccaccgcg

SEQ ID NO: 1059160 - RNA, 18 nt, Mycobacterium bovis subsp bovis AF2122/97
caccagggccaccgcgcc

SEQ ID NO: 1059161 - RNA, 23 nt, Mycobacterium bovis subsp bovis AF2122/97
caccagggccuccacccgccacg

SEQ ID NO: 1059162 - RNA, 23 nt, Mycobacterium bovis subsp bovis AF2122/97
caccagguugcaaccuugggcgc

SEQ ID NO: 1059163 - RNA, 16 nt, Mycobacterium bovis subsp bovis AF2122/97
caccaguaccaccggc

SEQ ID NO: 1059164 - RNA, 18 nt, Mycobacterium bovis subsp bovis AF2122/97
caccaguaccaccggcac

SEQ ID NO: 1059165 - RNA, 17 nt, Mycobacterium bovis subsp bovis AF2122/97
caccaguccagcgggca

SEQ ID NO: 1059166 - RNA, 14 nt, Mycobacterium bovis subsp bovis AF2122/97
caccagucgcccca

SEQ ID NO: 1059167 - RNA, 20 nt, Mycobacterium bovis subsp bovis AF2122/97
caccagucgccccaagcgcc

SEQ ID NO: 1059168 - RNA, 20 nt, Mycobacterium bovis subsp bovis AF2122/97
caccacuagcggcucaccgc

SEQ ID NO: 1059169 - RNA, 23 nt, Mycobacterium bovis subsp bovis AF2122/97
caccacuagcggcucaccgcgca

SEQ ID NO: 1059170 - RNA, 20 nt, Mycobacterium bovis subsp bovis AF2122/97
caccacuaggucgccggcca

SEQ ID NO: 1059171 - RNA, 22 nt, Mycobacterium bovis subsp bovis AF2122/97
caccacuaggucgccggccacg

SEQ ID NO: 1059172 - RNA, 23 nt, Mycobacterium bovis subsp bovis AF2122/97
caccacuccggcguugacgauca

SEQ ID NO: 1059173 - RNA, 16 nt, Mycobacterium bovis subsp bovis AF2122/97
caccacguggcccucc

SEQ ID NO: 1059174 - RNA, 18 nt, Mycobacterium bovis subsp bovis AF2122/97
caccacgucgacgauguc

SEQ ID NO: 1059175 - RNA, 20 nt, Mycobacterium bovis subsp bovis AF2122/97
caccacgguuggccaccagc

SEQ ID NO: 1059176 - RNA, 13 nt, Mycobacterium bovis subsp bovis AF2122/97
caccaggcggccg

SEQ ID NO: 1059177 - RNA, 23 nt, Mycobacterium bovis subsp bovis AF2122/97
caccaggcggccguaacggcgaa

SEQ ID NO: 1059178 - RNA, 18 nt, Mycobacterium bovis subsp bovis AF2122/97
caccacuucggcgccgcg

SEQ ID NO: 1059179 - RNA, 22 nt, Mycobacterium bovis subsp bovis AF2122/97
caccacuucggcgccgcgccgu

SEQ ID NO: 1059180 - RNA, 21 nt, Mycobacterium bovis subsp bovis AF2122/97
caccaggcgagccggcgcgca

SEQ ID NO: 1059181 - RNA, 16 nt, Mycobacterium bovis subsp bovis AF2122/97
cacagcugacgagccg

SEQ ID NO: 1059182 - RNA, 20 nt, Mycobacterium bovis subsp bovis AF2122/97
cacagcguccgucgucggcg

SEQ ID NO: 1059183 - RNA, 15 nt, Mycobacterium bovis subsp bovis AF2122/97
cacagcuugagcaca

SEQ ID NO: 1059184 - RNA, 16 nt, Mycobacterium bovis subsp bovis AF2122/97
cacagcuugcccgagc

SEQ ID NO: 1059185 - RNA, 22 nt, Mycobacterium bovis subsp bovis AF2122/97
cacaggaagcguugucgcccac

SEQ ID NO: 1059186 - RNA, 17 nt, Mycobacterium bovis subsp bovis AF2122/97
cacagcuuggacguggu

SEQ ID NO: 1059187 - RNA, 15 nt, Mycobacterium bovis subsp bovis AF2122/97
cacagcugcgcacgu

SEQ ID NO: 1059188 - RNA, 22 nt, Mycobacterium bovis subsp bovis AF2122/97
cacagguagaccgucuccaucg

SEQ ID NO: 1059189 - RNA, 20 nt, Mycobacterium bovis subsp bovis AF2122/97
cacagugccaauuccagccc

SEQ ID NO: 1059190 - RNA, 15 nt, Mycobacterium bovis subsp bovis AF2122/97
cacagucgccggccg

SEQ ID NO: 1059191 - RNA, 14 nt, Mycobacterium bovis subsp bovis AF2122/97
cacagucgcucgcu

SEQ ID NO: 1059192 - RNA, 15 nt, Mycobacterium bovis subsp bovis AF2122/97
cacagguccugcgcc

SEQ ID NO: 1059193 - RNA, 20 nt, Mycobacterium bovis subsp bovis AF2122/97
cacagguccugcgccgcacg

SEQ ID NO: 1059194 - RNA, 21 nt, Mycobacterium bovis subsp bovis AF2122/97
cacaggugccaaacgccgccc

SEQ ID NO: 1059195 - RNA, 22 nt, Mycobacterium bovis subsp bovis AF2122/97
cacaggugccaaacgccgcccg

SEQ ID NO: 1059196 - RNA, 14 nt, Mycobacterium bovis subsp bovis AF2122/97
cacaggcggccagc

SEQ ID NO: 1059197 - RNA, 18 nt, Mycobacterium bovis subsp bovis AF2122/97
cacaggggcagcgcggcc

SEQ ID NO: 1059198 - RNA, 13 nt, Mycobacterium bovis subsp bovis AF2122/97
cacaggggccagc

SEQ ID NO: 1059199 - RNA, 16 nt, Mycobacterium bovis subsp bovis AF2122/97
cacaggcugaagacga

SEQ ID NO: 1059200 - RNA, 17 nt, Mycobacterium bovis subsp bovis AF2122/97
cacaggcguccaucgcc

SEQ ID NO: 1059201 - RNA, 16 nt, Mycobacterium bovis subsp bovis AF2122/97
cacaggcgcgaucgcu

SEQ ID NO: 1059202 - RNA, 15 nt, Mycobacterium bovis subsp bovis AF2122/97
cacaucggugccacg

SEQ ID NO: 1059203 - RNA, 22 nt, Mycobacterium bovis subsp bovis AF2122/97
cacaucgguguggcccaacacc

SEQ ID NO: 1059204 - RNA, 19 nt, Mycobacterium bovis subsp bovis AF2122/97
cacaucguucaugaucggc

SEQ ID NO: 1059205 - RNA, 21 nt, Mycobacterium bovis subsp bovis AF2122/97
cacaucguucaugaucggcag

SEQ ID NO: 1059206 - RNA, 12 nt, Mycobacterium bovis subsp bovis AF2122/97
cacaugacgauc

SEQ ID NO: 1059207 - RNA, 13 nt, Mycobacterium bovis subsp bovis AF2122/97
cacaucggccucu

SEQ ID NO: 1059208 - RNA, 19 nt, Mycobacterium bovis subsp bovis AF2122/97
cacaucggcucugauggug

SEQ ID NO: 1059209 - RNA, 20 nt, Mycobacterium bovis subsp bovis AF2122/97
cacaucgcgggcgugccgac

SEQ ID NO: 1059210 - RNA, 23 nt, Mycobacterium bovis subsp bovis AF2122/97
cacauccaguaaccguccgcgga

SEQ ID NO: 1059211 - RNA, 14 nt, Mycobacterium bovis subsp bovis AF2122/97
cacauccuggcggc

SEQ ID NO: 1059212 - RNA, 18 nt, Mycobacterium bovis subsp bovis AF2122/97
cacaucagccgcaccagu

SEQ ID NO: 1059213 - RNA, 20 nt, Mycobacterium bovis subsp bovis AF2122/97
cacaucaaaacggcgguggg

SEQ ID NO: 1059214 - RNA, 14 nt, Mycobacterium bovis subsp bovis AF2122/97
cacaucaggucggc

SEQ ID NO: 1059215 - RNA, 13 nt, Mycobacterium bovis subsp bovis AF2122/97
cacauccacgcac

SEQ ID NO: 1059216 - RNA, 22 nt, Mycobacterium bovis subsp bovis AF2122/97
cacauccacuucacgugcgacg

SEQ ID NO: 1059217 - RNA, 14 nt, Mycobacterium bovis subsp bovis AF2122/97
cacauaccaccacg

SEQ ID NO: 1059218 - RNA, 14 nt, Mycobacterium bovis subsp bovis AF2122/97
cacauaccggcgca

SEQ ID NO: 1059219 - RNA, 16 nt, Mycobacterium bovis subsp bovis AF2122/97
caccacgagcagccga

SEQ ID NO: 1059220 - RNA, 15 nt, Mycobacterium bovis subsp bovis AF2122/97
caccacgagcagccg

SEQ ID NO: 1059221 - RNA, 13 nt, Mycobacterium bovis subsp bovis AF2122/97
caccaccgcggcg

SEQ ID NO: 1059222 - RNA, 15 nt, Mycobacterium bovis subsp bovis AF2122/97
caccaccgcucgucg

SEQ ID NO: 1059223 - RNA, 16 nt, Mycobacterium bovis subsp bovis AF2122/97
caccaccgcugccggc

SEQ ID NO: 1059224 - RNA, 21 nt, Mycobacterium bovis subsp bovis AF2122/97
caccacgaacucggccgggcg

SEQ ID NO: 1059225 - RNA, 23 nt, Mycobacterium bovis subsp bovis AF2122/97
caccacgaacucggccgggcggu

SEQ ID NO: 1059226 - RNA, 14 nt, Mycobacterium bovis subsp bovis AF2122/97
caccaccgcucguc

SEQ ID NO: 1059227 - RNA, 15 nt, Mycobacterium bovis subsp bovis AF2122/97
caccaccgcggcggc

SEQ ID NO: 1059228 - RNA, 19 nt, Mycobacterium bovis subsp bovis AF2122/97
caccaccgcggcggcggcc

SEQ ID NO: 1059229 - RNA, 20 nt, Mycobacterium bovis subsp bovis AF2122/97
caccaccgcggcggcggcca

SEQ ID NO: 1059230 - RNA, 13 nt, Mycobacterium bovis subsp bovis AF2122/97
caccacgaucgca

SEQ ID NO: 1059231 - RNA, 19 nt, Mycobacterium bovis subsp bovis AF2122/97
caccacgauggcggccacc

SEQ ID NO: 1059232 - RNA, 22 nt, Mycobacterium bovis subsp bovis AF2122/97
caccacgauggcggccaccguc

SEQ ID NO: 1059233 - RNA, 17 nt, Mycobacterium bovis subsp bovis AF2122/97
caccacgcccgacgagg

SEQ ID NO: 1059234 - RNA, 20 nt, Mycobacterium bovis subsp bovis AF2122/97
caccacgccagcccguccgg

SEQ ID NO: 1059235 - RNA, 12 nt, Mycobacterium bovis subsp bovis AF2122/97
caccacgcgacg

SEQ ID NO: 1059236 - RNA, 16 nt, Mycobacterium bovis subsp bovis AF2122/97
caccacgcggcggucg

SEQ ID NO: 1059237 - RNA, 20 nt, Mycobacterium bovis subsp bovis AF2122/97
caccacgcggcggucguugc

SEQ ID NO: 1059238 - RNA, 17 nt, Mycobacterium bovis subsp bovis AF2122/97
caccaccgcgccgucgu

SEQ ID NO: 1059239 - RNA, 15 nt, Mycobacterium bovis subsp bovis AF2122/97
caccacaccggagcc

SEQ ID NO: 1059240 - RNA, 19 nt, Mycobacterium bovis subsp bovis AF2122/97
caccaccgccggugccgcc

SEQ ID NO: 1059241 - RNA, 15 nt, Mycobacterium bovis subsp bovis AF2122/97
caccaccgccggugc

SEQ ID NO: 1059242 - RNA, 14 nt, Mycobacterium bovis subsp bovis AF2122/97
caccaccgccgccg

SEQ ID NO: 1059243 - RNA, 11 nt, Mycobacterium bovis subsp bovis AF2122/97
caccaccgccg

SEQ ID NO: 1059244 - RNA, 14 nt, Mycobacterium bovis subsp bovis AF2122/97
caccaccgccgacc

SEQ ID NO: 1059245 - RNA, 19 nt, Mycobacterium bovis subsp bovis AF2122/97
caccaccgccccgcgccca

SEQ ID NO: 1059246 - RNA, 12 nt, Mycobacterium bovis subsp bovis AF2122/97
caccaccgccag

SEQ ID NO: 1059247 - RNA, 15 nt, Mycobacterium bovis subsp bovis AF2122/97
caccaccgcacaucg

SEQ ID NO: 1059248 - RNA, 13 nt, Mycobacterium bovis subsp bovis AF2122/97
caccaccgcccgc

SEQ ID NO: 1059249 - RNA, 15 nt, Mycobacterium bovis subsp bovis AF2122/97
caccacacagccgcg

SEQ ID NO: 1059250 - RNA, 15 nt, Mycobacterium bovis subsp bovis AF2122/97
caccacaauccacgc

SEQ ID NO: 1059251 - RNA, 14 nt, Mycobacterium bovis subsp bovis AF2122/97
caccacacagccgc

SEQ ID NO: 1059252 - RNA, 13 nt, Mycobacterium bovis subsp bovis AF2122/97
caccaacucgacg

SEQ ID NO: 1059253 - RNA, 18 nt, Mycobacterium bovis subsp bovis AF2122/97
caccaacucggcgaccug

SEQ ID NO: 1059254 - RNA, 21 nt, Mycobacterium bovis subsp bovis AF2122/97
caccaacugaauggcaccgag

SEQ ID NO: 1059255 - RNA, 15 nt, Mycobacterium bovis subsp bovis AF2122/97
caccaagacaccggc

SEQ ID NO: 1059256 - RNA, 16 nt, Mycobacterium bovis subsp bovis AF2122/97
caccaagcagcgacca

SEQ ID NO: 1059257 - RNA, 15 nt, Mycobacterium bovis subsp bovis AF2122/97
caccaaggucggcga

SEQ ID NO: 1059258 - RNA, 17 nt, Mycobacterium bovis subsp bovis AF2122/97
caccaagcucggccagc

SEQ ID NO: 1059259 - RNA, 18 nt, Mycobacterium bovis subsp bovis AF2122/97
caccaagcucggccagca

SEQ ID NO: 1059260 - RNA, 17 nt, Mycobacterium bovis subsp bovis AF2122/97
caccaaggccgugaugc

SEQ ID NO: 1059261 - RNA, 21 nt, Mycobacterium bovis subsp bovis AF2122/97
caccaaggccgugaugccacg

SEQ ID NO: 1059262 - RNA, 18 nt, Mycobacterium bovis subsp bovis AF2122/97
caccaaucugcgggccgg

SEQ ID NO: 1059263 - RNA, 20 nt, Mycobacterium bovis subsp bovis AF2122/97
caccaaucugcgggccggug

SEQ ID NO: 1059264 - RNA, 19 nt, Mycobacterium bovis subsp bovis AF2122/97
caccaaucggguccacguc

SEQ ID NO: 1059265 - RNA, 13 nt, Mycobacterium bovis subsp bovis AF2122/97
caccaauaccgca

SEQ ID NO: 1059266 - RNA, 20 nt, Mycobacterium bovis subsp bovis AF2122/97
caccaauaccgcacccgcuc

SEQ ID NO: 1059267 - RNA, 22 nt, Mycobacterium bovis subsp bovis AF2122/97
caccaaccucaucgcggucgcc

SEQ ID NO: 1059268 - RNA, 14 nt, Mycobacterium bovis subsp bovis AF2122/97
caccaaccugagca

SEQ ID NO: 1059269 - RNA, 13 nt, Mycobacterium bovis subsp bovis AF2122/97
caccaacgacagc

SEQ ID NO: 1059270 - RNA, 15 nt, Mycobacterium bovis subsp bovis AF2122/97
caccaacgacagcga

SEQ ID NO: 1059271 - RNA, 15 nt, Mycobacterium bovis subsp bovis AF2122/97
caccaacaccgcggc

SEQ ID NO: 1059272 - RNA, 13 nt, Mycobacterium bovis subsp bovis AF2122/97
caccaacaccggu

SEQ ID NO: 1059273 - RNA, 14 nt, Mycobacterium bovis subsp bovis AF2122/97
caccaaccaccgac

SEQ ID NO: 1059274 - RNA, 22 nt, Mycobacterium bovis subsp bovis AF2122/97
caccaacccaccccccagcgcc

SEQ ID NO: 1059275 - RNA, 16 nt, Mycobacterium bovis subsp bovis AF2122/97
caccaacgccaccguc

SEQ ID NO: 1059276 - RNA, 16 nt, Mycobacterium bovis subsp bovis AF2122/97
cacaugcucggccugc

SEQ ID NO: 1059277 - RNA, 16 nt, Mycobacterium bovis subsp bovis AF2122/97
cacaugcgcguccagc

SEQ ID NO: 1059278 - RNA, 15 nt, Mycobacterium bovis subsp bovis AF2122/97
cacaugugcgcgucg

SEQ ID NO: 1059279 - RNA, 20 nt, Mycobacterium bovis subsp bovis AF2122/97
cacauugaucgacggccagc

SEQ ID NO: 1059280 - RNA, 20 nt, Mycobacterium bovis subsp bovis AF2122/97
cacauuucuuugggcggccc

SEQ ID NO: 1059281 - RNA, 15 nt, Mycobacterium bovis subsp bovis AF2122/97
cacagccgcuuggcg

SEQ ID NO: 1059282 - RNA, 14 nt, Mycobacterium bovis subsp bovis AF2122/97
cacagcccggcggc

SEQ ID NO: 1059283 - RNA, 12 nt, Mycobacterium bovis subsp bovis AF2122/97
cacagccgcgcc

SEQ ID NO: 1059284 - RNA, 16 nt, Mycobacterium bovis subsp bovis AF2122/97
cacagccgcgccgacc

SEQ ID NO: 1059285 - RNA, 17 nt, Mycobacterium bovis subsp bovis AF2122/97
cacagccgcgcugcgac

SEQ ID NO: 1059286 - RNA, 13 nt, Mycobacterium bovis subsp bovis AF2122/97
cacagcccggcga

SEQ ID NO: 1059287 - RNA, 15 nt, Mycobacterium bovis subsp bovis AF2122/97
cacagcccggcgacg

SEQ ID NO: 1059288 - RNA, 15 nt, Mycobacterium bovis subsp bovis AF2122/97
cacagcccgaugccg

SEQ ID NO: 1059289 - RNA, 15 nt, Mycobacterium bovis subsp bovis AF2122/97
cacagccaccagccg

SEQ ID NO: 1059290 - RNA, 13 nt, Mycobacterium bovis subsp bovis AF2122/97
cacagcgacgaga

SEQ ID NO: 1059291 - RNA, 20 nt, Mycobacterium bovis subsp bovis AF2122/97
cacagccgucgcaccagauc

SEQ ID NO: 1059292 - RNA, 17 nt, Mycobacterium bovis subsp bovis AF2122/97
cacagcgcaaaaucacc

SEQ ID NO: 1059293 - RNA, 18 nt, Mycobacterium bovis subsp bovis AF2122/97
cacagcgcguagcgggcg

SEQ ID NO: 1059294 - RNA, 13 nt, Mycobacterium bovis subsp bovis AF2122/97
cacagcggagacg

SEQ ID NO: 1059295 - RNA, 17 nt, Mycobacterium bovis subsp bovis AF2122/97
cacagcggagacgaucg

SEQ ID NO: 1059296 - RNA, 12 nt, Mycobacterium bovis subsp bovis AF2122/97
cacagcggccau

SEQ ID NO: 1059297 - RNA, 15 nt, Mycobacterium bovis subsp bovis AF2122/97
cacagcauaaagauc

SEQ ID NO: 1059298 - RNA, 16 nt, Mycobacterium bovis subsp bovis AF2122/97
cacagcauuguccggc

SEQ ID NO: 1059299 - RNA, 12 nt, Mycobacterium bovis subsp bovis AF2122/97
cacacgaugacg

SEQ ID NO: 1059300 - RNA, 16 nt, Mycobacterium bovis subsp bovis AF2122/97
cacacgaucgcgguga

SEQ ID NO: 1059301 - RNA, 18 nt, Mycobacterium bovis subsp bovis AF2122/97
cacacgaucgcggugaug

SEQ ID NO: 1059302 - RNA, 20 nt, Mycobacterium bovis subsp bovis AF2122/97
cacacuuugguugcccgcau

SEQ ID NO: 1059303 - RNA, 15 nt, Mycobacterium bovis subsp bovis AF2122/97
cacacgccgccggug

SEQ ID NO: 1059304 - RNA, 16 nt, Mycobacterium bovis subsp bovis AF2122/97
cacacgccgccggugu

SEQ ID NO: 1059305 - RNA, 18 nt, Mycobacterium bovis subsp bovis AF2122/97
cacacgccuaccgcgacg

SEQ ID NO: 1059306 - RNA, 22 nt, Mycobacterium bovis subsp bovis AF2122/97
cacacgaugacguugacgucgg

SEQ ID NO: 1059307 - RNA, 18 nt, Mycobacterium bovis subsp bovis AF2122/97
cacacgcccucgacgccg

SEQ ID NO: 1059308 - RNA, 19 nt, Mycobacterium bovis subsp bovis AF2122/97
cacagaccgaacagcaccg

SEQ ID NO: 1059309 - RNA, 20 nt, Mycobacterium bovis subsp bovis AF2122/97
cacagaccgaacagcaccga

SEQ ID NO: 1059310 - RNA, 17 nt, Mycobacterium bovis subsp bovis AF2122/97
cacagacugcgcggcac

SEQ ID NO: 1059311 - RNA, 15 nt, Mycobacterium bovis subsp bovis AF2122/97
cacagaacucaccga

SEQ ID NO: 1059312 - RNA, 17 nt, Mycobacterium bovis subsp bovis AF2122/97
cacagaacucaccgacg

SEQ ID NO: 1059313 - RNA, 19 nt, Mycobacterium bovis subsp bovis AF2122/97
cacaccagcgggcaucgcg

SEQ ID NO: 1059314 - RNA, 23 nt, Mycobacterium bovis subsp bovis AF2122/97
cacacccagcgugcccgccaccg

SEQ ID NO: 1059315 - RNA, 21 nt, Mycobacterium bovis subsp bovis AF2122/97
cacaccgggaugggagccacu

SEQ ID NO: 1059316 - RNA, 12 nt, Mycobacterium bovis subsp bovis AF2122/97
cacaccgggcgg

SEQ ID NO: 1059317 - RNA, 13 nt, Mycobacterium bovis subsp bovis AF2122/97
cacaccgggcggg

SEQ ID NO: 1059318 - RNA, 23 nt, Mycobacterium bovis subsp bovis AF2122/97
cacaccgguggacccggcggugc

SEQ ID NO: 1059319 - RNA, 19 nt, Mycobacterium bovis subsp bovis AF2122/97
cacaccaugguuggcgacu

SEQ ID NO: 1059320 - RNA, 13 nt, Mycobacterium bovis subsp bovis AF2122/97
cacaccaccgccg

SEQ ID NO: 1059321 - RNA, 19 nt, Mycobacterium bovis subsp bovis AF2122/97
cacaacaucgccgcagugc

SEQ ID NO: 1059322 - RNA, 16 nt, Mycobacterium bovis subsp bovis AF2122/97
cacaccuaccguacgc

SEQ ID NO: 1059323 - RNA, 12 nt, Mycobacterium bovis subsp bovis AF2122/97
cacaccgucgca

SEQ ID NO: 1059324 - RNA, 13 nt, Mycobacterium bovis subsp bovis AF2122/97
cacaccguaccga

SEQ ID NO: 1059325 - RNA, 15 nt, Mycobacterium bovis subsp bovis AF2122/97
cacacccagaugcag

SEQ ID NO: 1059326 - RNA, 15 nt, Mycobacterium bovis subsp bovis AF2122/97
cacaccuuggccgcc

SEQ ID NO: 1059327 - RNA, 21 nt, Mycobacterium bovis subsp bovis AF2122/97
cacaccuuggccgccggccgc

SEQ ID NO: 1059328 - RNA, 14 nt, Mycobacterium bovis subsp bovis AF2122/97
cacacagucacgga

SEQ ID NO: 1059329 - RNA, 22 nt, Mycobacterium bovis subsp bovis AF2122/97
cacacagguccugcgccgcacg

SEQ ID NO: 1059330 - RNA, 23 nt, Mycobacterium bovis subsp bovis AF2122/97
cacacagguccugcgccgcacgc

SEQ ID NO: 1059331 - RNA, 17 nt, Mycobacterium bovis subsp bovis AF2122/97
cacacauagcgauucgc

SEQ ID NO: 1059332 - RNA, 17 nt, Mycobacterium bovis subsp bovis AF2122/97
cacacaggcggcgaacu

SEQ ID NO: 1059333 - RNA, 14 nt, Mycobacterium bovis subsp bovis AF2122/97
cacaaaggcgccgg

SEQ ID NO: 1059334 - RNA, 18 nt, Mycobacterium bovis subsp bovis AF2122/97
caaugcgcuggcgccgcc

SEQ ID NO: 1059335 - RNA, 19 nt, Mycobacterium bovis subsp bovis AF2122/97
caaugcgcuggcgccgccg

SEQ ID NO: 1059336 - RNA, 19 nt, Mycobacterium bovis subsp bovis AF2122/97
caaugcgguaccaaccugc

SEQ ID NO: 1059337 - RNA, 15 nt, Mycobacterium bovis subsp bovis AF2122/97
caaugaccuggccgc

SEQ ID NO: 1059338 - RNA, 19 nt, Mycobacterium bovis subsp bovis AF2122/97
caaugaccuggccgcccgc

SEQ ID NO: 1059339 - RNA, 15 nt, Mycobacterium bovis subsp bovis AF2122/97
caaugacgucgucgg

SEQ ID NO: 1059340 - RNA, 19 nt, Mycobacterium bovis subsp bovis AF2122/97
caaugacgucgucggccaa

SEQ ID NO: 1059341 - RNA, 22 nt, Mycobacterium bovis subsp bovis AF2122/97
caaugacuggaccgcggugacc

SEQ ID NO: 1059342 - RNA, 16 nt, Mycobacterium bovis subsp bovis AF2122/97
caaggucuucaggccg

SEQ ID NO: 1059343 - RNA, 13 nt, Mycobacterium bovis subsp bovis AF2122/97
caagguggccacc

SEQ ID NO: 1059344 - RNA, 20 nt, Mycobacterium bovis subsp bovis AF2122/97
caaggugagcagcaagaccg

SEQ ID NO: 1059345 - RNA, 23 nt, Mycobacterium bovis subsp bovis AF2122/97
caaggugagcagcaagaccgcgc

SEQ ID NO: 1059346 - RNA, 14 nt, Mycobacterium bovis subsp bovis AF2122/97
caagguguccagca

SEQ ID NO: 1059347 - RNA, 18 nt, Mycobacterium bovis subsp bovis AF2122/97
caagguggccaccaaacg

SEQ ID NO: 1059348 - RNA, 15 nt, Mycobacterium bovis subsp bovis AF2122/97
caagguggcggccag

SEQ ID NO: 1059349 - RNA, 23 nt, Mycobacterium bovis subsp bovis AF2122/97
caagguggcggccaguucggcgg

SEQ ID NO: 1059350 - RNA, 15 nt, Mycobacterium bovis subsp bovis AF2122/97
caagguguggugaca

SEQ ID NO: 1059351 - RNA, 14 nt, Mycobacterium bovis subsp bovis AF2122/97
caaggccgaccugu

SEQ ID NO: 1059352 - RNA, 13 nt, Mycobacterium bovis subsp bovis AF2122/97
caaggccaccggc

SEQ ID NO: 1059353 - RNA, 14 nt, Mycobacterium bovis subsp bovis AF2122/97
caagggcggcaacg

SEQ ID NO: 1059354 - RNA, 13 nt, Mycobacterium bovis subsp bovis AF2122/97
caaggggcgucgc

SEQ ID NO: 1059355 - RNA, 14 nt, Mycobacterium bovis subsp bovis AF2122/97
caagggugcccgga

SEQ ID NO: 1059356 - RNA, 16 nt, Mycobacterium bovis subsp bovis AF2122/97
caaggguggggccggc

SEQ ID NO: 1059357 - RNA, 15 nt, Mycobacterium bovis subsp bovis AF2122/97
caaggguggugacgc

SEQ ID NO: 1059358 - RNA, 17 nt, Mycobacterium bovis subsp bovis AF2122/97
caaggucgacggaaucg

SEQ ID NO: 1059359 - RNA, 15 nt, Mycobacterium bovis subsp bovis AF2122/97
caauggacaccaacc

SEQ ID NO: 1059360 - RNA, 19 nt, Mycobacterium bovis subsp bovis AF2122/97
caaugcuccuaucugccgg

SEQ ID NO: 1059361 - RNA, 18 nt, Mycobacterium bovis subsp bovis AF2122/97
caaugcguugacgucgag

SEQ ID NO: 1059362 - RNA, 17 nt, Mycobacterium bovis subsp bovis AF2122/97
caaugcguugacgucga

SEQ ID NO: 1059363 - RNA, 13 nt, Mycobacterium bovis subsp bovis AF2122/97
caaugcuggcggc

SEQ ID NO: 1059364 - RNA, 16 nt, Mycobacterium bovis subsp bovis AF2122/97
caaugcuggcggcgcg

SEQ ID NO: 1059365 - RNA, 14 nt, Mycobacterium bovis subsp bovis AF2122/97
caauggaaccgguu

SEQ ID NO: 1059366 - RNA, 20 nt, Mycobacterium bovis subsp bovis AF2122/97
caaugcuggcagcggccucc

SEQ ID NO: 1059367 - RNA, 17 nt, Mycobacterium bovis subsp bovis AF2122/97
caauuccggugaucgcg

SEQ ID NO: 1059368 - RNA, 19 nt, Mycobacterium bovis subsp bovis AF2122/97
caauucgcaaucggcguua

SEQ ID NO: 1059369 - RNA, 18 nt, Mycobacterium bovis subsp bovis AF2122/97
caauuccgcuugcucucg

SEQ ID NO: 1059370 - RNA, 19 nt, Mycobacterium bovis subsp bovis AF2122/97
caauucgggcauggucgcc

SEQ ID NO: 1059371 - RNA, 18 nt, Mycobacterium bovis subsp bovis AF2122/97
caauucccaucggccugg

SEQ ID NO: 1059372 - RNA, 18 nt, Mycobacterium bovis subsp bovis AF2122/97
caauucccgcgcggcgug

SEQ ID NO: 1059373 - RNA, 22 nt, Mycobacterium bovis subsp bovis AF2122/97
caauuccacgaucggcucacga

SEQ ID NO: 1059374 - RNA, 22 nt, Mycobacterium bovis subsp bovis AF2122/97
caauuccagccccccggcgacg

SEQ ID NO: 1059375 - RNA, 15 nt, Mycobacterium bovis subsp bovis AF2122/97
caauucacgcaccac

SEQ ID NO: 1059376 - RNA, 19 nt, Mycobacterium bovis subsp bovis AF2122/97
caauucaacacacggcgcg

SEQ ID NO: 1059377 - RNA, 15 nt, Mycobacterium bovis subsp bovis AF2122/97
agcugguugugcugg

SEQ ID NO: 1059378 - RNA, 18 nt, Mycobacterium bovis subsp bovis AF2122/97
agcugguuugcggugccc

SEQ ID NO: 1059379 - RNA, 22 nt, Mycobacterium bovis subsp bovis AF2122/97
agcugucccucgggaucaccga

SEQ ID NO: 1059380 - RNA, 18 nt, Mycobacterium bovis subsp bovis AF2122/97
agcuguagaccuggccgu

SEQ ID NO: 1059381 - RNA, 20 nt, Mycobacterium bovis subsp bovis AF2122/97
agcuggugcguagcccaccc

SEQ ID NO: 1059382 - RNA, 19 nt, Mycobacterium bovis subsp bovis AF2122/97
agcuggggaacagcagcgc

SEQ ID NO: 1059383 - RNA, 22 nt, Mycobacterium bovis subsp bovis AF2122/97
agcuggggcggauaugaugauc

SEQ ID NO: 1059384 - RNA, 19 nt, Mycobacterium bovis subsp bovis AF2122/97
agcugguaggucaccgguc

SEQ ID NO: 1059385 - RNA, 23 nt, Mycobacterium bovis subsp bovis AF2122/97
agcugggcaucaccgccgcggcc

SEQ ID NO: 1059386 - RNA, 17 nt, Mycobacterium bovis subsp bovis AF2122/97
agcugggucaugccgua

SEQ ID NO: 1059387 - RNA, 17 nt, Mycobacterium bovis subsp bovis AF2122/97
agcugggucccgcuggc

SEQ ID NO: 1059388 - RNA, 19 nt, Mycobacterium bovis subsp bovis AF2122/97
agcugggugaccucgucga

SEQ ID NO: 1059389 - RNA, 13 nt, Mycobacterium bovis subsp bovis AF2122/97
agcugggugcgcc

SEQ ID NO: 1059390 - RNA, 18 nt, Mycobacterium bovis subsp bovis AF2122/97
agcuggggaacagcagcg

SEQ ID NO: 1059391 - RNA, 18 nt, Mycobacterium bovis subsp bovis AF2122/97
agcuggcgguugcccgag

SEQ ID NO: 1059392 - RNA, 20 nt, Mycobacterium bovis subsp bovis AF2122/97
agcuggcuacgggccgcucc

SEQ ID NO: 1059393 - RNA, 21 nt, Mycobacterium bovis subsp bovis AF2122/97
agcuggccgucagcgucggcg

SEQ ID NO: 1059394 - RNA, 13 nt, Mycobacterium bovis subsp bovis AF2122/97
agcuggcggcagc

SEQ ID NO: 1059395 - RNA, 20 nt, Mycobacterium bovis subsp bovis AF2122/97
agcugucgcaacgcaucgau

SEQ ID NO: 1059396 - RNA, 22 nt, Mycobacterium bovis subsp bovis AF2122/97
agcugucggcgaccgagacggc

SEQ ID NO: 1059397 - RNA, 15 nt, Mycobacterium bovis subsp bovis AF2122/97
agcuguugucgcgga

SEQ ID NO: 1059398 - RNA, 15 nt, Mycobacterium bovis subsp bovis AF2122/97
agcuguugaccgugu

SEQ ID NO: 1059399 - RNA, 21 nt, Mycobacterium bovis subsp bovis AF2122/97
agcuguugacuaccaccgcgu

SEQ ID NO: 1059400 - RNA, 15 nt, Mycobacterium bovis subsp bovis AF2122/97
agcuguuugccggcu

SEQ ID NO: 1059401 - RNA, 22 nt, Mycobacterium bovis subsp bovis AF2122/97
agcuguuuggggucgcgcugcc

SEQ ID NO: 1059402 - RNA, 16 nt, Mycobacterium bovis subsp bovis AF2122/97
agcuucaacaccggca

SEQ ID NO: 1059403 - RNA, 14 nt, Mycobacterium bovis subsp bovis AF2122/97
agcugcugaugcgg

SEQ ID NO: 1059404 - RNA, 23 nt, Mycobacterium bovis subsp bovis AF2122/97
agcugcugaugcgguagucgccg

SEQ ID NO: 1059405 - RNA, 22 nt, Mycobacterium bovis subsp bovis AF2122/97
agcugcugccgauacagcacau

SEQ ID NO: 1059406 - RNA, 17 nt, Mycobacterium bovis subsp bovis AF2122/97
agcugcucgucggcgcc

SEQ ID NO: 1059407 - RNA, 14 nt, Mycobacterium bovis subsp bovis AF2122/97
agcugcucgccggc

SEQ ID NO: 1059408 - RNA, 19 nt, Mycobacterium bovis subsp bovis AF2122/97
agcugcucgucggcgccgg

SEQ ID NO: 1059409 - RNA, 15 nt, Mycobacterium bovis subsp bovis AF2122/97
agcugcucgucgucg

SEQ ID NO: 1059410 - RNA, 15 nt, Mycobacterium bovis subsp bovis AF2122/97
agcugcuggcgcgcc

SEQ ID NO: 1059411 - RNA, 14 nt, Mycobacterium bovis subsp bovis AF2122/97
agcuggccgcggcg

SEQ ID NO: 1059412 - RNA, 17 nt, Mycobacterium bovis subsp bovis AF2122/97
agcuggcaacgccgcgc

SEQ ID NO: 1059413 - RNA, 19 nt, Mycobacterium bovis subsp bovis AF2122/97
agcuggcaacgccgcgccg

SEQ ID NO: 1059414 - RNA, 22 nt, Mycobacterium bovis subsp bovis AF2122/97
agcuggacggccuccaucgcga

SEQ ID NO: 1059415 - RNA, 20 nt, Mycobacterium bovis subsp bovis AF2122/97
agcuggccaccgcaucgccg

SEQ ID NO: 1059416 - RNA, 18 nt, Mycobacterium bovis subsp bovis AF2122/97
agcugcgggucucgccga

SEQ ID NO: 1059417 - RNA, 21 nt, Mycobacterium bovis subsp bovis AF2122/97
agcugcggucgaacaucaucg

SEQ ID NO: 1059418 - RNA, 14 nt, Mycobacterium bovis subsp bovis AF2122/97
agcugcggucgcgg

SEQ ID NO: 1059419 - RNA, 17 nt, Mycobacterium bovis subsp bovis AF2122/97
agcgucuggccgucgcu

SEQ ID NO: 1059420 - RNA, 21 nt, Mycobacterium bovis subsp bovis AF2122/97
agcgucuggcgacaucucggu

SEQ ID NO: 1059421 - RNA, 18 nt, Mycobacterium bovis subsp bovis AF2122/97
agcgucccggucgccaaa

SEQ ID NO: 1059422 - RNA, 21 nt, Mycobacterium bovis subsp bovis AF2122/97
agcgucucgaucaccucgcgg

SEQ ID NO: 1059423 - RNA, 13 nt, Mycobacterium bovis subsp bovis AF2122/97
agcgucguugcuc

SEQ ID NO: 1059424 - RNA, 13 nt, Mycobacterium bovis subsp bovis AF2122/97
agcgucucaaggc

SEQ ID NO: 1059425 - RNA, 17 nt, Mycobacterium bovis subsp bovis AF2122/97
agcgucggugccaccac

SEQ ID NO: 1059426 - RNA, 17 nt, Mycobacterium bovis subsp bovis AF2122/97
agcgucguaaccgucgc

SEQ ID NO: 1059427 - RNA, 20 nt, Mycobacterium bovis subsp bovis AF2122/97
agcgucguaaccgucgccug

SEQ ID NO: 1059428 - RNA, 19 nt, Mycobacterium bovis subsp bovis AF2122/97
agcguccauggucgcgcca

SEQ ID NO: 1059429 - RNA, 14 nt, Mycobacterium bovis subsp bovis AF2122/97
agcguccgcgcccg

SEQ ID NO: 1059430 - RNA, 15 nt, Mycobacterium bovis subsp bovis AF2122/97
aggaaccacccaccg

SEQ ID NO: 1059431 - RNA, 14 nt, Mycobacterium bovis subsp bovis AF2122/97
aggaacucggaccc

SEQ ID NO: 1059432 - RNA, 17 nt, Mycobacterium bovis subsp bovis AF2122/97
aggaacccuccggaccc

SEQ ID NO: 1059433 - RNA, 18 nt, Mycobacterium bovis subsp bovis AF2122/97
aggaacccuccggaccca

SEQ ID NO: 1059434 - RNA, 14 nt, Mycobacterium bovis subsp bovis AF2122/97
aggaacgccggcau

SEQ ID NO: 1059435 - RNA, 13 nt, Mycobacterium bovis subsp bovis AF2122/97
aggaacgccgggg

SEQ ID NO: 1059436 - RNA, 14 nt, Mycobacterium bovis subsp bovis AF2122/97
aggaagccgcggcc

SEQ ID NO: 1059437 - RNA, 14 nt, Mycobacterium bovis subsp bovis AF2122/97
aggacaccggcacc

SEQ ID NO: 1059438 - RNA, 16 nt, Mycobacterium bovis subsp bovis AF2122/97
aggacagcagccgccg

SEQ ID NO: 1059439 - RNA, 17 nt, Mycobacterium bovis subsp bovis AF2122/97
aggacagcagccgccgg

SEQ ID NO: 1059440 - RNA, 19 nt, Mycobacterium bovis subsp bovis AF2122/97
aggacaauggacaccaacc

SEQ ID NO: 1059441 - RNA, 18 nt, Mycobacterium bovis subsp bovis AF2122/97
aggacaauuuucgcaccu

SEQ ID NO: 1059442 - RNA, 12 nt, Mycobacterium bovis subsp bovis AF2122/97
aggacaccaccg

SEQ ID NO: 1059443 - RNA, 19 nt, Mycobacterium bovis subsp bovis AF2122/97
aggaaucccucggccgcag

SEQ ID NO: 1059444 - RNA, 19 nt, Mycobacterium bovis subsp bovis AF2122/97
agcuucucgucggugcgcg

SEQ ID NO: 1059445 - RNA, 16 nt, Mycobacterium bovis subsp bovis AF2122/97
agcuucgcgcagccgg

SEQ ID NO: 1059446 - RNA, 15 nt, Mycobacterium bovis subsp bovis AF2122/97
agcuucgcuugccga

SEQ ID NO: 1059447 - RNA, 21 nt, Mycobacterium bovis subsp bovis AF2122/97
agcuucccgguagcggcggca

SEQ ID NO: 1059448 - RNA, 18 nt, Mycobacterium bovis subsp bovis AF2122/97
agcuuccgguccagcggc

SEQ ID NO: 1059449 - RNA, 16 nt, Mycobacterium bovis subsp bovis AF2122/97
agcuugacguugccgg

SEQ ID NO: 1059450 - RNA, 17 nt, Mycobacterium bovis subsp bovis AF2122/97
agcuugccaaucaccgu

SEQ ID NO: 1059451 - RNA, 17 nt, Mycobacterium bovis subsp bovis AF2122/97
agcuugcccgacggcgu

SEQ ID NO: 1059452 - RNA, 15 nt, Mycobacterium bovis subsp bovis AF2122/97
agcuugccgucgcug

SEQ ID NO: 1059453 - RNA, 15 nt, Mycobacterium bovis subsp bovis AF2122/97
agcuuggacaccagu

SEQ ID NO: 1059454 - RNA, 15 nt, Mycobacterium bovis subsp bovis AF2122/97
agcuuggcgucgaug

SEQ ID NO: 1059455 - RNA, 18 nt, Mycobacterium bovis subsp bovis AF2122/97
agcuuggcgucgaugcgg

SEQ ID NO: 1059456 - RNA, 21 nt, Mycobacterium bovis subsp bovis AF2122/97
agcuugggccggugcagcacg

SEQ ID NO: 1059457 - RNA, 13 nt, Mycobacterium bovis subsp bovis AF2122/97
agcuuguugcagc

SEQ ID NO: 1059458 - RNA, 20 nt, Mycobacterium bovis subsp bovis AF2122/97
agcuuguuuuccaccagcga

SEQ ID NO: 1059459 - RNA, 21 nt, Mycobacterium bovis subsp bovis AF2122/97
agcuuguccagauaucgaagc

SEQ ID NO: 1059460 - RNA, 21 nt, Mycobacterium bovis subsp bovis AF2122/97
aggccagagucgcccgcacac

SEQ ID NO: 1059461 - RNA, 19 nt, Mycobacterium bovis subsp bovis AF2122/97
aggcccgcacguuggcggc

SEQ ID NO: 1059462 - RNA, 23 nt, Mycobacterium bovis subsp bovis AF2122/97
aggcccgcacguuggcggccagc

SEQ ID NO: 1059463 - RNA, 16 nt, Mycobacterium bovis subsp bovis AF2122/97
aggcccgacggcgccc

SEQ ID NO: 1059464 - RNA, 17 nt, Mycobacterium bovis subsp bovis AF2122/97
aggcccggcgcggccgc

SEQ ID NO: 1059465 - RNA, 19 nt, Mycobacterium bovis subsp bovis AF2122/97
aggcccgggcggaugcugu

SEQ ID NO: 1059466 - RNA, 21 nt, Mycobacterium bovis subsp bovis AF2122/97
aggcccgccacaacggcggcg

SEQ ID NO: 1059467 - RNA, 22 nt, Mycobacterium bovis subsp bovis AF2122/97
aggcccgccacaacggcggcgc

SEQ ID NO: 1059468 - RNA, 23 nt, Mycobacterium bovis subsp bovis AF2122/97
aggcccgcgguggaccgggcaag

SEQ ID NO: 1059469 - RNA, 21 nt, Mycobacterium bovis subsp bovis AF2122/97
aggccacccgcgaagccgcca

SEQ ID NO: 1059470 - RNA, 12 nt, Mycobacterium bovis subsp bovis AF2122/97
aggccaccgucg

SEQ ID NO: 1059471 - RNA, 13 nt, Mycobacterium bovis subsp bovis AF2122/97
aggccacggggau

SEQ ID NO: 1059472 - RNA, 21 nt, Mycobacterium bovis subsp bovis AF2122/97
aggccacggggauuggcgacg

SEQ ID NO: 1059473 - RNA, 16 nt, Mycobacterium bovis subsp bovis AF2122/97
aggccacugccgacca

SEQ ID NO: 1059474 - RNA, 18 nt, Mycobacterium bovis subsp bovis AF2122/97
aggccacugccgaccagc

SEQ ID NO: 1059475 - RNA, 18 nt, Mycobacterium bovis subsp bovis AF2122/97
aggccagagucgcccgca

SEQ ID NO: 1059476 - RNA, 13 nt, Mycobacterium bovis subsp bovis AF2122/97
aggcaucaccgga

SEQ ID NO: 1059477 - RNA, 21 nt, Mycobacterium bovis subsp bovis AF2122/97
aggcagguuggccaccgccca

SEQ ID NO: 1059478 - RNA, 17 nt, Mycobacterium bovis subsp bovis AF2122/97
aggcaguccaccgcgcg

SEQ ID NO: 1059479 - RNA, 15 nt, Mycobacterium bovis subsp bovis AF2122/97
aggcagcgaccgucg

SEQ ID NO: 1059480 - RNA, 19 nt, Mycobacterium bovis subsp bovis AF2122/97
aggcagcgucgucgacgac

SEQ ID NO: 1059481 - RNA, 22 nt, Mycobacterium bovis subsp bovis AF2122/97
aggcagcuugccaaucaccgua

SEQ ID NO: 1059482 - RNA, 22 nt, Mycobacterium bovis subsp bovis AF2122/97
aggcacguucagccaggcgugc

SEQ ID NO: 1059483 - RNA, 12 nt, Mycobacterium bovis subsp bovis AF2122/97
aggcacgucgaa

SEQ ID NO: 1059484 - RNA, 20 nt, Mycobacterium bovis subsp bovis AF2122/97
aggcacguucagccaggcgu

SEQ ID NO: 1059485 - RNA, 17 nt, Mycobacterium bovis subsp bovis AF2122/97
aggcaccgaaaaacacc

SEQ ID NO: 1059486 - RNA, 22 nt, Mycobacterium bovis subsp bovis AF2122/97
aggcaccgaaaaacaccagcga

SEQ ID NO: 1059487 - RNA, 16 nt, Mycobacterium bovis subsp bovis AF2122/97
aggcaccccgaucacc

SEQ ID NO: 1059488 - RNA, 18 nt, Mycobacterium bovis subsp bovis AF2122/97
aggcacaacaucgccgca

SEQ ID NO: 1059489 - RNA, 23 nt, Mycobacterium bovis subsp bovis AF2122/97
aggcaaugcgagcacccguugau

SEQ ID NO: 1059490 - RNA, 19 nt, Mycobacterium bovis subsp bovis AF2122/97
aggcacaucgcgaaaccgg

SEQ ID NO: 1059491 - RNA, 17 nt, Mycobacterium bovis subsp bovis AF2122/97
aggaucgcguccgccuc

SEQ ID NO: 1059492 - RNA, 19 nt, Mycobacterium bovis subsp bovis AF2122/97
aggaucgguuucugcggcc

SEQ ID NO: 1059493 - RNA, 18 nt, Mycobacterium bovis subsp bovis AF2122/97
aggauccgcugcggcccg

SEQ ID NO: 1059494 - RNA, 20 nt, Mycobacterium bovis subsp bovis AF2122/97
aggaucccgccgcugccgcc

SEQ ID NO: 1059495 - RNA, 19 nt, Mycobacterium bovis subsp bovis AF2122/97
aggaucgcaaugccgugcg

SEQ ID NO: 1059496 - RNA, 12 nt, Mycobacterium bovis subsp bovis AF2122/97
aggaucacgccg

SEQ ID NO: 1059497 - RNA, 19 nt, Mycobacterium bovis subsp bovis AF2122/97
aggagaucgaucgacagcg

SEQ ID NO: 1059498 - RNA, 16 nt, Mycobacterium bovis subsp bovis AF2122/97
aggagcagcacgucga

SEQ ID NO: 1059499 - RNA, 16 nt, Mycobacterium bovis subsp bovis AF2122/97
aggagccgucacgccg

SEQ ID NO: 1059500 - RNA, 14 nt, Mycobacterium bovis subsp bovis AF2122/97
aggagcgcggcccg

SEQ ID NO: 1059501 - RNA, 13 nt, Mycobacterium bovis subsp bovis AF2122/97
aggagcgggugca

SEQ ID NO: 1059502 - RNA, 13 nt, Mycobacterium bovis subsp bovis AF2122/97
aggaguggccggg

SEQ ID NO: 1059503 - RNA, 22 nt, Mycobacterium bovis subsp bovis AF2122/97
aggagugguacggcucggcgcu

SEQ ID NO: 1059504 - RNA, 18 nt, Mycobacterium bovis subsp bovis AF2122/97
aggagugguugcccgcac

SEQ ID NO: 1059505 - RNA, 20 nt, Mycobacterium bovis subsp bovis AF2122/97
aggacgagguucugccgcga

SEQ ID NO: 1059506 - RNA, 19 nt, Mycobacterium bovis subsp bovis AF2122/97
aggacgaacaacgcgacga

SEQ ID NO: 1059507 - RNA, 16 nt, Mycobacterium bovis subsp bovis AF2122/97
aggacgcaccgccagu

SEQ ID NO: 1059508 - RNA, 13 nt, Mycobacterium bovis subsp bovis AF2122/97
aggacgccagcaa

SEQ ID NO: 1059509 - RNA, 13 nt, Mycobacterium bovis subsp bovis AF2122/97
aggacgccggcgc

SEQ ID NO: 1059510 - RNA, 15 nt, Mycobacterium bovis subsp bovis AF2122/97
aggacgccggcgccg

SEQ ID NO: 1059511 - RNA, 13 nt, Mycobacterium bovis subsp bovis AF2122/97
aggacgccgcgcc

SEQ ID NO: 1059512 - RNA, 14 nt, Mycobacterium bovis subsp bovis AF2122/97
aggacgccgcgccg

SEQ ID NO: 1059513 - RNA, 16 nt, Mycobacterium bovis subsp bovis AF2122/97
aggacccaucgccagc

SEQ ID NO: 1059514 - RNA, 17 nt, Mycobacterium bovis subsp bovis AF2122/97
aggaccagagcucgaag

SEQ ID NO: 1059515 - RNA, 13 nt, Mycobacterium bovis subsp bovis AF2122/97
aggaccagcaccg

SEQ ID NO: 1059516 - RNA, 15 nt, Mycobacterium bovis subsp bovis AF2122/97
aggaccaucccgccg

SEQ ID NO: 1059517 - RNA, 16 nt, Mycobacterium bovis subsp bovis AF2122/97
aggaccugcucgggcg

SEQ ID NO: 1059518 - RNA, 18 nt, Mycobacterium bovis subsp bovis AF2122/97
aggacagcugguugugcu

SEQ ID NO: 1059519 - RNA, 15 nt, Mycobacterium bovis subsp bovis AF2122/97
aggacauucccgagu

SEQ ID NO: 1059520 - RNA, 15 nt, Mycobacterium bovis subsp bovis AF2122/97
aggaccagcaccgcc

SEQ ID NO: 1059521 - RNA, 17 nt, Mycobacterium bovis subsp bovis AF2122/97
aggaccagcaccgccgc

SEQ ID NO: 1059522 - RNA, 18 nt, Mycobacterium bovis subsp bovis AF2122/97
aggacggcuaccaccgca

SEQ ID NO: 1059523 - RNA, 19 nt, Mycobacterium bovis subsp bovis AF2122/97
aggacggcuaccaccgcac

SEQ ID NO: 1059524 - RNA, 16 nt, Mycobacterium bovis subsp bovis AF2122/97
aggacggcagccacca

SEQ ID NO: 1059525 - RNA, 18 nt, Mycobacterium bovis subsp bovis AF2122/97
aggacggcagccaccagc

SEQ ID NO: 1059526 - RNA, 15 nt, Mycobacterium bovis subsp bovis AF2122/97
aggacgucaccguca

SEQ ID NO: 1059527 - RNA, 21 nt, Mycobacterium bovis subsp bovis AF2122/97
aggacggcgcgagccgcacga

SEQ ID NO: 1059528 - RNA, 18 nt, Mycobacterium bovis subsp bovis AF2122/97
aggacggcugccgucagc

SEQ ID NO: 1059529 - RNA, 19 nt, Mycobacterium bovis subsp bovis AF2122/97
aggacguuucagccgggug

SEQ ID NO: 1059530 - RNA, 21 nt, Mycobacterium bovis subsp bovis AF2122/97
aggacguuucagccgggugcc

SEQ ID NO: 1059531 - RNA, 18 nt, Mycobacterium bovis subsp bovis AF2122/97
aggacguuugagacccca

SEQ ID NO: 1059532 - RNA, 15 nt, Mycobacterium bovis subsp bovis AF2122/97
aggacucacgcagcg

SEQ ID NO: 1059533 - RNA, 22 nt, Mycobacterium bovis subsp bovis AF2122/97
aggacugaacaguugcacaccg

SEQ ID NO: 1059534 - RNA, 18 nt, Mycobacterium bovis subsp bovis AF2122/97
aggacucggacgcgccgg

SEQ ID NO: 1059535 - RNA, 20 nt, Mycobacterium bovis subsp bovis AF2122/97
aggacucggacgcgccggcg

SEQ ID NO: 1059536 - RNA, 17 nt, Mycobacterium bovis subsp bovis AF2122/97
aggacucuucggucagg

SEQ ID NO: 1059537 - RNA, 13 nt, Mycobacterium bovis subsp bovis AF2122/97
aggagaaccaaac

SEQ ID NO: 1059538 - RNA, 19 nt, Mycobacterium bovis subsp bovis AF2122/97
aggacuuguccaucacauc

SEQ ID NO: 1059539 - RNA, 22 nt, Mycobacterium bovis subsp bovis AF2122/97
aggacgucggcgaauccgccgc

SEQ ID NO: 1059540 - RNA, 17 nt, Mycobacterium bovis subsp bovis AF2122/97
aggacugaccgucugcg

SEQ ID NO: 1059541 - RNA, 22 nt, Mycobacterium bovis subsp bovis AF2122/97
aggacugaccgucugcgacccg

SEQ ID NO: 1059542 - RNA, 16 nt, Mycobacterium bovis subsp bovis AF2122/97
aggacugcgccaccgg

SEQ ID NO: 1059543 - RNA, 22 nt, Mycobacterium bovis subsp bovis AF2122/97
aggacugcgccaccggugaggc

SEQ ID NO: 1059544 - RNA, 18 nt, Mycobacterium bovis subsp bovis AF2122/97
aggacuggcaccgccagc

SEQ ID NO: 1059545 - RNA, 23 nt, Mycobacterium bovis subsp bovis AF2122/97
aggacuggcaccgccagccacca

SEQ ID NO: 1059546 - RNA, 18 nt, Mycobacterium bovis subsp bovis AF2122/97
aggagauccuuaucgcuc

SEQ ID NO: 1059547 - RNA, 22 nt, Mycobacterium bovis subsp bovis AF2122/97
aggagaauuaguuucgucccca

SEQ ID NO: 1059548 - RNA, 22 nt, Mycobacterium bovis subsp bovis AF2122/97
agggucgccgcauugcagaacc

SEQ ID NO: 1059549 - RNA, 18 nt, Mycobacterium bovis subsp bovis AF2122/97
agggucgggguccgcggc

SEQ ID NO: 1059550 - RNA, 21 nt, Mycobacterium bovis subsp bovis AF2122/97
agggucaugucgaucagcgcg

SEQ ID NO: 1059551 - RNA, 15 nt, Mycobacterium bovis subsp bovis AF2122/97
agggucaucgccagc

SEQ ID NO: 1059552 - RNA, 16 nt, Mycobacterium bovis subsp bovis AF2122/97
agggucaucgccagcg

SEQ ID NO: 1059553 - RNA, 17 nt, Mycobacterium bovis subsp bovis AF2122/97
agggucagcgccgcgcc

SEQ ID NO: 1059554 - RNA, 18 nt, Mycobacterium bovis subsp bovis AF2122/97
agggucgaugucgucgac

SEQ ID NO: 1059555 - RNA, 18 nt, Mycobacterium bovis subsp bovis AF2122/97
aggggcgcuuccguggcc

SEQ ID NO: 1059556 - RNA, 22 nt, Mycobacterium bovis subsp bovis AF2122/97
aggggaguugcgacgauacacg

SEQ ID NO: 1059557 - RNA, 18 nt, Mycobacterium bovis subsp bovis AF2122/97
agggcuugucgccggcau

SEQ ID NO: 1059558 - RNA, 15 nt, Mycobacterium bovis subsp bovis AF2122/97
agggcuugucgccgg

SEQ ID NO: 1059559 - RNA, 21 nt, Mycobacterium bovis subsp bovis AF2122/97
agggcugguaucgagcacccc

SEQ ID NO: 1059560 - RNA, 19 nt, Mycobacterium bovis subsp bovis AF2122/97
agggcuguugacgccacga

SEQ ID NO: 1059561 - RNA, 20 nt, Mycobacterium bovis subsp bovis AF2122/97
agggcuguugacgccacgac

SEQ ID NO: 1059562 - RNA, 21 nt, Mycobacterium bovis subsp bovis AF2122/97
agguccccgacaacggcggca

SEQ ID NO: 1059563 - RNA, 12 nt, Mycobacterium bovis subsp bovis AF2122/97
aggucccgugcg

SEQ ID NO: 1059564 - RNA, 23 nt, Mycobacterium bovis subsp bovis AF2122/97
aggucccgugcgcgcgcagcuga

SEQ ID NO: 1059565 - RNA, 15 nt, Mycobacterium bovis subsp bovis AF2122/97
agguccgccggugcc

SEQ ID NO: 1059566 - RNA, 16 nt, Mycobacterium bovis subsp bovis AF2122/97
agguccgccggugccg

SEQ ID NO: 1059567 - RNA, 15 nt, Mycobacterium bovis subsp bovis AF2122/97
agguccucgucggcg

SEQ ID NO: 1059568 - RNA, 21 nt, Mycobacterium bovis subsp bovis AF2122/97
agguccggggaaagccgcagc

SEQ ID NO: 1059569 - RNA, 18 nt, Mycobacterium bovis subsp bovis AF2122/97
aggucaacgccacgccga

SEQ ID NO: 1059570 - RNA, 12 nt, Mycobacterium bovis subsp bovis AF2122/97
agguccgcggcc

SEQ ID NO: 1059571 - RNA, 16 nt, Mycobacterium bovis subsp bovis AF2122/97
agguauucguggucgg

SEQ ID NO: 1059572 - RNA, 13 nt, Mycobacterium bovis subsp bovis AF2122/97
agguaugcgguug

SEQ ID NO: 1059573 - RNA, 17 nt, Mycobacterium bovis subsp bovis AF2122/97
agguaagcagccagcaa

SEQ ID NO: 1059574 - RNA, 20 nt, Mycobacterium bovis subsp bovis AF2122/97
agguaagcagccagcaacac

SEQ ID NO: 1059575 - RNA, 16 nt, Mycobacterium bovis subsp bovis AF2122/97
aggguuuccaagucgg

SEQ ID NO: 1059576 - RNA, 20 nt, Mycobacterium bovis subsp bovis AF2122/97
agggcgccgggggcgccgcc

SEQ ID NO: 1059577 - RNA, 23 nt, Mycobacterium bovis subsp bovis AF2122/97
agggcggaaaaucggcuggcccg

SEQ ID NO: 1059578 - RNA, 18 nt, Mycobacterium bovis subsp bovis AF2122/97
agggcggccuccccgacc

SEQ ID NO: 1059579 - RNA, 18 nt, Mycobacterium bovis subsp bovis AF2122/97
agggcgauuuccaucgcg

SEQ ID NO: 1059580 - RNA, 19 nt, Mycobacterium bovis subsp bovis AF2122/97
agggcgccacugaccgcga

SEQ ID NO: 1059581 - RNA, 20 nt, Mycobacterium bovis subsp bovis AF2122/97
agggcgccacugaccgcgau

SEQ ID NO: 1059582 - RNA, 21 nt, Mycobacterium bovis subsp bovis AF2122/97
agggcgccacugaccgcgauc

SEQ ID NO: 1059583 - RNA, 12 nt, Mycobacterium bovis subsp bovis AF2122/97
agggcgcccgcc

SEQ ID NO: 1059584 - RNA, 12 nt, Mycobacterium bovis subsp bovis AF2122/97
agggcgccgaau

SEQ ID NO: 1059585 - RNA, 21 nt, Mycobacterium bovis subsp bovis AF2122/97
agggcggugccaucgggcgcg

SEQ ID NO: 1059586 - RNA, 20 nt, Mycobacterium bovis subsp bovis AF2122/97
agggcgucgaccgcggcccg

SEQ ID NO: 1059587 - RNA, 18 nt, Mycobacterium bovis subsp bovis AF2122/97
agggcggggcagaagucg

SEQ ID NO: 1059588 - RNA, 17 nt, Mycobacterium bovis subsp bovis AF2122/97
agggcgucgccgccguu

SEQ ID NO: 1059589 - RNA, 15 nt, Mycobacterium bovis subsp bovis AF2122/97
aggcuugcaaggucg

SEQ ID NO: 1059590 - RNA, 23 nt, Mycobacterium bovis subsp bovis AF2122/97
aggcuucgcuggcuugggccagc

SEQ ID NO: 1059591 - RNA, 14 nt, Mycobacterium bovis subsp bovis AF2122/97
agggcccuggcggc

SEQ ID NO: 1059592 - RNA, 17 nt, Mycobacterium bovis subsp bovis AF2122/97
agggcccuggcggcccg

SEQ ID NO: 1059593 - RNA, 23 nt, Mycobacterium bovis subsp bovis AF2122/97
agggccggguggccacgaauccg

SEQ ID NO: 1059594 - RNA, 15 nt, Mycobacterium bovis subsp bovis AF2122/97
agggccggcaccgca

SEQ ID NO: 1059595 - RNA, 17 nt, Mycobacterium bovis subsp bovis AF2122/97
agggccggcaccgcagc

SEQ ID NO: 1059596 - RNA, 22 nt, Mycobacterium bovis subsp bovis AF2122/97
agggccgccgcgaacgggucgg

SEQ ID NO: 1059597 - RNA, 21 nt, Mycobacterium bovis subsp bovis AF2122/97
agggccgcucgccucgauggc

SEQ ID NO: 1059598 - RNA, 21 nt, Mycobacterium bovis subsp bovis AF2122/97
agggccugccgcacugggcga

SEQ ID NO: 1059599 - RNA, 14 nt, Mycobacterium bovis subsp bovis AF2122/97
agggccucgaccgc

SEQ ID NO: 1059600 - RNA, 13 nt, Mycobacterium bovis subsp bovis AF2122/97
agggcgacggcca

SEQ ID NO: 1059601 - RNA, 21 nt, Mycobacterium bovis subsp bovis AF2122/97
agggcgacgagaucugcgaug

SEQ ID NO: 1059602 - RNA, 15 nt, Mycobacterium bovis subsp bovis AF2122/97
agggcgacauugcga

SEQ ID NO: 1059603 - RNA, 17 nt, Mycobacterium bovis subsp bovis AF2122/97
agggccuugaucggcac

SEQ ID NO: 1059604 - RNA, 21 nt, Mycobacterium bovis subsp bovis AF2122/97
aggccgaucagcguggcgccc

SEQ ID NO: 1059605 - RNA, 16 nt, Mycobacterium bovis subsp bovis AF2122/97
aggccgcaauacccga

SEQ ID NO: 1059606 - RNA, 15 nt, Mycobacterium bovis subsp bovis AF2122/97
aggccgcacagcacc

SEQ ID NO: 1059607 - RNA, 13 nt, Mycobacterium bovis subsp bovis AF2122/97
aggccgcaccgcc

SEQ ID NO: 1059608 - RNA, 14 nt, Mycobacterium bovis subsp bovis AF2122/97
aggccgcaccgcca

SEQ ID NO: 1059609 - RNA, 15 nt, Mycobacterium bovis subsp bovis AF2122/97
aggccgcaccgccac

SEQ ID NO: 1059610 - RNA, 21 nt, Mycobacterium bovis subsp bovis AF2122/97
aggccgaucagcgcggcgccc

SEQ ID NO: 1059611 - RNA, 22 nt, Mycobacterium bovis subsp bovis AF2122/97
aggccgaugugucgaugaggau

SEQ ID NO: 1059612 - RNA, 15 nt, Mycobacterium bovis subsp bovis AF2122/97
aggccucgaccgcgg

SEQ ID NO: 1059613 - RNA, 14 nt, Mycobacterium bovis subsp bovis AF2122/97
aggccuccgcugcc

SEQ ID NO: 1059614 - RNA, 18 nt, Mycobacterium bovis subsp bovis AF2122/97
aggccuccgcugccgccc

SEQ ID NO: 1059615 - RNA, 13 nt, Mycobacterium bovis subsp bovis AF2122/97
aggccucggcagc

SEQ ID NO: 1059616 - RNA, 17 nt, Mycobacterium bovis subsp bovis AF2122/97
aggccgaggccgcugcc

SEQ ID NO: 1059617 - RNA, 14 nt, Mycobacterium bovis subsp bovis AF2122/97
aggccccuggccgc

SEQ ID NO: 1059618 - RNA, 13 nt, Mycobacterium bovis subsp bovis AF2122/97
aggccgaucagcg

SEQ ID NO: 1059619 - RNA, 14 nt, Mycobacterium bovis subsp bovis AF2122/97
aggccgagcccggu

SEQ ID NO: 1059620 - RNA, 23 nt, Mycobacterium bovis subsp bovis AF2122/97
aggcccgggugcuacuggguggg

SEQ ID NO: 1059621 - RNA, 14 nt, Mycobacterium bovis subsp bovis AF2122/97
aggccuggccccgg

SEQ ID NO: 1059622 - RNA, 17 nt, Mycobacterium bovis subsp bovis AF2122/97
aggccuggcgagccagc

SEQ ID NO: 1059623 - RNA, 20 nt, Mycobacterium bovis subsp bovis AF2122/97
aggccucggcgccgcccagc

SEQ ID NO: 1059624 - RNA, 15 nt, Mycobacterium bovis subsp bovis AF2122/97
aggcgaaaaacaccu

SEQ ID NO: 1059625 - RNA, 20 nt, Mycobacterium bovis subsp bovis AF2122/97
aggcgacgagcacacaacac

SEQ ID NO: 1059626 - RNA, 22 nt, Mycobacterium bovis subsp bovis AF2122/97
aggcgacggcucuaccgguccg

SEQ ID NO: 1059627 - RNA, 17 nt, Mycobacterium bovis subsp bovis AF2122/97
aggcgacucggugcggu

SEQ ID NO: 1059628 - RNA, 14 nt, Mycobacterium bovis subsp bovis AF2122/97
aggcgaguucgcgc

SEQ ID NO: 1059629 - RNA, 21 nt, Mycobacterium bovis subsp bovis AF2122/97
aggcgaguucgcgcacgucgg

SEQ ID NO: 1059630 - RNA, 20 nt, Mycobacterium bovis subsp bovis AF2122/97
aggcgauaaagccgcugaac

SEQ ID NO: 1059631 - RNA, 14 nt, Mycobacterium bovis subsp bovis AF2122/97
aggcgagucaccgg

SEQ ID NO: 1059632 - RNA, 17 nt, Mycobacterium bovis subsp bovis AF2122/97
aggcgaccggacgagcg

SEQ ID NO: 1059633 - RNA, 13 nt, Mycobacterium bovis subsp bovis AF2122/97
aggcgaacaccag

SEQ ID NO: 1059634 - RNA, 20 nt, Mycobacterium bovis subsp bovis AF2122/97
aggcgaccagauagaacaac

SEQ ID NO: 1059635 - RNA, 21 nt, Mycobacterium bovis subsp bovis AF2122/97
aggcgaagcgggacugcagcg

SEQ ID NO: 1059636 - RNA, 20 nt, Mycobacterium bovis subsp bovis AF2122/97
aggcgcaagaaugccgccga

SEQ ID NO: 1059637 - RNA, 23 nt, Mycobacterium bovis subsp bovis AF2122/97
aggcgcauagggccaccgccgcc

SEQ ID NO: 1059638 - RNA, 13 nt, Mycobacterium bovis subsp bovis AF2122/97
aggcgccgucucg

SEQ ID NO: 1059639 - RNA, 16 nt, Mycobacterium bovis subsp bovis AF2122/97
aggcgccggucgccug

SEQ ID NO: 1059640 - RNA, 15 nt, Mycobacterium bovis subsp bovis AF2122/97
aggcgcagcgccagc

SEQ ID NO: 1059641 - RNA, 16 nt, Mycobacterium bovis subsp bovis AF2122/97
aggcgcagcugggugc

SEQ ID NO: 1059642 - RNA, 14 nt, Mycobacterium bovis subsp bovis AF2122/97
aggcggccagcgcg

SEQ ID NO: 1059643 - RNA, 15 nt, Mycobacterium bovis subsp bovis AF2122/97
aggcggccagcgcgc

SEQ ID NO: 1059644 - RNA, 13 nt, Mycobacterium bovis subsp bovis AF2122/97
aggcggcccccgg

SEQ ID NO: 1059645 - RNA, 17 nt, Mycobacterium bovis subsp bovis AF2122/97
aggcggcccccggcagc

SEQ ID NO: 1059646 - RNA, 20 nt, Mycobacterium bovis subsp bovis AF2122/97
aggcggccaucgacgacacg

SEQ ID NO: 1059647 - RNA, 12 nt, Mycobacterium bovis subsp bovis AF2122/97
aggcggcagguu

SEQ ID NO: 1059648 - RNA, 18 nt, Mycobacterium bovis subsp bovis AF2122/97
aggcgcgcaccaccgcgg

SEQ ID NO: 1059649 - RNA, 13 nt, Mycobacterium bovis subsp bovis AF2122/97
aggcggccgccgg

SEQ ID NO: 1059650 - RNA, 15 nt, Mycobacterium bovis subsp bovis AF2122/97
aggcggccgccggga

SEQ ID NO: 1059651 - RNA, 15 nt, Mycobacterium bovis subsp bovis AF2122/97
aggcggccgucgucg

SEQ ID NO: 1059652 - RNA, 20 nt, Mycobacterium bovis subsp bovis AF2122/97
aggcggcgucgagcaccucc

SEQ ID NO: 1059653 - RNA, 19 nt, Mycobacterium bovis subsp bovis AF2122/97
aggcggcggccuggcaccc

SEQ ID NO: 1059654 - RNA, 16 nt, Mycobacterium bovis subsp bovis AF2122/97
aggcggcgccgcaccc

SEQ ID NO: 1059655 - RNA, 14 nt, Mycobacterium bovis subsp bovis AF2122/97
aggcggcuggcggu

SEQ ID NO: 1059656 - RNA, 19 nt, Mycobacterium bovis subsp bovis AF2122/97
aggcggcuugaucagccgc

SEQ ID NO: 1059657 - RNA, 20 nt, Mycobacterium bovis subsp bovis AF2122/97
aggcggcuugaucagccgcc

SEQ ID NO: 1059658 - RNA, 21 nt, Mycobacterium bovis subsp bovis AF2122/97
aggcggcuugaucagccgcca

SEQ ID NO: 1059659 - RNA, 21 nt, Mycobacterium bovis subsp bovis AF2122/97
aggcguccaucgccaccgcgu

SEQ ID NO: 1059660 - RNA, 13 nt, Mycobacterium bovis subsp bovis AF2122/97
aggcgucaccccg

SEQ ID NO: 1059661 - RNA, 17 nt, Mycobacterium bovis subsp bovis AF2122/97
aggcucauccgccgggc

SEQ ID NO: 1059662 - RNA, 14 nt, Mycobacterium bovis subsp bovis AF2122/97
aggcguccgagcgc

SEQ ID NO: 1059663 - RNA, 23 nt, Mycobacterium bovis subsp bovis AF2122/97
aggcuccagcgcgcgccgcagcg

SEQ ID NO: 1059664 - RNA, 16 nt, Mycobacterium bovis subsp bovis AF2122/97
aggcuggcugccacga

SEQ ID NO: 1059665 - RNA, 19 nt, Mycobacterium bovis subsp bovis AF2122/97
aggcuguaacacccggccg

SEQ ID NO: 1059666 - RNA, 22 nt, Mycobacterium bovis subsp bovis AF2122/97
aggcuguaacacccggccgccg

SEQ ID NO: 1059667 - RNA, 24 nt, Mycobacterium bovis subsp bovis AF2122/97
aggcugucgcgggccaccaccgag

SEQ ID NO: 1059668 - RNA, 13 nt, Mycobacterium bovis subsp bovis AF2122/97
aggcucgggcaag

SEQ ID NO: 1059669 - RNA, 16 nt, Mycobacterium bovis subsp bovis AF2122/97
aggcucggucggcagc

SEQ ID NO: 1059670 - RNA, 18 nt, Mycobacterium bovis subsp bovis AF2122/97
aggcuccggccggccagc

SEQ ID NO: 1059671 - RNA, 20 nt, Mycobacterium bovis subsp bovis AF2122/97
aggcucgccaguucgcgcca

SEQ ID NO: 1059672 - RNA, 19 nt, Mycobacterium bovis subsp bovis AF2122/97
aggcugaccguggcgccgg

SEQ ID NO: 1059673 - RNA, 19 nt, Mycobacterium bovis subsp bovis AF2122/97
aggcucguggcgacggcgu

SEQ ID NO: 1059674 - RNA, 17 nt, Mycobacterium bovis subsp bovis AF2122/97
aggcucgcguggccgcc

SEQ ID NO: 1059675 - RNA, 13 nt, Mycobacterium bovis subsp bovis AF2122/97
aggucgccggcca

SEQ ID NO: 1059676 - RNA, 16 nt, Mycobacterium bovis subsp bovis AF2122/97
aggucgccggccacga

SEQ ID NO: 1059677 - RNA, 15 nt, Mycobacterium bovis subsp bovis AF2122/97
aggucgaaccgccgg

SEQ ID NO: 1059678 - RNA, 15 nt, Mycobacterium bovis subsp bovis AF2122/97
agguccugcgccgca

SEQ ID NO: 1059679 - RNA, 22 nt, Mycobacterium bovis subsp bovis AF2122/97
aggucgcgauagccgccgcggu

SEQ ID NO: 1059680 - RNA, 14 nt, Mycobacterium bovis subsp bovis AF2122/97
aggucgcgcaguug

SEQ ID NO: 1059681 - RNA, 21 nt, Mycobacterium bovis subsp bovis AF2122/97
aggucgcggucuuugagccgg

SEQ ID NO: 1059682 - RNA, 21 nt, Mycobacterium bovis subsp bovis AF2122/97
aggucggcgaugaugacggcg

SEQ ID NO: 1059683 - RNA, 17 nt, Mycobacterium bovis subsp bovis AF2122/97
aggucggcgaucugcgc

SEQ ID NO: 1059684 - RNA, 15 nt, Mycobacterium bovis subsp bovis AF2122/97
aggucggccaccgug

SEQ ID NO: 1059685 - RNA, 21 nt, Mycobacterium bovis subsp bovis AF2122/97
aggucggcgaacaaccgccgc

SEQ ID NO: 1059686 - RNA, 20 nt, Mycobacterium bovis subsp bovis AF2122/97
aguagccggucggcaccacc

SEQ ID NO: 1059687 - RNA, 19 nt, Mycobacterium bovis subsp bovis AF2122/97
aguagcgcaaugcggcccg

SEQ ID NO: 1059688 - RNA, 23 nt, Mycobacterium bovis subsp bovis AF2122/97
aguagccgaccaggaccaccgca

SEQ ID NO: 1059689 - RNA, 17 nt, Mycobacterium bovis subsp bovis AF2122/97
aguagauugcugacgag

SEQ ID NO: 1059690 - RNA, 21 nt, Mycobacterium bovis subsp bovis AF2122/97
aguacgcccuggaaugccgcc

SEQ ID NO: 1059691 - RNA, 16 nt, Mycobacterium bovis subsp bovis AF2122/97
aguacgcgaccgcgau

SEQ ID NO: 1059692 - RNA, 17 nt, Mycobacterium bovis subsp bovis AF2122/97
aguacgcgacgggccgc

SEQ ID NO: 1059693 - RNA, 20 nt, Mycobacterium bovis subsp bovis AF2122/97
aguacggugguaagacgccg

SEQ ID NO: 1059694 - RNA, 19 nt, Mycobacterium bovis subsp bovis AF2122/97
agucaacaccgcggccgag

SEQ ID NO: 1059695 - RNA, 16 nt, Mycobacterium bovis subsp bovis AF2122/97
aguagugcaucggcag

SEQ ID NO: 1059696 - RNA, 16 nt, Mycobacterium bovis subsp bovis AF2122/97
aguagucggccgauga

SEQ ID NO: 1059697 - RNA, 17 nt, Mycobacterium bovis subsp bovis AF2122/97
aguagucggcgccgaga

SEQ ID NO: 1059698 - RNA, 16 nt, Mycobacterium bovis subsp bovis AF2122/97
aguaggcggcuccgau

SEQ ID NO: 1059699 - RNA, 15 nt, Mycobacterium bovis subsp bovis AF2122/97
aguccacgcaccacg

SEQ ID NO: 1059700 - RNA, 18 nt, Mycobacterium bovis subsp bovis AF2122/97
agucagaaccgacggcca

SEQ ID NO: 1059701 - RNA, 16 nt, Mycobacterium bovis subsp bovis AF2122/97
aguccagccgggugcc

SEQ ID NO: 1059702 - RNA, 15 nt, Mycobacterium bovis subsp bovis AF2122/97
aguccgcugagcggg

SEQ ID NO: 1059703 - RNA, 12 nt, Mycobacterium bovis subsp bovis AF2122/97
agucccccgcuc

SEQ ID NO: 1059704 - RNA, 13 nt, Mycobacterium bovis subsp bovis AF2122/97
aguccccgccggc

SEQ ID NO: 1059705 - RNA, 14 nt, Mycobacterium bovis subsp bovis AF2122/97
aguccccgccggcc

SEQ ID NO: 1059706 - RNA, 20 nt, Mycobacterium bovis subsp bovis AF2122/97
aguccggcccccgacuccgg

SEQ ID NO: 1059707 - RNA, 14 nt, Mycobacterium bovis subsp bovis AF2122/97
aguccggccgaccc

SEQ ID NO: 1059708 - RNA, 20 nt, Mycobacterium bovis subsp bovis AF2122/97
aguccggacggcagccgggc

SEQ ID NO: 1059709 - RNA, 21 nt, Mycobacterium bovis subsp bovis AF2122/97
aguccgggccccuucgcagca

SEQ ID NO: 1059710 - RNA, 22 nt, Mycobacterium bovis subsp bovis AF2122/97
aguccggcucauccgacgggau

SEQ ID NO: 1059711 - RNA, 14 nt, Mycobacterium bovis subsp bovis AF2122/97
aguccgguagcagc

SEQ ID NO: 1059712 - RNA, 17 nt, Mycobacterium bovis subsp bovis AF2122/97
aguccgguuacgcucgc

SEQ ID NO: 1059713 - RNA, 17 nt, Mycobacterium bovis subsp bovis AF2122/97
aguccguacuugccacc

SEQ ID NO: 1059714 - RNA, 13 nt, Mycobacterium bovis subsp bovis AF2122/97
agucgccgucgug

SEQ ID NO: 1059715 - RNA, 11 nt, Mycobacterium bovis subsp bovis AF2122/97
agucgccggcc

SEQ ID NO: 1059716 - RNA, 12 nt, Mycobacterium bovis subsp bovis AF2122/97
agucgccggccg

SEQ ID NO: 1059717 - RNA, 13 nt, Mycobacterium bovis subsp bovis AF2122/97
agucgccggccgg

SEQ ID NO: 1059718 - RNA, 16 nt, Mycobacterium bovis subsp bovis AF2122/97
agucgcgaccgcgggc

SEQ ID NO: 1059719 - RNA, 19 nt, Mycobacterium bovis subsp bovis AF2122/97
agucgcgaacucaugcccg

SEQ ID NO: 1059720 - RNA, 23 nt, Mycobacterium bovis subsp bovis AF2122/97
agucgcgaacucaugcccgacga

SEQ ID NO: 1059721 - RNA, 21 nt, Mycobacterium bovis subsp bovis AF2122/97
aguccuccacuuuuccgccgg

SEQ ID NO: 1059722 - RNA, 23 nt, Mycobacterium bovis subsp bovis AF2122/97
aguccuccacuuuuccgccggcc

SEQ ID NO: 1059723 - RNA, 17 nt, Mycobacterium bovis subsp bovis AF2122/97
aguccucgagugccgcc

SEQ ID NO: 1059724 - RNA, 21 nt, Mycobacterium bovis subsp bovis AF2122/97
agucgccgaggucgaaccgcc

SEQ ID NO: 1059725 - RNA, 19 nt, Mycobacterium bovis subsp bovis AF2122/97
agucggccuccucgucgcu

SEQ ID NO: 1059726 - RNA, 14 nt, Mycobacterium bovis subsp bovis AF2122/97
agucggcgcuggcc

SEQ ID NO: 1059727 - RNA, 19 nt, Mycobacterium bovis subsp bovis AF2122/97
agucggcgggcgacaucga

SEQ ID NO: 1059728 - RNA, 15 nt, Mycobacterium bovis subsp bovis AF2122/97
agucggcggggcgga

SEQ ID NO: 1059729 - RNA, 14 nt, Mycobacterium bovis subsp bovis AF2122/97
agucggccagcucg

SEQ ID NO: 1059730 - RNA, 15 nt, Mycobacterium bovis subsp bovis AF2122/97
agucggccagcucgc

SEQ ID NO: 1059731 - RNA, 17 nt, Mycobacterium bovis subsp bovis AF2122/97
agucggagacccguccg

SEQ ID NO: 1059732 - RNA, 18 nt, Mycobacterium bovis subsp bovis AF2122/97
agucggagacccguccgg

SEQ ID NO: 1059733 - RNA, 18 nt, Mycobacterium bovis subsp bovis AF2122/97
agucgcgcagggcgacau

SEQ ID NO: 1059734 - RNA, 17 nt, Mycobacterium bovis subsp bovis AF2122/97
agucgcgguaccaucac

SEQ ID NO: 1059735 - RNA, 19 nt, Mycobacterium bovis subsp bovis AF2122/97
agucgcgguaccaucaccg

SEQ ID NO: 1059736 - RNA, 20 nt, Mycobacterium bovis subsp bovis AF2122/97
agucgcgguaccaucaccgc

SEQ ID NO: 1059737 - RNA, 18 nt, Mycobacterium bovis subsp bovis AF2122/97
agucgcggacgucgcccc

SEQ ID NO: 1059738 - RNA, 23 nt, Mycobacterium bovis subsp bovis AF2122/97
agucgucgacaguuuucaccgcg

SEQ ID NO: 1059739 - RNA, 15 nt, Mycobacterium bovis subsp bovis AF2122/97
agucguuccgccgcc

SEQ ID NO: 1059740 - RNA, 16 nt, Mycobacterium bovis subsp bovis AF2122/97
agucguagacggcgaa

SEQ ID NO: 1059741 - RNA, 21 nt, Mycobacterium bovis subsp bovis AF2122/97
agucguagcagguguaggugc

SEQ ID NO: 1059742 - RNA, 22 nt, Mycobacterium bovis subsp bovis AF2122/97
agucggugcggugcacacugac

SEQ ID NO: 1059743 - RNA, 23 nt, Mycobacterium bovis subsp bovis AF2122/97
agucguacucccaggccgccgcc

SEQ ID NO: 1059744 - RNA, 19 nt, Mycobacterium bovis subsp bovis AF2122/97
agucgggaagcgagcagcu

SEQ ID NO: 1059745 - RNA, 19 nt, Mycobacterium bovis subsp bovis AF2122/97
agucggcgccgccguccag

SEQ ID NO: 1059746 - RNA, 19 nt, Mycobacterium bovis subsp bovis AF2122/97
agucggcgucacgguggac

SEQ ID NO: 1059747 - RNA, 20 nt, Mycobacterium bovis subsp bovis AF2122/97
agucgggcaaggcggcggcc

SEQ ID NO: 1059748 - RNA, 14 nt, Mycobacterium bovis subsp bovis AF2122/97
agucuucggcgaca

SEQ ID NO: 1059749 - RNA, 16 nt, Mycobacterium bovis subsp bovis AF2122/97
agucuucaacgucgag

SEQ ID NO: 1059750 - RNA, 16 nt, Mycobacterium bovis subsp bovis AF2122/97
agucuuucccgccacc

SEQ ID NO: 1059751 - RNA, 17 nt, Mycobacterium bovis subsp bovis AF2122/97
agugaaaccaccggccg

SEQ ID NO: 1059752 - RNA, 16 nt, Mycobacterium bovis subsp bovis AF2122/97
agugaaauugccgccg

SEQ ID NO: 1059753 - RNA, 21 nt, Mycobacterium bovis subsp bovis AF2122/97
agugaacguaucgccucgagg

SEQ ID NO: 1059754 - RNA, 20 nt, Mycobacterium bovis subsp bovis AF2122/97
agugcccggccaaccaccaa

SEQ ID NO: 1059755 - RNA, 16 nt, Mycobacterium bovis subsp bovis AF2122/97
agugccgccgucgcca

SEQ ID NO: 1059756 - RNA, 22 nt, Mycobacterium bovis subsp bovis AF2122/97
agugccgccaccgccaccgcgg

SEQ ID NO: 1059757 - RNA, 15 nt, Mycobacterium bovis subsp bovis AF2122/97
agugccccgccgagc

SEQ ID NO: 1059758 - RNA, 18 nt, Mycobacterium bovis subsp bovis AF2122/97
agugccccgccgagcggu

SEQ ID NO: 1059759 - RNA, 14 nt, Mycobacterium bovis subsp bovis AF2122/97
agugccaggaucgc

SEQ ID NO: 1059760 - RNA, 21 nt, Mycobacterium bovis subsp bovis AF2122/97
agugccaggaucgcggcgccg

SEQ ID NO: 1059761 - RNA, 18 nt, Mycobacterium bovis subsp bovis AF2122/97
agugcaucgaucaccgcu

SEQ ID NO: 1059762 - RNA, 15 nt, Mycobacterium bovis subsp bovis AF2122/97
agugcaucggcagcc

SEQ ID NO: 1059763 - RNA, 13 nt, Mycobacterium bovis subsp bovis AF2122/97
agugcacccgggc

SEQ ID NO: 1059764 - RNA, 21 nt, Mycobacterium bovis subsp bovis AF2122/97
agugcauaucaaccccggugc

SEQ ID NO: 1059765 - RNA, 17 nt, Mycobacterium bovis subsp bovis AF2122/97
agugcagacaggcggcg

SEQ ID NO: 1059766 - RNA, 18 nt, Mycobacterium bovis subsp bovis AF2122/97
agugcagacaggcggcgg

SEQ ID NO: 1059767 - RNA, 20 nt, Mycobacterium bovis subsp bovis AF2122/97
agugcagacaggcggcggcc

SEQ ID NO: 1059768 - RNA, 23 nt, Mycobacterium bovis subsp bovis AF2122/97
agugcacggacaguuccccgggc

SEQ ID NO: 1059769 - RNA, 17 nt, Mycobacterium bovis subsp bovis AF2122/97
agugcacgucggcgggc

SEQ ID NO: 1059770 - RNA, 15 nt, Mycobacterium bovis subsp bovis AF2122/97
agugcagcgaucccg

SEQ ID NO: 1059771 - RNA, 22 nt, Mycobacterium bovis subsp bovis AF2122/97
agugcaggugcccggccaaaau

SEQ ID NO: 1059772 - RNA, 15 nt, Mycobacterium bovis subsp bovis AF2122/97
agugacucgaucacc

SEQ ID NO: 1059773 - RNA, 19 nt, Mycobacterium bovis subsp bovis AF2122/97
agugacgccucgacaccca

SEQ ID NO: 1059774 - RNA, 18 nt, Mycobacterium bovis subsp bovis AF2122/97
agugacgccacgaccgcc

SEQ ID NO: 1059775 - RNA, 23 nt, Mycobacterium bovis subsp bovis AF2122/97
agugacgccacgaccgccgauac

SEQ ID NO: 1059776 - RNA, 13 nt, Mycobacterium bovis subsp bovis AF2122/97
agugagcucggcu

SEQ ID NO: 1059777 - RNA, 18 nt, Mycobacterium bovis subsp bovis AF2122/97
agugcacgcucggcgccg

SEQ ID NO: 1059778 - RNA, 19 nt, Mycobacterium bovis subsp bovis AF2122/97
agugaucagcgcaucgccg

SEQ ID NO: 1059779 - RNA, 20 nt, Mycobacterium bovis subsp bovis AF2122/97
agugaucgaucgcggcgccc

SEQ ID NO: 1059780 - RNA, 14 nt, Mycobacterium bovis subsp bovis AF2122/97
agugcuccguccga

SEQ ID NO: 1059781 - RNA, 14 nt, Mycobacterium bovis subsp bovis AF2122/97
aguggcaaucccgc

SEQ ID NO: 1059782 - RNA, 15 nt, Mycobacterium bovis subsp bovis AF2122/97
aguggcaaucccgcc

SEQ ID NO: 1059783 - RNA, 16 nt, Mycobacterium bovis subsp bovis AF2122/97
aguggccacguugcgc

SEQ ID NO: 1059784 - RNA, 20 nt, Mycobacterium bovis subsp bovis AF2122/97
aguggccaguuggccggcca

SEQ ID NO: 1059785 - RNA, 14 nt, Mycobacterium bovis subsp bovis AF2122/97
aguggcccgcgggc

SEQ ID NO: 1059786 - RNA, 17 nt, Mycobacterium bovis subsp bovis AF2122/97
aguggcccgcgggcaag

SEQ ID NO: 1059787 - RNA, 23 nt, Mycobacterium bovis subsp bovis AF2122/97
aguggcccgcgggcaagccggac

SEQ ID NO: 1059788 - RNA, 17 nt, Mycobacterium bovis subsp bovis AF2122/97
aguggccgccacccgca

SEQ ID NO: 1059789 - RNA, 14 nt, Mycobacterium bovis subsp bovis AF2122/97
aguggccgggcggu

SEQ ID NO: 1059790 - RNA, 19 nt, Mycobacterium bovis subsp bovis AF2122/97
aguggccucguccagcucg

SEQ ID NO: 1059791 - RNA, 21 nt, Mycobacterium bovis subsp bovis AF2122/97
aguggccucguccagcucggu

SEQ ID NO: 1059792 - RNA, 15 nt, Mycobacterium bovis subsp bovis AF2122/97
agugcuuccggccau

SEQ ID NO: 1059793 - RNA, 19 nt, Mycobacterium bovis subsp bovis AF2122/97
agugcggugugugcaagcc

SEQ ID NO: 1059794 - RNA, 23 nt, Mycobacterium bovis subsp bovis AF2122/97
agugcggugugugcaagccgaac

SEQ ID NO: 1059795 - RNA, 17 nt, Mycobacterium bovis subsp bovis AF2122/97
agugcgucucgguggcu

SEQ ID NO: 1059796 - RNA, 15 nt, Mycobacterium bovis subsp bovis AF2122/97
agugcgaugcggugu

SEQ ID NO: 1059797 - RNA, 18 nt, Mycobacterium bovis subsp bovis AF2122/97
agugcgcacgguuggcgc

SEQ ID NO: 1059798 - RNA, 19 nt, Mycobacterium bovis subsp bovis AF2122/97
agugcgcagaacaccaccg

SEQ ID NO: 1059799 - RNA, 21 nt, Mycobacterium bovis subsp bovis AF2122/97
agugcgcagaacaccaccgcc

SEQ ID NO: 1059800 - RNA, 14 nt, Mycobacterium bovis subsp bovis AF2122/97
agugcgacccgggc

SEQ ID NO: 1059801 - RNA, 22 nt, Mycobacterium bovis subsp bovis AF2122/97
agugcgacguaaagggcgucgu

SEQ ID NO: 1059802 - RNA, 11 nt, Mycobacterium bovis subsp bovis AF2122/97
agugccggcgc

SEQ ID NO: 1059803 - RNA, 12 nt, Mycobacterium bovis subsp bovis AF2122/97
agugccucgcgg

SEQ ID NO: 1059804 - RNA, 16 nt, Mycobacterium bovis subsp bovis AF2122/97
agugccucgcguucgc

SEQ ID NO: 1059805 - RNA, 23 nt, Mycobacterium bovis subsp bovis AF2122/97
agugccucggcgaugggccgguc

SEQ ID NO: 1059806 - RNA, 12 nt, Mycobacterium bovis subsp bovis AF2122/97
agugcgccggcu

SEQ ID NO: 1059807 - RNA, 15 nt, Mycobacterium bovis subsp bovis AF2122/97
agugcgcagcccgca

SEQ ID NO: 1059808 - RNA, 15 nt, Mycobacterium bovis subsp bovis AF2122/97
agugcgcaucgccgg

SEQ ID NO: 1059809 - RNA, 17 nt, Mycobacterium bovis subsp bovis AF2122/97
agugcggcugcaacgau

SEQ ID NO: 1059810 - RNA, 22 nt, Mycobacterium bovis subsp bovis AF2122/97
agugcggcacgaucgccaacga

SEQ ID NO: 1059811 - RNA, 18 nt, Mycobacterium bovis subsp bovis AF2122/97
agugcggacuucgccgcc

SEQ ID NO: 1059812 - RNA, 20 nt, Mycobacterium bovis subsp bovis AF2122/97
agugcggacuucgccgcccg

SEQ ID NO: 1059813 - RNA, 14 nt, Mycobacterium bovis subsp bovis AF2122/97
agugcgggcaugcc

SEQ ID NO: 1059814 - RNA, 14 nt, Mycobacterium bovis subsp bovis AF2122/97
agugcgggcggcgu

SEQ ID NO: 1059815 - RNA, 23 nt, Mycobacterium bovis subsp bovis AF2122/97
agugcggccuuggcgacgucgcg

SEQ ID NO: 1059816 - RNA, 19 nt, Mycobacterium bovis subsp bovis AF2122/97
agugcgggggcgaccuggu

SEQ ID NO: 1059817 - RNA, 19 nt, Mycobacterium bovis subsp bovis AF2122/97
agugcggguggugagcuga

SEQ ID NO: 1059818 - RNA, 23 nt, Mycobacterium bovis subsp bovis AF2122/97
agugugcccugcuggugucggcu

SEQ ID NO: 1059819 - RNA, 17 nt, Mycobacterium bovis subsp bovis AF2122/97
agugggcguuggcggca

SEQ ID NO: 1059820 - RNA, 13 nt, Mycobacterium bovis subsp bovis AF2122/97
agugguaggccgc

SEQ ID NO: 1059821 - RNA, 18 nt, Mycobacterium bovis subsp bovis AF2122/97
agugggcuuuugcgucug

SEQ ID NO: 1059822 - RNA, 19 nt, Mycobacterium bovis subsp bovis AF2122/97
aguguguuugaguugcccg

SEQ ID NO: 1059823 - RNA, 22 nt, Mycobacterium bovis subsp bovis AF2122/97
agugggacaaagacgccgucgg

SEQ ID NO: 1059824 - RNA, 19 nt, Mycobacterium bovis subsp bovis AF2122/97
agugggcaauccggucagc

SEQ ID NO: 1059825 - RNA, 13 nt, Mycobacterium bovis subsp bovis AF2122/97
agugggccgacgu

SEQ ID NO: 1059826 - RNA, 17 nt, Mycobacterium bovis subsp bovis AF2122/97
aguggcuacgcgaucag

SEQ ID NO: 1059827 - RNA, 15 nt, Mycobacterium bovis subsp bovis AF2122/97
aguggcgcgcggcgc

SEQ ID NO: 1059828 - RNA, 17 nt, Mycobacterium bovis subsp bovis AF2122/97
aguggcgcgcggcgccg

SEQ ID NO: 1059829 - RNA, 16 nt, Mycobacterium bovis subsp bovis AF2122/97
aguggcgacgagcaac

SEQ ID NO: 1059830 - RNA, 19 nt, Mycobacterium bovis subsp bovis AF2122/97
aguucaacgaggccgacga

SEQ ID NO: 1059831 - RNA, 21 nt, Mycobacterium bovis subsp bovis AF2122/97
aguuaccgguggugcggcccu

SEQ ID NO: 1059832 - RNA, 21 nt, Mycobacterium bovis subsp bovis AF2122/97
aguucgcggccaucgccgaca

SEQ ID NO: 1059833 - RNA, 15 nt, Mycobacterium bovis subsp bovis AF2122/97
aguucgcugaccgcu

SEQ ID NO: 1059834 - RNA, 18 nt, Mycobacterium bovis subsp bovis AF2122/97
aguucgcugaccgcuacc

SEQ ID NO: 1059835 - RNA, 16 nt, Mycobacterium bovis subsp bovis AF2122/97
aguucaccaacgcggg

SEQ ID NO: 1059836 - RNA, 19 nt, Mycobacterium bovis subsp bovis AF2122/97
aguucaccaacgcgggaac

SEQ ID NO: 1059837 - RNA, 20 nt, Mycobacterium bovis subsp bovis AF2122/97
aguucgcacccguucgugag

SEQ ID NO: 1059838 - RNA, 12 nt, Mycobacterium bovis subsp bovis AF2122/97
aguuggcgcccg

SEQ ID NO: 1059839 - RNA, 13 nt, Mycobacterium bovis subsp bovis AF2122/97
aguuggccggcca

SEQ ID NO: 1059840 - RNA, 14 nt, Mycobacterium bovis subsp bovis AF2122/97
aguuggccguggcg

SEQ ID NO: 1059841 - RNA, 18 nt, Mycobacterium bovis subsp bovis AF2122/97
aguuggccaugcaccgau

SEQ ID NO: 1059842 - RNA, 17 nt, Mycobacterium bovis subsp bovis AF2122/97
aguuggaacugcccgau

SEQ ID NO: 1059843 - RNA, 15 nt, Mycobacterium bovis subsp bovis AF2122/97
aguugcgggugaugg

SEQ ID NO: 1059844 - RNA, 15 nt, Mycobacterium bovis subsp bovis AF2122/97
aguugcucgacacug

SEQ ID NO: 1059845 - RNA, 23 nt, Mycobacterium bovis subsp bovis AF2122/97
aguuggcguugucgguuggcagc

SEQ ID NO: 1059846 - RNA, 16 nt, Mycobacterium bovis subsp bovis AF2122/97
aguugguagccgcccu

SEQ ID NO: 1059847 - RNA, 21 nt, Mycobacterium bovis subsp bovis AF2122/97
aguugguccaggugaccgaga

SEQ ID NO: 1059848 - RNA, 16 nt, Mycobacterium bovis subsp bovis AF2122/97
aguuggcuugcgcgca

SEQ ID NO: 1059849 - RNA, 15 nt, Mycobacterium bovis subsp bovis AF2122/97
auacggguguggccg

SEQ ID NO: 1059850 - RNA, 15 nt, Mycobacterium bovis subsp bovis AF2122/97
auaccggcggcgagc

SEQ ID NO: 1059851 - RNA, 21 nt, Mycobacterium bovis subsp bovis AF2122/97
auaccgggaggacaccagcug

SEQ ID NO: 1059852 - RNA, 15 nt, Mycobacterium bovis subsp bovis AF2122/97
auaccgguggcagcc

SEQ ID NO: 1059853 - RNA, 23 nt, Mycobacterium bovis subsp bovis AF2122/97
auaccguucacccagcggaaccg

SEQ ID NO: 1059854 - RNA, 14 nt, Mycobacterium bovis subsp bovis AF2122/97
auacgaagccgccg

SEQ ID NO: 1059855 - RNA, 20 nt, Mycobacterium bovis subsp bovis AF2122/97
auaccugggacaggacgacu

SEQ ID NO: 1059856 - RNA, 15 nt, Mycobacterium bovis subsp bovis AF2122/97
auaccucgccgcccu

SEQ ID NO: 1059857 - RNA, 15 nt, Mycobacterium bovis subsp bovis AF2122/97
auacacggcggcgau

SEQ ID NO: 1059858 - RNA, 14 nt, Mycobacterium bovis subsp bovis AF2122/97
auaacgacucgaga

SEQ ID NO: 1059859 - RNA, 14 nt, Mycobacterium bovis subsp bovis AF2122/97
auaacgacucgcga

SEQ ID NO: 1059860 - RNA, 22 nt, Mycobacterium bovis subsp bovis AF2122/97
auaaccggcgcgccccgccgca

SEQ ID NO: 1059861 - RNA, 17 nt, Mycobacterium bovis subsp bovis AF2122/97
auaacccagcaccacaa

SEQ ID NO: 1059862 - RNA, 17 nt, Mycobacterium bovis subsp bovis AF2122/97
auaacccaaccgcgcca

SEQ ID NO: 1059863 - RNA, 18 nt, Mycobacterium bovis subsp bovis AF2122/97
auaagggagaccgcggcc

SEQ ID NO: 1059864 - RNA, 14 nt, Mycobacterium bovis subsp bovis AF2122/97
auagaacucgccgc

SEQ ID NO: 1059865 - RNA, 15 nt, Mycobacterium bovis subsp bovis AF2122/97
auagcucagaccggc

SEQ ID NO: 1059866 - RNA, 22 nt, Mycobacterium bovis subsp bovis AF2122/97
auagcggcggcggcacgcucgc

SEQ ID NO: 1059867 - RNA, 21 nt, Mycobacterium bovis subsp bovis AF2122/97
auagcgcggcaccagcaccgu

SEQ ID NO: 1059868 - RNA, 17 nt, Mycobacterium bovis subsp bovis AF2122/97
auaggccccgccagcgc

SEQ ID NO: 1059869 - RNA, 19 nt, Mycobacterium bovis subsp bovis AF2122/97
auaggcccgggcggccagc

SEQ ID NO: 1059870 - RNA, 15 nt, Mycobacterium bovis subsp bovis AF2122/97
auaggcaccaaggua

SEQ ID NO: 1059871 - RNA, 18 nt, Mycobacterium bovis subsp bovis AF2122/97
auagggccaccgccgccu

SEQ ID NO: 1059872 - RNA, 22 nt, Mycobacterium bovis subsp bovis AF2122/97
auaggucagaauugugugcagc

SEQ ID NO: 1059873 - RNA, 16 nt, Mycobacterium bovis subsp bovis AF2122/97
auaguucuggcccgca

SEQ ID NO: 1059874 - RNA, 17 nt, Mycobacterium bovis subsp bovis AF2122/97
auaguccuugcgccagc

SEQ ID NO: 1059875 - RNA, 15 nt, Mycobacterium bovis subsp bovis AF2122/97
auagucggccggcgg

SEQ ID NO: 1059876 - RNA, 21 nt, Mycobacterium bovis subsp bovis AF2122/97
auaucgggagcggcugcggca

SEQ ID NO: 1059877 - RNA, 15 nt, Mycobacterium bovis subsp bovis AF2122/97
auaucggugaccgug

SEQ ID NO: 1059878 - RNA, 23 nt, Mycobacterium bovis subsp bovis AF2122/97
auauaccagggcaucagcagagc

SEQ ID NO: 1059879 - RNA, 18 nt, Mycobacterium bovis subsp bovis AF2122/97
auaucgauaaccgcgacc

SEQ ID NO: 1059880 - RNA, 22 nt, Mycobacterium bovis subsp bovis AF2122/97
auauccgugaauggcagcacga

SEQ ID NO: 1059881 - RNA, 21 nt, Mycobacterium bovis subsp bovis AF2122/97
agcaccggggacagcccggca

SEQ ID NO: 1059882 - RNA, 16 nt, Mycobacterium bovis subsp bovis AF2122/97
agcaccgcgacgacga

SEQ ID NO: 1059883 - RNA, 21 nt, Mycobacterium bovis subsp bovis AF2122/97
agcaccgggaugugcggcugc

SEQ ID NO: 1059884 - RNA, 14 nt, Mycobacterium bovis subsp bovis AF2122/97
agcaccggcugcgg

SEQ ID NO: 1059885 - RNA, 22 nt, Mycobacterium bovis subsp bovis AF2122/97
agcaccggcugcggggcgaucc

SEQ ID NO: 1059886 - RNA, 19 nt, Mycobacterium bovis subsp bovis AF2122/97
agcaccguacggcgguccg

SEQ ID NO: 1059887 - RNA, 20 nt, Mycobacterium bovis subsp bovis AF2122/97
agcaccucagaaaguccccg

SEQ ID NO: 1059888 - RNA, 14 nt, Mycobacterium bovis subsp bovis AF2122/97
agcaccuccaccgc

SEQ ID NO: 1059889 - RNA, 17 nt, Mycobacterium bovis subsp bovis AF2122/97
agcaccuccaccgcgcc

SEQ ID NO: 1059890 - RNA, 11 nt, Mycobacterium bovis subsp bovis AF2122/97
agcaccgucgg

SEQ ID NO: 1059891 - RNA, 16 nt, Mycobacterium bovis subsp bovis AF2122/97
agcaccgugacagcgg

SEQ ID NO: 1059892 - RNA, 14 nt, Mycobacterium bovis subsp bovis AF2122/97
agcaccgugcccug

SEQ ID NO: 1059893 - RNA, 15 nt, Mycobacterium bovis subsp bovis AF2122/97
agcaccugcaccgca

SEQ ID NO: 1059894 - RNA, 16 nt, Mycobacterium bovis subsp bovis AF2122/97
agcaccugcaccgcau

SEQ ID NO: 1059895 - RNA, 15 nt, Mycobacterium bovis subsp bovis AF2122/97
agcaccucgaugaug

SEQ ID NO: 1059896 - RNA, 13 nt, Mycobacterium bovis subsp bovis AF2122/97
agcaccugcaccg

SEQ ID NO: 1059897 - RNA, 15 nt, Mycobacterium bovis subsp bovis AF2122/97
agcaccacgucgacg

SEQ ID NO: 1059898 - RNA, 14 nt, Mycobacterium bovis subsp bovis AF2122/97
agcaccacgugcga

SEQ ID NO: 1059899 - RNA, 13 nt, Mycobacterium bovis subsp bovis AF2122/97
agcaccggcaccc

SEQ ID NO: 1059900 - RNA, 16 nt, Mycobacterium bovis subsp bovis AF2122/97
agcaccggcacccgca

SEQ ID NO: 1059901 - RNA, 20 nt, Mycobacterium bovis subsp bovis AF2122/97
agcaccaccggaaccaccag

SEQ ID NO: 1059902 - RNA, 15 nt, Mycobacterium bovis subsp bovis AF2122/97
agcaccacggccagc

SEQ ID NO: 1059903 - RNA, 16 nt, Mycobacterium bovis subsp bovis AF2122/97
agcaccacaacgucgg

SEQ ID NO: 1059904 - RNA, 16 nt, Mycobacterium bovis subsp bovis AF2122/97
agcaccacaucgaagg

SEQ ID NO: 1059905 - RNA, 13 nt, Mycobacterium bovis subsp bovis AF2122/97
agcaccaccaccc

SEQ ID NO: 1059906 - RNA, 17 nt, Mycobacterium bovis subsp bovis AF2122/97
agcaccacaacgucggc

SEQ ID NO: 1059907 - RNA, 20 nt, Mycobacterium bovis subsp bovis AF2122/97
agcaccacccgggccucggc

SEQ ID NO: 1059908 - RNA, 15 nt, Mycobacterium bovis subsp bovis AF2122/97
agcacgaagcuggcg

SEQ ID NO: 1059909 - RNA, 13 nt, Mycobacterium bovis subsp bovis AF2122/97
agcacgccgccgg

SEQ ID NO: 1059910 - RNA, 21 nt, Mycobacterium bovis subsp bovis AF2122/97
agcacgaagcuggcgugcagc

SEQ ID NO: 1059911 - RNA, 22 nt, Mycobacterium bovis subsp bovis AF2122/97
agcacgccaacguugcgccagc

SEQ ID NO: 1059912 - RNA, 14 nt, Mycobacterium bovis subsp bovis AF2122/97
agcacgaugucgau

SEQ ID NO: 1059913 - RNA, 13 nt, Mycobacterium bovis subsp bovis AF2122/97
agcacggcaacca

SEQ ID NO: 1059914 - RNA, 19 nt, Mycobacterium bovis subsp bovis AF2122/97
agcacucggugucggccgc

SEQ ID NO: 1059915 - RNA, 20 nt, Mycobacterium bovis subsp bovis AF2122/97
agcacgcgugguucggucgg

SEQ ID NO: 1059916 - RNA, 13 nt, Mycobacterium bovis subsp bovis AF2122/97
agcacgccgggug

SEQ ID NO: 1059917 - RNA, 13 nt, Mycobacterium bovis subsp bovis AF2122/97
agcacgccgucca

SEQ ID NO: 1059918 - RNA, 20 nt, Mycobacterium bovis subsp bovis AF2122/97
agcacuuccaagccgaccug

SEQ ID NO: 1059919 - RNA, 21 nt, Mycobacterium bovis subsp bovis AF2122/97
agcacuuggacccggccggcc

SEQ ID NO: 1059920 - RNA, 23 nt, Mycobacterium bovis subsp bovis AF2122/97
agcagaaguccucggcggacccg

SEQ ID NO: 1059921 - RNA, 15 nt, Mycobacterium bovis subsp bovis AF2122/97
agcacaugcugccgc

SEQ ID NO: 1059922 - RNA, 16 nt, Mycobacterium bovis subsp bovis AF2122/97
agcacauucugcagcg

SEQ ID NO: 1059923 - RNA, 13 nt, Mycobacterium bovis subsp bovis AF2122/97
agcacaucgccgg

SEQ ID NO: 1059924 - RNA, 13 nt, Mycobacterium bovis subsp bovis AF2122/97
agcacagcgcagc

SEQ ID NO: 1059925 - RNA, 19 nt, Mycobacterium bovis subsp bovis AF2122/97
agcacauaugugcccggcg

SEQ ID NO: 1059926 - RNA, 12 nt, Mycobacterium bovis subsp bovis AF2122/97
agcacagcccgg

SEQ ID NO: 1059927 - RNA, 14 nt, Mycobacterium bovis subsp bovis AF2122/97
agcacagcccggcu

SEQ ID NO: 1059928 - RNA, 23 nt, Mycobacterium bovis subsp bovis AF2122/97
agcacacguccggcgaugaccag

SEQ ID NO: 1059929 - RNA, 23 nt, Mycobacterium bovis subsp bovis AF2122/97
agcacacucucgucguauugccu

SEQ ID NO: 1059930 - RNA, 23 nt, Mycobacterium bovis subsp bovis AF2122/97
agcacacuggccacaaucgcggu

SEQ ID NO: 1059931 - RNA, 14 nt, Mycobacterium bovis subsp bovis AF2122/97
agcacaccgccagc

SEQ ID NO: 1059932 - RNA, 15 nt, Mycobacterium bovis subsp bovis AF2122/97
agcacaccgccagcg

SEQ ID NO: 1059933 - RNA, 20 nt, Mycobacterium bovis subsp bovis AF2122/97
agcacaccgguugacagcuc

SEQ ID NO: 1059934 - RNA, 18 nt, Mycobacterium bovis subsp bovis AF2122/97
agcacaccguccgucggc

SEQ ID NO: 1059935 - RNA, 12 nt, Mycobacterium bovis subsp bovis AF2122/97
agcacaccgccc

SEQ ID NO: 1059936 - RNA, 15 nt, Mycobacterium bovis subsp bovis AF2122/97
agcaauacggcggcg

SEQ ID NO: 1059937 - RNA, 23 nt, Mycobacterium bovis subsp bovis AF2122/97
agcaagccagcaucggcagcagc

SEQ ID NO: 1059938 - RNA, 15 nt, Mycobacterium bovis subsp bovis AF2122/97
agcaagaucggcagc

SEQ ID NO: 1059939 - RNA, 17 nt, Mycobacterium bovis subsp bovis AF2122/97
agcaaagccagcgcagc

SEQ ID NO: 1059940 - RNA, 23 nt, Mycobacterium bovis subsp bovis AF2122/97
agcaaaccgaccgugaucagcgc

SEQ ID NO: 1059941 - RNA, 14 nt, Mycobacterium bovis subsp bovis AF2122/97
agcaaggcccgaaa

SEQ ID NO: 1059942 - RNA, 12 nt, Mycobacterium bovis subsp bovis AF2122/97
agauugcugacg

SEQ ID NO: 1059943 - RNA, 13 nt, Mycobacterium bovis subsp bovis AF2122/97
agauugccgagcc

SEQ ID NO: 1059944 - RNA, 18 nt, Mycobacterium bovis subsp bovis AF2122/97
agauugccgggccgccga

SEQ ID NO: 1059945 - RNA, 20 nt, Mycobacterium bovis subsp bovis AF2122/97
agauugccgggccgccgagc

SEQ ID NO: 1059946 - RNA, 22 nt, Mycobacterium bovis subsp bovis AF2122/97
agauugccgggccgccgagcgg

SEQ ID NO: 1059947 - RNA, 16 nt, Mycobacterium bovis subsp bovis AF2122/97
agaucagcggauccag

SEQ ID NO: 1059948 - RNA, 19 nt, Mycobacterium bovis subsp bovis AF2122/97
agauuucugggccgcucca

SEQ ID NO: 1059949 - RNA, 14 nt, Mycobacterium bovis subsp bovis AF2122/97
agauuucuugaccg

SEQ ID NO: 1059950 - RNA, 16 nt, Mycobacterium bovis subsp bovis AF2122/97
agcaaaauggccaccg

SEQ ID NO: 1059951 - RNA, 20 nt, Mycobacterium bovis subsp bovis AF2122/97
agcaaaauggccaccggcgg

SEQ ID NO: 1059952 - RNA, 18 nt, Mycobacterium bovis subsp bovis AF2122/97
agcaaacacgccucgccg

SEQ ID NO: 1059953 - RNA, 16 nt, Mycobacterium bovis subsp bovis AF2122/97
agauccacgccgacca

SEQ ID NO: 1059954 - RNA, 17 nt, Mycobacterium bovis subsp bovis AF2122/97
agauccagggagcggcu

SEQ ID NO: 1059955 - RNA, 15 nt, Mycobacterium bovis subsp bovis AF2122/97
agaucaugccggcga

SEQ ID NO: 1059956 - RNA, 16 nt, Mycobacterium bovis subsp bovis AF2122/97
agauccgacgaccgca

SEQ ID NO: 1059957 - RNA, 12 nt, Mycobacterium bovis subsp bovis AF2122/97
agauccgccacg

SEQ ID NO: 1059958 - RNA, 18 nt, Mycobacterium bovis subsp bovis AF2122/97
agauccauuggaugccau

SEQ ID NO: 1059959 - RNA, 14 nt, Mycobacterium bovis subsp bovis AF2122/97
agauccccgccacc

SEQ ID NO: 1059960 - RNA, 19 nt, Mycobacterium bovis subsp bovis AF2122/97
agauccccgccaccgaacg

SEQ ID NO: 1059961 - RNA, 14 nt, Mycobacterium bovis subsp bovis AF2122/97
agcaggacaccuac

SEQ ID NO: 1059962 - RNA, 20 nt, Mycobacterium bovis subsp bovis AF2122/97
agcagcugggcaucaccgcc

SEQ ID NO: 1059963 - RNA, 21 nt, Mycobacterium bovis subsp bovis AF2122/97
agcagcugggcaucaccgccg

SEQ ID NO: 1059964 - RNA, 23 nt, Mycobacterium bovis subsp bovis AF2122/97
agcaggccacugcguuccaucgc

SEQ ID NO: 1059965 - RNA, 20 nt, Mycobacterium bovis subsp bovis AF2122/97
agcaggaugaugaccgccau

SEQ ID NO: 1059966 - RNA, 18 nt, Mycobacterium bovis subsp bovis AF2122/97
agcagcgccggcaccgac

SEQ ID NO: 1059967 - RNA, 17 nt, Mycobacterium bovis subsp bovis AF2122/97
agcagcgguugaugcgg

SEQ ID NO: 1059968 - RNA, 19 nt, Mycobacterium bovis subsp bovis AF2122/97
agcagcggcggaaggacgg

SEQ ID NO: 1059969 - RNA, 23 nt, Mycobacterium bovis subsp bovis AF2122/97
agcagcggcggaaggacggcagc

SEQ ID NO: 1059970 - RNA, 22 nt, Mycobacterium bovis subsp bovis AF2122/97
agcagcggcucuauccggcgca

SEQ ID NO: 1059971 - RNA, 15 nt, Mycobacterium bovis subsp bovis AF2122/97
agcagcgcggccaga

SEQ ID NO: 1059972 - RNA, 21 nt, Mycobacterium bovis subsp bovis AF2122/97
agcagcgcggccagagccgcg

SEQ ID NO: 1059973 - RNA, 17 nt, Mycobacterium bovis subsp bovis AF2122/97
agcagcgucaucagguc

SEQ ID NO: 1059974 - RNA, 15 nt, Mycobacterium bovis subsp bovis AF2122/97
agcagcgucggugcc

SEQ ID NO: 1059975 - RNA, 20 nt, Mycobacterium bovis subsp bovis AF2122/97
agcagcucaaugucgaagac

SEQ ID NO: 1059976 - RNA, 12 nt, Mycobacterium bovis subsp bovis AF2122/97
agcagcucgccg

SEQ ID NO: 1059977 - RNA, 13 nt, Mycobacterium bovis subsp bovis AF2122/97
agcagcucgccgg

SEQ ID NO: 1059978 - RNA, 16 nt, Mycobacterium bovis subsp bovis AF2122/97
agcagcucgccggcac

SEQ ID NO: 1059979 - RNA, 14 nt, Mycobacterium bovis subsp bovis AF2122/97
agcagccgcgacau

SEQ ID NO: 1059980 - RNA, 13 nt, Mycobacterium bovis subsp bovis AF2122/97
agcagccgccgau

SEQ ID NO: 1059981 - RNA, 14 nt, Mycobacterium bovis subsp bovis AF2122/97
agcagccgccggcc

SEQ ID NO: 1059982 - RNA, 17 nt, Mycobacterium bovis subsp bovis AF2122/97
agcagccugcgccgcgc

SEQ ID NO: 1059983 - RNA, 14 nt, Mycobacterium bovis subsp bovis AF2122/97
agcagcgacgguca

SEQ ID NO: 1059984 - RNA, 20 nt, Mycobacterium bovis subsp bovis AF2122/97
agcagcgacgcugccgccag

SEQ ID NO: 1059985 - RNA, 13 nt, Mycobacterium bovis subsp bovis AF2122/97
agcagcgcgccgu

SEQ ID NO: 1059986 - RNA, 17 nt, Mycobacterium bovis subsp bovis AF2122/97
agcagcgcgccguucgc

SEQ ID NO: 1059987 - RNA, 14 nt, Mycobacterium bovis subsp bovis AF2122/97
agcagcgccagcag

SEQ ID NO: 1059988 - RNA, 16 nt, Mycobacterium bovis subsp bovis AF2122/97
agcagcgccacccgcg

SEQ ID NO: 1059989 - RNA, 17 nt, Mycobacterium bovis subsp bovis AF2122/97
agcagcgccacccgcgu

SEQ ID NO: 1059990 - RNA, 18 nt, Mycobacterium bovis subsp bovis AF2122/97
agcagacacagaaucgca

SEQ ID NO: 1059991 - RNA, 20 nt, Mycobacterium bovis subsp bovis AF2122/97
agcagacacuaaagcccucg

SEQ ID NO: 1059992 - RNA, 17 nt, Mycobacterium bovis subsp bovis AF2122/97
agcagaccaagcccuag

SEQ ID NO: 1059993 - RNA, 17 nt, Mycobacterium bovis subsp bovis AF2122/97
agcagaccaaguccggu

SEQ ID NO: 1059994 - RNA, 23 nt, Mycobacterium bovis subsp bovis AF2122/97
agcagauacuuguugaagccgau

SEQ ID NO: 1059995 - RNA, 20 nt, Mycobacterium bovis subsp bovis AF2122/97
agcagacacagaaucgccca

SEQ ID NO: 1059996 - RNA, 13 nt, Mycobacterium bovis subsp bovis AF2122/97
agcagagcggcac

SEQ ID NO: 1059997 - RNA, 14 nt, Mycobacterium bovis subsp bovis AF2122/97
agcagagcggcacg

SEQ ID NO: 1059998 - RNA, 14 nt, Mycobacterium bovis subsp bovis AF2122/97
agcagauccgcgau

SEQ ID NO: 1059999 - RNA, 16 nt, Mycobacterium bovis subsp bovis AF2122/97
agcagauccuggccgg

SEQ ID NO: 1060000 - RNA, 16 nt, Mycobacterium bovis subsp bovis AF2122/97
agcagauugucgacgg

SEQ ID NO: 1060001 - RNA, 21 nt, Mycobacterium bovis subsp bovis AF2122/97
agcagcaaaacccgagccugg

SEQ ID NO: 1060002 - RNA, 16 nt, Mycobacterium bovis subsp bovis AF2122/97
agcagcaccacccgca

SEQ ID NO: 1060003 - RNA, 19 nt, Mycobacterium bovis subsp bovis AF2122/97
agcagccgaugcugcgggc

SEQ ID NO: 1060004 - RNA, 15 nt, Mycobacterium bovis subsp bovis AF2122/97
agcagcaagccgccg

SEQ ID NO: 1060005 - RNA, 12 nt, Mycobacterium bovis subsp bovis AF2122/97
agcagcaccacc

SEQ ID NO: 1060006 - RNA, 17 nt, Mycobacterium bovis subsp bovis AF2122/97
agcaggcccauaccgau

SEQ ID NO: 1060007 - RNA, 16 nt, Mycobacterium bovis subsp bovis AF2122/97
agcaggccgggacagc

SEQ ID NO: 1060008 - RNA, 13 nt, Mycobacterium bovis subsp bovis AF2122/97
agcaggccgggcg

SEQ ID NO: 1060009 - RNA, 15 nt, Mycobacterium bovis subsp bovis AF2122/97
agcaggccgggcgca

SEQ ID NO: 1060010 - RNA, 21 nt, Mycobacterium bovis subsp bovis AF2122/97
agcaggggacgaccaugccga

SEQ ID NO: 1060011 - RNA, 20 nt, Mycobacterium bovis subsp bovis AF2122/97
agcaggggacgggcggccag

SEQ ID NO: 1060012 - RNA, 17 nt, Mycobacterium bovis subsp bovis AF2122/97
agcaggggaucguccgg

SEQ ID NO: 1060013 - RNA, 19 nt, Mycobacterium bovis subsp bovis AF2122/97
agcagguacaucaccacga

SEQ ID NO: 1060014 - RNA, 20 nt, Mycobacterium bovis subsp bovis AF2122/97
agcagguacaucaccacgau

SEQ ID NO: 1060015 - RNA, 12 nt, Mycobacterium bovis subsp bovis AF2122/97
agcagugcgggg

SEQ ID NO: 1060016 - RNA, 23 nt, Mycobacterium bovis subsp bovis AF2122/97
agcagugcgguaaagaucuuguc

SEQ ID NO: 1060017 - RNA, 17 nt, Mycobacterium bovis subsp bovis AF2122/97
agcauauccgccggcga

SEQ ID NO: 1060018 - RNA, 13 nt, Mycobacterium bovis subsp bovis AF2122/97
agcauaccgccgc

SEQ ID NO: 1060019 - RNA, 20 nt, Mycobacterium bovis subsp bovis AF2122/97
agcaugucucgggcgcgggu

SEQ ID NO: 1060020 - RNA, 22 nt, Mycobacterium bovis subsp bovis AF2122/97
agcaugucgcggacccgcgcgu

SEQ ID NO: 1060021 - RNA, 15 nt, Mycobacterium bovis subsp bovis AF2122/97
agcauugaguucggc

SEQ ID NO: 1060022 - RNA, 23 nt, Mycobacterium bovis subsp bovis AF2122/97
agcauugaguucggccaccaacc

SEQ ID NO: 1060023 - RNA, 16 nt, Mycobacterium bovis subsp bovis AF2122/97
agcauugaccaaucca

SEQ ID NO: 1060024 - RNA, 15 nt, Mycobacterium bovis subsp bovis AF2122/97
agccacagcccggcg

SEQ ID NO: 1060025 - RNA, 22 nt, Mycobacterium bovis subsp bovis AF2122/97
agccacauacaggcccgccagc

SEQ ID NO: 1060026 - RNA, 20 nt, Mycobacterium bovis subsp bovis AF2122/97
agccacauacaggcccgcca

SEQ ID NO: 1060027 - RNA, 18 nt, Mycobacterium bovis subsp bovis AF2122/97
agccaccccugcgguccg

SEQ ID NO: 1060028 - RNA, 15 nt, Mycobacterium bovis subsp bovis AF2122/97
agccaccaacaccgc

SEQ ID NO: 1060029 - RNA, 12 nt, Mycobacterium bovis subsp bovis AF2122/97
agccaccaccag

SEQ ID NO: 1060030 - RNA, 11 nt, Mycobacterium bovis subsp bovis AF2122/97
agcaucggcac

SEQ ID NO: 1060031 - RNA, 13 nt, Mycobacterium bovis subsp bovis AF2122/97
agcaucggcaccc

SEQ ID NO: 1060032 - RNA, 14 nt, Mycobacterium bovis subsp bovis AF2122/97
agcaucggcacccc

SEQ ID NO: 1060033 - RNA, 16 nt, Mycobacterium bovis subsp bovis AF2122/97
agcaucggcagcagcg

SEQ ID NO: 1060034 - RNA, 16 nt, Mycobacterium bovis subsp bovis AF2122/97
agcaucuccgccgguc

SEQ ID NO: 1060035 - RNA, 17 nt, Mycobacterium bovis subsp bovis AF2122/97
agcaucuccgucggcca

SEQ ID NO: 1060036 - RNA, 19 nt, Mycobacterium bovis subsp bovis AF2122/97
agcaucuccgucggccagg

SEQ ID NO: 1060037 - RNA, 21 nt, Mycobacterium bovis subsp bovis AF2122/97
agcaucuccgucggccaggcc

SEQ ID NO: 1060038 - RNA, 12 nt, Mycobacterium bovis subsp bovis AF2122/97
agcauggugcgg

SEQ ID NO: 1060039 - RNA, 18 nt, Mycobacterium bovis subsp bovis AF2122/97
agacgcggaaucgcaccg

SEQ ID NO: 1060040 - RNA, 20 nt, Mycobacterium bovis subsp bovis AF2122/97
agacgcgaaaucccccgaca

SEQ ID NO: 1060041 - RNA, 22 nt, Mycobacterium bovis subsp bovis AF2122/97
agacgcgaaaucccccgacacg

SEQ ID NO: 1060042 - RNA, 18 nt, Mycobacterium bovis subsp bovis AF2122/97
agacgccgucgacgucga

SEQ ID NO: 1060043 - RNA, 19 nt, Mycobacterium bovis subsp bovis AF2122/97
agacgccgucgacgucgau

SEQ ID NO: 1060044 - RNA, 19 nt, Mycobacterium bovis subsp bovis AF2122/97
agacgccgucggcgccggc

SEQ ID NO: 1060045 - RNA, 16 nt, Mycobacterium bovis subsp bovis AF2122/97
agacgccgacuccgcg

SEQ ID NO: 1060046 - RNA, 12 nt, Mycobacterium bovis subsp bovis AF2122/97
agacgccgccgc

SEQ ID NO: 1060047 - RNA, 16 nt, Mycobacterium bovis subsp bovis AF2122/97
agacgccacugccagc

SEQ ID NO: 1060048 - RNA, 20 nt, Mycobacterium bovis subsp bovis AF2122/97
agacgcauaagcccccgaca

SEQ ID NO: 1060049 - RNA, 20 nt, Mycobacterium bovis subsp bovis AF2122/97
agacgcagaaucgcccaauu

SEQ ID NO: 1060050 - RNA, 17 nt, Mycobacterium bovis subsp bovis AF2122/97
agacgcagagucgcacu

SEQ ID NO: 1060051 - RNA, 22 nt, Mycobacterium bovis subsp bovis AF2122/97
agacgcacggccaccgcgcaac

SEQ ID NO: 1060052 - RNA, 17 nt, Mycobacterium bovis subsp bovis AF2122/97
agacgcagaagccccca

SEQ ID NO: 1060053 - RNA, 20 nt, Mycobacterium bovis subsp bovis AF2122/97
agacgcagaaucgcacgcga

SEQ ID NO: 1060054 - RNA, 19 nt, Mycobacterium bovis subsp bovis AF2122/97
agacgcagaaucgcccaau

SEQ ID NO: 1060055 - RNA, 17 nt, Mycobacterium bovis subsp bovis AF2122/97
agacgaaccgccgacgg

SEQ ID NO: 1060056 - RNA, 16 nt, Mycobacterium bovis subsp bovis AF2122/97
agaccuucucgccgcc

SEQ ID NO: 1060057 - RNA, 18 nt, Mycobacterium bovis subsp bovis AF2122/97
agaccuucucgccgccgc

SEQ ID NO: 1060058 - RNA, 22 nt, Mycobacterium bovis subsp bovis AF2122/97
agacgacaucgucaucagcgcg

SEQ ID NO: 1060059 - RNA, 16 nt, Mycobacterium bovis subsp bovis AF2122/97
agacgacaucgucauc

SEQ ID NO: 1060060 - RNA, 16 nt, Mycobacterium bovis subsp bovis AF2122/97
agacgaauaacgccgc

SEQ ID NO: 1060061 - RNA, 20 nt, Mycobacterium bovis subsp bovis AF2122/97
agacgcaaaaucgcccaauu

SEQ ID NO: 1060062 - RNA, 20 nt, Mycobacterium bovis subsp bovis AF2122/97
agacgcaaaaagcuccaaau

SEQ ID NO: 1060063 - RNA, 20 nt, Mycobacterium bovis subsp bovis AF2122/97
agacgcaaaaucgcccgaaa

SEQ ID NO: 1060064 - RNA, 19 nt, Mycobacterium bovis subsp bovis AF2122/97
agacgcaaaaucgcccauu

SEQ ID NO: 1060065 - RNA, 19 nt, Mycobacterium bovis subsp bovis AF2122/97
agacgcaaaaucgcccgaa

SEQ ID NO: 1060066 - RNA, 20 nt, Mycobacterium bovis subsp bovis AF2122/97
agaccgucgauccgucggcg

SEQ ID NO: 1060067 - RNA, 17 nt, Mycobacterium bovis subsp bovis AF2122/97
agaccuagcaccgcgcc

SEQ ID NO: 1060068 - RNA, 13 nt, Mycobacterium bovis subsp bovis AF2122/97
agaccucgucgcg

SEQ ID NO: 1060069 - RNA, 17 nt, Mycobacterium bovis subsp bovis AF2122/97
agaccuggccgucgcug

SEQ ID NO: 1060070 - RNA, 22 nt, Mycobacterium bovis subsp bovis AF2122/97
agaccuggccgucgcugguggc

SEQ ID NO: 1060071 - RNA, 15 nt, Mycobacterium bovis subsp bovis AF2122/97
agaccugucgguacc

SEQ ID NO: 1060072 - RNA, 22 nt, Mycobacterium bovis subsp bovis AF2122/97
agaccugucgguaccgcccagu

SEQ ID NO: 1060073 - RNA, 21 nt, Mycobacterium bovis subsp bovis AF2122/97
agaccgguuucuucggccagc

SEQ ID NO: 1060074 - RNA, 17 nt, Mycobacterium bovis subsp bovis AF2122/97
agaccggcucgucgggc

SEQ ID NO: 1060075 - RNA, 19 nt, Mycobacterium bovis subsp bovis AF2122/97
agaccggugagcaccggau

SEQ ID NO: 1060076 - RNA, 21 nt, Mycobacterium bovis subsp bovis AF2122/97
agaccgggugggucguucacc

SEQ ID NO: 1060077 - RNA, 13 nt, Mycobacterium bovis subsp bovis AF2122/97
agaccgcggcggc

SEQ ID NO: 1060078 - RNA, 16 nt, Mycobacterium bovis subsp bovis AF2122/97
agaccgcgucggcggc

SEQ ID NO: 1060079 - RNA, 20 nt, Mycobacterium bovis subsp bovis AF2122/97
agaccgcgucggcggccagu

SEQ ID NO: 1060080 - RNA, 13 nt, Mycobacterium bovis subsp bovis AF2122/97
agaccgccaccgg

SEQ ID NO: 1060081 - RNA, 13 nt, Mycobacterium bovis subsp bovis AF2122/97
agaccgccgacgc

SEQ ID NO: 1060082 - RNA, 15 nt, Mycobacterium bovis subsp bovis AF2122/97
agaccgccgacgccg

SEQ ID NO: 1060083 - RNA, 21 nt, Mycobacterium bovis subsp bovis AF2122/97
agaccgccgcugccgccgagc

SEQ ID NO: 1060084 - RNA, 21 nt, Mycobacterium bovis subsp bovis AF2122/97
agaccgccuccaccgccgcgc

SEQ ID NO: 1060085 - RNA, 23 nt, Mycobacterium bovis subsp bovis AF2122/97
agaccgcgaacagcgggggcagc

SEQ ID NO: 1060086 - RNA, 14 nt, Mycobacterium bovis subsp bovis AF2122/97
agaccgcgagcagc

SEQ ID NO: 1060087 - RNA, 21 nt, Mycobacterium bovis subsp bovis AF2122/97
agaccgcgagcagcacagcau

SEQ ID NO: 1060088 - RNA, 13 nt, Mycobacterium bovis subsp bovis AF2122/97
agacccgguggcg

SEQ ID NO: 1060089 - RNA, 14 nt, Mycobacterium bovis subsp bovis AF2122/97
agacccgucaccgc

SEQ ID NO: 1060090 - RNA, 19 nt, Mycobacterium bovis subsp bovis AF2122/97
agacccgugagcggagcaa

SEQ ID NO: 1060091 - RNA, 12 nt, Mycobacterium bovis subsp bovis AF2122/97
agacccacgaug

SEQ ID NO: 1060092 - RNA, 17 nt, Mycobacterium bovis subsp bovis AF2122/97
agacccagcgcggcaac

SEQ ID NO: 1060093 - RNA, 18 nt, Mycobacterium bovis subsp bovis AF2122/97
agacccaccaccgcaacc

SEQ ID NO: 1060094 - RNA, 17 nt, Mycobacterium bovis subsp bovis AF2122/97
agaccgacagcggcacc

SEQ ID NO: 1060095 - RNA, 15 nt, Mycobacterium bovis subsp bovis AF2122/97
agaccgaacagcacc

SEQ ID NO: 1060096 - RNA, 17 nt, Mycobacterium bovis subsp bovis AF2122/97
agaccgaacagcggcag

SEQ ID NO: 1060097 - RNA, 14 nt, Mycobacterium bovis subsp bovis AF2122/97
agaccgagcccgau

SEQ ID NO: 1060098 - RNA, 14 nt, Mycobacterium bovis subsp bovis AF2122/97
agaccgaucggcag

SEQ ID NO: 1060099 - RNA, 13 nt, Mycobacterium bovis subsp bovis AF2122/97
agaccgcagucgc

SEQ ID NO: 1060100 - RNA, 16 nt, Mycobacterium bovis subsp bovis AF2122/97
agaccaggccggugac

SEQ ID NO: 1060101 - RNA, 13 nt, Mycobacterium bovis subsp bovis AF2122/97
agaccagggcagc

SEQ ID NO: 1060102 - RNA, 18 nt, Mycobacterium bovis subsp bovis AF2122/97
agaccagggcagcggcca

SEQ ID NO: 1060103 - RNA, 15 nt, Mycobacterium bovis subsp bovis AF2122/97
agaccaccgcccaca

SEQ ID NO: 1060104 - RNA, 14 nt, Mycobacterium bovis subsp bovis AF2122/97
agaccaccggcagc

SEQ ID NO: 1060105 - RNA, 13 nt, Mycobacterium bovis subsp bovis AF2122/97
agauacgagcugu

SEQ ID NO: 1060106 - RNA, 21 nt, Mycobacterium bovis subsp bovis AF2122/97
agauacucgaguggcgaacgg

SEQ ID NO: 1060107 - RNA, 21 nt, Mycobacterium bovis subsp bovis AF2122/97
agauacgcguguggcagaugu

SEQ ID NO: 1060108 - RNA, 15 nt, Mycobacterium bovis subsp bovis AF2122/97
agauaccaccgccgc

SEQ ID NO: 1060109 - RNA, 21 nt, Mycobacterium bovis subsp bovis AF2122/97
agagcgaacccccgccgcgca

SEQ ID NO: 1060110 - RNA, 13 nt, Mycobacterium bovis subsp bovis AF2122/97
agagccggcggcg

SEQ ID NO: 1060111 - RNA, 14 nt, Mycobacterium bovis subsp bovis AF2122/97
agagccggcggcga

SEQ ID NO: 1060112 - RNA, 19 nt, Mycobacterium bovis subsp bovis AF2122/97
agagccccggcaagcgcag

SEQ ID NO: 1060113 - RNA, 13 nt, Mycobacterium bovis subsp bovis AF2122/97
agagccgaccggg

SEQ ID NO: 1060114 - RNA, 19 nt, Mycobacterium bovis subsp bovis AF2122/97
agagccgacgugcggcggc

SEQ ID NO: 1060115 - RNA, 15 nt, Mycobacterium bovis subsp bovis AF2122/97
agagcaugccgcccg

SEQ ID NO: 1060116 - RNA, 17 nt, Mycobacterium bovis subsp bovis AF2122/97
agagcaugccgcccgcg

SEQ ID NO: 1060117 - RNA, 15 nt, Mycobacterium bovis subsp bovis AF2122/97
agagaacuccgccac

SEQ ID NO: 1060118 - RNA, 13 nt, Mycobacterium bovis subsp bovis AF2122/97
agacugcgcggca

SEQ ID NO: 1060119 - RNA, 12 nt, Mycobacterium bovis subsp bovis AF2122/97
agacugccgccg

SEQ ID NO: 1060120 - RNA, 14 nt, Mycobacterium bovis subsp bovis AF2122/97
agacuugccgagug

SEQ ID NO: 1060121 - RNA, 23 nt, Mycobacterium bovis subsp bovis AF2122/97
agacuugcuggcccgcacgaacc

SEQ ID NO: 1060122 - RNA, 21 nt, Mycobacterium bovis subsp bovis AF2122/97
agacuguugucccuauaccgc

SEQ ID NO: 1060123 - RNA, 16 nt, Mycobacterium bovis subsp bovis AF2122/97
agacuucuucgacgcg

SEQ ID NO: 1060124 - RNA, 20 nt, Mycobacterium bovis subsp bovis AF2122/97
agacggggcgagcaugccgu

SEQ ID NO: 1060125 - RNA, 16 nt, Mycobacterium bovis subsp bovis AF2122/97
agacggggucgcccgg

SEQ ID NO: 1060126 - RNA, 19 nt, Mycobacterium bovis subsp bovis AF2122/97
agacggggucgcccggggc

SEQ ID NO: 1060127 - RNA, 13 nt, Mycobacterium bovis subsp bovis AF2122/97
agacggugcgggc

SEQ ID NO: 1060128 - RNA, 17 nt, Mycobacterium bovis subsp bovis AF2122/97
agacguaaccgcuggcc

SEQ ID NO: 1060129 - RNA, 14 nt, Mycobacterium bovis subsp bovis AF2122/97
agacguccgcgguc

SEQ ID NO: 1060130 - RNA, 15 nt, Mycobacterium bovis subsp bovis AF2122/97
agacguccgcggucg

SEQ ID NO: 1060131 - RNA, 20 nt, Mycobacterium bovis subsp bovis AF2122/97
agacguccgcggucgcagca

SEQ ID NO: 1060132 - RNA, 20 nt, Mycobacterium bovis subsp bovis AF2122/97
agacguauaucgguugcugc

SEQ ID NO: 1060133 - RNA, 19 nt, Mycobacterium bovis subsp bovis AF2122/97
agacuccagcaaggccagc

SEQ ID NO: 1060134 - RNA, 14 nt, Mycobacterium bovis subsp bovis AF2122/97
agacucgccaccgc

SEQ ID NO: 1060135 - RNA, 13 nt, Mycobacterium bovis subsp bovis AF2122/97
agacgcugcgcgc

SEQ ID NO: 1060136 - RNA, 13 nt, Mycobacterium bovis subsp bovis AF2122/97
agacggcggcauc

SEQ ID NO: 1060137 - RNA, 14 nt, Mycobacterium bovis subsp bovis AF2122/97
agacggcgacgaug

SEQ ID NO: 1060138 - RNA, 22 nt, Mycobacterium bovis subsp bovis AF2122/97
agacgcggaaucgcaucggcgg

SEQ ID NO: 1060139 - RNA, 16 nt, Mycobacterium bovis subsp bovis AF2122/97
agacgcuuuccgccgc

SEQ ID NO: 1060140 - RNA, 17 nt, Mycobacterium bovis subsp bovis AF2122/97
agacgcuuuccgccgca

SEQ ID NO: 1060141 - RNA, 23 nt, Mycobacterium bovis subsp bovis AF2122/97
agacgcguuucgucgaccgcgcc

SEQ ID NO: 1060142 - RNA, 13 nt, Mycobacterium bovis subsp bovis AF2122/97
agacgcucgaccu

SEQ ID NO: 1060143 - RNA, 23 nt, Mycobacterium bovis subsp bovis AF2122/97
agaacuuguuugucaccgcagcc

SEQ ID NO: 1060144 - RNA, 14 nt, Mycobacterium bovis subsp bovis AF2122/97
agaagcccgaaguc

SEQ ID NO: 1060145 - RNA, 17 nt, Mycobacterium bovis subsp bovis AF2122/97
agaagaugaucgcgaac

SEQ ID NO: 1060146 - RNA, 12 nt, Mycobacterium bovis subsp bovis AF2122/97
agaagcccgaag

SEQ ID NO: 1060147 - RNA, 17 nt, Mycobacterium bovis subsp bovis AF2122/97
agaacucggugccccca

SEQ ID NO: 1060148 - RNA, 19 nt, Mycobacterium bovis subsp bovis AF2122/97
agaacgucaaacccagcga

SEQ ID NO: 1060149 - RNA, 23 nt, Mycobacterium bovis subsp bovis AF2122/97
agaacggcguugcggaaucagca

SEQ ID NO: 1060150 - RNA, 23 nt, Mycobacterium bovis subsp bovis AF2122/97
agaacggauaauucaacagcacc

SEQ ID NO: 1060151 - RNA, 15 nt, Mycobacterium bovis subsp bovis AF2122/97
agaacggaugccggu

SEQ ID NO: 1060152 - RNA, 20 nt, Mycobacterium bovis subsp bovis AF2122/97
agaaccuggagccgugcggu

SEQ ID NO: 1060153 - RNA, 15 nt, Mycobacterium bovis subsp bovis AF2122/97
agaaccggccgacga

SEQ ID NO: 1060154 - RNA, 20 nt, Mycobacterium bovis subsp bovis AF2122/97
agaaccggguaaugcgacgc

SEQ ID NO: 1060155 - RNA, 23 nt, Mycobacterium bovis subsp bovis AF2122/97
agaaccggguaaugcgacgccgg

SEQ ID NO: 1060156 - RNA, 14 nt, Mycobacterium bovis subsp bovis AF2122/97
agaacgacgccacc

SEQ ID NO: 1060157 - RNA, 15 nt, Mycobacterium bovis subsp bovis AF2122/97
agaaccuggagccgu

SEQ ID NO: 1060158 - RNA, 18 nt, Mycobacterium bovis subsp bovis AF2122/97
agaacgauguccgcgcga

SEQ ID NO: 1060159 - RNA, 21 nt, Mycobacterium bovis subsp bovis AF2122/97
agaacauguaggucgccgcuu

SEQ ID NO: 1060160 - RNA, 14 nt, Mycobacterium bovis subsp bovis AF2122/97
agaacaucccccgg

SEQ ID NO: 1060161 - RNA, 11 nt, Mycobacterium bovis subsp bovis AF2122/97
agaaccacgac

SEQ ID NO: 1060162 - RNA, 13 nt, Mycobacterium bovis subsp bovis AF2122/97
agaaccacgacgu

SEQ ID NO: 1060163 - RNA, 20 nt, Mycobacterium bovis subsp bovis AF2122/97
acugcugggcuucgagugcg

SEQ ID NO: 1060164 - RNA, 15 nt, Mycobacterium bovis subsp bovis AF2122/97
acugcucgacgaggc

SEQ ID NO: 1060165 - RNA, 17 nt, Mycobacterium bovis subsp bovis AF2122/97
acugcucggauccggcc

SEQ ID NO: 1060166 - RNA, 20 nt, Mycobacterium bovis subsp bovis AF2122/97
acugcucggauccggccagg

SEQ ID NO: 1060167 - RNA, 16 nt, Mycobacterium bovis subsp bovis AF2122/97
acugcucgauccgcaa

SEQ ID NO: 1060168 - RNA, 15 nt, Mycobacterium bovis subsp bovis AF2122/97
acuggaaggcgggca

SEQ ID NO: 1060169 - RNA, 15 nt, Mycobacterium bovis subsp bovis AF2122/97
acuggaauggcucac

SEQ ID NO: 1060170 - RNA, 23 nt, Mycobacterium bovis subsp bovis AF2122/97
agacagcgcgggacacgucgcgc

SEQ ID NO: 1060171 - RNA, 14 nt, Mycobacterium bovis subsp bovis AF2122/97
agacaggcggcggc

SEQ ID NO: 1060172 - RNA, 15 nt, Mycobacterium bovis subsp bovis AF2122/97
agacaggcggcggcc

SEQ ID NO: 1060173 - RNA, 20 nt, Mycobacterium bovis subsp bovis AF2122/97
agacaucagugcgccggcga

SEQ ID NO: 1060174 - RNA, 14 nt, Mycobacterium bovis subsp bovis AF2122/97
agacaucgcgacga

SEQ ID NO: 1060175 - RNA, 19 nt, Mycobacterium bovis subsp bovis AF2122/97
agacaugucgcugccgccg

SEQ ID NO: 1060176 - RNA, 18 nt, Mycobacterium bovis subsp bovis AF2122/97
agaccaagcccgucgucg

SEQ ID NO: 1060177 - RNA, 17 nt, Mycobacterium bovis subsp bovis AF2122/97
agaccaaguccggucgc

SEQ ID NO: 1060178 - RNA, 16 nt, Mycobacterium bovis subsp bovis AF2122/97
agacacgagucgccag

SEQ ID NO: 1060179 - RNA, 19 nt, Mycobacterium bovis subsp bovis AF2122/97
agacacgagucgccagacc

SEQ ID NO: 1060180 - RNA, 12 nt, Mycobacterium bovis subsp bovis AF2122/97
agacaccggcgu

SEQ ID NO: 1060181 - RNA, 12 nt, Mycobacterium bovis subsp bovis AF2122/97
agacagcgcggg

SEQ ID NO: 1060182 - RNA, 19 nt, Mycobacterium bovis subsp bovis AF2122/97
agacagcgccaugcccucg

SEQ ID NO: 1060183 - RNA, 18 nt, Mycobacterium bovis subsp bovis AF2122/97
agacagcaccgccggugc

SEQ ID NO: 1060184 - RNA, 15 nt, Mycobacterium bovis subsp bovis AF2122/97
agacaacaacacggg

SEQ ID NO: 1060185 - RNA, 18 nt, Mycobacterium bovis subsp bovis AF2122/97
agacaaaggugccgaccg

SEQ ID NO: 1060186 - RNA, 20 nt, Mycobacterium bovis subsp bovis AF2122/97
agacacagaaucgcccauuu

SEQ ID NO: 1060187 - RNA, 18 nt, Mycobacterium bovis subsp bovis AF2122/97
agacaccgcgaucaccac

SEQ ID NO: 1060188 - RNA, 21 nt, Mycobacterium bovis subsp bovis AF2122/97
agacaccgcgaucaccaccgg

SEQ ID NO: 1060189 - RNA, 21 nt, Mycobacterium bovis subsp bovis AF2122/97
agaaggugacgaucgacagcc

SEQ ID NO: 1060190 - RNA, 17 nt, Mycobacterium bovis subsp bovis AF2122/97
agaaguaggcggcgacg

SEQ ID NO: 1060191 - RNA, 19 nt, Mycobacterium bovis subsp bovis AF2122/97
agaaugggauggcaccacc

SEQ ID NO: 1060192 - RNA, 18 nt, Mycobacterium bovis subsp bovis AF2122/97
agaaucgccugcgacagc

SEQ ID NO: 1060193 - RNA, 16 nt, Mycobacterium bovis subsp bovis AF2122/97
agaaucggcucagcaa

SEQ ID NO: 1060194 - RNA, 20 nt, Mycobacterium bovis subsp bovis AF2122/97
agccggcagcagcgggcgcg

SEQ ID NO: 1060195 - RNA, 22 nt, Mycobacterium bovis subsp bovis AF2122/97
agccggcagcagcgggcgcgcu

SEQ ID NO: 1060196 - RNA, 19 nt, Mycobacterium bovis subsp bovis AF2122/97
agccggcccgucgcgucga

SEQ ID NO: 1060197 - RNA, 23 nt, Mycobacterium bovis subsp bovis AF2122/97
agccggcccgucgcgucgaccgg

SEQ ID NO: 1060198 - RNA, 16 nt, Mycobacterium bovis subsp bovis AF2122/97
agccggcccugcucgc

SEQ ID NO: 1060199 - RNA, 18 nt, Mycobacterium bovis subsp bovis AF2122/97
agccggcccugcucgccg

SEQ ID NO: 1060200 - RNA, 23 nt, Mycobacterium bovis subsp bovis AF2122/97
agccggcccugcucgccgucucg

SEQ ID NO: 1060201 - RNA, 20 nt, Mycobacterium bovis subsp bovis AF2122/97
agccggccaccucggugcgg

SEQ ID NO: 1060202 - RNA, 14 nt, Mycobacterium bovis subsp bovis AF2122/97
agccggccgugaug

SEQ ID NO: 1060203 - RNA, 16 nt, Mycobacterium bovis subsp bovis AF2122/97
agccggccugucccgc

SEQ ID NO: 1060204 - RNA, 13 nt, Mycobacterium bovis subsp bovis AF2122/97
agccggccgcgac

SEQ ID NO: 1060205 - RNA, 18 nt, Mycobacterium bovis subsp bovis AF2122/97
agccggccgcgaccgcga

SEQ ID NO: 1060206 - RNA, 17 nt, Mycobacterium bovis subsp bovis AF2122/97
agccggcgacaccgcag

SEQ ID NO: 1060207 - RNA, 22 nt, Mycobacterium bovis subsp bovis AF2122/97
agccggccgcuuggccgcugcc

SEQ ID NO: 1060208 - RNA, 15 nt, Mycobacterium bovis subsp bovis AF2122/97
agccggcgcagcugu

SEQ ID NO: 1060209 - RNA, 15 nt, Mycobacterium bovis subsp bovis AF2122/97
agccggcgcgccgga

SEQ ID NO: 1060210 - RNA, 13 nt, Mycobacterium bovis subsp bovis AF2122/97
agccggcgcccgc

SEQ ID NO: 1060211 - RNA, 14 nt, Mycobacterium bovis subsp bovis AF2122/97
agccggcgcccgcc

SEQ ID NO: 1060212 - RNA, 18 nt, Mycobacterium bovis subsp bovis AF2122/97
agccggcgccgccgugcg

SEQ ID NO: 1060213 - RNA, 19 nt, Mycobacterium bovis subsp bovis AF2122/97
agccggcgccgccgugcgg

SEQ ID NO: 1060214 - RNA, 14 nt, Mycobacterium bovis subsp bovis AF2122/97
agccggcgcggcgg

SEQ ID NO: 1060215 - RNA, 20 nt, Mycobacterium bovis subsp bovis AF2122/97
agccggcuucggugagcggg

SEQ ID NO: 1060216 - RNA, 21 nt, Mycobacterium bovis subsp bovis AF2122/97
agccggcuucggugagcgggc

SEQ ID NO: 1060217 - RNA, 19 nt, Mycobacterium bovis subsp bovis AF2122/97
agccggcuugggcgguagc

SEQ ID NO: 1060218 - RNA, 20 nt, Mycobacterium bovis subsp bovis AF2122/97
agccggcuugggcgguagcc

SEQ ID NO: 1060219 - RNA, 16 nt, Mycobacterium bovis subsp bovis AF2122/97
agccgggaacgcugac

SEQ ID NO: 1060220 - RNA, 19 nt, Mycobacterium bovis subsp bovis AF2122/97
agccgggccaaccggucgu

SEQ ID NO: 1060221 - RNA, 18 nt, Mycobacterium bovis subsp bovis AF2122/97
agccggcuguuaggcgau

SEQ ID NO: 1060222 - RNA, 18 nt, Mycobacterium bovis subsp bovis AF2122/97
agccgggagucgucggca

SEQ ID NO: 1060223 - RNA, 14 nt, Mycobacterium bovis subsp bovis AF2122/97
agccgggauugccg

SEQ ID NO: 1060224 - RNA, 13 nt, Mycobacterium bovis subsp bovis AF2122/97
agccgggcaacca

SEQ ID NO: 1060225 - RNA, 15 nt, Mycobacterium bovis subsp bovis AF2122/97
agccgggcaccaccc

SEQ ID NO: 1060226 - RNA, 13 nt, Mycobacterium bovis subsp bovis AF2122/97
agccgggcacccu

SEQ ID NO: 1060227 - RNA, 19 nt, Mycobacterium bovis subsp bovis AF2122/97
agccgggccccacaucgcc

SEQ ID NO: 1060228 - RNA, 21 nt, Mycobacterium bovis subsp bovis AF2122/97
agccgggccccacaucgcccc

SEQ ID NO: 1060229 - RNA, 15 nt, Mycobacterium bovis subsp bovis AF2122/97
agccgggccguccgg

SEQ ID NO: 1060230 - RNA, 17 nt, Mycobacterium bovis subsp bovis AF2122/97
agccgggcgcgccggcc

SEQ ID NO: 1060231 - RNA, 13 nt, Mycobacterium bovis subsp bovis AF2122/97
agccggucggcac

SEQ ID NO: 1060232 - RNA, 20 nt, Mycobacterium bovis subsp bovis AF2122/97
agccgguccagacccagcuc

SEQ ID NO: 1060233 - RNA, 13 nt, Mycobacterium bovis subsp bovis AF2122/97
agccgguccagca

SEQ ID NO: 1060234 - RNA, 17 nt, Mycobacterium bovis subsp bovis AF2122/97
agccggucuugcaucgc

SEQ ID NO: 1060235 - RNA, 18 nt, Mycobacterium bovis subsp bovis AF2122/97
agccggucuugcaucgcc

SEQ ID NO: 1060236 - RNA, 21 nt, Mycobacterium bovis subsp bovis AF2122/97
agccgguguugauguugccgg

SEQ ID NO: 1060237 - RNA, 22 nt, Mycobacterium bovis subsp bovis AF2122/97
agccgguggucugcgcggugcc

SEQ ID NO: 1060238 - RNA, 23 nt, Mycobacterium bovis subsp bovis AF2122/97
agccgguggucugcgcggugccc

SEQ ID NO: 1060239 - RNA, 17 nt, Mycobacterium bovis subsp bovis AF2122/97
agccgguggcccgccgg

SEQ ID NO: 1060240 - RNA, 19 nt, Mycobacterium bovis subsp bovis AF2122/97
agccgguggcccgccggca

SEQ ID NO: 1060241 - RNA, 18 nt, Mycobacterium bovis subsp bovis AF2122/97
agccggugacgugguggg

SEQ ID NO: 1060242 - RNA, 15 nt, Mycobacterium bovis subsp bovis AF2122/97
agccggugaccgcga

SEQ ID NO: 1060243 - RNA, 17 nt, Mycobacterium bovis subsp bovis AF2122/97
agccggugccacugccg

SEQ ID NO: 1060244 - RNA, 21 nt, Mycobacterium bovis subsp bovis AF2122/97
agccggugccggcguugccgc

SEQ ID NO: 1060245 - RNA, 11 nt, Mycobacterium bovis subsp bovis AF2122/97
agccggugccg

SEQ ID NO: 1060246 - RNA, 21 nt, Mycobacterium bovis subsp bovis AF2122/97
agccggugccgacggcgccga

SEQ ID NO: 1060247 - RNA, 15 nt, Mycobacterium bovis subsp bovis AF2122/97
agccggugccgccgu

SEQ ID NO: 1060248 - RNA, 12 nt, Mycobacterium bovis subsp bovis AF2122/97
agccggugccgg

SEQ ID NO: 1060249 - RNA, 14 nt, Mycobacterium bovis subsp bovis AF2122/97
agccggggaacgug

SEQ ID NO: 1060250 - RNA, 17 nt, Mycobacterium bovis subsp bovis AF2122/97
agccgggcucgucgagu

SEQ ID NO: 1060251 - RNA, 18 nt, Mycobacterium bovis subsp bovis AF2122/97
agccgggcggccucguug

SEQ ID NO: 1060252 - RNA, 16 nt, Mycobacterium bovis subsp bovis AF2122/97
agccgggcgucgcugg

SEQ ID NO: 1060253 - RNA, 13 nt, Mycobacterium bovis subsp bovis AF2122/97
agccgggugccgg

SEQ ID NO: 1060254 - RNA, 15 nt, Mycobacterium bovis subsp bovis AF2122/97
agccgggugccggca

SEQ ID NO: 1060255 - RNA, 15 nt, Mycobacterium bovis subsp bovis AF2122/97
agccgggugcgcacc

SEQ ID NO: 1060256 - RNA, 19 nt, Mycobacterium bovis subsp bovis AF2122/97
agccgggugggagcagccg

SEQ ID NO: 1060257 - RNA, 19 nt, Mycobacterium bovis subsp bovis AF2122/97
agccggguugccugcgcga

SEQ ID NO: 1060258 - RNA, 14 nt, Mycobacterium bovis subsp bovis AF2122/97
agccggguugguac

SEQ ID NO: 1060259 - RNA, 14 nt, Mycobacterium bovis subsp bovis AF2122/97
agccgguaaccgcg

SEQ ID NO: 1060260 - RNA, 18 nt, Mycobacterium bovis subsp bovis AF2122/97
agccgguaaccgcgucga

SEQ ID NO: 1060261 - RNA, 13 nt, Mycobacterium bovis subsp bovis AF2122/97
agccgguagccgg

SEQ ID NO: 1060262 - RNA, 19 nt, Mycobacterium bovis subsp bovis AF2122/97
agccugcucgcagcgggcg

SEQ ID NO: 1060263 - RNA, 14 nt, Mycobacterium bovis subsp bovis AF2122/97
agccugcggcggcg

SEQ ID NO: 1060264 - RNA, 15 nt, Mycobacterium bovis subsp bovis AF2122/97
agccugccgaugacg

SEQ ID NO: 1060265 - RNA, 22 nt, Mycobacterium bovis subsp bovis AF2122/97
agccugauaaagcccggcggca

SEQ ID NO: 1060266 - RNA, 22 nt, Mycobacterium bovis subsp bovis AF2122/97
agccugcuucugggcuuucugc

SEQ ID NO: 1060267 - RNA, 22 nt, Mycobacterium bovis subsp bovis AF2122/97
agcgaaaacccggucggcgaaa

SEQ ID NO: 1060268 - RNA, 23 nt, Mycobacterium bovis subsp bovis AF2122/97
agccguaguaguggccgccaccc

SEQ ID NO: 1060269 - RNA, 15 nt, Mycobacterium bovis subsp bovis AF2122/97
agccguagccgccgu

SEQ ID NO: 1060270 - RNA, 13 nt, Mycobacterium bovis subsp bovis AF2122/97
agccgucaccgcg

SEQ ID NO: 1060271 - RNA, 16 nt, Mycobacterium bovis subsp bovis AF2122/97
agccgucaccgcgacc

SEQ ID NO: 1060272 - RNA, 17 nt, Mycobacterium bovis subsp bovis AF2122/97
agccgucacgccggaug

SEQ ID NO: 1060273 - RNA, 18 nt, Mycobacterium bovis subsp bovis AF2122/97
agccguagcugggcaccc

SEQ ID NO: 1060274 - RNA, 17 nt, Mycobacterium bovis subsp bovis AF2122/97
agccgguugucgcagcg

SEQ ID NO: 1060275 - RNA, 21 nt, Mycobacterium bovis subsp bovis AF2122/97
agccugagcacguucaccgcg

SEQ ID NO: 1060276 - RNA, 13 nt, Mycobacterium bovis subsp bovis AF2122/97
agccucggccauc

SEQ ID NO: 1060277 - RNA, 13 nt, Mycobacterium bovis subsp bovis AF2122/97
agccucggcggcg

SEQ ID NO: 1060278 - RNA, 22 nt, Mycobacterium bovis subsp bovis AF2122/97
agccucguagaacgcuagcgcc

SEQ ID NO: 1060279 - RNA, 17 nt, Mycobacterium bovis subsp bovis AF2122/97
agccucggcaugcagcc

SEQ ID NO: 1060280 - RNA, 15 nt, Mycobacterium bovis subsp bovis AF2122/97
agcgacucgccggcg

SEQ ID NO: 1060281 - RNA, 16 nt, Mycobacterium bovis subsp bovis AF2122/97
agcgacucgccggcga

SEQ ID NO: 1060282 - RNA, 17 nt, Mycobacterium bovis subsp bovis AF2122/97
agcgacucgccggcgaa

SEQ ID NO: 1060283 - RNA, 17 nt, Mycobacterium bovis subsp bovis AF2122/97
agcgacuccagcgcccg

SEQ ID NO: 1060284 - RNA, 19 nt, Mycobacterium bovis subsp bovis AF2122/97
agcgacguuaaugacgcca

SEQ ID NO: 1060285 - RNA, 23 nt, Mycobacterium bovis subsp bovis AF2122/97
agcgacuccaccccacccagcga

SEQ ID NO: 1060286 - RNA, 17 nt, Mycobacterium bovis subsp bovis AF2122/97
agcgacugcagcggcgc

SEQ ID NO: 1060287 - RNA, 14 nt, Mycobacterium bovis subsp bovis AF2122/97
agcgacgagcagca

SEQ ID NO: 1060288 - RNA, 13 nt, Mycobacterium bovis subsp bovis AF2122/97
agcgacgccggcc

SEQ ID NO: 1060289 - RNA, 14 nt, Mycobacterium bovis subsp bovis AF2122/97
agcgacgccggccc

SEQ ID NO: 1060290 - RNA, 16 nt, Mycobacterium bovis subsp bovis AF2122/97
agcgacgcugccgcca

SEQ ID NO: 1060291 - RNA, 23 nt, Mycobacterium bovis subsp bovis AF2122/97
agcgacggucccggcacgucgac

SEQ ID NO: 1060292 - RNA, 20 nt, Mycobacterium bovis subsp bovis AF2122/97
agcgacgguuuagcgccggu

SEQ ID NO: 1060293 - RNA, 17 nt, Mycobacterium bovis subsp bovis AF2122/97
agcgacggccgccagca

SEQ ID NO: 1060294 - RNA, 15 nt, Mycobacterium bovis subsp bovis AF2122/97
agcgaccucgccgcg

SEQ ID NO: 1060295 - RNA, 18 nt, Mycobacterium bovis subsp bovis AF2122/97
agcgaccucgccgcggcg

SEQ ID NO: 1060296 - RNA, 12 nt, Mycobacterium bovis subsp bovis AF2122/97
agcgaccugggu

SEQ ID NO: 1060297 - RNA, 22 nt, Mycobacterium bovis subsp bovis AF2122/97
agcgaccgguaauccguugccg

SEQ ID NO: 1060298 - RNA, 17 nt, Mycobacterium bovis subsp bovis AF2122/97
agcgaccgucccagcgc

SEQ ID NO: 1060299 - RNA, 18 nt, Mycobacterium bovis subsp bovis AF2122/97
agcgaccgucgucaccgc

SEQ ID NO: 1060300 - RNA, 15 nt, Mycobacterium bovis subsp bovis AF2122/97
agcgaccgcggcccc

SEQ ID NO: 1060301 - RNA, 18 nt, Mycobacterium bovis subsp bovis AF2122/97
agcgaccgcggucgcugc

SEQ ID NO: 1060302 - RNA, 16 nt, Mycobacterium bovis subsp bovis AF2122/97
agcgaccgcugcagau

SEQ ID NO: 1060303 - RNA, 21 nt, Mycobacterium bovis subsp bovis AF2122/97
agcgacccccagcgcccgccg

SEQ ID NO: 1060304 - RNA, 16 nt, Mycobacterium bovis subsp bovis AF2122/97
agcgacccggccagcg

SEQ ID NO: 1060305 - RNA, 14 nt, Mycobacterium bovis subsp bovis AF2122/97
agcgaccgacgcca

SEQ ID NO: 1060306 - RNA, 13 nt, Mycobacterium bovis subsp bovis AF2122/97
agcgaagccgggu

SEQ ID NO: 1060307 - RNA, 17 nt, Mycobacterium bovis subsp bovis AF2122/97
agcgaccaggucgccag

SEQ ID NO: 1060308 - RNA, 16 nt, Mycobacterium bovis subsp bovis AF2122/97
agccuguccacgucca

SEQ ID NO: 1060309 - RNA, 19 nt, Mycobacterium bovis subsp bovis AF2122/97
agcgaaacgagccggugcg

SEQ ID NO: 1060310 - RNA, 19 nt, Mycobacterium bovis subsp bovis AF2122/97
agcgaacccgagccgccgu

SEQ ID NO: 1060311 - RNA, 23 nt, Mycobacterium bovis subsp bovis AF2122/97
agcgaacccgagccgccguggaa

SEQ ID NO: 1060312 - RNA, 13 nt, Mycobacterium bovis subsp bovis AF2122/97
agcgaaccgccgg

SEQ ID NO: 1060313 - RNA, 19 nt, Mycobacterium bovis subsp bovis AF2122/97
agcgaacggguagucgggc

SEQ ID NO: 1060314 - RNA, 13 nt, Mycobacterium bovis subsp bovis AF2122/97
agcgaaccaccgg

SEQ ID NO: 1060315 - RNA, 15 nt, Mycobacterium bovis subsp bovis AF2122/97
agcgaaccgccggca

SEQ ID NO: 1060316 - RNA, 16 nt, Mycobacterium bovis subsp bovis AF2122/97
agcgaaccgccggcac

SEQ ID NO: 1060317 - RNA, 17 nt, Mycobacterium bovis subsp bovis AF2122/97
agcgaaccgccggcacc

SEQ ID NO: 1060318 - RNA, 16 nt, Mycobacterium bovis subsp bovis AF2122/97
agccgagaccacgcgc

SEQ ID NO: 1060319 - RNA, 19 nt, Mycobacterium bovis subsp bovis AF2122/97
agccgacuaucggccgccg

SEQ ID NO: 1060320 - RNA, 20 nt, Mycobacterium bovis subsp bovis AF2122/97
agccgacuaucggccgccgg

SEQ ID NO: 1060321 - RNA, 20 nt, Mycobacterium bovis subsp bovis AF2122/97
agccgaaguugaugucgcgu

SEQ ID NO: 1060322 - RNA, 17 nt, Mycobacterium bovis subsp bovis AF2122/97
agccgaaggggaacgcg

SEQ ID NO: 1060323 - RNA, 13 nt, Mycobacterium bovis subsp bovis AF2122/97
agccgacaacgac

SEQ ID NO: 1060324 - RNA, 20 nt, Mycobacterium bovis subsp bovis AF2122/97
agccgacaacgacgucgccg

SEQ ID NO: 1060325 - RNA, 21 nt, Mycobacterium bovis subsp bovis AF2122/97
agccgacaacgacgucgccga

SEQ ID NO: 1060326 - RNA, 12 nt, Mycobacterium bovis subsp bovis AF2122/97
agccgacgucgc

SEQ ID NO: 1060327 - RNA, 18 nt, Mycobacterium bovis subsp bovis AF2122/97
agccgacgucgccggacg

SEQ ID NO: 1060328 - RNA, 19 nt, Mycobacterium bovis subsp bovis AF2122/97
agccgacguugaagccgcc

SEQ ID NO: 1060329 - RNA, 20 nt, Mycobacterium bovis subsp bovis AF2122/97
agccgacguugaagccgccg

SEQ ID NO: 1060330 - RNA, 21 nt, Mycobacterium bovis subsp bovis AF2122/97
agccgacguugaagccgccgg

SEQ ID NO: 1060331 - RNA, 16 nt, Mycobacterium bovis subsp bovis AF2122/97
agccgacuaucggccg

SEQ ID NO: 1060332 - RNA, 20 nt, Mycobacterium bovis subsp bovis AF2122/97
agccgaagcgcccguuggcc

SEQ ID NO: 1060333 - RNA, 17 nt, Mycobacterium bovis subsp bovis AF2122/97
agccgaagaaccggucg

SEQ ID NO: 1060334 - RNA, 18 nt, Mycobacterium bovis subsp bovis AF2122/97
agccgaagaaccggucgc

SEQ ID NO: 1060335 - RNA, 21 nt, Mycobacterium bovis subsp bovis AF2122/97
agccgaagaaccggucgcagu

SEQ ID NO: 1060336 - RNA, 13 nt, Mycobacterium bovis subsp bovis AF2122/97
agccgaacaccgu

SEQ ID NO: 1060337 - RNA, 14 nt, Mycobacterium bovis subsp bovis AF2122/97
agccgaacaccguc

SEQ ID NO: 1060338 - RNA, 14 nt, Mycobacterium bovis subsp bovis AF2122/97
agccgcacgaugcc

SEQ ID NO: 1060339 - RNA, 14 nt, Mycobacterium bovis subsp bovis AF2122/97
agccgcaccccgcc

SEQ ID NO: 1060340 - RNA, 15 nt, Mycobacterium bovis subsp bovis AF2122/97
agccgcacgaugccg

SEQ ID NO: 1060341 - RNA, 17 nt, Mycobacterium bovis subsp bovis AF2122/97
agccgcacgaugccggg

SEQ ID NO: 1060342 - RNA, 18 nt, Mycobacterium bovis subsp bovis AF2122/97
agccgaugaucgaacacg

SEQ ID NO: 1060343 - RNA, 18 nt, Mycobacterium bovis subsp bovis AF2122/97
agccgauguccgacgcca

SEQ ID NO: 1060344 - RNA, 21 nt, Mycobacterium bovis subsp bovis AF2122/97
agccgauguccgacgccaccg

SEQ ID NO: 1060345 - RNA, 14 nt, Mycobacterium bovis subsp bovis AF2122/97
agccgagcggcggc

SEQ ID NO: 1060346 - RNA, 18 nt, Mycobacterium bovis subsp bovis AF2122/97
agccgaugaccugcccgu

SEQ ID NO: 1060347 - RNA, 14 nt, Mycobacterium bovis subsp bovis AF2122/97
agccgagccagcuc

SEQ ID NO: 1060348 - RNA, 18 nt, Mycobacterium bovis subsp bovis AF2122/97
agccgagccagcuccggc

SEQ ID NO: 1060349 - RNA, 12 nt, Mycobacterium bovis subsp bovis AF2122/97
agccgagcggcg

SEQ ID NO: 1060350 - RNA, 17 nt, Mycobacterium bovis subsp bovis AF2122/97
agccgagcccgucgauc

SEQ ID NO: 1060351 - RNA, 19 nt, Mycobacterium bovis subsp bovis AF2122/97
agccgagcccgucgaucag

SEQ ID NO: 1060352 - RNA, 15 nt, Mycobacterium bovis subsp bovis AF2122/97
agccgagcgcccgca

SEQ ID NO: 1060353 - RNA, 15 nt, Mycobacterium bovis subsp bovis AF2122/97
agcccgguacgccgc

SEQ ID NO: 1060354 - RNA, 19 nt, Mycobacterium bovis subsp bovis AF2122/97
agcccgguacgccgcgccg

SEQ ID NO: 1060355 - RNA, 20 nt, Mycobacterium bovis subsp bovis AF2122/97
agcccgguacgccgcgccga

SEQ ID NO: 1060356 - RNA, 23 nt, Mycobacterium bovis subsp bovis AF2122/97
agcccgguacgccgcgccgaauc

SEQ ID NO: 1060357 - RNA, 17 nt, Mycobacterium bovis subsp bovis AF2122/97
agcccgguaucgucccg

SEQ ID NO: 1060358 - RNA, 20 nt, Mycobacterium bovis subsp bovis AF2122/97
agcccgguaucgucccggcg

SEQ ID NO: 1060359 - RNA, 15 nt, Mycobacterium bovis subsp bovis AF2122/97
agcccggggaugccu

SEQ ID NO: 1060360 - RNA, 22 nt, Mycobacterium bovis subsp bovis AF2122/97
agcccguagcacaccgguggac

SEQ ID NO: 1060361 - RNA, 14 nt, Mycobacterium bovis subsp bovis AF2122/97
agcccguagccgau

SEQ ID NO: 1060362 - RNA, 18 nt, Mycobacterium bovis subsp bovis AF2122/97
agcccggucauggucagc

SEQ ID NO: 1060363 - RNA, 14 nt, Mycobacterium bovis subsp bovis AF2122/97
agcccguccaggcc

SEQ ID NO: 1060364 - RNA, 22 nt, Mycobacterium bovis subsp bovis AF2122/97
agcccggugcuaccggcuuggc

SEQ ID NO: 1060365 - RNA, 21 nt, Mycobacterium bovis subsp bovis AF2122/97
agcccgucagcuccccgucgg

SEQ ID NO: 1060366 - RNA, 17 nt, Mycobacterium bovis subsp bovis AF2122/97
agcccgucgcggccggc

SEQ ID NO: 1060367 - RNA, 19 nt, Mycobacterium bovis subsp bovis AF2122/97
agcccgucgcggccggcgg

SEQ ID NO: 1060368 - RNA, 23 nt, Mycobacterium bovis subsp bovis AF2122/97
agcccgucgcggccggcggccgc

SEQ ID NO: 1060369 - RNA, 13 nt, Mycobacterium bovis subsp bovis AF2122/97
agcccgucgucgg

SEQ ID NO: 1060370 - RNA, 18 nt, Mycobacterium bovis subsp bovis AF2122/97
agcccguugguagccggu

SEQ ID NO: 1060371 - RNA, 16 nt, Mycobacterium bovis subsp bovis AF2122/97
agcccguugaccugcg

SEQ ID NO: 1060372 - RNA, 22 nt, Mycobacterium bovis subsp bovis AF2122/97
agcccguugguagccggugacc

SEQ ID NO: 1060373 - RNA, 13 nt, Mycobacterium bovis subsp bovis AF2122/97
agcccuuggcgcg

SEQ ID NO: 1060374 - RNA, 14 nt, Mycobacterium bovis subsp bovis AF2122/97
agcccuuggcgcgc

SEQ ID NO: 1060375 - RNA, 15 nt, Mycobacterium bovis subsp bovis AF2122/97
agcccuuggcgcgca

SEQ ID NO: 1060376 - RNA, 20 nt, Mycobacterium bovis subsp bovis AF2122/97
agcccuuguagcacaccgac

SEQ ID NO: 1060377 - RNA, 21 nt, Mycobacterium bovis subsp bovis AF2122/97
agcccuuguagcacaccgaca

SEQ ID NO: 1060378 - RNA, 16 nt, Mycobacterium bovis subsp bovis AF2122/97
agcccguucgaaguuc

SEQ ID NO: 1060379 - RNA, 23 nt, Mycobacterium bovis subsp bovis AF2122/97
agcccguggucgaucaugacgag

SEQ ID NO: 1060380 - RNA, 12 nt, Mycobacterium bovis subsp bovis AF2122/97
agccaccgacga

SEQ ID NO: 1060381 - RNA, 19 nt, Mycobacterium bovis subsp bovis AF2122/97
agccaccgcgaaaauucgu

SEQ ID NO: 1060382 - RNA, 21 nt, Mycobacterium bovis subsp bovis AF2122/97
agccaccuuggacaccacgag

SEQ ID NO: 1060383 - RNA, 19 nt, Mycobacterium bovis subsp bovis AF2122/97
agcccggccuugccgccgg

SEQ ID NO: 1060384 - RNA, 21 nt, Mycobacterium bovis subsp bovis AF2122/97
agcccggccuugccgccggcc

SEQ ID NO: 1060385 - RNA, 20 nt, Mycobacterium bovis subsp bovis AF2122/97
agccaccgucaugccgacga

SEQ ID NO: 1060386 - RNA, 16 nt, Mycobacterium bovis subsp bovis AF2122/97
agcccggcgcuuccgc

SEQ ID NO: 1060387 - RNA, 19 nt, Mycobacterium bovis subsp bovis AF2122/97
agccaccggugagcgcagc

SEQ ID NO: 1060388 - RNA, 23 nt, Mycobacterium bovis subsp bovis AF2122/97
agcccggcgaugagcaugcccag

SEQ ID NO: 1060389 - RNA, 14 nt, Mycobacterium bovis subsp bovis AF2122/97
agcccggcggcagc

SEQ ID NO: 1060390 - RNA, 23 nt, Mycobacterium bovis subsp bovis AF2122/97
agcccggcgacgacccgggucgg

SEQ ID NO: 1060391 - RNA, 14 nt, Mycobacterium bovis subsp bovis AF2122/97
agcccggcgcgccg

SEQ ID NO: 1060392 - RNA, 14 nt, Mycobacterium bovis subsp bovis AF2122/97
agcccggcggccgc

SEQ ID NO: 1060393 - RNA, 22 nt, Mycobacterium bovis subsp bovis AF2122/97
agcccggcggccgcuucggcgg

SEQ ID NO: 1060394 - RNA, 17 nt, Mycobacterium bovis subsp bovis AF2122/97
agcccggcggcggucac

SEQ ID NO: 1060395 - RNA, 12 nt, Mycobacterium bovis subsp bovis AF2122/97
agcccgggcagc

SEQ ID NO: 1060396 - RNA, 18 nt, Mycobacterium bovis subsp bovis AF2122/97
agcccgggauaccgcuca

SEQ ID NO: 1060397 - RNA, 13 nt, Mycobacterium bovis subsp bovis AF2122/97
agccgccggugcc

SEQ ID NO: 1060398 - RNA, 18 nt, Mycobacterium bovis subsp bovis AF2122/97
agccgccggugccgccgg

SEQ ID NO: 1060399 - RNA, 12 nt, Mycobacterium bovis subsp bovis AF2122/97
agccgccgggca

SEQ ID NO: 1060400 - RNA, 14 nt, Mycobacterium bovis subsp bovis AF2122/97
agccgccgggugcg

SEQ ID NO: 1060401 - RNA, 22 nt, Mycobacterium bovis subsp bovis AF2122/97
agccgccgggugcgccguugcc

SEQ ID NO: 1060402 - RNA, 18 nt, Mycobacterium bovis subsp bovis AF2122/97
agccgccgucgccggugc

SEQ ID NO: 1060403 - RNA, 14 nt, Mycobacterium bovis subsp bovis AF2122/97
agccgccguugccg

SEQ ID NO: 1060404 - RNA, 18 nt, Mycobacterium bovis subsp bovis AF2122/97
agccgccguugccgccgg

SEQ ID NO: 1060405 - RNA, 13 nt, Mycobacterium bovis subsp bovis AF2122/97
agccgccucaaug

SEQ ID NO: 1060406 - RNA, 19 nt, Mycobacterium bovis subsp bovis AF2122/97
agccgcgcgccaucgccuc

SEQ ID NO: 1060407 - RNA, 21 nt, Mycobacterium bovis subsp bovis AF2122/97
agccgcgcgguacugcgcagc

SEQ ID NO: 1060408 - RNA, 17 nt, Mycobacterium bovis subsp bovis AF2122/97
agccgcgcuagcucggc

SEQ ID NO: 1060409 - RNA, 17 nt, Mycobacterium bovis subsp bovis AF2122/97
agccgcggcccucgaug

SEQ ID NO: 1060410 - RNA, 18 nt, Mycobacterium bovis subsp bovis AF2122/97
agccgcggcaccgccgag

SEQ ID NO: 1060411 - RNA, 12 nt, Mycobacterium bovis subsp bovis AF2122/97
agccgcggcccg

SEQ ID NO: 1060412 - RNA, 22 nt, Mycobacterium bovis subsp bovis AF2122/97
agccgcggcccucgaugccgcg

SEQ ID NO: 1060413 - RNA, 18 nt, Mycobacterium bovis subsp bovis AF2122/97
agccgcggcuaggccagc

SEQ ID NO: 1060414 - RNA, 15 nt, Mycobacterium bovis subsp bovis AF2122/97
agccgcgggccgcgu

SEQ ID NO: 1060415 - RNA, 22 nt, Mycobacterium bovis subsp bovis AF2122/97
agccgcggcgccauagccgcga

SEQ ID NO: 1060416 - RNA, 15 nt, Mycobacterium bovis subsp bovis AF2122/97
agccgcggcggcagc

SEQ ID NO: 1060417 - RNA, 20 nt, Mycobacterium bovis subsp bovis AF2122/97
agccgcggcggcagcaccca

SEQ ID NO: 1060418 - RNA, 16 nt, Mycobacterium bovis subsp bovis AF2122/97
agccgcagccccgaca

SEQ ID NO: 1060419 - RNA, 14 nt, Mycobacterium bovis subsp bovis AF2122/97
agccgcagccgcag

SEQ ID NO: 1060420 - RNA, 19 nt, Mycobacterium bovis subsp bovis AF2122/97
agccgcagccgcaggccau

SEQ ID NO: 1060421 - RNA, 16 nt, Mycobacterium bovis subsp bovis AF2122/97
agccgcacgguugccg

SEQ ID NO: 1060422 - RNA, 15 nt, Mycobacterium bovis subsp bovis AF2122/97
agccgcagcggccug

SEQ ID NO: 1060423 - RNA, 22 nt, Mycobacterium bovis subsp bovis AF2122/97
agccgcagcggccugaccggcu

SEQ ID NO: 1060424 - RNA, 19 nt, Mycobacterium bovis subsp bovis AF2122/97
agccgcacaaacgggcgug

SEQ ID NO: 1060425 - RNA, 19 nt, Mycobacterium bovis subsp bovis AF2122/97
agccgcaucuggccggcgg

SEQ ID NO: 1060426 - RNA, 20 nt, Mycobacterium bovis subsp bovis AF2122/97
agccgcaucuggccggcggu

SEQ ID NO: 1060427 - RNA, 18 nt, Mycobacterium bovis subsp bovis AF2122/97
agccgcagcugagccgug

SEQ ID NO: 1060428 - RNA, 14 nt, Mycobacterium bovis subsp bovis AF2122/97
agccgcagcuuggc

SEQ ID NO: 1060429 - RNA, 13 nt, Mycobacterium bovis subsp bovis AF2122/97
agccgccggccgg

SEQ ID NO: 1060430 - RNA, 17 nt, Mycobacterium bovis subsp bovis AF2122/97
agccgccggccggcauc

SEQ ID NO: 1060431 - RNA, 14 nt, Mycobacterium bovis subsp bovis AF2122/97
agccgccggcgccg

SEQ ID NO: 1060432 - RNA, 17 nt, Mycobacterium bovis subsp bovis AF2122/97
agccgccggcgccgaac

SEQ ID NO: 1060433 - RNA, 14 nt, Mycobacterium bovis subsp bovis AF2122/97
agccgccaaccgca

SEQ ID NO: 1060434 - RNA, 15 nt, Mycobacterium bovis subsp bovis AF2122/97
agccgccgcgacggc

SEQ ID NO: 1060435 - RNA, 12 nt, Mycobacterium bovis subsp bovis AF2122/97
agccgccaccgu

SEQ ID NO: 1060436 - RNA, 13 nt, Mycobacterium bovis subsp bovis AF2122/97
agccggauucggc

SEQ ID NO: 1060437 - RNA, 21 nt, Mycobacterium bovis subsp bovis AF2122/97
agccggauucggcugccaccg

SEQ ID NO: 1060438 - RNA, 14 nt, Mycobacterium bovis subsp bovis AF2122/97
agccggcaaccgac

SEQ ID NO: 1060439 - RNA, 13 nt, Mycobacterium bovis subsp bovis AF2122/97
agccggcagcagc

SEQ ID NO: 1060440 - RNA, 14 nt, Mycobacterium bovis subsp bovis AF2122/97
agccggcagcagcg

SEQ ID NO: 1060441 - RNA, 23 nt, Mycobacterium bovis subsp bovis AF2122/97
agccggauaaucauccgagcggu

SEQ ID NO: 1060442 - RNA, 22 nt, Mycobacterium bovis subsp bovis AF2122/97
agccggaugcgcuuccaucgcc

SEQ ID NO: 1060443 - RNA, 18 nt, Mycobacterium bovis subsp bovis AF2122/97
agccgcuuucccggcugg

SEQ ID NO: 1060444 - RNA, 13 nt, Mycobacterium bovis subsp bovis AF2122/97
agccggaccgcga

SEQ ID NO: 1060445 - RNA, 22 nt, Mycobacterium bovis subsp bovis AF2122/97
agccggaguucuguaccggcug

SEQ ID NO: 1060446 - RNA, 22 nt, Mycobacterium bovis subsp bovis AF2122/97
agccgcucgggguggucggcuc

SEQ ID NO: 1060447 - RNA, 15 nt, Mycobacterium bovis subsp bovis AF2122/97
agccgcuggaagucg

SEQ ID NO: 1060448 - RNA, 18 nt, Mycobacterium bovis subsp bovis AF2122/97
agccgcuggaagucgguc

SEQ ID NO: 1060449 - RNA, 17 nt, Mycobacterium bovis subsp bovis AF2122/97
agccgcucgacggcccg

SEQ ID NO: 1060450 - RNA, 21 nt, Mycobacterium bovis subsp bovis AF2122/97
agccgcuccgcccauucccag

SEQ ID NO: 1060451 - RNA, 18 nt, Mycobacterium bovis subsp bovis AF2122/97
agccgcucacccggucgc

SEQ ID NO: 1060452 - RNA, 21 nt, Mycobacterium bovis subsp bovis AF2122/97
agccgcguucgcgcaaaugcc

SEQ ID NO: 1060453 - RNA, 20 nt, Mycobacterium bovis subsp bovis AF2122/97
agccgcuacguuacgccgag

SEQ ID NO: 1060454 - RNA, 18 nt, Mycobacterium bovis subsp bovis AF2122/97
agccgcucaucgaucccg

SEQ ID NO: 1060455 - RNA, 18 nt, Mycobacterium bovis subsp bovis AF2122/97
agccgcguucgcgcaaau

SEQ ID NO: 1060456 - RNA, 12 nt, Mycobacterium bovis subsp bovis AF2122/97
agccgcggucac

SEQ ID NO: 1060457 - RNA, 21 nt, Mycobacterium bovis subsp bovis AF2122/97
agccgcggucggcgugcaggg

SEQ ID NO: 1060458 - RNA, 21 nt, Mycobacterium bovis subsp bovis AF2122/97
agccgcggcgccauagccgcg

SEQ ID NO: 1060459 - RNA, 18 nt, Mycobacterium bovis subsp bovis AF2122/97
agcgcgcccgacacccgu

SEQ ID NO: 1060460 - RNA, 18 nt, Mycobacterium bovis subsp bovis AF2122/97
agcgcgccaaucgcccag

SEQ ID NO: 1060461 - RNA, 13 nt, Mycobacterium bovis subsp bovis AF2122/97
agcgcgccaccca

SEQ ID NO: 1060462 - RNA, 18 nt, Mycobacterium bovis subsp bovis AF2122/97
agcgcgaaggucagcgac

SEQ ID NO: 1060463 - RNA, 18 nt, Mycobacterium bovis subsp bovis AF2122/97
agcgcgaaguacgacgac

SEQ ID NO: 1060464 - RNA, 19 nt, Mycobacterium bovis subsp bovis AF2122/97
agcgcgaaguacgacgacc

SEQ ID NO: 1060465 - RNA, 21 nt, Mycobacterium bovis subsp bovis AF2122/97
agcgcgaaccugcucggcgcg

SEQ ID NO: 1060466 - RNA, 14 nt, Mycobacterium bovis subsp bovis AF2122/97
agcgcgaaagcgcc

SEQ ID NO: 1060467 - RNA, 15 nt, Mycobacterium bovis subsp bovis AF2122/97
agcgccuugucgauc

SEQ ID NO: 1060468 - RNA, 17 nt, Mycobacterium bovis subsp bovis AF2122/97
agcgcgcuuuguccggu

SEQ ID NO: 1060469 - RNA, 21 nt, Mycobacterium bovis subsp bovis AF2122/97
agcgcgcuggccagcccgguc

SEQ ID NO: 1060470 - RNA, 19 nt, Mycobacterium bovis subsp bovis AF2122/97
agcgcgcuggcuacccacc

SEQ ID NO: 1060471 - RNA, 24 nt, Mycobacterium bovis subsp bovis AF2122/97
agcgcgcuggcuacccaccggccg

SEQ ID NO: 1060472 - RNA, 19 nt, Mycobacterium bovis subsp bovis AF2122/97
agcgcgcugcggaucgugg

SEQ ID NO: 1060473 - RNA, 16 nt, Mycobacterium bovis subsp bovis AF2122/97
agcgcgcccgcggccg

SEQ ID NO: 1060474 - RNA, 19 nt, Mycobacterium bovis subsp bovis AF2122/97
agcgcgcugagguggcggu

SEQ ID NO: 1060475 - RNA, 13 nt, Mycobacterium bovis subsp bovis AF2122/97
agcgcggccacgc

SEQ ID NO: 1060476 - RNA, 15 nt, Mycobacterium bovis subsp bovis AF2122/97
agcgcggcaccagca

SEQ ID NO: 1060477 - RNA, 16 nt, Mycobacterium bovis subsp bovis AF2122/97
agcgcggcaccagcac

SEQ ID NO: 1060478 - RNA, 22 nt, Mycobacterium bovis subsp bovis AF2122/97
agcgcggcaccagcaccgucgg

SEQ ID NO: 1060479 - RNA, 13 nt, Mycobacterium bovis subsp bovis AF2122/97
agcgcggcacggu

SEQ ID NO: 1060480 - RNA, 19 nt, Mycobacterium bovis subsp bovis AF2122/97
agcgcggcacggugugcgg

SEQ ID NO: 1060481 - RNA, 14 nt, Mycobacterium bovis subsp bovis AF2122/97
agcgcggccagcag

SEQ ID NO: 1060482 - RNA, 21 nt, Mycobacterium bovis subsp bovis AF2122/97
agcgcggcaagcucguccggu

SEQ ID NO: 1060483 - RNA, 17 nt, Mycobacterium bovis subsp bovis AF2122/97
agcgcgucggagccggg

SEQ ID NO: 1060484 - RNA, 15 nt, Mycobacterium bovis subsp bovis AF2122/97
agcgcgucggucacc

SEQ ID NO: 1060485 - RNA, 21 nt, Mycobacterium bovis subsp bovis AF2122/97
agcgcgucgggaugcgcguua

SEQ ID NO: 1060486 - RNA, 17 nt, Mycobacterium bovis subsp bovis AF2122/97
agcgcggcuacggucgc

SEQ ID NO: 1060487 - RNA, 18 nt, Mycobacterium bovis subsp bovis AF2122/97
agcgcggcguguacgucg

SEQ ID NO: 1060488 - RNA, 19 nt, Mycobacterium bovis subsp bovis AF2122/97
agcgcggcguguacgucga

SEQ ID NO: 1060489 - RNA, 20 nt, Mycobacterium bovis subsp bovis AF2122/97
agcgcggcuacggucgcagu

SEQ ID NO: 1060490 - RNA, 23 nt, Mycobacterium bovis subsp bovis AF2122/97
agcgcgggauguaccccggcccg

SEQ ID NO: 1060491 - RNA, 14 nt, Mycobacterium bovis subsp bovis AF2122/97
agcgcgggcucaca

SEQ ID NO: 1060492 - RNA, 20 nt, Mycobacterium bovis subsp bovis AF2122/97
agcgcggguggcucgggugg

SEQ ID NO: 1060493 - RNA, 22 nt, Mycobacterium bovis subsp bovis AF2122/97
agcgcgucguccagggcgacga

SEQ ID NO: 1060494 - RNA, 16 nt, Mycobacterium bovis subsp bovis AF2122/97
agcgcgugugcgucgc

SEQ ID NO: 1060495 - RNA, 16 nt, Mycobacterium bovis subsp bovis AF2122/97
agcgcugagccgcuca

SEQ ID NO: 1060496 - RNA, 22 nt, Mycobacterium bovis subsp bovis AF2122/97
agcgcgugcuguggaugccgac

SEQ ID NO: 1060497 - RNA, 16 nt, Mycobacterium bovis subsp bovis AF2122/97
agcgcguucggcaccu

SEQ ID NO: 1060498 - RNA, 19 nt, Mycobacterium bovis subsp bovis AF2122/97
agcgcgugugcgucgcacg

SEQ ID NO: 1060499 - RNA, 13 nt, Mycobacterium bovis subsp bovis AF2122/97
agcgcugccaccg

SEQ ID NO: 1060500 - RNA, 14 nt, Mycobacterium bovis subsp bovis AF2122/97
agcgcugccaccgc

SEQ ID NO: 1060501 - RNA, 16 nt, Mycobacterium bovis subsp bovis AF2122/97
agcgcugccaccgcgg

SEQ ID NO: 1060502 - RNA, 17 nt, Mycobacterium bovis subsp bovis AF2122/97
agcgcugccaccgcggu

SEQ ID NO: 1060503 - RNA, 15 nt, Mycobacterium bovis subsp bovis AF2122/97
agcgcuucacgggcc

SEQ ID NO: 1060504 - RNA, 21 nt, Mycobacterium bovis subsp bovis AF2122/97
agcgcuggcaggccgggcacc

SEQ ID NO: 1060505 - RNA, 21 nt, Mycobacterium bovis subsp bovis AF2122/97
agcgcugccaccgcgguggcg

SEQ ID NO: 1060506 - RNA, 10 nt, Mycobacterium bovis subsp bovis AF2122/97
agcgccgccg

SEQ ID NO: 1060507 - RNA, 23 nt, Mycobacterium bovis subsp bovis AF2122/97
agcgccgccggaagcgccggccg

SEQ ID NO: 1060508 - RNA, 21 nt, Mycobacterium bovis subsp bovis AF2122/97
agcgccgccgcgagcgccggc

SEQ ID NO: 1060509 - RNA, 14 nt, Mycobacterium bovis subsp bovis AF2122/97
agcgccgccgcgag

SEQ ID NO: 1060510 - RNA, 15 nt, Mycobacterium bovis subsp bovis AF2122/97
agcgccgccgcgagc

SEQ ID NO: 1060511 - RNA, 20 nt, Mycobacterium bovis subsp bovis AF2122/97
agcgccgccgcgagcgccgg

SEQ ID NO: 1060512 - RNA, 15 nt, Mycobacterium bovis subsp bovis AF2122/97
agcgccgccgccgac

SEQ ID NO: 1060513 - RNA, 14 nt, Mycobacterium bovis subsp bovis AF2122/97
agcgccgccggcgc

SEQ ID NO: 1060514 - RNA, 16 nt, Mycobacterium bovis subsp bovis AF2122/97
agcgccgccggcgccg

SEQ ID NO: 1060515 - RNA, 13 nt, Mycobacterium bovis subsp bovis AF2122/97
agcgccgccaccc

SEQ ID NO: 1060516 - RNA, 12 nt, Mycobacterium bovis subsp bovis AF2122/97
agcgccgcacuu

SEQ ID NO: 1060517 - RNA, 23 nt, Mycobacterium bovis subsp bovis AF2122/97
agcgccgcagcgaaaacccgguc

SEQ ID NO: 1060518 - RNA, 21 nt, Mycobacterium bovis subsp bovis AF2122/97
agcgccgccagguguucgccg

SEQ ID NO: 1060519 - RNA, 23 nt, Mycobacterium bovis subsp bovis AF2122/97
agcgccggucagggacgaacugc

SEQ ID NO: 1060520 - RNA, 16 nt, Mycobacterium bovis subsp bovis AF2122/97
agcgccguacagcggc

SEQ ID NO: 1060521 - RNA, 18 nt, Mycobacterium bovis subsp bovis AF2122/97
agcgccguacagcggcgg

SEQ ID NO: 1060522 - RNA, 19 nt, Mycobacterium bovis subsp bovis AF2122/97
agcgccguacagcggcggc

SEQ ID NO: 1060523 - RNA, 15 nt, Mycobacterium bovis subsp bovis AF2122/97
agcgccggcuucggg

SEQ ID NO: 1060524 - RNA, 19 nt, Mycobacterium bovis subsp bovis AF2122/97
agcgccggcuucggguguu

SEQ ID NO: 1060525 - RNA, 12 nt, Mycobacterium bovis subsp bovis AF2122/97
agcgccggccga

SEQ ID NO: 1060526 - RNA, 21 nt, Mycobacterium bovis subsp bovis AF2122/97
agcgccggccgcggcggcccc

SEQ ID NO: 1060527 - RNA, 13 nt, Mycobacterium bovis subsp bovis AF2122/97
agcgccgcgccca

SEQ ID NO: 1060528 - RNA, 17 nt, Mycobacterium bovis subsp bovis AF2122/97
agcgccuccagcaccac

SEQ ID NO: 1060529 - RNA, 19 nt, Mycobacterium bovis subsp bovis AF2122/97
agcgccgugaacggaugug

SEQ ID NO: 1060530 - RNA, 22 nt, Mycobacterium bovis subsp bovis AF2122/97
agcgccuccacucuucgggcgg

SEQ ID NO: 1060531 - RNA, 17 nt, Mycobacterium bovis subsp bovis AF2122/97
agcgccuugaccagcag

SEQ ID NO: 1060532 - RNA, 21 nt, Mycobacterium bovis subsp bovis AF2122/97
agcgccgauguggccggcgau

SEQ ID NO: 1060533 - RNA, 22 nt, Mycobacterium bovis subsp bovis AF2122/97
agcgccgauguggccggcgaug

SEQ ID NO: 1060534 - RNA, 18 nt, Mycobacterium bovis subsp bovis AF2122/97
agcgcccuuggacgcgau

SEQ ID NO: 1060535 - RNA, 19 nt, Mycobacterium bovis subsp bovis AF2122/97
agcgcccuuggacgcgaug

SEQ ID NO: 1060536 - RNA, 17 nt, Mycobacterium bovis subsp bovis AF2122/97
agcgccgaauucauccg

SEQ ID NO: 1060537 - RNA, 22 nt, Mycobacterium bovis subsp bovis AF2122/97
agcgcccgucguagguggccgg

SEQ ID NO: 1060538 - RNA, 17 nt, Mycobacterium bovis subsp bovis AF2122/97
agcgcccagaucgccga

SEQ ID NO: 1060539 - RNA, 20 nt, Mycobacterium bovis subsp bovis AF2122/97
agcgcccaccguagacgaca

SEQ ID NO: 1060540 - RNA, 16 nt, Mycobacterium bovis subsp bovis AF2122/97
agcgccaggccgcaca

SEQ ID NO: 1060541 - RNA, 13 nt, Mycobacterium bovis subsp bovis AF2122/97
agcgccaguagca

SEQ ID NO: 1060542 - RNA, 15 nt, Mycobacterium bovis subsp bovis AF2122/97
agcgccaggggugug

SEQ ID NO: 1060543 - RNA, 19 nt, Mycobacterium bovis subsp bovis AF2122/97
agcgccaguucgcggcugc

SEQ ID NO: 1060544 - RNA, 21 nt, Mycobacterium bovis subsp bovis AF2122/97
agcgauggguguugcuggccg

SEQ ID NO: 1060545 - RNA, 21 nt, Mycobacterium bovis subsp bovis AF2122/97
agcgauucccaaccgguggcc

SEQ ID NO: 1060546 - RNA, 23 nt, Mycobacterium bovis subsp bovis AF2122/97
agcgauucccaaccgguggccgg

SEQ ID NO: 1060547 - RNA, 22 nt, Mycobacterium bovis subsp bovis AF2122/97
agcgaugaugucggccgcgggu

SEQ ID NO: 1060548 - RNA, 13 nt, Mycobacterium bovis subsp bovis AF2122/97
agcgauggcacca

SEQ ID NO: 1060549 - RNA, 17 nt, Mycobacterium bovis subsp bovis AF2122/97
agcggaccgagccgauc

SEQ ID NO: 1060550 - RNA, 21 nt, Mycobacterium bovis subsp bovis AF2122/97
agcggaccgagccgaucugcu

SEQ ID NO: 1060551 - RNA, 16 nt, Mycobacterium bovis subsp bovis AF2122/97
agcggaccgaugacga

SEQ ID NO: 1060552 - RNA, 17 nt, Mycobacterium bovis subsp bovis AF2122/97
agcggaccgaugacgau

SEQ ID NO: 1060553 - RNA, 23 nt, Mycobacterium bovis subsp bovis AF2122/97
agcggaccgaugacgaucggcgg

SEQ ID NO: 1060554 - RNA, 14 nt, Mycobacterium bovis subsp bovis AF2122/97
agcggacagcucgc

SEQ ID NO: 1060555 - RNA, 16 nt, Mycobacterium bovis subsp bovis AF2122/97
agcggacagcucgcgg

SEQ ID NO: 1060556 - RNA, 18 nt, Mycobacterium bovis subsp bovis AF2122/97
agcggaccaccgcucgcc

SEQ ID NO: 1060557 - RNA, 12 nt, Mycobacterium bovis subsp bovis AF2122/97
agcggacccgac

SEQ ID NO: 1060558 - RNA, 20 nt, Mycobacterium bovis subsp bovis AF2122/97
agcggacacauaagcccccg

SEQ ID NO: 1060559 - RNA, 17 nt, Mycobacterium bovis subsp bovis AF2122/97
agcgcuucggcggucgc

SEQ ID NO: 1060560 - RNA, 18 nt, Mycobacterium bovis subsp bovis AF2122/97
agcgcuucggcggucgcc

SEQ ID NO: 1060561 - RNA, 16 nt, Mycobacterium bovis subsp bovis AF2122/97
agcggaauggcgccgg

SEQ ID NO: 1060562 - RNA, 19 nt, Mycobacterium bovis subsp bovis AF2122/97
agcggagcaauuccacgau

SEQ ID NO: 1060563 - RNA, 13 nt, Mycobacterium bovis subsp bovis AF2122/97
agcggagccggcg

SEQ ID NO: 1060564 - RNA, 16 nt, Mycobacterium bovis subsp bovis AF2122/97
agcggcaccgcgccgg

SEQ ID NO: 1060565 - RNA, 18 nt, Mycobacterium bovis subsp bovis AF2122/97
agcggcaccgcgccggcg

SEQ ID NO: 1060566 - RNA, 13 nt, Mycobacterium bovis subsp bovis AF2122/97
agcggcaccgcgg

SEQ ID NO: 1060567 - RNA, 17 nt, Mycobacterium bovis subsp bovis AF2122/97
agcggcaccgcggccag

SEQ ID NO: 1060568 - RNA, 19 nt, Mycobacterium bovis subsp bovis AF2122/97
agcggcaccgcggccagcg

SEQ ID NO: 1060569 - RNA, 21 nt, Mycobacterium bovis subsp bovis AF2122/97
agcggcacacccaucaccgcc

SEQ ID NO: 1060570 - RNA, 22 nt, Mycobacterium bovis subsp bovis AF2122/97
agcggcacacccaucaccgcca

SEQ ID NO: 1060571 - RNA, 23 nt, Mycobacterium bovis subsp bovis AF2122/97
agcggauagcggcaaagccgggu

SEQ ID NO: 1060572 - RNA, 23 nt, Mycobacterium bovis subsp bovis AF2122/97
agcggcagccuggccucgccauu

SEQ ID NO: 1060573 - RNA, 16 nt, Mycobacterium bovis subsp bovis AF2122/97
agcggcaucggccagc

SEQ ID NO: 1060574 - RNA, 19 nt, Mycobacterium bovis subsp bovis AF2122/97
agcggcaucggucaccgcg

SEQ ID NO: 1060575 - RNA, 14 nt, Mycobacterium bovis subsp bovis AF2122/97
agcggccaccgccg

SEQ ID NO: 1060576 - RNA, 17 nt, Mycobacterium bovis subsp bovis AF2122/97
agcggccaccgccgccg

SEQ ID NO: 1060577 - RNA, 21 nt, Mycobacterium bovis subsp bovis AF2122/97
agcggccaccgccgccgccac

SEQ ID NO: 1060578 - RNA, 21 nt, Mycobacterium bovis subsp bovis AF2122/97
agcggcaguuguggcgcugcg

SEQ ID NO: 1060579 - RNA, 19 nt, Mycobacterium bovis subsp bovis AF2122/97
agcggcaugcgaaccgagg

SEQ ID NO: 1060580 - RNA, 21 nt, Mycobacterium bovis subsp bovis AF2122/97
agcggccaccguagccagcag

SEQ ID NO: 1060581 - RNA, 14 nt, Mycobacterium bovis subsp bovis AF2122/97
agcggccgcaggcg

SEQ ID NO: 1060582 - RNA, 15 nt, Mycobacterium bovis subsp bovis AF2122/97
agcggcccgucaccg

SEQ ID NO: 1060583 - RNA, 18 nt, Mycobacterium bovis subsp bovis AF2122/97
agcggcccgucaccgcgg

SEQ ID NO: 1060584 - RNA, 16 nt, Mycobacterium bovis subsp bovis AF2122/97
agcggccaggucgguc

SEQ ID NO: 1060585 - RNA, 21 nt, Mycobacterium bovis subsp bovis AF2122/97
agcggccauaucgcccaccac

SEQ ID NO: 1060586 - RNA, 22 nt, Mycobacterium bovis subsp bovis AF2122/97
agcggccaccguagccagcagg

SEQ ID NO: 1060587 - RNA, 18 nt, Mycobacterium bovis subsp bovis AF2122/97
agcggccagcagugcggu

SEQ ID NO: 1060588 - RNA, 12 nt, Mycobacterium bovis subsp bovis AF2122/97
agcggccagcau

SEQ ID NO: 1060589 - RNA, 19 nt, Mycobacterium bovis subsp bovis AF2122/97
agcggccagcccagccggg

SEQ ID NO: 1060590 - RNA, 20 nt, Mycobacterium bovis subsp bovis AF2122/97
agcggccagcccagccggga

SEQ ID NO: 1060591 - RNA, 21 nt, Mycobacterium bovis subsp bovis AF2122/97
agcggccuaggacgccgcccu

SEQ ID NO: 1060592 - RNA, 12 nt, Mycobacterium bovis subsp bovis AF2122/97
agcggccgucgg

SEQ ID NO: 1060593 - RNA, 21 nt, Mycobacterium bovis subsp bovis AF2122/97
agcggccgucgggacggccaa

SEQ ID NO: 1060594 - RNA, 18 nt, Mycobacterium bovis subsp bovis AF2122/97
agcggccuccagcacccg

SEQ ID NO: 1060595 - RNA, 21 nt, Mycobacterium bovis subsp bovis AF2122/97
agcggccuccagcacccgguc

SEQ ID NO: 1060596 - RNA, 14 nt, Mycobacterium bovis subsp bovis AF2122/97
agcggccugcucgg

SEQ ID NO: 1060597 - RNA, 14 nt, Mycobacterium bovis subsp bovis AF2122/97
agcggccgaccgcg

SEQ ID NO: 1060598 - RNA, 15 nt, Mycobacterium bovis subsp bovis AF2122/97
agcggccgaccgcga

SEQ ID NO: 1060599 - RNA, 13 nt, Mycobacterium bovis subsp bovis AF2122/97
agcggccgcgaug

SEQ ID NO: 1060600 - RNA, 12 nt, Mycobacterium bovis subsp bovis AF2122/97
agcggccgggcg

SEQ ID NO: 1060601 - RNA, 17 nt, Mycobacterium bovis subsp bovis AF2122/97
agcggccgggcggccag

SEQ ID NO: 1060602 - RNA, 23 nt, Mycobacterium bovis subsp bovis AF2122/97
agcggcggcaacccugcccggcc

SEQ ID NO: 1060603 - RNA, 18 nt, Mycobacterium bovis subsp bovis AF2122/97
agcggcggcaacgguggc

SEQ ID NO: 1060604 - RNA, 16 nt, Mycobacterium bovis subsp bovis AF2122/97
agcggcgagccaaacu

SEQ ID NO: 1060605 - RNA, 20 nt, Mycobacterium bovis subsp bovis AF2122/97
agcggcgaccgcauccgguc

SEQ ID NO: 1060606 - RNA, 19 nt, Mycobacterium bovis subsp bovis AF2122/97
agcggcgguggugucgcuc

SEQ ID NO: 1060607 - RNA, 19 nt, Mycobacterium bovis subsp bovis AF2122/97
agcgggcgaugagcgcgau

SEQ ID NO: 1060608 - RNA, 22 nt, Mycobacterium bovis subsp bovis AF2122/97
agcgggcgaugagcgcgaucuc

SEQ ID NO: 1060609 - RNA, 13 nt, Mycobacterium bovis subsp bovis AF2122/97
agcgggcgucgcg

SEQ ID NO: 1060610 - RNA, 23 nt, Mycobacterium bovis subsp bovis AF2122/97
agcgggcgucgcgguagccuggc

SEQ ID NO: 1060611 - RNA, 22 nt, Mycobacterium bovis subsp bovis AF2122/97
agcgggcgggccugcgcgaucc

SEQ ID NO: 1060612 - RNA, 23 nt, Mycobacterium bovis subsp bovis AF2122/97
agcggcggucucggcgucgacca

SEQ ID NO: 1060613 - RNA, 15 nt, Mycobacterium bovis subsp bovis AF2122/97
agcggcgggucccgc

SEQ ID NO: 1060614 - RNA, 19 nt, Mycobacterium bovis subsp bovis AF2122/97
agcggcgggcgaugacccg

SEQ ID NO: 1060615 - RNA, 17 nt, Mycobacterium bovis subsp bovis AF2122/97
agcggcgggggcgucgc

SEQ ID NO: 1060616 - RNA, 19 nt, Mycobacterium bovis subsp bovis AF2122/97
agcggcgggggcgucgccg

SEQ ID NO: 1060617 - RNA, 20 nt, Mycobacterium bovis subsp bovis AF2122/97
agcggcggguagauccgccg

SEQ ID NO: 1060618 - RNA, 18 nt, Mycobacterium bovis subsp bovis AF2122/97
agcggcggcgacgagcgc

SEQ ID NO: 1060619 - RNA, 20 nt, Mycobacterium bovis subsp bovis AF2122/97
agcggcggcggcacgcucgc

SEQ ID NO: 1060620 - RNA, 17 nt, Mycobacterium bovis subsp bovis AF2122/97
agcggcggcggcggcaa

SEQ ID NO: 1060621 - RNA, 18 nt, Mycobacterium bovis subsp bovis AF2122/97
agcggcggaaggacggca

SEQ ID NO: 1060622 - RNA, 20 nt, Mycobacterium bovis subsp bovis AF2122/97
agcgguccggauugaagucg

SEQ ID NO: 1060623 - RNA, 17 nt, Mycobacterium bovis subsp bovis AF2122/97
agcgguccagccaccgc

SEQ ID NO: 1060624 - RNA, 21 nt, Mycobacterium bovis subsp bovis AF2122/97
agcgguccagcgucgccgcca

SEQ ID NO: 1060625 - RNA, 14 nt, Mycobacterium bovis subsp bovis AF2122/97
agcggucagccggc

SEQ ID NO: 1060626 - RNA, 15 nt, Mycobacterium bovis subsp bovis AF2122/97
agcgguagccgagcu

SEQ ID NO: 1060627 - RNA, 15 nt, Mycobacterium bovis subsp bovis AF2122/97
agcgguaggagcggg

SEQ ID NO: 1060628 - RNA, 14 nt, Mycobacterium bovis subsp bovis AF2122/97
agcgguaaugccag

SEQ ID NO: 1060629 - RNA, 18 nt, Mycobacterium bovis subsp bovis AF2122/97
agcgguagcucauugccg

SEQ ID NO: 1060630 - RNA, 12 nt, Mycobacterium bovis subsp bovis AF2122/97
agcgguagccga

SEQ ID NO: 1060631 - RNA, 19 nt, Mycobacterium bovis subsp bovis AF2122/97
agcggggauguccgcggcc

SEQ ID NO: 1060632 - RNA, 20 nt, Mycobacterium bovis subsp bovis AF2122/97
agcgggcuguaggcgaucac

SEQ ID NO: 1060633 - RNA, 17 nt, Mycobacterium bovis subsp bovis AF2122/97
agcguccaggucaugcc

SEQ ID NO: 1060634 - RNA, 22 nt, Mycobacterium bovis subsp bovis AF2122/97
agcgucaggccuccaaaaucgc

SEQ ID NO: 1060635 - RNA, 21 nt, Mycobacterium bovis subsp bovis AF2122/97
agcguccagcgccugcgccca

SEQ ID NO: 1060636 - RNA, 14 nt, Mycobacterium bovis subsp bovis AF2122/97
agcgucaaccgguc

SEQ ID NO: 1060637 - RNA, 15 nt, Mycobacterium bovis subsp bovis AF2122/97
agcgucaaccggucc

SEQ ID NO: 1060638 - RNA, 23 nt, Mycobacterium bovis subsp bovis AF2122/97
agcgucacccugucgcgcaccgg

SEQ ID NO: 1060639 - RNA, 12 nt, Mycobacterium bovis subsp bovis AF2122/97
agcgucacccug

SEQ ID NO: 1060640 - RNA, 22 nt, Mycobacterium bovis subsp bovis AF2122/97
agcgucaaccacggccgccgcg

SEQ ID NO: 1060641 - RNA, 18 nt, Mycobacterium bovis subsp bovis AF2122/97
agcguauuggacgcugcc

SEQ ID NO: 1060642 - RNA, 16 nt, Mycobacterium bovis subsp bovis AF2122/97
agcguagcccgaguug

SEQ ID NO: 1060643 - RNA, 14 nt, Mycobacterium bovis subsp bovis AF2122/97
agcgguugaaguug

SEQ ID NO: 1060644 - RNA, 18 nt, Mycobacterium bovis subsp bovis AF2122/97
agcgguuguccggucgcc

SEQ ID NO: 1060645 - RNA, 23 nt, Mycobacterium bovis subsp bovis AF2122/97
agcgguuuccgcacgaucgcccg

SEQ ID NO: 1060646 - RNA, 23 nt, Mycobacterium bovis subsp bovis AF2122/97
agcgguuucgaauguuucggcga

SEQ ID NO: 1060647 - RNA, 18 nt, Mycobacterium bovis subsp bovis AF2122/97
agcguaacguggcugcga

SEQ ID NO: 1060648 - RNA, 19 nt, Mycobacterium bovis subsp bovis AF2122/97
agcguaaugcugcugcagc

SEQ ID NO: 1060649 - RNA, 19 nt, Mycobacterium bovis subsp bovis AF2122/97
guucgaugggugcaccgaa

SEQ ID NO: 1060650 - RNA, 12 nt, Mycobacterium bovis subsp bovis AF2122/97
guucgcacaccu

SEQ ID NO: 1060651 - RNA, 19 nt, Mycobacterium bovis subsp bovis AF2122/97
guucgcccacagcuugccc

SEQ ID NO: 1060652 - RNA, 20 nt, Mycobacterium bovis subsp bovis AF2122/97
guucgcccacagcuugcccg

SEQ ID NO: 1060653 - RNA, 16 nt, Mycobacterium bovis subsp bovis AF2122/97
guucgcccacaugccg

SEQ ID NO: 1060654 - RNA, 18 nt, Mycobacterium bovis subsp bovis AF2122/97
guucgcccacaugccggu

SEQ ID NO: 1060655 - RNA, 16 nt, Mycobacterium bovis subsp bovis AF2122/97
guucgccgcccggcgu

SEQ ID NO: 1060656 - RNA, 14 nt, Mycobacterium bovis subsp bovis AF2122/97
guucgccgaagccg

SEQ ID NO: 1060657 - RNA, 17 nt, Mycobacterium bovis subsp bovis AF2122/97
guucgccgaagccggac

SEQ ID NO: 1060658 - RNA, 23 nt, Mycobacterium bovis subsp bovis AF2122/97
guucgccgcgaaugucgccgccu

SEQ ID NO: 1060659 - RNA, 15 nt, Mycobacterium bovis subsp bovis AF2122/97
guucgacucaugccg

SEQ ID NO: 1060660 - RNA, 13 nt, Mycobacterium bovis subsp bovis AF2122/97
guucgacggcguc

SEQ ID NO: 1060661 - RNA, 15 nt, Mycobacterium bovis subsp bovis AF2122/97
guucgacggcgucaa

SEQ ID NO: 1060662 - RNA, 14 nt, Mycobacterium bovis subsp bovis AF2122/97
guucgacgggccgg

SEQ ID NO: 1060663 - RNA, 17 nt, Mycobacterium bovis subsp bovis AF2122/97
guucgacgggccggacc

SEQ ID NO: 1060664 - RNA, 21 nt, Mycobacterium bovis subsp bovis AF2122/97
guucgagaccccgacgaugcg

SEQ ID NO: 1060665 - RNA, 16 nt, Mycobacterium bovis subsp bovis AF2122/97
guucgaucccguccgc

SEQ ID NO: 1060666 - RNA, 17 nt, Mycobacterium bovis subsp bovis AF2122/97
guucgauagcggcggcg

SEQ ID NO: 1060667 - RNA, 14 nt, Mycobacterium bovis subsp bovis AF2122/97
guucgaguucggcc

SEQ ID NO: 1060668 - RNA, 21 nt, Mycobacterium bovis subsp bovis AF2122/97
guucaccaccgcacaucgucc

SEQ ID NO: 1060669 - RNA, 20 nt, Mycobacterium bovis subsp bovis AF2122/97
guucgaccguguaaccaucg

SEQ ID NO: 1060670 - RNA, 15 nt, Mycobacterium bovis subsp bovis AF2122/97
guucgacggacaccc

SEQ ID NO: 1060671 - RNA, 14 nt, Mycobacterium bovis subsp bovis AF2122/97
guuauugaugcccg

SEQ ID NO: 1060672 - RNA, 18 nt, Mycobacterium bovis subsp bovis AF2122/97
guucaacgaggccgacga

SEQ ID NO: 1060673 - RNA, 17 nt, Mycobacterium bovis subsp bovis AF2122/97
guucaacuccggcaccg

SEQ ID NO: 1060674 - RNA, 20 nt, Mycobacterium bovis subsp bovis AF2122/97
guucaacuccggcaccggca

SEQ ID NO: 1060675 - RNA, 17 nt, Mycobacterium bovis subsp bovis AF2122/97
guucaacucgggcagcu

SEQ ID NO: 1060676 - RNA, 15 nt, Mycobacterium bovis subsp bovis AF2122/97
guucggaaucggagc

SEQ ID NO: 1060677 - RNA, 20 nt, Mycobacterium bovis subsp bovis AF2122/97
guucggaugucucggcacca

SEQ ID NO: 1060678 - RNA, 17 nt, Mycobacterium bovis subsp bovis AF2122/97
guucggacggcugguag

SEQ ID NO: 1060679 - RNA, 13 nt, Mycobacterium bovis subsp bovis AF2122/97
guucggagcuggg

SEQ ID NO: 1060680 - RNA, 14 nt, Mycobacterium bovis subsp bovis AF2122/97
guucggagcugggc

SEQ ID NO: 1060681 - RNA, 15 nt, Mycobacterium bovis subsp bovis AF2122/97
guucgcugacggcca

SEQ ID NO: 1060682 - RNA, 16 nt, Mycobacterium bovis subsp bovis AF2122/97
guucgcgucgccgaug

SEQ ID NO: 1060683 - RNA, 16 nt, Mycobacterium bovis subsp bovis AF2122/97
guucggccauggcggc

SEQ ID NO: 1060684 - RNA, 17 nt, Mycobacterium bovis subsp bovis AF2122/97
guucggccauggcggcg

SEQ ID NO: 1060685 - RNA, 12 nt, Mycobacterium bovis subsp bovis AF2122/97
guucggccguca

SEQ ID NO: 1060686 - RNA, 13 nt, Mycobacterium bovis subsp bovis AF2122/97
guucggccaccaa

SEQ ID NO: 1060687 - RNA, 15 nt, Mycobacterium bovis subsp bovis AF2122/97
guucggccaacccgg

SEQ ID NO: 1060688 - RNA, 21 nt, Mycobacterium bovis subsp bovis AF2122/97
guucggcacaaccaacgacag

SEQ ID NO: 1060689 - RNA, 18 nt, Mycobacterium bovis subsp bovis AF2122/97
guucgcggccaucgccga

SEQ ID NO: 1060690 - RNA, 19 nt, Mycobacterium bovis subsp bovis AF2122/97
guucgcgggcgucccgcau

SEQ ID NO: 1060691 - RNA, 22 nt, Mycobacterium bovis subsp bovis AF2122/97
guucgcgggcgucccgcauacc

SEQ ID NO: 1060692 - RNA, 15 nt, Mycobacterium bovis subsp bovis AF2122/97
guucgcgucacacca

SEQ ID NO: 1060693 - RNA, 17 nt, Mycobacterium bovis subsp bovis AF2122/97
guucgcgucacaccagc

SEQ ID NO: 1060694 - RNA, 15 nt, Mycobacterium bovis subsp bovis AF2122/97
guucgcgucgccgau

SEQ ID NO: 1060695 - RNA, 19 nt, Mycobacterium bovis subsp bovis AF2122/97
guucgcgccguggcgucgg

SEQ ID NO: 1060696 - RNA, 20 nt, Mycobacterium bovis subsp bovis AF2122/97
guucgccuggucaccgaaga

SEQ ID NO: 1060697 - RNA, 17 nt, Mycobacterium bovis subsp bovis AF2122/97
guucgcgaagcugugcc

SEQ ID NO: 1060698 - RNA, 23 nt, Mycobacterium bovis subsp bovis AF2122/97
guucgcgaagcugugcccggcgc

SEQ ID NO: 1060699 - RNA, 22 nt, Mycobacterium bovis subsp bovis AF2122/97
guugacccaucaugguccgggc

SEQ ID NO: 1060700 - RNA, 19 nt, Mycobacterium bovis subsp bovis AF2122/97
guugacccaucucgucguc

SEQ ID NO: 1060701 - RNA, 22 nt, Mycobacterium bovis subsp bovis AF2122/97
guugacccaucucgucgucggg

SEQ ID NO: 1060702 - RNA, 12 nt, Mycobacterium bovis subsp bovis AF2122/97
guugacacccgg

SEQ ID NO: 1060703 - RNA, 23 nt, Mycobacterium bovis subsp bovis AF2122/97
guugacacccgggccaccccgag

SEQ ID NO: 1060704 - RNA, 14 nt, Mycobacterium bovis subsp bovis AF2122/97
guugaccaccaccg

SEQ ID NO: 1060705 - RNA, 22 nt, Mycobacterium bovis subsp bovis AF2122/97
guugaccaccaccgagccgucc

SEQ ID NO: 1060706 - RNA, 19 nt, Mycobacterium bovis subsp bovis AF2122/97
guugacucugcguccacca

SEQ ID NO: 1060707 - RNA, 20 nt, Mycobacterium bovis subsp bovis AF2122/97
guugagaacaacgcgucgau

SEQ ID NO: 1060708 - RNA, 13 nt, Mycobacterium bovis subsp bovis AF2122/97
guugacuggccgc

SEQ ID NO: 1060709 - RNA, 19 nt, Mycobacterium bovis subsp bovis AF2122/97
guugacuggccgcccggcg

SEQ ID NO: 1060710 - RNA, 21 nt, Mycobacterium bovis subsp bovis AF2122/97
guugacuggccgcccggcgag

SEQ ID NO: 1060711 - RNA, 20 nt, Mycobacterium bovis subsp bovis AF2122/97
guugaaggcuugugccagau

SEQ ID NO: 1060712 - RNA, 16 nt, Mycobacterium bovis subsp bovis AF2122/97
guugaaggugccggcg

SEQ ID NO: 1060713 - RNA, 20 nt, Mycobacterium bovis subsp bovis AF2122/97
guugaaggugccggcguuag

SEQ ID NO: 1060714 - RNA, 14 nt, Mycobacterium bovis subsp bovis AF2122/97
guugaaggcgccgg

SEQ ID NO: 1060715 - RNA, 14 nt, Mycobacterium bovis subsp bovis AF2122/97
guugaagccgcccg

SEQ ID NO: 1060716 - RNA, 18 nt, Mycobacterium bovis subsp bovis AF2122/97
guugaagacggccaccgg

SEQ ID NO: 1060717 - RNA, 21 nt, Mycobacterium bovis subsp bovis AF2122/97
guugaagacggccaccggggu

SEQ ID NO: 1060718 - RNA, 16 nt, Mycobacterium bovis subsp bovis AF2122/97
guugaagaaagcggcc

SEQ ID NO: 1060719 - RNA, 23 nt, Mycobacterium bovis subsp bovis AF2122/97
guugaagccgauguccgacgcca

SEQ ID NO: 1060720 - RNA, 16 nt, Mycobacterium bovis subsp bovis AF2122/97
guucucgcccacccgc

SEQ ID NO: 1060721 - RNA, 22 nt, Mycobacterium bovis subsp bovis AF2122/97
guucucgccgaagcccggccac

SEQ ID NO: 1060722 - RNA, 22 nt, Mycobacterium bovis subsp bovis AF2122/97
guucucgcuguugaagccgccc

SEQ ID NO: 1060723 - RNA, 23 nt, Mycobacterium bovis subsp bovis AF2122/97
guucucgcuguugaagccgcccg

SEQ ID NO: 1060724 - RNA, 18 nt, Mycobacterium bovis subsp bovis AF2122/97
guucucggucccgccggu

SEQ ID NO: 1060725 - RNA, 22 nt, Mycobacterium bovis subsp bovis AF2122/97
guucugcuggauguaguuggcg

SEQ ID NO: 1060726 - RNA, 16 nt, Mycobacterium bovis subsp bovis AF2122/97
guucugcuggcugugg

SEQ ID NO: 1060727 - RNA, 18 nt, Mycobacterium bovis subsp bovis AF2122/97
guucugggccugcggcau

SEQ ID NO: 1060728 - RNA, 23 nt, Mycobacterium bovis subsp bovis AF2122/97
guucugggaccgauaaguucggc

SEQ ID NO: 1060729 - RNA, 18 nt, Mycobacterium bovis subsp bovis AF2122/97
guucugccuuaccaaccg

SEQ ID NO: 1060730 - RNA, 13 nt, Mycobacterium bovis subsp bovis AF2122/97
guucugcgcccac

SEQ ID NO: 1060731 - RNA, 17 nt, Mycobacterium bovis subsp bovis AF2122/97
guucugcgcccguccgc

SEQ ID NO: 1060732 - RNA, 23 nt, Mycobacterium bovis subsp bovis AF2122/97
guucugcgcucccguacgccggc

SEQ ID NO: 1060733 - RNA, 22 nt, Mycobacterium bovis subsp bovis AF2122/97
guucugcggccgcgugccgccc

SEQ ID NO: 1060734 - RNA, 15 nt, Mycobacterium bovis subsp bovis AF2122/97
guucugcggucgguc

SEQ ID NO: 1060735 - RNA, 21 nt, Mycobacterium bovis subsp bovis AF2122/97
guucggcguacaaaccgucgg

SEQ ID NO: 1060736 - RNA, 13 nt, Mycobacterium bovis subsp bovis AF2122/97
guucggcgucgac

SEQ ID NO: 1060737 - RNA, 14 nt, Mycobacterium bovis subsp bovis AF2122/97
guucggcugcgcuu

SEQ ID NO: 1060738 - RNA, 16 nt, Mycobacterium bovis subsp bovis AF2122/97
guucggcuggcgucga

SEQ ID NO: 1060739 - RNA, 14 nt, Mycobacterium bovis subsp bovis AF2122/97
guucgggacgcgag

SEQ ID NO: 1060740 - RNA, 16 nt, Mycobacterium bovis subsp bovis AF2122/97
guucgggcagcuggcg

SEQ ID NO: 1060741 - RNA, 14 nt, Mycobacterium bovis subsp bovis AF2122/97
guucggguacccgg

SEQ ID NO: 1060742 - RNA, 22 nt, Mycobacterium bovis subsp bovis AF2122/97
guucggguuggagaagauuuuc

SEQ ID NO: 1060743 - RNA, 14 nt, Mycobacterium bovis subsp bovis AF2122/97
guucggcgaugcgc

SEQ ID NO: 1060744 - RNA, 14 nt, Mycobacterium bovis subsp bovis AF2122/97
guucggucagcgcc

SEQ ID NO: 1060745 - RNA, 22 nt, Mycobacterium bovis subsp bovis AF2122/97
guucggucggggagcugcggcg

SEQ ID NO: 1060746 - RNA, 18 nt, Mycobacterium bovis subsp bovis AF2122/97
guucggugagguccucgg

SEQ ID NO: 1060747 - RNA, 16 nt, Mycobacterium bovis subsp bovis AF2122/97
guucgucgacgucggc

SEQ ID NO: 1060748 - RNA, 20 nt, Mycobacterium bovis subsp bovis AF2122/97
guucgucgacgucggcgagc

SEQ ID NO: 1060749 - RNA, 19 nt, Mycobacterium bovis subsp bovis AF2122/97
guucgucgggacgccgccc

SEQ ID NO: 1060750 - RNA, 22 nt, Mycobacterium bovis subsp bovis AF2122/97
guucgucgguugccacgccgcc

SEQ ID NO: 1060751 - RNA, 23 nt, Mycobacterium bovis subsp bovis AF2122/97
guucgucguaguccaggccguag

SEQ ID NO: 1060752 - RNA, 13 nt, Mycobacterium bovis subsp bovis AF2122/97
guucgucgucguc

SEQ ID NO: 1060753 - RNA, 16 nt, Mycobacterium bovis subsp bovis AF2122/97
guucgugagcggccag

SEQ ID NO: 1060754 - RNA, 14 nt, Mycobacterium bovis subsp bovis AF2122/97
guucgugcacggcg

SEQ ID NO: 1060755 - RNA, 15 nt, Mycobacterium bovis subsp bovis AF2122/97
guucgugcacggcga

SEQ ID NO: 1060756 - RNA, 22 nt, Mycobacterium bovis subsp bovis AF2122/97
guucguggcuggcaugccggcg

SEQ ID NO: 1060757 - RNA, 20 nt, Mycobacterium bovis subsp bovis AF2122/97
guucuauuccaugucgucga

SEQ ID NO: 1060758 - RNA, 13 nt, Mycobacterium bovis subsp bovis AF2122/97
guugccgccggcg

SEQ ID NO: 1060759 - RNA, 20 nt, Mycobacterium bovis subsp bovis AF2122/97
guugccgccgucaccgccgu

SEQ ID NO: 1060760 - RNA, 18 nt, Mycobacterium bovis subsp bovis AF2122/97
guugccgccggcgccgcc

SEQ ID NO: 1060761 - RNA, 19 nt, Mycobacterium bovis subsp bovis AF2122/97
guugccgccggcgccgccg

SEQ ID NO: 1060762 - RNA, 16 nt, Mycobacterium bovis subsp bovis AF2122/97
guugccgccgucaccg

SEQ ID NO: 1060763 - RNA, 14 nt, Mycobacterium bovis subsp bovis AF2122/97
guugccgccgucgc

SEQ ID NO: 1060764 - RNA, 18 nt, Mycobacterium bovis subsp bovis AF2122/97
guugccgccgucgccgcc

SEQ ID NO: 1060765 - RNA, 20 nt, Mycobacterium bovis subsp bovis AF2122/97
guugccgccguuaccgccgc

SEQ ID NO: 1060766 - RNA, 16 nt, Mycobacterium bovis subsp bovis AF2122/97
guugccgccguugccg

SEQ ID NO: 1060767 - RNA, 21 nt, Mycobacterium bovis subsp bovis AF2122/97
guugccgccguugccgccauu

SEQ ID NO: 1060768 - RNA, 22 nt, Mycobacterium bovis subsp bovis AF2122/97
guugccgccugucccgccggcc

SEQ ID NO: 1060769 - RNA, 18 nt, Mycobacterium bovis subsp bovis AF2122/97
guugccgccgcggcgccc

SEQ ID NO: 1060770 - RNA, 22 nt, Mycobacterium bovis subsp bovis AF2122/97
guugccgccgcggcgcccggcg

SEQ ID NO: 1060771 - RNA, 14 nt, Mycobacterium bovis subsp bovis AF2122/97
guugccgccgacgc

SEQ ID NO: 1060772 - RNA, 13 nt, Mycobacterium bovis subsp bovis AF2122/97
guugccgccgacu

SEQ ID NO: 1060773 - RNA, 13 nt, Mycobacterium bovis subsp bovis AF2122/97
guugccgccgccu

SEQ ID NO: 1060774 - RNA, 16 nt, Mycobacterium bovis subsp bovis AF2122/97
guugccgccgccuccg

SEQ ID NO: 1060775 - RNA, 16 nt, Mycobacterium bovis subsp bovis AF2122/97
guugagaucgcccgag

SEQ ID NO: 1060776 - RNA, 14 nt, Mycobacterium bovis subsp bovis AF2122/97
guugccgcccacgc

SEQ ID NO: 1060777 - RNA, 19 nt, Mycobacterium bovis subsp bovis AF2122/97
guugccgcccacgcugccc

SEQ ID NO: 1060778 - RNA, 16 nt, Mycobacterium bovis subsp bovis AF2122/97
guugccgccgaagccg

SEQ ID NO: 1060779 - RNA, 14 nt, Mycobacterium bovis subsp bovis AF2122/97
guugagcuggaccu

SEQ ID NO: 1060780 - RNA, 17 nt, Mycobacterium bovis subsp bovis AF2122/97
guugagccgccgcgacg

SEQ ID NO: 1060781 - RNA, 18 nt, Mycobacterium bovis subsp bovis AF2122/97
guugagcaggugcccgag

SEQ ID NO: 1060782 - RNA, 21 nt, Mycobacterium bovis subsp bovis AF2122/97
guugagaaccggcucaccacg

SEQ ID NO: 1060783 - RNA, 14 nt, Mycobacterium bovis subsp bovis AF2122/97
guugagaucgcccg

SEQ ID NO: 1060784 - RNA, 17 nt, Mycobacterium bovis subsp bovis AF2122/97
guugcgaucugcggcgc

SEQ ID NO: 1060785 - RNA, 20 nt, Mycobacterium bovis subsp bovis AF2122/97
guugcgaucugcggcgcccg

SEQ ID NO: 1060786 - RNA, 16 nt, Mycobacterium bovis subsp bovis AF2122/97
guugccguccaccgau

SEQ ID NO: 1060787 - RNA, 18 nt, Mycobacterium bovis subsp bovis AF2122/97
guugccgucggcguacag

SEQ ID NO: 1060788 - RNA, 16 nt, Mycobacterium bovis subsp bovis AF2122/97
guugccgucgucgccg

SEQ ID NO: 1060789 - RNA, 16 nt, Mycobacterium bovis subsp bovis AF2122/97
guugccguuggugccg

SEQ ID NO: 1060790 - RNA, 17 nt, Mycobacterium bovis subsp bovis AF2122/97
guugccggagacgucgc

SEQ ID NO: 1060791 - RNA, 19 nt, Mycobacterium bovis subsp bovis AF2122/97
guugccggaguugucgacg

SEQ ID NO: 1060792 - RNA, 14 nt, Mycobacterium bovis subsp bovis AF2122/97
guugccggaucgac

SEQ ID NO: 1060793 - RNA, 17 nt, Mycobacterium bovis subsp bovis AF2122/97
guugccgcggucggcga

SEQ ID NO: 1060794 - RNA, 19 nt, Mycobacterium bovis subsp bovis AF2122/97
guugccgcugaauuggcgc

SEQ ID NO: 1060795 - RNA, 19 nt, Mycobacterium bovis subsp bovis AF2122/97
guugccggacaaccugggg

SEQ ID NO: 1060796 - RNA, 22 nt, Mycobacterium bovis subsp bovis AF2122/97
guugccggucgcauggucgacg

SEQ ID NO: 1060797 - RNA, 16 nt, Mycobacterium bovis subsp bovis AF2122/97
guugccggcggcgacg

SEQ ID NO: 1060798 - RNA, 18 nt, Mycobacterium bovis subsp bovis AF2122/97
guugccggcuucggcgag

SEQ ID NO: 1060799 - RNA, 19 nt, Mycobacterium bovis subsp bovis AF2122/97
guugccgggguuggucguc

SEQ ID NO: 1060800 - RNA, 20 nt, Mycobacterium bovis subsp bovis AF2122/97
guugccgggguuggucgucg

SEQ ID NO: 1060801 - RNA, 22 nt, Mycobacterium bovis subsp bovis AF2122/97
guugcgacaccuccgucagcgc

SEQ ID NO: 1060802 - RNA, 20 nt, Mycobacterium bovis subsp bovis AF2122/97
guugcgccauaacaccgggu

SEQ ID NO: 1060803 - RNA, 19 nt, Mycobacterium bovis subsp bovis AF2122/97
guugcgccgaccggccacg

SEQ ID NO: 1060804 - RNA, 17 nt, Mycobacterium bovis subsp bovis AF2122/97
guugcuggucgccgucg

SEQ ID NO: 1060805 - RNA, 16 nt, Mycobacterium bovis subsp bovis AF2122/97
guugcgcggcaguggc

SEQ ID NO: 1060806 - RNA, 16 nt, Mycobacterium bovis subsp bovis AF2122/97
guugcgcucacccggu

SEQ ID NO: 1060807 - RNA, 16 nt, Mycobacterium bovis subsp bovis AF2122/97
guuggaagucccgccg

SEQ ID NO: 1060808 - RNA, 19 nt, Mycobacterium bovis subsp bovis AF2122/97
guuggaagucccgccguug

SEQ ID NO: 1060809 - RNA, 18 nt, Mycobacterium bovis subsp bovis AF2122/97
guuggccgaacagcugcc

SEQ ID NO: 1060810 - RNA, 19 nt, Mycobacterium bovis subsp bovis AF2122/97
guuggccgccacaccgccg

SEQ ID NO: 1060811 - RNA, 17 nt, Mycobacterium bovis subsp bovis AF2122/97
guuggccgagcagggcc

SEQ ID NO: 1060812 - RNA, 19 nt, Mycobacterium bovis subsp bovis AF2122/97
guuggccagccacagccga

SEQ ID NO: 1060813 - RNA, 13 nt, Mycobacterium bovis subsp bovis AF2122/97
guuggccccggcc

SEQ ID NO: 1060814 - RNA, 19 nt, Mycobacterium bovis subsp bovis AF2122/97
guuggccagucccucgcca

SEQ ID NO: 1060815 - RNA, 21 nt, Mycobacterium bovis subsp bovis AF2122/97
guuggccaagaaugugggcga

SEQ ID NO: 1060816 - RNA, 20 nt, Mycobacterium bovis subsp bovis AF2122/97
guuggcacgcaacaccgcca

SEQ ID NO: 1060817 - RNA, 18 nt, Mycobacterium bovis subsp bovis AF2122/97
guuggcagggccagcggc

SEQ ID NO: 1060818 - RNA, 13 nt, Mycobacterium bovis subsp bovis AF2122/97
guuggcaguggcg

SEQ ID NO: 1060819 - RNA, 15 nt, Mycobacterium bovis subsp bovis AF2122/97
guuggcaugccgccc

SEQ ID NO: 1060820 - RNA, 14 nt, Mycobacterium bovis subsp bovis AF2122/97
guuggccaccgccc

SEQ ID NO: 1060821 - RNA, 15 nt, Mycobacterium bovis subsp bovis AF2122/97
guuggccaccgccca

SEQ ID NO: 1060822 - RNA, 14 nt, Mycobacterium bovis subsp bovis AF2122/97
guuggccagaccgc

SEQ ID NO: 1060823 - RNA, 15 nt, Mycobacterium bovis subsp bovis AF2122/97
guuggauacggugcg

SEQ ID NO: 1060824 - RNA, 18 nt, Mycobacterium bovis subsp bovis AF2122/97
guuggagcccgagcucgc

SEQ ID NO: 1060825 - RNA, 14 nt, Mycobacterium bovis subsp bovis AF2122/97
guuggcaccagccg

SEQ ID NO: 1060826 - RNA, 15 nt, Mycobacterium bovis subsp bovis AF2122/97
guuggaucgccaccg

SEQ ID NO: 1060827 - RNA, 23 nt, Mycobacterium bovis subsp bovis AF2122/97
guuggaccacgugaucgacgacc

SEQ ID NO: 1060828 - RNA, 18 nt, Mycobacterium bovis subsp bovis AF2122/97
guugucuuucacaugcgc

SEQ ID NO: 1060829 - RNA, 17 nt, Mycobacterium bovis subsp bovis AF2122/97
guugucgggggcguggc

SEQ ID NO: 1060830 - RNA, 14 nt, Mycobacterium bovis subsp bovis AF2122/97
guugugcggccagg

SEQ ID NO: 1060831 - RNA, 18 nt, Mycobacterium bovis subsp bovis AF2122/97
guuguggaaccacggcgc

SEQ ID NO: 1060832 - RNA, 16 nt, Mycobacterium bovis subsp bovis AF2122/97
guugugccgcaagccu

SEQ ID NO: 1060833 - RNA, 22 nt, Mycobacterium bovis subsp bovis AF2122/97
guugucgaucagaaucugccuc

SEQ ID NO: 1060834 - RNA, 15 nt, Mycobacterium bovis subsp bovis AF2122/97
guugucgacggccac

SEQ ID NO: 1060835 - RNA, 22 nt, Mycobacterium bovis subsp bovis AF2122/97
guuguccagcgucucgaucacc

SEQ ID NO: 1060836 - RNA, 16 nt, Mycobacterium bovis subsp bovis AF2122/97
guuguccaccgccacc

SEQ ID NO: 1060837 - RNA, 21 nt, Mycobacterium bovis subsp bovis AF2122/97
guuguccaccgccaccacggu

SEQ ID NO: 1060838 - RNA, 16 nt, Mycobacterium bovis subsp bovis AF2122/97
guuggcaguggcgcgg

SEQ ID NO: 1060839 - RNA, 13 nt, Mycobacterium bovis subsp bovis AF2122/97
guuggcggugguc

SEQ ID NO: 1060840 - RNA, 20 nt, Mycobacterium bovis subsp bovis AF2122/97
guuggcgucgcuacgcaacg

SEQ ID NO: 1060841 - RNA, 22 nt, Mycobacterium bovis subsp bovis AF2122/97
guuggcugagcagcgcggccag

SEQ ID NO: 1060842 - RNA, 16 nt, Mycobacterium bovis subsp bovis AF2122/97
guuggcucgagccgcc

SEQ ID NO: 1060843 - RNA, 17 nt, Mycobacterium bovis subsp bovis AF2122/97
guuggcucgagccgccc

SEQ ID NO: 1060844 - RNA, 16 nt, Mycobacterium bovis subsp bovis AF2122/97
guuggcucgcugggac

SEQ ID NO: 1060845 - RNA, 14 nt, Mycobacterium bovis subsp bovis AF2122/97
guuggcugccggca

SEQ ID NO: 1060846 - RNA, 18 nt, Mycobacterium bovis subsp bovis AF2122/97
guuggcggcugcacgcug

SEQ ID NO: 1060847 - RNA, 18 nt, Mycobacterium bovis subsp bovis AF2122/97
guuggcgggagcaccgac

SEQ ID NO: 1060848 - RNA, 19 nt, Mycobacterium bovis subsp bovis AF2122/97
guuggcggcuucgccccga

SEQ ID NO: 1060849 - RNA, 22 nt, Mycobacterium bovis subsp bovis AF2122/97
guuggccgcccgaaugcgguga

SEQ ID NO: 1060850 - RNA, 18 nt, Mycobacterium bovis subsp bovis AF2122/97
guuguuauuuuuggccau

SEQ ID NO: 1060851 - RNA, 20 nt, Mycobacterium bovis subsp bovis AF2122/97
guuguucaccgacgcgaacg

SEQ ID NO: 1060852 - RNA, 19 nt, Mycobacterium bovis subsp bovis AF2122/97
guugugucaccggcgucgc

SEQ ID NO: 1060853 - RNA, 17 nt, Mycobacterium bovis subsp bovis AF2122/97
guuguugaagcccgaga

SEQ ID NO: 1060854 - RNA, 20 nt, Mycobacterium bovis subsp bovis AF2122/97
guuguucgacugcagaaaca

SEQ ID NO: 1060855 - RNA, 16 nt, Mycobacterium bovis subsp bovis AF2122/97
guuguuggugccagcc

SEQ ID NO: 1060856 - RNA, 20 nt, Mycobacterium bovis subsp bovis AF2122/97
guuuacauagaccaccggca

SEQ ID NO: 1060857 - RNA, 16 nt, Mycobacterium bovis subsp bovis AF2122/97
guuuaugcccggcaaa

SEQ ID NO: 1060858 - RNA, 17 nt, Mycobacterium bovis subsp bovis AF2122/97
uaaucguuuguguugaa

SEQ ID NO: 1060859 - RNA, 17 nt, Mycobacterium bovis subsp bovis AF2122/97
uaauccagcgccgaccu

SEQ ID NO: 1060860 - RNA, 15 nt, Mycobacterium bovis subsp bovis AF2122/97
uaauccccgacaucg

SEQ ID NO: 1060861 - RNA, 16 nt, Mycobacterium bovis subsp bovis AF2122/97
uaaugccagcggcaca

SEQ ID NO: 1060862 - RNA, 14 nt, Mycobacterium bovis subsp bovis AF2122/97
uaacgacgucggcg

SEQ ID NO: 1060863 - RNA, 18 nt, Mycobacterium bovis subsp bovis AF2122/97
uaacgacugacaacggcc

SEQ ID NO: 1060864 - RNA, 21 nt, Mycobacterium bovis subsp bovis AF2122/97
uaacgacugacaacggccaca

SEQ ID NO: 1060865 - RNA, 17 nt, Mycobacterium bovis subsp bovis AF2122/97
uaaggagaaccaaaccg

SEQ ID NO: 1060866 - RNA, 22 nt, Mycobacterium bovis subsp bovis AF2122/97
uaaccguugaccucuucgggca

SEQ ID NO: 1060867 - RNA, 21 nt, Mycobacterium bovis subsp bovis AF2122/97
uaaccgguggggacccgcucc

SEQ ID NO: 1060868 - RNA, 19 nt, Mycobacterium bovis subsp bovis AF2122/97
uaaccgucgccugccgacg

SEQ ID NO: 1060869 - RNA, 19 nt, Mycobacterium bovis subsp bovis AF2122/97
uaacagauuguccggccgg

SEQ ID NO: 1060870 - RNA, 16 nt, Mycobacterium bovis subsp bovis AF2122/97
guuuccgccgccgccg

SEQ ID NO: 1060871 - RNA, 20 nt, Mycobacterium bovis subsp bovis AF2122/97
uaaagccaacuggucgccaa

SEQ ID NO: 1060872 - RNA, 24 nt, Mycobacterium bovis subsp bovis AF2122/97
gucggcgucgaagugggugaaccg

SEQ ID NO: 1060873 - RNA, 14 nt, Mycobacterium bovis subsp bovis AF2122/97
gucggcggccgcca

SEQ ID NO: 1060874 - RNA, 20 nt, Mycobacterium bovis subsp bovis AF2122/97
gucggcguggucgcgcggca

SEQ ID NO: 1060875 - RNA, 18 nt, Mycobacterium bovis subsp bovis AF2122/97
gucggcgugucgcgucgc

SEQ ID NO: 1060876 - RNA, 18 nt, Mycobacterium bovis subsp bovis AF2122/97
gugaucaaaccggccuua

SEQ ID NO: 1060877 - RNA, 16 nt, Mycobacterium bovis subsp bovis AF2122/97
gugaucaccgcggcgg

SEQ ID NO: 1060878 - RNA, 13 nt, Mycobacterium bovis subsp bovis AF2122/97
gugaucaccggca

SEQ ID NO: 1060879 - RNA, 19 nt, Mycobacterium bovis subsp bovis AF2122/97
gugaucaaaccggcggcga

SEQ ID NO: 1060880 - RNA, 22 nt, Mycobacterium bovis subsp bovis AF2122/97
gugaucaaaccggcggcgacgg

SEQ ID NO: 1060881 - RNA, 16 nt, Mycobacterium bovis subsp bovis AF2122/97
gugaucacccgcaucg

SEQ ID NO: 1060882 - RNA, 18 nt, Mycobacterium bovis subsp bovis AF2122/97
gugaucgaaaacgggggc

SEQ ID NO: 1060883 - RNA, 15 nt, Mycobacterium bovis subsp bovis AF2122/97
gugaucgaucgcggc

SEQ ID NO: 1060884 - RNA, 17 nt, Mycobacterium bovis subsp bovis AF2122/97
gugaucggcgauccgac

SEQ ID NO: 1060885 - RNA, 20 nt, Mycobacterium bovis subsp bovis AF2122/97
gugaucggcgauccgacgac

SEQ ID NO: 1060886 - RNA, 14 nt, Mycobacterium bovis subsp bovis AF2122/97
gugaucggcgcccg

SEQ ID NO: 1060887 - RNA, 23 nt, Mycobacterium bovis subsp bovis AF2122/97
gugaucgcgguccaacagcgcca

SEQ ID NO: 1060888 - RNA, 14 nt, Mycobacterium bovis subsp bovis AF2122/97
gugaucagcucgcg

SEQ ID NO: 1060889 - RNA, 17 nt, Mycobacterium bovis subsp bovis AF2122/97
gugaucagcucgcgcac

SEQ ID NO: 1060890 - RNA, 20 nt, Mycobacterium bovis subsp bovis AF2122/97
gugaucagguaagcgaacgg

SEQ ID NO: 1060891 - RNA, 21 nt, Mycobacterium bovis subsp bovis AF2122/97
gugauccaacuggccgcgucg

SEQ ID NO: 1060892 - RNA, 13 nt, Mycobacterium bovis subsp bovis AF2122/97
gugaucagcagga

SEQ ID NO: 1060893 - RNA, 13 nt, Mycobacterium bovis subsp bovis AF2122/97
gugaucaccgaca

SEQ ID NO: 1060894 - RNA, 15 nt, Mycobacterium bovis subsp bovis AF2122/97
gugaucagccaccgg

SEQ ID NO: 1060895 - RNA, 12 nt, Mycobacterium bovis subsp bovis AF2122/97
gugaucagcgca

SEQ ID NO: 1060896 - RNA, 12 nt, Mycobacterium bovis subsp bovis AF2122/97
gugauccacgcu

SEQ ID NO: 1060897 - RNA, 15 nt, Mycobacterium bovis subsp bovis AF2122/97
gugauugagcucagg

SEQ ID NO: 1060898 - RNA, 13 nt, Mycobacterium bovis subsp bovis AF2122/97
gugaugguugcuc

SEQ ID NO: 1060899 - RNA, 14 nt, Mycobacterium bovis subsp bovis AF2122/97
gugaugguugcucg

SEQ ID NO: 1060900 - RNA, 17 nt, Mycobacterium bovis subsp bovis AF2122/97
gugauguagggcugcuc

SEQ ID NO: 1060901 - RNA, 13 nt, Mycobacterium bovis subsp bovis AF2122/97
gugaugucaacgu

SEQ ID NO: 1060902 - RNA, 18 nt, Mycobacterium bovis subsp bovis AF2122/97
gugauggucagcuggccg

SEQ ID NO: 1060903 - RNA, 18 nt, Mycobacterium bovis subsp bovis AF2122/97
gugauggccgaccagccg

SEQ ID NO: 1060904 - RNA, 18 nt, Mycobacterium bovis subsp bovis AF2122/97
gugauggcuuggaccagc

SEQ ID NO: 1060905 - RNA, 13 nt, Mycobacterium bovis subsp bovis AF2122/97
gugaugccgccgu

SEQ ID NO: 1060906 - RNA, 20 nt, Mycobacterium bovis subsp bovis AF2122/97
gugaugaauucgcuugcagc

SEQ ID NO: 1060907 - RNA, 18 nt, Mycobacterium bovis subsp bovis AF2122/97
gugaugacgccgucggcg

SEQ ID NO: 1060908 - RNA, 18 nt, Mycobacterium bovis subsp bovis AF2122/97
gugaugccacggcgucgc

SEQ ID NO: 1060909 - RNA, 21 nt, Mycobacterium bovis subsp bovis AF2122/97
gugaugccacggcgucgcucg

SEQ ID NO: 1060910 - RNA, 20 nt, Mycobacterium bovis subsp bovis AF2122/97
gugaucuucugccuuggccg

SEQ ID NO: 1060911 - RNA, 17 nt, Mycobacterium bovis subsp bovis AF2122/97
gugaugaacaccggcgc

SEQ ID NO: 1060912 - RNA, 18 nt, Mycobacterium bovis subsp bovis AF2122/97
gugaugaacaccggcgcc

SEQ ID NO: 1060913 - RNA, 17 nt, Mycobacterium bovis subsp bovis AF2122/97
gugaucgugaccggcaa

SEQ ID NO: 1060914 - RNA, 12 nt, Mycobacterium bovis subsp bovis AF2122/97
gugcacggcggc

SEQ ID NO: 1060915 - RNA, 18 nt, Mycobacterium bovis subsp bovis AF2122/97
gugcacggcuucggcgag

SEQ ID NO: 1060916 - RNA, 19 nt, Mycobacterium bovis subsp bovis AF2122/97
gugcacggcuuuucgacgc

SEQ ID NO: 1060917 - RNA, 16 nt, Mycobacterium bovis subsp bovis AF2122/97
gugcacgcucggcgcc

SEQ ID NO: 1060918 - RNA, 14 nt, Mycobacterium bovis subsp bovis AF2122/97
gugcacgagcggac

SEQ ID NO: 1060919 - RNA, 16 nt, Mycobacterium bovis subsp bovis AF2122/97
gugcacgaucgcggug

SEQ ID NO: 1060920 - RNA, 22 nt, Mycobacterium bovis subsp bovis AF2122/97
gugcaaccccaaguccagcagc

SEQ ID NO: 1060921 - RNA, 17 nt, Mycobacterium bovis subsp bovis AF2122/97
gugcaaccgugccgcau

SEQ ID NO: 1060922 - RNA, 14 nt, Mycobacterium bovis subsp bovis AF2122/97
gugcaacggcguug

SEQ ID NO: 1060923 - RNA, 17 nt, Mycobacterium bovis subsp bovis AF2122/97
gugauugcggccgccga

SEQ ID NO: 1060924 - RNA, 20 nt, Mycobacterium bovis subsp bovis AF2122/97
gugcacaacccgugcaggau

SEQ ID NO: 1060925 - RNA, 20 nt, Mycobacterium bovis subsp bovis AF2122/97
gugcaagcccuuucgacuuc

SEQ ID NO: 1060926 - RNA, 18 nt, Mycobacterium bovis subsp bovis AF2122/97
gugcaagccgaacaccgu

SEQ ID NO: 1060927 - RNA, 17 nt, Mycobacterium bovis subsp bovis AF2122/97
gugcaaucgcgugcugg

SEQ ID NO: 1060928 - RNA, 21 nt, Mycobacterium bovis subsp bovis AF2122/97
gugcacaaaauacuccgcgag

SEQ ID NO: 1060929 - RNA, 21 nt, Mycobacterium bovis subsp bovis AF2122/97
gugcagcagcauccggccguc

SEQ ID NO: 1060930 - RNA, 21 nt, Mycobacterium bovis subsp bovis AF2122/97
gugcaggcgaguuaggccgcc

SEQ ID NO: 1060931 - RNA, 15 nt, Mycobacterium bovis subsp bovis AF2122/97
gugcagacaggcggc

SEQ ID NO: 1060932 - RNA, 17 nt, Mycobacterium bovis subsp bovis AF2122/97
gugcagaccaucuugcc

SEQ ID NO: 1060933 - RNA, 17 nt, Mycobacterium bovis subsp bovis AF2122/97
gugcagaucgucgccga

SEQ ID NO: 1060934 - RNA, 16 nt, Mycobacterium bovis subsp bovis AF2122/97
gugcaguccgaugccg

SEQ ID NO: 1060935 - RNA, 17 nt, Mycobacterium bovis subsp bovis AF2122/97
gugcagugccucggcgg

SEQ ID NO: 1060936 - RNA, 15 nt, Mycobacterium bovis subsp bovis AF2122/97
gugcaggucgugcuc

SEQ ID NO: 1060937 - RNA, 20 nt, Mycobacterium bovis subsp bovis AF2122/97
gugcaggugacgaucagguc

SEQ ID NO: 1060938 - RNA, 22 nt, Mycobacterium bovis subsp bovis AF2122/97
gugcagggacccggcgccgucg

SEQ ID NO: 1060939 - RNA, 20 nt, Mycobacterium bovis subsp bovis AF2122/97
gugcaggucguccaucgcgu

SEQ ID NO: 1060940 - RNA, 17 nt, Mycobacterium bovis subsp bovis AF2122/97
gugcauaagcccgcgag

SEQ ID NO: 1060941 - RNA, 21 nt, Mycobacterium bovis subsp bovis AF2122/97
gugcauagcaauccgcacagc

SEQ ID NO: 1060942 - RNA, 22 nt, Mycobacterium bovis subsp bovis AF2122/97
gugcauagcaauccgcacagcg

SEQ ID NO: 1060943 - RNA, 19 nt, Mycobacterium bovis subsp bovis AF2122/97
gugccacccuugccgccgg

SEQ ID NO: 1060944 - RNA, 20 nt, Mycobacterium bovis subsp bovis AF2122/97
gugccacccuugccgccggu

SEQ ID NO: 1060945 - RNA, 13 nt, Mycobacterium bovis subsp bovis AF2122/97
gugccaccgacgc

SEQ ID NO: 1060946 - RNA, 15 nt, Mycobacterium bovis subsp bovis AF2122/97
gugccacgaggaccc

SEQ ID NO: 1060947 - RNA, 22 nt, Mycobacterium bovis subsp bovis AF2122/97
gugccaccgcuggaucgacuuc

SEQ ID NO: 1060948 - RNA, 17 nt, Mycobacterium bovis subsp bovis AF2122/97
gugccacuuccacggcg

SEQ ID NO: 1060949 - RNA, 18 nt, Mycobacterium bovis subsp bovis AF2122/97
gugccacuuccacggcgu

SEQ ID NO: 1060950 - RNA, 13 nt, Mycobacterium bovis subsp bovis AF2122/97
gugccacguucgc

SEQ ID NO: 1060951 - RNA, 19 nt, Mycobacterium bovis subsp bovis AF2122/97
gugccagcccguugcagga

SEQ ID NO: 1060952 - RNA, 18 nt, Mycobacterium bovis subsp bovis AF2122/97
gugcccagcagcgcgacg

SEQ ID NO: 1060953 - RNA, 17 nt, Mycobacterium bovis subsp bovis AF2122/97
gugccacugccgguggg

SEQ ID NO: 1060954 - RNA, 23 nt, Mycobacterium bovis subsp bovis AF2122/97
gugccagaccagggcagcggcca

SEQ ID NO: 1060955 - RNA, 22 nt, Mycobacterium bovis subsp bovis AF2122/97
gugccagcacuccaccgcuggc

SEQ ID NO: 1060956 - RNA, 15 nt, Mycobacterium bovis subsp bovis AF2122/97
gugccagcagcagcg

SEQ ID NO: 1060957 - RNA, 17 nt, Mycobacterium bovis subsp bovis AF2122/97
gugccagcagcagcgcc

SEQ ID NO: 1060958 - RNA, 11 nt, Mycobacterium bovis subsp bovis AF2122/97
gugccagcagg

SEQ ID NO: 1060959 - RNA, 15 nt, Mycobacterium bovis subsp bovis AF2122/97
gugcccagcgaugcg

SEQ ID NO: 1060960 - RNA, 22 nt, Mycobacterium bovis subsp bovis AF2122/97
gugcccaggaaggcgacgccga

SEQ ID NO: 1060961 - RNA, 18 nt, Mycobacterium bovis subsp bovis AF2122/97
gugcccaggccaccggcu

SEQ ID NO: 1060962 - RNA, 24 nt, Mycobacterium bovis subsp bovis AF2122/97
gugcccagggcgaucugcgcgaug

SEQ ID NO: 1060963 - RNA, 16 nt, Mycobacterium bovis subsp bovis AF2122/97
gugcccaugaugguca

SEQ ID NO: 1060964 - RNA, 13 nt, Mycobacterium bovis subsp bovis AF2122/97
gugccccggcgcg

SEQ ID NO: 1060965 - RNA, 11 nt, Mycobacterium bovis subsp bovis AF2122/97
gugccccgggc

SEQ ID NO: 1060966 - RNA, 18 nt, Mycobacterium bovis subsp bovis AF2122/97
gugcccccggugccgccc

SEQ ID NO: 1060967 - RNA, 22 nt, Mycobacterium bovis subsp bovis AF2122/97
gugcugaccccgccggcugcgg

SEQ ID NO: 1060968 - RNA, 14 nt, Mycobacterium bovis subsp bovis AF2122/97
gugcugaccgcgcc

SEQ ID NO: 1060969 - RNA, 16 nt, Mycobacterium bovis subsp bovis AF2122/97
gugcugaccgcgccgg

SEQ ID NO: 1060970 - RNA, 13 nt, Mycobacterium bovis subsp bovis AF2122/97
gugcugccaccgg

SEQ ID NO: 1060971 - RNA, 17 nt, Mycobacterium bovis subsp bovis AF2122/97
gugcugcagaucggccg

SEQ ID NO: 1060972 - RNA, 17 nt, Mycobacterium bovis subsp bovis AF2122/97
gugcugccauugccgca

SEQ ID NO: 1060973 - RNA, 21 nt, Mycobacterium bovis subsp bovis AF2122/97
gugcugcccaucccggccgag

SEQ ID NO: 1060974 - RNA, 20 nt, Mycobacterium bovis subsp bovis AF2122/97
gugcucucguggauggccgc

SEQ ID NO: 1060975 - RNA, 17 nt, Mycobacterium bovis subsp bovis AF2122/97
gugcucuugcgccacgg

SEQ ID NO: 1060976 - RNA, 24 nt, Mycobacterium bovis subsp bovis AF2122/97
gugcucaacggcgacaucggcccg

SEQ ID NO: 1060977 - RNA, 20 nt, Mycobacterium bovis subsp bovis AF2122/97
gugcucagcuucgcgucggg

SEQ ID NO: 1060978 - RNA, 14 nt, Mycobacterium bovis subsp bovis AF2122/97
gugcucacggcggc

SEQ ID NO: 1060979 - RNA, 17 nt, Mycobacterium bovis subsp bovis AF2122/97
gugcucaggucgcagac

SEQ ID NO: 1060980 - RNA, 18 nt, Mycobacterium bovis subsp bovis AF2122/97
gugcgguaucggucagcc

SEQ ID NO: 1060981 - RNA, 14 nt, Mycobacterium bovis subsp bovis AF2122/97
gugcggucaaagga

SEQ ID NO: 1060982 - RNA, 14 nt, Mycobacterium bovis subsp bovis AF2122/97
gugcggucuccgcc

SEQ ID NO: 1060983 - RNA, 21 nt, Mycobacterium bovis subsp bovis AF2122/97
gugcgggugggcacaccggug

SEQ ID NO: 1060984 - RNA, 16 nt, Mycobacterium bovis subsp bovis AF2122/97
gugcgggguuggccgu

SEQ ID NO: 1060985 - RNA, 17 nt, Mycobacterium bovis subsp bovis AF2122/97
gugcgggguuggccgug

SEQ ID NO: 1060986 - RNA, 15 nt, Mycobacterium bovis subsp bovis AF2122/97
gugcgggguugggcg

SEQ ID NO: 1060987 - RNA, 19 nt, Mycobacterium bovis subsp bovis AF2122/97
gugcggguggugccggcgg

SEQ ID NO: 1060988 - RNA, 18 nt, Mycobacterium bovis subsp bovis AF2122/97
gugcggugccguggugga

SEQ ID NO: 1060989 - RNA, 14 nt, Mycobacterium bovis subsp bovis AF2122/97
gugcguugucggcu

SEQ ID NO: 1060990 - RNA, 23 nt, Mycobacterium bovis subsp bovis AF2122/97
gugcggugccgugguggacgaug

SEQ ID NO: 1060991 - RNA, 14 nt, Mycobacterium bovis subsp bovis AF2122/97
gugcguuggaugaa

SEQ ID NO: 1060992 - RNA, 16 nt, Mycobacterium bovis subsp bovis AF2122/97
gugcgcgcggcgacca

SEQ ID NO: 1060993 - RNA, 14 nt, Mycobacterium bovis subsp bovis AF2122/97
gugcgcgcgcccga

SEQ ID NO: 1060994 - RNA, 15 nt, Mycobacterium bovis subsp bovis AF2122/97
gugcgcgcgcccgaa

SEQ ID NO: 1060995 - RNA, 14 nt, Mycobacterium bovis subsp bovis AF2122/97
gugcgcggccggca

SEQ ID NO: 1060996 - RNA, 23 nt, Mycobacterium bovis subsp bovis AF2122/97
gugcgcggcaauugcgguucgaa

SEQ ID NO: 1060997 - RNA, 21 nt, Mycobacterium bovis subsp bovis AF2122/97
gugcgcucgcgguagcgccgu

SEQ ID NO: 1060998 - RNA, 14 nt, Mycobacterium bovis subsp bovis AF2122/97
gugcgcgucggugu

SEQ ID NO: 1060999 - RNA, 13 nt, Mycobacterium bovis subsp bovis AF2122/97
gugcgcggugacg

SEQ ID NO: 1061000 - RNA, 22 nt, Mycobacterium bovis subsp bovis AF2122/97
gugcgcuuggucgaccgccgag

SEQ ID NO: 1061001 - RNA, 14 nt, Mycobacterium bovis subsp bovis AF2122/97
gugcgcuggcggcg

SEQ ID NO: 1061002 - RNA, 15 nt, Mycobacterium bovis subsp bovis AF2122/97
gugcggggccggucg

SEQ ID NO: 1061003 - RNA, 17 nt, Mycobacterium bovis subsp bovis AF2122/97
gugcggggccggucggg

SEQ ID NO: 1061004 - RNA, 20 nt, Mycobacterium bovis subsp bovis AF2122/97
gugcgcugggugaugagcgc

SEQ ID NO: 1061005 - RNA, 14 nt, Mycobacterium bovis subsp bovis AF2122/97
gugcgccgguccuc

SEQ ID NO: 1061006 - RNA, 19 nt, Mycobacterium bovis subsp bovis AF2122/97
gugcgccgguccucgucgg

SEQ ID NO: 1061007 - RNA, 16 nt, Mycobacterium bovis subsp bovis AF2122/97
gugcgccacgccaccg

SEQ ID NO: 1061008 - RNA, 20 nt, Mycobacterium bovis subsp bovis AF2122/97
gugcgccuugaccacagcgg

SEQ ID NO: 1061009 - RNA, 17 nt, Mycobacterium bovis subsp bovis AF2122/97
gugcgccaccucgacgc

SEQ ID NO: 1061010 - RNA, 19 nt, Mycobacterium bovis subsp bovis AF2122/97
gugcgcacggcgccgaccc

SEQ ID NO: 1061011 - RNA, 21 nt, Mycobacterium bovis subsp bovis AF2122/97
gugcgcagaacaccaccgcca

SEQ ID NO: 1061012 - RNA, 14 nt, Mycobacterium bovis subsp bovis AF2122/97
gugccggcggugac

SEQ ID NO: 1061013 - RNA, 15 nt, Mycobacterium bovis subsp bovis AF2122/97
gugccggcggugacg

SEQ ID NO: 1061014 - RNA, 18 nt, Mycobacterium bovis subsp bovis AF2122/97
gugccggcggugacggcg

SEQ ID NO: 1061015 - RNA, 13 nt, Mycobacterium bovis subsp bovis AF2122/97
gugccggcgucgc

SEQ ID NO: 1061016 - RNA, 14 nt, Mycobacterium bovis subsp bovis AF2122/97
gugccggcgugcgc

SEQ ID NO: 1061017 - RNA, 19 nt, Mycobacterium bovis subsp bovis AF2122/97
gugccggcgaaccccagcg

SEQ ID NO: 1061018 - RNA, 17 nt, Mycobacterium bovis subsp bovis AF2122/97
gugccggcgccgccagc

SEQ ID NO: 1061019 - RNA, 17 nt, Mycobacterium bovis subsp bovis AF2122/97
gugccggcgccgcccuu

SEQ ID NO: 1061020 - RNA, 15 nt, Mycobacterium bovis subsp bovis AF2122/97
gugccggcgccgcca

SEQ ID NO: 1061021 - RNA, 13 nt, Mycobacterium bovis subsp bovis AF2122/97
gugccggcgacgc

SEQ ID NO: 1061022 - RNA, 20 nt, Mycobacterium bovis subsp bovis AF2122/97
gugccggcgacgcuaccgcc

SEQ ID NO: 1061023 - RNA, 19 nt, Mycobacterium bovis subsp bovis AF2122/97
gugccggcccugcucggcc

SEQ ID NO: 1061024 - RNA, 20 nt, Mycobacterium bovis subsp bovis AF2122/97
gugccggcccugcucggcca

SEQ ID NO: 1061025 - RNA, 15 nt, Mycobacterium bovis subsp bovis AF2122/97
gugccggagacaccg

SEQ ID NO: 1061026 - RNA, 23 nt, Mycobacterium bovis subsp bovis AF2122/97
gugccggcccugcucggccaacg

SEQ ID NO: 1061027 - RNA, 12 nt, Mycobacterium bovis subsp bovis AF2122/97
gugccggcaccc

SEQ ID NO: 1061028 - RNA, 13 nt, Mycobacterium bovis subsp bovis AF2122/97
gugccggcacccg

SEQ ID NO: 1061029 - RNA, 18 nt, Mycobacterium bovis subsp bovis AF2122/97
gugccggcauagaucggg

SEQ ID NO: 1061030 - RNA, 19 nt, Mycobacterium bovis subsp bovis AF2122/97
gugccggccagacucgcgg

SEQ ID NO: 1061031 - RNA, 17 nt, Mycobacterium bovis subsp bovis AF2122/97
gugccggccaucgcccg

SEQ ID NO: 1061032 - RNA, 14 nt, Mycobacterium bovis subsp bovis AF2122/97
gugccgacggcgcc

SEQ ID NO: 1061033 - RNA, 20 nt, Mycobacterium bovis subsp bovis AF2122/97
gugccgaagaugaccgcucg

SEQ ID NO: 1061034 - RNA, 15 nt, Mycobacterium bovis subsp bovis AF2122/97
gugccgaaaugggcg

SEQ ID NO: 1061035 - RNA, 16 nt, Mycobacterium bovis subsp bovis AF2122/97
gugccgaaaaucgcag

SEQ ID NO: 1061036 - RNA, 18 nt, Mycobacterium bovis subsp bovis AF2122/97
gugcccugcauaggcgcg

SEQ ID NO: 1061037 - RNA, 14 nt, Mycobacterium bovis subsp bovis AF2122/97
gugcccugccggca

SEQ ID NO: 1061038 - RNA, 16 nt, Mycobacterium bovis subsp bovis AF2122/97
gugccgacccgccgcg

SEQ ID NO: 1061039 - RNA, 21 nt, Mycobacterium bovis subsp bovis AF2122/97
gugccgacccgccgcgcccgg

SEQ ID NO: 1061040 - RNA, 18 nt, Mycobacterium bovis subsp bovis AF2122/97
gugccgaacgccagaccg

SEQ ID NO: 1061041 - RNA, 15 nt, Mycobacterium bovis subsp bovis AF2122/97
gugccgaccagcauc

SEQ ID NO: 1061042 - RNA, 21 nt, Mycobacterium bovis subsp bovis AF2122/97
gugccgacgccccgaucggcc

SEQ ID NO: 1061043 - RNA, 13 nt, Mycobacterium bovis subsp bovis AF2122/97
gugccgacggcgc

SEQ ID NO: 1061044 - RNA, 19 nt, Mycobacterium bovis subsp bovis AF2122/97
gugccgcgucaaccgaucg

SEQ ID NO: 1061045 - RNA, 19 nt, Mycobacterium bovis subsp bovis AF2122/97
gugccgcgguaggugcaug

SEQ ID NO: 1061046 - RNA, 15 nt, Mycobacterium bovis subsp bovis AF2122/97
gugccuacuugcucg

SEQ ID NO: 1061047 - RNA, 22 nt, Mycobacterium bovis subsp bovis AF2122/97
gugccguugcgucugcucggcg

SEQ ID NO: 1061048 - RNA, 19 nt, Mycobacterium bovis subsp bovis AF2122/97
gugccucgauuguggccag

SEQ ID NO: 1061049 - RNA, 22 nt, Mycobacterium bovis subsp bovis AF2122/97
gugccucucgggggccgagccg

SEQ ID NO: 1061050 - RNA, 20 nt, Mycobacterium bovis subsp bovis AF2122/97
gugccugccgcacguucggc

SEQ ID NO: 1061051 - RNA, 21 nt, Mycobacterium bovis subsp bovis AF2122/97
gugccugccgcacguucggcg

SEQ ID NO: 1061052 - RNA, 17 nt, Mycobacterium bovis subsp bovis AF2122/97
gugccugcuuggccacu

SEQ ID NO: 1061053 - RNA, 15 nt, Mycobacterium bovis subsp bovis AF2122/97
gugcgcaccaccgag

SEQ ID NO: 1061054 - RNA, 16 nt, Mycobacterium bovis subsp bovis AF2122/97
gugcgcaccaccgagc

SEQ ID NO: 1061055 - RNA, 15 nt, Mycobacterium bovis subsp bovis AF2122/97
gugcgcaccagcaca

SEQ ID NO: 1061056 - RNA, 23 nt, Mycobacterium bovis subsp bovis AF2122/97
gugccggcggaucugaucggcgc

SEQ ID NO: 1061057 - RNA, 18 nt, Mycobacterium bovis subsp bovis AF2122/97
gugccgggaugccgccgc

SEQ ID NO: 1061058 - RNA, 16 nt, Mycobacterium bovis subsp bovis AF2122/97
gugccggcgugcgcga

SEQ ID NO: 1061059 - RNA, 20 nt, Mycobacterium bovis subsp bovis AF2122/97
gugccggcguugccgccguu

SEQ ID NO: 1061060 - RNA, 13 nt, Mycobacterium bovis subsp bovis AF2122/97
gugccgggaucgc

SEQ ID NO: 1061061 - RNA, 12 nt, Mycobacterium bovis subsp bovis AF2122/97
gugccggcggcg

SEQ ID NO: 1061062 - RNA, 22 nt, Mycobacterium bovis subsp bovis AF2122/97
gugccggcggaucugaucggcg

SEQ ID NO: 1061063 - RNA, 15 nt, Mycobacterium bovis subsp bovis AF2122/97
gugccgucggcgugc

SEQ ID NO: 1061064 - RNA, 22 nt, Mycobacterium bovis subsp bovis AF2122/97
gugccgugcugaacuccgccgc

SEQ ID NO: 1061065 - RNA, 21 nt, Mycobacterium bovis subsp bovis AF2122/97
gugccgucgaguccaggccgg

SEQ ID NO: 1061066 - RNA, 16 nt, Mycobacterium bovis subsp bovis AF2122/97
gugccguguccagcau

SEQ ID NO: 1061067 - RNA, 13 nt, Mycobacterium bovis subsp bovis AF2122/97
gugcgcaccaccg

SEQ ID NO: 1061068 - RNA, 15 nt, Mycobacterium bovis subsp bovis AF2122/97
aaguggucuccggca

SEQ ID NO: 1061069 - RNA, 19 nt, Mycobacterium bovis subsp bovis AF2122/97
gugcgcaccagcacacccg

SEQ ID NO: 1061070 - RNA, 16 nt, Mycobacterium bovis subsp bovis AF2122/97
aagugggugccggcac

SEQ ID NO: 1061071 - RNA, 19 nt, Mycobacterium bovis subsp bovis AF2122/97
aagugcuuuggguccgggc

SEQ ID NO: 1061072 - RNA, 15 nt, Mycobacterium bovis subsp bovis AF2122/97
guggccagcccgccc

SEQ ID NO: 1061073 - RNA, 20 nt, Mycobacterium bovis subsp bovis AF2122/97
guggccaucgaucccuuguc

SEQ ID NO: 1061074 - RNA, 12 nt, Mycobacterium bovis subsp bovis AF2122/97
guggccagcacg

SEQ ID NO: 1061075 - RNA, 24 nt, Mycobacterium bovis subsp bovis AF2122/97
guggccagcggagcgcccuugauc

SEQ ID NO: 1061076 - RNA, 17 nt, Mycobacterium bovis subsp bovis AF2122/97
guggccagcgucgcgau

SEQ ID NO: 1061077 - RNA, 14 nt, Mycobacterium bovis subsp bovis AF2122/97
guggccagcgcuug

SEQ ID NO: 1061078 - RNA, 22 nt, Mycobacterium bovis subsp bovis AF2122/97
guggccccaagcgugcugccgc

SEQ ID NO: 1061079 - RNA, 16 nt, Mycobacterium bovis subsp bovis AF2122/97
guggcccccgccggcc

SEQ ID NO: 1061080 - RNA, 17 nt, Mycobacterium bovis subsp bovis AF2122/97
guggcccguagcgucga

SEQ ID NO: 1061081 - RNA, 17 nt, Mycobacterium bovis subsp bovis AF2122/97
guggcccaacaccgcca

SEQ ID NO: 1061082 - RNA, 22 nt, Mycobacterium bovis subsp bovis AF2122/97
guggcccacauguccagcgucc

SEQ ID NO: 1061083 - RNA, 22 nt, Mycobacterium bovis subsp bovis AF2122/97
guggcccaacccgguucggaug

SEQ ID NO: 1061084 - RNA, 20 nt, Mycobacterium bovis subsp bovis AF2122/97
gugcugggcaucaccgacgc

SEQ ID NO: 1061085 - RNA, 22 nt, Mycobacterium bovis subsp bovis AF2122/97
gugcuggggaugcgauggcccg

SEQ ID NO: 1061086 - RNA, 18 nt, Mycobacterium bovis subsp bovis AF2122/97
gugcugguauagccggcg

SEQ ID NO: 1061087 - RNA, 16 nt, Mycobacterium bovis subsp bovis AF2122/97
gugcuggucaacagcg

SEQ ID NO: 1061088 - RNA, 14 nt, Mycobacterium bovis subsp bovis AF2122/97
gugcugguggcggc

SEQ ID NO: 1061089 - RNA, 23 nt, Mycobacterium bovis subsp bovis AF2122/97
gugcugucgucuuggcgaucggg

SEQ ID NO: 1061090 - RNA, 13 nt, Mycobacterium bovis subsp bovis AF2122/97
gugcugcucgaca

SEQ ID NO: 1061091 - RNA, 20 nt, Mycobacterium bovis subsp bovis AF2122/97
gugcugccuugggaccgcgc

SEQ ID NO: 1061092 - RNA, 21 nt, Mycobacterium bovis subsp bovis AF2122/97
gugcugcuagccagucggcca

SEQ ID NO: 1061093 - RNA, 17 nt, Mycobacterium bovis subsp bovis AF2122/97
gugcugcgcgcggcggc

SEQ ID NO: 1061094 - RNA, 22 nt, Mycobacterium bovis subsp bovis AF2122/97
gugcugcgcggguguggcuacg

SEQ ID NO: 1061095 - RNA, 19 nt, Mycobacterium bovis subsp bovis AF2122/97
guggcgaaccaggggucgc

SEQ ID NO: 1061096 - RNA, 12 nt, Mycobacterium bovis subsp bovis AF2122/97
guggcgaccacg

SEQ ID NO: 1061097 - RNA, 13 nt, Mycobacterium bovis subsp bovis AF2122/97
guggcgaccacga

SEQ ID NO: 1061098 - RNA, 16 nt, Mycobacterium bovis subsp bovis AF2122/97
guggcgaaugacggcc

SEQ ID NO: 1061099 - RNA, 19 nt, Mycobacterium bovis subsp bovis AF2122/97
guggcgaaugacggccagu

SEQ ID NO: 1061100 - RNA, 15 nt, Mycobacterium bovis subsp bovis AF2122/97
guggcgaaaucgucg

SEQ ID NO: 1061101 - RNA, 18 nt, Mycobacterium bovis subsp bovis AF2122/97
guggcgaaaucgucgaac

SEQ ID NO: 1061102 - RNA, 16 nt, Mycobacterium bovis subsp bovis AF2122/97
guggccgcaucgccuc

SEQ ID NO: 1061103 - RNA, 17 nt, Mycobacterium bovis subsp bovis AF2122/97
guggccguguaucgggu

SEQ ID NO: 1061104 - RNA, 20 nt, Mycobacterium bovis subsp bovis AF2122/97
guggccguuggccggaucga

SEQ ID NO: 1061105 - RNA, 19 nt, Mycobacterium bovis subsp bovis AF2122/97
guggccucguccagcucgg

SEQ ID NO: 1061106 - RNA, 17 nt, Mycobacterium bovis subsp bovis AF2122/97
guggccucgucccggac

SEQ ID NO: 1061107 - RNA, 16 nt, Mycobacterium bovis subsp bovis AF2122/97
guggccgcgcugguca

SEQ ID NO: 1061108 - RNA, 14 nt, Mycobacterium bovis subsp bovis AF2122/97
guggccgcgcaggg

SEQ ID NO: 1061109 - RNA, 19 nt, Mycobacterium bovis subsp bovis AF2122/97
guggccgggaugguuucga

SEQ ID NO: 1061110 - RNA, 22 nt, Mycobacterium bovis subsp bovis AF2122/97
guggccgggucgaucaccgaca

SEQ ID NO: 1061111 - RNA, 14 nt, Mycobacterium bovis subsp bovis AF2122/97
guggccggacccau

SEQ ID NO: 1061112 - RNA, 13 nt, Mycobacterium bovis subsp bovis AF2122/97
guggccgccaccc

SEQ ID NO: 1061113 - RNA, 16 nt, Mycobacterium bovis subsp bovis AF2122/97
guggccgccacccgca

SEQ ID NO: 1061114 - RNA, 17 nt, Mycobacterium bovis subsp bovis AF2122/97
guggccgccaccuccca

SEQ ID NO: 1061115 - RNA, 15 nt, Mycobacterium bovis subsp bovis AF2122/97
guggccgcaucgacg

SEQ ID NO: 1061116 - RNA, 22 nt, Mycobacterium bovis subsp bovis AF2122/97
guggccgaacgggucggcgacc

SEQ ID NO: 1061117 - RNA, 22 nt, Mycobacterium bovis subsp bovis AF2122/97
guggcccggaacaccgacguca

SEQ ID NO: 1061118 - RNA, 22 nt, Mycobacterium bovis subsp bovis AF2122/97
guggcccggggacgggucggca

SEQ ID NO: 1061119 - RNA, 19 nt, Mycobacterium bovis subsp bovis AF2122/97
guggccgacaagucaagau

SEQ ID NO: 1061120 - RNA, 21 nt, Mycobacterium bovis subsp bovis AF2122/97
guggccgaaagccaggcggca

SEQ ID NO: 1061121 - RNA, 22 nt, Mycobacterium bovis subsp bovis AF2122/97
guggcgaugaccacgccgacga

SEQ ID NO: 1061122 - RNA, 12 nt, Mycobacterium bovis subsp bovis AF2122/97
guggcgccgccg

SEQ ID NO: 1061123 - RNA, 13 nt, Mycobacterium bovis subsp bovis AF2122/97
guggcgccgccgg

SEQ ID NO: 1061124 - RNA, 20 nt, Mycobacterium bovis subsp bovis AF2122/97
guggcgcgccgcaucggcga

SEQ ID NO: 1061125 - RNA, 15 nt, Mycobacterium bovis subsp bovis AF2122/97
guggcgcgccaacac

SEQ ID NO: 1061126 - RNA, 12 nt, Mycobacterium bovis subsp bovis AF2122/97
guggcgcgggcc

SEQ ID NO: 1061127 - RNA, 17 nt, Mycobacterium bovis subsp bovis AF2122/97
guggcgcggggccgccg

SEQ ID NO: 1061128 - RNA, 17 nt, Mycobacterium bovis subsp bovis AF2122/97
guggcgcgcggcgccgc

SEQ ID NO: 1061129 - RNA, 12 nt, Mycobacterium bovis subsp bovis AF2122/97
guggcggccagu

SEQ ID NO: 1061130 - RNA, 19 nt, Mycobacterium bovis subsp bovis AF2122/97
guggcggccaguucggcgg

SEQ ID NO: 1061131 - RNA, 14 nt, Mycobacterium bovis subsp bovis AF2122/97
guggcggacggcgu

SEQ ID NO: 1061132 - RNA, 14 nt, Mycobacterium bovis subsp bovis AF2122/97
guggcggaucgcga

SEQ ID NO: 1061133 - RNA, 16 nt, Mycobacterium bovis subsp bovis AF2122/97
guggcggcgggccucg

SEQ ID NO: 1061134 - RNA, 17 nt, Mycobacterium bovis subsp bovis AF2122/97
guggcggcgggccucgg

SEQ ID NO: 1061135 - RNA, 22 nt, Mycobacterium bovis subsp bovis AF2122/97
guggcgccaacgcaacggugau

SEQ ID NO: 1061136 - RNA, 20 nt, Mycobacterium bovis subsp bovis AF2122/97
guggcgccacggcagcgccc

SEQ ID NO: 1061137 - RNA, 15 nt, Mycobacterium bovis subsp bovis AF2122/97
guggcgccagggccu

SEQ ID NO: 1061138 - RNA, 18 nt, Mycobacterium bovis subsp bovis AF2122/97
guggcgccauccccgccg

SEQ ID NO: 1061139 - RNA, 13 nt, Mycobacterium bovis subsp bovis AF2122/97
guggcgccaugaa

SEQ ID NO: 1061140 - RNA, 11 nt, Mycobacterium bovis subsp bovis AF2122/97
guggcgcccau

SEQ ID NO: 1061141 - RNA, 18 nt, Mycobacterium bovis subsp bovis AF2122/97
guggcgcccauggccacc

SEQ ID NO: 1061142 - RNA, 21 nt, Mycobacterium bovis subsp bovis AF2122/97
guggcgcccgcguucagggca

SEQ ID NO: 1061143 - RNA, 18 nt, Mycobacterium bovis subsp bovis AF2122/97
guggcgcccgugccgccc

SEQ ID NO: 1061144 - RNA, 19 nt, Mycobacterium bovis subsp bovis AF2122/97
guggcgcccgugccgcccg

SEQ ID NO: 1061145 - RNA, 16 nt, Mycobacterium bovis subsp bovis AF2122/97
guggcgccgaacgcaa

SEQ ID NO: 1061146 - RNA, 13 nt, Mycobacterium bovis subsp bovis AF2122/97
guggcgcacaucg

SEQ ID NO: 1061147 - RNA, 18 nt, Mycobacterium bovis subsp bovis AF2122/97
guggcgauuucggcgccu

SEQ ID NO: 1061148 - RNA, 13 nt, Mycobacterium bovis subsp bovis AF2122/97
guggcgaucaucg

SEQ ID NO: 1061149 - RNA, 14 nt, Mycobacterium bovis subsp bovis AF2122/97
guggcgacggcguc

SEQ ID NO: 1061150 - RNA, 18 nt, Mycobacterium bovis subsp bovis AF2122/97
guggcgagcgccuuucgg

SEQ ID NO: 1061151 - RNA, 20 nt, Mycobacterium bovis subsp bovis AF2122/97
guggcgaggcagcacccgca

SEQ ID NO: 1061152 - RNA, 15 nt, Mycobacterium bovis subsp bovis AF2122/97
guggcgucgcucguc

SEQ ID NO: 1061153 - RNA, 21 nt, Mycobacterium bovis subsp bovis AF2122/97
guggcguuacgcucggcgaac

SEQ ID NO: 1061154 - RNA, 14 nt, Mycobacterium bovis subsp bovis AF2122/97
guggcguggucucg

SEQ ID NO: 1061155 - RNA, 13 nt, Mycobacterium bovis subsp bovis AF2122/97
guggcggcgucga

SEQ ID NO: 1061156 - RNA, 16 nt, Mycobacterium bovis subsp bovis AF2122/97
guggcgggaucaccau

SEQ ID NO: 1061157 - RNA, 13 nt, Mycobacterium bovis subsp bovis AF2122/97
guggcgggcuugc

SEQ ID NO: 1061158 - RNA, 19 nt, Mycobacterium bovis subsp bovis AF2122/97
guggcgggccggaugacgc

SEQ ID NO: 1061159 - RNA, 21 nt, Mycobacterium bovis subsp bovis AF2122/97
guggcgggcgaugcgggccgc

SEQ ID NO: 1061160 - RNA, 21 nt, Mycobacterium bovis subsp bovis AF2122/97
guggcgggcugcagccgacag

SEQ ID NO: 1061161 - RNA, 15 nt, Mycobacterium bovis subsp bovis AF2122/97
guggcguaucgggcc

SEQ ID NO: 1061162 - RNA, 19 nt, Mycobacterium bovis subsp bovis AF2122/97
gugggcaagcugaccgcca

SEQ ID NO: 1061163 - RNA, 13 nt, Mycobacterium bovis subsp bovis AF2122/97
gugggcaccccgc

SEQ ID NO: 1061164 - RNA, 19 nt, Mycobacterium bovis subsp bovis AF2122/97
gugggcaccuuggccggcc

SEQ ID NO: 1061165 - RNA, 22 nt, Mycobacterium bovis subsp bovis AF2122/97
gugggcaagcugaccgccagcg

SEQ ID NO: 1061166 - RNA, 21 nt, Mycobacterium bovis subsp bovis AF2122/97
gugggcaauccggucagcgcg

SEQ ID NO: 1061167 - RNA, 13 nt, Mycobacterium bovis subsp bovis AF2122/97
gugggcagcaggc

SEQ ID NO: 1061168 - RNA, 18 nt, Mycobacterium bovis subsp bovis AF2122/97
gugggcagcagcuggucg

SEQ ID NO: 1061169 - RNA, 12 nt, Mycobacterium bovis subsp bovis AF2122/97
gugggcagcagc

SEQ ID NO: 1061170 - RNA, 17 nt, Mycobacterium bovis subsp bovis AF2122/97
gugggaguucgcacccg

SEQ ID NO: 1061171 - RNA, 18 nt, Mycobacterium bovis subsp bovis AF2122/97
gugggauucugacgaccg

SEQ ID NO: 1061172 - RNA, 19 nt, Mycobacterium bovis subsp bovis AF2122/97
gugggauucugacgaccgg

SEQ ID NO: 1061173 - RNA, 17 nt, Mycobacterium bovis subsp bovis AF2122/97
guggcguugguggucug

SEQ ID NO: 1061174 - RNA, 18 nt, Mycobacterium bovis subsp bovis AF2122/97
guggcuacgcgaucagcu

SEQ ID NO: 1061175 - RNA, 13 nt, Mycobacterium bovis subsp bovis AF2122/97
gugucaccggcgu

SEQ ID NO: 1061176 - RNA, 16 nt, Mycobacterium bovis subsp bovis AF2122/97
gugucaccggcgucgc

SEQ ID NO: 1061177 - RNA, 15 nt, Mycobacterium bovis subsp bovis AF2122/97
gugucaacgcgcggc

SEQ ID NO: 1061178 - RNA, 19 nt, Mycobacterium bovis subsp bovis AF2122/97
gugucaacgcgcggcucga

SEQ ID NO: 1061179 - RNA, 17 nt, Mycobacterium bovis subsp bovis AF2122/97
gugucaaugacaccggg

SEQ ID NO: 1061180 - RNA, 22 nt, Mycobacterium bovis subsp bovis AF2122/97
gugucacccaauggagccgcga

SEQ ID NO: 1061181 - RNA, 20 nt, Mycobacterium bovis subsp bovis AF2122/97
guguaugcauccacugcggc

SEQ ID NO: 1061182 - RNA, 16 nt, Mycobacterium bovis subsp bovis AF2122/97
gugucagcgccacaua

SEQ ID NO: 1061183 - RNA, 19 nt, Mycobacterium bovis subsp bovis AF2122/97
gugucugugauugcgcggg

SEQ ID NO: 1061184 - RNA, 22 nt, Mycobacterium bovis subsp bovis AF2122/97
gugucacgacccaagucgccga

SEQ ID NO: 1061185 - RNA, 18 nt, Mycobacterium bovis subsp bovis AF2122/97
gugucagcaagaucggca

SEQ ID NO: 1061186 - RNA, 20 nt, Mycobacterium bovis subsp bovis AF2122/97
gugucagcaagaucggcagc

SEQ ID NO: 1061187 - RNA, 22 nt, Mycobacterium bovis subsp bovis AF2122/97
gugucagcaagaucggcagcgu

SEQ ID NO: 1061188 - RNA, 21 nt, Mycobacterium bovis subsp bovis AF2122/97
gugucagcagaugggcgucgg

SEQ ID NO: 1061189 - RNA, 17 nt, Mycobacterium bovis subsp bovis AF2122/97
guguagcaagucgccga

SEQ ID NO: 1061190 - RNA, 19 nt, Mycobacterium bovis subsp bovis AF2122/97
guguagcaagucgccgagg

SEQ ID NO: 1061191 - RNA, 20 nt, Mycobacterium bovis subsp bovis AF2122/97
guguagcagcgccagcagcu

SEQ ID NO: 1061192 - RNA, 19 nt, Mycobacterium bovis subsp bovis AF2122/97
guguagccggcgccgccgu

SEQ ID NO: 1061193 - RNA, 17 nt, Mycobacterium bovis subsp bovis AF2122/97
guguacgcccgcucgga

SEQ ID NO: 1061194 - RNA, 17 nt, Mycobacterium bovis subsp bovis AF2122/97
guguacgugcucguaga

SEQ ID NO: 1061195 - RNA, 19 nt, Mycobacterium bovis subsp bovis AF2122/97
guguagaagcgggcgucgc

SEQ ID NO: 1061196 - RNA, 19 nt, Mycobacterium bovis subsp bovis AF2122/97
guguaguggcccgcgggca

SEQ ID NO: 1061197 - RNA, 18 nt, Mycobacterium bovis subsp bovis AF2122/97
guguagacgugcgucagg

SEQ ID NO: 1061198 - RNA, 20 nt, Mycobacterium bovis subsp bovis AF2122/97
guguaggcaaccuuuggccg

SEQ ID NO: 1061199 - RNA, 16 nt, Mycobacterium bovis subsp bovis AF2122/97
gugugccccgcucucg

SEQ ID NO: 1061200 - RNA, 15 nt, Mycobacterium bovis subsp bovis AF2122/97
gugugcccgcaccgu

SEQ ID NO: 1061201 - RNA, 22 nt, Mycobacterium bovis subsp bovis AF2122/97
gugugcgaacaaguggccagcg

SEQ ID NO: 1061202 - RNA, 22 nt, Mycobacterium bovis subsp bovis AF2122/97
guguuccaacuccugcagcccg

SEQ ID NO: 1061203 - RNA, 18 nt, Mycobacterium bovis subsp bovis AF2122/97
guguuccacaccaggccg

SEQ ID NO: 1061204 - RNA, 15 nt, Mycobacterium bovis subsp bovis AF2122/97
guguuccggucgccc

SEQ ID NO: 1061205 - RNA, 14 nt, Mycobacterium bovis subsp bovis AF2122/97
guguuccgccgcgc

SEQ ID NO: 1061206 - RNA, 21 nt, Mycobacterium bovis subsp bovis AF2122/97
gugugaacuggucgacgucgg

SEQ ID NO: 1061207 - RNA, 24 nt, Mycobacterium bovis subsp bovis AF2122/97
gugugauuccgggucggcgaacgc

SEQ ID NO: 1061208 - RNA, 22 nt, Mycobacterium bovis subsp bovis AF2122/97
gugugagcagacccaguccggu

SEQ ID NO: 1061209 - RNA, 20 nt, Mycobacterium bovis subsp bovis AF2122/97
gugugagucccacgccagcg

SEQ ID NO: 1061210 - RNA, 14 nt, Mycobacterium bovis subsp bovis AF2122/97
gugugauacagcgc

SEQ ID NO: 1061211 - RNA, 19 nt, Mycobacterium bovis subsp bovis AF2122/97
gugugcaggaucacgccgc

SEQ ID NO: 1061212 - RNA, 14 nt, Mycobacterium bovis subsp bovis AF2122/97
gugugcaggccgcg

SEQ ID NO: 1061213 - RNA, 16 nt, Mycobacterium bovis subsp bovis AF2122/97
gugugcaagccgaaca

SEQ ID NO: 1061214 - RNA, 18 nt, Mycobacterium bovis subsp bovis AF2122/97
gugugacagcccgcuggc

SEQ ID NO: 1061215 - RNA, 21 nt, Mycobacterium bovis subsp bovis AF2122/97
gugugcacggcuucggcgagc

SEQ ID NO: 1061216 - RNA, 12 nt, Mycobacterium bovis subsp bovis AF2122/97
gugugcagcagc

SEQ ID NO: 1061217 - RNA, 22 nt, Mycobacterium bovis subsp bovis AF2122/97
guguacaccgcgcccgccgauc

SEQ ID NO: 1061218 - RNA, 21 nt, Mycobacterium bovis subsp bovis AF2122/97
gugguuuucccgucgccgccc

SEQ ID NO: 1061219 - RNA, 16 nt, Mycobacterium bovis subsp bovis AF2122/97
guguacgcccgcucgg

SEQ ID NO: 1061220 - RNA, 15 nt, Mycobacterium bovis subsp bovis AF2122/97
guguaacccuggcgg

SEQ ID NO: 1061221 - RNA, 13 nt, Mycobacterium bovis subsp bovis AF2122/97
gugguuguggcgg

SEQ ID NO: 1061222 - RNA, 18 nt, Mycobacterium bovis subsp bovis AF2122/97
gugguuguucggccaucg

SEQ ID NO: 1061223 - RNA, 19 nt, Mycobacterium bovis subsp bovis AF2122/97
gugguuuucccgucgccgc

SEQ ID NO: 1061224 - RNA, 15 nt, Mycobacterium bovis subsp bovis AF2122/97
guggugcugaccgcg

SEQ ID NO: 1061225 - RNA, 16 nt, Mycobacterium bovis subsp bovis AF2122/97
gugguggacgaccgcg

SEQ ID NO: 1061226 - RNA, 18 nt, Mycobacterium bovis subsp bovis AF2122/97
guggugcuagcgccgcca

SEQ ID NO: 1061227 - RNA, 17 nt, Mycobacterium bovis subsp bovis AF2122/97
guggugccgcggccacc

SEQ ID NO: 1061228 - RNA, 14 nt, Mycobacterium bovis subsp bovis AF2122/97
guggugcggcgcga

SEQ ID NO: 1061229 - RNA, 15 nt, Mycobacterium bovis subsp bovis AF2122/97
guggugccggcgccg

SEQ ID NO: 1061230 - RNA, 14 nt, Mycobacterium bovis subsp bovis AF2122/97
guggugcgcaaucg

SEQ ID NO: 1061231 - RNA, 15 nt, Mycobacterium bovis subsp bovis AF2122/97
guggggccgccacca

SEQ ID NO: 1061232 - RNA, 14 nt, Mycobacterium bovis subsp bovis AF2122/97
guggggcgccgggg

SEQ ID NO: 1061233 - RNA, 14 nt, Mycobacterium bovis subsp bovis AF2122/97
gugggggcgcaccg

SEQ ID NO: 1061234 - RNA, 20 nt, Mycobacterium bovis subsp bovis AF2122/97
guggguaucgagaugccauc

SEQ ID NO: 1061235 - RNA, 19 nt, Mycobacterium bovis subsp bovis AF2122/97
gugggucaagaucggugcc

SEQ ID NO: 1061236 - RNA, 19 nt, Mycobacterium bovis subsp bovis AF2122/97
guggugacagauccgcccc

SEQ ID NO: 1061237 - RNA, 18 nt, Mycobacterium bovis subsp bovis AF2122/97
guggugauccagccgucg

SEQ ID NO: 1061238 - RNA, 19 nt, Mycobacterium bovis subsp bovis AF2122/97
guggugauccagccgucgg

SEQ ID NO: 1061239 - RNA, 21 nt, Mycobacterium bovis subsp bovis AF2122/97
guggugaccaaguagucgggu

SEQ ID NO: 1061240 - RNA, 20 nt, Mycobacterium bovis subsp bovis AF2122/97
guggugaccgacgcggacag

SEQ ID NO: 1061241 - RNA, 19 nt, Mycobacterium bovis subsp bovis AF2122/97
gugggcguggcuggucaug

SEQ ID NO: 1061242 - RNA, 16 nt, Mycobacterium bovis subsp bovis AF2122/97
gugggcauugcggcgc

SEQ ID NO: 1061243 - RNA, 13 nt, Mycobacterium bovis subsp bovis AF2122/97
guggggacccgcu

SEQ ID NO: 1061244 - RNA, 19 nt, Mycobacterium bovis subsp bovis AF2122/97
guggggauagccgcgucgc

SEQ ID NO: 1061245 - RNA, 13 nt, Mycobacterium bovis subsp bovis AF2122/97
guggggaucacga

SEQ ID NO: 1061246 - RNA, 15 nt, Mycobacterium bovis subsp bovis AF2122/97
guuacgcucgcgggc

SEQ ID NO: 1061247 - RNA, 16 nt, Mycobacterium bovis subsp bovis AF2122/97
guuacuccgacggccc

SEQ ID NO: 1061248 - RNA, 16 nt, Mycobacterium bovis subsp bovis AF2122/97
guuacucgcagcgccg

SEQ ID NO: 1061249 - RNA, 22 nt, Mycobacterium bovis subsp bovis AF2122/97
guuacgcaucgucagcgaccac

SEQ ID NO: 1061250 - RNA, 22 nt, Mycobacterium bovis subsp bovis AF2122/97
guuaccgccguuaccgacgccg

SEQ ID NO: 1061251 - RNA, 19 nt, Mycobacterium bovis subsp bovis AF2122/97
guuaccgauuggcccgagu

SEQ ID NO: 1061252 - RNA, 14 nt, Mycobacterium bovis subsp bovis AF2122/97
guuaccgccggcgc

SEQ ID NO: 1061253 - RNA, 16 nt, Mycobacterium bovis subsp bovis AF2122/97
guuaccgacgccggug

SEQ ID NO: 1061254 - RNA, 17 nt, Mycobacterium bovis subsp bovis AF2122/97
guuauguauccgcgccg

SEQ ID NO: 1061255 - RNA, 14 nt, Mycobacterium bovis subsp bovis AF2122/97
aaguucgccggucc

SEQ ID NO: 1061256 - RNA, 19 nt, Mycobacterium bovis subsp bovis AF2122/97
guguugaugggcagccgcc

SEQ ID NO: 1061257 - RNA, 16 nt, Mycobacterium bovis subsp bovis AF2122/97
guguucggcagcgcgg

SEQ ID NO: 1061258 - RNA, 20 nt, Mycobacterium bovis subsp bovis AF2122/97
guguucgggucgaucaccga

SEQ ID NO: 1061259 - RNA, 19 nt, Mycobacterium bovis subsp bovis AF2122/97
guguugaagaagcccgagu

SEQ ID NO: 1061260 - RNA, 20 nt, Mycobacterium bovis subsp bovis AF2122/97
guguucaucacgccgccgga

SEQ ID NO: 1061261 - RNA, 16 nt, Mycobacterium bovis subsp bovis AF2122/97
guguugagaucgcccg

SEQ ID NO: 1061262 - RNA, 22 nt, Mycobacterium bovis subsp bovis AF2122/97
guuacagaugaaggugacgacg

SEQ ID NO: 1061263 - RNA, 22 nt, Mycobacterium bovis subsp bovis AF2122/97
guuaacugcgccuaaccccggc

SEQ ID NO: 1061264 - RNA, 13 nt, Mycobacterium bovis subsp bovis AF2122/97
uauggaccgccgc

SEQ ID NO: 1061265 - RNA, 18 nt, Mycobacterium bovis subsp bovis AF2122/97
uauggaccgccgccgaca

SEQ ID NO: 1061266 - RNA, 22 nt, Mycobacterium bovis subsp bovis AF2122/97
uaugcgggacugacccugaucg

SEQ ID NO: 1061267 - RNA, 15 nt, Mycobacterium bovis subsp bovis AF2122/97
uaugcucgcuggcgc

SEQ ID NO: 1061268 - RNA, 16 nt, Mycobacterium bovis subsp bovis AF2122/97
uaucggcgaacccgca

SEQ ID NO: 1061269 - RNA, 19 nt, Mycobacterium bovis subsp bovis AF2122/97
uaucgccaguggugcaccg

SEQ ID NO: 1061270 - RNA, 14 nt, Mycobacterium bovis subsp bovis AF2122/97
uaucgaaggcgaca

SEQ ID NO: 1061271 - RNA, 14 nt, Mycobacterium bovis subsp bovis AF2122/97
uaucgccggccgcg

SEQ ID NO: 1061272 - RNA, 17 nt, Mycobacterium bovis subsp bovis AF2122/97
uauucguuggcgaacug

SEQ ID NO: 1061273 - RNA, 14 nt, Mycobacterium bovis subsp bovis AF2122/97
uauggcccgggccg

SEQ ID NO: 1061274 - RNA, 18 nt, Mycobacterium bovis subsp bovis AF2122/97
uauggaucaacgcacggc

SEQ ID NO: 1061275 - RNA, 13 nt, Mycobacterium bovis subsp bovis AF2122/97
uauggcggcgacg

SEQ ID NO: 1061276 - RNA, 14 nt, Mycobacterium bovis subsp bovis AF2122/97
uauggguccucgag

SEQ ID NO: 1061277 - RNA, 15 nt, Mycobacterium bovis subsp bovis AF2122/97
uauguauccgcgccg

SEQ ID NO: 1061278 - RNA, 13 nt, Mycobacterium bovis subsp bovis AF2122/97
ucaacaccggcau

SEQ ID NO: 1061279 - RNA, 15 nt, Mycobacterium bovis subsp bovis AF2122/97
ucaacaccggcaucg

SEQ ID NO: 1061280 - RNA, 21 nt, Mycobacterium bovis subsp bovis AF2122/97
ucaacagaccuagcaccgcgc

SEQ ID NO: 1061281 - RNA, 18 nt, Mycobacterium bovis subsp bovis AF2122/97
ucaacaggccucgaccgc

SEQ ID NO: 1061282 - RNA, 21 nt, Mycobacterium bovis subsp bovis AF2122/97
ucaacaggucuacccggucgc

SEQ ID NO: 1061283 - RNA, 21 nt, Mycobacterium bovis subsp bovis AF2122/97
ucaaccaagugaccggccugc

SEQ ID NO: 1061284 - RNA, 18 nt, Mycobacterium bovis subsp bovis AF2122/97
ucaaaaucagggugccgu

SEQ ID NO: 1061285 - RNA, 16 nt, Mycobacterium bovis subsp bovis AF2122/97
ucaacaaucggugguc

SEQ ID NO: 1061286 - RNA, 22 nt, Mycobacterium bovis subsp bovis AF2122/97
uauugaccuucucgucggccag

SEQ ID NO: 1061287 - RNA, 21 nt, Mycobacterium bovis subsp bovis AF2122/97
uaguccagcucgcugcgcgcc

SEQ ID NO: 1061288 - RNA, 23 nt, Mycobacterium bovis subsp bovis AF2122/97
uagucagaugguuggaucgccac

SEQ ID NO: 1061289 - RNA, 23 nt, Mycobacterium bovis subsp bovis AF2122/97
uagucgacgucgauuucggcgac

SEQ ID NO: 1061290 - RNA, 15 nt, Mycobacterium bovis subsp bovis AF2122/97
uagucgcgaccgcgg

SEQ ID NO: 1061291 - RNA, 16 nt, Mycobacterium bovis subsp bovis AF2122/97
uagucgaaggucagca

SEQ ID NO: 1061292 - RNA, 21 nt, Mycobacterium bovis subsp bovis AF2122/97
uagucgaauggcaacacaccg

SEQ ID NO: 1061293 - RNA, 19 nt, Mycobacterium bovis subsp bovis AF2122/97
uagucgauuggcugcgccg

SEQ ID NO: 1061294 - RNA, 13 nt, Mycobacterium bovis subsp bovis AF2122/97
uagucggccagcu

SEQ ID NO: 1061295 - RNA, 16 nt, Mycobacterium bovis subsp bovis AF2122/97
uaguucaccaacgcgg

SEQ ID NO: 1061296 - RNA, 22 nt, Mycobacterium bovis subsp bovis AF2122/97
uaguggcgaucugcugcucgau

SEQ ID NO: 1061297 - RNA, 16 nt, Mycobacterium bovis subsp bovis AF2122/97
uaguggcgcgcggcgc

SEQ ID NO: 1061298 - RNA, 14 nt, Mycobacterium bovis subsp bovis AF2122/97
uagugcuccacguc

SEQ ID NO: 1061299 - RNA, 16 nt, Mycobacterium bovis subsp bovis AF2122/97
uaguggaagccgacca

SEQ ID NO: 1061300 - RNA, 18 nt, Mycobacterium bovis subsp bovis AF2122/97
uagugccaggaucgcggc

SEQ ID NO: 1061301 - RNA, 13 nt, Mycobacterium bovis subsp bovis AF2122/97
uaguucaccgcgu

SEQ ID NO: 1061302 - RNA, 17 nt, Mycobacterium bovis subsp bovis AF2122/97
uaguugauggccccggg

SEQ ID NO: 1061303 - RNA, 19 nt, Mycobacterium bovis subsp bovis AF2122/97
uaguugguccaggugaccg

SEQ ID NO: 1061304 - RNA, 12 nt, Mycobacterium bovis subsp bovis AF2122/97
uagcugcugaug

SEQ ID NO: 1061305 - RNA, 17 nt, Mycobacterium bovis subsp bovis AF2122/97
uagcgucugcuggaucg

SEQ ID NO: 1061306 - RNA, 15 nt, Mycobacterium bovis subsp bovis AF2122/97
uagcgucuggcgaca

SEQ ID NO: 1061307 - RNA, 20 nt, Mycobacterium bovis subsp bovis AF2122/97
uagcuggcgaucuggucggc

SEQ ID NO: 1061308 - RNA, 17 nt, Mycobacterium bovis subsp bovis AF2122/97
uaggugcaugucgauga

SEQ ID NO: 1061309 - RNA, 23 nt, Mycobacterium bovis subsp bovis AF2122/97
uaggugcaacaggcgcgucggug

SEQ ID NO: 1061310 - RNA, 16 nt, Mycobacterium bovis subsp bovis AF2122/97
uaggugacgacgucgu

SEQ ID NO: 1061311 - RNA, 13 nt, Mycobacterium bovis subsp bovis AF2122/97
uagguggccagcg

SEQ ID NO: 1061312 - RNA, 21 nt, Mycobacterium bovis subsp bovis AF2122/97
uaggugggcucguagcgcgca

SEQ ID NO: 1061313 - RNA, 20 nt, Mycobacterium bovis subsp bovis AF2122/97
uagguggucuuggcgguggc

SEQ ID NO: 1061314 - RNA, 17 nt, Mycobacterium bovis subsp bovis AF2122/97
uaggugucgggcucgca

SEQ ID NO: 1061315 - RNA, 15 nt, Mycobacterium bovis subsp bovis AF2122/97
uaggugugcgacgac

SEQ ID NO: 1061316 - RNA, 14 nt, Mycobacterium bovis subsp bovis AF2122/97
uaggugcggggccg

SEQ ID NO: 1061317 - RNA, 17 nt, Mycobacterium bovis subsp bovis AF2122/97
uagguucagcgacugag

SEQ ID NO: 1061318 - RNA, 18 nt, Mycobacterium bovis subsp bovis AF2122/97
uagguucaguuccaccgc

SEQ ID NO: 1061319 - RNA, 15 nt, Mycobacterium bovis subsp bovis AF2122/97
uagguuuucggcggc

SEQ ID NO: 1061320 - RNA, 17 nt, Mycobacterium bovis subsp bovis AF2122/97
uagucagaaccgacggc

SEQ ID NO: 1061321 - RNA, 19 nt, Mycobacterium bovis subsp bovis AF2122/97
uaucgaaaaguagaccgag

SEQ ID NO: 1061322 - RNA, 16 nt, Mycobacterium bovis subsp bovis AF2122/97
uagccauuuccuuggc

SEQ ID NO: 1061323 - RNA, 15 nt, Mycobacterium bovis subsp bovis AF2122/97
uagccagucggccac

SEQ ID NO: 1061324 - RNA, 23 nt, Mycobacterium bovis subsp bovis AF2122/97
uagccaggucgauaccggcgugc

SEQ ID NO: 1061325 - RNA, 17 nt, Mycobacterium bovis subsp bovis AF2122/97
uagccaggcaaccgguc

SEQ ID NO: 1061326 - RNA, 18 nt, Mycobacterium bovis subsp bovis AF2122/97
uagccccguguuguuguc

SEQ ID NO: 1061327 - RNA, 19 nt, Mycobacterium bovis subsp bovis AF2122/97
uagcccgaucgaagaaacg

SEQ ID NO: 1061328 - RNA, 20 nt, Mycobacterium bovis subsp bovis AF2122/97
uagcccgauggugccgaccc

SEQ ID NO: 1061329 - RNA, 20 nt, Mycobacterium bovis subsp bovis AF2122/97
uagccggacuauacgcgucg

SEQ ID NO: 1061330 - RNA, 19 nt, Mycobacterium bovis subsp bovis AF2122/97
uagccgcugcacguggcca

SEQ ID NO: 1061331 - RNA, 15 nt, Mycobacterium bovis subsp bovis AF2122/97
uagaucacccgcagc

SEQ ID NO: 1061332 - RNA, 14 nt, Mycobacterium bovis subsp bovis AF2122/97
uagcaggucgacgg

SEQ ID NO: 1061333 - RNA, 19 nt, Mycobacterium bovis subsp bovis AF2122/97
uagcaggucgacggccacg

SEQ ID NO: 1061334 - RNA, 23 nt, Mycobacterium bovis subsp bovis AF2122/97
uagccaaccugaagccagcgcag

SEQ ID NO: 1061335 - RNA, 22 nt, Mycobacterium bovis subsp bovis AF2122/97
uagccaagcgagcggucgacgu

SEQ ID NO: 1061336 - RNA, 17 nt, Mycobacterium bovis subsp bovis AF2122/97
uagcguccaggucaugc

SEQ ID NO: 1061337 - RNA, 18 nt, Mycobacterium bovis subsp bovis AF2122/97
uagcgguccagcgucgcc

SEQ ID NO: 1061338 - RNA, 15 nt, Mycobacterium bovis subsp bovis AF2122/97
uagcguagcccgagu

SEQ ID NO: 1061339 - RNA, 20 nt, Mycobacterium bovis subsp bovis AF2122/97
uagcggucccgcggaccgca

SEQ ID NO: 1061340 - RNA, 20 nt, Mycobacterium bovis subsp bovis AF2122/97
uagcggucugugcugcgcug

SEQ ID NO: 1061341 - RNA, 14 nt, Mycobacterium bovis subsp bovis AF2122/97
uagcggugucaugc

SEQ ID NO: 1061342 - RNA, 20 nt, Mycobacterium bovis subsp bovis AF2122/97
uagcgguucaucaccgucag

SEQ ID NO: 1061343 - RNA, 21 nt, Mycobacterium bovis subsp bovis AF2122/97
uagcgggggagcgaacggcgc

SEQ ID NO: 1061344 - RNA, 14 nt, Mycobacterium bovis subsp bovis AF2122/97
uagcggcggcggca

SEQ ID NO: 1061345 - RNA, 23 nt, Mycobacterium bovis subsp bovis AF2122/97
uagcgccucgccggccacccgcg

SEQ ID NO: 1061346 - RNA, 11 nt, Mycobacterium bovis subsp bovis AF2122/97
uagccggccgc

SEQ ID NO: 1061347 - RNA, 18 nt, Mycobacterium bovis subsp bovis AF2122/97
uagccggcgacaccgcag

SEQ ID NO: 1061348 - RNA, 13 nt, Mycobacterium bovis subsp bovis AF2122/97
uagccggcgcgcc

SEQ ID NO: 1061349 - RNA, 15 nt, Mycobacterium bovis subsp bovis AF2122/97
uagccggugaccgcg

SEQ ID NO: 1061350 - RNA, 18 nt, Mycobacterium bovis subsp bovis AF2122/97
uagccgggcgcgccggcc

SEQ ID NO: 1061351 - RNA, 22 nt, Mycobacterium bovis subsp bovis AF2122/97
uagcgcauaggcuuccggcgcg

SEQ ID NO: 1061352 - RNA, 23 nt, Mycobacterium bovis subsp bovis AF2122/97
uagcgcauccaauaucgcuuucg

SEQ ID NO: 1061353 - RNA, 15 nt, Mycobacterium bovis subsp bovis AF2122/97
uagcgcaucgccaau

SEQ ID NO: 1061354 - RNA, 16 nt, Mycobacterium bovis subsp bovis AF2122/97
uagaggauaucgccga

SEQ ID NO: 1061355 - RNA, 21 nt, Mycobacterium bovis subsp bovis AF2122/97
uagagcaugccgcccgcgccg

SEQ ID NO: 1061356 - RNA, 13 nt, Mycobacterium bovis subsp bovis AF2122/97
uagagcgcaccgc

SEQ ID NO: 1061357 - RNA, 19 nt, Mycobacterium bovis subsp bovis AF2122/97
uagaucgcguggaucgcgc

SEQ ID NO: 1061358 - RNA, 20 nt, Mycobacterium bovis subsp bovis AF2122/97
uagaucagcagcggcgaccg

SEQ ID NO: 1061359 - RNA, 20 nt, Mycobacterium bovis subsp bovis AF2122/97
uagauauggaccgccgccga

SEQ ID NO: 1061360 - RNA, 12 nt, Mycobacterium bovis subsp bovis AF2122/97
uagacggcgacg

SEQ ID NO: 1061361 - RNA, 23 nt, Mycobacterium bovis subsp bovis AF2122/97
uagacgguuaccgcgaagcugcg

SEQ ID NO: 1061362 - RNA, 20 nt, Mycobacterium bovis subsp bovis AF2122/97
uagaacugcaucauggccgu

SEQ ID NO: 1061363 - RNA, 21 nt, Mycobacterium bovis subsp bovis AF2122/97
uacggcaauacccgccgcgau

SEQ ID NO: 1061364 - RNA, 15 nt, Mycobacterium bovis subsp bovis AF2122/97
uacgccggccgcgcu

SEQ ID NO: 1061365 - RNA, 22 nt, Mycobacterium bovis subsp bovis AF2122/97
uacuccgcgagcccggccucgg

SEQ ID NO: 1061366 - RNA, 13 nt, Mycobacterium bovis subsp bovis AF2122/97
uacucucgcgaca

SEQ ID NO: 1061367 - RNA, 23 nt, Mycobacterium bovis subsp bovis AF2122/97
uacucggcauccaggcugucgcg

SEQ ID NO: 1061368 - RNA, 16 nt, Mycobacterium bovis subsp bovis AF2122/97
uacuggccgccgcgca

SEQ ID NO: 1061369 - RNA, 20 nt, Mycobacterium bovis subsp bovis AF2122/97
uaccugggacaggacgacug

SEQ ID NO: 1061370 - RNA, 15 nt, Mycobacterium bovis subsp bovis AF2122/97
uaccugguucgacuc

SEQ ID NO: 1061371 - RNA, 16 nt, Mycobacterium bovis subsp bovis AF2122/97
uaccucggccgccagc

SEQ ID NO: 1061372 - RNA, 13 nt, Mycobacterium bovis subsp bovis AF2122/97
uaccucggcgacc

SEQ ID NO: 1061373 - RNA, 14 nt, Mycobacterium bovis subsp bovis AF2122/97
uaccugaagccgcg

SEQ ID NO: 1061374 - RNA, 11 nt, Mycobacterium bovis subsp bovis AF2122/97
uaccucccgcg

SEQ ID NO: 1061375 - RNA, 18 nt, Mycobacterium bovis subsp bovis AF2122/97
uaccucccgcgugcgggg

SEQ ID NO: 1061376 - RNA, 15 nt, Mycobacterium bovis subsp bovis AF2122/97
uaccucaucgcagac

SEQ ID NO: 1061377 - RNA, 16 nt, Mycobacterium bovis subsp bovis AF2122/97
uaccguuguugaggau

SEQ ID NO: 1061378 - RNA, 20 nt, Mycobacterium bovis subsp bovis AF2122/97
uaccggucagcaccuccacc

SEQ ID NO: 1061379 - RNA, 11 nt, Mycobacterium bovis subsp bovis AF2122/97
uaccggcggcg

SEQ ID NO: 1061380 - RNA, 17 nt, Mycobacterium bovis subsp bovis AF2122/97
uaccggcggcgccggag

SEQ ID NO: 1061381 - RNA, 13 nt, Mycobacterium bovis subsp bovis AF2122/97
uaccggcgggcga

SEQ ID NO: 1061382 - RNA, 23 nt, Mycobacterium bovis subsp bovis AF2122/97
uaccggcgugcaguacaccccau

SEQ ID NO: 1061383 - RNA, 21 nt, Mycobacterium bovis subsp bovis AF2122/97
uaccggcuacggcgacacgcc

SEQ ID NO: 1061384 - RNA, 23 nt, Mycobacterium bovis subsp bovis AF2122/97
uaccgggaucccacggcgggcga

SEQ ID NO: 1061385 - RNA, 19 nt, Mycobacterium bovis subsp bovis AF2122/97
uaccgugcuggcaccagca

SEQ ID NO: 1061386 - RNA, 18 nt, Mycobacterium bovis subsp bovis AF2122/97
uaccgucgugcgugcggc

SEQ ID NO: 1061387 - RNA, 21 nt, Mycobacterium bovis subsp bovis AF2122/97
uaccgucgugcgugcggcgaa

SEQ ID NO: 1061388 - RNA, 16 nt, Mycobacterium bovis subsp bovis AF2122/97
uaccgugcauaccgca

SEQ ID NO: 1061389 - RNA, 22 nt, Mycobacterium bovis subsp bovis AF2122/97
uaccgucgaccacuagcccagu

SEQ ID NO: 1061390 - RNA, 14 nt, Mycobacterium bovis subsp bovis AF2122/97
uaccgucagcgccg

SEQ ID NO: 1061391 - RNA, 19 nt, Mycobacterium bovis subsp bovis AF2122/97
uaccgguugacgggcucgg

SEQ ID NO: 1061392 - RNA, 15 nt, Mycobacterium bovis subsp bovis AF2122/97
uaccgcgcucccggc

SEQ ID NO: 1061393 - RNA, 20 nt, Mycobacterium bovis subsp bovis AF2122/97
uaccgcgcguuguggcgaug

SEQ ID NO: 1061394 - RNA, 17 nt, Mycobacterium bovis subsp bovis AF2122/97
uaccgcgaagcugcggg

SEQ ID NO: 1061395 - RNA, 18 nt, Mycobacterium bovis subsp bovis AF2122/97
uaccgccgcgaccgcgag

SEQ ID NO: 1061396 - RNA, 16 nt, Mycobacterium bovis subsp bovis AF2122/97
uaccgccggcggcggc

SEQ ID NO: 1061397 - RNA, 19 nt, Mycobacterium bovis subsp bovis AF2122/97
uaccgccggcuccgccguu

SEQ ID NO: 1061398 - RNA, 15 nt, Mycobacterium bovis subsp bovis AF2122/97
uaccgccggccccac

SEQ ID NO: 1061399 - RNA, 17 nt, Mycobacterium bovis subsp bovis AF2122/97
uaccgccggcgccggug

SEQ ID NO: 1061400 - RNA, 12 nt, Mycobacterium bovis subsp bovis AF2122/97
uaccgccggcgg

SEQ ID NO: 1061401 - RNA, 16 nt, Mycobacterium bovis subsp bovis AF2122/97
uaccgcucgggcgcga

SEQ ID NO: 1061402 - RNA, 20 nt, Mycobacterium bovis subsp bovis AF2122/97
uaccgcgugcgccggggaca

SEQ ID NO: 1061403 - RNA, 18 nt, Mycobacterium bovis subsp bovis AF2122/97
uaccggccagccgcggcc

SEQ ID NO: 1061404 - RNA, 16 nt, Mycobacterium bovis subsp bovis AF2122/97
uaccggcacgccggcg

SEQ ID NO: 1061405 - RNA, 14 nt, Mycobacterium bovis subsp bovis AF2122/97
uacccgcagcgugc

SEQ ID NO: 1061406 - RNA, 20 nt, Mycobacterium bovis subsp bovis AF2122/97
uacccgcaugacgccggcgg

SEQ ID NO: 1061407 - RNA, 23 nt, Mycobacterium bovis subsp bovis AF2122/97
uacccgcccacggcaccaccaag

SEQ ID NO: 1061408 - RNA, 15 nt, Mycobacterium bovis subsp bovis AF2122/97
uacccccgauggcgu

SEQ ID NO: 1061409 - RNA, 18 nt, Mycobacterium bovis subsp bovis AF2122/97
uaccccgcagcucaccuc

SEQ ID NO: 1061410 - RNA, 19 nt, Mycobacterium bovis subsp bovis AF2122/97
uaccccagggagugccgca

SEQ ID NO: 1061411 - RNA, 18 nt, Mycobacterium bovis subsp bovis AF2122/97
uacccguuaugcgccgcc

SEQ ID NO: 1061412 - RNA, 11 nt, Mycobacterium bovis subsp bovis AF2122/97
uacccgcggcg

SEQ ID NO: 1061413 - RNA, 15 nt, Mycobacterium bovis subsp bovis AF2122/97
uacccgcggggaauc

SEQ ID NO: 1061414 - RNA, 14 nt, Mycobacterium bovis subsp bovis AF2122/97
uacccgcgcgcacc

SEQ ID NO: 1061415 - RNA, 21 nt, Mycobacterium bovis subsp bovis AF2122/97
uacccggaccgucguggcggu

SEQ ID NO: 1061416 - RNA, 16 nt, Mycobacterium bovis subsp bovis AF2122/97
uacccgggcggcggcg

SEQ ID NO: 1061417 - RNA, 12 nt, Mycobacterium bovis subsp bovis AF2122/97
uacccggcgacg

SEQ ID NO: 1061418 - RNA, 23 nt, Mycobacterium bovis subsp bovis AF2122/97
uaccgacggggauggagccggug

SEQ ID NO: 1061419 - RNA, 13 nt, Mycobacterium bovis subsp bovis AF2122/97
uaccgcacccgcu

SEQ ID NO: 1061420 - RNA, 20 nt, Mycobacterium bovis subsp bovis AF2122/97
uaccgauagccugcggcggc

SEQ ID NO: 1061421 - RNA, 19 nt, Mycobacterium bovis subsp bovis AF2122/97
uaccgaugguggugccaac

SEQ ID NO: 1061422 - RNA, 16 nt, Mycobacterium bovis subsp bovis AF2122/97
uaccgaugaaccaggc

SEQ ID NO: 1061423 - RNA, 16 nt, Mycobacterium bovis subsp bovis AF2122/97
uacccagccagccgcg

SEQ ID NO: 1061424 - RNA, 21 nt, Mycobacterium bovis subsp bovis AF2122/97
uacccacaguuaucagccgcg

SEQ ID NO: 1061425 - RNA, 14 nt, Mycobacterium bovis subsp bovis AF2122/97
uacccaccggccgg

SEQ ID NO: 1061426 - RNA, 21 nt, Mycobacterium bovis subsp bovis AF2122/97
uacccaccguuugggcgccgg

SEQ ID NO: 1061427 - RNA, 12 nt, Mycobacterium bovis subsp bovis AF2122/97
uacccaccuccc

SEQ ID NO: 1061428 - RNA, 20 nt, Mycobacterium bovis subsp bovis AF2122/97
uacccaucaacaucggcccg

SEQ ID NO: 1061429 - RNA, 15 nt, Mycobacterium bovis subsp bovis AF2122/97
uacccaucgucgagc

SEQ ID NO: 1061430 - RNA, 14 nt, Mycobacterium bovis subsp bovis AF2122/97
uacccauggcccgu

SEQ ID NO: 1061431 - RNA, 17 nt, Mycobacterium bovis subsp bovis AF2122/97
ucagcgggcacgccgcc

SEQ ID NO: 1061432 - RNA, 18 nt, Mycobacterium bovis subsp bovis AF2122/97
ucagcgggcacgccgccg

SEQ ID NO: 1061433 - RNA, 22 nt, Mycobacterium bovis subsp bovis AF2122/97
ucagcgggcagcaggcgaugcg

SEQ ID NO: 1061434 - RNA, 23 nt, Mycobacterium bovis subsp bovis AF2122/97
ucagcgggcagcaggcgaugcgc

SEQ ID NO: 1061435 - RNA, 16 nt, Mycobacterium bovis subsp bovis AF2122/97
ucaggcccugccgacg

SEQ ID NO: 1061436 - RNA, 21 nt, Mycobacterium bovis subsp bovis AF2122/97
ucaggccgacgucuaggccaa

SEQ ID NO: 1061437 - RNA, 19 nt, Mycobacterium bovis subsp bovis AF2122/97
ucaggccgaugcgggucuc

SEQ ID NO: 1061438 - RNA, 23 nt, Mycobacterium bovis subsp bovis AF2122/97
ucaggccgaugacgaugccgccg

SEQ ID NO: 1061439 - RNA, 19 nt, Mycobacterium bovis subsp bovis AF2122/97
ucaggcggcuggcccgcau

SEQ ID NO: 1061440 - RNA, 18 nt, Mycobacterium bovis subsp bovis AF2122/97
ucaggcucacacucggcc

SEQ ID NO: 1061441 - RNA, 15 nt, Mycobacterium bovis subsp bovis AF2122/97
ucaggcucauccgcc

SEQ ID NO: 1061442 - RNA, 16 nt, Mycobacterium bovis subsp bovis AF2122/97
ucaggcucauccgccg

SEQ ID NO: 1061443 - RNA, 14 nt, Mycobacterium bovis subsp bovis AF2122/97
ucaggcgccgcuau

SEQ ID NO: 1061444 - RNA, 23 nt, Mycobacterium bovis subsp bovis AF2122/97
ucagggcacgcuggaacuuggcg

SEQ ID NO: 1061445 - RNA, 21 nt, Mycobacterium bovis subsp bovis AF2122/97
ucaggcugaaggacggcagcu

SEQ ID NO: 1061446 - RNA, 18 nt, Mycobacterium bovis subsp bovis AF2122/97
ucagggacgaacugcuga

SEQ ID NO: 1061447 - RNA, 14 nt, Mycobacterium bovis subsp bovis AF2122/97
ucagggugccgucg

SEQ ID NO: 1061448 - RNA, 14 nt, Mycobacterium bovis subsp bovis AF2122/97
ucagggugcgccgc

SEQ ID NO: 1061449 - RNA, 16 nt, Mycobacterium bovis subsp bovis AF2122/97
ucagggucugcgccgc

SEQ ID NO: 1061450 - RNA, 18 nt, Mycobacterium bovis subsp bovis AF2122/97
ucagggucugcgccgccg

SEQ ID NO: 1061451 - RNA, 12 nt, Mycobacterium bovis subsp bovis AF2122/97
ucagggugggcg

SEQ ID NO: 1061452 - RNA, 13 nt, Mycobacterium bovis subsp bovis AF2122/97
ucagggugucgaa

SEQ ID NO: 1061453 - RNA, 16 nt, Mycobacterium bovis subsp bovis AF2122/97
ucagggugucgacaac

SEQ ID NO: 1061454 - RNA, 18 nt, Mycobacterium bovis subsp bovis AF2122/97
ucaggguguucacguuca

SEQ ID NO: 1061455 - RNA, 16 nt, Mycobacterium bovis subsp bovis AF2122/97
ucagggcucgcucgcc

SEQ ID NO: 1061456 - RNA, 13 nt, Mycobacterium bovis subsp bovis AF2122/97
ucagggucagcgc

SEQ ID NO: 1061457 - RNA, 21 nt, Mycobacterium bovis subsp bovis AF2122/97
ucaggucaccggccgccgaca

SEQ ID NO: 1061458 - RNA, 17 nt, Mycobacterium bovis subsp bovis AF2122/97
ucaggucaucggcggcg

SEQ ID NO: 1061459 - RNA, 18 nt, Mycobacterium bovis subsp bovis AF2122/97
ucagguacaucccggugu

SEQ ID NO: 1061460 - RNA, 16 nt, Mycobacterium bovis subsp bovis AF2122/97
ucagguacggcgggcg

SEQ ID NO: 1061461 - RNA, 16 nt, Mycobacterium bovis subsp bovis AF2122/97
ucaggucgguggucuc

SEQ ID NO: 1061462 - RNA, 20 nt, Mycobacterium bovis subsp bovis AF2122/97
ucaggucgguggucucgacg

SEQ ID NO: 1061463 - RNA, 19 nt, Mycobacterium bovis subsp bovis AF2122/97
ucaggucugacagaccggg

SEQ ID NO: 1061464 - RNA, 16 nt, Mycobacterium bovis subsp bovis AF2122/97
ucaggugcgcgaccag

SEQ ID NO: 1061465 - RNA, 17 nt, Mycobacterium bovis subsp bovis AF2122/97
ucaggugagaccagguu

SEQ ID NO: 1061466 - RNA, 15 nt, Mycobacterium bovis subsp bovis AF2122/97
ucagguucgcaccgg

SEQ ID NO: 1061467 - RNA, 11 nt, Mycobacterium bovis subsp bovis AF2122/97
ucaucggcgcu

SEQ ID NO: 1061468 - RNA, 17 nt, Mycobacterium bovis subsp bovis AF2122/97
ucaucggcacaggcggc

SEQ ID NO: 1061469 - RNA, 22 nt, Mycobacterium bovis subsp bovis AF2122/97
ucaucggcacaggcggccagca

SEQ ID NO: 1061470 - RNA, 14 nt, Mycobacterium bovis subsp bovis AF2122/97
ucaucggcaucgac

SEQ ID NO: 1061471 - RNA, 20 nt, Mycobacterium bovis subsp bovis AF2122/97
ucaucggcaucgacugccag

SEQ ID NO: 1061472 - RNA, 16 nt, Mycobacterium bovis subsp bovis AF2122/97
ucaugaacaucggccg

SEQ ID NO: 1061473 - RNA, 16 nt, Mycobacterium bovis subsp bovis AF2122/97
ucaugaacgcaagcag

SEQ ID NO: 1061474 - RNA, 14 nt, Mycobacterium bovis subsp bovis AF2122/97
ucaucgcgcccgcc

SEQ ID NO: 1061475 - RNA, 13 nt, Mycobacterium bovis subsp bovis AF2122/97
ucaucgcggugug

SEQ ID NO: 1061476 - RNA, 19 nt, Mycobacterium bovis subsp bovis AF2122/97
ucaucggcaaacuccugca

SEQ ID NO: 1061477 - RNA, 19 nt, Mycobacterium bovis subsp bovis AF2122/97
ucaucgcugugcgcugguc

SEQ ID NO: 1061478 - RNA, 19 nt, Mycobacterium bovis subsp bovis AF2122/97
ucaucgcccaccgcaacgc

SEQ ID NO: 1061479 - RNA, 18 nt, Mycobacterium bovis subsp bovis AF2122/97
ucaucgcccaccgcaacg

SEQ ID NO: 1061480 - RNA, 19 nt, Mycobacterium bovis subsp bovis AF2122/97
ucaucgcccugggcgccgg

SEQ ID NO: 1061481 - RNA, 16 nt, Mycobacterium bovis subsp bovis AF2122/97
ucaucgccucgaggac

SEQ ID NO: 1061482 - RNA, 12 nt, Mycobacterium bovis subsp bovis AF2122/97
ucaucccgacca

SEQ ID NO: 1061483 - RNA, 18 nt, Mycobacterium bovis subsp bovis AF2122/97
ucauccauccgggccgcg

SEQ ID NO: 1061484 - RNA, 13 nt, Mycobacterium bovis subsp bovis AF2122/97
ucauccccgacug

SEQ ID NO: 1061485 - RNA, 12 nt, Mycobacterium bovis subsp bovis AF2122/97
ucauccggccgu

SEQ ID NO: 1061486 - RNA, 13 nt, Mycobacterium bovis subsp bovis AF2122/97
ucauccggccguc

SEQ ID NO: 1061487 - RNA, 16 nt, Mycobacterium bovis subsp bovis AF2122/97
ucauccgagcgguggu

SEQ ID NO: 1061488 - RNA, 17 nt, Mycobacterium bovis subsp bovis AF2122/97
ucauccauucggcggcg

SEQ ID NO: 1061489 - RNA, 18 nt, Mycobacterium bovis subsp bovis AF2122/97
ucaucacccagcgccgac

SEQ ID NO: 1061490 - RNA, 21 nt, Mycobacterium bovis subsp bovis AF2122/97
ucaucacccagcgccgaccca

SEQ ID NO: 1061491 - RNA, 13 nt, Mycobacterium bovis subsp bovis AF2122/97
ucaucaccggcau

SEQ ID NO: 1061492 - RNA, 14 nt, Mycobacterium bovis subsp bovis AF2122/97
ucaucaccggcgca

SEQ ID NO: 1061493 - RNA, 14 nt, Mycobacterium bovis subsp bovis AF2122/97
ucaguaccgcacgc

SEQ ID NO: 1061494 - RNA, 16 nt, Mycobacterium bovis subsp bovis AF2122/97
ucagucaacucaccgu

SEQ ID NO: 1061495 - RNA, 15 nt, Mycobacterium bovis subsp bovis AF2122/97
ucagugcgaugcggu

SEQ ID NO: 1061496 - RNA, 16 nt, Mycobacterium bovis subsp bovis AF2122/97
ucagugccccgcccgg

SEQ ID NO: 1061497 - RNA, 23 nt, Mycobacterium bovis subsp bovis AF2122/97
ucagugauucggccugagcggcc

SEQ ID NO: 1061498 - RNA, 16 nt, Mycobacterium bovis subsp bovis AF2122/97
ucagugccccgcagca

SEQ ID NO: 1061499 - RNA, 13 nt, Mycobacterium bovis subsp bovis AF2122/97
ucagugcgggcgg

SEQ ID NO: 1061500 - RNA, 23 nt, Mycobacterium bovis subsp bovis AF2122/97
ucagugcgugauggcggcgcacc

SEQ ID NO: 1061501 - RNA, 20 nt, Mycobacterium bovis subsp bovis AF2122/97
ucagugggcgguugaucgcc

SEQ ID NO: 1061502 - RNA, 22 nt, Mycobacterium bovis subsp bovis AF2122/97
ucaguucacguucggcgacgcg

SEQ ID NO: 1061503 - RNA, 22 nt, Mycobacterium bovis subsp bovis AF2122/97
ucaucaacucgacccggccaag

SEQ ID NO: 1061504 - RNA, 15 nt, Mycobacterium bovis subsp bovis AF2122/97
ucaucaagguguugc

SEQ ID NO: 1061505 - RNA, 19 nt, Mycobacterium bovis subsp bovis AF2122/97
uccacgguugccggcggcg

SEQ ID NO: 1061506 - RNA, 18 nt, Mycobacterium bovis subsp bovis AF2122/97
uccacgcgcucggugccg

SEQ ID NO: 1061507 - RNA, 23 nt, Mycobacterium bovis subsp bovis AF2122/97
uccacggcgggaacggugccgau

SEQ ID NO: 1061508 - RNA, 22 nt, Mycobacterium bovis subsp bovis AF2122/97
uccacgcagaggcggcuggcgg

SEQ ID NO: 1061509 - RNA, 16 nt, Mycobacterium bovis subsp bovis AF2122/97
uccacggagaccggcc

SEQ ID NO: 1061510 - RNA, 18 nt, Mycobacterium bovis subsp bovis AF2122/97
uccacggagaccggccgg

SEQ ID NO: 1061511 - RNA, 15 nt, Mycobacterium bovis subsp bovis AF2122/97
uccacgcugaccaac

SEQ ID NO: 1061512 - RNA, 21 nt, Mycobacterium bovis subsp bovis AF2122/97
uccagcgccugcgcccagccg

SEQ ID NO: 1061513 - RNA, 19 nt, Mycobacterium bovis subsp bovis AF2122/97
uccagcagcucgccggcac

SEQ ID NO: 1061514 - RNA, 17 nt, Mycobacterium bovis subsp bovis AF2122/97
uccagcagcucggccga

SEQ ID NO: 1061515 - RNA, 16 nt, Mycobacterium bovis subsp bovis AF2122/97
uccagcaggccgucga

SEQ ID NO: 1061516 - RNA, 21 nt, Mycobacterium bovis subsp bovis AF2122/97
uccagcagguccgcggccgcg

SEQ ID NO: 1061517 - RNA, 17 nt, Mycobacterium bovis subsp bovis AF2122/97
uccagcaguacaccgcc

SEQ ID NO: 1061518 - RNA, 18 nt, Mycobacterium bovis subsp bovis AF2122/97
uccagcaguacaccgccc

SEQ ID NO: 1061519 - RNA, 13 nt, Mycobacterium bovis subsp bovis AF2122/97
uccagccaacggg

SEQ ID NO: 1061520 - RNA, 23 nt, Mycobacterium bovis subsp bovis AF2122/97
uccagccaacgggaacaacggcg

SEQ ID NO: 1061521 - RNA, 12 nt, Mycobacterium bovis subsp bovis AF2122/97
uccagccaccgc

SEQ ID NO: 1061522 - RNA, 15 nt, Mycobacterium bovis subsp bovis AF2122/97
uccagcaugcccgcc

SEQ ID NO: 1061523 - RNA, 15 nt, Mycobacterium bovis subsp bovis AF2122/97
uccagcugcugccga

SEQ ID NO: 1061524 - RNA, 20 nt, Mycobacterium bovis subsp bovis AF2122/97
uccagcuguacaacgccguc

SEQ ID NO: 1061525 - RNA, 12 nt, Mycobacterium bovis subsp bovis AF2122/97
uccagcgccgga

SEQ ID NO: 1061526 - RNA, 21 nt, Mycobacterium bovis subsp bovis AF2122/97
uccagcucgggggcgccggcg

SEQ ID NO: 1061527 - RNA, 18 nt, Mycobacterium bovis subsp bovis AF2122/97
uccagcucgucgucggcg

SEQ ID NO: 1061528 - RNA, 14 nt, Mycobacterium bovis subsp bovis AF2122/97
uccaggccagggcg

SEQ ID NO: 1061529 - RNA, 19 nt, Mycobacterium bovis subsp bovis AF2122/97
uccaggcccagccgagcgg

SEQ ID NO: 1061530 - RNA, 15 nt, Mycobacterium bovis subsp bovis AF2122/97
uccaggagccgagga

SEQ ID NO: 1061531 - RNA, 20 nt, Mycobacterium bovis subsp bovis AF2122/97
uccaggaauuccccaccguc

SEQ ID NO: 1061532 - RNA, 22 nt, Mycobacterium bovis subsp bovis AF2122/97
uccaggaauuccccaccgucgu

SEQ ID NO: 1061533 - RNA, 12 nt, Mycobacterium bovis subsp bovis AF2122/97
uccaggccggca

SEQ ID NO: 1061534 - RNA, 21 nt, Mycobacterium bovis subsp bovis AF2122/97
uccaggcccuggccagcccga

SEQ ID NO: 1061535 - RNA, 14 nt, Mycobacterium bovis subsp bovis AF2122/97
uccaggcgcgccgc

SEQ ID NO: 1061536 - RNA, 13 nt, Mycobacterium bovis subsp bovis AF2122/97
uccaggcgccacc

SEQ ID NO: 1061537 - RNA, 22 nt, Mycobacterium bovis subsp bovis AF2122/97
uccaggcguuggaucccagccc

SEQ ID NO: 1061538 - RNA, 18 nt, Mycobacterium bovis subsp bovis AF2122/97
uccaggcgggcggcaccg

SEQ ID NO: 1061539 - RNA, 13 nt, Mycobacterium bovis subsp bovis AF2122/97
uccaccggaccga

SEQ ID NO: 1061540 - RNA, 19 nt, Mycobacterium bovis subsp bovis AF2122/97
uccaccggaccgaccaccg

SEQ ID NO: 1061541 - RNA, 20 nt, Mycobacterium bovis subsp bovis AF2122/97
uccaccggacggguuacucg

SEQ ID NO: 1061542 - RNA, 17 nt, Mycobacterium bovis subsp bovis AF2122/97
uccaccgcgccggcggc

SEQ ID NO: 1061543 - RNA, 15 nt, Mycobacterium bovis subsp bovis AF2122/97
uccaccgcgccggcg

SEQ ID NO: 1061544 - RNA, 18 nt, Mycobacterium bovis subsp bovis AF2122/97
uccaccgccgacgcccga

SEQ ID NO: 1061545 - RNA, 23 nt, Mycobacterium bovis subsp bovis AF2122/97
uccaccgcacggaugucgcccaa

SEQ ID NO: 1061546 - RNA, 23 nt, Mycobacterium bovis subsp bovis AF2122/97
uccaccgcagauccccgccaccg

SEQ ID NO: 1061547 - RNA, 13 nt, Mycobacterium bovis subsp bovis AF2122/97
uccacgacgucga

SEQ ID NO: 1061548 - RNA, 14 nt, Mycobacterium bovis subsp bovis AF2122/97
uccaccgucgccgc

SEQ ID NO: 1061549 - RNA, 20 nt, Mycobacterium bovis subsp bovis AF2122/97
uccaccgggauagccgcgac

SEQ ID NO: 1061550 - RNA, 16 nt, Mycobacterium bovis subsp bovis AF2122/97
uccaccgggcccgccg

SEQ ID NO: 1061551 - RNA, 17 nt, Mycobacterium bovis subsp bovis AF2122/97
uccaccgggcccgccgg

SEQ ID NO: 1061552 - RNA, 16 nt, Mycobacterium bovis subsp bovis AF2122/97
uccaccgucgccgccg

SEQ ID NO: 1061553 - RNA, 18 nt, Mycobacterium bovis subsp bovis AF2122/97
uccaccugaacggcaacg

SEQ ID NO: 1061554 - RNA, 19 nt, Mycobacterium bovis subsp bovis AF2122/97
uccacccuugccgcuggug

SEQ ID NO: 1061555 - RNA, 20 nt, Mycobacterium bovis subsp bovis AF2122/97
uccaccgaaaaguccgccgc

SEQ ID NO: 1061556 - RNA, 14 nt, Mycobacterium bovis subsp bovis AF2122/97
uccacccgacgacg

SEQ ID NO: 1061557 - RNA, 14 nt, Mycobacterium bovis subsp bovis AF2122/97
uccaccccgccgau

SEQ ID NO: 1061558 - RNA, 14 nt, Mycobacterium bovis subsp bovis AF2122/97
uccaccccgauccg

SEQ ID NO: 1061559 - RNA, 18 nt, Mycobacterium bovis subsp bovis AF2122/97
uccaccccgauccgccac

SEQ ID NO: 1061560 - RNA, 17 nt, Mycobacterium bovis subsp bovis AF2122/97
uccaccaggucgugccc

SEQ ID NO: 1061561 - RNA, 17 nt, Mycobacterium bovis subsp bovis AF2122/97
uccacccaacgcggugg

SEQ ID NO: 1061562 - RNA, 14 nt, Mycobacterium bovis subsp bovis AF2122/97
uccacccaagcucg

SEQ ID NO: 1061563 - RNA, 23 nt, Mycobacterium bovis subsp bovis AF2122/97
uccacccaggccgaugugucgau

SEQ ID NO: 1061564 - RNA, 16 nt, Mycobacterium bovis subsp bovis AF2122/97
uccaccacgacgucgg

SEQ ID NO: 1061565 - RNA, 13 nt, Mycobacterium bovis subsp bovis AF2122/97
uccaccacgucgg

SEQ ID NO: 1061566 - RNA, 23 nt, Mycobacterium bovis subsp bovis AF2122/97
uccaaauggugagcucgcgcaga

SEQ ID NO: 1061567 - RNA, 16 nt, Mycobacterium bovis subsp bovis AF2122/97
uccaacuccugcagcc

SEQ ID NO: 1061568 - RNA, 22 nt, Mycobacterium bovis subsp bovis AF2122/97
uccaccaccgucgagccggaca

SEQ ID NO: 1061569 - RNA, 18 nt, Mycobacterium bovis subsp bovis AF2122/97
ucaugccggcgaacucgc

SEQ ID NO: 1061570 - RNA, 23 nt, Mycobacterium bovis subsp bovis AF2122/97
ucaugcuaggccaccggcgaccg

SEQ ID NO: 1061571 - RNA, 20 nt, Mycobacterium bovis subsp bovis AF2122/97
ucaugcccaugauggccgcg

SEQ ID NO: 1061572 - RNA, 21 nt, Mycobacterium bovis subsp bovis AF2122/97
ucaugcaaaagccgcgaucgg

SEQ ID NO: 1061573 - RNA, 14 nt, Mycobacterium bovis subsp bovis AF2122/97
ucaugcccaccgcc

SEQ ID NO: 1061574 - RNA, 12 nt, Mycobacterium bovis subsp bovis AF2122/97
ucaugagccgcu

SEQ ID NO: 1061575 - RNA, 18 nt, Mycobacterium bovis subsp bovis AF2122/97
ucauggcgaguacggccu

SEQ ID NO: 1061576 - RNA, 18 nt, Mycobacterium bovis subsp bovis AF2122/97
ucauggauaauccaugac

SEQ ID NO: 1061577 - RNA, 17 nt, Mycobacterium bovis subsp bovis AF2122/97
ucauggcgaaccgucag

SEQ ID NO: 1061578 - RNA, 14 nt, Mycobacterium bovis subsp bovis AF2122/97
uccaaaaucgcggc

SEQ ID NO: 1061579 - RNA, 20 nt, Mycobacterium bovis subsp bovis AF2122/97
uccaacgacuguggcgccgc

SEQ ID NO: 1061580 - RNA, 15 nt, Mycobacterium bovis subsp bovis AF2122/97
uccaacucggcggcc

SEQ ID NO: 1061581 - RNA, 16 nt, Mycobacterium bovis subsp bovis AF2122/97
uccaacuggccgcguc

SEQ ID NO: 1061582 - RNA, 18 nt, Mycobacterium bovis subsp bovis AF2122/97
uccaacccaggguggcga

SEQ ID NO: 1061583 - RNA, 19 nt, Mycobacterium bovis subsp bovis AF2122/97
uccaacaggaacaggcaaa

SEQ ID NO: 1061584 - RNA, 19 nt, Mycobacterium bovis subsp bovis AF2122/97
uccaaauccuucggcgugg

SEQ ID NO: 1061585 - RNA, 18 nt, Mycobacterium bovis subsp bovis AF2122/97
uccaacaacuccagcagg

SEQ ID NO: 1061586 - RNA, 20 nt, Mycobacterium bovis subsp bovis AF2122/97
ucaccaaguucagcacgugg

SEQ ID NO: 1061587 - RNA, 16 nt, Mycobacterium bovis subsp bovis AF2122/97
ucaccaagacaccggc

SEQ ID NO: 1061588 - RNA, 23 nt, Mycobacterium bovis subsp bovis AF2122/97
ucaccaacgcgggaacgaugccg

SEQ ID NO: 1061589 - RNA, 16 nt, Mycobacterium bovis subsp bovis AF2122/97
ucaccacccgaccgcc

SEQ ID NO: 1061590 - RNA, 19 nt, Mycobacterium bovis subsp bovis AF2122/97
ucaccacccgaccgccauc

SEQ ID NO: 1061591 - RNA, 18 nt, Mycobacterium bovis subsp bovis AF2122/97
ucaccacccgucggcccg

SEQ ID NO: 1061592 - RNA, 14 nt, Mycobacterium bovis subsp bovis AF2122/97
ucaccacaccggca

SEQ ID NO: 1061593 - RNA, 16 nt, Mycobacterium bovis subsp bovis AF2122/97
ucaccacaucggugug

SEQ ID NO: 1061594 - RNA, 13 nt, Mycobacterium bovis subsp bovis AF2122/97
ucaccaccggcag

SEQ ID NO: 1061595 - RNA, 14 nt, Mycobacterium bovis subsp bovis AF2122/97
ucaccaccguggcc

SEQ ID NO: 1061596 - RNA, 21 nt, Mycobacterium bovis subsp bovis AF2122/97
ucacccaaccccgccggccgg

SEQ ID NO: 1061597 - RNA, 17 nt, Mycobacterium bovis subsp bovis AF2122/97
ucaccaucgccgccgcg

SEQ ID NO: 1061598 - RNA, 16 nt, Mycobacterium bovis subsp bovis AF2122/97
ucaccauggcgccgcg

SEQ ID NO: 1061599 - RNA, 19 nt, Mycobacterium bovis subsp bovis AF2122/97
ucaccaggguuggcaccgu

SEQ ID NO: 1061600 - RNA, 21 nt, Mycobacterium bovis subsp bovis AF2122/97
ucaccagcgcaucggccagca

SEQ ID NO: 1061601 - RNA, 13 nt, Mycobacterium bovis subsp bovis AF2122/97
ucaccagcgguca

SEQ ID NO: 1061602 - RNA, 21 nt, Mycobacterium bovis subsp bovis AF2122/97
ucaacggaaugaaggcaccga

SEQ ID NO: 1061603 - RNA, 21 nt, Mycobacterium bovis subsp bovis AF2122/97
ucaacggucucaacgcaucgg

SEQ ID NO: 1061604 - RNA, 21 nt, Mycobacterium bovis subsp bovis AF2122/97
ucaacgucccagcccuuggcg

SEQ ID NO: 1061605 - RNA, 13 nt, Mycobacterium bovis subsp bovis AF2122/97
ucacacccaucac

SEQ ID NO: 1061606 - RNA, 17 nt, Mycobacterium bovis subsp bovis AF2122/97
ucaacgaugguggcgau

SEQ ID NO: 1061607 - RNA, 21 nt, Mycobacterium bovis subsp bovis AF2122/97
ucaacgcacggcagacacgcu

SEQ ID NO: 1061608 - RNA, 21 nt, Mycobacterium bovis subsp bovis AF2122/97
ucaacgccucugcucagccgu

SEQ ID NO: 1061609 - RNA, 13 nt, Mycobacterium bovis subsp bovis AF2122/97
ucacaucggccuc

SEQ ID NO: 1061610 - RNA, 15 nt, Mycobacterium bovis subsp bovis AF2122/97
ucacagccaccagcc

SEQ ID NO: 1061611 - RNA, 21 nt, Mycobacterium bovis subsp bovis AF2122/97
ucacagccggguuuggugcag

SEQ ID NO: 1061612 - RNA, 17 nt, Mycobacterium bovis subsp bovis AF2122/97
ucacaugcccgcaccgu

SEQ ID NO: 1061613 - RNA, 13 nt, Mycobacterium bovis subsp bovis AF2122/97
ucacaucguuguc

SEQ ID NO: 1061614 - RNA, 16 nt, Mycobacterium bovis subsp bovis AF2122/97
ucacaugcccgcaccg

SEQ ID NO: 1061615 - RNA, 20 nt, Mycobacterium bovis subsp bovis AF2122/97
ucaccaacccguguggcacg

SEQ ID NO: 1061616 - RNA, 23 nt, Mycobacterium bovis subsp bovis AF2122/97
ucaccaaaaacccggugaccagc

SEQ ID NO: 1061617 - RNA, 15 nt, Mycobacterium bovis subsp bovis AF2122/97
ucacauucaacagau

SEQ ID NO: 1061618 - RNA, 21 nt, Mycobacterium bovis subsp bovis AF2122/97
ucaccaaaaacccggugacca

SEQ ID NO: 1061619 - RNA, 22 nt, Mycobacterium bovis subsp bovis AF2122/97
ucaccgcccuugccgccggccc

SEQ ID NO: 1061620 - RNA, 13 nt, Mycobacterium bovis subsp bovis AF2122/97
ucaccgccgcgac

SEQ ID NO: 1061621 - RNA, 14 nt, Mycobacterium bovis subsp bovis AF2122/97
ucaccgccgcgacc

SEQ ID NO: 1061622 - RNA, 17 nt, Mycobacterium bovis subsp bovis AF2122/97
ucaccgccgcggccgcc

SEQ ID NO: 1061623 - RNA, 17 nt, Mycobacterium bovis subsp bovis AF2122/97
ucaccgccgcuaccgcc

SEQ ID NO: 1061624 - RNA, 22 nt, Mycobacterium bovis subsp bovis AF2122/97
ucaccgccgcuaccgcccgcgc

SEQ ID NO: 1061625 - RNA, 19 nt, Mycobacterium bovis subsp bovis AF2122/97
ucaccgcgcgcucgcccag

SEQ ID NO: 1061626 - RNA, 14 nt, Mycobacterium bovis subsp bovis AF2122/97
ucaccgcgcagcga

SEQ ID NO: 1061627 - RNA, 18 nt, Mycobacterium bovis subsp bovis AF2122/97
ucaccgcgauuagcaaac

SEQ ID NO: 1061628 - RNA, 20 nt, Mycobacterium bovis subsp bovis AF2122/97
ucaccgcgauuagcaaaccg

SEQ ID NO: 1061629 - RNA, 13 nt, Mycobacterium bovis subsp bovis AF2122/97
ucaccgcgacccc

SEQ ID NO: 1061630 - RNA, 17 nt, Mycobacterium bovis subsp bovis AF2122/97
ucaccgccggcggcggg

SEQ ID NO: 1061631 - RNA, 21 nt, Mycobacterium bovis subsp bovis AF2122/97
ucaccgccugugccgccggcg

SEQ ID NO: 1061632 - RNA, 22 nt, Mycobacterium bovis subsp bovis AF2122/97
ucaccgccugugccgccggcgc

SEQ ID NO: 1061633 - RNA, 24 nt, Mycobacterium bovis subsp bovis AF2122/97
ucaccgccgucggguugcgacgaa

SEQ ID NO: 1061634 - RNA, 19 nt, Mycobacterium bovis subsp bovis AF2122/97
ucaccgccguugccgaucg

SEQ ID NO: 1061635 - RNA, 18 nt, Mycobacterium bovis subsp bovis AF2122/97
ucaccgccguugccgccg

SEQ ID NO: 1061636 - RNA, 12 nt, Mycobacterium bovis subsp bovis AF2122/97
ucaccgccgggg

SEQ ID NO: 1061637 - RNA, 18 nt, Mycobacterium bovis subsp bovis AF2122/97
ucaccgccggugcugacg

SEQ ID NO: 1061638 - RNA, 15 nt, Mycobacterium bovis subsp bovis AF2122/97
ucaccgccgucaccg

SEQ ID NO: 1061639 - RNA, 20 nt, Mycobacterium bovis subsp bovis AF2122/97
ucacccccgauagcgaccgc

SEQ ID NO: 1061640 - RNA, 19 nt, Mycobacterium bovis subsp bovis AF2122/97
ucacccacucgacgucguc

SEQ ID NO: 1061641 - RNA, 20 nt, Mycobacterium bovis subsp bovis AF2122/97
ucacccagcucgcgcaccca

SEQ ID NO: 1061642 - RNA, 17 nt, Mycobacterium bovis subsp bovis AF2122/97
ucacccacauggugauc

SEQ ID NO: 1061643 - RNA, 13 nt, Mycobacterium bovis subsp bovis AF2122/97
ucacccacccgca

SEQ ID NO: 1061644 - RNA, 13 nt, Mycobacterium bovis subsp bovis AF2122/97
ucaccccggccgg

SEQ ID NO: 1061645 - RNA, 22 nt, Mycobacterium bovis subsp bovis AF2122/97
ucaccccggucccgccgaccga

SEQ ID NO: 1061646 - RNA, 17 nt, Mycobacterium bovis subsp bovis AF2122/97
ucaccccggucggcccg

SEQ ID NO: 1061647 - RNA, 20 nt, Mycobacterium bovis subsp bovis AF2122/97
ucaccccggucggcccgcgc

SEQ ID NO: 1061648 - RNA, 22 nt, Mycobacterium bovis subsp bovis AF2122/97
ucacccgccgcgguuaucgccg

SEQ ID NO: 1061649 - RNA, 19 nt, Mycobacterium bovis subsp bovis AF2122/97
ucacccgcaacgacugauc

SEQ ID NO: 1061650 - RNA, 13 nt, Mycobacterium bovis subsp bovis AF2122/97
ucacccgagccau

SEQ ID NO: 1061651 - RNA, 15 nt, Mycobacterium bovis subsp bovis AF2122/97
ucacccgcagccgcg

SEQ ID NO: 1061652 - RNA, 18 nt, Mycobacterium bovis subsp bovis AF2122/97
ucaccggggccgucggca

SEQ ID NO: 1061653 - RNA, 14 nt, Mycobacterium bovis subsp bovis AF2122/97
ucaccgggcccgac

SEQ ID NO: 1061654 - RNA, 17 nt, Mycobacterium bovis subsp bovis AF2122/97
ucaccgggcccgacgac

SEQ ID NO: 1061655 - RNA, 17 nt, Mycobacterium bovis subsp bovis AF2122/97
ucaccggcaucccggaa

SEQ ID NO: 1061656 - RNA, 16 nt, Mycobacterium bovis subsp bovis AF2122/97
ucaccggcaugcccgc

SEQ ID NO: 1061657 - RNA, 18 nt, Mycobacterium bovis subsp bovis AF2122/97
ucaccggcuggugccaac

SEQ ID NO: 1061658 - RNA, 17 nt, Mycobacterium bovis subsp bovis AF2122/97
ucaccggcgcccagcgc

SEQ ID NO: 1061659 - RNA, 17 nt, Mycobacterium bovis subsp bovis AF2122/97
ucaccggucaccgcgca

SEQ ID NO: 1061660 - RNA, 15 nt, Mycobacterium bovis subsp bovis AF2122/97
ucaccggucggccau

SEQ ID NO: 1061661 - RNA, 24 nt, Mycobacterium bovis subsp bovis AF2122/97
ucaccguaauuucuucacggucga

SEQ ID NO: 1061662 - RNA, 15 nt, Mycobacterium bovis subsp bovis AF2122/97
ucaccgcgcccgccg

SEQ ID NO: 1061663 - RNA, 22 nt, Mycobacterium bovis subsp bovis AF2122/97
ucaccgucaacgccugcgagga

SEQ ID NO: 1061664 - RNA, 20 nt, Mycobacterium bovis subsp bovis AF2122/97
ucaccgucuugcacguccaa

SEQ ID NO: 1061665 - RNA, 19 nt, Mycobacterium bovis subsp bovis AF2122/97
ucaccgugaaccgcccgcc

SEQ ID NO: 1061666 - RNA, 19 nt, Mycobacterium bovis subsp bovis AF2122/97
ucaccgucugcaccggcag

SEQ ID NO: 1061667 - RNA, 17 nt, Mycobacterium bovis subsp bovis AF2122/97
ucaccgucauugccacc

SEQ ID NO: 1061668 - RNA, 22 nt, Mycobacterium bovis subsp bovis AF2122/97
ucaccguugcguuggcgccacc

SEQ ID NO: 1061669 - RNA, 20 nt, Mycobacterium bovis subsp bovis AF2122/97
ucaccgugggccugcccggc

SEQ ID NO: 1061670 - RNA, 14 nt, Mycobacterium bovis subsp bovis AF2122/97
ucaccucggcgacg

SEQ ID NO: 1061671 - RNA, 14 nt, Mycobacterium bovis subsp bovis AF2122/97
ucaccucgaugcgg

SEQ ID NO: 1061672 - RNA, 13 nt, Mycobacterium bovis subsp bovis AF2122/97
ucaccucgcacga

SEQ ID NO: 1061673 - RNA, 21 nt, Mycobacterium bovis subsp bovis AF2122/97
ucacgacguccgaucgguguc

SEQ ID NO: 1061674 - RNA, 21 nt, Mycobacterium bovis subsp bovis AF2122/97
ucacgaccggccaacgccgcc

SEQ ID NO: 1061675 - RNA, 16 nt, Mycobacterium bovis subsp bovis AF2122/97
ucacgacgccgagcag

SEQ ID NO: 1061676 - RNA, 15 nt, Mycobacterium bovis subsp bovis AF2122/97
ucacgaagaccgcgu

SEQ ID NO: 1061677 - RNA, 20 nt, Mycobacterium bovis subsp bovis AF2122/97
ucacgaagaccgcgucggcg

SEQ ID NO: 1061678 - RNA, 22 nt, Mycobacterium bovis subsp bovis AF2122/97
ucacgaagaccaggccggugac

SEQ ID NO: 1061679 - RNA, 21 nt, Mycobacterium bovis subsp bovis AF2122/97
ucaccuuuggccgcgaccggc

SEQ ID NO: 1061680 - RNA, 14 nt, Mycobacterium bovis subsp bovis AF2122/97
ucagcagcgccguc

SEQ ID NO: 1061681 - RNA, 14 nt, Mycobacterium bovis subsp bovis AF2122/97
ucagcagcggcgga

SEQ ID NO: 1061682 - RNA, 13 nt, Mycobacterium bovis subsp bovis AF2122/97
ucagcagcgucgg

SEQ ID NO: 1061683 - RNA, 20 nt, Mycobacterium bovis subsp bovis AF2122/97
ucagcagcuccacuggcguc

SEQ ID NO: 1061684 - RNA, 16 nt, Mycobacterium bovis subsp bovis AF2122/97
ucagcagagccccggc

SEQ ID NO: 1061685 - RNA, 15 nt, Mycobacterium bovis subsp bovis AF2122/97
ucagcacgacgacaa

SEQ ID NO: 1061686 - RNA, 17 nt, Mycobacterium bovis subsp bovis AF2122/97
ucagcacggugaucagc

SEQ ID NO: 1061687 - RNA, 12 nt, Mycobacterium bovis subsp bovis AF2122/97
ucagcacgucgc

SEQ ID NO: 1061688 - RNA, 13 nt, Mycobacterium bovis subsp bovis AF2122/97
ucagcaccggcgc

SEQ ID NO: 1061689 - RNA, 21 nt, Mycobacterium bovis subsp bovis AF2122/97
ucagcacggugaucagcagca

SEQ ID NO: 1061690 - RNA, 19 nt, Mycobacterium bovis subsp bovis AF2122/97
ucagcaccggaucgaccaa

SEQ ID NO: 1061691 - RNA, 22 nt, Mycobacterium bovis subsp bovis AF2122/97
ucagcaccuccaccgcgccggc

SEQ ID NO: 1061692 - RNA, 19 nt, Mycobacterium bovis subsp bovis AF2122/97
ucagccgcgaccgcagcug

SEQ ID NO: 1061693 - RNA, 18 nt, Mycobacterium bovis subsp bovis AF2122/97
ucagccgccugucgggcu

SEQ ID NO: 1061694 - RNA, 15 nt, Mycobacterium bovis subsp bovis AF2122/97
ucagccgacaagguc

SEQ ID NO: 1061695 - RNA, 14 nt, Mycobacterium bovis subsp bovis AF2122/97
ucagccgccgccug

SEQ ID NO: 1061696 - RNA, 14 nt, Mycobacterium bovis subsp bovis AF2122/97
ucagcccggcacug

SEQ ID NO: 1061697 - RNA, 12 nt, Mycobacterium bovis subsp bovis AF2122/97
ucagcccggcgc

SEQ ID NO: 1061698 - RNA, 14 nt, Mycobacterium bovis subsp bovis AF2122/97
ucagcaggaccaac

SEQ ID NO: 1061699 - RNA, 23 nt, Mycobacterium bovis subsp bovis AF2122/97
ucagcaggggaucguccggccgg

SEQ ID NO: 1061700 - RNA, 22 nt, Mycobacterium bovis subsp bovis AF2122/97
ucagcgccgacuccaguucggu

SEQ ID NO: 1061701 - RNA, 19 nt, Mycobacterium bovis subsp bovis AF2122/97
ucagcgccgcauucgcgac

SEQ ID NO: 1061702 - RNA, 15 nt, Mycobacterium bovis subsp bovis AF2122/97
ucagcgccacgucca

SEQ ID NO: 1061703 - RNA, 20 nt, Mycobacterium bovis subsp bovis AF2122/97
ucagcgcagcaacugggcgg

SEQ ID NO: 1061704 - RNA, 23 nt, Mycobacterium bovis subsp bovis AF2122/97
ucagcgcaucgccgcuggccagc

SEQ ID NO: 1061705 - RNA, 21 nt, Mycobacterium bovis subsp bovis AF2122/97
ucagcgcaucgccgcuggcca

SEQ ID NO: 1061706 - RNA, 14 nt, Mycobacterium bovis subsp bovis AF2122/97
ucagcgaguggucc

SEQ ID NO: 1061707 - RNA, 16 nt, Mycobacterium bovis subsp bovis AF2122/97
ucagcgcacuggccgc

SEQ ID NO: 1061708 - RNA, 12 nt, Mycobacterium bovis subsp bovis AF2122/97
ucagccgcggcg

SEQ ID NO: 1061709 - RNA, 22 nt, Mycobacterium bovis subsp bovis AF2122/97
ucagccgcgccggguccgcgga

SEQ ID NO: 1061710 - RNA, 14 nt, Mycobacterium bovis subsp bovis AF2122/97
ucagcggccagcag

SEQ ID NO: 1061711 - RNA, 19 nt, Mycobacterium bovis subsp bovis AF2122/97
ucagcggccgcgacguuga

SEQ ID NO: 1061712 - RNA, 12 nt, Mycobacterium bovis subsp bovis AF2122/97
ucagcggcggcc

SEQ ID NO: 1061713 - RNA, 16 nt, Mycobacterium bovis subsp bovis AF2122/97
ucagcggcgaccgcau

SEQ ID NO: 1061714 - RNA, 17 nt, Mycobacterium bovis subsp bovis AF2122/97
ucacgccguccggugug

SEQ ID NO: 1061715 - RNA, 17 nt, Mycobacterium bovis subsp bovis AF2122/97
ucacgcgaaugacgauc

SEQ ID NO: 1061716 - RNA, 13 nt, Mycobacterium bovis subsp bovis AF2122/97
ucacgcgaccacc

SEQ ID NO: 1061717 - RNA, 15 nt, Mycobacterium bovis subsp bovis AF2122/97
ucacgcgaccaccgc

SEQ ID NO: 1061718 - RNA, 16 nt, Mycobacterium bovis subsp bovis AF2122/97
ucacgcgaccaccgcc

SEQ ID NO: 1061719 - RNA, 22 nt, Mycobacterium bovis subsp bovis AF2122/97
ucacgcgcggaucggcggccgc

SEQ ID NO: 1061720 - RNA, 20 nt, Mycobacterium bovis subsp bovis AF2122/97
ucacgcgcucaccgacgcug

SEQ ID NO: 1061721 - RNA, 19 nt, Mycobacterium bovis subsp bovis AF2122/97
ucacgccgccccugcgcgg

SEQ ID NO: 1061722 - RNA, 16 nt, Mycobacterium bovis subsp bovis AF2122/97
ucacgccgccggcgaa

SEQ ID NO: 1061723 - RNA, 20 nt, Mycobacterium bovis subsp bovis AF2122/97
ucacgacguugccucgcgac

SEQ ID NO: 1061724 - RNA, 15 nt, Mycobacterium bovis subsp bovis AF2122/97
ucacgccccucacgu

SEQ ID NO: 1061725 - RNA, 12 nt, Mycobacterium bovis subsp bovis AF2122/97
ucacgucgaugu

SEQ ID NO: 1061726 - RNA, 14 nt, Mycobacterium bovis subsp bovis AF2122/97
ucacguccgcgggg

SEQ ID NO: 1061727 - RNA, 15 nt, Mycobacterium bovis subsp bovis AF2122/97
ucacucgccgaaucg

SEQ ID NO: 1061728 - RNA, 17 nt, Mycobacterium bovis subsp bovis AF2122/97
ucacucguugaccggcc

SEQ ID NO: 1061729 - RNA, 14 nt, Mycobacterium bovis subsp bovis AF2122/97
ucacguacgccgcc

SEQ ID NO: 1061730 - RNA, 21 nt, Mycobacterium bovis subsp bovis AF2122/97
ucacguagcgaccgcggucgc

SEQ ID NO: 1061731 - RNA, 15 nt, Mycobacterium bovis subsp bovis AF2122/97
ucacguagcgagccc

SEQ ID NO: 1061732 - RNA, 21 nt, Mycobacterium bovis subsp bovis AF2122/97
ucacguagcgagcccacgugg

SEQ ID NO: 1061733 - RNA, 19 nt, Mycobacterium bovis subsp bovis AF2122/97
ucacgguucgcccgucgcc

SEQ ID NO: 1061734 - RNA, 17 nt, Mycobacterium bovis subsp bovis AF2122/97
ucacgguggccgcaucg

SEQ ID NO: 1061735 - RNA, 14 nt, Mycobacterium bovis subsp bovis AF2122/97
ucacgguugccgcg

SEQ ID NO: 1061736 - RNA, 20 nt, Mycobacterium bovis subsp bovis AF2122/97
ucagcacccaacccggcggc

SEQ ID NO: 1061737 - RNA, 21 nt, Mycobacterium bovis subsp bovis AF2122/97
ucagcaagaucggcagcgugg

SEQ ID NO: 1061738 - RNA, 21 nt, Mycobacterium bovis subsp bovis AF2122/97
ucagagcgcugguuggccugc

SEQ ID NO: 1061739 - RNA, 21 nt, Mycobacterium bovis subsp bovis AF2122/97
ucagcaacgcauuguccugaa

SEQ ID NO: 1061740 - RNA, 16 nt, Mycobacterium bovis subsp bovis AF2122/97
ucagcaacucggccac

SEQ ID NO: 1061741 - RNA, 16 nt, Mycobacterium bovis subsp bovis AF2122/97
ucagacgcucgaccug

SEQ ID NO: 1061742 - RNA, 18 nt, Mycobacterium bovis subsp bovis AF2122/97
ucagacgcucgaccugcc

SEQ ID NO: 1061743 - RNA, 15 nt, Mycobacterium bovis subsp bovis AF2122/97
ucagaaugugucgac

SEQ ID NO: 1061744 - RNA, 14 nt, Mycobacterium bovis subsp bovis AF2122/97
ucacugcggcgcca

SEQ ID NO: 1061745 - RNA, 14 nt, Mycobacterium bovis subsp bovis AF2122/97
ucacugcgaccguc

SEQ ID NO: 1061746 - RNA, 22 nt, Mycobacterium bovis subsp bovis AF2122/97
ucacugcgaccgucccggccuc

SEQ ID NO: 1061747 - RNA, 17 nt, Mycobacterium bovis subsp bovis AF2122/97
ucgccgagauagggccg

SEQ ID NO: 1061748 - RNA, 19 nt, Mycobacterium bovis subsp bovis AF2122/97
ucgccgagauagggccgcg

SEQ ID NO: 1061749 - RNA, 15 nt, Mycobacterium bovis subsp bovis AF2122/97
ucgccgagaaccagc

SEQ ID NO: 1061750 - RNA, 22 nt, Mycobacterium bovis subsp bovis AF2122/97
ucgccgagaacgauguccgcgc

SEQ ID NO: 1061751 - RNA, 16 nt, Mycobacterium bovis subsp bovis AF2122/97
ucgccgagaccggcca

SEQ ID NO: 1061752 - RNA, 14 nt, Mycobacterium bovis subsp bovis AF2122/97
ucgccgagauccgc

SEQ ID NO: 1061753 - RNA, 21 nt, Mycobacterium bovis subsp bovis AF2122/97
ucgccgccauugccgccggug

SEQ ID NO: 1061754 - RNA, 16 nt, Mycobacterium bovis subsp bovis AF2122/97
ucgccgcccgcagggc

SEQ ID NO: 1061755 - RNA, 12 nt, Mycobacterium bovis subsp bovis AF2122/97
ucgccgcccggc

SEQ ID NO: 1061756 - RNA, 18 nt, Mycobacterium bovis subsp bovis AF2122/97
ucgccgccgcuaccgccg

SEQ ID NO: 1061757 - RNA, 21 nt, Mycobacterium bovis subsp bovis AF2122/97
ucgccgcggcggcagcggcga

SEQ ID NO: 1061758 - RNA, 17 nt, Mycobacterium bovis subsp bovis AF2122/97
ucgccgccgccacggca

SEQ ID NO: 1061759 - RNA, 20 nt, Mycobacterium bovis subsp bovis AF2122/97
ucgccgccgcuaccgccggg

SEQ ID NO: 1061760 - RNA, 19 nt, Mycobacterium bovis subsp bovis AF2122/97
ucgccgccgcgggcgccgg

SEQ ID NO: 1061761 - RNA, 13 nt, Mycobacterium bovis subsp bovis AF2122/97
ucgccgccgcuac

SEQ ID NO: 1061762 - RNA, 17 nt, Mycobacterium bovis subsp bovis AF2122/97
ucgccggcgaacugauc

SEQ ID NO: 1061763 - RNA, 18 nt, Mycobacterium bovis subsp bovis AF2122/97
ucgccggcgaacugaucg

SEQ ID NO: 1061764 - RNA, 23 nt, Mycobacterium bovis subsp bovis AF2122/97
ucgccggcgaacugaucguuggc

SEQ ID NO: 1061765 - RNA, 12 nt, Mycobacterium bovis subsp bovis AF2122/97
ucgccggcgacc

SEQ ID NO: 1061766 - RNA, 17 nt, Mycobacterium bovis subsp bovis AF2122/97
ucgccggcgcgcagccg

SEQ ID NO: 1061767 - RNA, 16 nt, Mycobacterium bovis subsp bovis AF2122/97
ucgccggcgcgccggg

SEQ ID NO: 1061768 - RNA, 16 nt, Mycobacterium bovis subsp bovis AF2122/97
ucgccggacugcggcc

SEQ ID NO: 1061769 - RNA, 20 nt, Mycobacterium bovis subsp bovis AF2122/97
ucgccgcgguagacgccgcc

SEQ ID NO: 1061770 - RNA, 21 nt, Mycobacterium bovis subsp bovis AF2122/97
ucgccgcucauuagcccccgc

SEQ ID NO: 1061771 - RNA, 16 nt, Mycobacterium bovis subsp bovis AF2122/97
ucgccgcuggccagca

SEQ ID NO: 1061772 - RNA, 20 nt, Mycobacterium bovis subsp bovis AF2122/97
ucgccgcuggccagcacacc

SEQ ID NO: 1061773 - RNA, 19 nt, Mycobacterium bovis subsp bovis AF2122/97
ucgccggacgggugcagcg

SEQ ID NO: 1061774 - RNA, 16 nt, Mycobacterium bovis subsp bovis AF2122/97
ucgccggaaagcccgu

SEQ ID NO: 1061775 - RNA, 18 nt, Mycobacterium bovis subsp bovis AF2122/97
ucgccggaaagcccgucg

SEQ ID NO: 1061776 - RNA, 20 nt, Mycobacterium bovis subsp bovis AF2122/97
ucgccggaaagcccgucguc

SEQ ID NO: 1061777 - RNA, 17 nt, Mycobacterium bovis subsp bovis AF2122/97
ucgccgcuuucuuggcg

SEQ ID NO: 1061778 - RNA, 14 nt, Mycobacterium bovis subsp bovis AF2122/97
ucgccggcggcccg

SEQ ID NO: 1061779 - RNA, 15 nt, Mycobacterium bovis subsp bovis AF2122/97
ucgccggcggcccgc

SEQ ID NO: 1061780 - RNA, 18 nt, Mycobacterium bovis subsp bovis AF2122/97
ucgccggcggcccgcucg

SEQ ID NO: 1061781 - RNA, 15 nt, Mycobacterium bovis subsp bovis AF2122/97
ucgccguccagcaau

SEQ ID NO: 1061782 - RNA, 22 nt, Mycobacterium bovis subsp bovis AF2122/97
ucgccgucccgauacggccggc

SEQ ID NO: 1061783 - RNA, 13 nt, Mycobacterium bovis subsp bovis AF2122/97
ucgccgucgaagc

SEQ ID NO: 1061784 - RNA, 13 nt, Mycobacterium bovis subsp bovis AF2122/97
ucgccgucggugc

SEQ ID NO: 1061785 - RNA, 15 nt, Mycobacterium bovis subsp bovis AF2122/97
ucgccgucggcgacu

SEQ ID NO: 1061786 - RNA, 17 nt, Mycobacterium bovis subsp bovis AF2122/97
ucgccgucggcggugag

SEQ ID NO: 1061787 - RNA, 15 nt, Mycobacterium bovis subsp bovis AF2122/97
ucgccgucgcgaccg

SEQ ID NO: 1061788 - RNA, 23 nt, Mycobacterium bovis subsp bovis AF2122/97
ucgccggaauacaccagcgacgc

SEQ ID NO: 1061789 - RNA, 17 nt, Mycobacterium bovis subsp bovis AF2122/97
ucgccgucgugccaccg

SEQ ID NO: 1061790 - RNA, 13 nt, Mycobacterium bovis subsp bovis AF2122/97
ucgccgucgucga

SEQ ID NO: 1061791 - RNA, 14 nt, Mycobacterium bovis subsp bovis AF2122/97
ucgccgucgucgau

SEQ ID NO: 1061792 - RNA, 17 nt, Mycobacterium bovis subsp bovis AF2122/97
ucgccgucgucgaucga

SEQ ID NO: 1061793 - RNA, 22 nt, Mycobacterium bovis subsp bovis AF2122/97
ucgccuccagcagguccgcggc

SEQ ID NO: 1061794 - RNA, 18 nt, Mycobacterium bovis subsp bovis AF2122/97
ucgccuccagccggcgaa

SEQ ID NO: 1061795 - RNA, 23 nt, Mycobacterium bovis subsp bovis AF2122/97
ucgccucggcguaggcgauggcg

SEQ ID NO: 1061796 - RNA, 14 nt, Mycobacterium bovis subsp bovis AF2122/97
ucgccucgaugcca

SEQ ID NO: 1061797 - RNA, 15 nt, Mycobacterium bovis subsp bovis AF2122/97
ucgccuccgggguga

SEQ ID NO: 1061798 - RNA, 18 nt, Mycobacterium bovis subsp bovis AF2122/97
ucgccuccucgacgucgg

SEQ ID NO: 1061799 - RNA, 17 nt, Mycobacterium bovis subsp bovis AF2122/97
ucgccucgaggaccacc

SEQ ID NO: 1061800 - RNA, 16 nt, Mycobacterium bovis subsp bovis AF2122/97
ucgccucaccacgucg

SEQ ID NO: 1061801 - RNA, 15 nt, Mycobacterium bovis subsp bovis AF2122/97
ucgccguugccggcg

SEQ ID NO: 1061802 - RNA, 18 nt, Mycobacterium bovis subsp bovis AF2122/97
ucgccguugccggcgacc

SEQ ID NO: 1061803 - RNA, 14 nt, Mycobacterium bovis subsp bovis AF2122/97
ucgcgcagccgccg

SEQ ID NO: 1061804 - RNA, 16 nt, Mycobacterium bovis subsp bovis AF2122/97
ucgcgcagccgccgcg

SEQ ID NO: 1061805 - RNA, 19 nt, Mycobacterium bovis subsp bovis AF2122/97
ucgcgcagccgccgcgccc

SEQ ID NO: 1061806 - RNA, 15 nt, Mycobacterium bovis subsp bovis AF2122/97
ucgcgccaucgucgc

SEQ ID NO: 1061807 - RNA, 21 nt, Mycobacterium bovis subsp bovis AF2122/97
ucgcgccaucgucgcgccgcg

SEQ ID NO: 1061808 - RNA, 15 nt, Mycobacterium bovis subsp bovis AF2122/97
ucgcgcccucagccg

SEQ ID NO: 1061809 - RNA, 21 nt, Mycobacterium bovis subsp bovis AF2122/97
ucgcgcccgcuaacuggcccg

SEQ ID NO: 1061810 - RNA, 19 nt, Mycobacterium bovis subsp bovis AF2122/97
ucgcgcccgcugagccagc

SEQ ID NO: 1061811 - RNA, 21 nt, Mycobacterium bovis subsp bovis AF2122/97
ucgcgccaggcuugcggcacc

SEQ ID NO: 1061812 - RNA, 15 nt, Mycobacterium bovis subsp bovis AF2122/97
ucgcgccaggccacg

SEQ ID NO: 1061813 - RNA, 16 nt, Mycobacterium bovis subsp bovis AF2122/97
ucgcgccaggccacgu

SEQ ID NO: 1061814 - RNA, 16 nt, Mycobacterium bovis subsp bovis AF2122/97
ucgcgcaaggcgccgc

SEQ ID NO: 1061815 - RNA, 12 nt, Mycobacterium bovis subsp bovis AF2122/97
ucgcgcacgucg

SEQ ID NO: 1061816 - RNA, 13 nt, Mycobacterium bovis subsp bovis AF2122/97
ucgcgcacgucgg

SEQ ID NO: 1061817 - RNA, 22 nt, Mycobacterium bovis subsp bovis AF2122/97
ucgcgcagcauggugcggcggc

SEQ ID NO: 1061818 - RNA, 23 nt, Mycobacterium bovis subsp bovis AF2122/97
ucgcgcagcauggugcggcggcg

SEQ ID NO: 1061819 - RNA, 16 nt, Mycobacterium bovis subsp bovis AF2122/97
ucgcgauagccgccgc

SEQ ID NO: 1061820 - RNA, 17 nt, Mycobacterium bovis subsp bovis AF2122/97
ucgcgauagccgccgcg

SEQ ID NO: 1061821 - RNA, 20 nt, Mycobacterium bovis subsp bovis AF2122/97
ucgcgaucgcagugagcagc

SEQ ID NO: 1061822 - RNA, 22 nt, Mycobacterium bovis subsp bovis AF2122/97
ucgcgauguccuuguuggccag

SEQ ID NO: 1061823 - RNA, 17 nt, Mycobacterium bovis subsp bovis AF2122/97
ucgcgauuccggcggcc

SEQ ID NO: 1061824 - RNA, 20 nt, Mycobacterium bovis subsp bovis AF2122/97
ucgcgauuccggcggccacg

SEQ ID NO: 1061825 - RNA, 18 nt, Mycobacterium bovis subsp bovis AF2122/97
ucgccuucccagccgacg

SEQ ID NO: 1061826 - RNA, 17 nt, Mycobacterium bovis subsp bovis AF2122/97
ucgccuuggcgcccgcg

SEQ ID NO: 1061827 - RNA, 19 nt, Mycobacterium bovis subsp bovis AF2122/97
ucgccuuggcgcccgcgaa

SEQ ID NO: 1061828 - RNA, 15 nt, Mycobacterium bovis subsp bovis AF2122/97
ucgcgaaaccggacc

SEQ ID NO: 1061829 - RNA, 22 nt, Mycobacterium bovis subsp bovis AF2122/97
ucgcgaagaacgacgccaccgc

SEQ ID NO: 1061830 - RNA, 21 nt, Mycobacterium bovis subsp bovis AF2122/97
ucgcgaagaauaaggagaacc

SEQ ID NO: 1061831 - RNA, 20 nt, Mycobacterium bovis subsp bovis AF2122/97
ucgcgaagcggaccgagccg

SEQ ID NO: 1061832 - RNA, 18 nt, Mycobacterium bovis subsp bovis AF2122/97
ucgcgaaauagcugcgga

SEQ ID NO: 1061833 - RNA, 18 nt, Mycobacterium bovis subsp bovis AF2122/97
ucgcgaacaucgccagcg

SEQ ID NO: 1061834 - RNA, 19 nt, Mycobacterium bovis subsp bovis AF2122/97
ucgcgaacaucgccagcgc

SEQ ID NO: 1061835 - RNA, 21 nt, Mycobacterium bovis subsp bovis AF2122/97
ucgcgaacaucgccagcgccg

SEQ ID NO: 1061836 - RNA, 11 nt, Mycobacterium bovis subsp bovis AF2122/97
ucgcgaacucg

SEQ ID NO: 1061837 - RNA, 14 nt, Mycobacterium bovis subsp bovis AF2122/97
ucgcgaccgcgggc

SEQ ID NO: 1061838 - RNA, 17 nt, Mycobacterium bovis subsp bovis AF2122/97
ucgcgacaucgguggcg

SEQ ID NO: 1061839 - RNA, 19 nt, Mycobacterium bovis subsp bovis AF2122/97
ucgcgacaucgguggcggc

SEQ ID NO: 1061840 - RNA, 21 nt, Mycobacterium bovis subsp bovis AF2122/97
ucgccugcccccgcgcgcacg

SEQ ID NO: 1061841 - RNA, 20 nt, Mycobacterium bovis subsp bovis AF2122/97
ucgccugcccgaaccaccac

SEQ ID NO: 1061842 - RNA, 16 nt, Mycobacterium bovis subsp bovis AF2122/97
ucgccugccgacgagg

SEQ ID NO: 1061843 - RNA, 23 nt, Mycobacterium bovis subsp bovis AF2122/97
ucgccugcgggaacgcggcggcg

SEQ ID NO: 1061844 - RNA, 14 nt, Mycobacterium bovis subsp bovis AF2122/97
ucgccuggaugccg

SEQ ID NO: 1061845 - RNA, 13 nt, Mycobacterium bovis subsp bovis AF2122/97
ucgccgacggcga

SEQ ID NO: 1061846 - RNA, 18 nt, Mycobacterium bovis subsp bovis AF2122/97
ucgccgacggcgaccacc

SEQ ID NO: 1061847 - RNA, 18 nt, Mycobacterium bovis subsp bovis AF2122/97
ucgccgaccuuggcgucg

SEQ ID NO: 1061848 - RNA, 14 nt, Mycobacterium bovis subsp bovis AF2122/97
ucgccgacgccaga

SEQ ID NO: 1061849 - RNA, 20 nt, Mycobacterium bovis subsp bovis AF2122/97
ucgcccugagaacacguucg

SEQ ID NO: 1061850 - RNA, 13 nt, Mycobacterium bovis subsp bovis AF2122/97
ucgcccugacacc

SEQ ID NO: 1061851 - RNA, 19 nt, Mycobacterium bovis subsp bovis AF2122/97
ucgcccucguaauccacgc

SEQ ID NO: 1061852 - RNA, 14 nt, Mycobacterium bovis subsp bovis AF2122/97
ucgcccgaucggcg

SEQ ID NO: 1061853 - RNA, 12 nt, Mycobacterium bovis subsp bovis AF2122/97
ucgcccgaugcg

SEQ ID NO: 1061854 - RNA, 18 nt, Mycobacterium bovis subsp bovis AF2122/97
ucgcccgagucgaaaccg

SEQ ID NO: 1061855 - RNA, 13 nt, Mycobacterium bovis subsp bovis AF2122/97
ucgcccucccggg

SEQ ID NO: 1061856 - RNA, 18 nt, Mycobacterium bovis subsp bovis AF2122/97
ucgcccgugagcagcggg

SEQ ID NO: 1061857 - RNA, 16 nt, Mycobacterium bovis subsp bovis AF2122/97
ucgcccauuggccagg

SEQ ID NO: 1061858 - RNA, 17 nt, Mycobacterium bovis subsp bovis AF2122/97
ucgcccauuucggcccg

SEQ ID NO: 1061859 - RNA, 19 nt, Mycobacterium bovis subsp bovis AF2122/97
ucgccccagugcucaucga

SEQ ID NO: 1061860 - RNA, 20 nt, Mycobacterium bovis subsp bovis AF2122/97
ucgcccccagugcacgcucg

SEQ ID NO: 1061861 - RNA, 22 nt, Mycobacterium bovis subsp bovis AF2122/97
ucgccccugcacagcaggcucg

SEQ ID NO: 1061862 - RNA, 17 nt, Mycobacterium bovis subsp bovis AF2122/97
ucgccccguucacgcuc

SEQ ID NO: 1061863 - RNA, 15 nt, Mycobacterium bovis subsp bovis AF2122/97
ucgcccagagccgcu

SEQ ID NO: 1061864 - RNA, 23 nt, Mycobacterium bovis subsp bovis AF2122/97
ucgcccagagccgcugcggcacc

SEQ ID NO: 1061865 - RNA, 18 nt, Mycobacterium bovis subsp bovis AF2122/97
ucgcccagcaaggcccga

SEQ ID NO: 1061866 - RNA, 19 nt, Mycobacterium bovis subsp bovis AF2122/97
ucgcccagcaaggcccgaa

SEQ ID NO: 1061867 - RNA, 12 nt, Mycobacterium bovis subsp bovis AF2122/97
ucgcccaccgca

SEQ ID NO: 1061868 - RNA, 22 nt, Mycobacterium bovis subsp bovis AF2122/97
ucgcccaccacgaacacguucg

SEQ ID NO: 1061869 - RNA, 14 nt, Mycobacterium bovis subsp bovis AF2122/97
ucgccaggccgucg

SEQ ID NO: 1061870 - RNA, 21 nt, Mycobacterium bovis subsp bovis AF2122/97
ucgcccaacaccgcgccgacg

SEQ ID NO: 1061871 - RNA, 13 nt, Mycobacterium bovis subsp bovis AF2122/97
ucgcccaauuucg

SEQ ID NO: 1061872 - RNA, 19 nt, Mycobacterium bovis subsp bovis AF2122/97
ucgcccaauuucgucucga

SEQ ID NO: 1061873 - RNA, 21 nt, Mycobacterium bovis subsp bovis AF2122/97
ucgccagcugacacccgcagc

SEQ ID NO: 1061874 - RNA, 14 nt, Mycobacterium bovis subsp bovis AF2122/97
ucgccagcggcgcg

SEQ ID NO: 1061875 - RNA, 19 nt, Mycobacterium bovis subsp bovis AF2122/97
ucgccagcggcgcgaccgu

SEQ ID NO: 1061876 - RNA, 22 nt, Mycobacterium bovis subsp bovis AF2122/97
ucgccaggccgagcccggugcu

SEQ ID NO: 1061877 - RNA, 16 nt, Mycobacterium bovis subsp bovis AF2122/97
ucgccaugucggccag

SEQ ID NO: 1061878 - RNA, 18 nt, Mycobacterium bovis subsp bovis AF2122/97
ucgccagcaucagcccgg

SEQ ID NO: 1061879 - RNA, 19 nt, Mycobacterium bovis subsp bovis AF2122/97
ucgccagcaucagcccggc

SEQ ID NO: 1061880 - RNA, 12 nt, Mycobacterium bovis subsp bovis AF2122/97
ucgccagcagca

SEQ ID NO: 1061881 - RNA, 17 nt, Mycobacterium bovis subsp bovis AF2122/97
ucgccagccugugcugc

SEQ ID NO: 1061882 - RNA, 14 nt, Mycobacterium bovis subsp bovis AF2122/97
ucgccagcgccgga

SEQ ID NO: 1061883 - RNA, 13 nt, Mycobacterium bovis subsp bovis AF2122/97
ucgccacggucgc

SEQ ID NO: 1061884 - RNA, 14 nt, Mycobacterium bovis subsp bovis AF2122/97
ucgccacucagccc

SEQ ID NO: 1061885 - RNA, 21 nt, Mycobacterium bovis subsp bovis AF2122/97
ucgccacucagcccgacaccg

SEQ ID NO: 1061886 - RNA, 16 nt, Mycobacterium bovis subsp bovis AF2122/97
ucgccagcaacgucgg

SEQ ID NO: 1061887 - RNA, 20 nt, Mycobacterium bovis subsp bovis AF2122/97
ucgccaccgcggcgauuacg

SEQ ID NO: 1061888 - RNA, 15 nt, Mycobacterium bovis subsp bovis AF2122/97
ucgcaggccggcggc

SEQ ID NO: 1061889 - RNA, 16 nt, Mycobacterium bovis subsp bovis AF2122/97
ucgcaggccggcggcg

SEQ ID NO: 1061890 - RNA, 20 nt, Mycobacterium bovis subsp bovis AF2122/97
ucgcaggccggcggcggugg

SEQ ID NO: 1061891 - RNA, 15 nt, Mycobacterium bovis subsp bovis AF2122/97
ucgcagggaucaccc

SEQ ID NO: 1061892 - RNA, 16 nt, Mycobacterium bovis subsp bovis AF2122/97
ucgcagugagcagccg

SEQ ID NO: 1061893 - RNA, 22 nt, Mycobacterium bovis subsp bovis AF2122/97
ucgcagugagcagccggaccgu

SEQ ID NO: 1061894 - RNA, 20 nt, Mycobacterium bovis subsp bovis AF2122/97
ucgcagugacguuccgcucg

SEQ ID NO: 1061895 - RNA, 14 nt, Mycobacterium bovis subsp bovis AF2122/97
ucgcagugagcagc

SEQ ID NO: 1061896 - RNA, 22 nt, Mycobacterium bovis subsp bovis AF2122/97
ucgcaguauucacagucgcucg

SEQ ID NO: 1061897 - RNA, 20 nt, Mycobacterium bovis subsp bovis AF2122/97
ucgcagcgguggucggcgcg

SEQ ID NO: 1061898 - RNA, 20 nt, Mycobacterium bovis subsp bovis AF2122/97
ucgcaggcaccccgaucacc

SEQ ID NO: 1061899 - RNA, 16 nt, Mycobacterium bovis subsp bovis AF2122/97
ucgcagcgacacguug

SEQ ID NO: 1061900 - RNA, 22 nt, Mycobacterium bovis subsp bovis AF2122/97
ucgcagcgcacacuaccgccgc

SEQ ID NO: 1061901 - RNA, 20 nt, Mycobacterium bovis subsp bovis AF2122/97
ucgcagccacguuacgcucg

SEQ ID NO: 1061902 - RNA, 19 nt, Mycobacterium bovis subsp bovis AF2122/97
ucgcagcagcaucuggggg

SEQ ID NO: 1061903 - RNA, 22 nt, Mycobacterium bovis subsp bovis AF2122/97
ucgaugacccauacgaacucac

SEQ ID NO: 1061904 - RNA, 19 nt, Mycobacterium bovis subsp bovis AF2122/97
ucgcagcacgggugagcac

SEQ ID NO: 1061905 - RNA, 19 nt, Mycobacterium bovis subsp bovis AF2122/97
ucgcagcaucacguccgcg

SEQ ID NO: 1061906 - RNA, 13 nt, Mycobacterium bovis subsp bovis AF2122/97
ucgcagccaacgc

SEQ ID NO: 1061907 - RNA, 21 nt, Mycobacterium bovis subsp bovis AF2122/97
ucgaugaagcgucguugcucg

SEQ ID NO: 1061908 - RNA, 20 nt, Mycobacterium bovis subsp bovis AF2122/97
ucgaucugcggaggcgggug

SEQ ID NO: 1061909 - RNA, 18 nt, Mycobacterium bovis subsp bovis AF2122/97
ucgaucugucgcgccggu

SEQ ID NO: 1061910 - RNA, 22 nt, Mycobacterium bovis subsp bovis AF2122/97
ucgaucuggucaagacccgcau

SEQ ID NO: 1061911 - RNA, 15 nt, Mycobacterium bovis subsp bovis AF2122/97
ucgaucugcgggcgg

SEQ ID NO: 1061912 - RNA, 23 nt, Mycobacterium bovis subsp bovis AF2122/97
ucgaucugcccccgccggccguc

SEQ ID NO: 1061913 - RNA, 16 nt, Mycobacterium bovis subsp bovis AF2122/97
ucgaucguuccgcugg

SEQ ID NO: 1061914 - RNA, 14 nt, Mycobacterium bovis subsp bovis AF2122/97
ucgaucucggccag

SEQ ID NO: 1061915 - RNA, 14 nt, Mycobacterium bovis subsp bovis AF2122/97
ucgaucucgaucga

SEQ ID NO: 1061916 - RNA, 21 nt, Mycobacterium bovis subsp bovis AF2122/97
ucgccacgccugcucggagag

SEQ ID NO: 1061917 - RNA, 22 nt, Mycobacterium bovis subsp bovis AF2122/97
ucgccacgacaggucgcccggu

SEQ ID NO: 1061918 - RNA, 17 nt, Mycobacterium bovis subsp bovis AF2122/97
ucgccacgacaggucgc

SEQ ID NO: 1061919 - RNA, 18 nt, Mycobacterium bovis subsp bovis AF2122/97
ucgccaccgguaccggcg

SEQ ID NO: 1061920 - RNA, 18 nt, Mycobacterium bovis subsp bovis AF2122/97
ucgccaccgccggcagca

SEQ ID NO: 1061921 - RNA, 16 nt, Mycobacterium bovis subsp bovis AF2122/97
ucgccaccaucaccgc

SEQ ID NO: 1061922 - RNA, 17 nt, Mycobacterium bovis subsp bovis AF2122/97
ucgccaccaucaccgcc

SEQ ID NO: 1061923 - RNA, 21 nt, Mycobacterium bovis subsp bovis AF2122/97
ucgccaagugcagggcugcua

SEQ ID NO: 1061924 - RNA, 16 nt, Mycobacterium bovis subsp bovis AF2122/97
ucgccaaugcccaggu

SEQ ID NO: 1061925 - RNA, 23 nt, Mycobacterium bovis subsp bovis AF2122/97
ucgccacauuucaccaccguggc

SEQ ID NO: 1061926 - RNA, 12 nt, Mycobacterium bovis subsp bovis AF2122/97
ucgcauggcggc

SEQ ID NO: 1061927 - RNA, 19 nt, Mycobacterium bovis subsp bovis AF2122/97
ucgcauguucuccacgccg

SEQ ID NO: 1061928 - RNA, 22 nt, Mycobacterium bovis subsp bovis AF2122/97
ucgcauguucuccacgccgauc

SEQ ID NO: 1061929 - RNA, 15 nt, Mycobacterium bovis subsp bovis AF2122/97
ucgcauccgcgguug

SEQ ID NO: 1061930 - RNA, 20 nt, Mycobacterium bovis subsp bovis AF2122/97
ucgcagguggugacacgacg

SEQ ID NO: 1061931 - RNA, 15 nt, Mycobacterium bovis subsp bovis AF2122/97
ucgcaucucgcagag

SEQ ID NO: 1061932 - RNA, 22 nt, Mycobacterium bovis subsp bovis AF2122/97
ucgccaaacccaugucggcgcg

SEQ ID NO: 1061933 - RNA, 19 nt, Mycobacterium bovis subsp bovis AF2122/97
ucgccaaauccgacgugga

SEQ ID NO: 1061934 - RNA, 15 nt, Mycobacterium bovis subsp bovis AF2122/97
ucgccaaauccggug

SEQ ID NO: 1061935 - RNA, 15 nt, Mycobacterium bovis subsp bovis AF2122/97
ucgccaacaccaacc

SEQ ID NO: 1061936 - RNA, 22 nt, Mycobacterium bovis subsp bovis AF2122/97
ucgccaaccuuugcguugcuga

SEQ ID NO: 1061937 - RNA, 19 nt, Mycobacterium bovis subsp bovis AF2122/97
ucggccaaccaugcugucg

SEQ ID NO: 1061938 - RNA, 12 nt, Mycobacterium bovis subsp bovis AF2122/97
ucggccaacccg

SEQ ID NO: 1061939 - RNA, 18 nt, Mycobacterium bovis subsp bovis AF2122/97
ucggccaacgacggccga

SEQ ID NO: 1061940 - RNA, 14 nt, Mycobacterium bovis subsp bovis AF2122/97
ucggccaccaaccu

SEQ ID NO: 1061941 - RNA, 20 nt, Mycobacterium bovis subsp bovis AF2122/97
ucggccaccaaccucaucgc

SEQ ID NO: 1061942 - RNA, 17 nt, Mycobacterium bovis subsp bovis AF2122/97
ucggcaugggccggcgc

SEQ ID NO: 1061943 - RNA, 23 nt, Mycobacterium bovis subsp bovis AF2122/97
ucggcauguuccuugcggccgcu

SEQ ID NO: 1061944 - RNA, 14 nt, Mycobacterium bovis subsp bovis AF2122/97
ucggcauucaccgc

SEQ ID NO: 1061945 - RNA, 16 nt, Mycobacterium bovis subsp bovis AF2122/97
ucggcauucaccgcgg

SEQ ID NO: 1061946 - RNA, 19 nt, Mycobacterium bovis subsp bovis AF2122/97
ucggccaacagguccaccg

SEQ ID NO: 1061947 - RNA, 20 nt, Mycobacterium bovis subsp bovis AF2122/97
ucggccaacagguccaccgg

SEQ ID NO: 1061948 - RNA, 13 nt, Mycobacterium bovis subsp bovis AF2122/97
ucggccacccgca

SEQ ID NO: 1061949 - RNA, 15 nt, Mycobacterium bovis subsp bovis AF2122/97
ucggccacccggaca

SEQ ID NO: 1061950 - RNA, 23 nt, Mycobacterium bovis subsp bovis AF2122/97
ucggccaagcuguuuggggucgc

SEQ ID NO: 1061951 - RNA, 19 nt, Mycobacterium bovis subsp bovis AF2122/97
ucggccaccgccugagcgg

SEQ ID NO: 1061952 - RNA, 22 nt, Mycobacterium bovis subsp bovis AF2122/97
ucggccaccagcgcccggcccg

SEQ ID NO: 1061953 - RNA, 14 nt, Mycobacterium bovis subsp bovis AF2122/97
ucggccaccagaac

SEQ ID NO: 1061954 - RNA, 22 nt, Mycobacterium bovis subsp bovis AF2122/97
ucggccaccagaaccagcgacc

SEQ ID NO: 1061955 - RNA, 15 nt, Mycobacterium bovis subsp bovis AF2122/97
ucggccaccggcguc

SEQ ID NO: 1061956 - RNA, 15 nt, Mycobacterium bovis subsp bovis AF2122/97
ucggcccuccaccgg

SEQ ID NO: 1061957 - RNA, 13 nt, Mycobacterium bovis subsp bovis AF2122/97
ucggccagugccg

SEQ ID NO: 1061958 - RNA, 17 nt, Mycobacterium bovis subsp bovis AF2122/97
ucggccaggaucaaccg

SEQ ID NO: 1061959 - RNA, 20 nt, Mycobacterium bovis subsp bovis AF2122/97
ucggccagcacgccgccggc

SEQ ID NO: 1061960 - RNA, 19 nt, Mycobacterium bovis subsp bovis AF2122/97
ucggccaggaucaaccggc

SEQ ID NO: 1061961 - RNA, 24 nt, Mycobacterium bovis subsp bovis AF2122/97
ucggccagcagcagugccaccggu

SEQ ID NO: 1061962 - RNA, 13 nt, Mycobacterium bovis subsp bovis AF2122/97
ucggccagcagcg

SEQ ID NO: 1061963 - RNA, 18 nt, Mycobacterium bovis subsp bovis AF2122/97
ucggccagcguguccgcc

SEQ ID NO: 1061964 - RNA, 16 nt, Mycobacterium bovis subsp bovis AF2122/97
ucggccagcucccggg

SEQ ID NO: 1061965 - RNA, 23 nt, Mycobacterium bovis subsp bovis AF2122/97
ucggccagcucccgggcggcggc

SEQ ID NO: 1061966 - RNA, 15 nt, Mycobacterium bovis subsp bovis AF2122/97
ucggccagcgucagc

SEQ ID NO: 1061967 - RNA, 13 nt, Mycobacterium bovis subsp bovis AF2122/97
ucggccagcagca

SEQ ID NO: 1061968 - RNA, 15 nt, Mycobacterium bovis subsp bovis AF2122/97
ucggccagcacgccg

SEQ ID NO: 1061969 - RNA, 17 nt, Mycobacterium bovis subsp bovis AF2122/97
ucggagacgucuucggg

SEQ ID NO: 1061970 - RNA, 15 nt, Mycobacterium bovis subsp bovis AF2122/97
ucggagaacacgucg

SEQ ID NO: 1061971 - RNA, 22 nt, Mycobacterium bovis subsp bovis AF2122/97
ucggcaaccaccucgugggcca

SEQ ID NO: 1061972 - RNA, 16 nt, Mycobacterium bovis subsp bovis AF2122/97
ucggcaacccgcacca

SEQ ID NO: 1061973 - RNA, 20 nt, Mycobacterium bovis subsp bovis AF2122/97
ucggcaacccgcaccagggu

SEQ ID NO: 1061974 - RNA, 17 nt, Mycobacterium bovis subsp bovis AF2122/97
ucggcaaggacguggcg

SEQ ID NO: 1061975 - RNA, 20 nt, Mycobacterium bovis subsp bovis AF2122/97
ucggcaaugacggccugcac

SEQ ID NO: 1061976 - RNA, 23 nt, Mycobacterium bovis subsp bovis AF2122/97
ucggcacaggcggccagcaucgc

SEQ ID NO: 1061977 - RNA, 22 nt, Mycobacterium bovis subsp bovis AF2122/97
ucggcacaugcgcguccagcug

SEQ ID NO: 1061978 - RNA, 15 nt, Mycobacterium bovis subsp bovis AF2122/97
ucggcaccaccgcga

SEQ ID NO: 1061979 - RNA, 18 nt, Mycobacterium bovis subsp bovis AF2122/97
ucggcaaugucuucgaua

SEQ ID NO: 1061980 - RNA, 22 nt, Mycobacterium bovis subsp bovis AF2122/97
ucggcaccgugcggggggcagc

SEQ ID NO: 1061981 - RNA, 12 nt, Mycobacterium bovis subsp bovis AF2122/97
ucggcaccgcgg

SEQ ID NO: 1061982 - RNA, 23 nt, Mycobacterium bovis subsp bovis AF2122/97
ucggcaccggugcccaccaccga

SEQ ID NO: 1061983 - RNA, 21 nt, Mycobacterium bovis subsp bovis AF2122/97
ucggcaccgguuuucgccggc

SEQ ID NO: 1061984 - RNA, 15 nt, Mycobacterium bovis subsp bovis AF2122/97
ucggcaccgucucgc

SEQ ID NO: 1061985 - RNA, 21 nt, Mycobacterium bovis subsp bovis AF2122/97
ucggcaccgucucgcaccgcg

SEQ ID NO: 1061986 - RNA, 12 nt, Mycobacterium bovis subsp bovis AF2122/97
ucggcacgaccc

SEQ ID NO: 1061987 - RNA, 18 nt, Mycobacterium bovis subsp bovis AF2122/97
ucggcacgacccgggaag

SEQ ID NO: 1061988 - RNA, 20 nt, Mycobacterium bovis subsp bovis AF2122/97
ucggcacgacccgggaagga

SEQ ID NO: 1061989 - RNA, 12 nt, Mycobacterium bovis subsp bovis AF2122/97
ucggcacccgcc

SEQ ID NO: 1061990 - RNA, 18 nt, Mycobacterium bovis subsp bovis AF2122/97
ucggcacccggcagagca

SEQ ID NO: 1061991 - RNA, 21 nt, Mycobacterium bovis subsp bovis AF2122/97
ucggcacggaccgcgucgcgg

SEQ ID NO: 1061992 - RNA, 20 nt, Mycobacterium bovis subsp bovis AF2122/97
ucggcacggucgcccgaucg

SEQ ID NO: 1061993 - RNA, 21 nt, Mycobacterium bovis subsp bovis AF2122/97
ucggcagagacguacugggcg

SEQ ID NO: 1061994 - RNA, 22 nt, Mycobacterium bovis subsp bovis AF2122/97
ucggcagagacguacugggcga

SEQ ID NO: 1061995 - RNA, 22 nt, Mycobacterium bovis subsp bovis AF2122/97
ucggcacgcgcaguuuggcggc

SEQ ID NO: 1061996 - RNA, 14 nt, Mycobacterium bovis subsp bovis AF2122/97
ucggcaugcagccc

SEQ ID NO: 1061997 - RNA, 19 nt, Mycobacterium bovis subsp bovis AF2122/97
ucggcaauacuccgcugac

SEQ ID NO: 1061998 - RNA, 15 nt, Mycobacterium bovis subsp bovis AF2122/97
ucggcaucggcggcg

SEQ ID NO: 1061999 - RNA, 21 nt, Mycobacterium bovis subsp bovis AF2122/97
ucggcaugccggucuucgcgg

SEQ ID NO: 1062000 - RNA, 14 nt, Mycobacterium bovis subsp bovis AF2122/97
ucggcgacgcgccg

SEQ ID NO: 1062001 - RNA, 15 nt, Mycobacterium bovis subsp bovis AF2122/97
ucggcgacgaugucg

SEQ ID NO: 1062002 - RNA, 20 nt, Mycobacterium bovis subsp bovis AF2122/97
ucggcgacgaugucgagcgc

SEQ ID NO: 1062003 - RNA, 14 nt, Mycobacterium bovis subsp bovis AF2122/97
ucggcgaccggccg

SEQ ID NO: 1062004 - RNA, 16 nt, Mycobacterium bovis subsp bovis AF2122/97
ucggcgaccgucgggg

SEQ ID NO: 1062005 - RNA, 19 nt, Mycobacterium bovis subsp bovis AF2122/97
ucggcgaccgccugcgcgg

SEQ ID NO: 1062006 - RNA, 21 nt, Mycobacterium bovis subsp bovis AF2122/97
ucggcgaccugccggaccgcg

SEQ ID NO: 1062007 - RNA, 19 nt, Mycobacterium bovis subsp bovis AF2122/97
ucggcgaccuggcucaucg

SEQ ID NO: 1062008 - RNA, 22 nt, Mycobacterium bovis subsp bovis AF2122/97
ucggcgaccuccgggaugucga

SEQ ID NO: 1062009 - RNA, 16 nt, Mycobacterium bovis subsp bovis AF2122/97
ucggcgaucugcguuu

SEQ ID NO: 1062010 - RNA, 16 nt, Mycobacterium bovis subsp bovis AF2122/97
ucggcgaucuccggcg

SEQ ID NO: 1062011 - RNA, 20 nt, Mycobacterium bovis subsp bovis AF2122/97
ucggcgaucgucaagccggg

SEQ ID NO: 1062012 - RNA, 14 nt, Mycobacterium bovis subsp bovis AF2122/97
ucggcgagcagacg

SEQ ID NO: 1062013 - RNA, 19 nt, Mycobacterium bovis subsp bovis AF2122/97
ucggcgagcagacgccgcg

SEQ ID NO: 1062014 - RNA, 13 nt, Mycobacterium bovis subsp bovis AF2122/97
ucggcgacgucgc

SEQ ID NO: 1062015 - RNA, 13 nt, Mycobacterium bovis subsp bovis AF2122/97
ucggcgacguaga

SEQ ID NO: 1062016 - RNA, 13 nt, Mycobacterium bovis subsp bovis AF2122/97
ucggcgacgucca

SEQ ID NO: 1062017 - RNA, 18 nt, Mycobacterium bovis subsp bovis AF2122/97
ucggcgacgcggaguccg

SEQ ID NO: 1062018 - RNA, 17 nt, Mycobacterium bovis subsp bovis AF2122/97
ucggcgacugcgucggc

SEQ ID NO: 1062019 - RNA, 19 nt, Mycobacterium bovis subsp bovis AF2122/97
ucggcgacugcgucggcgg

SEQ ID NO: 1062020 - RNA, 20 nt, Mycobacterium bovis subsp bovis AF2122/97
ucggcgagcaacacgagcgc

SEQ ID NO: 1062021 - RNA, 12 nt, Mycobacterium bovis subsp bovis AF2122/97
ucggcgaugccg

SEQ ID NO: 1062022 - RNA, 19 nt, Mycobacterium bovis subsp bovis AF2122/97
ucggcgaugcguccgccca

SEQ ID NO: 1062023 - RNA, 21 nt, Mycobacterium bovis subsp bovis AF2122/97
ucggcgaugcguccgcccagc

SEQ ID NO: 1062024 - RNA, 23 nt, Mycobacterium bovis subsp bovis AF2122/97
ucggcgaugcguccgcccagccg

SEQ ID NO: 1062025 - RNA, 23 nt, Mycobacterium bovis subsp bovis AF2122/97
ucggcgccgccguccagcgccgc

SEQ ID NO: 1062026 - RNA, 14 nt, Mycobacterium bovis subsp bovis AF2122/97
ucggcgccgcauac

SEQ ID NO: 1062027 - RNA, 13 nt, Mycobacterium bovis subsp bovis AF2122/97
ucggcgccgccca

SEQ ID NO: 1062028 - RNA, 15 nt, Mycobacterium bovis subsp bovis AF2122/97
ucggcgccgcccagc

SEQ ID NO: 1062029 - RNA, 20 nt, Mycobacterium bovis subsp bovis AF2122/97
ucggcgauuuugcgucgcgc

SEQ ID NO: 1062030 - RNA, 14 nt, Mycobacterium bovis subsp bovis AF2122/97
ucggcgcacagcga

SEQ ID NO: 1062031 - RNA, 14 nt, Mycobacterium bovis subsp bovis AF2122/97
ucggcgccggcggc

SEQ ID NO: 1062032 - RNA, 20 nt, Mycobacterium bovis subsp bovis AF2122/97
ucggcgccggcggccgcggu

SEQ ID NO: 1062033 - RNA, 11 nt, Mycobacterium bovis subsp bovis AF2122/97
ucggccgcgag

SEQ ID NO: 1062034 - RNA, 19 nt, Mycobacterium bovis subsp bovis AF2122/97
ucggccgccuucuccggcg

SEQ ID NO: 1062035 - RNA, 15 nt, Mycobacterium bovis subsp bovis AF2122/97
ucggccgccggauca

SEQ ID NO: 1062036 - RNA, 15 nt, Mycobacterium bovis subsp bovis AF2122/97
ucggccgcaccagca

SEQ ID NO: 1062037 - RNA, 17 nt, Mycobacterium bovis subsp bovis AF2122/97
ucggccgcauccccggu

SEQ ID NO: 1062038 - RNA, 20 nt, Mycobacterium bovis subsp bovis AF2122/97
ucggccgcacugggugcguc

SEQ ID NO: 1062039 - RNA, 16 nt, Mycobacterium bovis subsp bovis AF2122/97
ucggccgcagccagcg

SEQ ID NO: 1062040 - RNA, 17 nt, Mycobacterium bovis subsp bovis AF2122/97
ucggccgagucgauugc

SEQ ID NO: 1062041 - RNA, 13 nt, Mycobacterium bovis subsp bovis AF2122/97
ucggccgaugcgc

SEQ ID NO: 1062042 - RNA, 15 nt, Mycobacterium bovis subsp bovis AF2122/97
ucggccgaugcgcag

SEQ ID NO: 1062043 - RNA, 13 nt, Mycobacterium bovis subsp bovis AF2122/97
ucggccgaggcgg

SEQ ID NO: 1062044 - RNA, 16 nt, Mycobacterium bovis subsp bovis AF2122/97
ucggccauccaccgca

SEQ ID NO: 1062045 - RNA, 18 nt, Mycobacterium bovis subsp bovis AF2122/97
ucggccgcggucggccac

SEQ ID NO: 1062046 - RNA, 16 nt, Mycobacterium bovis subsp bovis AF2122/97
ucggccuguccaccga

SEQ ID NO: 1062047 - RNA, 24 nt, Mycobacterium bovis subsp bovis AF2122/97
ucggccugguacucccgcgaucgc

SEQ ID NO: 1062048 - RNA, 22 nt, Mycobacterium bovis subsp bovis AF2122/97
ucggccuugaucgugcuggcga

SEQ ID NO: 1062049 - RNA, 18 nt, Mycobacterium bovis subsp bovis AF2122/97
ucggcgaaaggccagucg

SEQ ID NO: 1062050 - RNA, 17 nt, Mycobacterium bovis subsp bovis AF2122/97
ucggcgaacaaccgccg

SEQ ID NO: 1062051 - RNA, 15 nt, Mycobacterium bovis subsp bovis AF2122/97
ucggcgaacgccgug

SEQ ID NO: 1062052 - RNA, 21 nt, Mycobacterium bovis subsp bovis AF2122/97
ucggcgaacgccguggugcgc

SEQ ID NO: 1062053 - RNA, 15 nt, Mycobacterium bovis subsp bovis AF2122/97
ucggcgaagcacacc

SEQ ID NO: 1062054 - RNA, 15 nt, Mycobacterium bovis subsp bovis AF2122/97
ucggcgaaggccgcg

SEQ ID NO: 1062055 - RNA, 23 nt, Mycobacterium bovis subsp bovis AF2122/97
ucggcgaaggccgcgcgcagggc

SEQ ID NO: 1062056 - RNA, 15 nt, Mycobacterium bovis subsp bovis AF2122/97
ucggcgacagcgcgg

SEQ ID NO: 1062057 - RNA, 16 nt, Mycobacterium bovis subsp bovis AF2122/97
ucggcgacaggagacg

SEQ ID NO: 1062058 - RNA, 19 nt, Mycobacterium bovis subsp bovis AF2122/97
ucggcgaaguugcgcgacg

SEQ ID NO: 1062059 - RNA, 20 nt, Mycobacterium bovis subsp bovis AF2122/97
ucggcgaacccuccgcagcu

SEQ ID NO: 1062060 - RNA, 17 nt, Mycobacterium bovis subsp bovis AF2122/97
ucggcgaccaccagcgc

SEQ ID NO: 1062061 - RNA, 19 nt, Mycobacterium bovis subsp bovis AF2122/97
ucggcgaccaccagcgccg

SEQ ID NO: 1062062 - RNA, 21 nt, Mycobacterium bovis subsp bovis AF2122/97
ucggcgaccaccagcgccgac

SEQ ID NO: 1062063 - RNA, 21 nt, Mycobacterium bovis subsp bovis AF2122/97
ucggcgaccagaaucucgccg

SEQ ID NO: 1062064 - RNA, 18 nt, Mycobacterium bovis subsp bovis AF2122/97
ucgcuguugaagccgccc

SEQ ID NO: 1062065 - RNA, 20 nt, Mycobacterium bovis subsp bovis AF2122/97
ucgcuguugaagccgcccga

SEQ ID NO: 1062066 - RNA, 18 nt, Mycobacterium bovis subsp bovis AF2122/97
ucgcugcucagcaacggc

SEQ ID NO: 1062067 - RNA, 14 nt, Mycobacterium bovis subsp bovis AF2122/97
ucgcugcggugggc

SEQ ID NO: 1062068 - RNA, 15 nt, Mycobacterium bovis subsp bovis AF2122/97
ucgcugcugccgcac

SEQ ID NO: 1062069 - RNA, 18 nt, Mycobacterium bovis subsp bovis AF2122/97
ucgcugcugccgcaccgg

SEQ ID NO: 1062070 - RNA, 21 nt, Mycobacterium bovis subsp bovis AF2122/97
ucgcugcggcgcuggccagca

SEQ ID NO: 1062071 - RNA, 15 nt, Mycobacterium bovis subsp bovis AF2122/97
ucgcugccgccgccg

SEQ ID NO: 1062072 - RNA, 17 nt, Mycobacterium bovis subsp bovis AF2122/97
ucgcugccgccgucgcc

SEQ ID NO: 1062073 - RNA, 22 nt, Mycobacterium bovis subsp bovis AF2122/97
ucgcuucagcgccaaugucagc

SEQ ID NO: 1062074 - RNA, 17 nt, Mycobacterium bovis subsp bovis AF2122/97
ucggaccagcugccggc

SEQ ID NO: 1062075 - RNA, 23 nt, Mycobacterium bovis subsp bovis AF2122/97
ucggacccacccuggucgaaacg

SEQ ID NO: 1062076 - RNA, 16 nt, Mycobacterium bovis subsp bovis AF2122/97
ucggaccuuccgggug

SEQ ID NO: 1062077 - RNA, 20 nt, Mycobacterium bovis subsp bovis AF2122/97
ucggacccgcaauuccggug

SEQ ID NO: 1062078 - RNA, 21 nt, Mycobacterium bovis subsp bovis AF2122/97
ucggacggcugagacagaccg

SEQ ID NO: 1062079 - RNA, 22 nt, Mycobacterium bovis subsp bovis AF2122/97
ucggacggcugguagcugcggu

SEQ ID NO: 1062080 - RNA, 21 nt, Mycobacterium bovis subsp bovis AF2122/97
ucggacgggaugcuuggucuc

SEQ ID NO: 1062081 - RNA, 21 nt, Mycobacterium bovis subsp bovis AF2122/97
ucggaccuuccgggugaaguu

SEQ ID NO: 1062082 - RNA, 18 nt, Mycobacterium bovis subsp bovis AF2122/97
ucgcgugggaugucgagc

SEQ ID NO: 1062083 - RNA, 13 nt, Mycobacterium bovis subsp bovis AF2122/97
ucgcgugcggcug

SEQ ID NO: 1062084 - RNA, 14 nt, Mycobacterium bovis subsp bovis AF2122/97
ucgcgugcaucgcc

SEQ ID NO: 1062085 - RNA, 16 nt, Mycobacterium bovis subsp bovis AF2122/97
ucgcgugcaucgccug

SEQ ID NO: 1062086 - RNA, 19 nt, Mycobacterium bovis subsp bovis AF2122/97
ucgcgucugcucgccagcg

SEQ ID NO: 1062087 - RNA, 16 nt, Mycobacterium bovis subsp bovis AF2122/97
ucgcuaauugcggccg

SEQ ID NO: 1062088 - RNA, 17 nt, Mycobacterium bovis subsp bovis AF2122/97
ucgcuacccgccacggu

SEQ ID NO: 1062089 - RNA, 15 nt, Mycobacterium bovis subsp bovis AF2122/97
ucgcuaccuucuugg

SEQ ID NO: 1062090 - RNA, 15 nt, Mycobacterium bovis subsp bovis AF2122/97
ucgcuacgcaacggg

SEQ ID NO: 1062091 - RNA, 15 nt, Mycobacterium bovis subsp bovis AF2122/97
ucgcguugagcgcag

SEQ ID NO: 1062092 - RNA, 23 nt, Mycobacterium bovis subsp bovis AF2122/97
ucgcguuagccaggucgauaccg

SEQ ID NO: 1062093 - RNA, 16 nt, Mycobacterium bovis subsp bovis AF2122/97
ucgcguuucgcagccg

SEQ ID NO: 1062094 - RNA, 16 nt, Mycobacterium bovis subsp bovis AF2122/97
ucgcucgcgccagguc

SEQ ID NO: 1062095 - RNA, 18 nt, Mycobacterium bovis subsp bovis AF2122/97
ucgcuccgaccgguggcg

SEQ ID NO: 1062096 - RNA, 20 nt, Mycobacterium bovis subsp bovis AF2122/97
ucgcuccggcccugccgccg

SEQ ID NO: 1062097 - RNA, 21 nt, Mycobacterium bovis subsp bovis AF2122/97
ucgcuccggcccugccgccgg

SEQ ID NO: 1062098 - RNA, 14 nt, Mycobacterium bovis subsp bovis AF2122/97
ucgcucaccggcgc

SEQ ID NO: 1062099 - RNA, 15 nt, Mycobacterium bovis subsp bovis AF2122/97
ucgcucaccggcgcg

SEQ ID NO: 1062100 - RNA, 18 nt, Mycobacterium bovis subsp bovis AF2122/97
ucgcucaccaccgaccuc

SEQ ID NO: 1062101 - RNA, 13 nt, Mycobacterium bovis subsp bovis AF2122/97
ucgcuauccggcg

SEQ ID NO: 1062102 - RNA, 18 nt, Mycobacterium bovis subsp bovis AF2122/97
ucgcgucggaccguuucg

SEQ ID NO: 1062103 - RNA, 13 nt, Mycobacterium bovis subsp bovis AF2122/97
ucgcgucgagcgc

SEQ ID NO: 1062104 - RNA, 14 nt, Mycobacterium bovis subsp bovis AF2122/97
ucgcgucgagcgcc

SEQ ID NO: 1062105 - RNA, 19 nt, Mycobacterium bovis subsp bovis AF2122/97
ucgcgucgagcgccggccg

SEQ ID NO: 1062106 - RNA, 15 nt, Mycobacterium bovis subsp bovis AF2122/97
ucgcgucgacccgaa

SEQ ID NO: 1062107 - RNA, 18 nt, Mycobacterium bovis subsp bovis AF2122/97
ucgcgucgacccgaacug

SEQ ID NO: 1062108 - RNA, 22 nt, Mycobacterium bovis subsp bovis AF2122/97
ucgcgucgacccgaacugggcg

SEQ ID NO: 1062109 - RNA, 16 nt, Mycobacterium bovis subsp bovis AF2122/97
ucgcgucgaccggaca

SEQ ID NO: 1062110 - RNA, 15 nt, Mycobacterium bovis subsp bovis AF2122/97
ucgcgucacccgggg

SEQ ID NO: 1062111 - RNA, 22 nt, Mycobacterium bovis subsp bovis AF2122/97
ucgcgucacccggggcucucgg

SEQ ID NO: 1062112 - RNA, 12 nt, Mycobacterium bovis subsp bovis AF2122/97
ucgcguccaccc

SEQ ID NO: 1062113 - RNA, 23 nt, Mycobacterium bovis subsp bovis AF2122/97
ucgcgguuggagguaauccggcu

SEQ ID NO: 1062114 - RNA, 16 nt, Mycobacterium bovis subsp bovis AF2122/97
ucgcguagggccagcg

SEQ ID NO: 1062115 - RNA, 17 nt, Mycobacterium bovis subsp bovis AF2122/97
ucgcgguuguccuccga

SEQ ID NO: 1062116 - RNA, 16 nt, Mycobacterium bovis subsp bovis AF2122/97
ucgcguaauuuggcuu

SEQ ID NO: 1062117 - RNA, 22 nt, Mycobacterium bovis subsp bovis AF2122/97
ucgcggugugcggcagcccgcu

SEQ ID NO: 1062118 - RNA, 22 nt, Mycobacterium bovis subsp bovis AF2122/97
ucgcgguggcggcggugccacg

SEQ ID NO: 1062119 - RNA, 23 nt, Mycobacterium bovis subsp bovis AF2122/97
ucgcgguggcggugucggcgccg

SEQ ID NO: 1062120 - RNA, 18 nt, Mycobacterium bovis subsp bovis AF2122/97
ucgcggugggccccgauc

SEQ ID NO: 1062121 - RNA, 19 nt, Mycobacterium bovis subsp bovis AF2122/97
ucgcggugggccccgaucc

SEQ ID NO: 1062122 - RNA, 12 nt, Mycobacterium bovis subsp bovis AF2122/97
ucgcggugaccu

SEQ ID NO: 1062123 - RNA, 17 nt, Mycobacterium bovis subsp bovis AF2122/97
ucgcgguccaacagcgc

SEQ ID NO: 1062124 - RNA, 20 nt, Mycobacterium bovis subsp bovis AF2122/97
ucgcgguccgagcggcaucg

SEQ ID NO: 1062125 - RNA, 19 nt, Mycobacterium bovis subsp bovis AF2122/97
ucgcggucuuugagccggu

SEQ ID NO: 1062126 - RNA, 22 nt, Mycobacterium bovis subsp bovis AF2122/97
ucgcggguguuccacaccaggc

SEQ ID NO: 1062127 - RNA, 15 nt, Mycobacterium bovis subsp bovis AF2122/97
ucgcgguagcagccg

SEQ ID NO: 1062128 - RNA, 16 nt, Mycobacterium bovis subsp bovis AF2122/97
ucgcgguagccuggcu

SEQ ID NO: 1062129 - RNA, 17 nt, Mycobacterium bovis subsp bovis AF2122/97
ucgcgguagcgccguga

SEQ ID NO: 1062130 - RNA, 18 nt, Mycobacterium bovis subsp bovis AF2122/97
ucgcgguaccaucaccgc

SEQ ID NO: 1062131 - RNA, 17 nt, Mycobacterium bovis subsp bovis AF2122/97
ucgcggucgcccgcuac

SEQ ID NO: 1062132 - RNA, 23 nt, Mycobacterium bovis subsp bovis AF2122/97
ucgcgguaguugucccgccgcgc

SEQ ID NO: 1062133 - RNA, 16 nt, Mycobacterium bovis subsp bovis AF2122/97
ucgcgguagucguugc

SEQ ID NO: 1062134 - RNA, 19 nt, Mycobacterium bovis subsp bovis AF2122/97
ucgcggucagguugcgcca

SEQ ID NO: 1062135 - RNA, 13 nt, Mycobacterium bovis subsp bovis AF2122/97
ucgcgcgcaaccg

SEQ ID NO: 1062136 - RNA, 13 nt, Mycobacterium bovis subsp bovis AF2122/97
ucgcgcgccgcga

SEQ ID NO: 1062137 - RNA, 14 nt, Mycobacterium bovis subsp bovis AF2122/97
ucgcgcgccgcgac

SEQ ID NO: 1062138 - RNA, 11 nt, Mycobacterium bovis subsp bovis AF2122/97
ucgcgcgccga

SEQ ID NO: 1062139 - RNA, 13 nt, Mycobacterium bovis subsp bovis AF2122/97
ucgcgcgccgacc

SEQ ID NO: 1062140 - RNA, 16 nt, Mycobacterium bovis subsp bovis AF2122/97
ucgcgcgccgaccgac

SEQ ID NO: 1062141 - RNA, 23 nt, Mycobacterium bovis subsp bovis AF2122/97
ucgcgcgcgaacacccgaagccg

SEQ ID NO: 1062142 - RNA, 21 nt, Mycobacterium bovis subsp bovis AF2122/97
ucgcgggucuuggcgaucucc

SEQ ID NO: 1062143 - RNA, 20 nt, Mycobacterium bovis subsp bovis AF2122/97
ucgcgcggcugugcccgauc

SEQ ID NO: 1062144 - RNA, 14 nt, Mycobacterium bovis subsp bovis AF2122/97
ucgcgcgcugggcg

SEQ ID NO: 1062145 - RNA, 13 nt, Mycobacterium bovis subsp bovis AF2122/97
ucgcgcgcucaac

SEQ ID NO: 1062146 - RNA, 12 nt, Mycobacterium bovis subsp bovis AF2122/97
ucgcgcgcucgc

SEQ ID NO: 1062147 - RNA, 17 nt, Mycobacterium bovis subsp bovis AF2122/97
ucgcgcgcugggcgcgc

SEQ ID NO: 1062148 - RNA, 16 nt, Mycobacterium bovis subsp bovis AF2122/97
aauaccgccagcgcca

SEQ ID NO: 1062149 - RNA, 18 nt, Mycobacterium bovis subsp bovis AF2122/97
ucgcgggugaucuccacc

SEQ ID NO: 1062150 - RNA, 20 nt, Mycobacterium bovis subsp bovis AF2122/97
ucgcgggugaucuccaccgg

SEQ ID NO: 1062151 - RNA, 19 nt, Mycobacterium bovis subsp bovis AF2122/97
aauacgcggggccggccgg

SEQ ID NO: 1062152 - RNA, 18 nt, Mycobacterium bovis subsp bovis AF2122/97
aauacgaggacgacgauc

SEQ ID NO: 1062153 - RNA, 20 nt, Mycobacterium bovis subsp bovis AF2122/97
ucgagcaucucgucggugaa

SEQ ID NO: 1062154 - RNA, 19 nt, Mycobacterium bovis subsp bovis AF2122/97
ucgagcccaaggggcagcg

SEQ ID NO: 1062155 - RNA, 16 nt, Mycobacterium bovis subsp bovis AF2122/97
ucgagcccucguuauc

SEQ ID NO: 1062156 - RNA, 22 nt, Mycobacterium bovis subsp bovis AF2122/97
ucgagcccucguuaucgaccgc

SEQ ID NO: 1062157 - RNA, 24 nt, Mycobacterium bovis subsp bovis AF2122/97
ucgagagaacguaggguggccggu

SEQ ID NO: 1062158 - RNA, 12 nt, Mycobacterium bovis subsp bovis AF2122/97
ucgagaaucggc

SEQ ID NO: 1062159 - RNA, 17 nt, Mycobacterium bovis subsp bovis AF2122/97
ucgagaaugcugacggu

SEQ ID NO: 1062160 - RNA, 16 nt, Mycobacterium bovis subsp bovis AF2122/97
ucgagagguucgccgu

SEQ ID NO: 1062161 - RNA, 14 nt, Mycobacterium bovis subsp bovis AF2122/97
ucgagaucucacgu

SEQ ID NO: 1062162 - RNA, 20 nt, Mycobacterium bovis subsp bovis AF2122/97
ucgagcaacugcucgacgag

SEQ ID NO: 1062163 - RNA, 20 nt, Mycobacterium bovis subsp bovis AF2122/97
ucgagauugccgaggucacu

SEQ ID NO: 1062164 - RNA, 13 nt, Mycobacterium bovis subsp bovis AF2122/97
ucgagccgaucgc

SEQ ID NO: 1062165 - RNA, 15 nt, Mycobacterium bovis subsp bovis AF2122/97
ucgagccgaccgcgg

SEQ ID NO: 1062166 - RNA, 21 nt, Mycobacterium bovis subsp bovis AF2122/97
ucgagcugauacgcaugcgag

SEQ ID NO: 1062167 - RNA, 21 nt, Mycobacterium bovis subsp bovis AF2122/97
ucgagcucggcgaacggcacc

SEQ ID NO: 1062168 - RNA, 20 nt, Mycobacterium bovis subsp bovis AF2122/97
ucgagcucggcgaugcugag

SEQ ID NO: 1062169 - RNA, 21 nt, Mycobacterium bovis subsp bovis AF2122/97
ucgagcucgaggcccgggugc

SEQ ID NO: 1062170 - RNA, 19 nt, Mycobacterium bovis subsp bovis AF2122/97
ucgaggaccugcucgggcg

SEQ ID NO: 1062171 - RNA, 16 nt, Mycobacterium bovis subsp bovis AF2122/97
ucgaggaaggugugcg

SEQ ID NO: 1062172 - RNA, 20 nt, Mycobacterium bovis subsp bovis AF2122/97
ucgaggaccaccacuagguc

SEQ ID NO: 1062173 - RNA, 18 nt, Mycobacterium bovis subsp bovis AF2122/97
ucgaggaacacgaugccc

SEQ ID NO: 1062174 - RNA, 17 nt, Mycobacterium bovis subsp bovis AF2122/97
ucgaggaacacgaugcc

SEQ ID NO: 1062175 - RNA, 19 nt, Mycobacterium bovis subsp bovis AF2122/97
ucgaucgacucacacaccg

SEQ ID NO: 1062176 - RNA, 22 nt, Mycobacterium bovis subsp bovis AF2122/97
ucgaucgcuugccccgccgagc

SEQ ID NO: 1062177 - RNA, 17 nt, Mycobacterium bovis subsp bovis AF2122/97
ucgaucggaucggcacc

SEQ ID NO: 1062178 - RNA, 18 nt, Mycobacterium bovis subsp bovis AF2122/97
ucgaucggaucggcaccc

SEQ ID NO: 1062179 - RNA, 16 nt, Mycobacterium bovis subsp bovis AF2122/97
ucgaucgcgccgucgg

SEQ ID NO: 1062180 - RNA, 14 nt, Mycobacterium bovis subsp bovis AF2122/97
ucgaucgccgcgau

SEQ ID NO: 1062181 - RNA, 20 nt, Mycobacterium bovis subsp bovis AF2122/97
ucgaucgccgcgauggcggu

SEQ ID NO: 1062182 - RNA, 21 nt, Mycobacterium bovis subsp bovis AF2122/97
ucgauccgcaacaacgccgcg

SEQ ID NO: 1062183 - RNA, 16 nt, Mycobacterium bovis subsp bovis AF2122/97
ucgauccacugccgcg

SEQ ID NO: 1062184 - RNA, 18 nt, Mycobacterium bovis subsp bovis AF2122/97
ucgaucccggucggugug

SEQ ID NO: 1062185 - RNA, 18 nt, Mycobacterium bovis subsp bovis AF2122/97
ucgaguuuggccaguucg

SEQ ID NO: 1062186 - RNA, 17 nt, Mycobacterium bovis subsp bovis AF2122/97
ucgaguuuggcgacgag

SEQ ID NO: 1062187 - RNA, 14 nt, Mycobacterium bovis subsp bovis AF2122/97
ucgaguugcgcggc

SEQ ID NO: 1062188 - RNA, 16 nt, Mycobacterium bovis subsp bovis AF2122/97
ucgaguugcucgacac

SEQ ID NO: 1062189 - RNA, 15 nt, Mycobacterium bovis subsp bovis AF2122/97
ucgaggucgagcgcc

SEQ ID NO: 1062190 - RNA, 13 nt, Mycobacterium bovis subsp bovis AF2122/97
ucgagguccucgu

SEQ ID NO: 1062191 - RNA, 18 nt, Mycobacterium bovis subsp bovis AF2122/97
ucgagguccucgucggcg

SEQ ID NO: 1062192 - RNA, 21 nt, Mycobacterium bovis subsp bovis AF2122/97
ucgagguccucgucggcgucg

SEQ ID NO: 1062193 - RNA, 14 nt, Mycobacterium bovis subsp bovis AF2122/97
ucgagguccucggu

SEQ ID NO: 1062194 - RNA, 23 nt, Mycobacterium bovis subsp bovis AF2122/97
ucgagguacagcgggcacgcuau

SEQ ID NO: 1062195 - RNA, 17 nt, Mycobacterium bovis subsp bovis AF2122/97
ucgaggucagugggcgg

SEQ ID NO: 1062196 - RNA, 23 nt, Mycobacterium bovis subsp bovis AF2122/97
ucgagguccaccacccugcacug

SEQ ID NO: 1062197 - RNA, 16 nt, Mycobacterium bovis subsp bovis AF2122/97
ucgagguccucagcga

SEQ ID NO: 1062198 - RNA, 14 nt, Mycobacterium bovis subsp bovis AF2122/97
ucgaggucggcgau

SEQ ID NO: 1062199 - RNA, 22 nt, Mycobacterium bovis subsp bovis AF2122/97
ucgaggucguuucccuggccgc

SEQ ID NO: 1062200 - RNA, 21 nt, Mycobacterium bovis subsp bovis AF2122/97
ucgaggugacuugcacgcugu

SEQ ID NO: 1062201 - RNA, 17 nt, Mycobacterium bovis subsp bovis AF2122/97
ucgaguccaccaccugg

SEQ ID NO: 1062202 - RNA, 24 nt, Mycobacterium bovis subsp bovis AF2122/97
ucgaguaguucgucgacgucggcg

SEQ ID NO: 1062203 - RNA, 21 nt, Mycobacterium bovis subsp bovis AF2122/97
ucgaguauugcaggaaaucgu

SEQ ID NO: 1062204 - RNA, 16 nt, Mycobacterium bovis subsp bovis AF2122/97
ucgaguucggccgcgg

SEQ ID NO: 1062205 - RNA, 18 nt, Mycobacterium bovis subsp bovis AF2122/97
ucgaguucgggcugcggc

SEQ ID NO: 1062206 - RNA, 18 nt, Mycobacterium bovis subsp bovis AF2122/97
ucgagugccgccaccgcc

SEQ ID NO: 1062207 - RNA, 14 nt, Mycobacterium bovis subsp bovis AF2122/97
ucgagugccgccgu

SEQ ID NO: 1062208 - RNA, 16 nt, Mycobacterium bovis subsp bovis AF2122/97
ucgagugcgacggcga

SEQ ID NO: 1062209 - RNA, 21 nt, Mycobacterium bovis subsp bovis AF2122/97
ucgaguggaucacacauuucg

SEQ ID NO: 1062210 - RNA, 15 nt, Mycobacterium bovis subsp bovis AF2122/97
ucgaguguggccgaa

SEQ ID NO: 1062211 - RNA, 17 nt, Mycobacterium bovis subsp bovis AF2122/97
ucgaccaugagccggcg

SEQ ID NO: 1062212 - RNA, 17 nt, Mycobacterium bovis subsp bovis AF2122/97
ucgaccaugccgucguc

SEQ ID NO: 1062213 - RNA, 17 nt, Mycobacterium bovis subsp bovis AF2122/97
ucgaccauauuggcgcg

SEQ ID NO: 1062214 - RNA, 21 nt, Mycobacterium bovis subsp bovis AF2122/97
ucgaccaucaccacggccgcc

SEQ ID NO: 1062215 - RNA, 20 nt, Mycobacterium bovis subsp bovis AF2122/97
ucgacccccugccacagcga

SEQ ID NO: 1062216 - RNA, 22 nt, Mycobacterium bovis subsp bovis AF2122/97
ucgacccccugccacagcgaca

SEQ ID NO: 1062217 - RNA, 14 nt, Mycobacterium bovis subsp bovis AF2122/97
ucgaccaugcgacc

SEQ ID NO: 1062218 - RNA, 15 nt, Mycobacterium bovis subsp bovis AF2122/97
ucgaccagagccgcg

SEQ ID NO: 1062219 - RNA, 14 nt, Mycobacterium bovis subsp bovis AF2122/97
ucgaccacgacgug

SEQ ID NO: 1062220 - RNA, 15 nt, Mycobacterium bovis subsp bovis AF2122/97
ucgaccacucgccgc

SEQ ID NO: 1062221 - RNA, 16 nt, Mycobacterium bovis subsp bovis AF2122/97
ucgaccacucgccgcg

SEQ ID NO: 1062222 - RNA, 17 nt, Mycobacterium bovis subsp bovis AF2122/97
ucgaccacugcccgggg

SEQ ID NO: 1062223 - RNA, 22 nt, Mycobacterium bovis subsp bovis AF2122/97
ucgacgagccgcggucggcgug

SEQ ID NO: 1062224 - RNA, 13 nt, Mycobacterium bovis subsp bovis AF2122/97
ucgacgagcgaua

SEQ ID NO: 1062225 - RNA, 14 nt, Mycobacterium bovis subsp bovis AF2122/97
ucgacgacguccuc

SEQ ID NO: 1062226 - RNA, 22 nt, Mycobacterium bovis subsp bovis AF2122/97
ucgacgagacgaaccgccgacg

SEQ ID NO: 1062227 - RNA, 23 nt, Mycobacterium bovis subsp bovis AF2122/97
ucgacgagauagcauccgcccga

SEQ ID NO: 1062228 - RNA, 20 nt, Mycobacterium bovis subsp bovis AF2122/97
ucgacgagcaccgcgccgcg

SEQ ID NO: 1062229 - RNA, 18 nt, Mycobacterium bovis subsp bovis AF2122/97
ucgacgagcacgccgacc

SEQ ID NO: 1062230 - RNA, 20 nt, Mycobacterium bovis subsp bovis AF2122/97
ucgacgagaagacaccgcgc

SEQ ID NO: 1062231 - RNA, 19 nt, Mycobacterium bovis subsp bovis AF2122/97
ucgacgaggucagcgguug

SEQ ID NO: 1062232 - RNA, 12 nt, Mycobacterium bovis subsp bovis AF2122/97
ucgacgaucagc

SEQ ID NO: 1062233 - RNA, 16 nt, Mycobacterium bovis subsp bovis AF2122/97
ucgacgcggcgaccgu

SEQ ID NO: 1062234 - RNA, 18 nt, Mycobacterium bovis subsp bovis AF2122/97
ucgacgcgggcguugacg

SEQ ID NO: 1062235 - RNA, 17 nt, Mycobacterium bovis subsp bovis AF2122/97
ucgacgcgcauucgccg

SEQ ID NO: 1062236 - RNA, 20 nt, Mycobacterium bovis subsp bovis AF2122/97
ucgacgcgcauucgccgggc

SEQ ID NO: 1062237 - RNA, 16 nt, Mycobacterium bovis subsp bovis AF2122/97
ucgacgcacacccggu

SEQ ID NO: 1062238 - RNA, 13 nt, Mycobacterium bovis subsp bovis AF2122/97
ucgacgucggcaa

SEQ ID NO: 1062239 - RNA, 15 nt, Mycobacterium bovis subsp bovis AF2122/97
ucgacgucggcgacc

SEQ ID NO: 1062240 - RNA, 15 nt, Mycobacterium bovis subsp bovis AF2122/97
ucgacgucgauuucg

SEQ ID NO: 1062241 - RNA, 18 nt, Mycobacterium bovis subsp bovis AF2122/97
ucgacgucgauuucggcg

SEQ ID NO: 1062242 - RNA, 16 nt, Mycobacterium bovis subsp bovis AF2122/97
ucgacgcgcucgggcg

SEQ ID NO: 1062243 - RNA, 20 nt, Mycobacterium bovis subsp bovis AF2122/97
ucgacguccaucccggcgcc

SEQ ID NO: 1062244 - RNA, 13 nt, Mycobacterium bovis subsp bovis AF2122/97
ucgacggccacgg

SEQ ID NO: 1062245 - RNA, 14 nt, Mycobacterium bovis subsp bovis AF2122/97
ucgacggccagccc

SEQ ID NO: 1062246 - RNA, 18 nt, Mycobacterium bovis subsp bovis AF2122/97
ucgacggccagugcgcag

SEQ ID NO: 1062247 - RNA, 14 nt, Mycobacterium bovis subsp bovis AF2122/97
ucgacggcccgccg

SEQ ID NO: 1062248 - RNA, 13 nt, Mycobacterium bovis subsp bovis AF2122/97
ucgacggugucau

SEQ ID NO: 1062249 - RNA, 18 nt, Mycobacterium bovis subsp bovis AF2122/97
ucgacggaaucgucggcg

SEQ ID NO: 1062250 - RNA, 22 nt, Mycobacterium bovis subsp bovis AF2122/97
ucgacggaaucgucggcgcggc

SEQ ID NO: 1062251 - RNA, 21 nt, Mycobacterium bovis subsp bovis AF2122/97
ucgacguaaugcgcugccgcc

SEQ ID NO: 1062252 - RNA, 16 nt, Mycobacterium bovis subsp bovis AF2122/97
ucgacucgaccgcgac

SEQ ID NO: 1062253 - RNA, 17 nt, Mycobacterium bovis subsp bovis AF2122/97
ucgacucgaccgcgacg

SEQ ID NO: 1062254 - RNA, 12 nt, Mycobacterium bovis subsp bovis AF2122/97
ucgacguuggcg

SEQ ID NO: 1062255 - RNA, 17 nt, Mycobacterium bovis subsp bovis AF2122/97
ucgacguugcggacggc

SEQ ID NO: 1062256 - RNA, 15 nt, Mycobacterium bovis subsp bovis AF2122/97
ucgacucagcccggc

SEQ ID NO: 1062257 - RNA, 20 nt, Mycobacterium bovis subsp bovis AF2122/97
ucgacgucguagaccuccag

SEQ ID NO: 1062258 - RNA, 21 nt, Mycobacterium bovis subsp bovis AF2122/97
ucgacgucgucgucgacggcc

SEQ ID NO: 1062259 - RNA, 23 nt, Mycobacterium bovis subsp bovis AF2122/97
ucgacgucgucgucgacggccug

SEQ ID NO: 1062260 - RNA, 15 nt, Mycobacterium bovis subsp bovis AF2122/97
ucgacgucguugccg

SEQ ID NO: 1062261 - RNA, 21 nt, Mycobacterium bovis subsp bovis AF2122/97
ucgacgugaucgcgguccaac

SEQ ID NO: 1062262 - RNA, 16 nt, Mycobacterium bovis subsp bovis AF2122/97
ucgacgugcacgguca

SEQ ID NO: 1062263 - RNA, 11 nt, Mycobacterium bovis subsp bovis AF2122/97
ucgacguucgg

SEQ ID NO: 1062264 - RNA, 20 nt, Mycobacterium bovis subsp bovis AF2122/97
ucgacguucgggucgagccg

SEQ ID NO: 1062265 - RNA, 21 nt, Mycobacterium bovis subsp bovis AF2122/97
ucgacguucgguggcgaugcg

SEQ ID NO: 1062266 - RNA, 14 nt, Mycobacterium bovis subsp bovis AF2122/97
ucgacugccagcgc

SEQ ID NO: 1062267 - RNA, 13 nt, Mycobacterium bovis subsp bovis AF2122/97
ucgacugcagccc

SEQ ID NO: 1062268 - RNA, 17 nt, Mycobacterium bovis subsp bovis AF2122/97
ucgacucggcggcgcgg

SEQ ID NO: 1062269 - RNA, 23 nt, Mycobacterium bovis subsp bovis AF2122/97
ucgacugacuuugggucggcgau

SEQ ID NO: 1062270 - RNA, 16 nt, Mycobacterium bovis subsp bovis AF2122/97
ucgacuggccguuucg

SEQ ID NO: 1062271 - RNA, 15 nt, Mycobacterium bovis subsp bovis AF2122/97
ucgacuucgacgaca

SEQ ID NO: 1062272 - RNA, 16 nt, Mycobacterium bovis subsp bovis AF2122/97
uccuugggcgacgcgg

SEQ ID NO: 1062273 - RNA, 22 nt, Mycobacterium bovis subsp bovis AF2122/97
uccuuggcgaacgccacggcau

SEQ ID NO: 1062274 - RNA, 18 nt, Mycobacterium bovis subsp bovis AF2122/97
uccugguguucgggcagc

SEQ ID NO: 1062275 - RNA, 17 nt, Mycobacterium bovis subsp bovis AF2122/97
uccuugacgcggccaca

SEQ ID NO: 1062276 - RNA, 20 nt, Mycobacterium bovis subsp bovis AF2122/97
uccuugagcaaugacccgcg

SEQ ID NO: 1062277 - RNA, 18 nt, Mycobacterium bovis subsp bovis AF2122/97
uccugggauccggcggca

SEQ ID NO: 1062278 - RNA, 13 nt, Mycobacterium bovis subsp bovis AF2122/97
uccugggccgccg

SEQ ID NO: 1062279 - RNA, 15 nt, Mycobacterium bovis subsp bovis AF2122/97
uccuggugagauugg

SEQ ID NO: 1062280 - RNA, 15 nt, Mycobacterium bovis subsp bovis AF2122/97
uccuggucaaccgcg

SEQ ID NO: 1062281 - RNA, 17 nt, Mycobacterium bovis subsp bovis AF2122/97
uccuggguuggcaucca

SEQ ID NO: 1062282 - RNA, 18 nt, Mycobacterium bovis subsp bovis AF2122/97
uccugguaaggccggccg

SEQ ID NO: 1062283 - RNA, 16 nt, Mycobacterium bovis subsp bovis AF2122/97
uccuggcggguggcga

SEQ ID NO: 1062284 - RNA, 21 nt, Mycobacterium bovis subsp bovis AF2122/97
uccuggcggcugcagccgacc

SEQ ID NO: 1062285 - RNA, 20 nt, Mycobacterium bovis subsp bovis AF2122/97
uccugcugugggauucgggu

SEQ ID NO: 1062286 - RNA, 22 nt, Mycobacterium bovis subsp bovis AF2122/97
uccuggauaugcuccggccgca

SEQ ID NO: 1062287 - RNA, 22 nt, Mycobacterium bovis subsp bovis AF2122/97
ucgaaccugucgaucacggccg

SEQ ID NO: 1062288 - RNA, 20 nt, Mycobacterium bovis subsp bovis AF2122/97
ucgaaccagguaaucaccug

SEQ ID NO: 1062289 - RNA, 20 nt, Mycobacterium bovis subsp bovis AF2122/97
ucgaagcgaucgccggccgc

SEQ ID NO: 1062290 - RNA, 16 nt, Mycobacterium bovis subsp bovis AF2122/97
ucgaagcuucggccuu

SEQ ID NO: 1062291 - RNA, 17 nt, Mycobacterium bovis subsp bovis AF2122/97
ucgaagcucgcgcugug

SEQ ID NO: 1062292 - RNA, 18 nt, Mycobacterium bovis subsp bovis AF2122/97
ucgaaccagaggucacgc

SEQ ID NO: 1062293 - RNA, 17 nt, Mycobacterium bovis subsp bovis AF2122/97
ucgaacaggccggccgc

SEQ ID NO: 1062294 - RNA, 18 nt, Mycobacterium bovis subsp bovis AF2122/97
ucgaacaugauccgccgg

SEQ ID NO: 1062295 - RNA, 19 nt, Mycobacterium bovis subsp bovis AF2122/97
ucgaaggcacugcgaucgc

SEQ ID NO: 1062296 - RNA, 18 nt, Mycobacterium bovis subsp bovis AF2122/97
ucgaaggcuucgcuggcu

SEQ ID NO: 1062297 - RNA, 16 nt, Mycobacterium bovis subsp bovis AF2122/97
ucgaaggugaaucgac

SEQ ID NO: 1062298 - RNA, 20 nt, Mycobacterium bovis subsp bovis AF2122/97
ucgaagggcuugucgccggc

SEQ ID NO: 1062299 - RNA, 20 nt, Mycobacterium bovis subsp bovis AF2122/97
ucgaaguccgcuugggcggu

SEQ ID NO: 1062300 - RNA, 15 nt, Mycobacterium bovis subsp bovis AF2122/97
ucgacaucguuggcc

SEQ ID NO: 1062301 - RNA, 20 nt, Mycobacterium bovis subsp bovis AF2122/97
ucgacaucguuggccgggca

SEQ ID NO: 1062302 - RNA, 19 nt, Mycobacterium bovis subsp bovis AF2122/97
ucgaccaagguguccagca

SEQ ID NO: 1062303 - RNA, 18 nt, Mycobacterium bovis subsp bovis AF2122/97
ucgaccaauucgaccgcg

SEQ ID NO: 1062304 - RNA, 14 nt, Mycobacterium bovis subsp bovis AF2122/97
uccugcagcccggg

SEQ ID NO: 1062305 - RNA, 21 nt, Mycobacterium bovis subsp bovis AF2122/97
uccugcagcuggcgaaugcgg

SEQ ID NO: 1062306 - RNA, 16 nt, Mycobacterium bovis subsp bovis AF2122/97
uccucuuggguccaca

SEQ ID NO: 1062307 - RNA, 23 nt, Mycobacterium bovis subsp bovis AF2122/97
uccucggugacuucacucguuga

SEQ ID NO: 1062308 - RNA, 21 nt, Mycobacterium bovis subsp bovis AF2122/97
uccugaaucgguucggccaga

SEQ ID NO: 1062309 - RNA, 20 nt, Mycobacterium bovis subsp bovis AF2122/97
uccugauccgccugccgacg

SEQ ID NO: 1062310 - RNA, 19 nt, Mycobacterium bovis subsp bovis AF2122/97
uccugaccagccaggugau

SEQ ID NO: 1062311 - RNA, 15 nt, Mycobacterium bovis subsp bovis AF2122/97
uccugcccuccgugg

SEQ ID NO: 1062312 - RNA, 13 nt, Mycobacterium bovis subsp bovis AF2122/97
uccugcccaccau

SEQ ID NO: 1062313 - RNA, 20 nt, Mycobacterium bovis subsp bovis AF2122/97
uccugcccaccaucccgcuc

SEQ ID NO: 1062314 - RNA, 22 nt, Mycobacterium bovis subsp bovis AF2122/97
uccugcgagaggugcugcaccu

SEQ ID NO: 1062315 - RNA, 21 nt, Mycobacterium bovis subsp bovis AF2122/97
uccgguggccaacaccgccag

SEQ ID NO: 1062316 - RNA, 20 nt, Mycobacterium bovis subsp bovis AF2122/97
uccgguggcuggccgccacc

SEQ ID NO: 1062317 - RNA, 23 nt, Mycobacterium bovis subsp bovis AF2122/97
uccgguggcuggccgccaccgca

SEQ ID NO: 1062318 - RNA, 14 nt, Mycobacterium bovis subsp bovis AF2122/97
uccggugcccgcac

SEQ ID NO: 1062319 - RNA, 21 nt, Mycobacterium bovis subsp bovis AF2122/97
uccgguggaccgccgaucggc

SEQ ID NO: 1062320 - RNA, 21 nt, Mycobacterium bovis subsp bovis AF2122/97
uccggugauccaacuggccgc

SEQ ID NO: 1062321 - RNA, 18 nt, Mycobacterium bovis subsp bovis AF2122/97
uccggugaucgcgguggc

SEQ ID NO: 1062322 - RNA, 19 nt, Mycobacterium bovis subsp bovis AF2122/97
uccggugaucgcgguggcg

SEQ ID NO: 1062323 - RNA, 12 nt, Mycobacterium bovis subsp bovis AF2122/97
uccggugccgcg

SEQ ID NO: 1062324 - RNA, 19 nt, Mycobacterium bovis subsp bovis AF2122/97
uccggugccgcgaucgcgg

SEQ ID NO: 1062325 - RNA, 12 nt, Mycobacterium bovis subsp bovis AF2122/97
uccggugccggg

SEQ ID NO: 1062326 - RNA, 21 nt, Mycobacterium bovis subsp bovis AF2122/97
uccggugccgggaugccgccg

SEQ ID NO: 1062327 - RNA, 14 nt, Mycobacterium bovis subsp bovis AF2122/97
uccggugcgcagcc

SEQ ID NO: 1062328 - RNA, 22 nt, Mycobacterium bovis subsp bovis AF2122/97
uccggugcgccgaucccgccca

SEQ ID NO: 1062329 - RNA, 15 nt, Mycobacterium bovis subsp bovis AF2122/97
uccgguggaccgccg

SEQ ID NO: 1062330 - RNA, 16 nt, Mycobacterium bovis subsp bovis AF2122/97
uccggugaacccgauu

SEQ ID NO: 1062331 - RNA, 17 nt, Mycobacterium bovis subsp bovis AF2122/97
uccggucggccaggccg

SEQ ID NO: 1062332 - RNA, 16 nt, Mycobacterium bovis subsp bovis AF2122/97
uccggucgcuccgggu

SEQ ID NO: 1062333 - RNA, 18 nt, Mycobacterium bovis subsp bovis AF2122/97
uccggucgacuccagcac

SEQ ID NO: 1062334 - RNA, 15 nt, Mycobacterium bovis subsp bovis AF2122/97
uccgguccgccagcg

SEQ ID NO: 1062335 - RNA, 14 nt, Mycobacterium bovis subsp bovis AF2122/97
uccgguaucggcga

SEQ ID NO: 1062336 - RNA, 16 nt, Mycobacterium bovis subsp bovis AF2122/97
uccgguaucggcgacc

SEQ ID NO: 1062337 - RNA, 15 nt, Mycobacterium bovis subsp bovis AF2122/97
uccggucagcgcggc

SEQ ID NO: 1062338 - RNA, 17 nt, Mycobacterium bovis subsp bovis AF2122/97
uccggucagcgcggcgc

SEQ ID NO: 1062339 - RNA, 14 nt, Mycobacterium bovis subsp bovis AF2122/97
uccgguaggcgaga

SEQ ID NO: 1062340 - RNA, 20 nt, Mycobacterium bovis subsp bovis AF2122/97
uccguaggccacagcccggc

SEQ ID NO: 1062341 - RNA, 19 nt, Mycobacterium bovis subsp bovis AF2122/97
uccggugucggugcgcggc

SEQ ID NO: 1062342 - RNA, 19 nt, Mycobacterium bovis subsp bovis AF2122/97
uccgguguggcgcugaucg

SEQ ID NO: 1062343 - RNA, 22 nt, Mycobacterium bovis subsp bovis AF2122/97
uccgguguggcgcugaucggca

SEQ ID NO: 1062344 - RNA, 20 nt, Mycobacterium bovis subsp bovis AF2122/97
uccguagccggcgguggggc

SEQ ID NO: 1062345 - RNA, 21 nt, Mycobacterium bovis subsp bovis AF2122/97
uccucgggcaggcggccagcg

SEQ ID NO: 1062346 - RNA, 16 nt, Mycobacterium bovis subsp bovis AF2122/97
uccucggggcucucga

SEQ ID NO: 1062347 - RNA, 15 nt, Mycobacterium bovis subsp bovis AF2122/97
uccucgucaccgcga

SEQ ID NO: 1062348 - RNA, 16 nt, Mycobacterium bovis subsp bovis AF2122/97
uccucgguguccucga

SEQ ID NO: 1062349 - RNA, 19 nt, Mycobacterium bovis subsp bovis AF2122/97
uccucggugugcucgccga

SEQ ID NO: 1062350 - RNA, 18 nt, Mycobacterium bovis subsp bovis AF2122/97
uccucgugcucggccaga

SEQ ID NO: 1062351 - RNA, 13 nt, Mycobacterium bovis subsp bovis AF2122/97
uccucgucgacgu

SEQ ID NO: 1062352 - RNA, 14 nt, Mycobacterium bovis subsp bovis AF2122/97
uccucgucggcgaa

SEQ ID NO: 1062353 - RNA, 13 nt, Mycobacterium bovis subsp bovis AF2122/97
ucccgucgacgag

SEQ ID NO: 1062354 - RNA, 17 nt, Mycobacterium bovis subsp bovis AF2122/97
ucccgucgacgagcgcc

SEQ ID NO: 1062355 - RNA, 22 nt, Mycobacterium bovis subsp bovis AF2122/97
ucccgugacgaacuucgaugcc

SEQ ID NO: 1062356 - RNA, 16 nt, Mycobacterium bovis subsp bovis AF2122/97
ucccgugauccgccga

SEQ ID NO: 1062357 - RNA, 17 nt, Mycobacterium bovis subsp bovis AF2122/97
ucccgugauccgccgac

SEQ ID NO: 1062358 - RNA, 15 nt, Mycobacterium bovis subsp bovis AF2122/97
ucccugaagccagcg

SEQ ID NO: 1062359 - RNA, 17 nt, Mycobacterium bovis subsp bovis AF2122/97
ucccucgaaaaccgugg

SEQ ID NO: 1062360 - RNA, 19 nt, Mycobacterium bovis subsp bovis AF2122/97
ucccuacgccgccagcauu

SEQ ID NO: 1062361 - RNA, 17 nt, Mycobacterium bovis subsp bovis AF2122/97
ucccuauaccgcugggg

SEQ ID NO: 1062362 - RNA, 13 nt, Mycobacterium bovis subsp bovis AF2122/97
ucccggaugccga

SEQ ID NO: 1062363 - RNA, 15 nt, Mycobacterium bovis subsp bovis AF2122/97
ucccggaccaucgcc

SEQ ID NO: 1062364 - RNA, 15 nt, Mycobacterium bovis subsp bovis AF2122/97
ucccggaacgccgcc

SEQ ID NO: 1062365 - RNA, 20 nt, Mycobacterium bovis subsp bovis AF2122/97
ucccggaacgccgccagcgc

SEQ ID NO: 1062366 - RNA, 15 nt, Mycobacterium bovis subsp bovis AF2122/97
ucccggacgugccgg

SEQ ID NO: 1062367 - RNA, 15 nt, Mycobacterium bovis subsp bovis AF2122/97
ucccguauucgaugc

SEQ ID NO: 1062368 - RNA, 15 nt, Mycobacterium bovis subsp bovis AF2122/97
ucccgcuuggcguga

SEQ ID NO: 1062369 - RNA, 23 nt, Mycobacterium bovis subsp bovis AF2122/97
ucccgcuugaucugggcugcggc

SEQ ID NO: 1062370 - RNA, 18 nt, Mycobacterium bovis subsp bovis AF2122/97
ucccgcucuggucgucga

SEQ ID NO: 1062371 - RNA, 23 nt, Mycobacterium bovis subsp bovis AF2122/97
ucccgcggaccgcaacgacggcc

SEQ ID NO: 1062372 - RNA, 13 nt, Mycobacterium bovis subsp bovis AF2122/97
ucccgcggcaccu

SEQ ID NO: 1062373 - RNA, 16 nt, Mycobacterium bovis subsp bovis AF2122/97
ucccgcggccgggccg

SEQ ID NO: 1062374 - RNA, 22 nt, Mycobacterium bovis subsp bovis AF2122/97
ucccgccgcccgcaucgcggca

SEQ ID NO: 1062375 - RNA, 19 nt, Mycobacterium bovis subsp bovis AF2122/97
ucccgccguugccgccguc

SEQ ID NO: 1062376 - RNA, 20 nt, Mycobacterium bovis subsp bovis AF2122/97
ucccgccggugugcccgccu

SEQ ID NO: 1062377 - RNA, 18 nt, Mycobacterium bovis subsp bovis AF2122/97
ucccgccgugccgcggcg

SEQ ID NO: 1062378 - RNA, 22 nt, Mycobacterium bovis subsp bovis AF2122/97
uccccgguagcguucggcgagc

SEQ ID NO: 1062379 - RNA, 14 nt, Mycobacterium bovis subsp bovis AF2122/97
ucccgccgaccgac

SEQ ID NO: 1062380 - RNA, 18 nt, Mycobacterium bovis subsp bovis AF2122/97
ucccgccgaccgacacca

SEQ ID NO: 1062381 - RNA, 17 nt, Mycobacterium bovis subsp bovis AF2122/97
uccccggcugccagcgc

SEQ ID NO: 1062382 - RNA, 21 nt, Mycobacterium bovis subsp bovis AF2122/97
uccccggcugccagcgccgcc

SEQ ID NO: 1062383 - RNA, 14 nt, Mycobacterium bovis subsp bovis AF2122/97
uccccgggcucggu

SEQ ID NO: 1062384 - RNA, 13 nt, Mycobacterium bovis subsp bovis AF2122/97
uccccgucgggac

SEQ ID NO: 1062385 - RNA, 15 nt, Mycobacterium bovis subsp bovis AF2122/97
uccccggcccgcuca

SEQ ID NO: 1062386 - RNA, 15 nt, Mycobacterium bovis subsp bovis AF2122/97
uccccgguagccccg

SEQ ID NO: 1062387 - RNA, 11 nt, Mycobacterium bovis subsp bovis AF2122/97
uccccgccguc

SEQ ID NO: 1062388 - RNA, 16 nt, Mycobacterium bovis subsp bovis AF2122/97
uccccgccgucgccac

SEQ ID NO: 1062389 - RNA, 18 nt, Mycobacterium bovis subsp bovis AF2122/97
uccccgcguucggcggcg

SEQ ID NO: 1062390 - RNA, 20 nt, Mycobacterium bovis subsp bovis AF2122/97
uccccgcuuggcgagccacg

SEQ ID NO: 1062391 - RNA, 18 nt, Mycobacterium bovis subsp bovis AF2122/97
uccccgccggcgccaccg

SEQ ID NO: 1062392 - RNA, 22 nt, Mycobacterium bovis subsp bovis AF2122/97
uccccgcaauucccaucggccu

SEQ ID NO: 1062393 - RNA, 23 nt, Mycobacterium bovis subsp bovis AF2122/97
uccccgcaauucccaucggccug

SEQ ID NO: 1062394 - RNA, 15 nt, Mycobacterium bovis subsp bovis AF2122/97
uccccgaccgaaccg

SEQ ID NO: 1062395 - RNA, 22 nt, Mycobacterium bovis subsp bovis AF2122/97
uccccgaccgcgcccgcgggca

SEQ ID NO: 1062396 - RNA, 20 nt, Mycobacterium bovis subsp bovis AF2122/97
uccccgacggacuccggccg

SEQ ID NO: 1062397 - RNA, 12 nt, Mycobacterium bovis subsp bovis AF2122/97
uccccgccggaa

SEQ ID NO: 1062398 - RNA, 21 nt, Mycobacterium bovis subsp bovis AF2122/97
uccccgccggaacugcgcaac

SEQ ID NO: 1062399 - RNA, 18 nt, Mycobacterium bovis subsp bovis AF2122/97
uccccgcccuugccgcca

SEQ ID NO: 1062400 - RNA, 19 nt, Mycobacterium bovis subsp bovis AF2122/97
uccccgcccuugccgccag

SEQ ID NO: 1062401 - RNA, 16 nt, Mycobacterium bovis subsp bovis AF2122/97
uccccgccgacgccga

SEQ ID NO: 1062402 - RNA, 13 nt, Mycobacterium bovis subsp bovis AF2122/97
uccccgacgucag

SEQ ID NO: 1062403 - RNA, 19 nt, Mycobacterium bovis subsp bovis AF2122/97
ucccaggacuccggccgca

SEQ ID NO: 1062404 - RNA, 18 nt, Mycobacterium bovis subsp bovis AF2122/97
ucccagcugaccagcguc

SEQ ID NO: 1062405 - RNA, 17 nt, Mycobacterium bovis subsp bovis AF2122/97
ucccagcgguagccgag

SEQ ID NO: 1062406 - RNA, 22 nt, Mycobacterium bovis subsp bovis AF2122/97
ucccagccgacgccuuccagcc

SEQ ID NO: 1062407 - RNA, 13 nt, Mycobacterium bovis subsp bovis AF2122/97
ucccacucccgcc

SEQ ID NO: 1062408 - RNA, 21 nt, Mycobacterium bovis subsp bovis AF2122/97
ucccagccuggcaaccacguc

SEQ ID NO: 1062409 - RNA, 19 nt, Mycobacterium bovis subsp bovis AF2122/97
ucccagagaaucagcgugg

SEQ ID NO: 1062410 - RNA, 14 nt, Mycobacterium bovis subsp bovis AF2122/97
ucccacucgucguc

SEQ ID NO: 1062411 - RNA, 13 nt, Mycobacterium bovis subsp bovis AF2122/97
uccaggucaugcc

SEQ ID NO: 1062412 - RNA, 19 nt, Mycobacterium bovis subsp bovis AF2122/97
ucccacuggaggucgucga

SEQ ID NO: 1062413 - RNA, 13 nt, Mycobacterium bovis subsp bovis AF2122/97
uccaggucgacau

SEQ ID NO: 1062414 - RNA, 23 nt, Mycobacterium bovis subsp bovis AF2122/97
ucccacggcgguugccccgaccg

SEQ ID NO: 1062415 - RNA, 19 nt, Mycobacterium bovis subsp bovis AF2122/97
uccaggggauugccccgca

SEQ ID NO: 1062416 - RNA, 19 nt, Mycobacterium bovis subsp bovis AF2122/97
uccaggggcuggugcuacu

SEQ ID NO: 1062417 - RNA, 21 nt, Mycobacterium bovis subsp bovis AF2122/97
uccaggguccggacgaaaucg

SEQ ID NO: 1062418 - RNA, 19 nt, Mycobacterium bovis subsp bovis AF2122/97
uccagggagcggcugcacg

SEQ ID NO: 1062419 - RNA, 16 nt, Mycobacterium bovis subsp bovis AF2122/97
uccagggccgacgcga

SEQ ID NO: 1062420 - RNA, 17 nt, Mycobacterium bovis subsp bovis AF2122/97
uccagggccgacgcgaa

SEQ ID NO: 1062421 - RNA, 16 nt, Mycobacterium bovis subsp bovis AF2122/97
ucccccgcgcgaaccg

SEQ ID NO: 1062422 - RNA, 17 nt, Mycobacterium bovis subsp bovis AF2122/97
uccccgacaacgaaacc

SEQ ID NO: 1062423 - RNA, 18 nt, Mycobacterium bovis subsp bovis AF2122/97
uccccgacaucgcugcga

SEQ ID NO: 1062424 - RNA, 13 nt, Mycobacterium bovis subsp bovis AF2122/97
ucccccagccgcg

SEQ ID NO: 1062425 - RNA, 22 nt, Mycobacterium bovis subsp bovis AF2122/97
uccccaguugugcggccaggcg

SEQ ID NO: 1062426 - RNA, 14 nt, Mycobacterium bovis subsp bovis AF2122/97
uccccagcgccacc

SEQ ID NO: 1062427 - RNA, 21 nt, Mycobacterium bovis subsp bovis AF2122/97
ucccccaaaucaacagggugg

SEQ ID NO: 1062428 - RNA, 22 nt, Mycobacterium bovis subsp bovis AF2122/97
ucccccagaugcugguguugau

SEQ ID NO: 1062429 - RNA, 17 nt, Mycobacterium bovis subsp bovis AF2122/97
ucccaugcacggccgag

SEQ ID NO: 1062430 - RNA, 17 nt, Mycobacterium bovis subsp bovis AF2122/97
ucccagucauccaacgc

SEQ ID NO: 1062431 - RNA, 13 nt, Mycobacterium bovis subsp bovis AF2122/97
ucccauacgccgg

SEQ ID NO: 1062432 - RNA, 19 nt, Mycobacterium bovis subsp bovis AF2122/97
uccccaagucgacgguggc

SEQ ID NO: 1062433 - RNA, 14 nt, Mycobacterium bovis subsp bovis AF2122/97
uccccaccgucguc

SEQ ID NO: 1062434 - RNA, 22 nt, Mycobacterium bovis subsp bovis AF2122/97
uccggcgaaaagacugcgccgc

SEQ ID NO: 1062435 - RNA, 20 nt, Mycobacterium bovis subsp bovis AF2122/97
uccggccggccagcacccga

SEQ ID NO: 1062436 - RNA, 18 nt, Mycobacterium bovis subsp bovis AF2122/97
uccggccgcacgccgacc

SEQ ID NO: 1062437 - RNA, 14 nt, Mycobacterium bovis subsp bovis AF2122/97
uccggccgucggcg

SEQ ID NO: 1062438 - RNA, 17 nt, Mycobacterium bovis subsp bovis AF2122/97
uccggccgucgggcagc

SEQ ID NO: 1062439 - RNA, 16 nt, Mycobacterium bovis subsp bovis AF2122/97
uccggcggcuucgccg

SEQ ID NO: 1062440 - RNA, 18 nt, Mycobacterium bovis subsp bovis AF2122/97
uccggcggccacgccggc

SEQ ID NO: 1062441 - RNA, 20 nt, Mycobacterium bovis subsp bovis AF2122/97
uccggcggccacgccggcgu

SEQ ID NO: 1062442 - RNA, 13 nt, Mycobacterium bovis subsp bovis AF2122/97
uccggcggccgcc

SEQ ID NO: 1062443 - RNA, 15 nt, Mycobacterium bovis subsp bovis AF2122/97
uccggcgcuccgcca

SEQ ID NO: 1062444 - RNA, 21 nt, Mycobacterium bovis subsp bovis AF2122/97
uccggcggagcgggccagcac

SEQ ID NO: 1062445 - RNA, 21 nt, Mycobacterium bovis subsp bovis AF2122/97
uccggguauggcggcgacggc

SEQ ID NO: 1062446 - RNA, 19 nt, Mycobacterium bovis subsp bovis AF2122/97
uccgggucaccagcgcauc

SEQ ID NO: 1062447 - RNA, 17 nt, Mycobacterium bovis subsp bovis AF2122/97
uccggggggauccagca

SEQ ID NO: 1062448 - RNA, 22 nt, Mycobacterium bovis subsp bovis AF2122/97
uccggggggauccagcaggccg

SEQ ID NO: 1062449 - RNA, 19 nt, Mycobacterium bovis subsp bovis AF2122/97
uccgggguaucgacccucc

SEQ ID NO: 1062450 - RNA, 21 nt, Mycobacterium bovis subsp bovis AF2122/97
uccggcguacucggugaucgc

SEQ ID NO: 1062451 - RNA, 23 nt, Mycobacterium bovis subsp bovis AF2122/97
uccggcguucccccacucggacc

SEQ ID NO: 1062452 - RNA, 14 nt, Mycobacterium bovis subsp bovis AF2122/97
uccggggcccggac

SEQ ID NO: 1062453 - RNA, 17 nt, Mycobacterium bovis subsp bovis AF2122/97
uccgggugccggugcgc

SEQ ID NO: 1062454 - RNA, 18 nt, Mycobacterium bovis subsp bovis AF2122/97
uccgggugccggugcgcu

SEQ ID NO: 1062455 - RNA, 17 nt, Mycobacterium bovis subsp bovis AF2122/97
uccggguuuugcgcggc

SEQ ID NO: 1062456 - RNA, 14 nt, Mycobacterium bovis subsp bovis AF2122/97
uccgggucgacgac

SEQ ID NO: 1062457 - RNA, 15 nt, Mycobacterium bovis subsp bovis AF2122/97
uccgggucgacgacg

SEQ ID NO: 1062458 - RNA, 17 nt, Mycobacterium bovis subsp bovis AF2122/97
uccgggucgacgacguc

SEQ ID NO: 1062459 - RNA, 17 nt, Mycobacterium bovis subsp bovis AF2122/97
uccgggugcagaucgcc

SEQ ID NO: 1062460 - RNA, 13 nt, Mycobacterium bovis subsp bovis AF2122/97
uccgggucgacga

SEQ ID NO: 1062461 - RNA, 22 nt, Mycobacterium bovis subsp bovis AF2122/97
uccggccgacacgccgaugccg

SEQ ID NO: 1062462 - RNA, 15 nt, Mycobacterium bovis subsp bovis AF2122/97
uccggcccugccgcc

SEQ ID NO: 1062463 - RNA, 16 nt, Mycobacterium bovis subsp bovis AF2122/97
uccggcccugccgccg

SEQ ID NO: 1062464 - RNA, 17 nt, Mycobacterium bovis subsp bovis AF2122/97
uccggcccugccgccgg

SEQ ID NO: 1062465 - RNA, 14 nt, Mycobacterium bovis subsp bovis AF2122/97
uccggauggccccg

SEQ ID NO: 1062466 - RNA, 20 nt, Mycobacterium bovis subsp bovis AF2122/97
uccggcaagcacaccgccag

SEQ ID NO: 1062467 - RNA, 16 nt, Mycobacterium bovis subsp bovis AF2122/97
uccggcaagucgaugg

SEQ ID NO: 1062468 - RNA, 14 nt, Mycobacterium bovis subsp bovis AF2122/97
uccggcaccggcaa

SEQ ID NO: 1062469 - RNA, 18 nt, Mycobacterium bovis subsp bovis AF2122/97
uccggcaccaacgccacc

SEQ ID NO: 1062470 - RNA, 17 nt, Mycobacterium bovis subsp bovis AF2122/97
uccgcucacccgcccgg

SEQ ID NO: 1062471 - RNA, 15 nt, Mycobacterium bovis subsp bovis AF2122/97
uccgcguggugcuga

SEQ ID NO: 1062472 - RNA, 16 nt, Mycobacterium bovis subsp bovis AF2122/97
uccgcguggugcugac

SEQ ID NO: 1062473 - RNA, 22 nt, Mycobacterium bovis subsp bovis AF2122/97
uccgcgucggucagcugugcga

SEQ ID NO: 1062474 - RNA, 18 nt, Mycobacterium bovis subsp bovis AF2122/97
uccgcgucugcucggcgg

SEQ ID NO: 1062475 - RNA, 18 nt, Mycobacterium bovis subsp bovis AF2122/97
uccgcgucuggacgcgaa

SEQ ID NO: 1062476 - RNA, 15 nt, Mycobacterium bovis subsp bovis AF2122/97
uccgcucggucgccu

SEQ ID NO: 1062477 - RNA, 16 nt, Mycobacterium bovis subsp bovis AF2122/97
uccgcucggucgccuc

SEQ ID NO: 1062478 - RNA, 14 nt, Mycobacterium bovis subsp bovis AF2122/97
uccgcugacccgcc

SEQ ID NO: 1062479 - RNA, 16 nt, Mycobacterium bovis subsp bovis AF2122/97
uccgcugaugagccgc

SEQ ID NO: 1062480 - RNA, 15 nt, Mycobacterium bovis subsp bovis AF2122/97
uccgcugaacaccgu

SEQ ID NO: 1062481 - RNA, 14 nt, Mycobacterium bovis subsp bovis AF2122/97
uccggaucgccgaa

SEQ ID NO: 1062482 - RNA, 21 nt, Mycobacterium bovis subsp bovis AF2122/97
uccgccgugaguucacguucg

SEQ ID NO: 1062483 - RNA, 15 nt, Mycobacterium bovis subsp bovis AF2122/97
uccgccgucgccgcc

SEQ ID NO: 1062484 - RNA, 16 nt, Mycobacterium bovis subsp bovis AF2122/97
uccgccgucgccgccg

SEQ ID NO: 1062485 - RNA, 19 nt, Mycobacterium bovis subsp bovis AF2122/97
uccgccgucgccgccggcg

SEQ ID NO: 1062486 - RNA, 17 nt, Mycobacterium bovis subsp bovis AF2122/97
uccgccguugccgaucc

SEQ ID NO: 1062487 - RNA, 18 nt, Mycobacterium bovis subsp bovis AF2122/97
uccgccguugccgauccc

SEQ ID NO: 1062488 - RNA, 15 nt, Mycobacterium bovis subsp bovis AF2122/97
uccgccguucucgcg

SEQ ID NO: 1062489 - RNA, 21 nt, Mycobacterium bovis subsp bovis AF2122/97
uccgccguugccgauccccag

SEQ ID NO: 1062490 - RNA, 17 nt, Mycobacterium bovis subsp bovis AF2122/97
uccgccucgggugcauu

SEQ ID NO: 1062491 - RNA, 17 nt, Mycobacterium bovis subsp bovis AF2122/97
uccgccugcaccgccgc

SEQ ID NO: 1062492 - RNA, 19 nt, Mycobacterium bovis subsp bovis AF2122/97
uccgccugcaccgccgccg

SEQ ID NO: 1062493 - RNA, 19 nt, Mycobacterium bovis subsp bovis AF2122/97
uccgcgcgcaagucgaugu

SEQ ID NO: 1062494 - RNA, 14 nt, Mycobacterium bovis subsp bovis AF2122/97
uccgcgcgccgacc

SEQ ID NO: 1062495 - RNA, 13 nt, Mycobacterium bovis subsp bovis AF2122/97
uccgcgcgccggc

SEQ ID NO: 1062496 - RNA, 21 nt, Mycobacterium bovis subsp bovis AF2122/97
uccgcgacaccuguucaccaa

SEQ ID NO: 1062497 - RNA, 15 nt, Mycobacterium bovis subsp bovis AF2122/97
uccgccuguacggcg

SEQ ID NO: 1062498 - RNA, 16 nt, Mycobacterium bovis subsp bovis AF2122/97
uccgcggacuuggcgg

SEQ ID NO: 1062499 - RNA, 12 nt, Mycobacterium bovis subsp bovis AF2122/97
uccgcgcguccg

SEQ ID NO: 1062500 - RNA, 19 nt, Mycobacterium bovis subsp bovis AF2122/97
uccgcggcacgcuccagcu

SEQ ID NO: 1062501 - RNA, 12 nt, Mycobacterium bovis subsp bovis AF2122/97
uccgcgcgguuu

SEQ ID NO: 1062502 - RNA, 22 nt, Mycobacterium bovis subsp bovis AF2122/97
uccgcgcucaaccgcaaucgga

SEQ ID NO: 1062503 - RNA, 19 nt, Mycobacterium bovis subsp bovis AF2122/97
uccgcgggggaccgcccga

SEQ ID NO: 1062504 - RNA, 21 nt, Mycobacterium bovis subsp bovis AF2122/97
uccgcgggguugauugacccg

SEQ ID NO: 1062505 - RNA, 14 nt, Mycobacterium bovis subsp bovis AF2122/97
uccgcggccgcggu

SEQ ID NO: 1062506 - RNA, 14 nt, Mycobacterium bovis subsp bovis AF2122/97
uccgcggccaccac

SEQ ID NO: 1062507 - RNA, 22 nt, Mycobacterium bovis subsp bovis AF2122/97
uccgcggcgagcuccgaugccg

SEQ ID NO: 1062508 - RNA, 16 nt, Mycobacterium bovis subsp bovis AF2122/97
uccgcggucgcagcag

SEQ ID NO: 1062509 - RNA, 20 nt, Mycobacterium bovis subsp bovis AF2122/97
uccgcgggaaguucgccggu

SEQ ID NO: 1062510 - RNA, 14 nt, Mycobacterium bovis subsp bovis AF2122/97
ucccugggcgucga

SEQ ID NO: 1062511 - RNA, 15 nt, Mycobacterium bovis subsp bovis AF2122/97
ucccugugccagcag

SEQ ID NO: 1062512 - RNA, 20 nt, Mycobacterium bovis subsp bovis AF2122/97
ucccugugucgccgucgcgg

SEQ ID NO: 1062513 - RNA, 19 nt, Mycobacterium bovis subsp bovis AF2122/97
ucccugcaguccacugauc

SEQ ID NO: 1062514 - RNA, 20 nt, Mycobacterium bovis subsp bovis AF2122/97
ucccuggcggggaucagcga

SEQ ID NO: 1062515 - RNA, 16 nt, Mycobacterium bovis subsp bovis AF2122/97
ucccuugacggugaga

SEQ ID NO: 1062516 - RNA, 19 nt, Mycobacterium bovis subsp bovis AF2122/97
uccgaacuggucgacgccg

SEQ ID NO: 1062517 - RNA, 17 nt, Mycobacterium bovis subsp bovis AF2122/97
uccgaagagccagcaac

SEQ ID NO: 1062518 - RNA, 15 nt, Mycobacterium bovis subsp bovis AF2122/97
uccgaacacggugaa

SEQ ID NO: 1062519 - RNA, 20 nt, Mycobacterium bovis subsp bovis AF2122/97
uccgaaccaccuguccggug

SEQ ID NO: 1062520 - RNA, 20 nt, Mycobacterium bovis subsp bovis AF2122/97
uccgcccucaguucacgcuc

SEQ ID NO: 1062521 - RNA, 13 nt, Mycobacterium bovis subsp bovis AF2122/97
uccgccgagcaga

SEQ ID NO: 1062522 - RNA, 19 nt, Mycobacterium bovis subsp bovis AF2122/97
uccgccgcagacgccgacu

SEQ ID NO: 1062523 - RNA, 22 nt, Mycobacterium bovis subsp bovis AF2122/97
uccgccgaggccgccguugccg

SEQ ID NO: 1062524 - RNA, 19 nt, Mycobacterium bovis subsp bovis AF2122/97
uccgccgauagcaccggaa

SEQ ID NO: 1062525 - RNA, 14 nt, Mycobacterium bovis subsp bovis AF2122/97
uccgccccgcccgc

SEQ ID NO: 1062526 - RNA, 21 nt, Mycobacterium bovis subsp bovis AF2122/97
uccgacaagcugucggcgacc

SEQ ID NO: 1062527 - RNA, 18 nt, Mycobacterium bovis subsp bovis AF2122/97
uccgcccucaguucacgc

SEQ ID NO: 1062528 - RNA, 12 nt, Mycobacterium bovis subsp bovis AF2122/97
uccgcccggugc

SEQ ID NO: 1062529 - RNA, 16 nt, Mycobacterium bovis subsp bovis AF2122/97
uccgaaguacuggccg

SEQ ID NO: 1062530 - RNA, 15 nt, Mycobacterium bovis subsp bovis AF2122/97
uccgaacgcgauccg

SEQ ID NO: 1062531 - RNA, 22 nt, Mycobacterium bovis subsp bovis AF2122/97
ucggcgccgucggagccggcca

SEQ ID NO: 1062532 - RNA, 20 nt, Mycobacterium bovis subsp bovis AF2122/97
ucggcgccgucucgaucgcg

SEQ ID NO: 1062533 - RNA, 19 nt, Mycobacterium bovis subsp bovis AF2122/97
ucggcgccuaaagacucga

SEQ ID NO: 1062534 - RNA, 14 nt, Mycobacterium bovis subsp bovis AF2122/97
ucggcgccuggcgg

SEQ ID NO: 1062535 - RNA, 15 nt, Mycobacterium bovis subsp bovis AF2122/97
ucggcgcgacagccg

SEQ ID NO: 1062536 - RNA, 14 nt, Mycobacterium bovis subsp bovis AF2122/97
ucggcgcgcagcga

SEQ ID NO: 1062537 - RNA, 13 nt, Mycobacterium bovis subsp bovis AF2122/97
ucggcgcgccggu

SEQ ID NO: 1062538 - RNA, 23 nt, Mycobacterium bovis subsp bovis AF2122/97
ucggcgcgcggguugucggcgac

SEQ ID NO: 1062539 - RNA, 17 nt, Mycobacterium bovis subsp bovis AF2122/97
ucggcgcgccggucgcc

SEQ ID NO: 1062540 - RNA, 19 nt, Mycobacterium bovis subsp bovis AF2122/97
ucggcgcgccggucgccga

SEQ ID NO: 1062541 - RNA, 20 nt, Mycobacterium bovis subsp bovis AF2122/97
ucggcgcgccggucgccgac

SEQ ID NO: 1062542 - RNA, 14 nt, Mycobacterium bovis subsp bovis AF2122/97
ucgggaccgggaac

SEQ ID NO: 1062543 - RNA, 20 nt, Mycobacterium bovis subsp bovis AF2122/97
ucgggaccggcuugccgccg

SEQ ID NO: 1062544 - RNA, 17 nt, Mycobacterium bovis subsp bovis AF2122/97
ucgggaaguacggcagg

SEQ ID NO: 1062545 - RNA, 16 nt, Mycobacterium bovis subsp bovis AF2122/97
ucgggaagucgggccg

SEQ ID NO: 1062546 - RNA, 18 nt, Mycobacterium bovis subsp bovis AF2122/97
ucgggaagucgggccggu

SEQ ID NO: 1062547 - RNA, 14 nt, Mycobacterium bovis subsp bovis AF2122/97
ucgggaagccgccg

SEQ ID NO: 1062548 - RNA, 16 nt, Mycobacterium bovis subsp bovis AF2122/97
ucgggaagcgagcagc

SEQ ID NO: 1062549 - RNA, 19 nt, Mycobacterium bovis subsp bovis AF2122/97
ucgggaacgcucgucgaca

SEQ ID NO: 1062550 - RNA, 23 nt, Mycobacterium bovis subsp bovis AF2122/97
ucgggaaccagaugaaccccgaa

SEQ ID NO: 1062551 - RNA, 23 nt, Mycobacterium bovis subsp bovis AF2122/97
ucggcgcggccguagugcacguc

SEQ ID NO: 1062552 - RNA, 23 nt, Mycobacterium bovis subsp bovis AF2122/97
ucggcuugggaaacccggccagc

SEQ ID NO: 1062553 - RNA, 19 nt, Mycobacterium bovis subsp bovis AF2122/97
ucggcuugccugcgccgag

SEQ ID NO: 1062554 - RNA, 17 nt, Mycobacterium bovis subsp bovis AF2122/97
ucgggccagucgaaucg

SEQ ID NO: 1062555 - RNA, 21 nt, Mycobacterium bovis subsp bovis AF2122/97
ucgggccacagcaacgugugc

SEQ ID NO: 1062556 - RNA, 13 nt, Mycobacterium bovis subsp bovis AF2122/97
ucgggcccagccg

SEQ ID NO: 1062557 - RNA, 13 nt, Mycobacterium bovis subsp bovis AF2122/97
ucgggcccaccgc

SEQ ID NO: 1062558 - RNA, 23 nt, Mycobacterium bovis subsp bovis AF2122/97
ucgggauggacggcagccagcca

SEQ ID NO: 1062559 - RNA, 16 nt, Mycobacterium bovis subsp bovis AF2122/97
ucgggcaccuggucgg

SEQ ID NO: 1062560 - RNA, 17 nt, Mycobacterium bovis subsp bovis AF2122/97
ucgggcaccuggucggc

SEQ ID NO: 1062561 - RNA, 19 nt, Mycobacterium bovis subsp bovis AF2122/97
ucgggcaccuggucggccg

SEQ ID NO: 1062562 - RNA, 17 nt, Mycobacterium bovis subsp bovis AF2122/97
ucgggcacgggugacga

SEQ ID NO: 1062563 - RNA, 17 nt, Mycobacterium bovis subsp bovis AF2122/97
ucgggcagcacccgcgc

SEQ ID NO: 1062564 - RNA, 19 nt, Mycobacterium bovis subsp bovis AF2122/97
ucgggcagcacgccagccc

SEQ ID NO: 1062565 - RNA, 20 nt, Mycobacterium bovis subsp bovis AF2122/97
ucgggcagcacgccagcccc

SEQ ID NO: 1062566 - RNA, 18 nt, Mycobacterium bovis subsp bovis AF2122/97
ucgggcaggcggccagcg

SEQ ID NO: 1062567 - RNA, 16 nt, Mycobacterium bovis subsp bovis AF2122/97
ucgggcagggaccgca

SEQ ID NO: 1062568 - RNA, 22 nt, Mycobacterium bovis subsp bovis AF2122/97
ucgggcaccgguuugacgucca

SEQ ID NO: 1062569 - RNA, 17 nt, Mycobacterium bovis subsp bovis AF2122/97
ucgggcacaccgacgcc

SEQ ID NO: 1062570 - RNA, 17 nt, Mycobacterium bovis subsp bovis AF2122/97
ucgggcaaggcggcggc

SEQ ID NO: 1062571 - RNA, 17 nt, Mycobacterium bovis subsp bovis AF2122/97
ucgggcaaccugccggg

SEQ ID NO: 1062572 - RNA, 18 nt, Mycobacterium bovis subsp bovis AF2122/97
ucgggcaacuucagcaac

SEQ ID NO: 1062573 - RNA, 16 nt, Mycobacterium bovis subsp bovis AF2122/97
ucgggcaaggccaccg

SEQ ID NO: 1062574 - RNA, 19 nt, Mycobacterium bovis subsp bovis AF2122/97
ucgggcaaggccaccggcg

SEQ ID NO: 1062575 - RNA, 20 nt, Mycobacterium bovis subsp bovis AF2122/97
ucgggcaaggccaccggcgg

SEQ ID NO: 1062576 - RNA, 22 nt, Mycobacterium bovis subsp bovis AF2122/97
ucgggcaaccggagaucccggu

SEQ ID NO: 1062577 - RNA, 14 nt, Mycobacterium bovis subsp bovis AF2122/97
ucgggaugcucgau

SEQ ID NO: 1062578 - RNA, 22 nt, Mycobacterium bovis subsp bovis AF2122/97
ucgggauggacggcagccagcc

SEQ ID NO: 1062579 - RNA, 22 nt, Mycobacterium bovis subsp bovis AF2122/97
ucgggacgccuugaucggcgag

SEQ ID NO: 1062580 - RNA, 20 nt, Mycobacterium bovis subsp bovis AF2122/97
ucgggacggccaacagggcg

SEQ ID NO: 1062581 - RNA, 19 nt, Mycobacterium bovis subsp bovis AF2122/97
ucgggacucccgcgcgggc

SEQ ID NO: 1062582 - RNA, 15 nt, Mycobacterium bovis subsp bovis AF2122/97
ucgggacugcgcggc

SEQ ID NO: 1062583 - RNA, 12 nt, Mycobacterium bovis subsp bovis AF2122/97
ucgggaggcagc

SEQ ID NO: 1062584 - RNA, 14 nt, Mycobacterium bovis subsp bovis AF2122/97
ucgggaggcagcgc

SEQ ID NO: 1062585 - RNA, 18 nt, Mycobacterium bovis subsp bovis AF2122/97
ucgggaucugcgccgcgc

SEQ ID NO: 1062586 - RNA, 19 nt, Mycobacterium bovis subsp bovis AF2122/97
ucgggaugcccgcugauca

SEQ ID NO: 1062587 - RNA, 17 nt, Mycobacterium bovis subsp bovis AF2122/97
ucgggaucgcugccagc

SEQ ID NO: 1062588 - RNA, 12 nt, Mycobacterium bovis subsp bovis AF2122/97
ucgggaugcgcg

SEQ ID NO: 1062589 - RNA, 17 nt, Mycobacterium bovis subsp bovis AF2122/97
ucgggaguccgguagcu

SEQ ID NO: 1062590 - RNA, 19 nt, Mycobacterium bovis subsp bovis AF2122/97
ucgggauagcccagauaga

SEQ ID NO: 1062591 - RNA, 20 nt, Mycobacterium bovis subsp bovis AF2122/97
ucggggcuacaacugccgag

SEQ ID NO: 1062592 - RNA, 18 nt, Mycobacterium bovis subsp bovis AF2122/97
ucgggggcugcacgcucg

SEQ ID NO: 1062593 - RNA, 20 nt, Mycobacterium bovis subsp bovis AF2122/97
ucgggggcuuuuacgucugc

SEQ ID NO: 1062594 - RNA, 19 nt, Mycobacterium bovis subsp bovis AF2122/97
ucgggggcuuuugcgucug

SEQ ID NO: 1062595 - RNA, 20 nt, Mycobacterium bovis subsp bovis AF2122/97
ucgggggcuuuugcgucugc

SEQ ID NO: 1062596 - RNA, 20 nt, Mycobacterium bovis subsp bovis AF2122/97
ucggggggcaggucgagcgc

SEQ ID NO: 1062597 - RNA, 15 nt, Mycobacterium bovis subsp bovis AF2122/97
ucgggggccgagccg

SEQ ID NO: 1062598 - RNA, 16 nt, Mycobacterium bovis subsp bovis AF2122/97
ucgggggccgcgucuc

SEQ ID NO: 1062599 - RNA, 13 nt, Mycobacterium bovis subsp bovis AF2122/97
ucgggggcgcgcg

SEQ ID NO: 1062600 - RNA, 20 nt, Mycobacterium bovis subsp bovis AF2122/97
ucggggcgcgguaccggugu

SEQ ID NO: 1062601 - RNA, 23 nt, Mycobacterium bovis subsp bovis AF2122/97
ucggggcgcgguaccggugucag

SEQ ID NO: 1062602 - RNA, 13 nt, Mycobacterium bovis subsp bovis AF2122/97
ucggggcgacgau

SEQ ID NO: 1062603 - RNA, 12 nt, Mycobacterium bovis subsp bovis AF2122/97
ucggggccgucg

SEQ ID NO: 1062604 - RNA, 18 nt, Mycobacterium bovis subsp bovis AF2122/97
ucgggcugccgcaugcgc

SEQ ID NO: 1062605 - RNA, 18 nt, Mycobacterium bovis subsp bovis AF2122/97
ucgggcucguccagcaac

SEQ ID NO: 1062606 - RNA, 20 nt, Mycobacterium bovis subsp bovis AF2122/97
ucgggcucguccagcaaccu

SEQ ID NO: 1062607 - RNA, 17 nt, Mycobacterium bovis subsp bovis AF2122/97
ucgggcuggucggucaa

SEQ ID NO: 1062608 - RNA, 22 nt, Mycobacterium bovis subsp bovis AF2122/97
ucgggcuugcgcagcagcgugc

SEQ ID NO: 1062609 - RNA, 17 nt, Mycobacterium bovis subsp bovis AF2122/97
ucggggacggcgaaucg

SEQ ID NO: 1062610 - RNA, 17 nt, Mycobacterium bovis subsp bovis AF2122/97
ucggggagcugcggcgg

SEQ ID NO: 1062611 - RNA, 14 nt, Mycobacterium bovis subsp bovis AF2122/97
ucggggaacgcggc

SEQ ID NO: 1062612 - RNA, 22 nt, Mycobacterium bovis subsp bovis AF2122/97
ucggggaagccugcgggccggc

SEQ ID NO: 1062613 - RNA, 19 nt, Mycobacterium bovis subsp bovis AF2122/97
ucgggcccgaugucgucga

SEQ ID NO: 1062614 - RNA, 23 nt, Mycobacterium bovis subsp bovis AF2122/97
ucgggccggagccggugccgacg

SEQ ID NO: 1062615 - RNA, 13 nt, Mycobacterium bovis subsp bovis AF2122/97
ucgggccggccgc

SEQ ID NO: 1062616 - RNA, 19 nt, Mycobacterium bovis subsp bovis AF2122/97
ucgggccgucgggugugcg

SEQ ID NO: 1062617 - RNA, 16 nt, Mycobacterium bovis subsp bovis AF2122/97
ucgggcgcggggcggc

SEQ ID NO: 1062618 - RNA, 23 nt, Mycobacterium bovis subsp bovis AF2122/97
ucgggcgcgggugaccaggcggc

SEQ ID NO: 1062619 - RNA, 20 nt, Mycobacterium bovis subsp bovis AF2122/97
ucgggcgagcucgucgagcg

SEQ ID NO: 1062620 - RNA, 21 nt, Mycobacterium bovis subsp bovis AF2122/97
ucgggcgucaugaugucgaca

SEQ ID NO: 1062621 - RNA, 11 nt, Mycobacterium bovis subsp bovis AF2122/97
ucgggcggcgu

SEQ ID NO: 1062622 - RNA, 16 nt, Mycobacterium bovis subsp bovis AF2122/97
ucgggcggcgucgcgg

SEQ ID NO: 1062623 - RNA, 21 nt, Mycobacterium bovis subsp bovis AF2122/97
ucgggcgaagcuagcgcccgc

SEQ ID NO: 1062624 - RNA, 20 nt, Mycobacterium bovis subsp bovis AF2122/97
ucgggcgcaacgggacguca

SEQ ID NO: 1062625 - RNA, 23 nt, Mycobacterium bovis subsp bovis AF2122/97
ucgggcucgcauucggcgagccg

SEQ ID NO: 1062626 - RNA, 19 nt, Mycobacterium bovis subsp bovis AF2122/97
ucgggcgugcucgccgggu

SEQ ID NO: 1062627 - RNA, 22 nt, Mycobacterium bovis subsp bovis AF2122/97
ucggggucgaacaugauccgcc

SEQ ID NO: 1062628 - RNA, 14 nt, Mycobacterium bovis subsp bovis AF2122/97
ucgggguuacguug

SEQ ID NO: 1062629 - RNA, 18 nt, Mycobacterium bovis subsp bovis AF2122/97
ucgggguggucgcaccgc

SEQ ID NO: 1062630 - RNA, 20 nt, Mycobacterium bovis subsp bovis AF2122/97
ucgggguggucgcaccgccg

SEQ ID NO: 1062631 - RNA, 22 nt, Mycobacterium bovis subsp bovis AF2122/97
ucgggguugacuggccgcccgg

SEQ ID NO: 1062632 - RNA, 22 nt, Mycobacterium bovis subsp bovis AF2122/97
ucgggguuuaguuuaucggccg

SEQ ID NO: 1062633 - RNA, 21 nt, Mycobacterium bovis subsp bovis AF2122/97
ucggguaaccccaccuggagu

SEQ ID NO: 1062634 - RNA, 15 nt, Mycobacterium bovis subsp bovis AF2122/97
ucggggccugcgucc

SEQ ID NO: 1062635 - RNA, 19 nt, Mycobacterium bovis subsp bovis AF2122/97
ucgggucaaugcuggcagc

SEQ ID NO: 1062636 - RNA, 19 nt, Mycobacterium bovis subsp bovis AF2122/97
ucgggucaucuugccaccg

SEQ ID NO: 1062637 - RNA, 14 nt, Mycobacterium bovis subsp bovis AF2122/97
ucggguagccccgu

SEQ ID NO: 1062638 - RNA, 15 nt, Mycobacterium bovis subsp bovis AF2122/97
ucggguagccgggaa

SEQ ID NO: 1062639 - RNA, 13 nt, Mycobacterium bovis subsp bovis AF2122/97
ucggguagaucgc

SEQ ID NO: 1062640 - RNA, 22 nt, Mycobacterium bovis subsp bovis AF2122/97
ucggguagggcaucgucgccga

SEQ ID NO: 1062641 - RNA, 23 nt, Mycobacterium bovis subsp bovis AF2122/97
ucgggucccagccuggcaaccac

SEQ ID NO: 1062642 - RNA, 14 nt, Mycobacterium bovis subsp bovis AF2122/97
ucgggucgaucacc

SEQ ID NO: 1062643 - RNA, 17 nt, Mycobacterium bovis subsp bovis AF2122/97
ucgggucgaucaccgac

SEQ ID NO: 1062644 - RNA, 22 nt, Mycobacterium bovis subsp bovis AF2122/97
ucggucagcgggcacgccgccg

SEQ ID NO: 1062645 - RNA, 22 nt, Mycobacterium bovis subsp bovis AF2122/97
ucggucagcgucaggugcgcga

SEQ ID NO: 1062646 - RNA, 24 nt, Mycobacterium bovis subsp bovis AF2122/97
ucggucagcgucaggugcgcgacc

SEQ ID NO: 1062647 - RNA, 14 nt, Mycobacterium bovis subsp bovis AF2122/97
ucggucagccagcc

SEQ ID NO: 1062648 - RNA, 15 nt, Mycobacterium bovis subsp bovis AF2122/97
ucggucagccagccc

SEQ ID NO: 1062649 - RNA, 21 nt, Mycobacterium bovis subsp bovis AF2122/97
ucgggugcagcacggcgccgc

SEQ ID NO: 1062650 - RNA, 13 nt, Mycobacterium bovis subsp bovis AF2122/97
ucgggugcugaug

SEQ ID NO: 1062651 - RNA, 16 nt, Mycobacterium bovis subsp bovis AF2122/97
ucgggugugcaggccg

SEQ ID NO: 1062652 - RNA, 14 nt, Mycobacterium bovis subsp bovis AF2122/97
ucggguggccagcg

SEQ ID NO: 1062653 - RNA, 15 nt, Mycobacterium bovis subsp bovis AF2122/97
ucggguggcggguca

SEQ ID NO: 1062654 - RNA, 14 nt, Mycobacterium bovis subsp bovis AF2122/97
ucgguagucgaugc

SEQ ID NO: 1062655 - RNA, 23 nt, Mycobacterium bovis subsp bovis AF2122/97
ucgguagugucguaggcgaugag

SEQ ID NO: 1062656 - RNA, 19 nt, Mycobacterium bovis subsp bovis AF2122/97
ucgguaucgagggcagccg

SEQ ID NO: 1062657 - RNA, 20 nt, Mycobacterium bovis subsp bovis AF2122/97
ucgguaucgagggcagccgc

SEQ ID NO: 1062658 - RNA, 13 nt, Mycobacterium bovis subsp bovis AF2122/97
ucgguaucggcag

SEQ ID NO: 1062659 - RNA, 13 nt, Mycobacterium bovis subsp bovis AF2122/97
ucgguaugcccgg

SEQ ID NO: 1062660 - RNA, 14 nt, Mycobacterium bovis subsp bovis AF2122/97
ucgucggcgccggc

SEQ ID NO: 1062661 - RNA, 16 nt, Mycobacterium bovis subsp bovis AF2122/97
ucgucggcgccggcgg

SEQ ID NO: 1062662 - RNA, 17 nt, Mycobacterium bovis subsp bovis AF2122/97
ucgucggcgccggcggc

SEQ ID NO: 1062663 - RNA, 15 nt, Mycobacterium bovis subsp bovis AF2122/97
ucgucgccagggccg

SEQ ID NO: 1062664 - RNA, 15 nt, Mycobacterium bovis subsp bovis AF2122/97
ucgucggcgggcugc

SEQ ID NO: 1062665 - RNA, 15 nt, Mycobacterium bovis subsp bovis AF2122/97
ucgucggcggcgacg

SEQ ID NO: 1062666 - RNA, 18 nt, Mycobacterium bovis subsp bovis AF2122/97
ucgucgggaucguuggcc

SEQ ID NO: 1062667 - RNA, 22 nt, Mycobacterium bovis subsp bovis AF2122/97
ucgucggcgucgguggaggcgu

SEQ ID NO: 1062668 - RNA, 22 nt, Mycobacterium bovis subsp bovis AF2122/97
ucgucggcggcgacguggcgcc

SEQ ID NO: 1062669 - RNA, 14 nt, Mycobacterium bovis subsp bovis AF2122/97
ucgucggcgggcgg

SEQ ID NO: 1062670 - RNA, 15 nt, Mycobacterium bovis subsp bovis AF2122/97
ucgucggcgggcggc

SEQ ID NO: 1062671 - RNA, 21 nt, Mycobacterium bovis subsp bovis AF2122/97
ucgucggcuuuggacagguca

SEQ ID NO: 1062672 - RNA, 16 nt, Mycobacterium bovis subsp bovis AF2122/97
ucgucgggacgccgcc

SEQ ID NO: 1062673 - RNA, 11 nt, Mycobacterium bovis subsp bovis AF2122/97
ucgucgggagc

SEQ ID NO: 1062674 - RNA, 16 nt, Mycobacterium bovis subsp bovis AF2122/97
ucgucgaaguagccga

SEQ ID NO: 1062675 - RNA, 20 nt, Mycobacterium bovis subsp bovis AF2122/97
ucgucgaccaugcgaccggc

SEQ ID NO: 1062676 - RNA, 21 nt, Mycobacterium bovis subsp bovis AF2122/97
ucgucgaagggaucacgaccg

SEQ ID NO: 1062677 - RNA, 15 nt, Mycobacterium bovis subsp bovis AF2122/97
ucgucgaccacgacg

SEQ ID NO: 1062678 - RNA, 15 nt, Mycobacterium bovis subsp bovis AF2122/97
ucgucgaccgcgcca

SEQ ID NO: 1062679 - RNA, 13 nt, Mycobacterium bovis subsp bovis AF2122/97
ucgucgacgccga

SEQ ID NO: 1062680 - RNA, 11 nt, Mycobacterium bovis subsp bovis AF2122/97
ucgucgaucgc

SEQ ID NO: 1062681 - RNA, 14 nt, Mycobacterium bovis subsp bovis AF2122/97
ucgucgaucgccgc

SEQ ID NO: 1062682 - RNA, 19 nt, Mycobacterium bovis subsp bovis AF2122/97
ucgucgaccggcccccggu

SEQ ID NO: 1062683 - RNA, 15 nt, Mycobacterium bovis subsp bovis AF2122/97
ucgucgauccagccc

SEQ ID NO: 1062684 - RNA, 14 nt, Mycobacterium bovis subsp bovis AF2122/97
ucgucgacgagguc

SEQ ID NO: 1062685 - RNA, 15 nt, Mycobacterium bovis subsp bovis AF2122/97
ucgucgaucgccgcg

SEQ ID NO: 1062686 - RNA, 12 nt, Mycobacterium bovis subsp bovis AF2122/97
ucgucgaugccu

SEQ ID NO: 1062687 - RNA, 19 nt, Mycobacterium bovis subsp bovis AF2122/97
ucgucgauguucgccgcgc

SEQ ID NO: 1062688 - RNA, 20 nt, Mycobacterium bovis subsp bovis AF2122/97
ucgucgauggucuccggacg

SEQ ID NO: 1062689 - RNA, 13 nt, Mycobacterium bovis subsp bovis AF2122/97
ucgucgaugucga

SEQ ID NO: 1062690 - RNA, 22 nt, Mycobacterium bovis subsp bovis AF2122/97
ucgucgcaaacuucgcgcacgc

SEQ ID NO: 1062691 - RNA, 13 nt, Mycobacterium bovis subsp bovis AF2122/97
ucgucgucgguca

SEQ ID NO: 1062692 - RNA, 15 nt, Mycobacterium bovis subsp bovis AF2122/97
ucgucgucgcugccg

SEQ ID NO: 1062693 - RNA, 21 nt, Mycobacterium bovis subsp bovis AF2122/97
ucgucgucggcaggcagcucg

SEQ ID NO: 1062694 - RNA, 16 nt, Mycobacterium bovis subsp bovis AF2122/97
ucgucgucuugguugu

SEQ ID NO: 1062695 - RNA, 15 nt, Mycobacterium bovis subsp bovis AF2122/97
ucgucgugcacgacg

SEQ ID NO: 1062696 - RNA, 17 nt, Mycobacterium bovis subsp bovis AF2122/97
ucgucgugcacggcggc

SEQ ID NO: 1062697 - RNA, 18 nt, Mycobacterium bovis subsp bovis AF2122/97
ucgucgugcacggcggcc

SEQ ID NO: 1062698 - RNA, 14 nt, Mycobacterium bovis subsp bovis AF2122/97
ucgucgugcaggcg

SEQ ID NO: 1062699 - RNA, 18 nt, Mycobacterium bovis subsp bovis AF2122/97
ucgucgugagacugggcg

SEQ ID NO: 1062700 - RNA, 15 nt, Mycobacterium bovis subsp bovis AF2122/97
ucgucgugucgccgc

SEQ ID NO: 1062701 - RNA, 17 nt, Mycobacterium bovis subsp bovis AF2122/97
ucgucgguaccguccuc

SEQ ID NO: 1062702 - RNA, 21 nt, Mycobacterium bovis subsp bovis AF2122/97
ucgucggucaaaccggugccg

SEQ ID NO: 1062703 - RNA, 13 nt, Mycobacterium bovis subsp bovis AF2122/97
ucgucggugauca

SEQ ID NO: 1062704 - RNA, 22 nt, Mycobacterium bovis subsp bovis AF2122/97
ucgucggucucaugcacccggu

SEQ ID NO: 1062705 - RNA, 12 nt, Mycobacterium bovis subsp bovis AF2122/97
ucgucggucuca

SEQ ID NO: 1062706 - RNA, 14 nt, Mycobacterium bovis subsp bovis AF2122/97
ucgucgguguccuc

SEQ ID NO: 1062707 - RNA, 17 nt, Mycobacterium bovis subsp bovis AF2122/97
ucgucgguguccucggu

SEQ ID NO: 1062708 - RNA, 18 nt, Mycobacterium bovis subsp bovis AF2122/97
ucgucgguguuccgccgc

SEQ ID NO: 1062709 - RNA, 20 nt, Mycobacterium bovis subsp bovis AF2122/97
ucgucgguguuccgccgcgc

SEQ ID NO: 1062710 - RNA, 20 nt, Mycobacterium bovis subsp bovis AF2122/97
ucgucgguugccacgccgcc

SEQ ID NO: 1062711 - RNA, 14 nt, Mycobacterium bovis subsp bovis AF2122/97
ucgucgggucaccc

SEQ ID NO: 1062712 - RNA, 17 nt, Mycobacterium bovis subsp bovis AF2122/97
ucgucguacaugggcag

SEQ ID NO: 1062713 - RNA, 17 nt, Mycobacterium bovis subsp bovis AF2122/97
ucgugagccccagcgac

SEQ ID NO: 1062714 - RNA, 14 nt, Mycobacterium bovis subsp bovis AF2122/97
ucgugagcggccag

SEQ ID NO: 1062715 - RNA, 22 nt, Mycobacterium bovis subsp bovis AF2122/97
ucgugaucaacuuccgcagcgc

SEQ ID NO: 1062716 - RNA, 14 nt, Mycobacterium bovis subsp bovis AF2122/97
ucgugaccgccguu

SEQ ID NO: 1062717 - RNA, 13 nt, Mycobacterium bovis subsp bovis AF2122/97
ucgugaccggcgg

SEQ ID NO: 1062718 - RNA, 14 nt, Mycobacterium bovis subsp bovis AF2122/97
ucgugaccgaccgc

SEQ ID NO: 1062719 - RNA, 20 nt, Mycobacterium bovis subsp bovis AF2122/97
ucgucuccuugaucgacaac

SEQ ID NO: 1062720 - RNA, 20 nt, Mycobacterium bovis subsp bovis AF2122/97
ucgucguugagcaucaccgu

SEQ ID NO: 1062721 - RNA, 16 nt, Mycobacterium bovis subsp bovis AF2122/97
ucgucgugucgccgcc

SEQ ID NO: 1062722 - RNA, 19 nt, Mycobacterium bovis subsp bovis AF2122/97
ucgucgugucgccgccguu

SEQ ID NO: 1062723 - RNA, 22 nt, Mycobacterium bovis subsp bovis AF2122/97
ucgucgucccagggcugccggu

SEQ ID NO: 1062724 - RNA, 21 nt, Mycobacterium bovis subsp bovis AF2122/97
ucgucguugugauccgguggu

SEQ ID NO: 1062725 - RNA, 23 nt, Mycobacterium bovis subsp bovis AF2122/97
ucgucuuggcggcggugcagcag

SEQ ID NO: 1062726 - RNA, 15 nt, Mycobacterium bovis subsp bovis AF2122/97
ucgucucggccacga

SEQ ID NO: 1062727 - RNA, 17 nt, Mycobacterium bovis subsp bovis AF2122/97
ucgucugguggcagcgc

SEQ ID NO: 1062728 - RNA, 22 nt, Mycobacterium bovis subsp bovis AF2122/97
ucggucgccaccgccggcagca

SEQ ID NO: 1062729 - RNA, 15 nt, Mycobacterium bovis subsp bovis AF2122/97
ucggucgaugcucag

SEQ ID NO: 1062730 - RNA, 12 nt, Mycobacterium bovis subsp bovis AF2122/97
ucggucgacgau

SEQ ID NO: 1062731 - RNA, 21 nt, Mycobacterium bovis subsp bovis AF2122/97
ucggucgacgaucucgccggc

SEQ ID NO: 1062732 - RNA, 22 nt, Mycobacterium bovis subsp bovis AF2122/97
ucggucgacgaucucgccggcg

SEQ ID NO: 1062733 - RNA, 17 nt, Mycobacterium bovis subsp bovis AF2122/97
ucggucgacggguucac

SEQ ID NO: 1062734 - RNA, 19 nt, Mycobacterium bovis subsp bovis AF2122/97
ucggucccgccggucacga

SEQ ID NO: 1062735 - RNA, 19 nt, Mycobacterium bovis subsp bovis AF2122/97
ucggucauguccguccgcg

SEQ ID NO: 1062736 - RNA, 22 nt, Mycobacterium bovis subsp bovis AF2122/97
ucgguccacccaagcucgguca

SEQ ID NO: 1062737 - RNA, 17 nt, Mycobacterium bovis subsp bovis AF2122/97
ucggucaggcggcuggc

SEQ ID NO: 1062738 - RNA, 17 nt, Mycobacterium bovis subsp bovis AF2122/97
ucggucgcuucagcgcc

SEQ ID NO: 1062739 - RNA, 19 nt, Mycobacterium bovis subsp bovis AF2122/97
ucgguguagaucagcaacg

SEQ ID NO: 1062740 - RNA, 22 nt, Mycobacterium bovis subsp bovis AF2122/97
ucgguguagcaacgguagcggc

SEQ ID NO: 1062741 - RNA, 22 nt, Mycobacterium bovis subsp bovis AF2122/97
ucggucguccggaucggucggc

SEQ ID NO: 1062742 - RNA, 17 nt, Mycobacterium bovis subsp bovis AF2122/97
ucggucggcaccagguu

SEQ ID NO: 1062743 - RNA, 20 nt, Mycobacterium bovis subsp bovis AF2122/97
ucggugucgguucggucggc

SEQ ID NO: 1062744 - RNA, 22 nt, Mycobacterium bovis subsp bovis AF2122/97
ucggugucgccacccgcgcucc

SEQ ID NO: 1062745 - RNA, 14 nt, Mycobacterium bovis subsp bovis AF2122/97
ucggugucgccgaa

SEQ ID NO: 1062746 - RNA, 18 nt, Mycobacterium bovis subsp bovis AF2122/97
ucggugugcucgccgacc

SEQ ID NO: 1062747 - RNA, 18 nt, Mycobacterium bovis subsp bovis AF2122/97
ucgguguggcccaacacc

SEQ ID NO: 1062748 - RNA, 22 nt, Mycobacterium bovis subsp bovis AF2122/97
ucggugugccagugcugcaccg

SEQ ID NO: 1062749 - RNA, 15 nt, Mycobacterium bovis subsp bovis AF2122/97
ucgguguuccgccgc

SEQ ID NO: 1062750 - RNA, 17 nt, Mycobacterium bovis subsp bovis AF2122/97
ucgguguucgguggucc

SEQ ID NO: 1062751 - RNA, 17 nt, Mycobacterium bovis subsp bovis AF2122/97
ucguagaggacugcggu

SEQ ID NO: 1062752 - RNA, 19 nt, Mycobacterium bovis subsp bovis AF2122/97
ucgguugcccccagggccg

SEQ ID NO: 1062753 - RNA, 19 nt, Mycobacterium bovis subsp bovis AF2122/97
ucgguuggcucgggccaga

SEQ ID NO: 1062754 - RNA, 19 nt, Mycobacterium bovis subsp bovis AF2122/97
ucgguuucgaccugcggga

SEQ ID NO: 1062755 - RNA, 20 nt, Mycobacterium bovis subsp bovis AF2122/97
ucgguuccauugcgaacucg

SEQ ID NO: 1062756 - RNA, 20 nt, Mycobacterium bovis subsp bovis AF2122/97
ucguagcgggcaaacgaacg

SEQ ID NO: 1062757 - RNA, 14 nt, Mycobacterium bovis subsp bovis AF2122/97
ucguagcggccgca

SEQ ID NO: 1062758 - RNA, 21 nt, Mycobacterium bovis subsp bovis AF2122/97
ucguagccgccgucgccggug

SEQ ID NO: 1062759 - RNA, 18 nt, Mycobacterium bovis subsp bovis AF2122/97
ucguccaggucggccgcc

SEQ ID NO: 1062760 - RNA, 19 nt, Mycobacterium bovis subsp bovis AF2122/97
ucguccagcucggugcugu

SEQ ID NO: 1062761 - RNA, 18 nt, Mycobacterium bovis subsp bovis AF2122/97
ucguccagcgaucccggu

SEQ ID NO: 1062762 - RNA, 22 nt, Mycobacterium bovis subsp bovis AF2122/97
ucgucgaacggaucucgguggu

SEQ ID NO: 1062763 - RNA, 18 nt, Mycobacterium bovis subsp bovis AF2122/97
ucguccuguccgggcugc

SEQ ID NO: 1062764 - RNA, 22 nt, Mycobacterium bovis subsp bovis AF2122/97
ucguccuggaaccaaaccuggg

SEQ ID NO: 1062765 - RNA, 17 nt, Mycobacterium bovis subsp bovis AF2122/97
ucguccagggcgacgag

SEQ ID NO: 1062766 - RNA, 21 nt, Mycobacterium bovis subsp bovis AF2122/97
ucguccuguccgggcugcaug

SEQ ID NO: 1062767 - RNA, 14 nt, Mycobacterium bovis subsp bovis AF2122/97
ucgucccacugcgc

SEQ ID NO: 1062768 - RNA, 19 nt, Mycobacterium bovis subsp bovis AF2122/97
ucgucccagaaccggcuca

SEQ ID NO: 1062769 - RNA, 18 nt, Mycobacterium bovis subsp bovis AF2122/97
ucgucccagaagucguca

SEQ ID NO: 1062770 - RNA, 17 nt, Mycobacterium bovis subsp bovis AF2122/97
ucguagggugggucggc

SEQ ID NO: 1062771 - RNA, 21 nt, Mycobacterium bovis subsp bovis AF2122/97
ucguaggcgcuaggaacgcca

SEQ ID NO: 1062772 - RNA, 17 nt, Mycobacterium bovis subsp bovis AF2122/97
ucguagggacgccgagc

SEQ ID NO: 1062773 - RNA, 12 nt, Mycobacterium bovis subsp bovis AF2122/97
ucguaggcgaug

SEQ ID NO: 1062774 - RNA, 14 nt, Mycobacterium bovis subsp bovis AF2122/97
ucguaggugggcuc

SEQ ID NO: 1062775 - RNA, 16 nt, Mycobacterium bovis subsp bovis AF2122/97
ucguaguaggcgccgc

SEQ ID NO: 1062776 - RNA, 21 nt, Mycobacterium bovis subsp bovis AF2122/97
ucguaggugggcucguagcgc

SEQ ID NO: 1062777 - RNA, 23 nt, Mycobacterium bovis subsp bovis AF2122/97
ucguccaccgccgacauggcggu

SEQ ID NO: 1062778 - RNA, 16 nt, Mycobacterium bovis subsp bovis AF2122/97
ucgucaacgacgacga

SEQ ID NO: 1062779 - RNA, 14 nt, Mycobacterium bovis subsp bovis AF2122/97
ucgucaaucaccac

SEQ ID NO: 1062780 - RNA, 21 nt, Mycobacterium bovis subsp bovis AF2122/97
ucgucaaucaccaccgccagc

SEQ ID NO: 1062781 - RNA, 16 nt, Mycobacterium bovis subsp bovis AF2122/97
ucgucaaaucuggcug

SEQ ID NO: 1062782 - RNA, 12 nt, Mycobacterium bovis subsp bovis AF2122/97
ucugcgacacca

SEQ ID NO: 1062783 - RNA, 16 nt, Mycobacterium bovis subsp bovis AF2122/97
ucugccugcgcacgac

SEQ ID NO: 1062784 - RNA, 21 nt, Mycobacterium bovis subsp bovis AF2122/97
ucugcccccgccggccgucga

SEQ ID NO: 1062785 - RNA, 16 nt, Mycobacterium bovis subsp bovis AF2122/97
ucugccgccgcggcca

SEQ ID NO: 1062786 - RNA, 20 nt, Mycobacterium bovis subsp bovis AF2122/97
ucugaugguguacacgucgc

SEQ ID NO: 1062787 - RNA, 22 nt, Mycobacterium bovis subsp bovis AF2122/97
ucugaucuguguuugcggcuuc

SEQ ID NO: 1062788 - RNA, 19 nt, Mycobacterium bovis subsp bovis AF2122/97
ucugagacugccgccgcuu

SEQ ID NO: 1062789 - RNA, 20 nt, Mycobacterium bovis subsp bovis AF2122/97
ucugacgaaauccgccgggc

SEQ ID NO: 1062790 - RNA, 13 nt, Mycobacterium bovis subsp bovis AF2122/97
ucugacgcggccg

SEQ ID NO: 1062791 - RNA, 17 nt, Mycobacterium bovis subsp bovis AF2122/97
ucucuucccaaccgccc

SEQ ID NO: 1062792 - RNA, 22 nt, Mycobacterium bovis subsp bovis AF2122/97
ucucuucgcgcgcugggcgcgc

SEQ ID NO: 1062793 - RNA, 19 nt, Mycobacterium bovis subsp bovis AF2122/97
ucucuuggugcccgacuug

SEQ ID NO: 1062794 - RNA, 21 nt, Mycobacterium bovis subsp bovis AF2122/97
ucucguaacgcggcaccacgu

SEQ ID NO: 1062795 - RNA, 17 nt, Mycobacterium bovis subsp bovis AF2122/97
ucucggugguccagcgc

SEQ ID NO: 1062796 - RNA, 17 nt, Mycobacterium bovis subsp bovis AF2122/97
ucucgguggugcgcucg

SEQ ID NO: 1062797 - RNA, 17 nt, Mycobacterium bovis subsp bovis AF2122/97
ucucggugcagcagcgc

SEQ ID NO: 1062798 - RNA, 12 nt, Mycobacterium bovis subsp bovis AF2122/97
ucucggugcugg

SEQ ID NO: 1062799 - RNA, 18 nt, Mycobacterium bovis subsp bovis AF2122/97
ucucguggauggccgcca

SEQ ID NO: 1062800 - RNA, 19 nt, Mycobacterium bovis subsp bovis AF2122/97
ucucgucggguaccacgcu

SEQ ID NO: 1062801 - RNA, 17 nt, Mycobacterium bovis subsp bovis AF2122/97
ucucguugauacggcau

SEQ ID NO: 1062802 - RNA, 21 nt, Mycobacterium bovis subsp bovis AF2122/97
ucucggcguacucgugcaccg

SEQ ID NO: 1062803 - RNA, 13 nt, Mycobacterium bovis subsp bovis AF2122/97
ucucggucagccc

SEQ ID NO: 1062804 - RNA, 14 nt, Mycobacterium bovis subsp bovis AF2122/97
ucucgggccagucg

SEQ ID NO: 1062805 - RNA, 21 nt, Mycobacterium bovis subsp bovis AF2122/97
ucucggccgcucguuacgccg

SEQ ID NO: 1062806 - RNA, 23 nt, Mycobacterium bovis subsp bovis AF2122/97
ucucggcggccgcgugcucgccg

SEQ ID NO: 1062807 - RNA, 17 nt, Mycobacterium bovis subsp bovis AF2122/97
ucucggcgagcaccgug

SEQ ID NO: 1062808 - RNA, 19 nt, Mycobacterium bovis subsp bovis AF2122/97
ucucgccguggauggcccg

SEQ ID NO: 1062809 - RNA, 14 nt, Mycobacterium bovis subsp bovis AF2122/97
ucucgcgaaccgac

SEQ ID NO: 1062810 - RNA, 22 nt, Mycobacterium bovis subsp bovis AF2122/97
ucucgccgcgcaccgaccgcac

SEQ ID NO: 1062811 - RNA, 13 nt, Mycobacterium bovis subsp bovis AF2122/97
ucucgaucgcggu

SEQ ID NO: 1062812 - RNA, 17 nt, Mycobacterium bovis subsp bovis AF2122/97
ucucgauuaucgcgcgc

SEQ ID NO: 1062813 - RNA, 13 nt, Mycobacterium bovis subsp bovis AF2122/97
ucucgcaccgcgc

SEQ ID NO: 1062814 - RNA, 18 nt, Mycobacterium bovis subsp bovis AF2122/97
ucucgaucuugggccacg

SEQ ID NO: 1062815 - RNA, 21 nt, Mycobacterium bovis subsp bovis AF2122/97
ucucgcagcuccucgcccaga

SEQ ID NO: 1062816 - RNA, 17 nt, Mycobacterium bovis subsp bovis AF2122/97
ucucgacggcggccgcg

SEQ ID NO: 1062817 - RNA, 18 nt, Mycobacterium bovis subsp bovis AF2122/97
ucuccguccccgcagcgc

SEQ ID NO: 1062818 - RNA, 22 nt, Mycobacterium bovis subsp bovis AF2122/97
ucuccggugaucaccgacaccg

SEQ ID NO: 1062819 - RNA, 23 nt, Mycobacterium bovis subsp bovis AF2122/97
ucuccggugaucaccgacaccgu

SEQ ID NO: 1062820 - RNA, 21 nt, Mycobacterium bovis subsp bovis AF2122/97
ucuccgggucgaugucggggc

SEQ ID NO: 1062821 - RNA, 14 nt, Mycobacterium bovis subsp bovis AF2122/97
ucuccggcgccacc

SEQ ID NO: 1062822 - RNA, 14 nt, Mycobacterium bovis subsp bovis AF2122/97
ucuccgccgcccag

SEQ ID NO: 1062823 - RNA, 14 nt, Mycobacterium bovis subsp bovis AF2122/97
ucuccgccgucgcc

SEQ ID NO: 1062824 - RNA, 20 nt, Mycobacterium bovis subsp bovis AF2122/97
ucuccgccgugaguucacgu

SEQ ID NO: 1062825 - RNA, 15 nt, Mycobacterium bovis subsp bovis AF2122/97
ucucccuugccgcca

SEQ ID NO: 1062826 - RNA, 20 nt, Mycobacterium bovis subsp bovis AF2122/97
ucuccgaaucugccggccgg

SEQ ID NO: 1062827 - RNA, 20 nt, Mycobacterium bovis subsp bovis AF2122/97
ucucccauacgccggccgcg

SEQ ID NO: 1062828 - RNA, 14 nt, Mycobacterium bovis subsp bovis AF2122/97
ucuccccgaccgcg

SEQ ID NO: 1062829 - RNA, 15 nt, Mycobacterium bovis subsp bovis AF2122/97
ucucccgcacggccg

SEQ ID NO: 1062830 - RNA, 13 nt, Mycobacterium bovis subsp bovis AF2122/97
ucucccgaccgcc

SEQ ID NO: 1062831 - RNA, 13 nt, Mycobacterium bovis subsp bovis AF2122/97
ucguggucgacgu

SEQ ID NO: 1062832 - RNA, 15 nt, Mycobacterium bovis subsp bovis AF2122/97
ucguggggaccggca

SEQ ID NO: 1062833 - RNA, 14 nt, Mycobacterium bovis subsp bovis AF2122/97
ucguggggaucgac

SEQ ID NO: 1062834 - RNA, 21 nt, Mycobacterium bovis subsp bovis AF2122/97
ucguggggaucgaccaugguc

SEQ ID NO: 1062835 - RNA, 23 nt, Mycobacterium bovis subsp bovis AF2122/97
ucgugggccacuugaugcucgau

SEQ ID NO: 1062836 - RNA, 15 nt, Mycobacterium bovis subsp bovis AF2122/97
ucguggcgucgugcg

SEQ ID NO: 1062837 - RNA, 19 nt, Mycobacterium bovis subsp bovis AF2122/97
ucguggcgucgugcgcggc

SEQ ID NO: 1062838 - RNA, 21 nt, Mycobacterium bovis subsp bovis AF2122/97
ucguggcuggcaugccggcgu

SEQ ID NO: 1062839 - RNA, 20 nt, Mycobacterium bovis subsp bovis AF2122/97
ucguggcuuccggugguguc

SEQ ID NO: 1062840 - RNA, 14 nt, Mycobacterium bovis subsp bovis AF2122/97
ucguggcgaccacg

SEQ ID NO: 1062841 - RNA, 23 nt, Mycobacterium bovis subsp bovis AF2122/97
ucguggcgcugggguccgcgucg

SEQ ID NO: 1062842 - RNA, 14 nt, Mycobacterium bovis subsp bovis AF2122/97
ucguggcggcgucg

SEQ ID NO: 1062843 - RNA, 20 nt, Mycobacterium bovis subsp bovis AF2122/97
ucguggaucuucgcgcugua

SEQ ID NO: 1062844 - RNA, 20 nt, Mycobacterium bovis subsp bovis AF2122/97
ucguggauggccgccaggcg

SEQ ID NO: 1062845 - RNA, 20 nt, Mycobacterium bovis subsp bovis AF2122/97
ucguggagcucacgugcugc

SEQ ID NO: 1062846 - RNA, 18 nt, Mycobacterium bovis subsp bovis AF2122/97
ucgugguuguaccagccg

SEQ ID NO: 1062847 - RNA, 20 nt, Mycobacterium bovis subsp bovis AF2122/97
ucguggugcaacacgccggc

SEQ ID NO: 1062848 - RNA, 16 nt, Mycobacterium bovis subsp bovis AF2122/97
ucgugguucggcgucg

SEQ ID NO: 1062849 - RNA, 17 nt, Mycobacterium bovis subsp bovis AF2122/97
ucgugguucggcgucga

SEQ ID NO: 1062850 - RNA, 14 nt, Mycobacterium bovis subsp bovis AF2122/97
ucgugggugccggc

SEQ ID NO: 1062851 - RNA, 13 nt, Mycobacterium bovis subsp bovis AF2122/97
ucguggucgaucc

SEQ ID NO: 1062852 - RNA, 12 nt, Mycobacterium bovis subsp bovis AF2122/97
ucguguccaccg

SEQ ID NO: 1062853 - RNA, 18 nt, Mycobacterium bovis subsp bovis AF2122/97
ucgugucacccucgggcg

SEQ ID NO: 1062854 - RNA, 16 nt, Mycobacterium bovis subsp bovis AF2122/97
ucgugucaugcucacc

SEQ ID NO: 1062855 - RNA, 15 nt, Mycobacterium bovis subsp bovis AF2122/97
ucucacccacaugac

SEQ ID NO: 1062856 - RNA, 17 nt, Mycobacterium bovis subsp bovis AF2122/97
ucugcgccacagcagcg

SEQ ID NO: 1062857 - RNA, 14 nt, Mycobacterium bovis subsp bovis AF2122/97
ucugcgcgaggggc

SEQ ID NO: 1062858 - RNA, 17 nt, Mycobacterium bovis subsp bovis AF2122/97
ucugcgcgaugcccacg

SEQ ID NO: 1062859 - RNA, 16 nt, Mycobacterium bovis subsp bovis AF2122/97
ucugcugaucgagcgg

SEQ ID NO: 1062860 - RNA, 17 nt, Mycobacterium bovis subsp bovis AF2122/97
ucuggauacccagcgcc

SEQ ID NO: 1062861 - RNA, 21 nt, Mycobacterium bovis subsp bovis AF2122/97
ucuggaucagaucccgccgcg

SEQ ID NO: 1062862 - RNA, 17 nt, Mycobacterium bovis subsp bovis AF2122/97
ucuggaauccggccaga

SEQ ID NO: 1062863 - RNA, 15 nt, Mycobacterium bovis subsp bovis AF2122/97
ucuggccggcggugu

SEQ ID NO: 1062864 - RNA, 15 nt, Mycobacterium bovis subsp bovis AF2122/97
ucuggcaggccagca

SEQ ID NO: 1062865 - RNA, 15 nt, Mycobacterium bovis subsp bovis AF2122/97
ucuuagccagcagca

SEQ ID NO: 1062866 - RNA, 21 nt, Mycobacterium bovis subsp bovis AF2122/97
ucuucggcaccaccgcgaccu

SEQ ID NO: 1062867 - RNA, 16 nt, Mycobacterium bovis subsp bovis AF2122/97
ucuucgauaccgaccg

SEQ ID NO: 1062868 - RNA, 18 nt, Mycobacterium bovis subsp bovis AF2122/97
ucuuccaggagcgccguc

SEQ ID NO: 1062869 - RNA, 22 nt, Mycobacterium bovis subsp bovis AF2122/97
ucuucagcugcggauacagccg

SEQ ID NO: 1062870 - RNA, 16 nt, Mycobacterium bovis subsp bovis AF2122/97
ucuuccacagcgcgua

SEQ ID NO: 1062871 - RNA, 15 nt, Mycobacterium bovis subsp bovis AF2122/97
ucuucagguccaccg

SEQ ID NO: 1062872 - RNA, 16 nt, Mycobacterium bovis subsp bovis AF2122/97
ucuucgggugcagcca

SEQ ID NO: 1062873 - RNA, 14 nt, Mycobacterium bovis subsp bovis AF2122/97
ucuucgggcagcgc

SEQ ID NO: 1062874 - RNA, 17 nt, Mycobacterium bovis subsp bovis AF2122/97
ucuugcgacgcccgccu

SEQ ID NO: 1062875 - RNA, 21 nt, Mycobacterium bovis subsp bovis AF2122/97
ucuugcgacgcccgccuucga

SEQ ID NO: 1062876 - RNA, 14 nt, Mycobacterium bovis subsp bovis AF2122/97
ucuugcgggcagcc

SEQ ID NO: 1062877 - RNA, 23 nt, Mycobacterium bovis subsp bovis AF2122/97
ugaacagcgcgucggagccgggc

SEQ ID NO: 1062878 - RNA, 22 nt, Mycobacterium bovis subsp bovis AF2122/97
ugaaccaccacuucggcgccgc

SEQ ID NO: 1062879 - RNA, 17 nt, Mycobacterium bovis subsp bovis AF2122/97
ugaaccaggcggccgcg

SEQ ID NO: 1062880 - RNA, 16 nt, Mycobacterium bovis subsp bovis AF2122/97
ugaacgaguagccggu

SEQ ID NO: 1062881 - RNA, 22 nt, Mycobacterium bovis subsp bovis AF2122/97
ugaacgcaugcgagaacgucga

SEQ ID NO: 1062882 - RNA, 13 nt, Mycobacterium bovis subsp bovis AF2122/97
ugaaccuggcgac

SEQ ID NO: 1062883 - RNA, 15 nt, Mycobacterium bovis subsp bovis AF2122/97
ugaaccuggcgacgc

SEQ ID NO: 1062884 - RNA, 18 nt, Mycobacterium bovis subsp bovis AF2122/97
ugaaccuggcgacgcgac

SEQ ID NO: 1062885 - RNA, 15 nt, Mycobacterium bovis subsp bovis AF2122/97
ugaacgagaugccgc

SEQ ID NO: 1062886 - RNA, 19 nt, Mycobacterium bovis subsp bovis AF2122/97
ugaacaauccgguguugag

SEQ ID NO: 1062887 - RNA, 19 nt, Mycobacterium bovis subsp bovis AF2122/97
ugaacacgaauccggccac

SEQ ID NO: 1062888 - RNA, 13 nt, Mycobacterium bovis subsp bovis AF2122/97
ugaacaacagcgc

SEQ ID NO: 1062889 - RNA, 13 nt, Mycobacterium bovis subsp bovis AF2122/97
ugaaacgauggcg

SEQ ID NO: 1062890 - RNA, 14 nt, Mycobacterium bovis subsp bovis AF2122/97
ucuuggcgcccgcc

SEQ ID NO: 1062891 - RNA, 16 nt, Mycobacterium bovis subsp bovis AF2122/97
ucuuggccagcagcgc

SEQ ID NO: 1062892 - RNA, 17 nt, Mycobacterium bovis subsp bovis AF2122/97
ugcccaggccaccggcu

SEQ ID NO: 1062893 - RNA, 18 nt, Mycobacterium bovis subsp bovis AF2122/97
ugcccaggccaccggcug

SEQ ID NO: 1062894 - RNA, 21 nt, Mycobacterium bovis subsp bovis AF2122/97
ugcccagguguguggcggcgu

SEQ ID NO: 1062895 - RNA, 17 nt, Mycobacterium bovis subsp bovis AF2122/97
ugcccaucccggccgag

SEQ ID NO: 1062896 - RNA, 17 nt, Mycobacterium bovis subsp bovis AF2122/97
ugcccauccggccgucg

SEQ ID NO: 1062897 - RNA, 20 nt, Mycobacterium bovis subsp bovis AF2122/97
ugcccauccggccgucgggc

SEQ ID NO: 1062898 - RNA, 23 nt, Mycobacterium bovis subsp bovis AF2122/97
ugcccgaucguaggacucggcgg

SEQ ID NO: 1062899 - RNA, 12 nt, Mycobacterium bovis subsp bovis AF2122/97
ugcccgccgcgu

SEQ ID NO: 1062900 - RNA, 11 nt, Mycobacterium bovis subsp bovis AF2122/97
ugcccgccgac

SEQ ID NO: 1062901 - RNA, 20 nt, Mycobacterium bovis subsp bovis AF2122/97
ugcccgccagcgccgccgcg

SEQ ID NO: 1062902 - RNA, 14 nt, Mycobacterium bovis subsp bovis AF2122/97
ugcccgccaccggc

SEQ ID NO: 1062903 - RNA, 16 nt, Mycobacterium bovis subsp bovis AF2122/97
ugcccgccaccggcgc

SEQ ID NO: 1062904 - RNA, 19 nt, Mycobacterium bovis subsp bovis AF2122/97
ugcccgccaccggcgcgac

SEQ ID NO: 1062905 - RNA, 23 nt, Mycobacterium bovis subsp bovis AF2122/97
ugcccgaugguacccgcgccgcg

SEQ ID NO: 1062906 - RNA, 16 nt, Mycobacterium bovis subsp bovis AF2122/97
ugcccgcacugccgcc

SEQ ID NO: 1062907 - RNA, 18 nt, Mycobacterium bovis subsp bovis AF2122/97
ugcccgcacugccgccgg

SEQ ID NO: 1062908 - RNA, 18 nt, Mycobacterium bovis subsp bovis AF2122/97
ugcccgccagucccccgc

SEQ ID NO: 1062909 - RNA, 13 nt, Mycobacterium bovis subsp bovis AF2122/97
ugcccgccccgac

SEQ ID NO: 1062910 - RNA, 22 nt, Mycobacterium bovis subsp bovis AF2122/97
ugcccugccggcagcggcgagu

SEQ ID NO: 1062911 - RNA, 20 nt, Mycobacterium bovis subsp bovis AF2122/97
ugcccugggugauggccgcg

SEQ ID NO: 1062912 - RNA, 15 nt, Mycobacterium bovis subsp bovis AF2122/97
ugcccgucccgcucg

SEQ ID NO: 1062913 - RNA, 18 nt, Mycobacterium bovis subsp bovis AF2122/97
ugcccguauaaccggcca

SEQ ID NO: 1062914 - RNA, 20 nt, Mycobacterium bovis subsp bovis AF2122/97
ugcccgggguccaucggggc

SEQ ID NO: 1062915 - RNA, 21 nt, Mycobacterium bovis subsp bovis AF2122/97
ugcccggcuccuccccggccc

SEQ ID NO: 1062916 - RNA, 18 nt, Mycobacterium bovis subsp bovis AF2122/97
ugcccgggaugacugggc

SEQ ID NO: 1062917 - RNA, 12 nt, Mycobacterium bovis subsp bovis AF2122/97
ugcccgggucgg

SEQ ID NO: 1062918 - RNA, 14 nt, Mycobacterium bovis subsp bovis AF2122/97
ugcccgggucggcc

SEQ ID NO: 1062919 - RNA, 16 nt, Mycobacterium bovis subsp bovis AF2122/97
ugcccguagacgccga

SEQ ID NO: 1062920 - RNA, 18 nt, Mycobacterium bovis subsp bovis AF2122/97
ugcccggcggccaacgac

SEQ ID NO: 1062921 - RNA, 18 nt, Mycobacterium bovis subsp bovis AF2122/97
ugcccggcgcccggguag

SEQ ID NO: 1062922 - RNA, 11 nt, Mycobacterium bovis subsp bovis AF2122/97
ugcccggccgc

SEQ ID NO: 1062923 - RNA, 19 nt, Mycobacterium bovis subsp bovis AF2122/97
ugcccggccaaccaccaac

SEQ ID NO: 1062924 - RNA, 13 nt, Mycobacterium bovis subsp bovis AF2122/97
ugcccggccgcca

SEQ ID NO: 1062925 - RNA, 21 nt, Mycobacterium bovis subsp bovis AF2122/97
ugcccggacgauggcgucggc

SEQ ID NO: 1062926 - RNA, 20 nt, Mycobacterium bovis subsp bovis AF2122/97
ugcccggauuggcgaugaug

SEQ ID NO: 1062927 - RNA, 13 nt, Mycobacterium bovis subsp bovis AF2122/97
ugcccgcggcgga

SEQ ID NO: 1062928 - RNA, 19 nt, Mycobacterium bovis subsp bovis AF2122/97
ugcccgcgucuacgucguc

SEQ ID NO: 1062929 - RNA, 14 nt, Mycobacterium bovis subsp bovis AF2122/97
ugcccgcggugacg

SEQ ID NO: 1062930 - RNA, 20 nt, Mycobacterium bovis subsp bovis AF2122/97
ugcccgcguuugcgaagccc

SEQ ID NO: 1062931 - RNA, 19 nt, Mycobacterium bovis subsp bovis AF2122/97
ugccauccuuaugcgcggu

SEQ ID NO: 1062932 - RNA, 12 nt, Mycobacterium bovis subsp bovis AF2122/97
ugccaucggcac

SEQ ID NO: 1062933 - RNA, 19 nt, Mycobacterium bovis subsp bovis AF2122/97
ugccagcgccgccgccgac

SEQ ID NO: 1062934 - RNA, 23 nt, Mycobacterium bovis subsp bovis AF2122/97
ugccagccuuggacgugcgcgcc

SEQ ID NO: 1062935 - RNA, 13 nt, Mycobacterium bovis subsp bovis AF2122/97
ugccagcggccgg

SEQ ID NO: 1062936 - RNA, 21 nt, Mycobacterium bovis subsp bovis AF2122/97
ugccagcguggugaagucggu

SEQ ID NO: 1062937 - RNA, 21 nt, Mycobacterium bovis subsp bovis AF2122/97
ugccagccggucgaugccgau

SEQ ID NO: 1062938 - RNA, 16 nt, Mycobacterium bovis subsp bovis AF2122/97
ugccagccauggccgc

SEQ ID NO: 1062939 - RNA, 17 nt, Mycobacterium bovis subsp bovis AF2122/97
ugccagcagcagcgccg

SEQ ID NO: 1062940 - RNA, 22 nt, Mycobacterium bovis subsp bovis AF2122/97
ugccagcagcagcgccgcgugg

SEQ ID NO: 1062941 - RNA, 19 nt, Mycobacterium bovis subsp bovis AF2122/97
ugcccacgggccggccgag

SEQ ID NO: 1062942 - RNA, 18 nt, Mycobacterium bovis subsp bovis AF2122/97
ugcccagcaccaccgcgg

SEQ ID NO: 1062943 - RNA, 20 nt, Mycobacterium bovis subsp bovis AF2122/97
ugcccagcaccaccgcggug

SEQ ID NO: 1062944 - RNA, 22 nt, Mycobacterium bovis subsp bovis AF2122/97
ugccauugccucccgcgccggc

SEQ ID NO: 1062945 - RNA, 24 nt, Mycobacterium bovis subsp bovis AF2122/97
ugccauuccagaucaacgcgucgc

SEQ ID NO: 1062946 - RNA, 22 nt, Mycobacterium bovis subsp bovis AF2122/97
ugccagaccagggcagcggcca

SEQ ID NO: 1062947 - RNA, 15 nt, Mycobacterium bovis subsp bovis AF2122/97
ugccagcaccacguc

SEQ ID NO: 1062948 - RNA, 22 nt, Mycobacterium bovis subsp bovis AF2122/97
ugccacggcgccuacaccggcg

SEQ ID NO: 1062949 - RNA, 23 nt, Mycobacterium bovis subsp bovis AF2122/97
ugccacggcgccuacaccggcgc

SEQ ID NO: 1062950 - RNA, 23 nt, Mycobacterium bovis subsp bovis AF2122/97
ugccacggcaagccaaccagccc

SEQ ID NO: 1062951 - RNA, 19 nt, Mycobacterium bovis subsp bovis AF2122/97
ugccacggugacccuggug

SEQ ID NO: 1062952 - RNA, 21 nt, Mycobacterium bovis subsp bovis AF2122/97
ugccacggucauuggguguca

SEQ ID NO: 1062953 - RNA, 16 nt, Mycobacterium bovis subsp bovis AF2122/97
ugccacgccgccggug

SEQ ID NO: 1062954 - RNA, 22 nt, Mycobacterium bovis subsp bovis AF2122/97
ugcaguguuuuugcagacucgg

SEQ ID NO: 1062955 - RNA, 16 nt, Mycobacterium bovis subsp bovis AF2122/97
ugcaguuccgcggggc

SEQ ID NO: 1062956 - RNA, 21 nt, Mycobacterium bovis subsp bovis AF2122/97
ugcaguuccuugagacgccgg

SEQ ID NO: 1062957 - RNA, 18 nt, Mycobacterium bovis subsp bovis AF2122/97
ugccaccucuaccggugg

SEQ ID NO: 1062958 - RNA, 22 nt, Mycobacterium bovis subsp bovis AF2122/97
ugccacgacgaacaccagcgcg

SEQ ID NO: 1062959 - RNA, 16 nt, Mycobacterium bovis subsp bovis AF2122/97
ugcaggaucggcuugg

SEQ ID NO: 1062960 - RNA, 22 nt, Mycobacterium bovis subsp bovis AF2122/97
ugcaggacguuugagaccccaa

SEQ ID NO: 1062961 - RNA, 17 nt, Mycobacterium bovis subsp bovis AF2122/97
ugcaggacucgcguccu

SEQ ID NO: 1062962 - RNA, 12 nt, Mycobacterium bovis subsp bovis AF2122/97
ugcagcccgccg

SEQ ID NO: 1062963 - RNA, 13 nt, Mycobacterium bovis subsp bovis AF2122/97
ugcagccgaccga

SEQ ID NO: 1062964 - RNA, 13 nt, Mycobacterium bovis subsp bovis AF2122/97
ugcagccgggaaa

SEQ ID NO: 1062965 - RNA, 19 nt, Mycobacterium bovis subsp bovis AF2122/97
ugcagccgggaaaucucgg

SEQ ID NO: 1062966 - RNA, 18 nt, Mycobacterium bovis subsp bovis AF2122/97
ugcagcgaugcggcguug

SEQ ID NO: 1062967 - RNA, 16 nt, Mycobacterium bovis subsp bovis AF2122/97
ugcagcggguugcggu

SEQ ID NO: 1062968 - RNA, 17 nt, Mycobacterium bovis subsp bovis AF2122/97
ugcagcgguccagacau

SEQ ID NO: 1062969 - RNA, 20 nt, Mycobacterium bovis subsp bovis AF2122/97
ugcagcgucaagggcugggu

SEQ ID NO: 1062970 - RNA, 16 nt, Mycobacterium bovis subsp bovis AF2122/97
ugcagcacggcgccgc

SEQ ID NO: 1062971 - RNA, 13 nt, Mycobacterium bovis subsp bovis AF2122/97
ugcagcacguccg

SEQ ID NO: 1062972 - RNA, 17 nt, Mycobacterium bovis subsp bovis AF2122/97
ugcagcacguccgcgga

SEQ ID NO: 1062973 - RNA, 17 nt, Mycobacterium bovis subsp bovis AF2122/97
ugcagcccgggcagcac

SEQ ID NO: 1062974 - RNA, 17 nt, Mycobacterium bovis subsp bovis AF2122/97
ugcagcccaaggcgacg

SEQ ID NO: 1062975 - RNA, 19 nt, Mycobacterium bovis subsp bovis AF2122/97
ugcagccauugacggucca

SEQ ID NO: 1062976 - RNA, 21 nt, Mycobacterium bovis subsp bovis AF2122/97
ugcagccacauacaggcccgc

SEQ ID NO: 1062977 - RNA, 18 nt, Mycobacterium bovis subsp bovis AF2122/97
ugcagcacccccucggcu

SEQ ID NO: 1062978 - RNA, 21 nt, Mycobacterium bovis subsp bovis AF2122/97
ugcagaucguagugcgcgcca

SEQ ID NO: 1062979 - RNA, 21 nt, Mycobacterium bovis subsp bovis AF2122/97
ugcagacccgguaguccgcgc

SEQ ID NO: 1062980 - RNA, 16 nt, Mycobacterium bovis subsp bovis AF2122/97
ugcagaauucggcgcg

SEQ ID NO: 1062981 - RNA, 16 nt, Mycobacterium bovis subsp bovis AF2122/97
ugcagacucggcgaua

SEQ ID NO: 1062982 - RNA, 15 nt, Mycobacterium bovis subsp bovis AF2122/97
ugcacauucagcgcc

SEQ ID NO: 1062983 - RNA, 15 nt, Mycobacterium bovis subsp bovis AF2122/97
ugcaccacggcggcc

SEQ ID NO: 1062984 - RNA, 17 nt, Mycobacterium bovis subsp bovis AF2122/97
ugcaccacggcggccac

SEQ ID NO: 1062985 - RNA, 20 nt, Mycobacterium bovis subsp bovis AF2122/97
ugauggugcugcggcguccg

SEQ ID NO: 1062986 - RNA, 16 nt, Mycobacterium bovis subsp bovis AF2122/97
ugaugguggcaacggg

SEQ ID NO: 1062987 - RNA, 18 nt, Mycobacterium bovis subsp bovis AF2122/97
ugaugguguacacgucgc

SEQ ID NO: 1062988 - RNA, 18 nt, Mycobacterium bovis subsp bovis AF2122/97
ugauguacccggcgacgu

SEQ ID NO: 1062989 - RNA, 18 nt, Mycobacterium bovis subsp bovis AF2122/97
ugcaccagguugcaaccu

SEQ ID NO: 1062990 - RNA, 14 nt, Mycobacterium bovis subsp bovis AF2122/97
ugcacccgcaccgg

SEQ ID NO: 1062991 - RNA, 20 nt, Mycobacterium bovis subsp bovis AF2122/97
ugcaccagcugcucgucguc

SEQ ID NO: 1062992 - RNA, 15 nt, Mycobacterium bovis subsp bovis AF2122/97
ugcaccacauuggcg

SEQ ID NO: 1062993 - RNA, 21 nt, Mycobacterium bovis subsp bovis AF2122/97
ugcaccacauuggcgaucagc

SEQ ID NO: 1062994 - RNA, 15 nt, Mycobacterium bovis subsp bovis AF2122/97
ugauggacggugcgc

SEQ ID NO: 1062995 - RNA, 17 nt, Mycobacterium bovis subsp bovis AF2122/97
ugauggacaccagccag

SEQ ID NO: 1062996 - RNA, 22 nt, Mycobacterium bovis subsp bovis AF2122/97
ugauggccucgcgaauccuggc

SEQ ID NO: 1062997 - RNA, 14 nt, Mycobacterium bovis subsp bovis AF2122/97
ugauggccgcgccc

SEQ ID NO: 1062998 - RNA, 15 nt, Mycobacterium bovis subsp bovis AF2122/97
ugaugcguucggccg

SEQ ID NO: 1062999 - RNA, 20 nt, Mycobacterium bovis subsp bovis AF2122/97
ugauggcguuugccggccga

SEQ ID NO: 1063000 - RNA, 21 nt, Mycobacterium bovis subsp bovis AF2122/97
ugauggcguuugccggccgau

SEQ ID NO: 1063001 - RNA, 17 nt, Mycobacterium bovis subsp bovis AF2122/97
ugauggcuccggccgcg

SEQ ID NO: 1063002 - RNA, 22 nt, Mycobacterium bovis subsp bovis AF2122/97
ugauggcggcucguugcgggcg

SEQ ID NO: 1063003 - RNA, 21 nt, Mycobacterium bovis subsp bovis AF2122/97
ugauggucaaugccggccgcg

SEQ ID NO: 1063004 - RNA, 17 nt, Mycobacterium bovis subsp bovis AF2122/97
ugaugggggagccggug

SEQ ID NO: 1063005 - RNA, 13 nt, Mycobacterium bovis subsp bovis AF2122/97
ugcacgccggcgc

SEQ ID NO: 1063006 - RNA, 23 nt, Mycobacterium bovis subsp bovis AF2122/97
ugcacgcccaggcgaccgcugag

SEQ ID NO: 1063007 - RNA, 17 nt, Mycobacterium bovis subsp bovis AF2122/97
ugcacgcucggcgccgu

SEQ ID NO: 1063008 - RNA, 14 nt, Mycobacterium bovis subsp bovis AF2122/97
ugcacgaacgccug

SEQ ID NO: 1063009 - RNA, 19 nt, Mycobacterium bovis subsp bovis AF2122/97
ugcacgacaucgucgcgac

SEQ ID NO: 1063010 - RNA, 16 nt, Mycobacterium bovis subsp bovis AF2122/97
ugcacgacgguguccg

SEQ ID NO: 1063011 - RNA, 21 nt, Mycobacterium bovis subsp bovis AF2122/97
ugcacgacgacaucgagccaa

SEQ ID NO: 1063012 - RNA, 20 nt, Mycobacterium bovis subsp bovis AF2122/97
ugcacgucggcgggcgugug

SEQ ID NO: 1063013 - RNA, 12 nt, Mycobacterium bovis subsp bovis AF2122/97
ugcacgguggca

SEQ ID NO: 1063014 - RNA, 16 nt, Mycobacterium bovis subsp bovis AF2122/97
ugcacggucaugccgc

SEQ ID NO: 1063015 - RNA, 18 nt, Mycobacterium bovis subsp bovis AF2122/97
ugcacggggaccuuggcg

SEQ ID NO: 1063016 - RNA, 14 nt, Mycobacterium bovis subsp bovis AF2122/97
ugcacucggcgccc

SEQ ID NO: 1063017 - RNA, 20 nt, Mycobacterium bovis subsp bovis AF2122/97
ugcagaaacagccgcagcgg

SEQ ID NO: 1063018 - RNA, 23 nt, Mycobacterium bovis subsp bovis AF2122/97
ugaccgaagaagcccgacugguc

SEQ ID NO: 1063019 - RNA, 14 nt, Mycobacterium bovis subsp bovis AF2122/97
ugaccgaccgccau

SEQ ID NO: 1063020 - RNA, 21 nt, Mycobacterium bovis subsp bovis AF2122/97
ugaccgaagucugcagacggu

SEQ ID NO: 1063021 - RNA, 15 nt, Mycobacterium bovis subsp bovis AF2122/97
ugaccgaauggccgc

SEQ ID NO: 1063022 - RNA, 19 nt, Mycobacterium bovis subsp bovis AF2122/97
ugaccgaauggccgccgca

SEQ ID NO: 1063023 - RNA, 21 nt, Mycobacterium bovis subsp bovis AF2122/97
ugacccguacccacgacgggc

SEQ ID NO: 1063024 - RNA, 19 nt, Mycobacterium bovis subsp bovis AF2122/97
ugacccguucagcgacggc

SEQ ID NO: 1063025 - RNA, 19 nt, Mycobacterium bovis subsp bovis AF2122/97
ugacccguuccacgccggc

SEQ ID NO: 1063026 - RNA, 21 nt, Mycobacterium bovis subsp bovis AF2122/97
ugacccucgggucgucgcgau

SEQ ID NO: 1063027 - RNA, 23 nt, Mycobacterium bovis subsp bovis AF2122/97
ugacccucgggucgucgcgaucc

SEQ ID NO: 1063028 - RNA, 14 nt, Mycobacterium bovis subsp bovis AF2122/97
ugaacgccgccccg

SEQ ID NO: 1063029 - RNA, 12 nt, Mycobacterium bovis subsp bovis AF2122/97
ugacccgcuggg

SEQ ID NO: 1063030 - RNA, 17 nt, Mycobacterium bovis subsp bovis AF2122/97
ugacccggcagcccggc

SEQ ID NO: 1063031 - RNA, 18 nt, Mycobacterium bovis subsp bovis AF2122/97
ugaccgcgugagcagacg

SEQ ID NO: 1063032 - RNA, 13 nt, Mycobacterium bovis subsp bovis AF2122/97
ugaccgcugccca

SEQ ID NO: 1063033 - RNA, 17 nt, Mycobacterium bovis subsp bovis AF2122/97
ugaccgcuugcccgcgc

SEQ ID NO: 1063034 - RNA, 18 nt, Mycobacterium bovis subsp bovis AF2122/97
ugaccgcuugcccgcgca

SEQ ID NO: 1063035 - RNA, 22 nt, Mycobacterium bovis subsp bovis AF2122/97
ugaccgcggccgcuuggcguau

SEQ ID NO: 1063036 - RNA, 21 nt, Mycobacterium bovis subsp bovis AF2122/97
ugaccgcgccggacagcgcau

SEQ ID NO: 1063037 - RNA, 14 nt, Mycobacterium bovis subsp bovis AF2122/97
ugaccgcgaucgcc

SEQ ID NO: 1063038 - RNA, 20 nt, Mycobacterium bovis subsp bovis AF2122/97
ugaccgcgaugaucgcaucg

SEQ ID NO: 1063039 - RNA, 20 nt, Mycobacterium bovis subsp bovis AF2122/97
ugaccggaucugacggcgcc

SEQ ID NO: 1063040 - RNA, 16 nt, Mycobacterium bovis subsp bovis AF2122/97
ugaccggccgccaacu

SEQ ID NO: 1063041 - RNA, 23 nt, Mycobacterium bovis subsp bovis AF2122/97
ugaccgccaccgucauggcgggu

SEQ ID NO: 1063042 - RNA, 14 nt, Mycobacterium bovis subsp bovis AF2122/97
ugaccgcaccggcc

SEQ ID NO: 1063043 - RNA, 19 nt, Mycobacterium bovis subsp bovis AF2122/97
ugaccgcaccggccgcuau

SEQ ID NO: 1063044 - RNA, 18 nt, Mycobacterium bovis subsp bovis AF2122/97
ugaccgccgaugcccgac

SEQ ID NO: 1063045 - RNA, 17 nt, Mycobacterium bovis subsp bovis AF2122/97
ugaccgccgcgccggca

SEQ ID NO: 1063046 - RNA, 13 nt, Mycobacterium bovis subsp bovis AF2122/97
ugaccgagccgcg

SEQ ID NO: 1063047 - RNA, 21 nt, Mycobacterium bovis subsp bovis AF2122/97
ugaccgccguugucgaccucc

SEQ ID NO: 1063048 - RNA, 18 nt, Mycobacterium bovis subsp bovis AF2122/97
ugaccucacgggcgccgc

SEQ ID NO: 1063049 - RNA, 16 nt, Mycobacterium bovis subsp bovis AF2122/97
ugaccguucggcgguc

SEQ ID NO: 1063050 - RNA, 13 nt, Mycobacterium bovis subsp bovis AF2122/97
ugaccgugcugaa

SEQ ID NO: 1063051 - RNA, 20 nt, Mycobacterium bovis subsp bovis AF2122/97
ugaccguguggccguuggcc

SEQ ID NO: 1063052 - RNA, 16 nt, Mycobacterium bovis subsp bovis AF2122/97
ugaccguccaccgacg

SEQ ID NO: 1063053 - RNA, 12 nt, Mycobacterium bovis subsp bovis AF2122/97
ugaccgugccgu

SEQ ID NO: 1063054 - RNA, 17 nt, Mycobacterium bovis subsp bovis AF2122/97
ugaccgugccgucggcg

SEQ ID NO: 1063055 - RNA, 22 nt, Mycobacterium bovis subsp bovis AF2122/97
ugaccggggucggccugcggca

SEQ ID NO: 1063056 - RNA, 17 nt, Mycobacterium bovis subsp bovis AF2122/97
ugaccgggucgaugacg

SEQ ID NO: 1063057 - RNA, 17 nt, Mycobacterium bovis subsp bovis AF2122/97
ugaccggcucgccggcg

SEQ ID NO: 1063058 - RNA, 15 nt, Mycobacterium bovis subsp bovis AF2122/97
ugaccggcucggcgg

SEQ ID NO: 1063059 - RNA, 15 nt, Mycobacterium bovis subsp bovis AF2122/97
ugaccgggaggcggc

SEQ ID NO: 1063060 - RNA, 20 nt, Mycobacterium bovis subsp bovis AF2122/97
ugaccgggaggcggcgccgc

SEQ ID NO: 1063061 - RNA, 21 nt, Mycobacterium bovis subsp bovis AF2122/97
ugaccgggaggcggcgccgca

SEQ ID NO: 1063062 - RNA, 16 nt, Mycobacterium bovis subsp bovis AF2122/97
ugaccggucacccgug

SEQ ID NO: 1063063 - RNA, 18 nt, Mycobacterium bovis subsp bovis AF2122/97
ugaccgguauuaccgccg

SEQ ID NO: 1063064 - RNA, 14 nt, Mycobacterium bovis subsp bovis AF2122/97
ugaccguccaccga

SEQ ID NO: 1063065 - RNA, 16 nt, Mycobacterium bovis subsp bovis AF2122/97
ugaccguauagccgac

SEQ ID NO: 1063066 - RNA, 17 nt, Mycobacterium bovis subsp bovis AF2122/97
ugaccguauagccgacg

SEQ ID NO: 1063067 - RNA, 23 nt, Mycobacterium bovis subsp bovis AF2122/97
ugaccguauagccgacgccggug

SEQ ID NO: 1063068 - RNA, 19 nt, Mycobacterium bovis subsp bovis AF2122/97
ugaccucgcgcaccggcug

SEQ ID NO: 1063069 - RNA, 13 nt, Mycobacterium bovis subsp bovis AF2122/97
ugaccugcuggcg

SEQ ID NO: 1063070 - RNA, 15 nt, Mycobacterium bovis subsp bovis AF2122/97
ugaccucggcgacga

SEQ ID NO: 1063071 - RNA, 13 nt, Mycobacterium bovis subsp bovis AF2122/97
ugaccucggcgac

SEQ ID NO: 1063072 - RNA, 14 nt, Mycobacterium bovis subsp bovis AF2122/97
ugaccucggcgacg

SEQ ID NO: 1063073 - RNA, 16 nt, Mycobacterium bovis subsp bovis AF2122/97
ugaccuugggaccacc

SEQ ID NO: 1063074 - RNA, 15 nt, Mycobacterium bovis subsp bovis AF2122/97
ugaccuugcccacca

SEQ ID NO: 1063075 - RNA, 22 nt, Mycobacterium bovis subsp bovis AF2122/97
ugaccuguagaucagcagcggc

SEQ ID NO: 1063076 - RNA, 20 nt, Mycobacterium bovis subsp bovis AF2122/97
ugacgaauugguugcccuug

SEQ ID NO: 1063077 - RNA, 23 nt, Mycobacterium bovis subsp bovis AF2122/97
ugacgaauccacuggucaacggg

SEQ ID NO: 1063078 - RNA, 20 nt, Mycobacterium bovis subsp bovis AF2122/97
ugacgaaggguauccgugug

SEQ ID NO: 1063079 - RNA, 22 nt, Mycobacterium bovis subsp bovis AF2122/97
ugacgaacuggucucggcugag

SEQ ID NO: 1063080 - RNA, 17 nt, Mycobacterium bovis subsp bovis AF2122/97
ugacgaacuucgaugcc

SEQ ID NO: 1063081 - RNA, 18 nt, Mycobacterium bovis subsp bovis AF2122/97
ugacgaacuucgaugccg

SEQ ID NO: 1063082 - RNA, 15 nt, Mycobacterium bovis subsp bovis AF2122/97
ugacgaacccaccgu

SEQ ID NO: 1063083 - RNA, 17 nt, Mycobacterium bovis subsp bovis AF2122/97
ugaccuuguugaccacc

SEQ ID NO: 1063084 - RNA, 19 nt, Mycobacterium bovis subsp bovis AF2122/97
ugacgguccacgacgucga

SEQ ID NO: 1063085 - RNA, 16 nt, Mycobacterium bovis subsp bovis AF2122/97
ugacggguagcguacu

SEQ ID NO: 1063086 - RNA, 20 nt, Mycobacterium bovis subsp bovis AF2122/97
ugacgguccguucgaugcca

SEQ ID NO: 1063087 - RNA, 21 nt, Mycobacterium bovis subsp bovis AF2122/97
ugacgguccguucgaugccag

SEQ ID NO: 1063088 - RNA, 17 nt, Mycobacterium bovis subsp bovis AF2122/97
ugacggggcugaccgcc

SEQ ID NO: 1063089 - RNA, 19 nt, Mycobacterium bovis subsp bovis AF2122/97
ugacggggcugaccgccac

SEQ ID NO: 1063090 - RNA, 20 nt, Mycobacterium bovis subsp bovis AF2122/97
ugacggggcugaccgccacc

SEQ ID NO: 1063091 - RNA, 21 nt, Mycobacterium bovis subsp bovis AF2122/97
ugacgggaaacuccgcggcgc

SEQ ID NO: 1063092 - RNA, 23 nt, Mycobacterium bovis subsp bovis AF2122/97
ugacggcgaacccgccgaugcug

SEQ ID NO: 1063093 - RNA, 17 nt, Mycobacterium bovis subsp bovis AF2122/97
ugacggcgaacccgccg

SEQ ID NO: 1063094 - RNA, 15 nt, Mycobacterium bovis subsp bovis AF2122/97
ugacggccaguuggu

SEQ ID NO: 1063095 - RNA, 20 nt, Mycobacterium bovis subsp bovis AF2122/97
ugacggcuucggcagccgca

SEQ ID NO: 1063096 - RNA, 11 nt, Mycobacterium bovis subsp bovis AF2122/97
ugacggcggca

SEQ ID NO: 1063097 - RNA, 16 nt, Mycobacterium bovis subsp bovis AF2122/97
ugacggcggcaacggc

SEQ ID NO: 1063098 - RNA, 13 nt, Mycobacterium bovis subsp bovis AF2122/97
ugacggcggcccg

SEQ ID NO: 1063099 - RNA, 19 nt, Mycobacterium bovis subsp bovis AF2122/97
ugacggcggcugucggccg

SEQ ID NO: 1063100 - RNA, 20 nt, Mycobacterium bovis subsp bovis AF2122/97
ugacggcggcugucggccgg

SEQ ID NO: 1063101 - RNA, 14 nt, Mycobacterium bovis subsp bovis AF2122/97
ugacggcgguaccg

SEQ ID NO: 1063102 - RNA, 17 nt, Mycobacterium bovis subsp bovis AF2122/97
ugacggcgucgaccucg

SEQ ID NO: 1063103 - RNA, 17 nt, Mycobacterium bovis subsp bovis AF2122/97
ugacgcucggucgccac

SEQ ID NO: 1063104 - RNA, 18 nt, Mycobacterium bovis subsp bovis AF2122/97
ugacggaguuggcccgac

SEQ ID NO: 1063105 - RNA, 14 nt, Mycobacterium bovis subsp bovis AF2122/97
ugacgcuuggccaa

SEQ ID NO: 1063106 - RNA, 18 nt, Mycobacterium bovis subsp bovis AF2122/97
ugacgcucggucgccacc

SEQ ID NO: 1063107 - RNA, 13 nt, Mycobacterium bovis subsp bovis AF2122/97
ugacgcggccaca

SEQ ID NO: 1063108 - RNA, 13 nt, Mycobacterium bovis subsp bovis AF2122/97
ugacgcgcccgac

SEQ ID NO: 1063109 - RNA, 15 nt, Mycobacterium bovis subsp bovis AF2122/97
ugacgcgacgagccg

SEQ ID NO: 1063110 - RNA, 20 nt, Mycobacterium bovis subsp bovis AF2122/97
ugacgcgucagcggcgagca

SEQ ID NO: 1063111 - RNA, 22 nt, Mycobacterium bovis subsp bovis AF2122/97
ugacgcguucaacaccgccgac

SEQ ID NO: 1063112 - RNA, 15 nt, Mycobacterium bovis subsp bovis AF2122/97
ugacgcuaacgucga

SEQ ID NO: 1063113 - RNA, 18 nt, Mycobacterium bovis subsp bovis AF2122/97
ugacgcacgacugugcgc

SEQ ID NO: 1063114 - RNA, 20 nt, Mycobacterium bovis subsp bovis AF2122/97
ugacgcagcucgugaccgcc

SEQ ID NO: 1063115 - RNA, 21 nt, Mycobacterium bovis subsp bovis AF2122/97
ugacgcagcucgugaccgccg

SEQ ID NO: 1063116 - RNA, 17 nt, Mycobacterium bovis subsp bovis AF2122/97
ugacgccacgaccgccg

SEQ ID NO: 1063117 - RNA, 16 nt, Mycobacterium bovis subsp bovis AF2122/97
ugacgaucgcggcggg

SEQ ID NO: 1063118 - RNA, 13 nt, Mycobacterium bovis subsp bovis AF2122/97
ugacgcagcccgc

SEQ ID NO: 1063119 - RNA, 13 nt, Mycobacterium bovis subsp bovis AF2122/97
ugacgccaacgug

SEQ ID NO: 1063120 - RNA, 14 nt, Mycobacterium bovis subsp bovis AF2122/97
ugacgauugccacc

SEQ ID NO: 1063121 - RNA, 16 nt, Mycobacterium bovis subsp bovis AF2122/97
ugacgauggccgccgc

SEQ ID NO: 1063122 - RNA, 16 nt, Mycobacterium bovis subsp bovis AF2122/97
ugacgauugccaccaa

SEQ ID NO: 1063123 - RNA, 14 nt, Mycobacterium bovis subsp bovis AF2122/97
ugacgcaacaucgg

SEQ ID NO: 1063124 - RNA, 20 nt, Mycobacterium bovis subsp bovis AF2122/97
ugacgcacagcagcaccgcg

SEQ ID NO: 1063125 - RNA, 16 nt, Mycobacterium bovis subsp bovis AF2122/97
ugacgcccuccuggcg

SEQ ID NO: 1063126 - RNA, 17 nt, Mycobacterium bovis subsp bovis AF2122/97
ugacgccgucagcggcc

SEQ ID NO: 1063127 - RNA, 18 nt, Mycobacterium bovis subsp bovis AF2122/97
ugacgccgucggcgcgca

SEQ ID NO: 1063128 - RNA, 19 nt, Mycobacterium bovis subsp bovis AF2122/97
ugacgccgucggcgcgcac

SEQ ID NO: 1063129 - RNA, 19 nt, Mycobacterium bovis subsp bovis AF2122/97
ugacgaccggcuaccggcg

SEQ ID NO: 1063130 - RNA, 12 nt, Mycobacterium bovis subsp bovis AF2122/97
ugacgacaaacg

SEQ ID NO: 1063131 - RNA, 17 nt, Mycobacterium bovis subsp bovis AF2122/97
ugacgaccaaccaccga

SEQ ID NO: 1063132 - RNA, 17 nt, Mycobacterium bovis subsp bovis AF2122/97
ugacgacgagggccagc

SEQ ID NO: 1063133 - RNA, 15 nt, Mycobacterium bovis subsp bovis AF2122/97
ugacgacgucgccgc

SEQ ID NO: 1063134 - RNA, 20 nt, Mycobacterium bovis subsp bovis AF2122/97
ugacgacgucgccgccgcgg

SEQ ID NO: 1063135 - RNA, 17 nt, Mycobacterium bovis subsp bovis AF2122/97
ugacgacgccgucggac

SEQ ID NO: 1063136 - RNA, 14 nt, Mycobacterium bovis subsp bovis AF2122/97
ugacgagccaccac

SEQ ID NO: 1063137 - RNA, 16 nt, Mycobacterium bovis subsp bovis AF2122/97
ugacgagccgguggcg

SEQ ID NO: 1063138 - RNA, 17 nt, Mycobacterium bovis subsp bovis AF2122/97
ugacgaugaccgcgcgg

SEQ ID NO: 1063139 - RNA, 19 nt, Mycobacterium bovis subsp bovis AF2122/97
ugacgaugaccgcgcggcc

SEQ ID NO: 1063140 - RNA, 19 nt, Mycobacterium bovis subsp bovis AF2122/97
ugacgaucaggucgccgag

SEQ ID NO: 1063141 - RNA, 20 nt, Mycobacterium bovis subsp bovis AF2122/97
ugacgaucaggucgccgaga

SEQ ID NO: 1063142 - RNA, 17 nt, Mycobacterium bovis subsp bovis AF2122/97
ugacgaucgagcugacg

SEQ ID NO: 1063143 - RNA, 16 nt, Mycobacterium bovis subsp bovis AF2122/97
ugacgaggcgagcggc

SEQ ID NO: 1063144 - RNA, 17 nt, Mycobacterium bovis subsp bovis AF2122/97
ugacgaguucgcugacc

SEQ ID NO: 1063145 - RNA, 23 nt, Mycobacterium bovis subsp bovis AF2122/97
ugacgaguugaugcaagcgggca

SEQ ID NO: 1063146 - RNA, 21 nt, Mycobacterium bovis subsp bovis AF2122/97
ugaucgagcagggugaccagg

SEQ ID NO: 1063147 - RNA, 16 nt, Mycobacterium bovis subsp bovis AF2122/97
ugaucgacggccagcc

SEQ ID NO: 1063148 - RNA, 18 nt, Mycobacterium bovis subsp bovis AF2122/97
ugaucgacggccagccca

SEQ ID NO: 1063149 - RNA, 16 nt, Mycobacterium bovis subsp bovis AF2122/97
ugaucgacuucggcgu

SEQ ID NO: 1063150 - RNA, 16 nt, Mycobacterium bovis subsp bovis AF2122/97
ugaucgaggcggcggu

SEQ ID NO: 1063151 - RNA, 20 nt, Mycobacterium bovis subsp bovis AF2122/97
ugaucgagcaguuccagcuc

SEQ ID NO: 1063152 - RNA, 18 nt, Mycobacterium bovis subsp bovis AF2122/97
ugaucgaucgcggcgccc

SEQ ID NO: 1063153 - RNA, 11 nt, Mycobacterium bovis subsp bovis AF2122/97
ugaucgccacc

SEQ ID NO: 1063154 - RNA, 22 nt, Mycobacterium bovis subsp bovis AF2122/97
ugaucgccgaggccucggccag

SEQ ID NO: 1063155 - RNA, 18 nt, Mycobacterium bovis subsp bovis AF2122/97
ugaucgccaccgguaccg

SEQ ID NO: 1063156 - RNA, 21 nt, Mycobacterium bovis subsp bovis AF2122/97
ugaucgcgauccacccggcau

SEQ ID NO: 1063157 - RNA, 13 nt, Mycobacterium bovis subsp bovis AF2122/97
ugaucgcgguggc

SEQ ID NO: 1063158 - RNA, 16 nt, Mycobacterium bovis subsp bovis AF2122/97
ugaucgcgguccaaca

SEQ ID NO: 1063159 - RNA, 15 nt, Mycobacterium bovis subsp bovis AF2122/97
ugaucgcuggcgacc

SEQ ID NO: 1063160 - RNA, 15 nt, Mycobacterium bovis subsp bovis AF2122/97
ugaucaccgugcggu

SEQ ID NO: 1063161 - RNA, 14 nt, Mycobacterium bovis subsp bovis AF2122/97
ugaucaccguggug

SEQ ID NO: 1063162 - RNA, 23 nt, Mycobacterium bovis subsp bovis AF2122/97
ugaucgacaccgagccacgaccc

SEQ ID NO: 1063163 - RNA, 15 nt, Mycobacterium bovis subsp bovis AF2122/97
ugaucgaacuggggg

SEQ ID NO: 1063164 - RNA, 21 nt, Mycobacterium bovis subsp bovis AF2122/97
ugaucgaacugggggccggca

SEQ ID NO: 1063165 - RNA, 16 nt, Mycobacterium bovis subsp bovis AF2122/97
ugaucgaauacaccug

SEQ ID NO: 1063166 - RNA, 14 nt, Mycobacterium bovis subsp bovis AF2122/97
ugaucacccgcauc

SEQ ID NO: 1063167 - RNA, 18 nt, Mycobacterium bovis subsp bovis AF2122/97
ugaucaaggugucgacgg

SEQ ID NO: 1063168 - RNA, 20 nt, Mycobacterium bovis subsp bovis AF2122/97
ugaucaagaaggccagcgcg

SEQ ID NO: 1063169 - RNA, 21 nt, Mycobacterium bovis subsp bovis AF2122/97
ugaugccuuccgacgaccagg

SEQ ID NO: 1063170 - RNA, 22 nt, Mycobacterium bovis subsp bovis AF2122/97
ugaugagggacgaacacgucua

SEQ ID NO: 1063171 - RNA, 19 nt, Mycobacterium bovis subsp bovis AF2122/97
ugaugaggaucgcguccgc

SEQ ID NO: 1063172 - RNA, 19 nt, Mycobacterium bovis subsp bovis AF2122/97
ugaugacgccgucggcgcg

SEQ ID NO: 1063173 - RNA, 15 nt, Mycobacterium bovis subsp bovis AF2122/97
ugaugaccgccgccg

SEQ ID NO: 1063174 - RNA, 18 nt, Mycobacterium bovis subsp bovis AF2122/97
ugaugaccgccgccggau

SEQ ID NO: 1063175 - RNA, 21 nt, Mycobacterium bovis subsp bovis AF2122/97
ugaugaccguauagccgacgc

SEQ ID NO: 1063176 - RNA, 15 nt, Mycobacterium bovis subsp bovis AF2122/97
ugaugaaacgccguc

SEQ ID NO: 1063177 - RNA, 20 nt, Mycobacterium bovis subsp bovis AF2122/97
ugaugaacgacauccggccg

SEQ ID NO: 1063178 - RNA, 15 nt, Mycobacterium bovis subsp bovis AF2122/97
ugaucuugaaaucgg

SEQ ID NO: 1063179 - RNA, 19 nt, Mycobacterium bovis subsp bovis AF2122/97
ugaucugcuugccaccgcc

SEQ ID NO: 1063180 - RNA, 20 nt, Mycobacterium bovis subsp bovis AF2122/97
ugaucuccacggcggugccg

SEQ ID NO: 1063181 - RNA, 17 nt, Mycobacterium bovis subsp bovis AF2122/97
ugaucugagcgcgggug

SEQ ID NO: 1063182 - RNA, 21 nt, Mycobacterium bovis subsp bovis AF2122/97
ugaucggcgaacccaccgcau

SEQ ID NO: 1063183 - RNA, 16 nt, Mycobacterium bovis subsp bovis AF2122/97
ugaucggcacgcgcag

SEQ ID NO: 1063184 - RNA, 21 nt, Mycobacterium bovis subsp bovis AF2122/97
ugaucggcaggguggccagca

SEQ ID NO: 1063185 - RNA, 14 nt, Mycobacterium bovis subsp bovis AF2122/97
ugaucggugggcgg

SEQ ID NO: 1063186 - RNA, 23 nt, Mycobacterium bovis subsp bovis AF2122/97
ugaucggcgaggucccggccgag

SEQ ID NO: 1063187 - RNA, 15 nt, Mycobacterium bovis subsp bovis AF2122/97
ugaucggugcccaac

SEQ ID NO: 1063188 - RNA, 18 nt, Mycobacterium bovis subsp bovis AF2122/97
ugaucgugaacacgucgc

SEQ ID NO: 1063189 - RNA, 17 nt, Mycobacterium bovis subsp bovis AF2122/97
ugaucgucccgcggcgc

SEQ ID NO: 1063190 - RNA, 19 nt, Mycobacterium bovis subsp bovis AF2122/97
ugaucgugcuggcgacgua

SEQ ID NO: 1063191 - RNA, 18 nt, Mycobacterium bovis subsp bovis AF2122/97
ugagcgccaggccgcaca

SEQ ID NO: 1063192 - RNA, 19 nt, Mycobacterium bovis subsp bovis AF2122/97
ugagcgccaggccgcacag

SEQ ID NO: 1063193 - RNA, 15 nt, Mycobacterium bovis subsp bovis AF2122/97
ugagcgccacgccga

SEQ ID NO: 1063194 - RNA, 22 nt, Mycobacterium bovis subsp bovis AF2122/97
ugagcgcaaccagcaaugccga

SEQ ID NO: 1063195 - RNA, 15 nt, Mycobacterium bovis subsp bovis AF2122/97
ugagcgcucgggcaa

SEQ ID NO: 1063196 - RNA, 20 nt, Mycobacterium bovis subsp bovis AF2122/97
ugagcgcggcuacggucgca

SEQ ID NO: 1063197 - RNA, 16 nt, Mycobacterium bovis subsp bovis AF2122/97
ugagcgccgcggcgga

SEQ ID NO: 1063198 - RNA, 22 nt, Mycobacterium bovis subsp bovis AF2122/97
ugagcgacugcagcggcgcaua

SEQ ID NO: 1063199 - RNA, 20 nt, Mycobacterium bovis subsp bovis AF2122/97
ugaggacuugcacgucggcu

SEQ ID NO: 1063200 - RNA, 15 nt, Mycobacterium bovis subsp bovis AF2122/97
ugaggaagcggcggc

SEQ ID NO: 1063201 - RNA, 15 nt, Mycobacterium bovis subsp bovis AF2122/97
ugacuaccaccgcgu

SEQ ID NO: 1063202 - RNA, 21 nt, Mycobacterium bovis subsp bovis AF2122/97
ugacucgggcacgggugacga

SEQ ID NO: 1063203 - RNA, 20 nt, Mycobacterium bovis subsp bovis AF2122/97
ugacucugcguccaccacgc

SEQ ID NO: 1063204 - RNA, 20 nt, Mycobacterium bovis subsp bovis AF2122/97
ugacuccugcggcaccgcug

SEQ ID NO: 1063205 - RNA, 18 nt, Mycobacterium bovis subsp bovis AF2122/97
ugacguugcagccggcau

SEQ ID NO: 1063206 - RNA, 15 nt, Mycobacterium bovis subsp bovis AF2122/97
ugacgguguuggugg

SEQ ID NO: 1063207 - RNA, 18 nt, Mycobacterium bovis subsp bovis AF2122/97
ugacgugugagggccggg

SEQ ID NO: 1063208 - RNA, 14 nt, Mycobacterium bovis subsp bovis AF2122/97
ugaggcaccucggc

SEQ ID NO: 1063209 - RNA, 23 nt, Mycobacterium bovis subsp bovis AF2122/97
ugaggccggacuuuaaaccgaac

SEQ ID NO: 1063210 - RNA, 21 nt, Mycobacterium bovis subsp bovis AF2122/97
ugaggccggugaacggcagca

SEQ ID NO: 1063211 - RNA, 17 nt, Mycobacterium bovis subsp bovis AF2122/97
ugaguguugccgacgag

SEQ ID NO: 1063212 - RNA, 13 nt, Mycobacterium bovis subsp bovis AF2122/97
ugaguucggccac

SEQ ID NO: 1063213 - RNA, 12 nt, Mycobacterium bovis subsp bovis AF2122/97
ugaguucggcgg

SEQ ID NO: 1063214 - RNA, 21 nt, Mycobacterium bovis subsp bovis AF2122/97
ugaguuccuugaugcggccgc

SEQ ID NO: 1063215 - RNA, 19 nt, Mycobacterium bovis subsp bovis AF2122/97
ugaguugcccguucaugcg

SEQ ID NO: 1063216 - RNA, 14 nt, Mycobacterium bovis subsp bovis AF2122/97
ugaguucacguucg

SEQ ID NO: 1063217 - RNA, 13 nt, Mycobacterium bovis subsp bovis AF2122/97
ugauaccugccca

SEQ ID NO: 1063218 - RNA, 12 nt, Mycobacterium bovis subsp bovis AF2122/97
accgccuccacc

SEQ ID NO: 1063219 - RNA, 21 nt, Mycobacterium bovis subsp bovis AF2122/97
accgccuccucgauagcggcg

SEQ ID NO: 1063220 - RNA, 18 nt, Mycobacterium bovis subsp bovis AF2122/97
accgccugcucggcgacc

SEQ ID NO: 1063221 - RNA, 18 nt, Mycobacterium bovis subsp bovis AF2122/97
accgccugcgcggcugcc

SEQ ID NO: 1063222 - RNA, 20 nt, Mycobacterium bovis subsp bovis AF2122/97
accgccucgucgaugccuag

SEQ ID NO: 1063223 - RNA, 14 nt, Mycobacterium bovis subsp bovis AF2122/97
accgccugcgccgc

SEQ ID NO: 1063224 - RNA, 17 nt, Mycobacterium bovis subsp bovis AF2122/97
accgccguggcccgcuc

SEQ ID NO: 1063225 - RNA, 21 nt, Mycobacterium bovis subsp bovis AF2122/97
accgccgucggguugcgacga

SEQ ID NO: 1063226 - RNA, 22 nt, Mycobacterium bovis subsp bovis AF2122/97
accgccgucggguugcgacgaa

SEQ ID NO: 1063227 - RNA, 14 nt, Mycobacterium bovis subsp bovis AF2122/97
accgccgucgccac

SEQ ID NO: 1063228 - RNA, 13 nt, Mycobacterium bovis subsp bovis AF2122/97
accgccgcugccg

SEQ ID NO: 1063229 - RNA, 12 nt, Mycobacterium bovis subsp bovis AF2122/97
accgccggcccc

SEQ ID NO: 1063230 - RNA, 21 nt, Mycobacterium bovis subsp bovis AF2122/97
accgccggccccaccggugcc

SEQ ID NO: 1063231 - RNA, 21 nt, Mycobacterium bovis subsp bovis AF2122/97
accgccgcugccgguggcggc

SEQ ID NO: 1063232 - RNA, 18 nt, Mycobacterium bovis subsp bovis AF2122/97
accgccguuaccgccguu

SEQ ID NO: 1063233 - RNA, 22 nt, Mycobacterium bovis subsp bovis AF2122/97
accgccguggguguugaugggc

SEQ ID NO: 1063234 - RNA, 21 nt, Mycobacterium bovis subsp bovis AF2122/97
accgccguuaccgacgccggu

SEQ ID NO: 1063235 - RNA, 13 nt, Mycobacterium bovis subsp bovis AF2122/97
accgccguugccg

SEQ ID NO: 1063236 - RNA, 23 nt, Mycobacterium bovis subsp bovis AF2122/97
accgccguugccguacagcccgg

SEQ ID NO: 1063237 - RNA, 17 nt, Mycobacterium bovis subsp bovis AF2122/97
accgccguugccgccgg

SEQ ID NO: 1063238 - RNA, 19 nt, Mycobacterium bovis subsp bovis AF2122/97
accgccguugccgccggcg

SEQ ID NO: 1063239 - RNA, 23 nt, Mycobacterium bovis subsp bovis AF2122/97
accgccguugccgccggcgccgc

SEQ ID NO: 1063240 - RNA, 17 nt, Mycobacterium bovis subsp bovis AF2122/97
accgccuugucggcgau

SEQ ID NO: 1063241 - RNA, 14 nt, Mycobacterium bovis subsp bovis AF2122/97
accgccugugccgc

SEQ ID NO: 1063242 - RNA, 17 nt, Mycobacterium bovis subsp bovis AF2122/97
accgccugugccgccgg

SEQ ID NO: 1063243 - RNA, 18 nt, Mycobacterium bovis subsp bovis AF2122/97
accgccugugccgccggc

SEQ ID NO: 1063244 - RNA, 15 nt, Mycobacterium bovis subsp bovis AF2122/97
accgccugcuggccg

SEQ ID NO: 1063245 - RNA, 19 nt, Mycobacterium bovis subsp bovis AF2122/97
accgccugcuggccgcggc

SEQ ID NO: 1063246 - RNA, 13 nt, Mycobacterium bovis subsp bovis AF2122/97
accgccugggcgg

SEQ ID NO: 1063247 - RNA, 16 nt, Mycobacterium bovis subsp bovis AF2122/97
accgccugggcggcca

SEQ ID NO: 1063248 - RNA, 22 nt, Mycobacterium bovis subsp bovis AF2122/97
accgcgacaacaacucuucggc

SEQ ID NO: 1063249 - RNA, 16 nt, Mycobacterium bovis subsp bovis AF2122/97
accgcgaagccgaccg

SEQ ID NO: 1063250 - RNA, 15 nt, Mycobacterium bovis subsp bovis AF2122/97
accgccuuugcccgc

SEQ ID NO: 1063251 - RNA, 17 nt, Mycobacterium bovis subsp bovis AF2122/97
accgccuuugcccgccg

SEQ ID NO: 1063252 - RNA, 18 nt, Mycobacterium bovis subsp bovis AF2122/97
accgccuuugccgccggc

SEQ ID NO: 1063253 - RNA, 20 nt, Mycobacterium bovis subsp bovis AF2122/97
accgccuuugccgccggcac

SEQ ID NO: 1063254 - RNA, 19 nt, Mycobacterium bovis subsp bovis AF2122/97
accgcgaugaucgcaucga

SEQ ID NO: 1063255 - RNA, 13 nt, Mycobacterium bovis subsp bovis AF2122/97
accgcgaucgccg

SEQ ID NO: 1063256 - RNA, 18 nt, Mycobacterium bovis subsp bovis AF2122/97
accgcgaccgcgcacggc

SEQ ID NO: 1063257 - RNA, 16 nt, Mycobacterium bovis subsp bovis AF2122/97
accgcgaucaccaccg

SEQ ID NO: 1063258 - RNA, 17 nt, Mycobacterium bovis subsp bovis AF2122/97
accgcgagggccagcaa

SEQ ID NO: 1063259 - RNA, 21 nt, Mycobacterium bovis subsp bovis AF2122/97
accgcgaugccccacggugcg

SEQ ID NO: 1063260 - RNA, 17 nt, Mycobacterium bovis subsp bovis AF2122/97
accgcgcagaacgaucg

SEQ ID NO: 1063261 - RNA, 13 nt, Mycobacterium bovis subsp bovis AF2122/97
accgcgacgacga

SEQ ID NO: 1063262 - RNA, 14 nt, Mycobacterium bovis subsp bovis AF2122/97
accgcgaccgcgca

SEQ ID NO: 1063263 - RNA, 14 nt, Mycobacterium bovis subsp bovis AF2122/97
accgcgaccgcauu

SEQ ID NO: 1063264 - RNA, 15 nt, Mycobacterium bovis subsp bovis AF2122/97
accgcgacccggccc

SEQ ID NO: 1063265 - RNA, 18 nt, Mycobacterium bovis subsp bovis AF2122/97
accgcgacggcgccggca

SEQ ID NO: 1063266 - RNA, 14 nt, Mycobacterium bovis subsp bovis AF2122/97
accgcgacggcgcc

SEQ ID NO: 1063267 - RNA, 14 nt, Mycobacterium bovis subsp bovis AF2122/97
accgcgagcagcac

SEQ ID NO: 1063268 - RNA, 22 nt, Mycobacterium bovis subsp bovis AF2122/97
accgcgccuggagcgaucuccg

SEQ ID NO: 1063269 - RNA, 13 nt, Mycobacterium bovis subsp bovis AF2122/97
accgcgccggcgg

SEQ ID NO: 1063270 - RNA, 12 nt, Mycobacterium bovis subsp bovis AF2122/97
accgcgccgaac

SEQ ID NO: 1063271 - RNA, 15 nt, Mycobacterium bovis subsp bovis AF2122/97
accgcgccgaacacg

SEQ ID NO: 1063272 - RNA, 17 nt, Mycobacterium bovis subsp bovis AF2122/97
accgcgccgagcagacg

SEQ ID NO: 1063273 - RNA, 15 nt, Mycobacterium bovis subsp bovis AF2122/97
accgcgccgaucacc

SEQ ID NO: 1063274 - RNA, 17 nt, Mycobacterium bovis subsp bovis AF2122/97
accgcgcacggcuggcg

SEQ ID NO: 1063275 - RNA, 16 nt, Mycobacterium bovis subsp bovis AF2122/97
accgcgcccagaccga

SEQ ID NO: 1063276 - RNA, 21 nt, Mycobacterium bovis subsp bovis AF2122/97
accgcgcccgcgggcaguggc

SEQ ID NO: 1063277 - RNA, 19 nt, Mycobacterium bovis subsp bovis AF2122/97
accgcgcccuucagcacgg

SEQ ID NO: 1063278 - RNA, 18 nt, Mycobacterium bovis subsp bovis AF2122/97
accgcgcccgccgauccu

SEQ ID NO: 1063279 - RNA, 17 nt, Mycobacterium bovis subsp bovis AF2122/97
accgcgcccgccgcggc

SEQ ID NO: 1063280 - RNA, 15 nt, Mycobacterium bovis subsp bovis AF2122/97
accgcgccaacuccg

SEQ ID NO: 1063281 - RNA, 20 nt, Mycobacterium bovis subsp bovis AF2122/97
accgcgccagguacucggug

SEQ ID NO: 1063282 - RNA, 22 nt, Mycobacterium bovis subsp bovis AF2122/97
accgcgccauagcagagccggg

SEQ ID NO: 1063283 - RNA, 15 nt, Mycobacterium bovis subsp bovis AF2122/97
accgcgcaucaucgc

SEQ ID NO: 1063284 - RNA, 18 nt, Mycobacterium bovis subsp bovis AF2122/97
accgcgcagaacgaucgc

SEQ ID NO: 1063285 - RNA, 14 nt, Mycobacterium bovis subsp bovis AF2122/97
accgccgagcgggu

SEQ ID NO: 1063286 - RNA, 15 nt, Mycobacterium bovis subsp bovis AF2122/97
accgccgacggcgcc

SEQ ID NO: 1063287 - RNA, 12 nt, Mycobacterium bovis subsp bovis AF2122/97
accgccgagcgg

SEQ ID NO: 1063288 - RNA, 20 nt, Mycobacterium bovis subsp bovis AF2122/97
accgccgacgccguugccca

SEQ ID NO: 1063289 - RNA, 23 nt, Mycobacterium bovis subsp bovis AF2122/97
accgccgacgccguugcccacgu

SEQ ID NO: 1063290 - RNA, 21 nt, Mycobacterium bovis subsp bovis AF2122/97
accgccgcacgcuagccgaca

SEQ ID NO: 1063291 - RNA, 15 nt, Mycobacterium bovis subsp bovis AF2122/97
accgccgccaagcuc

SEQ ID NO: 1063292 - RNA, 12 nt, Mycobacterium bovis subsp bovis AF2122/97
accgccgccacc

SEQ ID NO: 1063293 - RNA, 12 nt, Mycobacterium bovis subsp bovis AF2122/97
accgccgcggcc

SEQ ID NO: 1063294 - RNA, 13 nt, Mycobacterium bovis subsp bovis AF2122/97
accgccgcggucg

SEQ ID NO: 1063295 - RNA, 15 nt, Mycobacterium bovis subsp bovis AF2122/97
accgccgaucggcca

SEQ ID NO: 1063296 - RNA, 16 nt, Mycobacterium bovis subsp bovis AF2122/97
accgccgcgucgagca

SEQ ID NO: 1063297 - RNA, 14 nt, Mycobacterium bovis subsp bovis AF2122/97
accgccggaccgcc

SEQ ID NO: 1063298 - RNA, 12 nt, Mycobacterium bovis subsp bovis AF2122/97
accgccggcacc

SEQ ID NO: 1063299 - RNA, 19 nt, Mycobacterium bovis subsp bovis AF2122/97
accgccggcagcaucggca

SEQ ID NO: 1063300 - RNA, 14 nt, Mycobacterium bovis subsp bovis AF2122/97
accgccggcaccgc

SEQ ID NO: 1063301 - RNA, 18 nt, Mycobacterium bovis subsp bovis AF2122/97
accgccggcaccgccagu

SEQ ID NO: 1063302 - RNA, 18 nt, Mycobacterium bovis subsp bovis AF2122/97
accgccggcaccgccgcc

SEQ ID NO: 1063303 - RNA, 15 nt, Mycobacterium bovis subsp bovis AF2122/97
accgccagccaccac

SEQ ID NO: 1063304 - RNA, 14 nt, Mycobacterium bovis subsp bovis AF2122/97
accgccagccccgc

SEQ ID NO: 1063305 - RNA, 15 nt, Mycobacterium bovis subsp bovis AF2122/97
accgccagccgcgag

SEQ ID NO: 1063306 - RNA, 14 nt, Mycobacterium bovis subsp bovis AF2122/97
accgccagcgccac

SEQ ID NO: 1063307 - RNA, 17 nt, Mycobacterium bovis subsp bovis AF2122/97
accgccagcgccaccgu

SEQ ID NO: 1063308 - RNA, 14 nt, Mycobacterium bovis subsp bovis AF2122/97
accgccagcgccgc

SEQ ID NO: 1063309 - RNA, 13 nt, Mycobacterium bovis subsp bovis AF2122/97
accgccgacgaac

SEQ ID NO: 1063310 - RNA, 18 nt, Mycobacterium bovis subsp bovis AF2122/97
accgccgaccggaccggg

SEQ ID NO: 1063311 - RNA, 21 nt, Mycobacterium bovis subsp bovis AF2122/97
accgccgaccuagucaccuug

SEQ ID NO: 1063312 - RNA, 21 nt, Mycobacterium bovis subsp bovis AF2122/97
accgccaaacgcugcgcccgg

SEQ ID NO: 1063313 - RNA, 17 nt, Mycobacterium bovis subsp bovis AF2122/97
accgccaaaaacgccag

SEQ ID NO: 1063314 - RNA, 17 nt, Mycobacterium bovis subsp bovis AF2122/97
accgcauucggacgcca

SEQ ID NO: 1063315 - RNA, 13 nt, Mycobacterium bovis subsp bovis AF2122/97
accgcagcgggcg

SEQ ID NO: 1063316 - RNA, 18 nt, Mycobacterium bovis subsp bovis AF2122/97
accgcaggcacaucgcga

SEQ ID NO: 1063317 - RNA, 14 nt, Mycobacterium bovis subsp bovis AF2122/97
accgcagccaacgu

SEQ ID NO: 1063318 - RNA, 19 nt, Mycobacterium bovis subsp bovis AF2122/97
accgcagccaacgucacca

SEQ ID NO: 1063319 - RNA, 18 nt, Mycobacterium bovis subsp bovis AF2122/97
accgcagauccccgccac

SEQ ID NO: 1063320 - RNA, 13 nt, Mycobacterium bovis subsp bovis AF2122/97
accgcagucgcgg

SEQ ID NO: 1063321 - RNA, 14 nt, Mycobacterium bovis subsp bovis AF2122/97
accgcagucgcugg

SEQ ID NO: 1063322 - RNA, 22 nt, Mycobacterium bovis subsp bovis AF2122/97
accgcaggccgaagacgugccg

SEQ ID NO: 1063323 - RNA, 15 nt, Mycobacterium bovis subsp bovis AF2122/97
accgcaggguccaca

SEQ ID NO: 1063324 - RNA, 17 nt, Mycobacterium bovis subsp bovis AF2122/97
accgcaggugccaccug

SEQ ID NO: 1063325 - RNA, 23 nt, Mycobacterium bovis subsp bovis AF2122/97
accgcaggugccguggcuaccgc

SEQ ID NO: 1063326 - RNA, 22 nt, Mycobacterium bovis subsp bovis AF2122/97
accgcauucguggagccggccg

SEQ ID NO: 1063327 - RNA, 23 nt, Mycobacterium bovis subsp bovis AF2122/97
accgcaucgguggggcgccgggg

SEQ ID NO: 1063328 - RNA, 15 nt, Mycobacterium bovis subsp bovis AF2122/97
accgcaucggcagcc

SEQ ID NO: 1063329 - RNA, 15 nt, Mycobacterium bovis subsp bovis AF2122/97
accgcaucgucgagc

SEQ ID NO: 1063330 - RNA, 21 nt, Mycobacterium bovis subsp bovis AF2122/97
accgcaucgucgagccacagc

SEQ ID NO: 1063331 - RNA, 19 nt, Mycobacterium bovis subsp bovis AF2122/97
accgcacggugaccacgcc

SEQ ID NO: 1063332 - RNA, 22 nt, Mycobacterium bovis subsp bovis AF2122/97
accgacgaucaacggaacaucg

SEQ ID NO: 1063333 - RNA, 20 nt, Mycobacterium bovis subsp bovis AF2122/97
accgacgcaccucgguggcu

SEQ ID NO: 1063334 - RNA, 14 nt, Mycobacterium bovis subsp bovis AF2122/97
accgacgaucaacg

SEQ ID NO: 1063335 - RNA, 17 nt, Mycobacterium bovis subsp bovis AF2122/97
accgcacggugcugauc

SEQ ID NO: 1063336 - RNA, 21 nt, Mycobacterium bovis subsp bovis AF2122/97
accgcacuugaucgacggcca

SEQ ID NO: 1063337 - RNA, 15 nt, Mycobacterium bovis subsp bovis AF2122/97
accgaccuggacgcg

SEQ ID NO: 1063338 - RNA, 22 nt, Mycobacterium bovis subsp bovis AF2122/97
accgaccuacugcggucgccca

SEQ ID NO: 1063339 - RNA, 18 nt, Mycobacterium bovis subsp bovis AF2122/97
accgaccgcaccgugccg

SEQ ID NO: 1063340 - RNA, 18 nt, Mycobacterium bovis subsp bovis AF2122/97
accgaccgcaugaucgca

SEQ ID NO: 1063341 - RNA, 20 nt, Mycobacterium bovis subsp bovis AF2122/97
accgaccgcaugaucgcacc

SEQ ID NO: 1063342 - RNA, 12 nt, Mycobacterium bovis subsp bovis AF2122/97
accgaccgcguu

SEQ ID NO: 1063343 - RNA, 22 nt, Mycobacterium bovis subsp bovis AF2122/97
accgaccgcguuguccgcggcc

SEQ ID NO: 1063344 - RNA, 14 nt, Mycobacterium bovis subsp bovis AF2122/97
accgaccgggucgc

SEQ ID NO: 1063345 - RNA, 20 nt, Mycobacterium bovis subsp bovis AF2122/97
accgaccgggucgcaaccgc

SEQ ID NO: 1063346 - RNA, 14 nt, Mycobacterium bovis subsp bovis AF2122/97
accgacccggccgc

SEQ ID NO: 1063347 - RNA, 19 nt, Mycobacterium bovis subsp bovis AF2122/97
accgacccggccgcugacg

SEQ ID NO: 1063348 - RNA, 19 nt, Mycobacterium bovis subsp bovis AF2122/97
accgacccgcugccaccca

SEQ ID NO: 1063349 - RNA, 18 nt, Mycobacterium bovis subsp bovis AF2122/97
accgaccagggccgccgc

SEQ ID NO: 1063350 - RNA, 23 nt, Mycobacterium bovis subsp bovis AF2122/97
accgaccagggccgccgcugccg

SEQ ID NO: 1063351 - RNA, 13 nt, Mycobacterium bovis subsp bovis AF2122/97
accgggucgccga

SEQ ID NO: 1063352 - RNA, 17 nt, Mycobacterium bovis subsp bovis AF2122/97
accgggcuggccagcgc

SEQ ID NO: 1063353 - RNA, 14 nt, Mycobacterium bovis subsp bovis AF2122/97
accgggucgcaacc

SEQ ID NO: 1063354 - RNA, 19 nt, Mycobacterium bovis subsp bovis AF2122/97
accgggucgggcaccgcgc

SEQ ID NO: 1063355 - RNA, 17 nt, Mycobacterium bovis subsp bovis AF2122/97
accgguaacgccaacac

SEQ ID NO: 1063356 - RNA, 21 nt, Mycobacterium bovis subsp bovis AF2122/97
accgguaacgccaacaccggc

SEQ ID NO: 1063357 - RNA, 22 nt, Mycobacterium bovis subsp bovis AF2122/97
accgguaacgccaacaccggca

SEQ ID NO: 1063358 - RNA, 23 nt, Mycobacterium bovis subsp bovis AF2122/97
accgggugggucguucaccgauc

SEQ ID NO: 1063359 - RNA, 12 nt, Mycobacterium bovis subsp bovis AF2122/97
accgggugugcg

SEQ ID NO: 1063360 - RNA, 15 nt, Mycobacterium bovis subsp bovis AF2122/97
accgggugugcgucg

SEQ ID NO: 1063361 - RNA, 18 nt, Mycobacterium bovis subsp bovis AF2122/97
accggguugagccgccgc

SEQ ID NO: 1063362 - RNA, 14 nt, Mycobacterium bovis subsp bovis AF2122/97
accgggugcaggug

SEQ ID NO: 1063363 - RNA, 22 nt, Mycobacterium bovis subsp bovis AF2122/97
accggggacagcccggcagaug

SEQ ID NO: 1063364 - RNA, 21 nt, Mycobacterium bovis subsp bovis AF2122/97
accggggacgucgacuucgcc

SEQ ID NO: 1063365 - RNA, 18 nt, Mycobacterium bovis subsp bovis AF2122/97
accgggggaagcgguagc

SEQ ID NO: 1063366 - RNA, 20 nt, Mycobacterium bovis subsp bovis AF2122/97
accgggucgaugacgccguc

SEQ ID NO: 1063367 - RNA, 20 nt, Mycobacterium bovis subsp bovis AF2122/97
accggguaaugcgacgccgg

SEQ ID NO: 1063368 - RNA, 22 nt, Mycobacterium bovis subsp bovis AF2122/97
accggggucaccuuggccgggu

SEQ ID NO: 1063369 - RNA, 15 nt, Mycobacterium bovis subsp bovis AF2122/97
accgggucgaucacc

SEQ ID NO: 1063370 - RNA, 15 nt, Mycobacterium bovis subsp bovis AF2122/97
accgggucgaugacg

SEQ ID NO: 1063371 - RNA, 14 nt, Mycobacterium bovis subsp bovis AF2122/97
accgggcgugccau

SEQ ID NO: 1063372 - RNA, 20 nt, Mycobacterium bovis subsp bovis AF2122/97
accgggcucagacuuucgcc

SEQ ID NO: 1063373 - RNA, 20 nt, Mycobacterium bovis subsp bovis AF2122/97
accgggcuccaauugcggcc

SEQ ID NO: 1063374 - RNA, 21 nt, Mycobacterium bovis subsp bovis AF2122/97
accgggcuccaauugcggccg

SEQ ID NO: 1063375 - RNA, 12 nt, Mycobacterium bovis subsp bovis AF2122/97
accgggcucugg

SEQ ID NO: 1063376 - RNA, 19 nt, Mycobacterium bovis subsp bovis AF2122/97
accggcugcaggugcuggu

SEQ ID NO: 1063377 - RNA, 17 nt, Mycobacterium bovis subsp bovis AF2122/97
accgggcgagucccggc

SEQ ID NO: 1063378 - RNA, 22 nt, Mycobacterium bovis subsp bovis AF2122/97
accggcucggaaaccgccccgu

SEQ ID NO: 1063379 - RNA, 15 nt, Mycobacterium bovis subsp bovis AF2122/97
accggcucgaucucg

SEQ ID NO: 1063380 - RNA, 19 nt, Mycobacterium bovis subsp bovis AF2122/97
accggcuggccagguggcc

SEQ ID NO: 1063381 - RNA, 21 nt, Mycobacterium bovis subsp bovis AF2122/97
accggcuggccagguggccgc

SEQ ID NO: 1063382 - RNA, 23 nt, Mycobacterium bovis subsp bovis AF2122/97
accggcugcaaccagcggcacau

SEQ ID NO: 1063383 - RNA, 14 nt, Mycobacterium bovis subsp bovis AF2122/97
accggcggcgacgg

SEQ ID NO: 1063384 - RNA, 18 nt, Mycobacterium bovis subsp bovis AF2122/97
accggcggcgagcggccu

SEQ ID NO: 1063385 - RNA, 20 nt, Mycobacterium bovis subsp bovis AF2122/97
accggcggcgagcggccucc

SEQ ID NO: 1063386 - RNA, 15 nt, Mycobacterium bovis subsp bovis AF2122/97
accggcggcgacggc

SEQ ID NO: 1063387 - RNA, 17 nt, Mycobacterium bovis subsp bovis AF2122/97
accggcggcgacggcgg

SEQ ID NO: 1063388 - RNA, 18 nt, Mycobacterium bovis subsp bovis AF2122/97
accggcggcgacggugcc

SEQ ID NO: 1063389 - RNA, 23 nt, Mycobacterium bovis subsp bovis AF2122/97
accggcggcgacggugccaccgc

SEQ ID NO: 1063390 - RNA, 11 nt, Mycobacterium bovis subsp bovis AF2122/97
accggcggcga

SEQ ID NO: 1063391 - RNA, 14 nt, Mycobacterium bovis subsp bovis AF2122/97
accggcggcaucga

SEQ ID NO: 1063392 - RNA, 22 nt, Mycobacterium bovis subsp bovis AF2122/97
accggcggcaucgaguucggcc

SEQ ID NO: 1063393 - RNA, 15 nt, Mycobacterium bovis subsp bovis AF2122/97
accggcggcgccgga

SEQ ID NO: 1063394 - RNA, 17 nt, Mycobacterium bovis subsp bovis AF2122/97
accggcggcgccggccu

SEQ ID NO: 1063395 - RNA, 16 nt, Mycobacterium bovis subsp bovis AF2122/97
accggcggcgccgggg

SEQ ID NO: 1063396 - RNA, 20 nt, Mycobacterium bovis subsp bovis AF2122/97
accggcuacggcgacacgcc

SEQ ID NO: 1063397 - RNA, 21 nt, Mycobacterium bovis subsp bovis AF2122/97
accggcuagcaguuagccggg

SEQ ID NO: 1063398 - RNA, 18 nt, Mycobacterium bovis subsp bovis AF2122/97
accggcuaugcuggcgca

SEQ ID NO: 1063399 - RNA, 16 nt, Mycobacterium bovis subsp bovis AF2122/97
accggcucaccacgcc

SEQ ID NO: 1063400 - RNA, 22 nt, Mycobacterium bovis subsp bovis AF2122/97
accggcgcggaacgcgucgccg

SEQ ID NO: 1063401 - RNA, 16 nt, Mycobacterium bovis subsp bovis AF2122/97
accggcgcgggcacgc

SEQ ID NO: 1063402 - RNA, 19 nt, Mycobacterium bovis subsp bovis AF2122/97
accggcgcgaccgcggcga

SEQ ID NO: 1063403 - RNA, 15 nt, Mycobacterium bovis subsp bovis AF2122/97
accggcgcgccccgc

SEQ ID NO: 1063404 - RNA, 16 nt, Mycobacterium bovis subsp bovis AF2122/97
accggcgcgccccgcc

SEQ ID NO: 1063405 - RNA, 21 nt, Mycobacterium bovis subsp bovis AF2122/97
accggcgcgccccgccgcacg

SEQ ID NO: 1063406 - RNA, 15 nt, Mycobacterium bovis subsp bovis AF2122/97
accggcgaucaccgu

SEQ ID NO: 1063407 - RNA, 13 nt, Mycobacterium bovis subsp bovis AF2122/97
accggcgaucggg

SEQ ID NO: 1063408 - RNA, 15 nt, Mycobacterium bovis subsp bovis AF2122/97
accggcaccgcugcc

SEQ ID NO: 1063409 - RNA, 16 nt, Mycobacterium bovis subsp bovis AF2122/97
accggcaccgcugccg

SEQ ID NO: 1063410 - RNA, 23 nt, Mycobacterium bovis subsp bovis AF2122/97
accggcaccgcugccgcugccga

SEQ ID NO: 1063411 - RNA, 19 nt, Mycobacterium bovis subsp bovis AF2122/97
accggcaccggccgugccg

SEQ ID NO: 1063412 - RNA, 13 nt, Mycobacterium bovis subsp bovis AF2122/97
accggcacccgca

SEQ ID NO: 1063413 - RNA, 13 nt, Mycobacterium bovis subsp bovis AF2122/97
accggcacccgcg

SEQ ID NO: 1063414 - RNA, 16 nt, Mycobacterium bovis subsp bovis AF2122/97
accggcacccgcggcg

SEQ ID NO: 1063415 - RNA, 17 nt, Mycobacterium bovis subsp bovis AF2122/97
accggcacccgcggcga

SEQ ID NO: 1063416 - RNA, 13 nt, Mycobacterium bovis subsp bovis AF2122/97
accggcacccgcu

SEQ ID NO: 1063417 - RNA, 20 nt, Mycobacterium bovis subsp bovis AF2122/97
accggcaccagcggcaccgc

SEQ ID NO: 1063418 - RNA, 19 nt, Mycobacterium bovis subsp bovis AF2122/97
accggcacccccgucgcca

SEQ ID NO: 1063419 - RNA, 16 nt, Mycobacterium bovis subsp bovis AF2122/97
accggcacgccggcgg

SEQ ID NO: 1063420 - RNA, 23 nt, Mycobacterium bovis subsp bovis AF2122/97
accggcaccgccugcgccgcccg

SEQ ID NO: 1063421 - RNA, 19 nt, Mycobacterium bovis subsp bovis AF2122/97
accggcacgccggcggcgg

SEQ ID NO: 1063422 - RNA, 15 nt, Mycobacterium bovis subsp bovis AF2122/97
accggccgugccgcc

SEQ ID NO: 1063423 - RNA, 23 nt, Mycobacterium bovis subsp bovis AF2122/97
accggccgugccgccgacaccac

SEQ ID NO: 1063424 - RNA, 15 nt, Mycobacterium bovis subsp bovis AF2122/97
accggccgucgacgc

SEQ ID NO: 1063425 - RNA, 16 nt, Mycobacterium bovis subsp bovis AF2122/97
accggccgucgacgca

SEQ ID NO: 1063426 - RNA, 14 nt, Mycobacterium bovis subsp bovis AF2122/97
accggccggugcca

SEQ ID NO: 1063427 - RNA, 19 nt, Mycobacterium bovis subsp bovis AF2122/97
accggccggugcccgggcg

SEQ ID NO: 1063428 - RNA, 21 nt, Mycobacterium bovis subsp bovis AF2122/97
accggcgaccggugccugcaa

SEQ ID NO: 1063429 - RNA, 13 nt, Mycobacterium bovis subsp bovis AF2122/97
accggcgacgccg

SEQ ID NO: 1063430 - RNA, 14 nt, Mycobacterium bovis subsp bovis AF2122/97
accggcgacgccgg

SEQ ID NO: 1063431 - RNA, 19 nt, Mycobacterium bovis subsp bovis AF2122/97
accggccuuauucacccgg

SEQ ID NO: 1063432 - RNA, 22 nt, Mycobacterium bovis subsp bovis AF2122/97
accgcguuguccgcggccaacg

SEQ ID NO: 1063433 - RNA, 18 nt, Mycobacterium bovis subsp bovis AF2122/97
accgcguuaugccaggcg

SEQ ID NO: 1063434 - RNA, 21 nt, Mycobacterium bovis subsp bovis AF2122/97
accgcguggucggcgaacgcg

SEQ ID NO: 1063435 - RNA, 21 nt, Mycobacterium bovis subsp bovis AF2122/97
accgcuaacagauuguccggc

SEQ ID NO: 1063436 - RNA, 17 nt, Mycobacterium bovis subsp bovis AF2122/97
accgcguuuugcaggcc

SEQ ID NO: 1063437 - RNA, 14 nt, Mycobacterium bovis subsp bovis AF2122/97
accgcucgggcgcg

SEQ ID NO: 1063438 - RNA, 18 nt, Mycobacterium bovis subsp bovis AF2122/97
accgcucgguccagccgg

SEQ ID NO: 1063439 - RNA, 20 nt, Mycobacterium bovis subsp bovis AF2122/97
accgcucgaugucccgagcc

SEQ ID NO: 1063440 - RNA, 19 nt, Mycobacterium bovis subsp bovis AF2122/97
accgcuaugaugccgccgg

SEQ ID NO: 1063441 - RNA, 23 nt, Mycobacterium bovis subsp bovis AF2122/97
accgcuaacagauuguccggccg

SEQ ID NO: 1063442 - RNA, 19 nt, Mycobacterium bovis subsp bovis AF2122/97
accgcucagggugcgccgc

SEQ ID NO: 1063443 - RNA, 16 nt, Mycobacterium bovis subsp bovis AF2122/97
accgcgcgcucgccca

SEQ ID NO: 1063444 - RNA, 21 nt, Mycobacterium bovis subsp bovis AF2122/97
accgcgcguaauccgagcgcg

SEQ ID NO: 1063445 - RNA, 16 nt, Mycobacterium bovis subsp bovis AF2122/97
accgcgcucccggcgu

SEQ ID NO: 1063446 - RNA, 21 nt, Mycobacterium bovis subsp bovis AF2122/97
accgcgcguugaagucgccgg

SEQ ID NO: 1063447 - RNA, 17 nt, Mycobacterium bovis subsp bovis AF2122/97
accgcgcguugaagucg

SEQ ID NO: 1063448 - RNA, 21 nt, Mycobacterium bovis subsp bovis AF2122/97
accgcgcuggucagccgugcc

SEQ ID NO: 1063449 - RNA, 22 nt, Mycobacterium bovis subsp bovis AF2122/97
accgcgcuggucagccgugccg

SEQ ID NO: 1063450 - RNA, 22 nt, Mycobacterium bovis subsp bovis AF2122/97
accgcgcuguugccaucgacgc

SEQ ID NO: 1063451 - RNA, 14 nt, Mycobacterium bovis subsp bovis AF2122/97
accgcgugcgccgg

SEQ ID NO: 1063452 - RNA, 17 nt, Mycobacterium bovis subsp bovis AF2122/97
accggcaaucggcggca

SEQ ID NO: 1063453 - RNA, 22 nt, Mycobacterium bovis subsp bovis AF2122/97
accggcaaucggcggcacccgg

SEQ ID NO: 1063454 - RNA, 14 nt, Mycobacterium bovis subsp bovis AF2122/97
accggcaacaucgg

SEQ ID NO: 1063455 - RNA, 23 nt, Mycobacterium bovis subsp bovis AF2122/97
accggauccauuagcacaucgcc

SEQ ID NO: 1063456 - RNA, 14 nt, Mycobacterium bovis subsp bovis AF2122/97
accggaucaccgcg

SEQ ID NO: 1063457 - RNA, 14 nt, Mycobacterium bovis subsp bovis AF2122/97
accggaucaucgcc

SEQ ID NO: 1063458 - RNA, 12 nt, Mycobacterium bovis subsp bovis AF2122/97
accggaucgccg

SEQ ID NO: 1063459 - RNA, 13 nt, Mycobacterium bovis subsp bovis AF2122/97
accggaucgccgu

SEQ ID NO: 1063460 - RNA, 16 nt, Mycobacterium bovis subsp bovis AF2122/97
accggaucgccgucgg

SEQ ID NO: 1063461 - RNA, 19 nt, Mycobacterium bovis subsp bovis AF2122/97
accggaucgccgucggcgg

SEQ ID NO: 1063462 - RNA, 19 nt, Mycobacterium bovis subsp bovis AF2122/97
accggagucgcccgguccg

SEQ ID NO: 1063463 - RNA, 14 nt, Mycobacterium bovis subsp bovis AF2122/97
accggagucggcgu

SEQ ID NO: 1063464 - RNA, 23 nt, Mycobacterium bovis subsp bovis AF2122/97
accggauaggaccacgggaugca

SEQ ID NO: 1063465 - RNA, 19 nt, Mycobacterium bovis subsp bovis AF2122/97
accggaguucucgcugauc

SEQ ID NO: 1063466 - RNA, 23 nt, Mycobacterium bovis subsp bovis AF2122/97
accggaaaccacagcgccaucag

SEQ ID NO: 1063467 - RNA, 22 nt, Mycobacterium bovis subsp bovis AF2122/97
accggaaccaccaguaccaccg

SEQ ID NO: 1063468 - RNA, 13 nt, Mycobacterium bovis subsp bovis AF2122/97
accggaacgccgu

SEQ ID NO: 1063469 - RNA, 19 nt, Mycobacterium bovis subsp bovis AF2122/97
accggaacgccgucgagca

SEQ ID NO: 1063470 - RNA, 14 nt, Mycobacterium bovis subsp bovis AF2122/97
accgcucgucgucc

SEQ ID NO: 1063471 - RNA, 19 nt, Mycobacterium bovis subsp bovis AF2122/97
accgcucgucguccggcca

SEQ ID NO: 1063472 - RNA, 15 nt, Mycobacterium bovis subsp bovis AF2122/97
accgcucgucgccgg

SEQ ID NO: 1063473 - RNA, 20 nt, Mycobacterium bovis subsp bovis AF2122/97
accgcucgucgccgguggca

SEQ ID NO: 1063474 - RNA, 14 nt, Mycobacterium bovis subsp bovis AF2122/97
accgcucggcggca

SEQ ID NO: 1063475 - RNA, 16 nt, Mycobacterium bovis subsp bovis AF2122/97
accgcugauagcgguc

SEQ ID NO: 1063476 - RNA, 18 nt, Mycobacterium bovis subsp bovis AF2122/97
accgcugccgcugccgaa

SEQ ID NO: 1063477 - RNA, 14 nt, Mycobacterium bovis subsp bovis AF2122/97
accgcugccggcac

SEQ ID NO: 1063478 - RNA, 16 nt, Mycobacterium bovis subsp bovis AF2122/97
accgcugccggcagcg

SEQ ID NO: 1063479 - RNA, 13 nt, Mycobacterium bovis subsp bovis AF2122/97
accgcugccggcg

SEQ ID NO: 1063480 - RNA, 14 nt, Mycobacterium bovis subsp bovis AF2122/97
accgcugccggcgc

SEQ ID NO: 1063481 - RNA, 16 nt, Mycobacterium bovis subsp bovis AF2122/97
accgcugccggcgccg

SEQ ID NO: 1063482 - RNA, 23 nt, Mycobacterium bovis subsp bovis AF2122/97
accgcugccggcgccgccacugc

SEQ ID NO: 1063483 - RNA, 23 nt, Mycobacterium bovis subsp bovis AF2122/97
accgcuucccccgguccggucgg

SEQ ID NO: 1063484 - RNA, 23 nt, Mycobacterium bovis subsp bovis AF2122/97
accgcuugaccccuggccgccgg

SEQ ID NO: 1063485 - RNA, 17 nt, Mycobacterium bovis subsp bovis AF2122/97
acccagaaugacaucgu

SEQ ID NO: 1063486 - RNA, 17 nt, Mycobacterium bovis subsp bovis AF2122/97
acccagaauuccggcgg

SEQ ID NO: 1063487 - RNA, 18 nt, Mycobacterium bovis subsp bovis AF2122/97
acccagaauuccggcgga

SEQ ID NO: 1063488 - RNA, 13 nt, Mycobacterium bovis subsp bovis AF2122/97
acccagaccgccg

SEQ ID NO: 1063489 - RNA, 15 nt, Mycobacterium bovis subsp bovis AF2122/97
acccacuccgccgau

SEQ ID NO: 1063490 - RNA, 18 nt, Mycobacterium bovis subsp bovis AF2122/97
acccacugcacggagccg

SEQ ID NO: 1063491 - RNA, 22 nt, Mycobacterium bovis subsp bovis AF2122/97
acccacuuucgacccgcggcgg

SEQ ID NO: 1063492 - RNA, 18 nt, Mycobacterium bovis subsp bovis AF2122/97
acccacuuuucgguggcg

SEQ ID NO: 1063493 - RNA, 20 nt, Mycobacterium bovis subsp bovis AF2122/97
acccacuuuucgguggcggc

SEQ ID NO: 1063494 - RNA, 23 nt, Mycobacterium bovis subsp bovis AF2122/97
acccacuuuucgguggcggcagc

SEQ ID NO: 1063495 - RNA, 16 nt, Mycobacterium bovis subsp bovis AF2122/97
acccagcacgcgcgcg

SEQ ID NO: 1063496 - RNA, 19 nt, Mycobacterium bovis subsp bovis AF2122/97
acccagccagcagcggcga

SEQ ID NO: 1063497 - RNA, 13 nt, Mycobacterium bovis subsp bovis AF2122/97
acccagccggccu

SEQ ID NO: 1063498 - RNA, 20 nt, Mycobacterium bovis subsp bovis AF2122/97
acccagccggccugucccgc

SEQ ID NO: 1063499 - RNA, 19 nt, Mycobacterium bovis subsp bovis AF2122/97
acccacgaucagcagcguc

SEQ ID NO: 1063500 - RNA, 12 nt, Mycobacterium bovis subsp bovis AF2122/97
acccacgccgac

SEQ ID NO: 1063501 - RNA, 23 nt, Mycobacterium bovis subsp bovis AF2122/97
accaggccacugccgaccagcgc

SEQ ID NO: 1063502 - RNA, 16 nt, Mycobacterium bovis subsp bovis AF2122/97
accaggacguggucgg

SEQ ID NO: 1063503 - RNA, 19 nt, Mycobacterium bovis subsp bovis AF2122/97
accaggacccaucgccagc

SEQ ID NO: 1063504 - RNA, 21 nt, Mycobacterium bovis subsp bovis AF2122/97
acccagcgugcccgccaccgg

SEQ ID NO: 1063505 - RNA, 17 nt, Mycobacterium bovis subsp bovis AF2122/97
acccagcugggucccgc

SEQ ID NO: 1063506 - RNA, 16 nt, Mycobacterium bovis subsp bovis AF2122/97
acccaggcacaacauc

SEQ ID NO: 1063507 - RNA, 19 nt, Mycobacterium bovis subsp bovis AF2122/97
acccaggcacaacaucgcc

SEQ ID NO: 1063508 - RNA, 17 nt, Mycobacterium bovis subsp bovis AF2122/97
acccaggccgucgcgcc

SEQ ID NO: 1063509 - RNA, 18 nt, Mycobacterium bovis subsp bovis AF2122/97
acccagggccuucccgau

SEQ ID NO: 1063510 - RNA, 19 nt, Mycobacterium bovis subsp bovis AF2122/97
acccagccgcgccagcucc

SEQ ID NO: 1063511 - RNA, 17 nt, Mycobacterium bovis subsp bovis AF2122/97
acccagcgacgcggcca

SEQ ID NO: 1063512 - RNA, 12 nt, Mycobacterium bovis subsp bovis AF2122/97
acccagcgcagc

SEQ ID NO: 1063513 - RNA, 14 nt, Mycobacterium bovis subsp bovis AF2122/97
acccagcgggucgc

SEQ ID NO: 1063514 - RNA, 16 nt, Mycobacterium bovis subsp bovis AF2122/97
acccagcgugcccgcc

SEQ ID NO: 1063515 - RNA, 17 nt, Mycobacterium bovis subsp bovis AF2122/97
acccagcgugcccgcca

SEQ ID NO: 1063516 - RNA, 20 nt, Mycobacterium bovis subsp bovis AF2122/97
acccagcggagccacucggc

SEQ ID NO: 1063517 - RNA, 12 nt, Mycobacterium bovis subsp bovis AF2122/97
acccagcgcccg

SEQ ID NO: 1063518 - RNA, 17 nt, Mycobacterium bovis subsp bovis AF2122/97
acccagcggcgccacgu

SEQ ID NO: 1063519 - RNA, 12 nt, Mycobacterium bovis subsp bovis AF2122/97
acccaguccggu

SEQ ID NO: 1063520 - RNA, 13 nt, Mycobacterium bovis subsp bovis AF2122/97
acccaucaucgcc

SEQ ID NO: 1063521 - RNA, 20 nt, Mycobacterium bovis subsp bovis AF2122/97
acccauccggcucgguggcg

SEQ ID NO: 1063522 - RNA, 14 nt, Mycobacterium bovis subsp bovis AF2122/97
acccaucaccagcg

SEQ ID NO: 1063523 - RNA, 15 nt, Mycobacterium bovis subsp bovis AF2122/97
acccaucaccgccag

SEQ ID NO: 1063524 - RNA, 16 nt, Mycobacterium bovis subsp bovis AF2122/97
acccaucaccgccagc

SEQ ID NO: 1063525 - RNA, 22 nt, Mycobacterium bovis subsp bovis AF2122/97
acccaucaccgccagccccgcg

SEQ ID NO: 1063526 - RNA, 15 nt, Mycobacterium bovis subsp bovis AF2122/97
acccagugccacgcc

SEQ ID NO: 1063527 - RNA, 16 nt, Mycobacterium bovis subsp bovis AF2122/97
acccaucaacaucggc

SEQ ID NO: 1063528 - RNA, 18 nt, Mycobacterium bovis subsp bovis AF2122/97
acccauucucggccggcg

SEQ ID NO: 1063529 - RNA, 19 nt, Mycobacterium bovis subsp bovis AF2122/97
acccauucucggccggcgg

SEQ ID NO: 1063530 - RNA, 20 nt, Mycobacterium bovis subsp bovis AF2122/97
acccauucucggccggcggc

SEQ ID NO: 1063531 - RNA, 15 nt, Mycobacterium bovis subsp bovis AF2122/97
acccaucgaccgccc

SEQ ID NO: 1063532 - RNA, 19 nt, Mycobacterium bovis subsp bovis AF2122/97
acccaucgaccgcccgcca

SEQ ID NO: 1063533 - RNA, 20 nt, Mycobacterium bovis subsp bovis AF2122/97
acccaucgaccgcccgccag

SEQ ID NO: 1063534 - RNA, 17 nt, Mycobacterium bovis subsp bovis AF2122/97
acccaucgucgagccgc

SEQ ID NO: 1063535 - RNA, 23 nt, Mycobacterium bovis subsp bovis AF2122/97
acccaucgucgagccgccagauu

SEQ ID NO: 1063536 - RNA, 15 nt, Mycobacterium bovis subsp bovis AF2122/97
accccgcgguagccg

SEQ ID NO: 1063537 - RNA, 13 nt, Mycobacterium bovis subsp bovis AF2122/97
accccggcugcgc

SEQ ID NO: 1063538 - RNA, 16 nt, Mycobacterium bovis subsp bovis AF2122/97
accccggucccgccga

SEQ ID NO: 1063539 - RNA, 17 nt, Mycobacterium bovis subsp bovis AF2122/97
accccggucccgccgac

SEQ ID NO: 1063540 - RNA, 21 nt, Mycobacterium bovis subsp bovis AF2122/97
accccggucggagcggugccg

SEQ ID NO: 1063541 - RNA, 16 nt, Mycobacterium bovis subsp bovis AF2122/97
accccggucggcccgc

SEQ ID NO: 1063542 - RNA, 15 nt, Mycobacterium bovis subsp bovis AF2122/97
accccggugcccgcg

SEQ ID NO: 1063543 - RNA, 18 nt, Mycobacterium bovis subsp bovis AF2122/97
accccguccucgaucgcg

SEQ ID NO: 1063544 - RNA, 17 nt, Mycobacterium bovis subsp bovis AF2122/97
accccguccucgaucgc

SEQ ID NO: 1063545 - RNA, 22 nt, Mycobacterium bovis subsp bovis AF2122/97
accccguuccacgaucacccgg

SEQ ID NO: 1063546 - RNA, 19 nt, Mycobacterium bovis subsp bovis AF2122/97
accccguuccacgaucacc

SEQ ID NO: 1063547 - RNA, 21 nt, Mycobacterium bovis subsp bovis AF2122/97
accccgguugacucgcuccga

SEQ ID NO: 1063548 - RNA, 20 nt, Mycobacterium bovis subsp bovis AF2122/97
accccggcucgacgcgucgc

SEQ ID NO: 1063549 - RNA, 18 nt, Mycobacterium bovis subsp bovis AF2122/97
accccggcucggccaccg

SEQ ID NO: 1063550 - RNA, 19 nt, Mycobacterium bovis subsp bovis AF2122/97
accccggcucggccaccga

SEQ ID NO: 1063551 - RNA, 12 nt, Mycobacterium bovis subsp bovis AF2122/97
accccggccagg

SEQ ID NO: 1063552 - RNA, 21 nt, Mycobacterium bovis subsp bovis AF2122/97
accccggccuugccaccggua

SEQ ID NO: 1063553 - RNA, 21 nt, Mycobacterium bovis subsp bovis AF2122/97
accccggccuuggcggcggca

SEQ ID NO: 1063554 - RNA, 14 nt, Mycobacterium bovis subsp bovis AF2122/97
accccggcggccau

SEQ ID NO: 1063555 - RNA, 15 nt, Mycobacterium bovis subsp bovis AF2122/97
accccggcggccauc

SEQ ID NO: 1063556 - RNA, 12 nt, Mycobacterium bovis subsp bovis AF2122/97
accccggccggc

SEQ ID NO: 1063557 - RNA, 13 nt, Mycobacterium bovis subsp bovis AF2122/97
accccggccacca

SEQ ID NO: 1063558 - RNA, 15 nt, Mycobacterium bovis subsp bovis AF2122/97
accccggccaccagc

SEQ ID NO: 1063559 - RNA, 17 nt, Mycobacterium bovis subsp bovis AF2122/97
accccgcgugaccgacu

SEQ ID NO: 1063560 - RNA, 12 nt, Mycobacterium bovis subsp bovis AF2122/97
accccgccagcc

SEQ ID NO: 1063561 - RNA, 22 nt, Mycobacterium bovis subsp bovis AF2122/97
accccgcuuuuucccggcggcg

SEQ ID NO: 1063562 - RNA, 15 nt, Mycobacterium bovis subsp bovis AF2122/97
accccggaaucccca

SEQ ID NO: 1063563 - RNA, 23 nt, Mycobacterium bovis subsp bovis AF2122/97
accccggaauccccaagcccgau

SEQ ID NO: 1063564 - RNA, 16 nt, Mycobacterium bovis subsp bovis AF2122/97
accccgcgcggugccc

SEQ ID NO: 1063565 - RNA, 23 nt, Mycobacterium bovis subsp bovis AF2122/97
accccgccggcugcggaggcggg

SEQ ID NO: 1063566 - RNA, 18 nt, Mycobacterium bovis subsp bovis AF2122/97
accccgccgggggcaccg

SEQ ID NO: 1063567 - RNA, 18 nt, Mycobacterium bovis subsp bovis AF2122/97
accccgcgcggugcccug

SEQ ID NO: 1063568 - RNA, 21 nt, Mycobacterium bovis subsp bovis AF2122/97
accccgaacauugcgcccagc

SEQ ID NO: 1063569 - RNA, 14 nt, Mycobacterium bovis subsp bovis AF2122/97
accccgauccgcca

SEQ ID NO: 1063570 - RNA, 14 nt, Mycobacterium bovis subsp bovis AF2122/97
accccgcagcucac

SEQ ID NO: 1063571 - RNA, 20 nt, Mycobacterium bovis subsp bovis AF2122/97
accccgcagcucaccucaug

SEQ ID NO: 1063572 - RNA, 17 nt, Mycobacterium bovis subsp bovis AF2122/97
accccgccaugcggcgc

SEQ ID NO: 1063573 - RNA, 22 nt, Mycobacterium bovis subsp bovis AF2122/97
accccgccaugcggcgcgucgc

SEQ ID NO: 1063574 - RNA, 16 nt, Mycobacterium bovis subsp bovis AF2122/97
accccccagcgacggc

SEQ ID NO: 1063575 - RNA, 18 nt, Mycobacterium bovis subsp bovis AF2122/97
accccccagcgacggcaa

SEQ ID NO: 1063576 - RNA, 15 nt, Mycobacterium bovis subsp bovis AF2122/97
accccccguccaccg

SEQ ID NO: 1063577 - RNA, 18 nt, Mycobacterium bovis subsp bovis AF2122/97
acccccgauagcgaccgc

SEQ ID NO: 1063578 - RNA, 21 nt, Mycobacterium bovis subsp bovis AF2122/97
acccccgauagcgaccgcggc

SEQ ID NO: 1063579 - RNA, 17 nt, Mycobacterium bovis subsp bovis AF2122/97
acccccgauggcgucgc

SEQ ID NO: 1063580 - RNA, 16 nt, Mycobacterium bovis subsp bovis AF2122/97
acccccaaccgccggc

SEQ ID NO: 1063581 - RNA, 15 nt, Mycobacterium bovis subsp bovis AF2122/97
accccgaacauccgc

SEQ ID NO: 1063582 - RNA, 17 nt, Mycobacterium bovis subsp bovis AF2122/97
acccccggggcgcucgc

SEQ ID NO: 1063583 - RNA, 18 nt, Mycobacterium bovis subsp bovis AF2122/97
acccccgucgccaccgau

SEQ ID NO: 1063584 - RNA, 21 nt, Mycobacterium bovis subsp bovis AF2122/97
acccccgucgccaccgauggc

SEQ ID NO: 1063585 - RNA, 21 nt, Mycobacterium bovis subsp bovis AF2122/97
acccccucggcuucggagccg

SEQ ID NO: 1063586 - RNA, 13 nt, Mycobacterium bovis subsp bovis AF2122/97
acccccugacggc

SEQ ID NO: 1063587 - RNA, 15 nt, Mycobacterium bovis subsp bovis AF2122/97
accccgagccgcagc

SEQ ID NO: 1063588 - RNA, 12 nt, Mycobacterium bovis subsp bovis AF2122/97
accccgagccgu

SEQ ID NO: 1063589 - RNA, 14 nt, Mycobacterium bovis subsp bovis AF2122/97
accccgagcggagc

SEQ ID NO: 1063590 - RNA, 19 nt, Mycobacterium bovis subsp bovis AF2122/97
accccgagcucaccaaggu

SEQ ID NO: 1063591 - RNA, 23 nt, Mycobacterium bovis subsp bovis AF2122/97
accccgaauagucggcaucgcga

SEQ ID NO: 1063592 - RNA, 14 nt, Mycobacterium bovis subsp bovis AF2122/97
accccgaccaccag

SEQ ID NO: 1063593 - RNA, 15 nt, Mycobacterium bovis subsp bovis AF2122/97
accccgacgaugcgc

SEQ ID NO: 1063594 - RNA, 16 nt, Mycobacterium bovis subsp bovis AF2122/97
accccauggccagcgc

SEQ ID NO: 1063595 - RNA, 22 nt, Mycobacterium bovis subsp bovis AF2122/97
accccauaaucacaucgcccgg

SEQ ID NO: 1063596 - RNA, 15 nt, Mycobacterium bovis subsp bovis AF2122/97
accccauacucggcg

SEQ ID NO: 1063597 - RNA, 18 nt, Mycobacterium bovis subsp bovis AF2122/97
accccauacucggcggcu

SEQ ID NO: 1063598 - RNA, 22 nt, Mycobacterium bovis subsp bovis AF2122/97
accccaggcgcucaucacccag

SEQ ID NO: 1063599 - RNA, 17 nt, Mycobacterium bovis subsp bovis AF2122/97
accccagggagugccgc

SEQ ID NO: 1063600 - RNA, 21 nt, Mycobacterium bovis subsp bovis AF2122/97
accccagcuuggcgucgaugc

SEQ ID NO: 1063601 - RNA, 12 nt, Mycobacterium bovis subsp bovis AF2122/97
accccagcuugg

SEQ ID NO: 1063602 - RNA, 21 nt, Mycobacterium bovis subsp bovis AF2122/97
accccagccggcagcagcggg

SEQ ID NO: 1063603 - RNA, 14 nt, Mycobacterium bovis subsp bovis AF2122/97
accccagcggccac

SEQ ID NO: 1063604 - RNA, 20 nt, Mycobacterium bovis subsp bovis AF2122/97
accccagcggccaccgaggc

SEQ ID NO: 1063605 - RNA, 14 nt, Mycobacterium bovis subsp bovis AF2122/97
accccacggccagu

SEQ ID NO: 1063606 - RNA, 13 nt, Mycobacterium bovis subsp bovis AF2122/97
accccagcgccac

SEQ ID NO: 1063607 - RNA, 20 nt, Mycobacterium bovis subsp bovis AF2122/97
accccacuggcacacgguca

SEQ ID NO: 1063608 - RNA, 13 nt, Mycobacterium bovis subsp bovis AF2122/97
accccacacccgg

SEQ ID NO: 1063609 - RNA, 16 nt, Mycobacterium bovis subsp bovis AF2122/97
accccaaucgaccgcc

SEQ ID NO: 1063610 - RNA, 21 nt, Mycobacterium bovis subsp bovis AF2122/97
accccaaucgaccgcccgcca

SEQ ID NO: 1063611 - RNA, 16 nt, Mycobacterium bovis subsp bovis AF2122/97
accccaaaaccgccgg

SEQ ID NO: 1063612 - RNA, 18 nt, Mycobacterium bovis subsp bovis AF2122/97
accccaaaaccgccgguu

SEQ ID NO: 1063613 - RNA, 15 nt, Mycobacterium bovis subsp bovis AF2122/97
accccaacaucccgg

SEQ ID NO: 1063614 - RNA, 16 nt, Mycobacterium bovis subsp bovis AF2122/97
acccauuucgucagcg

SEQ ID NO: 1063615 - RNA, 18 nt, Mycobacterium bovis subsp bovis AF2122/97
acccuuugcacgguggca

SEQ ID NO: 1063616 - RNA, 21 nt, Mycobacterium bovis subsp bovis AF2122/97
accgaaacgaugcggccugca

SEQ ID NO: 1063617 - RNA, 16 nt, Mycobacterium bovis subsp bovis AF2122/97
accgaaaccggucagc

SEQ ID NO: 1063618 - RNA, 20 nt, Mycobacterium bovis subsp bovis AF2122/97
accgaaaccggucagcacau

SEQ ID NO: 1063619 - RNA, 15 nt, Mycobacterium bovis subsp bovis AF2122/97
accgaaaaacaccag

SEQ ID NO: 1063620 - RNA, 18 nt, Mycobacterium bovis subsp bovis AF2122/97
accgaaaaacaccagcga

SEQ ID NO: 1063621 - RNA, 23 nt, Mycobacterium bovis subsp bovis AF2122/97
accgaaaagccguucgcgucgcc

SEQ ID NO: 1063622 - RNA, 16 nt, Mycobacterium bovis subsp bovis AF2122/97
accgaaaaguccgccg

SEQ ID NO: 1063623 - RNA, 19 nt, Mycobacterium bovis subsp bovis AF2122/97
acccugaugugaguccagc

SEQ ID NO: 1063624 - RNA, 20 nt, Mycobacterium bovis subsp bovis AF2122/97
acccugcgaauagccaccaa

SEQ ID NO: 1063625 - RNA, 15 nt, Mycobacterium bovis subsp bovis AF2122/97
acccugcgugcggcg

SEQ ID NO: 1063626 - RNA, 14 nt, Mycobacterium bovis subsp bovis AF2122/97
acccugcgccgcca

SEQ ID NO: 1063627 - RNA, 20 nt, Mycobacterium bovis subsp bovis AF2122/97
acccugcgcguugaccgaac

SEQ ID NO: 1063628 - RNA, 21 nt, Mycobacterium bovis subsp bovis AF2122/97
acccucgggcgucacggugcg

SEQ ID NO: 1063629 - RNA, 18 nt, Mycobacterium bovis subsp bovis AF2122/97
acccugcccuagcccgau

SEQ ID NO: 1063630 - RNA, 22 nt, Mycobacterium bovis subsp bovis AF2122/97
acccugcccuagcccgauucug

SEQ ID NO: 1063631 - RNA, 22 nt, Mycobacterium bovis subsp bovis AF2122/97
accgacagccccaucaccaccg

SEQ ID NO: 1063632 - RNA, 22 nt, Mycobacterium bovis subsp bovis AF2122/97
accgacaccccgaugccgugcc

SEQ ID NO: 1063633 - RNA, 15 nt, Mycobacterium bovis subsp bovis AF2122/97
accgacaccggccgc

SEQ ID NO: 1063634 - RNA, 22 nt, Mycobacterium bovis subsp bovis AF2122/97
accgacagcacccggccaccgg

SEQ ID NO: 1063635 - RNA, 22 nt, Mycobacterium bovis subsp bovis AF2122/97
accgacauguguggcagcccca

SEQ ID NO: 1063636 - RNA, 15 nt, Mycobacterium bovis subsp bovis AF2122/97
accgacaucgucauc

SEQ ID NO: 1063637 - RNA, 16 nt, Mycobacterium bovis subsp bovis AF2122/97
accgacagcggcaccg

SEQ ID NO: 1063638 - RNA, 17 nt, Mycobacterium bovis subsp bovis AF2122/97
accgacauuggugugga

SEQ ID NO: 1063639 - RNA, 15 nt, Mycobacterium bovis subsp bovis AF2122/97
accgacaccgugccg

SEQ ID NO: 1063640 - RNA, 13 nt, Mycobacterium bovis subsp bovis AF2122/97
accgacaccgugu

SEQ ID NO: 1063641 - RNA, 21 nt, Mycobacterium bovis subsp bovis AF2122/97
accgacaccgugucgccggcg

SEQ ID NO: 1063642 - RNA, 21 nt, Mycobacterium bovis subsp bovis AF2122/97
accgacaccguguugcugaac

SEQ ID NO: 1063643 - RNA, 20 nt, Mycobacterium bovis subsp bovis AF2122/97
accgacaccguguugcugcc

SEQ ID NO: 1063644 - RNA, 20 nt, Mycobacterium bovis subsp bovis AF2122/97
accgaacaguaggccuccgc

SEQ ID NO: 1063645 - RNA, 20 nt, Mycobacterium bovis subsp bovis AF2122/97
accgacaauucaacacacgg

SEQ ID NO: 1063646 - RNA, 13 nt, Mycobacterium bovis subsp bovis AF2122/97
accgaacccgacg

SEQ ID NO: 1063647 - RNA, 14 nt, Mycobacterium bovis subsp bovis AF2122/97
accgaacccgccac

SEQ ID NO: 1063648 - RNA, 15 nt, Mycobacterium bovis subsp bovis AF2122/97
accgaacccgccacc

SEQ ID NO: 1063649 - RNA, 14 nt, Mycobacterium bovis subsp bovis AF2122/97
accgaaacgccgac

SEQ ID NO: 1063650 - RNA, 23 nt, Mycobacterium bovis subsp bovis AF2122/97
accgaaauggucguucccgccgg

SEQ ID NO: 1063651 - RNA, 21 nt, Mycobacterium bovis subsp bovis AF2122/97
accgaaauacccagcgcagca

SEQ ID NO: 1063652 - RNA, 15 nt, Mycobacterium bovis subsp bovis AF2122/97
accgaaagccgcacc

SEQ ID NO: 1063653 - RNA, 18 nt, Mycobacterium bovis subsp bovis AF2122/97
acccggcgggcccgccgg

SEQ ID NO: 1063654 - RNA, 19 nt, Mycobacterium bovis subsp bovis AF2122/97
acccggcgggcccgccggc

SEQ ID NO: 1063655 - RNA, 18 nt, Mycobacterium bovis subsp bovis AF2122/97
acccggcggacgacgucg

SEQ ID NO: 1063656 - RNA, 14 nt, Mycobacterium bovis subsp bovis AF2122/97
acccggcggugccg

SEQ ID NO: 1063657 - RNA, 16 nt, Mycobacterium bovis subsp bovis AF2122/97
acccggcggugccguc

SEQ ID NO: 1063658 - RNA, 24 nt, Mycobacterium bovis subsp bovis AF2122/97
acccggcggugccgucagcggcgg

SEQ ID NO: 1063659 - RNA, 21 nt, Mycobacterium bovis subsp bovis AF2122/97
acccggcgggcggugggcagc

SEQ ID NO: 1063660 - RNA, 15 nt, Mycobacterium bovis subsp bovis AF2122/97
acccggcgucgacga

SEQ ID NO: 1063661 - RNA, 17 nt, Mycobacterium bovis subsp bovis AF2122/97
acccggcgccgucgaug

SEQ ID NO: 1063662 - RNA, 20 nt, Mycobacterium bovis subsp bovis AF2122/97
acccggcgccgucgaugacc

SEQ ID NO: 1063663 - RNA, 19 nt, Mycobacterium bovis subsp bovis AF2122/97
acccggcgcaacaaccggu

SEQ ID NO: 1063664 - RNA, 12 nt, Mycobacterium bovis subsp bovis AF2122/97
acccggccgccg

SEQ ID NO: 1063665 - RNA, 13 nt, Mycobacterium bovis subsp bovis AF2122/97
acccggccgccga

SEQ ID NO: 1063666 - RNA, 14 nt, Mycobacterium bovis subsp bovis AF2122/97
acccggccgccgaa

SEQ ID NO: 1063667 - RNA, 15 nt, Mycobacterium bovis subsp bovis AF2122/97
acccggccccguccg

SEQ ID NO: 1063668 - RNA, 21 nt, Mycobacterium bovis subsp bovis AF2122/97
acccggcccauugucgaucac

SEQ ID NO: 1063669 - RNA, 22 nt, Mycobacterium bovis subsp bovis AF2122/97
acccggccagguauguccgcca

SEQ ID NO: 1063670 - RNA, 22 nt, Mycobacterium bovis subsp bovis AF2122/97
acccggcccauugucgaucacc

SEQ ID NO: 1063671 - RNA, 17 nt, Mycobacterium bovis subsp bovis AF2122/97
acccggccgcugacgcc

SEQ ID NO: 1063672 - RNA, 19 nt, Mycobacterium bovis subsp bovis AF2122/97
acccggccucaacacccgg

SEQ ID NO: 1063673 - RNA, 20 nt, Mycobacterium bovis subsp bovis AF2122/97
acccggcgaccacggcaccg

SEQ ID NO: 1063674 - RNA, 20 nt, Mycobacterium bovis subsp bovis AF2122/97
acccggcgauuggaccgcca

SEQ ID NO: 1063675 - RNA, 23 nt, Mycobacterium bovis subsp bovis AF2122/97
acccguucagcgacggccgccag

SEQ ID NO: 1063676 - RNA, 17 nt, Mycobacterium bovis subsp bovis AF2122/97
acccguuccacgccggc

SEQ ID NO: 1063677 - RNA, 16 nt, Mycobacterium bovis subsp bovis AF2122/97
acccucgccggucagc

SEQ ID NO: 1063678 - RNA, 14 nt, Mycobacterium bovis subsp bovis AF2122/97
acccguguacgcgc

SEQ ID NO: 1063679 - RNA, 16 nt, Mycobacterium bovis subsp bovis AF2122/97
acccguguggcacgug

SEQ ID NO: 1063680 - RNA, 19 nt, Mycobacterium bovis subsp bovis AF2122/97
acccguguugagggugccc

SEQ ID NO: 1063681 - RNA, 22 nt, Mycobacterium bovis subsp bovis AF2122/97
acccguguugagggugcccgag

SEQ ID NO: 1063682 - RNA, 13 nt, Mycobacterium bovis subsp bovis AF2122/97
acccgucggcccg

SEQ ID NO: 1063683 - RNA, 16 nt, Mycobacterium bovis subsp bovis AF2122/97
acccgugcacgaucgc

SEQ ID NO: 1063684 - RNA, 17 nt, Mycobacterium bovis subsp bovis AF2122/97
acccgugcacgaucgcg

SEQ ID NO: 1063685 - RNA, 23 nt, Mycobacterium bovis subsp bovis AF2122/97
acccgugcacgaucgcggugacc

SEQ ID NO: 1063686 - RNA, 14 nt, Mycobacterium bovis subsp bovis AF2122/97
acccgucgaacgcg

SEQ ID NO: 1063687 - RNA, 13 nt, Mycobacterium bovis subsp bovis AF2122/97
acccgucgagccg

SEQ ID NO: 1063688 - RNA, 16 nt, Mycobacterium bovis subsp bovis AF2122/97
acccgucgagcagcau

SEQ ID NO: 1063689 - RNA, 20 nt, Mycobacterium bovis subsp bovis AF2122/97
acccguccaacuacgccagc

SEQ ID NO: 1063690 - RNA, 14 nt, Mycobacterium bovis subsp bovis AF2122/97
acccguccggccgg

SEQ ID NO: 1063691 - RNA, 17 nt, Mycobacterium bovis subsp bovis AF2122/97
acccggcuccagcaccg

SEQ ID NO: 1063692 - RNA, 13 nt, Mycobacterium bovis subsp bovis AF2122/97
acccguccgccgc

SEQ ID NO: 1063693 - RNA, 23 nt, Mycobacterium bovis subsp bovis AF2122/97
acccgcgggugauguucguaaag

SEQ ID NO: 1063694 - RNA, 19 nt, Mycobacterium bovis subsp bovis AF2122/97
acccgcggugccugcagcu

SEQ ID NO: 1063695 - RNA, 22 nt, Mycobacterium bovis subsp bovis AF2122/97
acccgcggugccugcagcuugg

SEQ ID NO: 1063696 - RNA, 20 nt, Mycobacterium bovis subsp bovis AF2122/97
acccgcgggucguccggcgg

SEQ ID NO: 1063697 - RNA, 21 nt, Mycobacterium bovis subsp bovis AF2122/97
acccgcgggucguccggcggc

SEQ ID NO: 1063698 - RNA, 12 nt, Mycobacterium bovis subsp bovis AF2122/97
acccgcggcgcg

SEQ ID NO: 1063699 - RNA, 13 nt, Mycobacterium bovis subsp bovis AF2122/97
acccgcggcgccg

SEQ ID NO: 1063700 - RNA, 13 nt, Mycobacterium bovis subsp bovis AF2122/97
acccgcgaacgcg

SEQ ID NO: 1063701 - RNA, 18 nt, Mycobacterium bovis subsp bovis AF2122/97
acccgcuccagcucggcg

SEQ ID NO: 1063702 - RNA, 17 nt, Mycobacterium bovis subsp bovis AF2122/97
acccgcucacgcucacc

SEQ ID NO: 1063703 - RNA, 14 nt, Mycobacterium bovis subsp bovis AF2122/97
acccgcgucgagug

SEQ ID NO: 1063704 - RNA, 15 nt, Mycobacterium bovis subsp bovis AF2122/97
acccgcguaccacgg

SEQ ID NO: 1063705 - RNA, 20 nt, Mycobacterium bovis subsp bovis AF2122/97
acccgcgucgagugccgcca

SEQ ID NO: 1063706 - RNA, 23 nt, Mycobacterium bovis subsp bovis AF2122/97
acccgcgucgagugccgccaccg

SEQ ID NO: 1063707 - RNA, 15 nt, Mycobacterium bovis subsp bovis AF2122/97
acccgcuacgacggu

SEQ ID NO: 1063708 - RNA, 15 nt, Mycobacterium bovis subsp bovis AF2122/97
acccggaugucgugc

SEQ ID NO: 1063709 - RNA, 18 nt, Mycobacterium bovis subsp bovis AF2122/97
acccggagaaucgguccg

SEQ ID NO: 1063710 - RNA, 16 nt, Mycobacterium bovis subsp bovis AF2122/97
acccggcacccaguuc

SEQ ID NO: 1063711 - RNA, 15 nt, Mycobacterium bovis subsp bovis AF2122/97
acccggccagcggca

SEQ ID NO: 1063712 - RNA, 16 nt, Mycobacterium bovis subsp bovis AF2122/97
acccggcagcccggcg

SEQ ID NO: 1063713 - RNA, 17 nt, Mycobacterium bovis subsp bovis AF2122/97
acccggagaaucggucc

SEQ ID NO: 1063714 - RNA, 23 nt, Mycobacterium bovis subsp bovis AF2122/97
acccggaccugggcgacuaccgg

SEQ ID NO: 1063715 - RNA, 23 nt, Mycobacterium bovis subsp bovis AF2122/97
acccgcuuucggaaaaccgcacc

SEQ ID NO: 1063716 - RNA, 14 nt, Mycobacterium bovis subsp bovis AF2122/97
acccggaaucccga

SEQ ID NO: 1063717 - RNA, 16 nt, Mycobacterium bovis subsp bovis AF2122/97
acccggacgaacgccg

SEQ ID NO: 1063718 - RNA, 14 nt, Mycobacterium bovis subsp bovis AF2122/97
acccggaaccagcc

SEQ ID NO: 1063719 - RNA, 19 nt, Mycobacterium bovis subsp bovis AF2122/97
acccggaaccagccgcgga

SEQ ID NO: 1063720 - RNA, 15 nt, Mycobacterium bovis subsp bovis AF2122/97
acccggaagaacucg

SEQ ID NO: 1063721 - RNA, 18 nt, Mycobacterium bovis subsp bovis AF2122/97
acccgcucccgugcuggc

SEQ ID NO: 1063722 - RNA, 18 nt, Mycobacterium bovis subsp bovis AF2122/97
acccggacagggcggcga

SEQ ID NO: 1063723 - RNA, 13 nt, Mycobacterium bovis subsp bovis AF2122/97
acccgccgcgaug

SEQ ID NO: 1063724 - RNA, 22 nt, Mycobacterium bovis subsp bovis AF2122/97
acccgccgcgaugacggugccg

SEQ ID NO: 1063725 - RNA, 16 nt, Mycobacterium bovis subsp bovis AF2122/97
acccgccgcgcccggc

SEQ ID NO: 1063726 - RNA, 16 nt, Mycobacterium bovis subsp bovis AF2122/97
acccgccgcggacacc

SEQ ID NO: 1063727 - RNA, 16 nt, Mycobacterium bovis subsp bovis AF2122/97
acccgccgaugaugcg

SEQ ID NO: 1063728 - RNA, 17 nt, Mycobacterium bovis subsp bovis AF2122/97
acccgccggguccgccg

SEQ ID NO: 1063729 - RNA, 18 nt, Mycobacterium bovis subsp bovis AF2122/97
acccgccggguccgccgg

SEQ ID NO: 1063730 - RNA, 21 nt, Mycobacterium bovis subsp bovis AF2122/97
acccgccggguccgccgggcc

SEQ ID NO: 1063731 - RNA, 19 nt, Mycobacterium bovis subsp bovis AF2122/97
acccgccggauucgcccgg

SEQ ID NO: 1063732 - RNA, 20 nt, Mycobacterium bovis subsp bovis AF2122/97
acccgccgugcccccggcuu

SEQ ID NO: 1063733 - RNA, 20 nt, Mycobacterium bovis subsp bovis AF2122/97
acccgccuaaagcgugucgc

SEQ ID NO: 1063734 - RNA, 23 nt, Mycobacterium bovis subsp bovis AF2122/97
acccgccuaaagcgugucgcccu

SEQ ID NO: 1063735 - RNA, 17 nt, Mycobacterium bovis subsp bovis AF2122/97
acccgccucgggccggc

SEQ ID NO: 1063736 - RNA, 22 nt, Mycobacterium bovis subsp bovis AF2122/97
acccgccaggccgcgcgacaac

SEQ ID NO: 1063737 - RNA, 13 nt, Mycobacterium bovis subsp bovis AF2122/97
acccgccagggcg

SEQ ID NO: 1063738 - RNA, 16 nt, Mycobacterium bovis subsp bovis AF2122/97
acccgccagggcggca

SEQ ID NO: 1063739 - RNA, 16 nt, Mycobacterium bovis subsp bovis AF2122/97
acccgcccuugccgcc

SEQ ID NO: 1063740 - RNA, 15 nt, Mycobacterium bovis subsp bovis AF2122/97
acccgaagccggcgc

SEQ ID NO: 1063741 - RNA, 20 nt, Mycobacterium bovis subsp bovis AF2122/97
acccgccgacgccgccggcc

SEQ ID NO: 1063742 - RNA, 23 nt, Mycobacterium bovis subsp bovis AF2122/97
acccgaagauuuugggcgccgac

SEQ ID NO: 1063743 - RNA, 14 nt, Mycobacterium bovis subsp bovis AF2122/97
acccgaagccggcg

SEQ ID NO: 1063744 - RNA, 14 nt, Mycobacterium bovis subsp bovis AF2122/97
acccgaacaacgcc

SEQ ID NO: 1063745 - RNA, 23 nt, Mycobacterium bovis subsp bovis AF2122/97
acccgaauacugaucuuggcccg

SEQ ID NO: 1063746 - RNA, 14 nt, Mycobacterium bovis subsp bovis AF2122/97
acccgaaucccaca

SEQ ID NO: 1063747 - RNA, 18 nt, Mycobacterium bovis subsp bovis AF2122/97
acccgacaacgcugggcg

SEQ ID NO: 1063748 - RNA, 19 nt, Mycobacterium bovis subsp bovis AF2122/97
acccgacaacgcugggcgg

SEQ ID NO: 1063749 - RNA, 19 nt, Mycobacterium bovis subsp bovis AF2122/97
acccgacaauggcgccagc

SEQ ID NO: 1063750 - RNA, 18 nt, Mycobacterium bovis subsp bovis AF2122/97
acccgcauccacgucgcc

SEQ ID NO: 1063751 - RNA, 22 nt, Mycobacterium bovis subsp bovis AF2122/97
acccgcaucggaaucgcgagcu

SEQ ID NO: 1063752 - RNA, 16 nt, Mycobacterium bovis subsp bovis AF2122/97
acccgcaugacgccgg

SEQ ID NO: 1063753 - RNA, 18 nt, Mycobacterium bovis subsp bovis AF2122/97
acccgcaugacgccggcg

SEQ ID NO: 1063754 - RNA, 14 nt, Mycobacterium bovis subsp bovis AF2122/97
acccgcauggacgc

SEQ ID NO: 1063755 - RNA, 18 nt, Mycobacterium bovis subsp bovis AF2122/97
acccgcauggcagcggcg

SEQ ID NO: 1063756 - RNA, 21 nt, Mycobacterium bovis subsp bovis AF2122/97
acccgcauggcagcggcggua

SEQ ID NO: 1063757 - RNA, 14 nt, Mycobacterium bovis subsp bovis AF2122/97
acccgccaccgcga

SEQ ID NO: 1063758 - RNA, 19 nt, Mycobacterium bovis subsp bovis AF2122/97
acccgccaccgcgacaccc

SEQ ID NO: 1063759 - RNA, 21 nt, Mycobacterium bovis subsp bovis AF2122/97
acccgccacgguucgggcagc

SEQ ID NO: 1063760 - RNA, 20 nt, Mycobacterium bovis subsp bovis AF2122/97
acccgccacguacuccaccg

SEQ ID NO: 1063761 - RNA, 13 nt, Mycobacterium bovis subsp bovis AF2122/97
acccgaaacaccg

SEQ ID NO: 1063762 - RNA, 14 nt, Mycobacterium bovis subsp bovis AF2122/97
acccgaaacaccgu

SEQ ID NO: 1063763 - RNA, 20 nt, Mycobacterium bovis subsp bovis AF2122/97
accccugucgggucgagucc

SEQ ID NO: 1063764 - RNA, 14 nt, Mycobacterium bovis subsp bovis AF2122/97
accccuucgccagc

SEQ ID NO: 1063765 - RNA, 17 nt, Mycobacterium bovis subsp bovis AF2122/97
accccuucgccagcgcc

SEQ ID NO: 1063766 - RNA, 19 nt, Mycobacterium bovis subsp bovis AF2122/97
accccuucgccagcgccac

SEQ ID NO: 1063767 - RNA, 18 nt, Mycobacterium bovis subsp bovis AF2122/97
accccuggccgccggcgc

SEQ ID NO: 1063768 - RNA, 21 nt, Mycobacterium bovis subsp bovis AF2122/97
accccugguagcacccacggc

SEQ ID NO: 1063769 - RNA, 12 nt, Mycobacterium bovis subsp bovis AF2122/97
acagcagcaccg

SEQ ID NO: 1063770 - RNA, 15 nt, Mycobacterium bovis subsp bovis AF2122/97
acagcagcaccgcga

SEQ ID NO: 1063771 - RNA, 13 nt, Mycobacterium bovis subsp bovis AF2122/97
acagccaccagcc

SEQ ID NO: 1063772 - RNA, 17 nt, Mycobacterium bovis subsp bovis AF2122/97
acagccaccagccgggc

SEQ ID NO: 1063773 - RNA, 17 nt, Mycobacterium bovis subsp bovis AF2122/97
acagcaccguccucggu

SEQ ID NO: 1063774 - RNA, 20 nt, Mycobacterium bovis subsp bovis AF2122/97
acagcaccguccucggucac

SEQ ID NO: 1063775 - RNA, 18 nt, Mycobacterium bovis subsp bovis AF2122/97
acagcaccgccggugcgg

SEQ ID NO: 1063776 - RNA, 12 nt, Mycobacterium bovis subsp bovis AF2122/97
acagcaccgcga

SEQ ID NO: 1063777 - RNA, 13 nt, Mycobacterium bovis subsp bovis AF2122/97
acagcaccgccgg

SEQ ID NO: 1063778 - RNA, 21 nt, Mycobacterium bovis subsp bovis AF2122/97
acagcaccgaacccgccaccg

SEQ ID NO: 1063779 - RNA, 20 nt, Mycobacterium bovis subsp bovis AF2122/97
acagcaccccgccgggggca

SEQ ID NO: 1063780 - RNA, 13 nt, Mycobacterium bovis subsp bovis AF2122/97
acacggcgcugcc

SEQ ID NO: 1063781 - RNA, 12 nt, Mycobacterium bovis subsp bovis AF2122/97
acacucgcagca

SEQ ID NO: 1063782 - RNA, 18 nt, Mycobacterium bovis subsp bovis AF2122/97
acacuccugagaugcggc

SEQ ID NO: 1063783 - RNA, 22 nt, Mycobacterium bovis subsp bovis AF2122/97
acacuggggauaaacugccgcg

SEQ ID NO: 1063784 - RNA, 13 nt, Mycobacterium bovis subsp bovis AF2122/97
acacuggccgucg

SEQ ID NO: 1063785 - RNA, 13 nt, Mycobacterium bovis subsp bovis AF2122/97
acacugcugcggc

SEQ ID NO: 1063786 - RNA, 14 nt, Mycobacterium bovis subsp bovis AF2122/97
acacugcugcggca

SEQ ID NO: 1063787 - RNA, 21 nt, Mycobacterium bovis subsp bovis AF2122/97
acacugccggacagccacgca

SEQ ID NO: 1063788 - RNA, 23 nt, Mycobacterium bovis subsp bovis AF2122/97
acacugcgaaggaccagagcucg

SEQ ID NO: 1063789 - RNA, 21 nt, Mycobacterium bovis subsp bovis AF2122/97
acacuguuacuccgacggccc

SEQ ID NO: 1063790 - RNA, 15 nt, Mycobacterium bovis subsp bovis AF2122/97
acagcgcguuggcga

SEQ ID NO: 1063791 - RNA, 12 nt, Mycobacterium bovis subsp bovis AF2122/97
acagcgcggcgg

SEQ ID NO: 1063792 - RNA, 22 nt, Mycobacterium bovis subsp bovis AF2122/97
acagcgcgggacacgucgcgcc

SEQ ID NO: 1063793 - RNA, 15 nt, Mycobacterium bovis subsp bovis AF2122/97
acagcggaucccgcc

SEQ ID NO: 1063794 - RNA, 17 nt, Mycobacterium bovis subsp bovis AF2122/97
acagcggaucccgccgg

SEQ ID NO: 1063795 - RNA, 23 nt, Mycobacterium bovis subsp bovis AF2122/97
acagcgccaugcccucggcgccg

SEQ ID NO: 1063796 - RNA, 22 nt, Mycobacterium bovis subsp bovis AF2122/97
acagcgccaugcccucggcgcc

SEQ ID NO: 1063797 - RNA, 13 nt, Mycobacterium bovis subsp bovis AF2122/97
acagcgacgccau

SEQ ID NO: 1063798 - RNA, 17 nt, Mycobacterium bovis subsp bovis AF2122/97
acagcgccaucgaugcg

SEQ ID NO: 1063799 - RNA, 22 nt, Mycobacterium bovis subsp bovis AF2122/97
acagcgccaucgaugcggugaa

SEQ ID NO: 1063800 - RNA, 23 nt, Mycobacterium bovis subsp bovis AF2122/97
acagcgcgagaucagccggcagc

SEQ ID NO: 1063801 - RNA, 21 nt, Mycobacterium bovis subsp bovis AF2122/97
acagcgccaguagcacguuga

SEQ ID NO: 1063802 - RNA, 15 nt, Mycobacterium bovis subsp bovis AF2122/97
acagcgaaccgccgg

SEQ ID NO: 1063803 - RNA, 17 nt, Mycobacterium bovis subsp bovis AF2122/97
acagcgauccgauccgc

SEQ ID NO: 1063804 - RNA, 17 nt, Mycobacterium bovis subsp bovis AF2122/97
acagcgaacagacaugc

SEQ ID NO: 1063805 - RNA, 16 nt, Mycobacterium bovis subsp bovis AF2122/97
acagcgaaccgccggc

SEQ ID NO: 1063806 - RNA, 21 nt, Mycobacterium bovis subsp bovis AF2122/97
acagcccgaacgaggcgccca

SEQ ID NO: 1063807 - RNA, 19 nt, Mycobacterium bovis subsp bovis AF2122/97
acagccccaucaccaccgg

SEQ ID NO: 1063808 - RNA, 18 nt, Mycobacterium bovis subsp bovis AF2122/97
acagccccaucaccaccg

SEQ ID NO: 1063809 - RNA, 21 nt, Mycobacterium bovis subsp bovis AF2122/97
acagcccaccggugccgcccg

SEQ ID NO: 1063810 - RNA, 13 nt, Mycobacterium bovis subsp bovis AF2122/97
acagcccgaugcc

SEQ ID NO: 1063811 - RNA, 14 nt, Mycobacterium bovis subsp bovis AF2122/97
acagcccgaugccg

SEQ ID NO: 1063812 - RNA, 12 nt, Mycobacterium bovis subsp bovis AF2122/97
acagccgucgca

SEQ ID NO: 1063813 - RNA, 14 nt, Mycobacterium bovis subsp bovis AF2122/97
acagccgucgcacc

SEQ ID NO: 1063814 - RNA, 19 nt, Mycobacterium bovis subsp bovis AF2122/97
acagccuauuccgaauuac

SEQ ID NO: 1063815 - RNA, 15 nt, Mycobacterium bovis subsp bovis AF2122/97
acaccguaccgacga

SEQ ID NO: 1063816 - RNA, 17 nt, Mycobacterium bovis subsp bovis AF2122/97
acaccgucacgccaccg

SEQ ID NO: 1063817 - RNA, 21 nt, Mycobacterium bovis subsp bovis AF2122/97
acaccgucacgccaccgcaac

SEQ ID NO: 1063818 - RNA, 18 nt, Mycobacterium bovis subsp bovis AF2122/97
acaccggugcgaccaaca

SEQ ID NO: 1063819 - RNA, 17 nt, Mycobacterium bovis subsp bovis AF2122/97
acaccgguggacccggc

SEQ ID NO: 1063820 - RNA, 18 nt, Mycobacterium bovis subsp bovis AF2122/97
acaccggugucggccagc

SEQ ID NO: 1063821 - RNA, 18 nt, Mycobacterium bovis subsp bovis AF2122/97
acaccgguugacagcucc

SEQ ID NO: 1063822 - RNA, 15 nt, Mycobacterium bovis subsp bovis AF2122/97
acaccggucggcagc

SEQ ID NO: 1063823 - RNA, 17 nt, Mycobacterium bovis subsp bovis AF2122/97
acaccgguaacgccaac

SEQ ID NO: 1063824 - RNA, 23 nt, Mycobacterium bovis subsp bovis AF2122/97
acaccgguaacgccaacaccggc

SEQ ID NO: 1063825 - RNA, 16 nt, Mycobacterium bovis subsp bovis AF2122/97
acaccguccgucggcg

SEQ ID NO: 1063826 - RNA, 23 nt, Mycobacterium bovis subsp bovis AF2122/97
acaccgucagcgucugagcgccg

SEQ ID NO: 1063827 - RNA, 19 nt, Mycobacterium bovis subsp bovis AF2122/97
acaccguccagcagcucgg

SEQ ID NO: 1063828 - RNA, 20 nt, Mycobacterium bovis subsp bovis AF2122/97
acaccgugaccgccgcgccg

SEQ ID NO: 1063829 - RNA, 19 nt, Mycobacterium bovis subsp bovis AF2122/97
acaccgugcaccagcucac

SEQ ID NO: 1063830 - RNA, 16 nt, Mycobacterium bovis subsp bovis AF2122/97
acacgagucgccagac

SEQ ID NO: 1063831 - RNA, 20 nt, Mycobacterium bovis subsp bovis AF2122/97
acacgagucgccagaccgca

SEQ ID NO: 1063832 - RNA, 15 nt, Mycobacterium bovis subsp bovis AF2122/97
acacgaugcccggca

SEQ ID NO: 1063833 - RNA, 15 nt, Mycobacterium bovis subsp bovis AF2122/97
acacgauaucgggcu

SEQ ID NO: 1063834 - RNA, 23 nt, Mycobacterium bovis subsp bovis AF2122/97
acacgauaucgggcucagcggcg

SEQ ID NO: 1063835 - RNA, 14 nt, Mycobacterium bovis subsp bovis AF2122/97
acaccgugucgccg

SEQ ID NO: 1063836 - RNA, 18 nt, Mycobacterium bovis subsp bovis AF2122/97
acaccgugucgccggcga

SEQ ID NO: 1063837 - RNA, 18 nt, Mycobacterium bovis subsp bovis AF2122/97
acacgacgaauguccgca

SEQ ID NO: 1063838 - RNA, 17 nt, Mycobacterium bovis subsp bovis AF2122/97
acacgccgugcgugcgg

SEQ ID NO: 1063839 - RNA, 13 nt, Mycobacterium bovis subsp bovis AF2122/97
acacgccggcccg

SEQ ID NO: 1063840 - RNA, 18 nt, Mycobacterium bovis subsp bovis AF2122/97
acacgccgccggugucgg

SEQ ID NO: 1063841 - RNA, 17 nt, Mycobacterium bovis subsp bovis AF2122/97
acacgccagccgugccg

SEQ ID NO: 1063842 - RNA, 17 nt, Mycobacterium bovis subsp bovis AF2122/97
acacgaugcgcggugcg

SEQ ID NO: 1063843 - RNA, 13 nt, Mycobacterium bovis subsp bovis AF2122/97
acaccgccagcau

SEQ ID NO: 1063844 - RNA, 20 nt, Mycobacterium bovis subsp bovis AF2122/97
acaccgcaccugggcggcgc

SEQ ID NO: 1063845 - RNA, 20 nt, Mycobacterium bovis subsp bovis AF2122/97
acaccgcauaaaucgggguu

SEQ ID NO: 1063846 - RNA, 16 nt, Mycobacterium bovis subsp bovis AF2122/97
acaccgcaacgcgugc

SEQ ID NO: 1063847 - RNA, 21 nt, Mycobacterium bovis subsp bovis AF2122/97
acaccgccaccacgccgucga

SEQ ID NO: 1063848 - RNA, 20 nt, Mycobacterium bovis subsp bovis AF2122/97
acaccgaggcgaccggaccg

SEQ ID NO: 1063849 - RNA, 16 nt, Mycobacterium bovis subsp bovis AF2122/97
acaccgcggcgaucug

SEQ ID NO: 1063850 - RNA, 12 nt, Mycobacterium bovis subsp bovis AF2122/97
acaccgcggcgc

SEQ ID NO: 1063851 - RNA, 21 nt, Mycobacterium bovis subsp bovis AF2122/97
acaccgcggacccgcagcugc

SEQ ID NO: 1063852 - RNA, 18 nt, Mycobacterium bovis subsp bovis AF2122/97
acaccgcggaaggccagc

SEQ ID NO: 1063853 - RNA, 15 nt, Mycobacterium bovis subsp bovis AF2122/97
acaccgcgccgacga

SEQ ID NO: 1063854 - RNA, 12 nt, Mycobacterium bovis subsp bovis AF2122/97
acaccgcccggc

SEQ ID NO: 1063855 - RNA, 13 nt, Mycobacterium bovis subsp bovis AF2122/97
acaccgcccggcc

SEQ ID NO: 1063856 - RNA, 15 nt, Mycobacterium bovis subsp bovis AF2122/97
acaccgcccggcccg

SEQ ID NO: 1063857 - RNA, 15 nt, Mycobacterium bovis subsp bovis AF2122/97
acaccgccagcucac

SEQ ID NO: 1063858 - RNA, 21 nt, Mycobacterium bovis subsp bovis AF2122/97
acacccucgggcaacucggug

SEQ ID NO: 1063859 - RNA, 17 nt, Mycobacterium bovis subsp bovis AF2122/97
acacccuugcccacggc

SEQ ID NO: 1063860 - RNA, 15 nt, Mycobacterium bovis subsp bovis AF2122/97
acacccguguugagg

SEQ ID NO: 1063861 - RNA, 20 nt, Mycobacterium bovis subsp bovis AF2122/97
acacccgacacggcucgccg

SEQ ID NO: 1063862 - RNA, 12 nt, Mycobacterium bovis subsp bovis AF2122/97
acacccgagcaa

SEQ ID NO: 1063863 - RNA, 19 nt, Mycobacterium bovis subsp bovis AF2122/97
acacccgggacgaaccggc

SEQ ID NO: 1063864 - RNA, 21 nt, Mycobacterium bovis subsp bovis AF2122/97
acacccgguaugcgcgucccc

SEQ ID NO: 1063865 - RNA, 18 nt, Mycobacterium bovis subsp bovis AF2122/97
acacccgcaccggaucgg

SEQ ID NO: 1063866 - RNA, 21 nt, Mycobacterium bovis subsp bovis AF2122/97
acacccgcaccggaucggcua

SEQ ID NO: 1063867 - RNA, 14 nt, Mycobacterium bovis subsp bovis AF2122/97
acacccgcccgggc

SEQ ID NO: 1063868 - RNA, 19 nt, Mycobacterium bovis subsp bovis AF2122/97
acacccggccgaccucggc

SEQ ID NO: 1063869 - RNA, 15 nt, Mycobacterium bovis subsp bovis AF2122/97
acacccggccgccga

SEQ ID NO: 1063870 - RNA, 22 nt, Mycobacterium bovis subsp bovis AF2122/97
acacaggcguccaucgccaccg

SEQ ID NO: 1063871 - RNA, 21 nt, Mycobacterium bovis subsp bovis AF2122/97
acacagaucuugugccaggcg

SEQ ID NO: 1063872 - RNA, 13 nt, Mycobacterium bovis subsp bovis AF2122/97
acacaccgagcgc

SEQ ID NO: 1063873 - RNA, 19 nt, Mycobacterium bovis subsp bovis AF2122/97
acacaccgcauaaggccca

SEQ ID NO: 1063874 - RNA, 18 nt, Mycobacterium bovis subsp bovis AF2122/97
acaaccccgaggcaacaa

SEQ ID NO: 1063875 - RNA, 14 nt, Mycobacterium bovis subsp bovis AF2122/97
acaaccccgccagg

SEQ ID NO: 1063876 - RNA, 19 nt, Mycobacterium bovis subsp bovis AF2122/97
acaacccuguuguugucgg

SEQ ID NO: 1063877 - RNA, 22 nt, Mycobacterium bovis subsp bovis AF2122/97
acaaccgugagcaccagcagca

SEQ ID NO: 1063878 - RNA, 23 nt, Mycobacterium bovis subsp bovis AF2122/97
acaaccgugagcaccagcagcac

SEQ ID NO: 1063879 - RNA, 17 nt, Mycobacterium bovis subsp bovis AF2122/97
acaacccggcgucgacg

SEQ ID NO: 1063880 - RNA, 23 nt, Mycobacterium bovis subsp bovis AF2122/97
acaacccguaggguggccgacga

SEQ ID NO: 1063881 - RNA, 19 nt, Mycobacterium bovis subsp bovis AF2122/97
acaacccgucgagccgugc

SEQ ID NO: 1063882 - RNA, 14 nt, Mycobacterium bovis subsp bovis AF2122/97
acaacagcgcucca

SEQ ID NO: 1063883 - RNA, 20 nt, Mycobacterium bovis subsp bovis AF2122/97
acaacagcgucuggccgucg

SEQ ID NO: 1063884 - RNA, 15 nt, Mycobacterium bovis subsp bovis AF2122/97
acaacaggccgucga

SEQ ID NO: 1063885 - RNA, 13 nt, Mycobacterium bovis subsp bovis AF2122/97
acaacaucgaauc

SEQ ID NO: 1063886 - RNA, 15 nt, Mycobacterium bovis subsp bovis AF2122/97
acaaccacccacccg

SEQ ID NO: 1063887 - RNA, 12 nt, Mycobacterium bovis subsp bovis AF2122/97
acaacaucgcca

SEQ ID NO: 1063888 - RNA, 15 nt, Mycobacterium bovis subsp bovis AF2122/97
acaaacggcgaccca

SEQ ID NO: 1063889 - RNA, 21 nt, Mycobacterium bovis subsp bovis AF2122/97
acaaagcugcucgucggcgcc

SEQ ID NO: 1063890 - RNA, 14 nt, Mycobacterium bovis subsp bovis AF2122/97
acaacagccgcagc

SEQ ID NO: 1063891 - RNA, 17 nt, Mycobacterium bovis subsp bovis AF2122/97
acaacaccaccagcacg

SEQ ID NO: 1063892 - RNA, 14 nt, Mycobacterium bovis subsp bovis AF2122/97
acaacacgccgucg

SEQ ID NO: 1063893 - RNA, 12 nt, Mycobacterium bovis subsp bovis AF2122/97
acaacacgggca

SEQ ID NO: 1063894 - RNA, 13 nt, Mycobacterium bovis subsp bovis AF2122/97
acaaacagcgcca

SEQ ID NO: 1063895 - RNA, 17 nt, Mycobacterium bovis subsp bovis AF2122/97
acaaaaucagcagcccc

SEQ ID NO: 1063896 - RNA, 13 nt, Mycobacterium bovis subsp bovis AF2122/97
acaaacaucgcac

SEQ ID NO: 1063897 - RNA, 21 nt, Mycobacterium bovis subsp bovis AF2122/97
acaaacugggaugugccgcgc

SEQ ID NO: 1063898 - RNA, 21 nt, Mycobacterium bovis subsp bovis AF2122/97
acaagucgaccaugagccggc

SEQ ID NO: 1063899 - RNA, 13 nt, Mycobacterium bovis subsp bovis AF2122/97
acaaguccgcgau

SEQ ID NO: 1063900 - RNA, 18 nt, Mycobacterium bovis subsp bovis AF2122/97
acaaggccaagcgccaac

SEQ ID NO: 1063901 - RNA, 22 nt, Mycobacterium bovis subsp bovis AF2122/97
acaaggccgccgccgucggcga

SEQ ID NO: 1063902 - RNA, 15 nt, Mycobacterium bovis subsp bovis AF2122/97
acaagaauggccgcc

SEQ ID NO: 1063903 - RNA, 23 nt, Mycobacterium bovis subsp bovis AF2122/97
acaagccgcugauguacccggcg

SEQ ID NO: 1063904 - RNA, 12 nt, Mycobacterium bovis subsp bovis AF2122/97
acaacggcggca

SEQ ID NO: 1063905 - RNA, 13 nt, Mycobacterium bovis subsp bovis AF2122/97
acaacggcggcgc

SEQ ID NO: 1063906 - RNA, 14 nt, Mycobacterium bovis subsp bovis AF2122/97
acaacggcgcggca

SEQ ID NO: 1063907 - RNA, 16 nt, Mycobacterium bovis subsp bovis AF2122/97
acaacgucgccgcggc

SEQ ID NO: 1063908 - RNA, 17 nt, Mycobacterium bovis subsp bovis AF2122/97
acaacgucgccgcggcg

SEQ ID NO: 1063909 - RNA, 19 nt, Mycobacterium bovis subsp bovis AF2122/97
acaacgucgccgcggcggc

SEQ ID NO: 1063910 - RNA, 20 nt, Mycobacterium bovis subsp bovis AF2122/97
acaacgucgccgcggcggca

SEQ ID NO: 1063911 - RNA, 22 nt, Mycobacterium bovis subsp bovis AF2122/97
acaacuaucgucgugucgccgc

SEQ ID NO: 1063912 - RNA, 14 nt, Mycobacterium bovis subsp bovis AF2122/97
acaacugcccgaug

SEQ ID NO: 1063913 - RNA, 16 nt, Mycobacterium bovis subsp bovis AF2122/97
acaacgccucgccauc

SEQ ID NO: 1063914 - RNA, 17 nt, Mycobacterium bovis subsp bovis AF2122/97
acaacgcuucggcgugc

SEQ ID NO: 1063915 - RNA, 22 nt, Mycobacterium bovis subsp bovis AF2122/97
acaacgauugcgaagggcaccg

SEQ ID NO: 1063916 - RNA, 12 nt, Mycobacterium bovis subsp bovis AF2122/97
acaacgccgcga

SEQ ID NO: 1063917 - RNA, 15 nt, Mycobacterium bovis subsp bovis AF2122/97
acaacgccgcgacgu

SEQ ID NO: 1063918 - RNA, 22 nt, Mycobacterium bovis subsp bovis AF2122/97
acaacgccgucgauguggcgcu

SEQ ID NO: 1063919 - RNA, 13 nt, Mycobacterium bovis subsp bovis AF2122/97
acaacgacacgcc

SEQ ID NO: 1063920 - RNA, 15 nt, Mycobacterium bovis subsp bovis AF2122/97
acaacgacgucgccg

SEQ ID NO: 1063921 - RNA, 17 nt, Mycobacterium bovis subsp bovis AF2122/97
acaacgacgucgccgac

SEQ ID NO: 1063922 - RNA, 15 nt, Mycobacterium bovis subsp bovis AF2122/97
acaacgaaaccgacc

SEQ ID NO: 1063923 - RNA, 19 nt, Mycobacterium bovis subsp bovis AF2122/97
acaauggcggcgccgucga

SEQ ID NO: 1063924 - RNA, 19 nt, Mycobacterium bovis subsp bovis AF2122/97
acacaacgggugucggcgu

SEQ ID NO: 1063925 - RNA, 20 nt, Mycobacterium bovis subsp bovis AF2122/97
acaauccacgucgcggcguu

SEQ ID NO: 1063926 - RNA, 14 nt, Mycobacterium bovis subsp bovis AF2122/97
acaaucucggcguu

SEQ ID NO: 1063927 - RNA, 23 nt, Mycobacterium bovis subsp bovis AF2122/97
accacgugcgagggcacggcggu

SEQ ID NO: 1063928 - RNA, 14 nt, Mycobacterium bovis subsp bovis AF2122/97
accacgugcgccac

SEQ ID NO: 1063929 - RNA, 22 nt, Mycobacterium bovis subsp bovis AF2122/97
accacgguagacaagucggcgc

SEQ ID NO: 1063930 - RNA, 23 nt, Mycobacterium bovis subsp bovis AF2122/97
accacgguagacaagucggcgcu

SEQ ID NO: 1063931 - RNA, 19 nt, Mycobacterium bovis subsp bovis AF2122/97
accacggcgcgcgcgccgg

SEQ ID NO: 1063932 - RNA, 15 nt, Mycobacterium bovis subsp bovis AF2122/97
accacggcggccacc

SEQ ID NO: 1063933 - RNA, 20 nt, Mycobacterium bovis subsp bovis AF2122/97
accacgguagacaagucggc

SEQ ID NO: 1063934 - RNA, 15 nt, Mycobacterium bovis subsp bovis AF2122/97
accacggcguugccg

SEQ ID NO: 1063935 - RNA, 20 nt, Mycobacterium bovis subsp bovis AF2122/97
accacggcguugccgccggc

SEQ ID NO: 1063936 - RNA, 14 nt, Mycobacterium bovis subsp bovis AF2122/97
accacggcgauccg

SEQ ID NO: 1063937 - RNA, 22 nt, Mycobacterium bovis subsp bovis AF2122/97
accacggcgauccggucggcca

SEQ ID NO: 1063938 - RNA, 23 nt, Mycobacterium bovis subsp bovis AF2122/97
accacggcgauccggucggccag

SEQ ID NO: 1063939 - RNA, 13 nt, Mycobacterium bovis subsp bovis AF2122/97
accacggcgcagu

SEQ ID NO: 1063940 - RNA, 21 nt, Mycobacterium bovis subsp bovis AF2122/97
accacggcagccaaccggcgc

SEQ ID NO: 1063941 - RNA, 22 nt, Mycobacterium bovis subsp bovis AF2122/97
accaccuguccgguggaaucca

SEQ ID NO: 1063942 - RNA, 20 nt, Mycobacterium bovis subsp bovis AF2122/97
accacggccagaaacccggc

SEQ ID NO: 1063943 - RNA, 14 nt, Mycobacterium bovis subsp bovis AF2122/97
accacggcaccgau

SEQ ID NO: 1063944 - RNA, 15 nt, Mycobacterium bovis subsp bovis AF2122/97
accaccgucaccgcc

SEQ ID NO: 1063945 - RNA, 23 nt, Mycobacterium bovis subsp bovis AF2122/97
accaccguuugagcggccaccgu

SEQ ID NO: 1063946 - RNA, 18 nt, Mycobacterium bovis subsp bovis AF2122/97
accaccuggugcaaccgu

SEQ ID NO: 1063947 - RNA, 21 nt, Mycobacterium bovis subsp bovis AF2122/97
accaccuggugcaaccgugcc

SEQ ID NO: 1063948 - RNA, 19 nt, Mycobacterium bovis subsp bovis AF2122/97
accaccucggugaccaggc

SEQ ID NO: 1063949 - RNA, 15 nt, Mycobacterium bovis subsp bovis AF2122/97
accaccggccgcgca

SEQ ID NO: 1063950 - RNA, 15 nt, Mycobacterium bovis subsp bovis AF2122/97
accaccggccguccc

SEQ ID NO: 1063951 - RNA, 17 nt, Mycobacterium bovis subsp bovis AF2122/97
accaccggccgucccgc

SEQ ID NO: 1063952 - RNA, 24 nt, Mycobacterium bovis subsp bovis AF2122/97
accaccggccgucccgcgagcagc

SEQ ID NO: 1063953 - RNA, 22 nt, Mycobacterium bovis subsp bovis AF2122/97
accaccggaucgccgucggcgg

SEQ ID NO: 1063954 - RNA, 21 nt, Mycobacterium bovis subsp bovis AF2122/97
accaccggccccaccggcacc

SEQ ID NO: 1063955 - RNA, 19 nt, Mycobacterium bovis subsp bovis AF2122/97
accaccgguccagcgccgg

SEQ ID NO: 1063956 - RNA, 21 nt, Mycobacterium bovis subsp bovis AF2122/97
accaccgguccagcgccggaa

SEQ ID NO: 1063957 - RNA, 13 nt, Mycobacterium bovis subsp bovis AF2122/97
accaccggcgccg

SEQ ID NO: 1063958 - RNA, 16 nt, Mycobacterium bovis subsp bovis AF2122/97
accaccggcgccgccg

SEQ ID NO: 1063959 - RNA, 17 nt, Mycobacterium bovis subsp bovis AF2122/97
accaccggcgccgccgg

SEQ ID NO: 1063960 - RNA, 18 nt, Mycobacterium bovis subsp bovis AF2122/97
accaccggcgccgccggc

SEQ ID NO: 1063961 - RNA, 18 nt, Mycobacterium bovis subsp bovis AF2122/97
accaccgucaccgccggc

SEQ ID NO: 1063962 - RNA, 13 nt, Mycobacterium bovis subsp bovis AF2122/97
accaccgucacga

SEQ ID NO: 1063963 - RNA, 14 nt, Mycobacterium bovis subsp bovis AF2122/97
accaccgucgagcc

SEQ ID NO: 1063964 - RNA, 16 nt, Mycobacterium bovis subsp bovis AF2122/97
accaccgcggugugcg

SEQ ID NO: 1063965 - RNA, 14 nt, Mycobacterium bovis subsp bovis AF2122/97
accaccgucaccgc

SEQ ID NO: 1063966 - RNA, 15 nt, Mycobacterium bovis subsp bovis AF2122/97
accaccgucgagccg

SEQ ID NO: 1063967 - RNA, 14 nt, Mycobacterium bovis subsp bovis AF2122/97
accaccgucuccgg

SEQ ID NO: 1063968 - RNA, 16 nt, Mycobacterium bovis subsp bovis AF2122/97
accaccgucucgccgc

SEQ ID NO: 1063969 - RNA, 12 nt, Mycobacterium bovis subsp bovis AF2122/97
accacccgcacu

SEQ ID NO: 1063970 - RNA, 13 nt, Mycobacterium bovis subsp bovis AF2122/97
accaccccgaggc

SEQ ID NO: 1063971 - RNA, 21 nt, Mycobacterium bovis subsp bovis AF2122/97
accacccagauugccugggcg

SEQ ID NO: 1063972 - RNA, 18 nt, Mycobacterium bovis subsp bovis AF2122/97
accaccccagcggccacc

SEQ ID NO: 1063973 - RNA, 16 nt, Mycobacterium bovis subsp bovis AF2122/97
accacccacccgcacc

SEQ ID NO: 1063974 - RNA, 20 nt, Mycobacterium bovis subsp bovis AF2122/97
accaccccagcggccaccga

SEQ ID NO: 1063975 - RNA, 13 nt, Mycobacterium bovis subsp bovis AF2122/97
accacccaacagc

SEQ ID NO: 1063976 - RNA, 21 nt, Mycobacterium bovis subsp bovis AF2122/97
accaccaguggcgcgugcagc

SEQ ID NO: 1063977 - RNA, 21 nt, Mycobacterium bovis subsp bovis AF2122/97
accaccaguaccaccggcacc

SEQ ID NO: 1063978 - RNA, 13 nt, Mycobacterium bovis subsp bovis AF2122/97
accaccggcaccc

SEQ ID NO: 1063979 - RNA, 14 nt, Mycobacterium bovis subsp bovis AF2122/97
accaccggcacccg

SEQ ID NO: 1063980 - RNA, 12 nt, Mycobacterium bovis subsp bovis AF2122/97
accaccggcccc

SEQ ID NO: 1063981 - RNA, 20 nt, Mycobacterium bovis subsp bovis AF2122/97
accaccggccccaccggcac

SEQ ID NO: 1063982 - RNA, 19 nt, Mycobacterium bovis subsp bovis AF2122/97
accaccggaauacgcgccg

SEQ ID NO: 1063983 - RNA, 23 nt, Mycobacterium bovis subsp bovis AF2122/97
accaccggaauacgcgccgccgg

SEQ ID NO: 1063984 - RNA, 17 nt, Mycobacterium bovis subsp bovis AF2122/97
accaccgcggcggcggc

SEQ ID NO: 1063985 - RNA, 22 nt, Mycobacterium bovis subsp bovis AF2122/97
accaccgcggcugcuccgucgc

SEQ ID NO: 1063986 - RNA, 15 nt, Mycobacterium bovis subsp bovis AF2122/97
accacccgccgcagc

SEQ ID NO: 1063987 - RNA, 19 nt, Mycobacterium bovis subsp bovis AF2122/97
accacccgggccucggcgc

SEQ ID NO: 1063988 - RNA, 22 nt, Mycobacterium bovis subsp bovis AF2122/97
accaccgaaauacccagcgcag

SEQ ID NO: 1063989 - RNA, 13 nt, Mycobacterium bovis subsp bovis AF2122/97
accaccacccgga

SEQ ID NO: 1063990 - RNA, 16 nt, Mycobacterium bovis subsp bovis AF2122/97
accaccaccgccgccg

SEQ ID NO: 1063991 - RNA, 22 nt, Mycobacterium bovis subsp bovis AF2122/97
accacauuggugauggccgacg

SEQ ID NO: 1063992 - RNA, 16 nt, Mycobacterium bovis subsp bovis AF2122/97
accacaucaugccagc

SEQ ID NO: 1063993 - RNA, 22 nt, Mycobacterium bovis subsp bovis AF2122/97
accacagugaaauccgagccgc

SEQ ID NO: 1063994 - RNA, 18 nt, Mycobacterium bovis subsp bovis AF2122/97
accacaccgugaccagcc

SEQ ID NO: 1063995 - RNA, 18 nt, Mycobacterium bovis subsp bovis AF2122/97
accacagacugcgcggca

SEQ ID NO: 1063996 - RNA, 17 nt, Mycobacterium bovis subsp bovis AF2122/97
accaaucgcacgccagc

SEQ ID NO: 1063997 - RNA, 18 nt, Mycobacterium bovis subsp bovis AF2122/97
accaaugaccgccagcag

SEQ ID NO: 1063998 - RNA, 14 nt, Mycobacterium bovis subsp bovis AF2122/97
accagcugucgggc

SEQ ID NO: 1063999 - RNA, 17 nt, Mycobacterium bovis subsp bovis AF2122/97
accagcguuugaacgca

SEQ ID NO: 1064000 - RNA, 16 nt, Mycobacterium bovis subsp bovis AF2122/97
accagcuugaccgacc

SEQ ID NO: 1064001 - RNA, 16 nt, Mycobacterium bovis subsp bovis AF2122/97
accagcugagccgucg

SEQ ID NO: 1064002 - RNA, 20 nt, Mycobacterium bovis subsp bovis AF2122/97
accagcugagccgucggcgc

SEQ ID NO: 1064003 - RNA, 21 nt, Mycobacterium bovis subsp bovis AF2122/97
accagcuccucgugcucggcc

SEQ ID NO: 1064004 - RNA, 15 nt, Mycobacterium bovis subsp bovis AF2122/97
accagcucagcugcg

SEQ ID NO: 1064005 - RNA, 14 nt, Mycobacterium bovis subsp bovis AF2122/97
accagcucacccgg

SEQ ID NO: 1064006 - RNA, 21 nt, Mycobacterium bovis subsp bovis AF2122/97
accagcgggucggcggugccg

SEQ ID NO: 1064007 - RNA, 17 nt, Mycobacterium bovis subsp bovis AF2122/97
accagcgggcaucgcga

SEQ ID NO: 1064008 - RNA, 16 nt, Mycobacterium bovis subsp bovis AF2122/97
accagcggucagccgg

SEQ ID NO: 1064009 - RNA, 17 nt, Mycobacterium bovis subsp bovis AF2122/97
accagcggucagccggc

SEQ ID NO: 1064010 - RNA, 15 nt, Mycobacterium bovis subsp bovis AF2122/97
accagcgucgcacgc

SEQ ID NO: 1064011 - RNA, 17 nt, Mycobacterium bovis subsp bovis AF2122/97
accagcgucgcacgcgc

SEQ ID NO: 1064012 - RNA, 18 nt, Mycobacterium bovis subsp bovis AF2122/97
accagcgucgcacgcgcg

SEQ ID NO: 1064013 - RNA, 22 nt, Mycobacterium bovis subsp bovis AF2122/97
accagcguguggagcucgcggc

SEQ ID NO: 1064014 - RNA, 23 nt, Mycobacterium bovis subsp bovis AF2122/97
accagcguaucggccggcagauu

SEQ ID NO: 1064015 - RNA, 18 nt, Mycobacterium bovis subsp bovis AF2122/97
accagcgaccaggucgcc

SEQ ID NO: 1064016 - RNA, 18 nt, Mycobacterium bovis subsp bovis AF2122/97
accagcgacgaccacacc

SEQ ID NO: 1064017 - RNA, 13 nt, Mycobacterium bovis subsp bovis AF2122/97
accagcgacgcca

SEQ ID NO: 1064018 - RNA, 21 nt, Mycobacterium bovis subsp bovis AF2122/97
accagccuuuccggccgccug

SEQ ID NO: 1064019 - RNA, 23 nt, Mycobacterium bovis subsp bovis AF2122/97
accagcgaauccagccgcgcgcc

SEQ ID NO: 1064020 - RNA, 15 nt, Mycobacterium bovis subsp bovis AF2122/97
accagccgugguggu

SEQ ID NO: 1064021 - RNA, 13 nt, Mycobacterium bovis subsp bovis AF2122/97
accagcggcggca

SEQ ID NO: 1064022 - RNA, 14 nt, Mycobacterium bovis subsp bovis AF2122/97
accagcggcggcaa

SEQ ID NO: 1064023 - RNA, 15 nt, Mycobacterium bovis subsp bovis AF2122/97
accagcggcggcccu

SEQ ID NO: 1064024 - RNA, 13 nt, Mycobacterium bovis subsp bovis AF2122/97
accagcggcggcg

SEQ ID NO: 1064025 - RNA, 18 nt, Mycobacterium bovis subsp bovis AF2122/97
accagcccggccgccgag

SEQ ID NO: 1064026 - RNA, 14 nt, Mycobacterium bovis subsp bovis AF2122/97
accagcccggccgc

SEQ ID NO: 1064027 - RNA, 22 nt, Mycobacterium bovis subsp bovis AF2122/97
accagccggucuuggacagcag

SEQ ID NO: 1064028 - RNA, 24 nt, Mycobacterium bovis subsp bovis AF2122/97
accagccggugagcgagcgcgcgu

SEQ ID NO: 1064029 - RNA, 19 nt, Mycobacterium bovis subsp bovis AF2122/97
accagccggucgucgcgca

SEQ ID NO: 1064030 - RNA, 22 nt, Mycobacterium bovis subsp bovis AF2122/97
accagccgaucaucaccggcau

SEQ ID NO: 1064031 - RNA, 16 nt, Mycobacterium bovis subsp bovis AF2122/97
accagcaggccgggcg

SEQ ID NO: 1064032 - RNA, 22 nt, Mycobacterium bovis subsp bovis AF2122/97
accagcaggccgggcgcaagca

SEQ ID NO: 1064033 - RNA, 23 nt, Mycobacterium bovis subsp bovis AF2122/97
accagcagacgccguagccggcc

SEQ ID NO: 1064034 - RNA, 22 nt, Mycobacterium bovis subsp bovis AF2122/97
accagcagauugucgacgguca

SEQ ID NO: 1064035 - RNA, 13 nt, Mycobacterium bovis subsp bovis AF2122/97
accagcagcacca

SEQ ID NO: 1064036 - RNA, 17 nt, Mycobacterium bovis subsp bovis AF2122/97
accagaaccuggagccg

SEQ ID NO: 1064037 - RNA, 14 nt, Mycobacterium bovis subsp bovis AF2122/97
accagaacgacgcc

SEQ ID NO: 1064038 - RNA, 18 nt, Mycobacterium bovis subsp bovis AF2122/97
accagaaacaccgacgac

SEQ ID NO: 1064039 - RNA, 20 nt, Mycobacterium bovis subsp bovis AF2122/97
accagaaacaccgacgacgg

SEQ ID NO: 1064040 - RNA, 15 nt, Mycobacterium bovis subsp bovis AF2122/97
accacuggacccgcc

SEQ ID NO: 1064041 - RNA, 18 nt, Mycobacterium bovis subsp bovis AF2122/97
accacuguuggugccgcc

SEQ ID NO: 1064042 - RNA, 23 nt, Mycobacterium bovis subsp bovis AF2122/97
accacuguuggugccgccaccac

SEQ ID NO: 1064043 - RNA, 13 nt, Mycobacterium bovis subsp bovis AF2122/97
accacuucggcgu

SEQ ID NO: 1064044 - RNA, 18 nt, Mycobacterium bovis subsp bovis AF2122/97
accacuuuccggccgaug

SEQ ID NO: 1064045 - RNA, 22 nt, Mycobacterium bovis subsp bovis AF2122/97
accacuucgcuuucccgucggc

SEQ ID NO: 1064046 - RNA, 18 nt, Mycobacterium bovis subsp bovis AF2122/97
accacggcggccaccugc

SEQ ID NO: 1064047 - RNA, 14 nt, Mycobacterium bovis subsp bovis AF2122/97
accacuagcggcuc

SEQ ID NO: 1064048 - RNA, 18 nt, Mycobacterium bovis subsp bovis AF2122/97
accacuaggucgccggcc

SEQ ID NO: 1064049 - RNA, 18 nt, Mycobacterium bovis subsp bovis AF2122/97
accacucggucguugccg

SEQ ID NO: 1064050 - RNA, 19 nt, Mycobacterium bovis subsp bovis AF2122/97
acauugguaucugucggga

SEQ ID NO: 1064051 - RNA, 17 nt, Mycobacterium bovis subsp bovis AF2122/97
acauugaucgacggcca

SEQ ID NO: 1064052 - RNA, 19 nt, Mycobacterium bovis subsp bovis AF2122/97
acauuggccaggucggcca

SEQ ID NO: 1064053 - RNA, 14 nt, Mycobacterium bovis subsp bovis AF2122/97
acauugccgacccg

SEQ ID NO: 1064054 - RNA, 12 nt, Mycobacterium bovis subsp bovis AF2122/97
acauugccaccg

SEQ ID NO: 1064055 - RNA, 11 nt, Mycobacterium bovis subsp bovis AF2122/97
acauugcccgu

SEQ ID NO: 1064056 - RNA, 15 nt, Mycobacterium bovis subsp bovis AF2122/97
acaucugccggucga

SEQ ID NO: 1064057 - RNA, 22 nt, Mycobacterium bovis subsp bovis AF2122/97
acaucuugucgaucugcccccg

SEQ ID NO: 1064058 - RNA, 20 nt, Mycobacterium bovis subsp bovis AF2122/97
acaucuccgcgucggucagc

SEQ ID NO: 1064059 - RNA, 14 nt, Mycobacterium bovis subsp bovis AF2122/97
acaugauccgccgg

SEQ ID NO: 1064060 - RNA, 18 nt, Mycobacterium bovis subsp bovis AF2122/97
acaugacgaucgcggcgg

SEQ ID NO: 1064061 - RNA, 20 nt, Mycobacterium bovis subsp bovis AF2122/97
acaugacgaucgcggcgggc

SEQ ID NO: 1064062 - RNA, 13 nt, Mycobacterium bovis subsp bovis AF2122/97
accaacccggcuc

SEQ ID NO: 1064063 - RNA, 24 nt, Mycobacterium bovis subsp bovis AF2122/97
accaacccucgccggucagcgugc

SEQ ID NO: 1064064 - RNA, 21 nt, Mycobacterium bovis subsp bovis AF2122/97
accaacauguugucgucgccg

SEQ ID NO: 1064065 - RNA, 22 nt, Mycobacterium bovis subsp bovis AF2122/97
accaacauguugucgucgccgc

SEQ ID NO: 1064066 - RNA, 16 nt, Mycobacterium bovis subsp bovis AF2122/97
accaacgcaacacggg

SEQ ID NO: 1064067 - RNA, 21 nt, Mycobacterium bovis subsp bovis AF2122/97
accaaccucggaucgccaggc

SEQ ID NO: 1064068 - RNA, 14 nt, Mycobacterium bovis subsp bovis AF2122/97
accaacgacagcga

SEQ ID NO: 1064069 - RNA, 20 nt, Mycobacterium bovis subsp bovis AF2122/97
accaacauguugucgucgcc

SEQ ID NO: 1064070 - RNA, 18 nt, Mycobacterium bovis subsp bovis AF2122/97
accaacaggauggugcgg

SEQ ID NO: 1064071 - RNA, 14 nt, Mycobacterium bovis subsp bovis AF2122/97
accaacacgucgag

SEQ ID NO: 1064072 - RNA, 13 nt, Mycobacterium bovis subsp bovis AF2122/97
accaacacgucga

SEQ ID NO: 1064073 - RNA, 14 nt, Mycobacterium bovis subsp bovis AF2122/97
accaacaccgcggc

SEQ ID NO: 1064074 - RNA, 16 nt, Mycobacterium bovis subsp bovis AF2122/97
accaaaccgucaacuu

SEQ ID NO: 1064075 - RNA, 21 nt, Mycobacterium bovis subsp bovis AF2122/97
accaacgcgggaacgaugccg

SEQ ID NO: 1064076 - RNA, 14 nt, Mycobacterium bovis subsp bovis AF2122/97
accaacgccaccgu

SEQ ID NO: 1064077 - RNA, 23 nt, Mycobacterium bovis subsp bovis AF2122/97
accaaguccaacgacuguggcgc

SEQ ID NO: 1064078 - RNA, 23 nt, Mycobacterium bovis subsp bovis AF2122/97
accaagggauccgaagagccagc

SEQ ID NO: 1064079 - RNA, 14 nt, Mycobacterium bovis subsp bovis AF2122/97
accaaggucggcga

SEQ ID NO: 1064080 - RNA, 19 nt, Mycobacterium bovis subsp bovis AF2122/97
accaagcccgucgucgugc

SEQ ID NO: 1064081 - RNA, 21 nt, Mycobacterium bovis subsp bovis AF2122/97
accaagcgcgguggucgcgac

SEQ ID NO: 1064082 - RNA, 16 nt, Mycobacterium bovis subsp bovis AF2122/97
accaaggacgaacgcg

SEQ ID NO: 1064083 - RNA, 18 nt, Mycobacterium bovis subsp bovis AF2122/97
accaaggacgaacgcgcc

SEQ ID NO: 1064084 - RNA, 14 nt, Mycobacterium bovis subsp bovis AF2122/97
acagucgcgcgcuc

SEQ ID NO: 1064085 - RNA, 23 nt, Mycobacterium bovis subsp bovis AF2122/97
acagucggugcagcgcacgcagc

SEQ ID NO: 1064086 - RNA, 20 nt, Mycobacterium bovis subsp bovis AF2122/97
acagugaaauccgagccgcg

SEQ ID NO: 1064087 - RNA, 20 nt, Mycobacterium bovis subsp bovis AF2122/97
acagucgagugaagccgaca

SEQ ID NO: 1064088 - RNA, 17 nt, Mycobacterium bovis subsp bovis AF2122/97
acagcgggggcagcgcg

SEQ ID NO: 1064089 - RNA, 14 nt, Mycobacterium bovis subsp bovis AF2122/97
acagcgggaucccg

SEQ ID NO: 1064090 - RNA, 23 nt, Mycobacterium bovis subsp bovis AF2122/97
acagcggcgauugauccgguggc

SEQ ID NO: 1064091 - RNA, 20 nt, Mycobacterium bovis subsp bovis AF2122/97
acaguggggguccggcggcc

SEQ ID NO: 1064092 - RNA, 16 nt, Mycobacterium bovis subsp bovis AF2122/97
acaguuaucagccgcg

SEQ ID NO: 1064093 - RNA, 17 nt, Mycobacterium bovis subsp bovis AF2122/97
acaguuaucagccgcgc

SEQ ID NO: 1064094 - RNA, 18 nt, Mycobacterium bovis subsp bovis AF2122/97
acaguucggcgagcacau

SEQ ID NO: 1064095 - RNA, 13 nt, Mycobacterium bovis subsp bovis AF2122/97
acaguugcccgac

SEQ ID NO: 1064096 - RNA, 18 nt, Mycobacterium bovis subsp bovis AF2122/97
acaucggucauguccguc

SEQ ID NO: 1064097 - RNA, 15 nt, Mycobacterium bovis subsp bovis AF2122/97
acauccuggcggcug

SEQ ID NO: 1064098 - RNA, 20 nt, Mycobacterium bovis subsp bovis AF2122/97
acauccuugacgcggccaca

SEQ ID NO: 1064099 - RNA, 18 nt, Mycobacterium bovis subsp bovis AF2122/97
acaucgaaaaccgaggca

SEQ ID NO: 1064100 - RNA, 18 nt, Mycobacterium bovis subsp bovis AF2122/97
acaucgguggcccggugc

SEQ ID NO: 1064101 - RNA, 23 nt, Mycobacterium bovis subsp bovis AF2122/97
acaucggugguuagguggcuggc

SEQ ID NO: 1064102 - RNA, 17 nt, Mycobacterium bovis subsp bovis AF2122/97
acaucgucggcgggcgg

SEQ ID NO: 1064103 - RNA, 22 nt, Mycobacterium bovis subsp bovis AF2122/97
acaucgucggcgggcggcagcg

SEQ ID NO: 1064104 - RNA, 23 nt, Mycobacterium bovis subsp bovis AF2122/97
acaucguggcgucgugcgcggcc

SEQ ID NO: 1064105 - RNA, 16 nt, Mycobacterium bovis subsp bovis AF2122/97
acaucgucaucagcgc

SEQ ID NO: 1064106 - RNA, 17 nt, Mycobacterium bovis subsp bovis AF2122/97
acauccgggccgagcgc

SEQ ID NO: 1064107 - RNA, 20 nt, Mycobacterium bovis subsp bovis AF2122/97
acauccgggccgagcgcacc

SEQ ID NO: 1064108 - RNA, 16 nt, Mycobacterium bovis subsp bovis AF2122/97
acauccuugacgcggc

SEQ ID NO: 1064109 - RNA, 10 nt, Mycobacterium bovis subsp bovis AF2122/97
acaucccgga

SEQ ID NO: 1064110 - RNA, 23 nt, Mycobacterium bovis subsp bovis AF2122/97
acauccaggcuguggccagcauc

SEQ ID NO: 1064111 - RNA, 23 nt, Mycobacterium bovis subsp bovis AF2122/97
acauccaguaaccguccgcggac

SEQ ID NO: 1064112 - RNA, 13 nt, Mycobacterium bovis subsp bovis AF2122/97
acauaggcgaucg

SEQ ID NO: 1064113 - RNA, 17 nt, Mycobacterium bovis subsp bovis AF2122/97
acgcuuuccgccgcacc

SEQ ID NO: 1064114 - RNA, 15 nt, Mycobacterium bovis subsp bovis AF2122/97
acgcuuuccggcggu

SEQ ID NO: 1064115 - RNA, 17 nt, Mycobacterium bovis subsp bovis AF2122/97
acggaggugccggcgcc

SEQ ID NO: 1064116 - RNA, 17 nt, Mycobacterium bovis subsp bovis AF2122/97
acgcuuggguagccuga

SEQ ID NO: 1064117 - RNA, 15 nt, Mycobacterium bovis subsp bovis AF2122/97
acggcaccgcgccca

SEQ ID NO: 1064118 - RNA, 18 nt, Mycobacterium bovis subsp bovis AF2122/97
acggcacccugcggcacc

SEQ ID NO: 1064119 - RNA, 20 nt, Mycobacterium bovis subsp bovis AF2122/97
acggauuacaugucacaccc

SEQ ID NO: 1064120 - RNA, 11 nt, Mycobacterium bovis subsp bovis AF2122/97
acggcaccccc

SEQ ID NO: 1064121 - RNA, 18 nt, Mycobacterium bovis subsp bovis AF2122/97
acggcacccccgacgaga

SEQ ID NO: 1064122 - RNA, 13 nt, Mycobacterium bovis subsp bovis AF2122/97
acggcaccggccc

SEQ ID NO: 1064123 - RNA, 14 nt, Mycobacterium bovis subsp bovis AF2122/97
acggcaccggccca

SEQ ID NO: 1064124 - RNA, 13 nt, Mycobacterium bovis subsp bovis AF2122/97
acggcagacacgc

SEQ ID NO: 1064125 - RNA, 15 nt, Mycobacterium bovis subsp bovis AF2122/97
acggaugaucagcga

SEQ ID NO: 1064126 - RNA, 12 nt, Mycobacterium bovis subsp bovis AF2122/97
acggaucgcggc

SEQ ID NO: 1064127 - RNA, 16 nt, Mycobacterium bovis subsp bovis AF2122/97
acggaucgcggcggcg

SEQ ID NO: 1064128 - RNA, 15 nt, Mycobacterium bovis subsp bovis AF2122/97
acggauccucgaaca

SEQ ID NO: 1064129 - RNA, 18 nt, Mycobacterium bovis subsp bovis AF2122/97
acggaugccggucggcgu

SEQ ID NO: 1064130 - RNA, 17 nt, Mycobacterium bovis subsp bovis AF2122/97
acggaucaggcccgggc

SEQ ID NO: 1064131 - RNA, 17 nt, Mycobacterium bovis subsp bovis AF2122/97
acggaugcgauggccga

SEQ ID NO: 1064132 - RNA, 17 nt, Mycobacterium bovis subsp bovis AF2122/97
acggauucccgcccagc

SEQ ID NO: 1064133 - RNA, 22 nt, Mycobacterium bovis subsp bovis AF2122/97
acgcggacgaacccguuuuggg

SEQ ID NO: 1064134 - RNA, 13 nt, Mycobacterium bovis subsp bovis AF2122/97
acgcgcgucgggu

SEQ ID NO: 1064135 - RNA, 13 nt, Mycobacterium bovis subsp bovis AF2122/97
acgcgcucaccga

SEQ ID NO: 1064136 - RNA, 20 nt, Mycobacterium bovis subsp bovis AF2122/97
acgcggccaacgaacgugcc

SEQ ID NO: 1064137 - RNA, 23 nt, Mycobacterium bovis subsp bovis AF2122/97
acgcgcucgcgcaagcggacccg

SEQ ID NO: 1064138 - RNA, 17 nt, Mycobacterium bovis subsp bovis AF2122/97
acgcggcaccacgucga

SEQ ID NO: 1064139 - RNA, 19 nt, Mycobacterium bovis subsp bovis AF2122/97
acgcuggccuccagcuugg

SEQ ID NO: 1064140 - RNA, 15 nt, Mycobacterium bovis subsp bovis AF2122/97
acgcuggccacucac

SEQ ID NO: 1064141 - RNA, 17 nt, Mycobacterium bovis subsp bovis AF2122/97
acgcuggcgcguaucgc

SEQ ID NO: 1064142 - RNA, 22 nt, Mycobacterium bovis subsp bovis AF2122/97
acgcuggcguuguugacgauca

SEQ ID NO: 1064143 - RNA, 18 nt, Mycobacterium bovis subsp bovis AF2122/97
acgcggccucgucgaguu

SEQ ID NO: 1064144 - RNA, 21 nt, Mycobacterium bovis subsp bovis AF2122/97
acgcuggccacgauccgcggu

SEQ ID NO: 1064145 - RNA, 22 nt, Mycobacterium bovis subsp bovis AF2122/97
acgcuggaacuuggcgucgaca

SEQ ID NO: 1064146 - RNA, 15 nt, Mycobacterium bovis subsp bovis AF2122/97
acggcccgccguccg

SEQ ID NO: 1064147 - RNA, 14 nt, Mycobacterium bovis subsp bovis AF2122/97
acggcccggcaccc

SEQ ID NO: 1064148 - RNA, 13 nt, Mycobacterium bovis subsp bovis AF2122/97
acggcccggcacc

SEQ ID NO: 1064149 - RNA, 16 nt, Mycobacterium bovis subsp bovis AF2122/97
acggcccuuguggagu

SEQ ID NO: 1064150 - RNA, 19 nt, Mycobacterium bovis subsp bovis AF2122/97
acggccggccgcggucucc

SEQ ID NO: 1064151 - RNA, 21 nt, Mycobacterium bovis subsp bovis AF2122/97
acggccgcucgggccagcgau

SEQ ID NO: 1064152 - RNA, 16 nt, Mycobacterium bovis subsp bovis AF2122/97
acggccgacaacccgg

SEQ ID NO: 1064153 - RNA, 17 nt, Mycobacterium bovis subsp bovis AF2122/97
acggccgacaacccggc

SEQ ID NO: 1064154 - RNA, 20 nt, Mycobacterium bovis subsp bovis AF2122/97
acggccgacaacccggccgg

SEQ ID NO: 1064155 - RNA, 13 nt, Mycobacterium bovis subsp bovis AF2122/97
acggccagcccag

SEQ ID NO: 1064156 - RNA, 22 nt, Mycobacterium bovis subsp bovis AF2122/97
acggccauauugggaguccggc

SEQ ID NO: 1064157 - RNA, 16 nt, Mycobacterium bovis subsp bovis AF2122/97
acggccaggucgacgg

SEQ ID NO: 1064158 - RNA, 19 nt, Mycobacterium bovis subsp bovis AF2122/97
acggccaggucgacgggca

SEQ ID NO: 1064159 - RNA, 17 nt, Mycobacterium bovis subsp bovis AF2122/97
acggccaggacaacgca

SEQ ID NO: 1064160 - RNA, 14 nt, Mycobacterium bovis subsp bovis AF2122/97
acggcccgccgucc

SEQ ID NO: 1064161 - RNA, 18 nt, Mycobacterium bovis subsp bovis AF2122/97
acggcccgaucccgaucg

SEQ ID NO: 1064162 - RNA, 24 nt, Mycobacterium bovis subsp bovis AF2122/97
acggcccgaucccgaucgaucagc

SEQ ID NO: 1064163 - RNA, 21 nt, Mycobacterium bovis subsp bovis AF2122/97
acggccccugccacgacgaac

SEQ ID NO: 1064164 - RNA, 14 nt, Mycobacterium bovis subsp bovis AF2122/97
acggcccgaucccg

SEQ ID NO: 1064165 - RNA, 19 nt, Mycobacterium bovis subsp bovis AF2122/97
acggccaugaucacaccgc

SEQ ID NO: 1064166 - RNA, 15 nt, Mycobacterium bovis subsp bovis AF2122/97
acggccaucgccagc

SEQ ID NO: 1064167 - RNA, 16 nt, Mycobacterium bovis subsp bovis AF2122/97
acggccaucgccagcc

SEQ ID NO: 1064168 - RNA, 20 nt, Mycobacterium bovis subsp bovis AF2122/97
acggcaggcggccgccggga

SEQ ID NO: 1064169 - RNA, 20 nt, Mycobacterium bovis subsp bovis AF2122/97
acggcaggcagggcagcccg

SEQ ID NO: 1064170 - RNA, 21 nt, Mycobacterium bovis subsp bovis AF2122/97
acggcaggcucgggcaaggcc

SEQ ID NO: 1064171 - RNA, 22 nt, Mycobacterium bovis subsp bovis AF2122/97
acggcauagcagccagcgucca

SEQ ID NO: 1064172 - RNA, 18 nt, Mycobacterium bovis subsp bovis AF2122/97
acggcaucaacgcgggcg

SEQ ID NO: 1064173 - RNA, 12 nt, Mycobacterium bovis subsp bovis AF2122/97
acggcagcgccc

SEQ ID NO: 1064174 - RNA, 15 nt, Mycobacterium bovis subsp bovis AF2122/97
acggcagcccgggcg

SEQ ID NO: 1064175 - RNA, 12 nt, Mycobacterium bovis subsp bovis AF2122/97
acggcagcccgu

SEQ ID NO: 1064176 - RNA, 15 nt, Mycobacterium bovis subsp bovis AF2122/97
acggcagccaaccgg

SEQ ID NO: 1064177 - RNA, 14 nt, Mycobacterium bovis subsp bovis AF2122/97
acggcagcacgguc

SEQ ID NO: 1064178 - RNA, 20 nt, Mycobacterium bovis subsp bovis AF2122/97
acggcagccaccgucaugcc

SEQ ID NO: 1064179 - RNA, 16 nt, Mycobacterium bovis subsp bovis AF2122/97
acggccagaaacccgg

SEQ ID NO: 1064180 - RNA, 16 nt, Mycobacterium bovis subsp bovis AF2122/97
acggccaccgggguca

SEQ ID NO: 1064181 - RNA, 18 nt, Mycobacterium bovis subsp bovis AF2122/97
acggccaccggggucacc

SEQ ID NO: 1064182 - RNA, 12 nt, Mycobacterium bovis subsp bovis AF2122/97
acggccaccccg

SEQ ID NO: 1064183 - RNA, 20 nt, Mycobacterium bovis subsp bovis AF2122/97
acggccacaccgucacgcca

SEQ ID NO: 1064184 - RNA, 18 nt, Mycobacterium bovis subsp bovis AF2122/97
acggccacaugccacagc

SEQ ID NO: 1064185 - RNA, 14 nt, Mycobacterium bovis subsp bovis AF2122/97
acggccaagaucgg

SEQ ID NO: 1064186 - RNA, 16 nt, Mycobacterium bovis subsp bovis AF2122/97
acggcagcucggggca

SEQ ID NO: 1064187 - RNA, 17 nt, Mycobacterium bovis subsp bovis AF2122/97
acggcauguaccgaccg

SEQ ID NO: 1064188 - RNA, 22 nt, Mycobacterium bovis subsp bovis AF2122/97
acggcauccgcucaacaaucgg

SEQ ID NO: 1064189 - RNA, 15 nt, Mycobacterium bovis subsp bovis AF2122/97
acggcaucggccacc

SEQ ID NO: 1064190 - RNA, 17 nt, Mycobacterium bovis subsp bovis AF2122/97
acggcaucggccaccug

SEQ ID NO: 1064191 - RNA, 19 nt, Mycobacterium bovis subsp bovis AF2122/97
acggccguggaaagccggc

SEQ ID NO: 1064192 - RNA, 19 nt, Mycobacterium bovis subsp bovis AF2122/97
acggccggccgcugccacu

SEQ ID NO: 1064193 - RNA, 12 nt, Mycobacterium bovis subsp bovis AF2122/97
acggccgucgac

SEQ ID NO: 1064194 - RNA, 13 nt, Mycobacterium bovis subsp bovis AF2122/97
acggccgucgccc

SEQ ID NO: 1064195 - RNA, 20 nt, Mycobacterium bovis subsp bovis AF2122/97
acggccggcggucgggcccg

SEQ ID NO: 1064196 - RNA, 17 nt, Mycobacterium bovis subsp bovis AF2122/97
acggccugcaacgucac

SEQ ID NO: 1064197 - RNA, 18 nt, Mycobacterium bovis subsp bovis AF2122/97
acggccugcgagucgcgc

SEQ ID NO: 1064198 - RNA, 16 nt, Mycobacterium bovis subsp bovis AF2122/97
acggccuccaucgcga

SEQ ID NO: 1064199 - RNA, 15 nt, Mycobacterium bovis subsp bovis AF2122/97
acggccucgucgaug

SEQ ID NO: 1064200 - RNA, 22 nt, Mycobacterium bovis subsp bovis AF2122/97
acggccucgucgauguucgccg

SEQ ID NO: 1064201 - RNA, 18 nt, Mycobacterium bovis subsp bovis AF2122/97
acggcgaaaaucccgcuc

SEQ ID NO: 1064202 - RNA, 20 nt, Mycobacterium bovis subsp bovis AF2122/97
acggcgaaaucgacagcagc

SEQ ID NO: 1064203 - RNA, 20 nt, Mycobacterium bovis subsp bovis AF2122/97
acggccuuggcgacgucggc

SEQ ID NO: 1064204 - RNA, 14 nt, Mycobacterium bovis subsp bovis AF2122/97
acggccuggccacc

SEQ ID NO: 1064205 - RNA, 19 nt, Mycobacterium bovis subsp bovis AF2122/97
acggccuggccaccugguu

SEQ ID NO: 1064206 - RNA, 20 nt, Mycobacterium bovis subsp bovis AF2122/97
acggccuggggcagccgggc

SEQ ID NO: 1064207 - RNA, 22 nt, Mycobacterium bovis subsp bovis AF2122/97
acggccuggggcagccgggcgu

SEQ ID NO: 1064208 - RNA, 17 nt, Mycobacterium bovis subsp bovis AF2122/97
acggcgaacccgccgau

SEQ ID NO: 1064209 - RNA, 22 nt, Mycobacterium bovis subsp bovis AF2122/97
acggcgaccaggagccuccagc

SEQ ID NO: 1064210 - RNA, 13 nt, Mycobacterium bovis subsp bovis AF2122/97
acggcgaccgcca

SEQ ID NO: 1064211 - RNA, 12 nt, Mycobacterium bovis subsp bovis AF2122/97
acggcgacgaca

SEQ ID NO: 1064212 - RNA, 15 nt, Mycobacterium bovis subsp bovis AF2122/97
acggcgaagucgagu

SEQ ID NO: 1064213 - RNA, 16 nt, Mycobacterium bovis subsp bovis AF2122/97
acggcgaccaccgcgg

SEQ ID NO: 1064214 - RNA, 20 nt, Mycobacterium bovis subsp bovis AF2122/97
acggcgaccacgccgccggc

SEQ ID NO: 1064215 - RNA, 22 nt, Mycobacterium bovis subsp bovis AF2122/97
acggcgaaucgguggucgaugg

SEQ ID NO: 1064216 - RNA, 16 nt, Mycobacterium bovis subsp bovis AF2122/97
acggcgacacgccagc

SEQ ID NO: 1064217 - RNA, 18 nt, Mycobacterium bovis subsp bovis AF2122/97
acggcgacacgccagccg

SEQ ID NO: 1064218 - RNA, 22 nt, Mycobacterium bovis subsp bovis AF2122/97
acggcgacacgccagccgugcc

SEQ ID NO: 1064219 - RNA, 16 nt, Mycobacterium bovis subsp bovis AF2122/97
acggcgacaucggccc

SEQ ID NO: 1064220 - RNA, 14 nt, Mycobacterium bovis subsp bovis AF2122/97
acggcgaguaggcg

SEQ ID NO: 1064221 - RNA, 23 nt, Mycobacterium bovis subsp bovis AF2122/97
acggcgacgugaauggugguguc

SEQ ID NO: 1064222 - RNA, 15 nt, Mycobacterium bovis subsp bovis AF2122/97
acggcgacucgagga

SEQ ID NO: 1064223 - RNA, 21 nt, Mycobacterium bovis subsp bovis AF2122/97
acggcgagaaaaugacccaca

SEQ ID NO: 1064224 - RNA, 18 nt, Mycobacterium bovis subsp bovis AF2122/97
acggcgcggugcgcucac

SEQ ID NO: 1064225 - RNA, 16 nt, Mycobacterium bovis subsp bovis AF2122/97
acggcgcucggcgagc

SEQ ID NO: 1064226 - RNA, 14 nt, Mycobacterium bovis subsp bovis AF2122/97
acggcgcugacgaa

SEQ ID NO: 1064227 - RNA, 19 nt, Mycobacterium bovis subsp bovis AF2122/97
acggcgcugcccacgccgg

SEQ ID NO: 1064228 - RNA, 16 nt, Mycobacterium bovis subsp bovis AF2122/97
acggcgcgcgcgccgg

SEQ ID NO: 1064229 - RNA, 18 nt, Mycobacterium bovis subsp bovis AF2122/97
acggcgcgcgcgccggcu

SEQ ID NO: 1064230 - RNA, 15 nt, Mycobacterium bovis subsp bovis AF2122/97
acggcggagucgcgc

SEQ ID NO: 1064231 - RNA, 21 nt, Mycobacterium bovis subsp bovis AF2122/97
acggcggagucgcgcagggcg

SEQ ID NO: 1064232 - RNA, 17 nt, Mycobacterium bovis subsp bovis AF2122/97
acggcggauaaccggca

SEQ ID NO: 1064233 - RNA, 17 nt, Mycobacterium bovis subsp bovis AF2122/97
acggcggaucggcggcc

SEQ ID NO: 1064234 - RNA, 22 nt, Mycobacterium bovis subsp bovis AF2122/97
acggcggaucggcggccggcac

SEQ ID NO: 1064235 - RNA, 13 nt, Mycobacterium bovis subsp bovis AF2122/97
acggcggccgcca

SEQ ID NO: 1064236 - RNA, 22 nt, Mycobacterium bovis subsp bovis AF2122/97
acggcggccaccugcuggccgu

SEQ ID NO: 1064237 - RNA, 23 nt, Mycobacterium bovis subsp bovis AF2122/97
acggcggccccggcauugcccga

SEQ ID NO: 1064238 - RNA, 17 nt, Mycobacterium bovis subsp bovis AF2122/97
acggcggcaacggcggc

SEQ ID NO: 1064239 - RNA, 15 nt, Mycobacterium bovis subsp bovis AF2122/97
acggcggcacgggcg

SEQ ID NO: 1064240 - RNA, 21 nt, Mycobacterium bovis subsp bovis AF2122/97
acggcggcacgggcggccaug

SEQ ID NO: 1064241 - RNA, 16 nt, Mycobacterium bovis subsp bovis AF2122/97
acggcggccaaggucg

SEQ ID NO: 1064242 - RNA, 13 nt, Mycobacterium bovis subsp bovis AF2122/97
acggcgccaggca

SEQ ID NO: 1064243 - RNA, 21 nt, Mycobacterium bovis subsp bovis AF2122/97
acggcgccauuggcgucccgc

SEQ ID NO: 1064244 - RNA, 12 nt, Mycobacterium bovis subsp bovis AF2122/97
acggcgccgcca

SEQ ID NO: 1064245 - RNA, 13 nt, Mycobacterium bovis subsp bovis AF2122/97
acggcgccgccac

SEQ ID NO: 1064246 - RNA, 14 nt, Mycobacterium bovis subsp bovis AF2122/97
acggcgccgccacg

SEQ ID NO: 1064247 - RNA, 16 nt, Mycobacterium bovis subsp bovis AF2122/97
acggcgccgaacccgg

SEQ ID NO: 1064248 - RNA, 14 nt, Mycobacterium bovis subsp bovis AF2122/97
acggcgccgacccg

SEQ ID NO: 1064249 - RNA, 13 nt, Mycobacterium bovis subsp bovis AF2122/97
acggcgccgccca

SEQ ID NO: 1064250 - RNA, 23 nt, Mycobacterium bovis subsp bovis AF2122/97
acggcgccgcccacggggcguga

SEQ ID NO: 1064251 - RNA, 15 nt, Mycobacterium bovis subsp bovis AF2122/97
acggcgcgccagaac

SEQ ID NO: 1064252 - RNA, 15 nt, Mycobacterium bovis subsp bovis AF2122/97
acggcgcgagccgca

SEQ ID NO: 1064253 - RNA, 24 nt, Mycobacterium bovis subsp bovis AF2122/97
acggcgauccggucggccaggccg

SEQ ID NO: 1064254 - RNA, 12 nt, Mycobacterium bovis subsp bovis AF2122/97
acggcgaugcgg

SEQ ID NO: 1064255 - RNA, 17 nt, Mycobacterium bovis subsp bovis AF2122/97
acggcgaguaggcgugg

SEQ ID NO: 1064256 - RNA, 12 nt, Mycobacterium bovis subsp bovis AF2122/97
acggcgaucacc

SEQ ID NO: 1064257 - RNA, 22 nt, Mycobacterium bovis subsp bovis AF2122/97
acggcgauugcccgugcgaugc

SEQ ID NO: 1064258 - RNA, 21 nt, Mycobacterium bovis subsp bovis AF2122/97
acggcgcaguuggcaccagcc

SEQ ID NO: 1064259 - RNA, 14 nt, Mycobacterium bovis subsp bovis AF2122/97
acggcgaugcagcc

SEQ ID NO: 1064260 - RNA, 14 nt, Mycobacterium bovis subsp bovis AF2122/97
acggcggcgacggc

SEQ ID NO: 1064261 - RNA, 14 nt, Mycobacterium bovis subsp bovis AF2122/97
acggcggcgaggcg

SEQ ID NO: 1064262 - RNA, 18 nt, Mycobacterium bovis subsp bovis AF2122/97
acggcggccuucggccgg

SEQ ID NO: 1064263 - RNA, 17 nt, Mycobacterium bovis subsp bovis AF2122/97
acggcggccuucggccg

SEQ ID NO: 1064264 - RNA, 15 nt, Mycobacterium bovis subsp bovis AF2122/97
acggcggccgcgaug

SEQ ID NO: 1064265 - RNA, 15 nt, Mycobacterium bovis subsp bovis AF2122/97
acggcggcaucggcg

SEQ ID NO: 1064266 - RNA, 14 nt, Mycobacterium bovis subsp bovis AF2122/97
acggcggcccgcuc

SEQ ID NO: 1064267 - RNA, 10 nt, Mycobacterium bovis subsp bovis AF2122/97
acggcggcgc

SEQ ID NO: 1064268 - RNA, 12 nt, Mycobacterium bovis subsp bovis AF2122/97
acggcggcgccg

SEQ ID NO: 1064269 - RNA, 14 nt, Mycobacterium bovis subsp bovis AF2122/97
acggcggcgccgcc

SEQ ID NO: 1064270 - RNA, 17 nt, Mycobacterium bovis subsp bovis AF2122/97
acggcggcgccgcccaa

SEQ ID NO: 1064271 - RNA, 20 nt, Mycobacterium bovis subsp bovis AF2122/97
acggcgguaccgccgcugcc

SEQ ID NO: 1064272 - RNA, 18 nt, Mycobacterium bovis subsp bovis AF2122/97
acggcgguccggaugcgc

SEQ ID NO: 1064273 - RNA, 15 nt, Mycobacterium bovis subsp bovis AF2122/97
acggcggggccggcg

SEQ ID NO: 1064274 - RNA, 16 nt, Mycobacterium bovis subsp bovis AF2122/97
acggcggggccggcgg

SEQ ID NO: 1064275 - RNA, 20 nt, Mycobacterium bovis subsp bovis AF2122/97
acggcggggccggcggcucg

SEQ ID NO: 1064276 - RNA, 18 nt, Mycobacterium bovis subsp bovis AF2122/97
acggcggcugucggccgg

SEQ ID NO: 1064277 - RNA, 22 nt, Mycobacterium bovis subsp bovis AF2122/97
acggcggcugucggccggguca

SEQ ID NO: 1064278 - RNA, 19 nt, Mycobacterium bovis subsp bovis AF2122/97
acggcgggaugcagcugcc

SEQ ID NO: 1064279 - RNA, 14 nt, Mycobacterium bovis subsp bovis AF2122/97
acggcgggcggccg

SEQ ID NO: 1064280 - RNA, 14 nt, Mycobacterium bovis subsp bovis AF2122/97
acggcggggaucgc

SEQ ID NO: 1064281 - RNA, 12 nt, Mycobacterium bovis subsp bovis AF2122/97
acgggacgacgg

SEQ ID NO: 1064282 - RNA, 13 nt, Mycobacterium bovis subsp bovis AF2122/97
acgggacgcaugc

SEQ ID NO: 1064283 - RNA, 24 nt, Mycobacterium bovis subsp bovis AF2122/97
acgggacgcaugcgugacccgaca

SEQ ID NO: 1064284 - RNA, 13 nt, Mycobacterium bovis subsp bovis AF2122/97
acgggacgucacc

SEQ ID NO: 1064285 - RNA, 22 nt, Mycobacterium bovis subsp bovis AF2122/97
acgggaacguccagccguggcg

SEQ ID NO: 1064286 - RNA, 12 nt, Mycobacterium bovis subsp bovis AF2122/97
acgggcagugaa

SEQ ID NO: 1064287 - RNA, 24 nt, Mycobacterium bovis subsp bovis AF2122/97
acgggcccaggacagcagccgccg

SEQ ID NO: 1064288 - RNA, 13 nt, Mycobacterium bovis subsp bovis AF2122/97
acgggccaccagc

SEQ ID NO: 1064289 - RNA, 18 nt, Mycobacterium bovis subsp bovis AF2122/97
acgggaaacuccgcggcg

SEQ ID NO: 1064290 - RNA, 20 nt, Mycobacterium bovis subsp bovis AF2122/97
acgggaaacuccgcggcgcg

SEQ ID NO: 1064291 - RNA, 22 nt, Mycobacterium bovis subsp bovis AF2122/97
acgggaaacuccgcggcgcgca

SEQ ID NO: 1064292 - RNA, 13 nt, Mycobacterium bovis subsp bovis AF2122/97
acgggaacaacgg

SEQ ID NO: 1064293 - RNA, 20 nt, Mycobacterium bovis subsp bovis AF2122/97
acggcuuggcgucggccggc

SEQ ID NO: 1064294 - RNA, 15 nt, Mycobacterium bovis subsp bovis AF2122/97
acggcuucgccgcgg

SEQ ID NO: 1064295 - RNA, 14 nt, Mycobacterium bovis subsp bovis AF2122/97
acggcuucggcagc

SEQ ID NO: 1064296 - RNA, 20 nt, Mycobacterium bovis subsp bovis AF2122/97
acggcuucggcgagcgcauc

SEQ ID NO: 1064297 - RNA, 20 nt, Mycobacterium bovis subsp bovis AF2122/97
acgggcgccggaacgagcgg

SEQ ID NO: 1064298 - RNA, 13 nt, Mycobacterium bovis subsp bovis AF2122/97
acgggcgcgucgg

SEQ ID NO: 1064299 - RNA, 17 nt, Mycobacterium bovis subsp bovis AF2122/97
acgggcggggacggcgg

SEQ ID NO: 1064300 - RNA, 18 nt, Mycobacterium bovis subsp bovis AF2122/97
acgggcggggacggcggc

SEQ ID NO: 1064301 - RNA, 15 nt, Mycobacterium bovis subsp bovis AF2122/97
acgggcgcgucggcg

SEQ ID NO: 1064302 - RNA, 14 nt, Mycobacterium bovis subsp bovis AF2122/97
acgggcgugcugcc

SEQ ID NO: 1064303 - RNA, 17 nt, Mycobacterium bovis subsp bovis AF2122/97
acgggccgcaucgucgc

SEQ ID NO: 1064304 - RNA, 13 nt, Mycobacterium bovis subsp bovis AF2122/97
acgggccgucgcc

SEQ ID NO: 1064305 - RNA, 22 nt, Mycobacterium bovis subsp bovis AF2122/97
acgggccgcaucgucgccgcgc

SEQ ID NO: 1064306 - RNA, 20 nt, Mycobacterium bovis subsp bovis AF2122/97
acgggccggccgagcgcacu

SEQ ID NO: 1064307 - RNA, 21 nt, Mycobacterium bovis subsp bovis AF2122/97
acgggccggugcgcaccagag

SEQ ID NO: 1064308 - RNA, 23 nt, Mycobacterium bovis subsp bovis AF2122/97
acgguagacaagucggcgcuggc

SEQ ID NO: 1064309 - RNA, 23 nt, Mycobacterium bovis subsp bovis AF2122/97
acgguaaucgcgaacgaagucga

SEQ ID NO: 1064310 - RNA, 16 nt, Mycobacterium bovis subsp bovis AF2122/97
acgguacauccagaga

SEQ ID NO: 1064311 - RNA, 13 nt, Mycobacterium bovis subsp bovis AF2122/97
acggguucacccu

SEQ ID NO: 1064312 - RNA, 22 nt, Mycobacterium bovis subsp bovis AF2122/97
acgggugugccuacuugcucga

SEQ ID NO: 1064313 - RNA, 23 nt, Mycobacterium bovis subsp bovis AF2122/97
acgggucguaggacaccaccgug

SEQ ID NO: 1064314 - RNA, 12 nt, Mycobacterium bovis subsp bovis AF2122/97
acgggucgaugu

SEQ ID NO: 1064315 - RNA, 21 nt, Mycobacterium bovis subsp bovis AF2122/97
acgggucgccggacugcggcc

SEQ ID NO: 1064316 - RNA, 19 nt, Mycobacterium bovis subsp bovis AF2122/97
acgggucuggccaacgccg

SEQ ID NO: 1064317 - RNA, 18 nt, Mycobacterium bovis subsp bovis AF2122/97
acgggcucggcaggcccg

SEQ ID NO: 1064318 - RNA, 12 nt, Mycobacterium bovis subsp bovis AF2122/97
acgggucgccgg

SEQ ID NO: 1064319 - RNA, 22 nt, Mycobacterium bovis subsp bovis AF2122/97
acgggugagcaccacgugcgcc

SEQ ID NO: 1064320 - RNA, 19 nt, Mycobacterium bovis subsp bovis AF2122/97
acgucggcaaucucgaucu

SEQ ID NO: 1064321 - RNA, 12 nt, Mycobacterium bovis subsp bovis AF2122/97
acgucggccagu

SEQ ID NO: 1064322 - RNA, 16 nt, Mycobacterium bovis subsp bovis AF2122/97
acgucggccgcaucgc

SEQ ID NO: 1064323 - RNA, 19 nt, Mycobacterium bovis subsp bovis AF2122/97
acgucgauuucggcgaccg

SEQ ID NO: 1064324 - RNA, 15 nt, Mycobacterium bovis subsp bovis AF2122/97
acgucgauggugcgg

SEQ ID NO: 1064325 - RNA, 13 nt, Mycobacterium bovis subsp bovis AF2122/97
acgucgaucagug

SEQ ID NO: 1064326 - RNA, 22 nt, Mycobacterium bovis subsp bovis AF2122/97
acgucggcgcguccgcaggcga

SEQ ID NO: 1064327 - RNA, 14 nt, Mycobacterium bovis subsp bovis AF2122/97
acgucggcgaacgc

SEQ ID NO: 1064328 - RNA, 12 nt, Mycobacterium bovis subsp bovis AF2122/97
acgucggcgaau

SEQ ID NO: 1064329 - RNA, 14 nt, Mycobacterium bovis subsp bovis AF2122/97
acgucggcgaccag

SEQ ID NO: 1064330 - RNA, 15 nt, Mycobacterium bovis subsp bovis AF2122/97
acgucggcgagcucg

SEQ ID NO: 1064331 - RNA, 23 nt, Mycobacterium bovis subsp bovis AF2122/97
acgucggcgagcucggccccgcc

SEQ ID NO: 1064332 - RNA, 19 nt, Mycobacterium bovis subsp bovis AF2122/97
acgucgaccgugucaccgc

SEQ ID NO: 1064333 - RNA, 18 nt, Mycobacterium bovis subsp bovis AF2122/97
acguccaucccggcgccg

SEQ ID NO: 1064334 - RNA, 21 nt, Mycobacterium bovis subsp bovis AF2122/97
acguccaucccggcgccgcgg

SEQ ID NO: 1064335 - RNA, 15 nt, Mycobacterium bovis subsp bovis AF2122/97
acguccaucccggcg

SEQ ID NO: 1064336 - RNA, 17 nt, Mycobacterium bovis subsp bovis AF2122/97
acguccaucaccggcgg

SEQ ID NO: 1064337 - RNA, 19 nt, Mycobacterium bovis subsp bovis AF2122/97
acguccaucaccggcggcc

SEQ ID NO: 1064338 - RNA, 14 nt, Mycobacterium bovis subsp bovis AF2122/97
acgucgagcagccg

SEQ ID NO: 1064339 - RNA, 20 nt, Mycobacterium bovis subsp bovis AF2122/97
acgucccagcccuuggcgcg

SEQ ID NO: 1064340 - RNA, 20 nt, Mycobacterium bovis subsp bovis AF2122/97
acgucgacuuguugggcgcg

SEQ ID NO: 1064341 - RNA, 15 nt, Mycobacterium bovis subsp bovis AF2122/97
acgucgacggcgaug

SEQ ID NO: 1064342 - RNA, 20 nt, Mycobacterium bovis subsp bovis AF2122/97
acgucgacggcgauggcgcg

SEQ ID NO: 1064343 - RNA, 17 nt, Mycobacterium bovis subsp bovis AF2122/97
acgucgacggcggccgc

SEQ ID NO: 1064344 - RNA, 16 nt, Mycobacterium bovis subsp bovis AF2122/97
acgucgacuucgcccg

SEQ ID NO: 1064345 - RNA, 15 nt, Mycobacterium bovis subsp bovis AF2122/97
acguccaacucggcc

SEQ ID NO: 1064346 - RNA, 15 nt, Mycobacterium bovis subsp bovis AF2122/97
acgucaucgccgacc

SEQ ID NO: 1064347 - RNA, 22 nt, Mycobacterium bovis subsp bovis AF2122/97
acguccagccguggcggcgggc

SEQ ID NO: 1064348 - RNA, 22 nt, Mycobacterium bovis subsp bovis AF2122/97
acguauaucgguugcugcgcga

SEQ ID NO: 1064349 - RNA, 14 nt, Mycobacterium bovis subsp bovis AF2122/97
acggucgucgauca

SEQ ID NO: 1064350 - RNA, 15 nt, Mycobacterium bovis subsp bovis AF2122/97
acggucgucgaucac

SEQ ID NO: 1064351 - RNA, 16 nt, Mycobacterium bovis subsp bovis AF2122/97
acggucgucgaucacg

SEQ ID NO: 1064352 - RNA, 13 nt, Mycobacterium bovis subsp bovis AF2122/97
acggucgucgcga

SEQ ID NO: 1064353 - RNA, 22 nt, Mycobacterium bovis subsp bovis AF2122/97
acggucggaucgauuccgccgc

SEQ ID NO: 1064354 - RNA, 15 nt, Mycobacterium bovis subsp bovis AF2122/97
acggucgggaccggc

SEQ ID NO: 1064355 - RNA, 14 nt, Mycobacterium bovis subsp bovis AF2122/97
acgguagcacgguc

SEQ ID NO: 1064356 - RNA, 20 nt, Mycobacterium bovis subsp bovis AF2122/97
acggucaauugugcggcccc

SEQ ID NO: 1064357 - RNA, 12 nt, Mycobacterium bovis subsp bovis AF2122/97
acggucacacgc

SEQ ID NO: 1064358 - RNA, 16 nt, Mycobacterium bovis subsp bovis AF2122/97
acggucacacgccagc

SEQ ID NO: 1064359 - RNA, 23 nt, Mycobacterium bovis subsp bovis AF2122/97
acggucgccgaccacucgagcgc

SEQ ID NO: 1064360 - RNA, 14 nt, Mycobacterium bovis subsp bovis AF2122/97
acguagucgccgau

SEQ ID NO: 1064361 - RNA, 15 nt, Mycobacterium bovis subsp bovis AF2122/97
acguaguggaagccg

SEQ ID NO: 1064362 - RNA, 15 nt, Mycobacterium bovis subsp bovis AF2122/97
acguaguugccggcu

SEQ ID NO: 1064363 - RNA, 19 nt, Mycobacterium bovis subsp bovis AF2122/97
acguaggcaccccggugcc

SEQ ID NO: 1064364 - RNA, 15 nt, Mycobacterium bovis subsp bovis AF2122/97
acguaggcggcggcc

SEQ ID NO: 1064365 - RNA, 19 nt, Mycobacterium bovis subsp bovis AF2122/97
acggugagggcgucgucga

SEQ ID NO: 1064366 - RNA, 17 nt, Mycobacterium bovis subsp bovis AF2122/97
acggucugccacgaggc

SEQ ID NO: 1064367 - RNA, 13 nt, Mycobacterium bovis subsp bovis AF2122/97
acggugacaucgc

SEQ ID NO: 1064368 - RNA, 18 nt, Mycobacterium bovis subsp bovis AF2122/97
acggugaagccgagcgcc

SEQ ID NO: 1064369 - RNA, 14 nt, Mycobacterium bovis subsp bovis AF2122/97
acggugaagccguu

SEQ ID NO: 1064370 - RNA, 13 nt, Mycobacterium bovis subsp bovis AF2122/97
acggugaaaccgg

SEQ ID NO: 1064371 - RNA, 16 nt, Mycobacterium bovis subsp bovis AF2122/97
acggugaaaccggccu

SEQ ID NO: 1064372 - RNA, 14 nt, Mycobacterium bovis subsp bovis AF2122/97
acguagcagcgccg

SEQ ID NO: 1064373 - RNA, 22 nt, Mycobacterium bovis subsp bovis AF2122/97
acguagcagcgccggcaccgac

SEQ ID NO: 1064374 - RNA, 16 nt, Mycobacterium bovis subsp bovis AF2122/97
acguagacgguccggu

SEQ ID NO: 1064375 - RNA, 14 nt, Mycobacterium bovis subsp bovis AF2122/97
acggugacgaucag

SEQ ID NO: 1064376 - RNA, 20 nt, Mycobacterium bovis subsp bovis AF2122/97
acguagaugguggucaccac

SEQ ID NO: 1064377 - RNA, 14 nt, Mycobacterium bovis subsp bovis AF2122/97
acguuggcggccag

SEQ ID NO: 1064378 - RNA, 22 nt, Mycobacterium bovis subsp bovis AF2122/97
acguuggcggccagcgcaccgc

SEQ ID NO: 1064379 - RNA, 14 nt, Mycobacterium bovis subsp bovis AF2122/97
acguucggcgacgc

SEQ ID NO: 1064380 - RNA, 21 nt, Mycobacterium bovis subsp bovis AF2122/97
acguucuuguccaggaucgcg

SEQ ID NO: 1064381 - RNA, 18 nt, Mycobacterium bovis subsp bovis AF2122/97
acguuggccaggcccgag

SEQ ID NO: 1064382 - RNA, 23 nt, Mycobacterium bovis subsp bovis AF2122/97
acguuggccgagcagggccggca

SEQ ID NO: 1064383 - RNA, 13 nt, Mycobacterium bovis subsp bovis AF2122/97
acguucgguggcg

SEQ ID NO: 1064384 - RNA, 16 nt, Mycobacterium bovis subsp bovis AF2122/97
acguucgguggcgaug

SEQ ID NO: 1064385 - RNA, 13 nt, Mycobacterium bovis subsp bovis AF2122/97
acguugugccgcu

SEQ ID NO: 1064386 - RNA, 19 nt, Mycobacterium bovis subsp bovis AF2122/97
acguuguaggagaacguca

SEQ ID NO: 1064387 - RNA, 18 nt, Mycobacterium bovis subsp bovis AF2122/97
acguuguacucgugcggu

SEQ ID NO: 1064388 - RNA, 19 nt, Mycobacterium bovis subsp bovis AF2122/97
acguugguccgcugcagca

SEQ ID NO: 1064389 - RNA, 13 nt, Mycobacterium bovis subsp bovis AF2122/97
acuaacggcagcc

SEQ ID NO: 1064390 - RNA, 16 nt, Mycobacterium bovis subsp bovis AF2122/97
acuacuccggucccgc

SEQ ID NO: 1064391 - RNA, 16 nt, Mycobacterium bovis subsp bovis AF2122/97
acuacuccugagauga

SEQ ID NO: 1064392 - RNA, 19 nt, Mycobacterium bovis subsp bovis AF2122/97
acguuuucgucaccccacc

SEQ ID NO: 1064393 - RNA, 18 nt, Mycobacterium bovis subsp bovis AF2122/97
acgucgggcauggcggcg

SEQ ID NO: 1064394 - RNA, 19 nt, Mycobacterium bovis subsp bovis AF2122/97
acgucgggcauggcggcgu

SEQ ID NO: 1064395 - RNA, 15 nt, Mycobacterium bovis subsp bovis AF2122/97
acgucgggcccgaug

SEQ ID NO: 1064396 - RNA, 12 nt, Mycobacterium bovis subsp bovis AF2122/97
acgucggcggcc

SEQ ID NO: 1064397 - RNA, 17 nt, Mycobacterium bovis subsp bovis AF2122/97
acgucgucagccaccgc

SEQ ID NO: 1064398 - RNA, 19 nt, Mycobacterium bovis subsp bovis AF2122/97
acgucgucagccaccgcau

SEQ ID NO: 1064399 - RNA, 13 nt, Mycobacterium bovis subsp bovis AF2122/97
acgucgucgcggg

SEQ ID NO: 1064400 - RNA, 13 nt, Mycobacterium bovis subsp bovis AF2122/97
acgucgucggcca

SEQ ID NO: 1064401 - RNA, 13 nt, Mycobacterium bovis subsp bovis AF2122/97
acgucgucggggu

SEQ ID NO: 1064402 - RNA, 18 nt, Mycobacterium bovis subsp bovis AF2122/97
acgucguugccguccacc

SEQ ID NO: 1064403 - RNA, 21 nt, Mycobacterium bovis subsp bovis AF2122/97
acgucguugugcagaucgucg

SEQ ID NO: 1064404 - RNA, 21 nt, Mycobacterium bovis subsp bovis AF2122/97
acgugcgagggcacggcggug

SEQ ID NO: 1064405 - RNA, 21 nt, Mycobacterium bovis subsp bovis AF2122/97
acgugcccgguguucaucacg

SEQ ID NO: 1064406 - RNA, 20 nt, Mycobacterium bovis subsp bovis AF2122/97
acgugcgagggcacggcggu

SEQ ID NO: 1064407 - RNA, 15 nt, Mycobacterium bovis subsp bovis AF2122/97
acgugccgggucacc

SEQ ID NO: 1064408 - RNA, 13 nt, Mycobacterium bovis subsp bovis AF2122/97
acgugccgguccc

SEQ ID NO: 1064409 - RNA, 18 nt, Mycobacterium bovis subsp bovis AF2122/97
acguucaguuccgcggcg

SEQ ID NO: 1064410 - RNA, 12 nt, Mycobacterium bovis subsp bovis AF2122/97
acgugcggcgcg

SEQ ID NO: 1064411 - RNA, 13 nt, Mycobacterium bovis subsp bovis AF2122/97
acgugcggcggcc

SEQ ID NO: 1064412 - RNA, 13 nt, Mycobacterium bovis subsp bovis AF2122/97
acgugcgguggcu

SEQ ID NO: 1064413 - RNA, 17 nt, Mycobacterium bovis subsp bovis AF2122/97
acgugcgucggcccggu

SEQ ID NO: 1064414 - RNA, 14 nt, Mycobacterium bovis subsp bovis AF2122/97
acugaugucgccga

SEQ ID NO: 1064415 - RNA, 19 nt, Mycobacterium bovis subsp bovis AF2122/97
acugauggcgcgcaacgag

SEQ ID NO: 1064416 - RNA, 16 nt, Mycobacterium bovis subsp bovis AF2122/97
acugccgagcagacgc

SEQ ID NO: 1064417 - RNA, 16 nt, Mycobacterium bovis subsp bovis AF2122/97
acugccgaccagcgcg

SEQ ID NO: 1064418 - RNA, 16 nt, Mycobacterium bovis subsp bovis AF2122/97
acugccagcguugcgg

SEQ ID NO: 1064419 - RNA, 13 nt, Mycobacterium bovis subsp bovis AF2122/97
acugccggcacgc

SEQ ID NO: 1064420 - RNA, 16 nt, Mycobacterium bovis subsp bovis AF2122/97
acugccggcagcgccc

SEQ ID NO: 1064421 - RNA, 15 nt, Mycobacterium bovis subsp bovis AF2122/97
acugccgcggcaccg

SEQ ID NO: 1064422 - RNA, 16 nt, Mycobacterium bovis subsp bovis AF2122/97
acugcgaaucuccgcg

SEQ ID NO: 1064423 - RNA, 16 nt, Mycobacterium bovis subsp bovis AF2122/97
acugcgaaugcugggc

SEQ ID NO: 1064424 - RNA, 15 nt, Mycobacterium bovis subsp bovis AF2122/97
acugccguugccgcc

SEQ ID NO: 1064425 - RNA, 20 nt, Mycobacterium bovis subsp bovis AF2122/97
acugccguugccgccggugc

SEQ ID NO: 1064426 - RNA, 19 nt, Mycobacterium bovis subsp bovis AF2122/97
acugcgaaugcugggcccg

SEQ ID NO: 1064427 - RNA, 18 nt, Mycobacterium bovis subsp bovis AF2122/97
acugcgaccgguucggcg

SEQ ID NO: 1064428 - RNA, 18 nt, Mycobacterium bovis subsp bovis AF2122/97
acugcgagggcacgcgca

SEQ ID NO: 1064429 - RNA, 14 nt, Mycobacterium bovis subsp bovis AF2122/97
acugcgcccgccac

SEQ ID NO: 1064430 - RNA, 16 nt, Mycobacterium bovis subsp bovis AF2122/97
acugcgcccgccacgu

SEQ ID NO: 1064431 - RNA, 15 nt, Mycobacterium bovis subsp bovis AF2122/97
acucggacgcgccgg

SEQ ID NO: 1064432 - RNA, 14 nt, Mycobacterium bovis subsp bovis AF2122/97
acucggaaucggcg

SEQ ID NO: 1064433 - RNA, 13 nt, Mycobacterium bovis subsp bovis AF2122/97
acucgcgguggcc

SEQ ID NO: 1064434 - RNA, 15 nt, Mycobacterium bovis subsp bovis AF2122/97
acucgcggcgcggcc

SEQ ID NO: 1064435 - RNA, 18 nt, Mycobacterium bovis subsp bovis AF2122/97
acucgcguggcaccgaca

SEQ ID NO: 1064436 - RNA, 19 nt, Mycobacterium bovis subsp bovis AF2122/97
acucgccgaaucgcugacc

SEQ ID NO: 1064437 - RNA, 18 nt, Mycobacterium bovis subsp bovis AF2122/97
acucgccgacgucgacgc

SEQ ID NO: 1064438 - RNA, 23 nt, Mycobacterium bovis subsp bovis AF2122/97
acucgccgacgucgacgccggcc

SEQ ID NO: 1064439 - RNA, 22 nt, Mycobacterium bovis subsp bovis AF2122/97
acucgccgcuggcaaucccgcg

SEQ ID NO: 1064440 - RNA, 15 nt, Mycobacterium bovis subsp bovis AF2122/97
acucgcggauccggg

SEQ ID NO: 1064441 - RNA, 17 nt, Mycobacterium bovis subsp bovis AF2122/97
acucgcggauccgggcg

SEQ ID NO: 1064442 - RNA, 15 nt, Mycobacterium bovis subsp bovis AF2122/97
acucgcggccggcgu

SEQ ID NO: 1064443 - RNA, 22 nt, Mycobacterium bovis subsp bovis AF2122/97
acucgcggccggcgucggcguc

SEQ ID NO: 1064444 - RNA, 19 nt, Mycobacterium bovis subsp bovis AF2122/97
acucgcgcacauaggcgau

SEQ ID NO: 1064445 - RNA, 20 nt, Mycobacterium bovis subsp bovis AF2122/97
acugaucgccacccgguccc

SEQ ID NO: 1064446 - RNA, 19 nt, Mycobacterium bovis subsp bovis AF2122/97
acugaucaagugccagcgu

SEQ ID NO: 1064447 - RNA, 23 nt, Mycobacterium bovis subsp bovis AF2122/97
acugaucggaaacggagccgagc

SEQ ID NO: 1064448 - RNA, 19 nt, Mycobacterium bovis subsp bovis AF2122/97
acugaucuucgagccggcg

SEQ ID NO: 1064449 - RNA, 18 nt, Mycobacterium bovis subsp bovis AF2122/97
acugaucuuggcccgggc

SEQ ID NO: 1064450 - RNA, 15 nt, Mycobacterium bovis subsp bovis AF2122/97
acugaaccguagcgc

SEQ ID NO: 1064451 - RNA, 22 nt, Mycobacterium bovis subsp bovis AF2122/97
acugaacgguuucuuucggcag

SEQ ID NO: 1064452 - RNA, 15 nt, Mycobacterium bovis subsp bovis AF2122/97
acugaacgucaccgu

SEQ ID NO: 1064453 - RNA, 16 nt, Mycobacterium bovis subsp bovis AF2122/97
acugaacucaacacca

SEQ ID NO: 1064454 - RNA, 20 nt, Mycobacterium bovis subsp bovis AF2122/97
acugaacucaacaccagcaa

SEQ ID NO: 1064455 - RNA, 15 nt, Mycobacterium bovis subsp bovis AF2122/97
acucuucgggcggcg

SEQ ID NO: 1064456 - RNA, 21 nt, Mycobacterium bovis subsp bovis AF2122/97
acuagcggcucaccgcgcauc

SEQ ID NO: 1064457 - RNA, 15 nt, Mycobacterium bovis subsp bovis AF2122/97
acuagacgccgccgc

SEQ ID NO: 1064458 - RNA, 15 nt, Mycobacterium bovis subsp bovis AF2122/97
acuagccgauccagc

SEQ ID NO: 1064459 - RNA, 21 nt, Mycobacterium bovis subsp bovis AF2122/97
acuagcgagccggcgccgggu

SEQ ID NO: 1064460 - RNA, 19 nt, Mycobacterium bovis subsp bovis AF2122/97
acucaugcccgacgagucg

SEQ ID NO: 1064461 - RNA, 14 nt, Mycobacterium bovis subsp bovis AF2122/97
acucaucggccgcg

SEQ ID NO: 1064462 - RNA, 21 nt, Mycobacterium bovis subsp bovis AF2122/97
acucaucuuugacaccggucg

SEQ ID NO: 1064463 - RNA, 13 nt, Mycobacterium bovis subsp bovis AF2122/97
acuccaccgcgcc

SEQ ID NO: 1064464 - RNA, 19 nt, Mycobacterium bovis subsp bovis AF2122/97
acucauggccggucugcug

SEQ ID NO: 1064465 - RNA, 19 nt, Mycobacterium bovis subsp bovis AF2122/97
acucauuacgguagacguu

SEQ ID NO: 1064466 - RNA, 20 nt, Mycobacterium bovis subsp bovis AF2122/97
acucccccgaaccugcggca

SEQ ID NO: 1064467 - RNA, 12 nt, Mycobacterium bovis subsp bovis AF2122/97
acucccgcgauc

SEQ ID NO: 1064468 - RNA, 22 nt, Mycobacterium bovis subsp bovis AF2122/97
acucccgcgaucgcgacacggc

SEQ ID NO: 1064469 - RNA, 18 nt, Mycobacterium bovis subsp bovis AF2122/97
acuccaucagcgcgaccg

SEQ ID NO: 1064470 - RNA, 20 nt, Mycobacterium bovis subsp bovis AF2122/97
acuccaucaccacaccggca

SEQ ID NO: 1064471 - RNA, 18 nt, Mycobacterium bovis subsp bovis AF2122/97
acuccagcuugccgaccu

SEQ ID NO: 1064472 - RNA, 14 nt, Mycobacterium bovis subsp bovis AF2122/97
acuccagcaaggcc

SEQ ID NO: 1064473 - RNA, 20 nt, Mycobacterium bovis subsp bovis AF2122/97
acuccagcaaggccagcacg

SEQ ID NO: 1064474 - RNA, 17 nt, Mycobacterium bovis subsp bovis AF2122/97
acuccagcaccagcacg

SEQ ID NO: 1064475 - RNA, 15 nt, Mycobacterium bovis subsp bovis AF2122/97
acuccagcacccgcu

SEQ ID NO: 1064476 - RNA, 14 nt, Mycobacterium bovis subsp bovis AF2122/97
acuccagcagcucg

SEQ ID NO: 1064477 - RNA, 17 nt, Mycobacterium bovis subsp bovis AF2122/97
acuccagcagcucgccg

SEQ ID NO: 1064478 - RNA, 14 nt, Mycobacterium bovis subsp bovis AF2122/97
acuccagcggcggg

SEQ ID NO: 1064479 - RNA, 14 nt, Mycobacterium bovis subsp bovis AF2122/97
acuccaccgcgccg

SEQ ID NO: 1064480 - RNA, 15 nt, Mycobacterium bovis subsp bovis AF2122/97
acuccacgcggaccu

SEQ ID NO: 1064481 - RNA, 13 nt, Mycobacterium bovis subsp bovis AF2122/97
acuccgcggcgcg

SEQ ID NO: 1064482 - RNA, 19 nt, Mycobacterium bovis subsp bovis AF2122/97
acuccgcggcgcgcaacac

SEQ ID NO: 1064483 - RNA, 18 nt, Mycobacterium bovis subsp bovis AF2122/97
acuccggcaagcacaccg

SEQ ID NO: 1064484 - RNA, 19 nt, Mycobacterium bovis subsp bovis AF2122/97
acuccggcaccggcaacau

SEQ ID NO: 1064485 - RNA, 20 nt, Mycobacterium bovis subsp bovis AF2122/97
acuccggcaggcccgacggc

SEQ ID NO: 1064486 - RNA, 14 nt, Mycobacterium bovis subsp bovis AF2122/97
acuccgacggcccg

SEQ ID NO: 1064487 - RNA, 23 nt, Mycobacterium bovis subsp bovis AF2122/97
acucccgcgcgggcggaucgccg

SEQ ID NO: 1064488 - RNA, 15 nt, Mycobacterium bovis subsp bovis AF2122/97
acucccucgaucacg

SEQ ID NO: 1064489 - RNA, 14 nt, Mycobacterium bovis subsp bovis AF2122/97
acucccggcucggc

SEQ ID NO: 1064490 - RNA, 19 nt, Mycobacterium bovis subsp bovis AF2122/97
acucccggcucggccagcc

SEQ ID NO: 1064491 - RNA, 17 nt, Mycobacterium bovis subsp bovis AF2122/97
acuccggucagcgcggc

SEQ ID NO: 1064492 - RNA, 15 nt, Mycobacterium bovis subsp bovis AF2122/97
acuccucagccgccu

SEQ ID NO: 1064493 - RNA, 20 nt, Mycobacterium bovis subsp bovis AF2122/97
acuccuagccaacgagcgcg

SEQ ID NO: 1064494 - RNA, 22 nt, Mycobacterium bovis subsp bovis AF2122/97
acucgcagcgccgucaucgugc

SEQ ID NO: 1064495 - RNA, 15 nt, Mycobacterium bovis subsp bovis AF2122/97
acucgcccgcugccg

SEQ ID NO: 1064496 - RNA, 16 nt, Mycobacterium bovis subsp bovis AF2122/97
acucgccgaaaucggc

SEQ ID NO: 1064497 - RNA, 17 nt, Mycobacterium bovis subsp bovis AF2122/97
acucgccacggucgccg

SEQ ID NO: 1064498 - RNA, 19 nt, Mycobacterium bovis subsp bovis AF2122/97
acucgcagcaacaccucgu

SEQ ID NO: 1064499 - RNA, 18 nt, Mycobacterium bovis subsp bovis AF2122/97
acucgagagcgaucaacg

SEQ ID NO: 1064500 - RNA, 18 nt, Mycobacterium bovis subsp bovis AF2122/97
acucgagaguggccucgu

SEQ ID NO: 1064501 - RNA, 18 nt, Mycobacterium bovis subsp bovis AF2122/97
acucgaguagucgcuggc

SEQ ID NO: 1064502 - RNA, 21 nt, Mycobacterium bovis subsp bovis AF2122/97
acucgaguggcgaacggguga

SEQ ID NO: 1064503 - RNA, 15 nt, Mycobacterium bovis subsp bovis AF2122/97
acucgacccggccaa

SEQ ID NO: 1064504 - RNA, 17 nt, Mycobacterium bovis subsp bovis AF2122/97
acucgaccaccgccggc

SEQ ID NO: 1064505 - RNA, 22 nt, Mycobacterium bovis subsp bovis AF2122/97
acucgaccgcgagcaugauguc

SEQ ID NO: 1064506 - RNA, 18 nt, Mycobacterium bovis subsp bovis AF2122/97
acucgacgucaugcaggg

SEQ ID NO: 1064507 - RNA, 22 nt, Mycobacterium bovis subsp bovis AF2122/97
acucgacgucgucgucgacggc

SEQ ID NO: 1064508 - RNA, 16 nt, Mycobacterium bovis subsp bovis AF2122/97
acuccugcggcaccgc

SEQ ID NO: 1064509 - RNA, 13 nt, Mycobacterium bovis subsp bovis AF2122/97
acucgaagcgggc

SEQ ID NO: 1064510 - RNA, 16 nt, Mycobacterium bovis subsp bovis AF2122/97
acucgaagucgcccag

SEQ ID NO: 1064511 - RNA, 16 nt, Mycobacterium bovis subsp bovis AF2122/97
acucgaccaccgccgg

SEQ ID NO: 1064512 - RNA, 18 nt, Mycobacterium bovis subsp bovis AF2122/97
accucgucgucgaaguug

SEQ ID NO: 1064513 - RNA, 17 nt, Mycobacterium bovis subsp bovis AF2122/97
accucgucgcgucgcca

SEQ ID NO: 1064514 - RNA, 14 nt, Mycobacterium bovis subsp bovis AF2122/97
accucgucggccga

SEQ ID NO: 1064515 - RNA, 19 nt, Mycobacterium bovis subsp bovis AF2122/97
accucgucggcgacggcca

SEQ ID NO: 1064516 - RNA, 21 nt, Mycobacterium bovis subsp bovis AF2122/97
accucgucggcgacggccagc

SEQ ID NO: 1064517 - RNA, 18 nt, Mycobacterium bovis subsp bovis AF2122/97
accucguugcugccggcg

SEQ ID NO: 1064518 - RNA, 14 nt, Mycobacterium bovis subsp bovis AF2122/97
accucuggcggcgg

SEQ ID NO: 1064519 - RNA, 14 nt, Mycobacterium bovis subsp bovis AF2122/97
accucggugccggc

SEQ ID NO: 1064520 - RNA, 23 nt, Mycobacterium bovis subsp bovis AF2122/97
accucguaugccguggccgccau

SEQ ID NO: 1064521 - RNA, 20 nt, Mycobacterium bovis subsp bovis AF2122/97
accucgguugguccucggcg

SEQ ID NO: 1064522 - RNA, 21 nt, Mycobacterium bovis subsp bovis AF2122/97
accucggugaccaggccggcc

SEQ ID NO: 1064523 - RNA, 12 nt, Mycobacterium bovis subsp bovis AF2122/97
accucggcggcg

SEQ ID NO: 1064524 - RNA, 13 nt, Mycobacterium bovis subsp bovis AF2122/97
accucgucgaucu

SEQ ID NO: 1064525 - RNA, 21 nt, Mycobacterium bovis subsp bovis AF2122/97
accucgucaaucaccaccgcc

SEQ ID NO: 1064526 - RNA, 22 nt, Mycobacterium bovis subsp bovis AF2122/97
accucgucgaucucgaucgacc

SEQ ID NO: 1064527 - RNA, 17 nt, Mycobacterium bovis subsp bovis AF2122/97
accucgucgaucgccgc

SEQ ID NO: 1064528 - RNA, 19 nt, Mycobacterium bovis subsp bovis AF2122/97
accucgucgaucgccgcgc

SEQ ID NO: 1064529 - RNA, 20 nt, Mycobacterium bovis subsp bovis AF2122/97
accucgucaccggucagcga

SEQ ID NO: 1064530 - RNA, 23 nt, Mycobacterium bovis subsp bovis AF2122/97
accucgucaccggucagcgacgc

SEQ ID NO: 1064531 - RNA, 15 nt, Mycobacterium bovis subsp bovis AF2122/97
accucgucacccggu

SEQ ID NO: 1064532 - RNA, 13 nt, Mycobacterium bovis subsp bovis AF2122/97
accucgucaccgg

SEQ ID NO: 1064533 - RNA, 19 nt, Mycobacterium bovis subsp bovis AF2122/97
accucggcgacgaugucga

SEQ ID NO: 1064534 - RNA, 22 nt, Mycobacterium bovis subsp bovis AF2122/97
accucggccagcuccgccugcc

SEQ ID NO: 1064535 - RNA, 18 nt, Mycobacterium bovis subsp bovis AF2122/97
accucggcgaugucgcgc

SEQ ID NO: 1064536 - RNA, 17 nt, Mycobacterium bovis subsp bovis AF2122/97
accucggcgcgaaacca

SEQ ID NO: 1064537 - RNA, 13 nt, Mycobacterium bovis subsp bovis AF2122/97
accucgccggccg

SEQ ID NO: 1064538 - RNA, 18 nt, Mycobacterium bovis subsp bovis AF2122/97
accucgcccucccgggcc

SEQ ID NO: 1064539 - RNA, 13 nt, Mycobacterium bovis subsp bovis AF2122/97
accucggcaacga

SEQ ID NO: 1064540 - RNA, 17 nt, Mycobacterium bovis subsp bovis AF2122/97
accucggcaacgacugc

SEQ ID NO: 1064541 - RNA, 15 nt, Mycobacterium bovis subsp bovis AF2122/97
accucgcuggccgca

SEQ ID NO: 1064542 - RNA, 16 nt, Mycobacterium bovis subsp bovis AF2122/97
accugccggaccgcgg

SEQ ID NO: 1064543 - RNA, 15 nt, Mycobacterium bovis subsp bovis AF2122/97
accugcccgucccgc

SEQ ID NO: 1064544 - RNA, 19 nt, Mycobacterium bovis subsp bovis AF2122/97
accugcgcaaauugcaaca

SEQ ID NO: 1064545 - RNA, 15 nt, Mycobacterium bovis subsp bovis AF2122/97
accugccaccagaca

SEQ ID NO: 1064546 - RNA, 15 nt, Mycobacterium bovis subsp bovis AF2122/97
accugcacccaggca

SEQ ID NO: 1064547 - RNA, 19 nt, Mycobacterium bovis subsp bovis AF2122/97
accugacgcucggucgcca

SEQ ID NO: 1064548 - RNA, 19 nt, Mycobacterium bovis subsp bovis AF2122/97
accugagcaucuccucgcc

SEQ ID NO: 1064549 - RNA, 22 nt, Mycobacterium bovis subsp bovis AF2122/97
accucuugcccuucuucgaccg

SEQ ID NO: 1064550 - RNA, 15 nt, Mycobacterium bovis subsp bovis AF2122/97
accugaagccgcgcu

SEQ ID NO: 1064551 - RNA, 14 nt, Mycobacterium bovis subsp bovis AF2122/97
accucgaccuggau

SEQ ID NO: 1064552 - RNA, 21 nt, Mycobacterium bovis subsp bovis AF2122/97
accucgaccuggaugggcucg

SEQ ID NO: 1064553 - RNA, 14 nt, Mycobacterium bovis subsp bovis AF2122/97
accucgagcguggc

SEQ ID NO: 1064554 - RNA, 16 nt, Mycobacterium bovis subsp bovis AF2122/97
accucgaccgccaacc

SEQ ID NO: 1064555 - RNA, 13 nt, Mycobacterium bovis subsp bovis AF2122/97
accucgauggcgu

SEQ ID NO: 1064556 - RNA, 17 nt, Mycobacterium bovis subsp bovis AF2122/97
accucgauggcguccau

SEQ ID NO: 1064557 - RNA, 17 nt, Mycobacterium bovis subsp bovis AF2122/97
accucgaugaugcgcuc

SEQ ID NO: 1064558 - RNA, 13 nt, Mycobacterium bovis subsp bovis AF2122/97
accucgccgcggc

SEQ ID NO: 1064559 - RNA, 15 nt, Mycobacterium bovis subsp bovis AF2122/97
accucgccgcggcgg

SEQ ID NO: 1064560 - RNA, 12 nt, Mycobacterium bovis subsp bovis AF2122/97
accucgccggcc

SEQ ID NO: 1064561 - RNA, 19 nt, Mycobacterium bovis subsp bovis AF2122/97
accucgaaaccguggccau

SEQ ID NO: 1064562 - RNA, 21 nt, Mycobacterium bovis subsp bovis AF2122/97
accuccggguccaggaacggc

SEQ ID NO: 1064563 - RNA, 19 nt, Mycobacterium bovis subsp bovis AF2122/97
accuccgacggccgcggcg

SEQ ID NO: 1064564 - RNA, 20 nt, Mycobacterium bovis subsp bovis AF2122/97
accuccgacggccgcggcgu

SEQ ID NO: 1064565 - RNA, 22 nt, Mycobacterium bovis subsp bovis AF2122/97
accuccgaggccgccaucgccg

SEQ ID NO: 1064566 - RNA, 23 nt, Mycobacterium bovis subsp bovis AF2122/97
accuccgaggccgccaucgccgc

SEQ ID NO: 1064567 - RNA, 16 nt, Mycobacterium bovis subsp bovis AF2122/97
accucccacgccgccg

SEQ ID NO: 1064568 - RNA, 14 nt, Mycobacterium bovis subsp bovis AF2122/97
accuccgccaccaa

SEQ ID NO: 1064569 - RNA, 15 nt, Mycobacterium bovis subsp bovis AF2122/97
accuccagugcggcc

SEQ ID NO: 1064570 - RNA, 14 nt, Mycobacterium bovis subsp bovis AF2122/97
accuccagugcggc

SEQ ID NO: 1064571 - RNA, 21 nt, Mycobacterium bovis subsp bovis AF2122/97
accuccacugggucgcugccg

SEQ ID NO: 1064572 - RNA, 22 nt, Mycobacterium bovis subsp bovis AF2122/97
accuccacugggucgcugccga

SEQ ID NO: 1064573 - RNA, 19 nt, Mycobacterium bovis subsp bovis AF2122/97
accucaugcacgccguagc

SEQ ID NO: 1064574 - RNA, 20 nt, Mycobacterium bovis subsp bovis AF2122/97
accuccaccgcgccggcggc

SEQ ID NO: 1064575 - RNA, 16 nt, Mycobacterium bovis subsp bovis AF2122/97
accuccaacaggccua

SEQ ID NO: 1064576 - RNA, 14 nt, Mycobacterium bovis subsp bovis AF2122/97
accucacugcggcg

SEQ ID NO: 1064577 - RNA, 18 nt, Mycobacterium bovis subsp bovis AF2122/97
accucagaaaguccccgc

SEQ ID NO: 1064578 - RNA, 15 nt, Mycobacterium bovis subsp bovis AF2122/97
accucaccgaacggc

SEQ ID NO: 1064579 - RNA, 21 nt, Mycobacterium bovis subsp bovis AF2122/97
accucaccgaucucgaccagc

SEQ ID NO: 1064580 - RNA, 24 nt, Mycobacterium bovis subsp bovis AF2122/97
accucaccgaucucgaccagcgcc

SEQ ID NO: 1064581 - RNA, 17 nt, Mycobacterium bovis subsp bovis AF2122/97
accucaccugacacgcc

SEQ ID NO: 1064582 - RNA, 16 nt, Mycobacterium bovis subsp bovis AF2122/97
accucaauguuugugu

SEQ ID NO: 1064583 - RNA, 22 nt, Mycobacterium bovis subsp bovis AF2122/97
accuauuugcgaccccgccgag

SEQ ID NO: 1064584 - RNA, 18 nt, Mycobacterium bovis subsp bovis AF2122/97
accucaacaccaggccgu

SEQ ID NO: 1064585 - RNA, 16 nt, Mycobacterium bovis subsp bovis AF2122/97
accuaugggaccggca

SEQ ID NO: 1064586 - RNA, 19 nt, Mycobacterium bovis subsp bovis AF2122/97
accuauggucaaccgcgcc

SEQ ID NO: 1064587 - RNA, 16 nt, Mycobacterium bovis subsp bovis AF2122/97
accuaucgcguuguga

SEQ ID NO: 1064588 - RNA, 16 nt, Mycobacterium bovis subsp bovis AF2122/97
accuauuggucgcucg

SEQ ID NO: 1064589 - RNA, 17 nt, Mycobacterium bovis subsp bovis AF2122/97
accgguaggcaccgauc

SEQ ID NO: 1064590 - RNA, 13 nt, Mycobacterium bovis subsp bovis AF2122/97
accggucaccgcg

SEQ ID NO: 1064591 - RNA, 15 nt, Mycobacterium bovis subsp bovis AF2122/97
accgguaucgccaaa

SEQ ID NO: 1064592 - RNA, 13 nt, Mycobacterium bovis subsp bovis AF2122/97
accgguaucgccg

SEQ ID NO: 1064593 - RNA, 18 nt, Mycobacterium bovis subsp bovis AF2122/97
accggucaaacgcgcgcg

SEQ ID NO: 1064594 - RNA, 13 nt, Mycobacterium bovis subsp bovis AF2122/97
accggucacccgu

SEQ ID NO: 1064595 - RNA, 19 nt, Mycobacterium bovis subsp bovis AF2122/97
accggucagcaccuccacc

SEQ ID NO: 1064596 - RNA, 23 nt, Mycobacterium bovis subsp bovis AF2122/97
accggucagcaccuccaccgcgc

SEQ ID NO: 1064597 - RNA, 17 nt, Mycobacterium bovis subsp bovis AF2122/97
accggucacgucgauga

SEQ ID NO: 1064598 - RNA, 15 nt, Mycobacterium bovis subsp bovis AF2122/97
accggucagcaccuc

SEQ ID NO: 1064599 - RNA, 14 nt, Mycobacterium bovis subsp bovis AF2122/97
accgguaccgccac

SEQ ID NO: 1064600 - RNA, 19 nt, Mycobacterium bovis subsp bovis AF2122/97
accgguaccggcgacgaau

SEQ ID NO: 1064601 - RNA, 18 nt, Mycobacterium bovis subsp bovis AF2122/97
accuagcagggugccggc

SEQ ID NO: 1064602 - RNA, 22 nt, Mycobacterium bovis subsp bovis AF2122/97
accuagcagggugccggcgccg

SEQ ID NO: 1064603 - RNA, 11 nt, Mycobacterium bovis subsp bovis AF2122/97
accuagccgca

SEQ ID NO: 1064604 - RNA, 17 nt, Mycobacterium bovis subsp bovis AF2122/97
accugcgucaucgcggg

SEQ ID NO: 1064605 - RNA, 15 nt, Mycobacterium bovis subsp bovis AF2122/97
accugcgcgacggcg

SEQ ID NO: 1064606 - RNA, 19 nt, Mycobacterium bovis subsp bovis AF2122/97
accugcgcgcggccgcgcu

SEQ ID NO: 1064607 - RNA, 15 nt, Mycobacterium bovis subsp bovis AF2122/97
accugcucgauacgg

SEQ ID NO: 1064608 - RNA, 21 nt, Mycobacterium bovis subsp bovis AF2122/97
accugcugcaccgucagcccg

SEQ ID NO: 1064609 - RNA, 17 nt, Mycobacterium bovis subsp bovis AF2122/97
accugcuggaucucggu

SEQ ID NO: 1064610 - RNA, 14 nt, Mycobacterium bovis subsp bovis AF2122/97
accugcucgggcgu

SEQ ID NO: 1064611 - RNA, 16 nt, Mycobacterium bovis subsp bovis AF2122/97
accugcucgggcguga

SEQ ID NO: 1064612 - RNA, 22 nt, Mycobacterium bovis subsp bovis AF2122/97
accugcucgggcgugaucccgc

SEQ ID NO: 1064613 - RNA, 19 nt, Mycobacterium bovis subsp bovis AF2122/97
accuggccugcggcaggug

SEQ ID NO: 1064614 - RNA, 21 nt, Mycobacterium bovis subsp bovis AF2122/97
accuggcgcagcaacucgacg

SEQ ID NO: 1064615 - RNA, 19 nt, Mycobacterium bovis subsp bovis AF2122/97
accuggcgauaaccgacga

SEQ ID NO: 1064616 - RNA, 21 nt, Mycobacterium bovis subsp bovis AF2122/97
accuggccgcccgcuccaaca

SEQ ID NO: 1064617 - RNA, 20 nt, Mycobacterium bovis subsp bovis AF2122/97
accuggccgcccgcugcggc

SEQ ID NO: 1064618 - RNA, 15 nt, Mycobacterium bovis subsp bovis AF2122/97
accuggcccgccacg

SEQ ID NO: 1064619 - RNA, 18 nt, Mycobacterium bovis subsp bovis AF2122/97
accuggcccgccacgaug

SEQ ID NO: 1064620 - RNA, 15 nt, Mycobacterium bovis subsp bovis AF2122/97
accuggacugcagcg

SEQ ID NO: 1064621 - RNA, 17 nt, Mycobacterium bovis subsp bovis AF2122/97
accuggaguccagcucg

SEQ ID NO: 1064622 - RNA, 19 nt, Mycobacterium bovis subsp bovis AF2122/97
accugggcgacuaccggcu

SEQ ID NO: 1064623 - RNA, 15 nt, Mycobacterium bovis subsp bovis AF2122/97
accugggcugccggc

SEQ ID NO: 1064624 - RNA, 17 nt, Mycobacterium bovis subsp bovis AF2122/97
accugggcugccggcca

SEQ ID NO: 1064625 - RNA, 19 nt, Mycobacterium bovis subsp bovis AF2122/97
accugggcugccggccaga

SEQ ID NO: 1064626 - RNA, 16 nt, Mycobacterium bovis subsp bovis AF2122/97
accuggcucaucgaug

SEQ ID NO: 1064627 - RNA, 23 nt, Mycobacterium bovis subsp bovis AF2122/97
accuggcggucccgcauauccgc

SEQ ID NO: 1064628 - RNA, 20 nt, Mycobacterium bovis subsp bovis AF2122/97
accuggaacugcaugguggc

SEQ ID NO: 1064629 - RNA, 16 nt, Mycobacterium bovis subsp bovis AF2122/97
accuggcgugucgccg

SEQ ID NO: 1064630 - RNA, 17 nt, Mycobacterium bovis subsp bovis AF2122/97
accuggcgugucgccgc

SEQ ID NO: 1064631 - RNA, 14 nt, Mycobacterium bovis subsp bovis AF2122/97
accuggcggugccg

SEQ ID NO: 1064632 - RNA, 18 nt, Mycobacterium bovis subsp bovis AF2122/97
accuggcggugccggcgg

SEQ ID NO: 1064633 - RNA, 21 nt, Mycobacterium bovis subsp bovis AF2122/97
accugggacaguucgcgccgu

SEQ ID NO: 1064634 - RNA, 18 nt, Mycobacterium bovis subsp bovis AF2122/97
accuguugacacaacgac

SEQ ID NO: 1064635 - RNA, 12 nt, Mycobacterium bovis subsp bovis AF2122/97
accuuggcuggg

SEQ ID NO: 1064636 - RNA, 19 nt, Mycobacterium bovis subsp bovis AF2122/97
accuuggcguugaccagca

SEQ ID NO: 1064637 - RNA, 18 nt, Mycobacterium bovis subsp bovis AF2122/97
accuuggacucggcggga

SEQ ID NO: 1064638 - RNA, 14 nt, Mycobacterium bovis subsp bovis AF2122/97
accuucaucaacga

SEQ ID NO: 1064639 - RNA, 13 nt, Mycobacterium bovis subsp bovis AF2122/97
accuugccgaaca

SEQ ID NO: 1064640 - RNA, 18 nt, Mycobacterium bovis subsp bovis AF2122/97
acgacugacaacggccac

SEQ ID NO: 1064641 - RNA, 22 nt, Mycobacterium bovis subsp bovis AF2122/97
acgacuccggcaagcacaccgc

SEQ ID NO: 1064642 - RNA, 17 nt, Mycobacterium bovis subsp bovis AF2122/97
acgacucgcgguggccg

SEQ ID NO: 1064643 - RNA, 13 nt, Mycobacterium bovis subsp bovis AF2122/97
acgacucccccgg

SEQ ID NO: 1064644 - RNA, 16 nt, Mycobacterium bovis subsp bovis AF2122/97
acgacuccggcaagca

SEQ ID NO: 1064645 - RNA, 21 nt, Mycobacterium bovis subsp bovis AF2122/97
acgacuccggcaagcacaccg

SEQ ID NO: 1064646 - RNA, 16 nt, Mycobacterium bovis subsp bovis AF2122/97
acgacguucgacgaca

SEQ ID NO: 1064647 - RNA, 15 nt, Mycobacterium bovis subsp bovis AF2122/97
acgacgucgagcgcc

SEQ ID NO: 1064648 - RNA, 16 nt, Mycobacterium bovis subsp bovis AF2122/97
acgacgucgccgccgc

SEQ ID NO: 1064649 - RNA, 24 nt, Mycobacterium bovis subsp bovis AF2122/97
acgacgucggccgcaucgcccaac

SEQ ID NO: 1064650 - RNA, 16 nt, Mycobacterium bovis subsp bovis AF2122/97
acgacguugcgaggcc

SEQ ID NO: 1064651 - RNA, 14 nt, Mycobacterium bovis subsp bovis AF2122/97
acgacgccgacgau

SEQ ID NO: 1064652 - RNA, 15 nt, Mycobacterium bovis subsp bovis AF2122/97
acgacgcauccggau

SEQ ID NO: 1064653 - RNA, 12 nt, Mycobacterium bovis subsp bovis AF2122/97
acgacgccggcc

SEQ ID NO: 1064654 - RNA, 23 nt, Mycobacterium bovis subsp bovis AF2122/97
acgacgccggccuggccgccaga

SEQ ID NO: 1064655 - RNA, 15 nt, Mycobacterium bovis subsp bovis AF2122/97
acgacgccgucggac

SEQ ID NO: 1064656 - RNA, 18 nt, Mycobacterium bovis subsp bovis AF2122/97
acgacgccgucggacacc

SEQ ID NO: 1064657 - RNA, 14 nt, Mycobacterium bovis subsp bovis AF2122/97
acgacgucggccgc

SEQ ID NO: 1064658 - RNA, 20 nt, Mycobacterium bovis subsp bovis AF2122/97
acgacgacaagugcccggcc

SEQ ID NO: 1064659 - RNA, 22 nt, Mycobacterium bovis subsp bovis AF2122/97
acgacgaucgcgucgggcucgg

SEQ ID NO: 1064660 - RNA, 18 nt, Mycobacterium bovis subsp bovis AF2122/97
acgacgaacaccagcgcg

SEQ ID NO: 1064661 - RNA, 17 nt, Mycobacterium bovis subsp bovis AF2122/97
acgacccgacguagccg

SEQ ID NO: 1064662 - RNA, 14 nt, Mycobacterium bovis subsp bovis AF2122/97
acgaccgcgacaac

SEQ ID NO: 1064663 - RNA, 23 nt, Mycobacterium bovis subsp bovis AF2122/97
acgaccgugcugggcgccgcgcu

SEQ ID NO: 1064664 - RNA, 21 nt, Mycobacterium bovis subsp bovis AF2122/97
acgaccgucgcgcugccggcc

SEQ ID NO: 1064665 - RNA, 22 nt, Mycobacterium bovis subsp bovis AF2122/97
acgaccgucgcgcugccggccg

SEQ ID NO: 1064666 - RNA, 23 nt, Mycobacterium bovis subsp bovis AF2122/97
acgaccgucgcgcugccggccgc

SEQ ID NO: 1064667 - RNA, 17 nt, Mycobacterium bovis subsp bovis AF2122/97
acgaccgucucgguggu

SEQ ID NO: 1064668 - RNA, 21 nt, Mycobacterium bovis subsp bovis AF2122/97
acgaauccacuggucaacggg

SEQ ID NO: 1064669 - RNA, 15 nt, Mycobacterium bovis subsp bovis AF2122/97
acgaauccgaucacc

SEQ ID NO: 1064670 - RNA, 14 nt, Mycobacterium bovis subsp bovis AF2122/97
acgaauccggccac

SEQ ID NO: 1064671 - RNA, 20 nt, Mycobacterium bovis subsp bovis AF2122/97
acgaaucgcccaucgcaagc

SEQ ID NO: 1064672 - RNA, 18 nt, Mycobacterium bovis subsp bovis AF2122/97
acgaauaccgggaugcga

SEQ ID NO: 1064673 - RNA, 20 nt, Mycobacterium bovis subsp bovis AF2122/97
acgacccgggaaggaaccgg

SEQ ID NO: 1064674 - RNA, 22 nt, Mycobacterium bovis subsp bovis AF2122/97
acgacccgggaaggaaccgggc

SEQ ID NO: 1064675 - RNA, 21 nt, Mycobacterium bovis subsp bovis AF2122/97
acgacccgcuggucgaugccu

SEQ ID NO: 1064676 - RNA, 13 nt, Mycobacterium bovis subsp bovis AF2122/97
acgacccgccgcc

SEQ ID NO: 1064677 - RNA, 17 nt, Mycobacterium bovis subsp bovis AF2122/97
acgacccgggucggcac

SEQ ID NO: 1064678 - RNA, 15 nt, Mycobacterium bovis subsp bovis AF2122/97
acgacccccgaucag

SEQ ID NO: 1064679 - RNA, 13 nt, Mycobacterium bovis subsp bovis AF2122/97
acgaccagcagau

SEQ ID NO: 1064680 - RNA, 16 nt, Mycobacterium bovis subsp bovis AF2122/97
acgacaaccggccaga

SEQ ID NO: 1064681 - RNA, 15 nt, Mycobacterium bovis subsp bovis AF2122/97
acgacaacagccagc

SEQ ID NO: 1064682 - RNA, 19 nt, Mycobacterium bovis subsp bovis AF2122/97
acgaaugucaccccgccca

SEQ ID NO: 1064683 - RNA, 19 nt, Mycobacterium bovis subsp bovis AF2122/97
acgccgccccugcgcggcc

SEQ ID NO: 1064684 - RNA, 21 nt, Mycobacterium bovis subsp bovis AF2122/97
acgccgccccugcgcggccac

SEQ ID NO: 1064685 - RNA, 22 nt, Mycobacterium bovis subsp bovis AF2122/97
acgccgccccugcgcggccacc

SEQ ID NO: 1064686 - RNA, 20 nt, Mycobacterium bovis subsp bovis AF2122/97
acgccgccagcaccucggcc

SEQ ID NO: 1064687 - RNA, 13 nt, Mycobacterium bovis subsp bovis AF2122/97
acgccgccagcag

SEQ ID NO: 1064688 - RNA, 12 nt, Mycobacterium bovis subsp bovis AF2122/97
acgccgccagcc

SEQ ID NO: 1064689 - RNA, 19 nt, Mycobacterium bovis subsp bovis AF2122/97
acgccgccagguccgccgg

SEQ ID NO: 1064690 - RNA, 12 nt, Mycobacterium bovis subsp bovis AF2122/97
acgccgccaccc

SEQ ID NO: 1064691 - RNA, 16 nt, Mycobacterium bovis subsp bovis AF2122/97
acgccgccacccggcg

SEQ ID NO: 1064692 - RNA, 19 nt, Mycobacterium bovis subsp bovis AF2122/97
acgccgccacccggcgggc

SEQ ID NO: 1064693 - RNA, 22 nt, Mycobacterium bovis subsp bovis AF2122/97
acgccgaugauggacaccagcc

SEQ ID NO: 1064694 - RNA, 15 nt, Mycobacterium bovis subsp bovis AF2122/97
acgccgaucgcggcg

SEQ ID NO: 1064695 - RNA, 17 nt, Mycobacterium bovis subsp bovis AF2122/97
acgccgaucgcggcggc

SEQ ID NO: 1064696 - RNA, 18 nt, Mycobacterium bovis subsp bovis AF2122/97
acgccgaucgcggcggcc

SEQ ID NO: 1064697 - RNA, 13 nt, Mycobacterium bovis subsp bovis AF2122/97
acgccgaggcguu

SEQ ID NO: 1064698 - RNA, 12 nt, Mycobacterium bovis subsp bovis AF2122/97
acgccgagcgcc

SEQ ID NO: 1064699 - RNA, 13 nt, Mycobacterium bovis subsp bovis AF2122/97
acgccgagcgcca

SEQ ID NO: 1064700 - RNA, 16 nt, Mycobacterium bovis subsp bovis AF2122/97
acgccgagaccgccgc

SEQ ID NO: 1064701 - RNA, 15 nt, Mycobacterium bovis subsp bovis AF2122/97
acgccgagaccgccg

SEQ ID NO: 1064702 - RNA, 23 nt, Mycobacterium bovis subsp bovis AF2122/97
acgccgacgaugacgcgcgaaac

SEQ ID NO: 1064703 - RNA, 15 nt, Mycobacterium bovis subsp bovis AF2122/97
acgccgacuccgcgu

SEQ ID NO: 1064704 - RNA, 16 nt, Mycobacterium bovis subsp bovis AF2122/97
acgccgaccggcccgc

SEQ ID NO: 1064705 - RNA, 15 nt, Mycobacterium bovis subsp bovis AF2122/97
acgccgaccagcacc

SEQ ID NO: 1064706 - RNA, 13 nt, Mycobacterium bovis subsp bovis AF2122/97
acgccgaccgcgc

SEQ ID NO: 1064707 - RNA, 16 nt, Mycobacterium bovis subsp bovis AF2122/97
acgccgaccgcgccgc

SEQ ID NO: 1064708 - RNA, 17 nt, Mycobacterium bovis subsp bovis AF2122/97
acgccgaccgcgccgca

SEQ ID NO: 1064709 - RNA, 15 nt, Mycobacterium bovis subsp bovis AF2122/97
acgccggccgcgcug

SEQ ID NO: 1064710 - RNA, 13 nt, Mycobacterium bovis subsp bovis AF2122/97
acgccggcgacgg

SEQ ID NO: 1064711 - RNA, 16 nt, Mycobacterium bovis subsp bovis AF2122/97
acgccguugccaccgu

SEQ ID NO: 1064712 - RNA, 19 nt, Mycobacterium bovis subsp bovis AF2122/97
acgccguggugcgcauggc

SEQ ID NO: 1064713 - RNA, 17 nt, Mycobacterium bovis subsp bovis AF2122/97
acgccguugccgccguu

SEQ ID NO: 1064714 - RNA, 20 nt, Mycobacterium bovis subsp bovis AF2122/97
acgccguugccgccguugcc

SEQ ID NO: 1064715 - RNA, 15 nt, Mycobacterium bovis subsp bovis AF2122/97
acgccggcgccgcca

SEQ ID NO: 1064716 - RNA, 18 nt, Mycobacterium bovis subsp bovis AF2122/97
acgccggccucgccgaag

SEQ ID NO: 1064717 - RNA, 12 nt, Mycobacterium bovis subsp bovis AF2122/97
acgccggccagc

SEQ ID NO: 1064718 - RNA, 18 nt, Mycobacterium bovis subsp bovis AF2122/97
acgccggcaucgcgcgcg

SEQ ID NO: 1064719 - RNA, 13 nt, Mycobacterium bovis subsp bovis AF2122/97
acgccggcaucgc

SEQ ID NO: 1064720 - RNA, 15 nt, Mycobacterium bovis subsp bovis AF2122/97
acgccggcaucgcgc

SEQ ID NO: 1064721 - RNA, 22 nt, Mycobacterium bovis subsp bovis AF2122/97
acgccggauuauucgcgguagc

SEQ ID NO: 1064722 - RNA, 20 nt, Mycobacterium bovis subsp bovis AF2122/97
acgccggacccggucgccgg

SEQ ID NO: 1064723 - RNA, 14 nt, Mycobacterium bovis subsp bovis AF2122/97
acgccgccgcugcc

SEQ ID NO: 1064724 - RNA, 18 nt, Mycobacterium bovis subsp bovis AF2122/97
acgccgccgcugccgccc

SEQ ID NO: 1064725 - RNA, 12 nt, Mycobacterium bovis subsp bovis AF2122/97
acgccgcggcgc

SEQ ID NO: 1064726 - RNA, 22 nt, Mycobacterium bovis subsp bovis AF2122/97
acgccgcggcgccggugggcgg

SEQ ID NO: 1064727 - RNA, 19 nt, Mycobacterium bovis subsp bovis AF2122/97
acgccgcgguuuucgccgg

SEQ ID NO: 1064728 - RNA, 20 nt, Mycobacterium bovis subsp bovis AF2122/97
acgccgcgguuuucgccgga

SEQ ID NO: 1064729 - RNA, 14 nt, Mycobacterium bovis subsp bovis AF2122/97
acgccgcucccgca

SEQ ID NO: 1064730 - RNA, 13 nt, Mycobacterium bovis subsp bovis AF2122/97
acgccgccgacgu

SEQ ID NO: 1064731 - RNA, 13 nt, Mycobacterium bovis subsp bovis AF2122/97
acgccucgccgaa

SEQ ID NO: 1064732 - RNA, 12 nt, Mycobacterium bovis subsp bovis AF2122/97
acgccucgagca

SEQ ID NO: 1064733 - RNA, 16 nt, Mycobacterium bovis subsp bovis AF2122/97
acgccucgccggccac

SEQ ID NO: 1064734 - RNA, 23 nt, Mycobacterium bovis subsp bovis AF2122/97
acgccuggcuacgcgcgcccgau

SEQ ID NO: 1064735 - RNA, 16 nt, Mycobacterium bovis subsp bovis AF2122/97
acgccucaccgacguc

SEQ ID NO: 1064736 - RNA, 23 nt, Mycobacterium bovis subsp bovis AF2122/97
acgccgugugcaucggcgaccgc

SEQ ID NO: 1064737 - RNA, 15 nt, Mycobacterium bovis subsp bovis AF2122/97
acgccucgauggcgg

SEQ ID NO: 1064738 - RNA, 18 nt, Mycobacterium bovis subsp bovis AF2122/97
acgccucgacacccagcc

SEQ ID NO: 1064739 - RNA, 13 nt, Mycobacterium bovis subsp bovis AF2122/97
acgccucgccauc

SEQ ID NO: 1064740 - RNA, 19 nt, Mycobacterium bovis subsp bovis AF2122/97
acgcgaugguggccgccac

SEQ ID NO: 1064741 - RNA, 17 nt, Mycobacterium bovis subsp bovis AF2122/97
acgcgaugaccgcaccg

SEQ ID NO: 1064742 - RNA, 22 nt, Mycobacterium bovis subsp bovis AF2122/97
acgcgcaacucgccacggucgc

SEQ ID NO: 1064743 - RNA, 21 nt, Mycobacterium bovis subsp bovis AF2122/97
acgcgauguccagguggcgcg

SEQ ID NO: 1064744 - RNA, 20 nt, Mycobacterium bovis subsp bovis AF2122/97
acgcgaugguggccgccacc

SEQ ID NO: 1064745 - RNA, 14 nt, Mycobacterium bovis subsp bovis AF2122/97
acgcgaugaccgca

SEQ ID NO: 1064746 - RNA, 22 nt, Mycobacterium bovis subsp bovis AF2122/97
acgcgaucagcgcgcacacggc

SEQ ID NO: 1064747 - RNA, 12 nt, Mycobacterium bovis subsp bovis AF2122/97
acgcgaucggcg

SEQ ID NO: 1064748 - RNA, 20 nt, Mycobacterium bovis subsp bovis AF2122/97
acgcgaucaccucgccacac

SEQ ID NO: 1064749 - RNA, 18 nt, Mycobacterium bovis subsp bovis AF2122/97
acgccuugagccgaggcg

SEQ ID NO: 1064750 - RNA, 12 nt, Mycobacterium bovis subsp bovis AF2122/97
acgcgccgcaca

SEQ ID NO: 1064751 - RNA, 18 nt, Mycobacterium bovis subsp bovis AF2122/97
acgcgcccgcaccaccgg

SEQ ID NO: 1064752 - RNA, 20 nt, Mycobacterium bovis subsp bovis AF2122/97
acgcgccccaguucgacggc

SEQ ID NO: 1064753 - RNA, 13 nt, Mycobacterium bovis subsp bovis AF2122/97
acgcgcggccagc

SEQ ID NO: 1064754 - RNA, 13 nt, Mycobacterium bovis subsp bovis AF2122/97
acgcgcggcggcg

SEQ ID NO: 1064755 - RNA, 20 nt, Mycobacterium bovis subsp bovis AF2122/97
acgcgcggaucggcggccgc

SEQ ID NO: 1064756 - RNA, 23 nt, Mycobacterium bovis subsp bovis AF2122/97
acgcgcgcguggucgccccgaug

SEQ ID NO: 1064757 - RNA, 20 nt, Mycobacterium bovis subsp bovis AF2122/97
acgcgcgcucgcucaccggc

SEQ ID NO: 1064758 - RNA, 15 nt, Mycobacterium bovis subsp bovis AF2122/97
acgcgcgcucgcuca

SEQ ID NO: 1064759 - RNA, 17 nt, Mycobacterium bovis subsp bovis AF2122/97
acgcgcgcucgcucacc

SEQ ID NO: 1064760 - RNA, 17 nt, Mycobacterium bovis subsp bovis AF2122/97
acgcgcaccuggcgcgc

SEQ ID NO: 1064761 - RNA, 17 nt, Mycobacterium bovis subsp bovis AF2122/97
acgcgcacgcgugccgc

SEQ ID NO: 1064762 - RNA, 16 nt, Mycobacterium bovis subsp bovis AF2122/97
acgcgcagcaucggcg

SEQ ID NO: 1064763 - RNA, 15 nt, Mycobacterium bovis subsp bovis AF2122/97
acgcgcacucgacgc

SEQ ID NO: 1064764 - RNA, 18 nt, Mycobacterium bovis subsp bovis AF2122/97
acgcgcagaaagucgcgc

SEQ ID NO: 1064765 - RNA, 14 nt, Mycobacterium bovis subsp bovis AF2122/97
acgcgcaugccccg

SEQ ID NO: 1064766 - RNA, 18 nt, Mycobacterium bovis subsp bovis AF2122/97
acgcgcaguuuggcggcg

SEQ ID NO: 1064767 - RNA, 20 nt, Mycobacterium bovis subsp bovis AF2122/97
acgcgcaguuuggcggcgcg

SEQ ID NO: 1064768 - RNA, 17 nt, Mycobacterium bovis subsp bovis AF2122/97
acgcgcauucgccgggc

SEQ ID NO: 1064769 - RNA, 18 nt, Mycobacterium bovis subsp bovis AF2122/97
acgcgcauucgccgggcg

SEQ ID NO: 1064770 - RNA, 17 nt, Mycobacterium bovis subsp bovis AF2122/97
acgccaggaucugggua

SEQ ID NO: 1064771 - RNA, 17 nt, Mycobacterium bovis subsp bovis AF2122/97
acgccagcucgccggcc

SEQ ID NO: 1064772 - RNA, 12 nt, Mycobacterium bovis subsp bovis AF2122/97
acgccagcugcc

SEQ ID NO: 1064773 - RNA, 16 nt, Mycobacterium bovis subsp bovis AF2122/97
acgccagcugcccgac

SEQ ID NO: 1064774 - RNA, 18 nt, Mycobacterium bovis subsp bovis AF2122/97
acgccagcugcccgacgu

SEQ ID NO: 1064775 - RNA, 12 nt, Mycobacterium bovis subsp bovis AF2122/97
acgccagccggu

SEQ ID NO: 1064776 - RNA, 13 nt, Mycobacterium bovis subsp bovis AF2122/97
acgccaccgucgc

SEQ ID NO: 1064777 - RNA, 14 nt, Mycobacterium bovis subsp bovis AF2122/97
acgccaccgucgcu

SEQ ID NO: 1064778 - RNA, 20 nt, Mycobacterium bovis subsp bovis AF2122/97
acgccaaugccgcggaggcg

SEQ ID NO: 1064779 - RNA, 23 nt, Mycobacterium bovis subsp bovis AF2122/97
acgccacccccaaccgccggcca

SEQ ID NO: 1064780 - RNA, 15 nt, Mycobacterium bovis subsp bovis AF2122/97
acgccacgaccgccg

SEQ ID NO: 1064781 - RNA, 18 nt, Mycobacterium bovis subsp bovis AF2122/97
acgccaccaccuccgcgu

SEQ ID NO: 1064782 - RNA, 13 nt, Mycobacterium bovis subsp bovis AF2122/97
acgccaccgcggu

SEQ ID NO: 1064783 - RNA, 19 nt, Mycobacterium bovis subsp bovis AF2122/97
acgccaaguacgcgaccgc

SEQ ID NO: 1064784 - RNA, 15 nt, Mycobacterium bovis subsp bovis AF2122/97
acgccaaguccgcuc

SEQ ID NO: 1064785 - RNA, 14 nt, Mycobacterium bovis subsp bovis AF2122/97
acgcaucgaugcgu

SEQ ID NO: 1064786 - RNA, 12 nt, Mycobacterium bovis subsp bovis AF2122/97
acgccaaugccg

SEQ ID NO: 1064787 - RNA, 19 nt, Mycobacterium bovis subsp bovis AF2122/97
acgcagugcccgaucgcuu

SEQ ID NO: 1064788 - RNA, 16 nt, Mycobacterium bovis subsp bovis AF2122/97
acgcaguucggucagc

SEQ ID NO: 1064789 - RNA, 12 nt, Mycobacterium bovis subsp bovis AF2122/97
acgcccggcccc

SEQ ID NO: 1064790 - RNA, 14 nt, Mycobacterium bovis subsp bovis AF2122/97
acgcccggccccgc

SEQ ID NO: 1064791 - RNA, 17 nt, Mycobacterium bovis subsp bovis AF2122/97
acgcccggccccgcggc

SEQ ID NO: 1064792 - RNA, 21 nt, Mycobacterium bovis subsp bovis AF2122/97
acgcccggccccgcggccagc

SEQ ID NO: 1064793 - RNA, 19 nt, Mycobacterium bovis subsp bovis AF2122/97
acgccgaacgugcaaccac

SEQ ID NO: 1064794 - RNA, 21 nt, Mycobacterium bovis subsp bovis AF2122/97
acgccgaacgugcaaccacgg

SEQ ID NO: 1064795 - RNA, 16 nt, Mycobacterium bovis subsp bovis AF2122/97
acgcccgcaucgccuc

SEQ ID NO: 1064796 - RNA, 17 nt, Mycobacterium bovis subsp bovis AF2122/97
acgcccgcacucggcgg

SEQ ID NO: 1064797 - RNA, 18 nt, Mycobacterium bovis subsp bovis AF2122/97
acgcccgcacucggcggu

SEQ ID NO: 1064798 - RNA, 19 nt, Mycobacterium bovis subsp bovis AF2122/97
acgcccacaaugacucggc

SEQ ID NO: 1064799 - RNA, 22 nt, Mycobacterium bovis subsp bovis AF2122/97
acgcccacaaugacucggccgc

SEQ ID NO: 1064800 - RNA, 19 nt, Mycobacterium bovis subsp bovis AF2122/97
acgcccacuccagcagcuc

SEQ ID NO: 1064801 - RNA, 20 nt, Mycobacterium bovis subsp bovis AF2122/97
acgcccaacgucgccagguc

SEQ ID NO: 1064802 - RNA, 19 nt, Mycobacterium bovis subsp bovis AF2122/97
acgccccuucccuaucacg

SEQ ID NO: 1064803 - RNA, 17 nt, Mycobacterium bovis subsp bovis AF2122/97
acgccaggggacccggg

SEQ ID NO: 1064804 - RNA, 16 nt, Mycobacterium bovis subsp bovis AF2122/97
acgcccacaugcucag

SEQ ID NO: 1064805 - RNA, 13 nt, Mycobacterium bovis subsp bovis AF2122/97
acgcccaccacgc

SEQ ID NO: 1064806 - RNA, 14 nt, Mycobacterium bovis subsp bovis AF2122/97
acgcccaccacgcg

SEQ ID NO: 1064807 - RNA, 18 nt, Mycobacterium bovis subsp bovis AF2122/97
acgcccaccacgcgacgc

SEQ ID NO: 1064808 - RNA, 17 nt, Mycobacterium bovis subsp bovis AF2122/97
acgccauucaucggcau

SEQ ID NO: 1064809 - RNA, 18 nt, Mycobacterium bovis subsp bovis AF2122/97
acgcaccacgagcagccg

SEQ ID NO: 1064810 - RNA, 13 nt, Mycobacterium bovis subsp bovis AF2122/97
acgcacccaccga

SEQ ID NO: 1064811 - RNA, 17 nt, Mycobacterium bovis subsp bovis AF2122/97
acgcaccgaggccgccg

SEQ ID NO: 1064812 - RNA, 18 nt, Mycobacterium bovis subsp bovis AF2122/97
acgcaccgaggccgccga

SEQ ID NO: 1064813 - RNA, 15 nt, Mycobacterium bovis subsp bovis AF2122/97
acgcaccgccccgcc

SEQ ID NO: 1064814 - RNA, 15 nt, Mycobacterium bovis subsp bovis AF2122/97
acgcagcacggcacc

SEQ ID NO: 1064815 - RNA, 15 nt, Mycobacterium bovis subsp bovis AF2122/97
acgcagcacccugcg

SEQ ID NO: 1064816 - RNA, 13 nt, Mycobacterium bovis subsp bovis AF2122/97
acgcagcacggca

SEQ ID NO: 1064817 - RNA, 20 nt, Mycobacterium bovis subsp bovis AF2122/97
acgcagaccguccagcaaca

SEQ ID NO: 1064818 - RNA, 20 nt, Mycobacterium bovis subsp bovis AF2122/97
acgcagcacggcacccaccc

SEQ ID NO: 1064819 - RNA, 16 nt, Mycobacterium bovis subsp bovis AF2122/97
acgcaggugaacgccg

SEQ ID NO: 1064820 - RNA, 23 nt, Mycobacterium bovis subsp bovis AF2122/97
acgcagccgauacaggccacgca

SEQ ID NO: 1064821 - RNA, 24 nt, Mycobacterium bovis subsp bovis AF2122/97
acgcagccgauacaggccacgcac

SEQ ID NO: 1064822 - RNA, 18 nt, Mycobacterium bovis subsp bovis AF2122/97
acgcagccaaugccggau

SEQ ID NO: 1064823 - RNA, 15 nt, Mycobacterium bovis subsp bovis AF2122/97
acgcagccccucguc

SEQ ID NO: 1064824 - RNA, 12 nt, Mycobacterium bovis subsp bovis AF2122/97
acgaugucgaug

SEQ ID NO: 1064825 - RNA, 15 nt, Mycobacterium bovis subsp bovis AF2122/97
acgauguccucgaug

SEQ ID NO: 1064826 - RNA, 23 nt, Mycobacterium bovis subsp bovis AF2122/97
acgaugucggucggaucggcgcc

SEQ ID NO: 1064827 - RNA, 18 nt, Mycobacterium bovis subsp bovis AF2122/97
acgauucccgcggacagc

SEQ ID NO: 1064828 - RNA, 21 nt, Mycobacterium bovis subsp bovis AF2122/97
acgcaagggaauccgaacucg

SEQ ID NO: 1064829 - RNA, 22 nt, Mycobacterium bovis subsp bovis AF2122/97
acgauucggcggccgugucggg

SEQ ID NO: 1064830 - RNA, 14 nt, Mycobacterium bovis subsp bovis AF2122/97
acgaugucggcacc

SEQ ID NO: 1064831 - RNA, 13 nt, Mycobacterium bovis subsp bovis AF2122/97
acgauuaccagcg

SEQ ID NO: 1064832 - RNA, 17 nt, Mycobacterium bovis subsp bovis AF2122/97
acgcaauagccaucacg

SEQ ID NO: 1064833 - RNA, 22 nt, Mycobacterium bovis subsp bovis AF2122/97
acgcacaauacggucagcagac

SEQ ID NO: 1064834 - RNA, 14 nt, Mycobacterium bovis subsp bovis AF2122/97
acgcacagcagcac

SEQ ID NO: 1064835 - RNA, 15 nt, Mycobacterium bovis subsp bovis AF2122/97
acgcacagcccgaug

SEQ ID NO: 1064836 - RNA, 23 nt, Mycobacterium bovis subsp bovis AF2122/97
acgagcuguacuugggauugcgg

SEQ ID NO: 1064837 - RNA, 18 nt, Mycobacterium bovis subsp bovis AF2122/97
acgagcgucagauccggc

SEQ ID NO: 1064838 - RNA, 14 nt, Mycobacterium bovis subsp bovis AF2122/97
acgagccgguggcg

SEQ ID NO: 1064839 - RNA, 23 nt, Mycobacterium bovis subsp bovis AF2122/97
acgagcgaaggugaacgacaugg

SEQ ID NO: 1064840 - RNA, 12 nt, Mycobacterium bovis subsp bovis AF2122/97
acgagcgauacg

SEQ ID NO: 1064841 - RNA, 13 nt, Mycobacterium bovis subsp bovis AF2122/97
acgagccgcgguc

SEQ ID NO: 1064842 - RNA, 17 nt, Mycobacterium bovis subsp bovis AF2122/97
acgagccgcggucggcg

SEQ ID NO: 1064843 - RNA, 17 nt, Mycobacterium bovis subsp bovis AF2122/97
acgagcgauacgucguc

SEQ ID NO: 1064844 - RNA, 21 nt, Mycobacterium bovis subsp bovis AF2122/97
acgaucgugagacgccgucga

SEQ ID NO: 1064845 - RNA, 24 nt, Mycobacterium bovis subsp bovis AF2122/97
acgaucgugagacgccgucgacgu

SEQ ID NO: 1064846 - RNA, 22 nt, Mycobacterium bovis subsp bovis AF2122/97
acgagccagagguggaucaggg

SEQ ID NO: 1064847 - RNA, 19 nt, Mycobacterium bovis subsp bovis AF2122/97
acgagcuuccacgccggac

SEQ ID NO: 1064848 - RNA, 20 nt, Mycobacterium bovis subsp bovis AF2122/97
acgaggacggcuugagccgc

SEQ ID NO: 1064849 - RNA, 13 nt, Mycobacterium bovis subsp bovis AF2122/97
acgaggaugucga

SEQ ID NO: 1064850 - RNA, 19 nt, Mycobacterium bovis subsp bovis AF2122/97
acgacuguggcgccgccgg

SEQ ID NO: 1064851 - RNA, 21 nt, Mycobacterium bovis subsp bovis AF2122/97
acgacuguggcgccgccggca

SEQ ID NO: 1064852 - RNA, 13 nt, Mycobacterium bovis subsp bovis AF2122/97
acgacugucccgc

SEQ ID NO: 1064853 - RNA, 13 nt, Mycobacterium bovis subsp bovis AF2122/97
acgacugggcgcc

SEQ ID NO: 1064854 - RNA, 14 nt, Mycobacterium bovis subsp bovis AF2122/97
acgacugggcgccc

SEQ ID NO: 1064855 - RNA, 22 nt, Mycobacterium bovis subsp bovis AF2122/97
acgacuggacaggucgcccaac

SEQ ID NO: 1064856 - RNA, 14 nt, Mycobacterium bovis subsp bovis AF2122/97
acgagcccacgcgc

SEQ ID NO: 1064857 - RNA, 20 nt, Mycobacterium bovis subsp bovis AF2122/97
acgagcauuucggaugccgc

SEQ ID NO: 1064858 - RNA, 12 nt, Mycobacterium bovis subsp bovis AF2122/97
acgagccaacaa

SEQ ID NO: 1064859 - RNA, 20 nt, Mycobacterium bovis subsp bovis AF2122/97
acgagccagagguggaucag

SEQ ID NO: 1064860 - RNA, 14 nt, Mycobacterium bovis subsp bovis AF2122/97
acgaugacgucgac

SEQ ID NO: 1064861 - RNA, 13 nt, Mycobacterium bovis subsp bovis AF2122/97
acgaugaccgcgc

SEQ ID NO: 1064862 - RNA, 14 nt, Mycobacterium bovis subsp bovis AF2122/97
acgaugaccgcgcg

SEQ ID NO: 1064863 - RNA, 23 nt, Mycobacterium bovis subsp bovis AF2122/97
acgaugaccgcgcggcccgccga

SEQ ID NO: 1064864 - RNA, 22 nt, Mycobacterium bovis subsp bovis AF2122/97
acgaugaucagggucagcgccg

SEQ ID NO: 1064865 - RNA, 19 nt, Mycobacterium bovis subsp bovis AF2122/97
acgaugaucuugccgcggc

SEQ ID NO: 1064866 - RNA, 14 nt, Mycobacterium bovis subsp bovis AF2122/97
acgauggcgaugag

SEQ ID NO: 1064867 - RNA, 15 nt, Mycobacterium bovis subsp bovis AF2122/97
acgauggcggccacc

SEQ ID NO: 1064868 - RNA, 16 nt, Mycobacterium bovis subsp bovis AF2122/97
acgauggcgucggcca

SEQ ID NO: 1064869 - RNA, 21 nt, Mycobacterium bovis subsp bovis AF2122/97
acgauggcucucacgagcggc

SEQ ID NO: 1064870 - RNA, 22 nt, Mycobacterium bovis subsp bovis AF2122/97
acgaugacagacaucgcgacga

SEQ ID NO: 1064871 - RNA, 20 nt, Mycobacterium bovis subsp bovis AF2122/97
acgaucuccgccaaccgggu

SEQ ID NO: 1064872 - RNA, 17 nt, Mycobacterium bovis subsp bovis AF2122/97
acgaucucgccgccagc

SEQ ID NO: 1064873 - RNA, 15 nt, Mycobacterium bovis subsp bovis AF2122/97
acgaucucggcggcc

SEQ ID NO: 1064874 - RNA, 17 nt, Mycobacterium bovis subsp bovis AF2122/97
acgaucucggcggccgc

SEQ ID NO: 1064875 - RNA, 15 nt, Mycobacterium bovis subsp bovis AF2122/97
acgaucgugcgaucg

SEQ ID NO: 1064876 - RNA, 16 nt, Mycobacterium bovis subsp bovis AF2122/97
acgaucgugcgaucga

SEQ ID NO: 1064877 - RNA, 19 nt, Mycobacterium bovis subsp bovis AF2122/97
acgaggcacaaucaccgcc

SEQ ID NO: 1064878 - RNA, 14 nt, Mycobacterium bovis subsp bovis AF2122/97
acgaggcaaugcga

SEQ ID NO: 1064879 - RNA, 21 nt, Mycobacterium bovis subsp bovis AF2122/97
uggacaacguugguccgcugc

SEQ ID NO: 1064880 - RNA, 20 nt, Mycobacterium bovis subsp bovis AF2122/97
uggacagaaucgaccgccgc

SEQ ID NO: 1064881 - RNA, 15 nt, Mycobacterium bovis subsp bovis AF2122/97
uggacacggcgcugc

SEQ ID NO: 1064882 - RNA, 21 nt, Mycobacterium bovis subsp bovis AF2122/97
uggacacguuguucaccgacg

SEQ ID NO: 1064883 - RNA, 22 nt, Mycobacterium bovis subsp bovis AF2122/97
uggacaccagccagaugccggu

SEQ ID NO: 1064884 - RNA, 22 nt, Mycobacterium bovis subsp bovis AF2122/97
uggccaccaaacgcugcuggca

SEQ ID NO: 1064885 - RNA, 17 nt, Mycobacterium bovis subsp bovis AF2122/97
uggccaccaucgccgcc

SEQ ID NO: 1064886 - RNA, 16 nt, Mycobacterium bovis subsp bovis AF2122/97
uggccacccggccgcg

SEQ ID NO: 1064887 - RNA, 18 nt, Mycobacterium bovis subsp bovis AF2122/97
uggccaccgaacgcggcc

SEQ ID NO: 1064888 - RNA, 22 nt, Mycobacterium bovis subsp bovis AF2122/97
uggccaccgaacgcggccaccg

SEQ ID NO: 1064889 - RNA, 24 nt, Mycobacterium bovis subsp bovis AF2122/97
uggccaccgaacgcggccaccgac

SEQ ID NO: 1064890 - RNA, 15 nt, Mycobacterium bovis subsp bovis AF2122/97
uggccaccgccgaaa

SEQ ID NO: 1064891 - RNA, 13 nt, Mycobacterium bovis subsp bovis AF2122/97
uggccaccggcgg

SEQ ID NO: 1064892 - RNA, 17 nt, Mycobacterium bovis subsp bovis AF2122/97
uggccaccggcggucug

SEQ ID NO: 1064893 - RNA, 11 nt, Mycobacterium bovis subsp bovis AF2122/97
uggccaacccc

SEQ ID NO: 1064894 - RNA, 14 nt, Mycobacterium bovis subsp bovis AF2122/97
uggccaaccccaug

SEQ ID NO: 1064895 - RNA, 19 nt, Mycobacterium bovis subsp bovis AF2122/97
uggccaacucuucagcaag

SEQ ID NO: 1064896 - RNA, 18 nt, Mycobacterium bovis subsp bovis AF2122/97
uggccaaccccauggcca

SEQ ID NO: 1064897 - RNA, 15 nt, Mycobacterium bovis subsp bovis AF2122/97
uggccaagcaggcgg

SEQ ID NO: 1064898 - RNA, 17 nt, Mycobacterium bovis subsp bovis AF2122/97
uggccaauccggcggcg

SEQ ID NO: 1064899 - RNA, 14 nt, Mycobacterium bovis subsp bovis AF2122/97
uggccaauccggcg

SEQ ID NO: 1064900 - RNA, 15 nt, Mycobacterium bovis subsp bovis AF2122/97
uggccaggucggcca

SEQ ID NO: 1064901 - RNA, 16 nt, Mycobacterium bovis subsp bovis AF2122/97
uggccaggucggccac

SEQ ID NO: 1064902 - RNA, 20 nt, Mycobacterium bovis subsp bovis AF2122/97
uggccaggucggccaccgug

SEQ ID NO: 1064903 - RNA, 22 nt, Mycobacterium bovis subsp bovis AF2122/97
uggccaggcccgaguuaccggu

SEQ ID NO: 1064904 - RNA, 23 nt, Mycobacterium bovis subsp bovis AF2122/97
uggccaggcuggcgucaccgcgg

SEQ ID NO: 1064905 - RNA, 17 nt, Mycobacterium bovis subsp bovis AF2122/97
uggccaggcuggcguca

SEQ ID NO: 1064906 - RNA, 21 nt, Mycobacterium bovis subsp bovis AF2122/97
uggccagguuguagacggcac

SEQ ID NO: 1064907 - RNA, 22 nt, Mycobacterium bovis subsp bovis AF2122/97
uggccaggcccaagccguggcc

SEQ ID NO: 1064908 - RNA, 12 nt, Mycobacterium bovis subsp bovis AF2122/97
uggccagcgcgg

SEQ ID NO: 1064909 - RNA, 18 nt, Mycobacterium bovis subsp bovis AF2122/97
uggccacgcccaggcaag

SEQ ID NO: 1064910 - RNA, 21 nt, Mycobacterium bovis subsp bovis AF2122/97
uggccaccuugugcaggccca

SEQ ID NO: 1064911 - RNA, 23 nt, Mycobacterium bovis subsp bovis AF2122/97
uggccacgaauccgaucaccucg

SEQ ID NO: 1064912 - RNA, 19 nt, Mycobacterium bovis subsp bovis AF2122/97
uggccacggcuuugcggcg

SEQ ID NO: 1064913 - RNA, 21 nt, Mycobacterium bovis subsp bovis AF2122/97
uggccacggcuuugcggcgcg

SEQ ID NO: 1064914 - RNA, 15 nt, Mycobacterium bovis subsp bovis AF2122/97
uggccacggggcugc

SEQ ID NO: 1064915 - RNA, 17 nt, Mycobacterium bovis subsp bovis AF2122/97
uggccagacccaccacc

SEQ ID NO: 1064916 - RNA, 17 nt, Mycobacterium bovis subsp bovis AF2122/97
uggccagaccgcgcgca

SEQ ID NO: 1064917 - RNA, 21 nt, Mycobacterium bovis subsp bovis AF2122/97
uggccacucccagccaacccg

SEQ ID NO: 1064918 - RNA, 16 nt, Mycobacterium bovis subsp bovis AF2122/97
uggccacuugcucggu

SEQ ID NO: 1064919 - RNA, 18 nt, Mycobacterium bovis subsp bovis AF2122/97
uggccacuugcucgguga

SEQ ID NO: 1064920 - RNA, 13 nt, Mycobacterium bovis subsp bovis AF2122/97
uggccagccgaca

SEQ ID NO: 1064921 - RNA, 14 nt, Mycobacterium bovis subsp bovis AF2122/97
uggccagccgacaa

SEQ ID NO: 1064922 - RNA, 14 nt, Mycobacterium bovis subsp bovis AF2122/97
uggccagcagcgcg

SEQ ID NO: 1064923 - RNA, 15 nt, Mycobacterium bovis subsp bovis AF2122/97
uggccagcagggcca

SEQ ID NO: 1064924 - RNA, 19 nt, Mycobacterium bovis subsp bovis AF2122/97
uggccagcagggccaccac

SEQ ID NO: 1064925 - RNA, 13 nt, Mycobacterium bovis subsp bovis AF2122/97
uggccagcagguu

SEQ ID NO: 1064926 - RNA, 13 nt, Mycobacterium bovis subsp bovis AF2122/97
uggccagcaccac

SEQ ID NO: 1064927 - RNA, 18 nt, Mycobacterium bovis subsp bovis AF2122/97
uggccagcagccgcgaca

SEQ ID NO: 1064928 - RNA, 18 nt, Mycobacterium bovis subsp bovis AF2122/97
uggccagcaccacggcca

SEQ ID NO: 1064929 - RNA, 19 nt, Mycobacterium bovis subsp bovis AF2122/97
uggccagcaacugccgcac

SEQ ID NO: 1064930 - RNA, 18 nt, Mycobacterium bovis subsp bovis AF2122/97
uggccgaguagauggucg

SEQ ID NO: 1064931 - RNA, 22 nt, Mycobacterium bovis subsp bovis AF2122/97
uggccgaguagauggucgacgg

SEQ ID NO: 1064932 - RNA, 15 nt, Mycobacterium bovis subsp bovis AF2122/97
uggccgagccgcggu

SEQ ID NO: 1064933 - RNA, 14 nt, Mycobacterium bovis subsp bovis AF2122/97
uggccgacagcggg

SEQ ID NO: 1064934 - RNA, 21 nt, Mycobacterium bovis subsp bovis AF2122/97
uggccgaugagcccagccgcg

SEQ ID NO: 1064935 - RNA, 22 nt, Mycobacterium bovis subsp bovis AF2122/97
uggccgaugagcccagccgcgg

SEQ ID NO: 1064936 - RNA, 20 nt, Mycobacterium bovis subsp bovis AF2122/97
uggccgauguaguccggcca

SEQ ID NO: 1064937 - RNA, 22 nt, Mycobacterium bovis subsp bovis AF2122/97
uggccgaugugggcggagccga

SEQ ID NO: 1064938 - RNA, 15 nt, Mycobacterium bovis subsp bovis AF2122/97
uggccgauuccgcgc

SEQ ID NO: 1064939 - RNA, 15 nt, Mycobacterium bovis subsp bovis AF2122/97
uggccgcaucgccuc

SEQ ID NO: 1064940 - RNA, 20 nt, Mycobacterium bovis subsp bovis AF2122/97
uggccgcauuggcgaccgcu

SEQ ID NO: 1064941 - RNA, 20 nt, Mycobacterium bovis subsp bovis AF2122/97
uggccgccacaccgccgcca

SEQ ID NO: 1064942 - RNA, 12 nt, Mycobacterium bovis subsp bovis AF2122/97
uggccgccaccg

SEQ ID NO: 1064943 - RNA, 15 nt, Mycobacterium bovis subsp bovis AF2122/97
uggccgccaccgcac

SEQ ID NO: 1064944 - RNA, 19 nt, Mycobacterium bovis subsp bovis AF2122/97
uggccgccaccgcgacgag

SEQ ID NO: 1064945 - RNA, 17 nt, Mycobacterium bovis subsp bovis AF2122/97
uggccgcccgcugcggc

SEQ ID NO: 1064946 - RNA, 19 nt, Mycobacterium bovis subsp bovis AF2122/97
uggccgcccuggccgccca

SEQ ID NO: 1064947 - RNA, 13 nt, Mycobacterium bovis subsp bovis AF2122/97
uggccgccgacaa

SEQ ID NO: 1064948 - RNA, 16 nt, Mycobacterium bovis subsp bovis AF2122/97
uggccgcccagaccgc

SEQ ID NO: 1064949 - RNA, 15 nt, Mycobacterium bovis subsp bovis AF2122/97
uggccgccggccgcg

SEQ ID NO: 1064950 - RNA, 15 nt, Mycobacterium bovis subsp bovis AF2122/97
uggccgccggcgccg

SEQ ID NO: 1064951 - RNA, 16 nt, Mycobacterium bovis subsp bovis AF2122/97
uggccgccggcgccgc

SEQ ID NO: 1064952 - RNA, 17 nt, Mycobacterium bovis subsp bovis AF2122/97
uggccgccggcgccgcc

SEQ ID NO: 1064953 - RNA, 18 nt, Mycobacterium bovis subsp bovis AF2122/97
uggccgccggcgcuggcg

SEQ ID NO: 1064954 - RNA, 21 nt, Mycobacterium bovis subsp bovis AF2122/97
uggccgccgccccggcgcugg

SEQ ID NO: 1064955 - RNA, 12 nt, Mycobacterium bovis subsp bovis AF2122/97
uggccgccgccg

SEQ ID NO: 1064956 - RNA, 24 nt, Mycobacterium bovis subsp bovis AF2122/97
uggccgccgcgaggaugcugagcg

SEQ ID NO: 1064957 - RNA, 15 nt, Mycobacterium bovis subsp bovis AF2122/97
uggccgccgcgcacc

SEQ ID NO: 1064958 - RNA, 19 nt, Mycobacterium bovis subsp bovis AF2122/97
uggccgccgcgcaccgcgg

SEQ ID NO: 1064959 - RNA, 19 nt, Mycobacterium bovis subsp bovis AF2122/97
uggccgcgaucccggccgu

SEQ ID NO: 1064960 - RNA, 22 nt, Mycobacterium bovis subsp bovis AF2122/97
uggccgccuccgcggcauuggc

SEQ ID NO: 1064961 - RNA, 23 nt, Mycobacterium bovis subsp bovis AF2122/97
uggccgcgucgcgaaaggccacg

SEQ ID NO: 1064962 - RNA, 19 nt, Mycobacterium bovis subsp bovis AF2122/97
uggccgcgccucggucugc

SEQ ID NO: 1064963 - RNA, 13 nt, Mycobacterium bovis subsp bovis AF2122/97
uggccgcgccggg

SEQ ID NO: 1064964 - RNA, 16 nt, Mycobacterium bovis subsp bovis AF2122/97
uggccgcgccggggag

SEQ ID NO: 1064965 - RNA, 22 nt, Mycobacterium bovis subsp bovis AF2122/97
uggccccgggcggugaggcagc

SEQ ID NO: 1064966 - RNA, 14 nt, Mycobacterium bovis subsp bovis AF2122/97
uggcccgacgcagc

SEQ ID NO: 1064967 - RNA, 19 nt, Mycobacterium bovis subsp bovis AF2122/97
uggccccgccagcggcagc

SEQ ID NO: 1064968 - RNA, 19 nt, Mycobacterium bovis subsp bovis AF2122/97
uggcccgauaaaugccgcg

SEQ ID NO: 1064969 - RNA, 16 nt, Mycobacterium bovis subsp bovis AF2122/97
uggcccgcacgaaccg

SEQ ID NO: 1064970 - RNA, 19 nt, Mycobacterium bovis subsp bovis AF2122/97
uggcccgcacgaaccgguc

SEQ ID NO: 1064971 - RNA, 20 nt, Mycobacterium bovis subsp bovis AF2122/97
uggccccaagcgugcugccg

SEQ ID NO: 1064972 - RNA, 17 nt, Mycobacterium bovis subsp bovis AF2122/97
uggcccccacaccacgc

SEQ ID NO: 1064973 - RNA, 17 nt, Mycobacterium bovis subsp bovis AF2122/97
uggcccccagguaaccc

SEQ ID NO: 1064974 - RNA, 13 nt, Mycobacterium bovis subsp bovis AF2122/97
uggcccccgccgg

SEQ ID NO: 1064975 - RNA, 17 nt, Mycobacterium bovis subsp bovis AF2122/97
uggcccccgccggccac

SEQ ID NO: 1064976 - RNA, 18 nt, Mycobacterium bovis subsp bovis AF2122/97
uggcccccgccggccacg

SEQ ID NO: 1064977 - RNA, 23 nt, Mycobacterium bovis subsp bovis AF2122/97
uggcccaccgccguugggccgcg

SEQ ID NO: 1064978 - RNA, 15 nt, Mycobacterium bovis subsp bovis AF2122/97
uggcccagcgugucu

SEQ ID NO: 1064979 - RNA, 18 nt, Mycobacterium bovis subsp bovis AF2122/97
uggcccaauugcgccgag

SEQ ID NO: 1064980 - RNA, 14 nt, Mycobacterium bovis subsp bovis AF2122/97
uggccaucgcgcgg

SEQ ID NO: 1064981 - RNA, 17 nt, Mycobacterium bovis subsp bovis AF2122/97
uggccaucgcgcggacc

SEQ ID NO: 1064982 - RNA, 13 nt, Mycobacterium bovis subsp bovis AF2122/97
uggcccguuggca

SEQ ID NO: 1064983 - RNA, 22 nt, Mycobacterium bovis subsp bovis AF2122/97
uggcccgucacgcccgcgaacc

SEQ ID NO: 1064984 - RNA, 23 nt, Mycobacterium bovis subsp bovis AF2122/97
uggcccugauguugaucguugug

SEQ ID NO: 1064985 - RNA, 17 nt, Mycobacterium bovis subsp bovis AF2122/97
uggcccuggcgaccagc

SEQ ID NO: 1064986 - RNA, 23 nt, Mycobacterium bovis subsp bovis AF2122/97
uggccgaacgggucggcgaccac

SEQ ID NO: 1064987 - RNA, 21 nt, Mycobacterium bovis subsp bovis AF2122/97
uggccgaacuaccgacgcacc

SEQ ID NO: 1064988 - RNA, 21 nt, Mycobacterium bovis subsp bovis AF2122/97
uggccgaaccguucggcgaca

SEQ ID NO: 1064989 - RNA, 15 nt, Mycobacterium bovis subsp bovis AF2122/97
uggccgacagccacc

SEQ ID NO: 1064990 - RNA, 16 nt, Mycobacterium bovis subsp bovis AF2122/97
uggccgacagccaccg

SEQ ID NO: 1064991 - RNA, 17 nt, Mycobacterium bovis subsp bovis AF2122/97
uggccgacagccaccgc

SEQ ID NO: 1064992 - RNA, 23 nt, Mycobacterium bovis subsp bovis AF2122/97
uggcccgggucuccggcgcaccu

SEQ ID NO: 1064993 - RNA, 22 nt, Mycobacterium bovis subsp bovis AF2122/97
uggcccgucgugaccgaccgcc

SEQ ID NO: 1064994 - RNA, 15 nt, Mycobacterium bovis subsp bovis AF2122/97
uggcccgugcgguug

SEQ ID NO: 1064995 - RNA, 18 nt, Mycobacterium bovis subsp bovis AF2122/97
uggcccgcucccugcacc

SEQ ID NO: 1064996 - RNA, 13 nt, Mycobacterium bovis subsp bovis AF2122/97
uggcccgccugac

SEQ ID NO: 1064997 - RNA, 20 nt, Mycobacterium bovis subsp bovis AF2122/97
uggcgucgccggcaccggcc

SEQ ID NO: 1064998 - RNA, 14 nt, Mycobacterium bovis subsp bovis AF2122/97
uggcgucgcgguug

SEQ ID NO: 1064999 - RNA, 16 nt, Mycobacterium bovis subsp bovis AF2122/97
uggcgucgcucgucgu

SEQ ID NO: 1065000 - RNA, 16 nt, Mycobacterium bovis subsp bovis AF2122/97
uggcgucgaugccggc

SEQ ID NO: 1065001 - RNA, 23 nt, Mycobacterium bovis subsp bovis AF2122/97
uggcgucgaugccggcugccgca

SEQ ID NO: 1065002 - RNA, 17 nt, Mycobacterium bovis subsp bovis AF2122/97
uggcgucgaugcgggcc

SEQ ID NO: 1065003 - RNA, 14 nt, Mycobacterium bovis subsp bovis AF2122/97
uggcgucgaucucg

SEQ ID NO: 1065004 - RNA, 19 nt, Mycobacterium bovis subsp bovis AF2122/97
uggcggucuugccgcaggc

SEQ ID NO: 1065005 - RNA, 16 nt, Mycobacterium bovis subsp bovis AF2122/97
uggcggugcgcaccac

SEQ ID NO: 1065006 - RNA, 17 nt, Mycobacterium bovis subsp bovis AF2122/97
uggcgucaccgccggug

SEQ ID NO: 1065007 - RNA, 23 nt, Mycobacterium bovis subsp bovis AF2122/97
uggcgucaccgccggugcugacg

SEQ ID NO: 1065008 - RNA, 18 nt, Mycobacterium bovis subsp bovis AF2122/97
uggcgucaccgcgggugg

SEQ ID NO: 1065009 - RNA, 19 nt, Mycobacterium bovis subsp bovis AF2122/97
uggcgggugcgacaucggu

SEQ ID NO: 1065010 - RNA, 15 nt, Mycobacterium bovis subsp bovis AF2122/97
uggcggucgccacac

SEQ ID NO: 1065011 - RNA, 15 nt, Mycobacterium bovis subsp bovis AF2122/97
uggcggucgguuccg

SEQ ID NO: 1065012 - RNA, 15 nt, Mycobacterium bovis subsp bovis AF2122/97
uggcggucaccacgc

SEQ ID NO: 1065013 - RNA, 22 nt, Mycobacterium bovis subsp bovis AF2122/97
uggcggucaccacgcggcgguc

SEQ ID NO: 1065014 - RNA, 12 nt, Mycobacterium bovis subsp bovis AF2122/97
uggcgggcugaa

SEQ ID NO: 1065015 - RNA, 21 nt, Mycobacterium bovis subsp bovis AF2122/97
uggcggguaagcgaccgacgc

SEQ ID NO: 1065016 - RNA, 22 nt, Mycobacterium bovis subsp bovis AF2122/97
uggcgguaaaccacucgcggau

SEQ ID NO: 1065017 - RNA, 23 nt, Mycobacterium bovis subsp bovis AF2122/97
uggcgguaaaccacucgcggauc

SEQ ID NO: 1065018 - RNA, 13 nt, Mycobacterium bovis subsp bovis AF2122/97
uggcgggcggcgu

SEQ ID NO: 1065019 - RNA, 16 nt, Mycobacterium bovis subsp bovis AF2122/97
uggcgggcugcagccg

SEQ ID NO: 1065020 - RNA, 19 nt, Mycobacterium bovis subsp bovis AF2122/97
uggcgggcugcagccgaca

SEQ ID NO: 1065021 - RNA, 14 nt, Mycobacterium bovis subsp bovis AF2122/97
uggcgggcgaucgc

SEQ ID NO: 1065022 - RNA, 18 nt, Mycobacterium bovis subsp bovis AF2122/97
uggcgggagaucgucgcc

SEQ ID NO: 1065023 - RNA, 16 nt, Mycobacterium bovis subsp bovis AF2122/97
uggcggcucacgaccg

SEQ ID NO: 1065024 - RNA, 14 nt, Mycobacterium bovis subsp bovis AF2122/97
uggcggcuccgccc

SEQ ID NO: 1065025 - RNA, 14 nt, Mycobacterium bovis subsp bovis AF2122/97
uggcggcucguugc

SEQ ID NO: 1065026 - RNA, 15 nt, Mycobacterium bovis subsp bovis AF2122/97
uggcggcugcagccg

SEQ ID NO: 1065027 - RNA, 17 nt, Mycobacterium bovis subsp bovis AF2122/97
uggcggcugcagccgac

SEQ ID NO: 1065028 - RNA, 16 nt, Mycobacterium bovis subsp bovis AF2122/97
uggcggcuucgacguc

SEQ ID NO: 1065029 - RNA, 18 nt, Mycobacterium bovis subsp bovis AF2122/97
uggcggcuucgacgucgg

SEQ ID NO: 1065030 - RNA, 19 nt, Mycobacterium bovis subsp bovis AF2122/97
uggcgggagcaccgaccag

SEQ ID NO: 1065031 - RNA, 17 nt, Mycobacterium bovis subsp bovis AF2122/97
uggcgcugggauguucg

SEQ ID NO: 1065032 - RNA, 11 nt, Mycobacterium bovis subsp bovis AF2122/97
uggcgcugggg

SEQ ID NO: 1065033 - RNA, 19 nt, Mycobacterium bovis subsp bovis AF2122/97
uggcggcgacacgccaggu

SEQ ID NO: 1065034 - RNA, 17 nt, Mycobacterium bovis subsp bovis AF2122/97
uggcggcgacacgccag

SEQ ID NO: 1065035 - RNA, 19 nt, Mycobacterium bovis subsp bovis AF2122/97
uggcggccuccuccccgac

SEQ ID NO: 1065036 - RNA, 23 nt, Mycobacterium bovis subsp bovis AF2122/97
uggcggccucgggcucaaacgga

SEQ ID NO: 1065037 - RNA, 14 nt, Mycobacterium bovis subsp bovis AF2122/97
uggcggcgagcagc

SEQ ID NO: 1065038 - RNA, 20 nt, Mycobacterium bovis subsp bovis AF2122/97
uggcggcgaugguaucgccg

SEQ ID NO: 1065039 - RNA, 22 nt, Mycobacterium bovis subsp bovis AF2122/97
uggcggcgccgcagaucaccgc

SEQ ID NO: 1065040 - RNA, 20 nt, Mycobacterium bovis subsp bovis AF2122/97
uggcggcgccggugguaccg

SEQ ID NO: 1065041 - RNA, 14 nt, Mycobacterium bovis subsp bovis AF2122/97
uggcggcggcggca

SEQ ID NO: 1065042 - RNA, 21 nt, Mycobacterium bovis subsp bovis AF2122/97
uggcggcgcguucgucgucgc

SEQ ID NO: 1065043 - RNA, 20 nt, Mycobacterium bovis subsp bovis AF2122/97
uggcggcgcgcgcugcgcag

SEQ ID NO: 1065044 - RNA, 21 nt, Mycobacterium bovis subsp bovis AF2122/97
uggcggcgggccucggcgacc

SEQ ID NO: 1065045 - RNA, 15 nt, Mycobacterium bovis subsp bovis AF2122/97
uggcggcggugcagc

SEQ ID NO: 1065046 - RNA, 14 nt, Mycobacterium bovis subsp bovis AF2122/97
uggcgcugcuggca

SEQ ID NO: 1065047 - RNA, 14 nt, Mycobacterium bovis subsp bovis AF2122/97
uggcgcucggcgag

SEQ ID NO: 1065048 - RNA, 19 nt, Mycobacterium bovis subsp bovis AF2122/97
uggcgcugagggugcucuc

SEQ ID NO: 1065049 - RNA, 13 nt, Mycobacterium bovis subsp bovis AF2122/97
uggcgcugaucgg

SEQ ID NO: 1065050 - RNA, 15 nt, Mycobacterium bovis subsp bovis AF2122/97
uggcgcugaucggca

SEQ ID NO: 1065051 - RNA, 16 nt, Mycobacterium bovis subsp bovis AF2122/97
uggcgcugaucggcag

SEQ ID NO: 1065052 - RNA, 12 nt, Mycobacterium bovis subsp bovis AF2122/97
uggcgcugaugc

SEQ ID NO: 1065053 - RNA, 15 nt, Mycobacterium bovis subsp bovis AF2122/97
uggcgcugaugcugg

SEQ ID NO: 1065054 - RNA, 18 nt, Mycobacterium bovis subsp bovis AF2122/97
uggcgcugauggugcugc

SEQ ID NO: 1065055 - RNA, 18 nt, Mycobacterium bovis subsp bovis AF2122/97
uggcgcggucggagucga

SEQ ID NO: 1065056 - RNA, 22 nt, Mycobacterium bovis subsp bovis AF2122/97
uggcgcggucggagucgagcac

SEQ ID NO: 1065057 - RNA, 23 nt, Mycobacterium bovis subsp bovis AF2122/97
uggcgcguggucgggaacccggu

SEQ ID NO: 1065058 - RNA, 16 nt, Mycobacterium bovis subsp bovis AF2122/97
uggcgaaggccgcaau

SEQ ID NO: 1065059 - RNA, 14 nt, Mycobacterium bovis subsp bovis AF2122/97
uggccgucgccgaa

SEQ ID NO: 1065060 - RNA, 18 nt, Mycobacterium bovis subsp bovis AF2122/97
uggcgaagucgucgaggu

SEQ ID NO: 1065061 - RNA, 22 nt, Mycobacterium bovis subsp bovis AF2122/97
uggcgagggcuaccggcgccgc

SEQ ID NO: 1065062 - RNA, 12 nt, Mycobacterium bovis subsp bovis AF2122/97
uggcgaggcagc

SEQ ID NO: 1065063 - RNA, 13 nt, Mycobacterium bovis subsp bovis AF2122/97
uggcgaccaccgc

SEQ ID NO: 1065064 - RNA, 21 nt, Mycobacterium bovis subsp bovis AF2122/97
uggcgaucagcagccgccgau

SEQ ID NO: 1065065 - RNA, 23 nt, Mycobacterium bovis subsp bovis AF2122/97
uggccgggcacgcgaggcgcuca

SEQ ID NO: 1065066 - RNA, 21 nt, Mycobacterium bovis subsp bovis AF2122/97
uggccggcuugucgaccacga

SEQ ID NO: 1065067 - RNA, 17 nt, Mycobacterium bovis subsp bovis AF2122/97
uggccgggaacacguga

SEQ ID NO: 1065068 - RNA, 23 nt, Mycobacterium bovis subsp bovis AF2122/97
uggccgcucuccaccccgucugc

SEQ ID NO: 1065069 - RNA, 14 nt, Mycobacterium bovis subsp bovis AF2122/97
uggccgggucgucu

SEQ ID NO: 1065070 - RNA, 16 nt, Mycobacterium bovis subsp bovis AF2122/97
uggccggguccagccc

SEQ ID NO: 1065071 - RNA, 16 nt, Mycobacterium bovis subsp bovis AF2122/97
uggccggugggccgcc

SEQ ID NO: 1065072 - RNA, 17 nt, Mycobacterium bovis subsp bovis AF2122/97
uggccggucacguccgc

SEQ ID NO: 1065073 - RNA, 15 nt, Mycobacterium bovis subsp bovis AF2122/97
uggccgucgcuggug

SEQ ID NO: 1065074 - RNA, 22 nt, Mycobacterium bovis subsp bovis AF2122/97
uggcgaaccucaccugacacgc

SEQ ID NO: 1065075 - RNA, 23 nt, Mycobacterium bovis subsp bovis AF2122/97
uggcgaaccucaccugacacgcc

SEQ ID NO: 1065076 - RNA, 14 nt, Mycobacterium bovis subsp bovis AF2122/97
uggccguccgaccg

SEQ ID NO: 1065077 - RNA, 15 nt, Mycobacterium bovis subsp bovis AF2122/97
uggccguccgaccga

SEQ ID NO: 1065078 - RNA, 18 nt, Mycobacterium bovis subsp bovis AF2122/97
uggccguaccggugaucg

SEQ ID NO: 1065079 - RNA, 15 nt, Mycobacterium bovis subsp bovis AF2122/97
uggccguaggcggcg

SEQ ID NO: 1065080 - RNA, 19 nt, Mycobacterium bovis subsp bovis AF2122/97
uggccguagucggcgaugc

SEQ ID NO: 1065081 - RNA, 20 nt, Mycobacterium bovis subsp bovis AF2122/97
uggcgccggucgccggcugg

SEQ ID NO: 1065082 - RNA, 14 nt, Mycobacterium bovis subsp bovis AF2122/97
uggcgccggggacc

SEQ ID NO: 1065083 - RNA, 20 nt, Mycobacterium bovis subsp bovis AF2122/97
uggcgccggggcgcagguug

SEQ ID NO: 1065084 - RNA, 12 nt, Mycobacterium bovis subsp bovis AF2122/97
uggcgccgucgg

SEQ ID NO: 1065085 - RNA, 17 nt, Mycobacterium bovis subsp bovis AF2122/97
uggcgccgucggccgag

SEQ ID NO: 1065086 - RNA, 20 nt, Mycobacterium bovis subsp bovis AF2122/97
uggcgccguugccggcguug

SEQ ID NO: 1065087 - RNA, 18 nt, Mycobacterium bovis subsp bovis AF2122/97
uggcgcgaccgaugaucg

SEQ ID NO: 1065088 - RNA, 13 nt, Mycobacterium bovis subsp bovis AF2122/97
uggcgcggcgagc

SEQ ID NO: 1065089 - RNA, 17 nt, Mycobacterium bovis subsp bovis AF2122/97
uggcgcggcgagcacgc

SEQ ID NO: 1065090 - RNA, 13 nt, Mycobacterium bovis subsp bovis AF2122/97
uggcgcggggccg

SEQ ID NO: 1065091 - RNA, 22 nt, Mycobacterium bovis subsp bovis AF2122/97
uggcgcggguccagccaccgac

SEQ ID NO: 1065092 - RNA, 12 nt, Mycobacterium bovis subsp bovis AF2122/97
uggcgcgggccg

SEQ ID NO: 1065093 - RNA, 21 nt, Mycobacterium bovis subsp bovis AF2122/97
uggcgcgggccggcgacuguc

SEQ ID NO: 1065094 - RNA, 16 nt, Mycobacterium bovis subsp bovis AF2122/97
uggcgcaccggcgucg

SEQ ID NO: 1065095 - RNA, 21 nt, Mycobacterium bovis subsp bovis AF2122/97
uggcgcaccggcgucggcgcg

SEQ ID NO: 1065096 - RNA, 20 nt, Mycobacterium bovis subsp bovis AF2122/97
uggcgcaccaccuccccgau

SEQ ID NO: 1065097 - RNA, 15 nt, Mycobacterium bovis subsp bovis AF2122/97
uggcgaugacgaucg

SEQ ID NO: 1065098 - RNA, 21 nt, Mycobacterium bovis subsp bovis AF2122/97
uggcgaugaggaacguuucgc

SEQ ID NO: 1065099 - RNA, 14 nt, Mycobacterium bovis subsp bovis AF2122/97
uggcgaugaggugg

SEQ ID NO: 1065100 - RNA, 20 nt, Mycobacterium bovis subsp bovis AF2122/97
uggcgaugagguggccgcgc

SEQ ID NO: 1065101 - RNA, 17 nt, Mycobacterium bovis subsp bovis AF2122/97
uggcgauggcaggggcg

SEQ ID NO: 1065102 - RNA, 14 nt, Mycobacterium bovis subsp bovis AF2122/97
uggcgaucaaccgc

SEQ ID NO: 1065103 - RNA, 16 nt, Mycobacterium bovis subsp bovis AF2122/97
uggcgaucucaccugg

SEQ ID NO: 1065104 - RNA, 17 nt, Mycobacterium bovis subsp bovis AF2122/97
uggcgaucuccagcggu

SEQ ID NO: 1065105 - RNA, 20 nt, Mycobacterium bovis subsp bovis AF2122/97
ugguccagcacaucggcgag

SEQ ID NO: 1065106 - RNA, 13 nt, Mycobacterium bovis subsp bovis AF2122/97
ugguccagccggu

SEQ ID NO: 1065107 - RNA, 18 nt, Mycobacterium bovis subsp bovis AF2122/97
ugguccagccggugacgu

SEQ ID NO: 1065108 - RNA, 22 nt, Mycobacterium bovis subsp bovis AF2122/97
ugguccagccggugacguggug

SEQ ID NO: 1065109 - RNA, 13 nt, Mycobacterium bovis subsp bovis AF2122/97
ugguccagcgcug

SEQ ID NO: 1065110 - RNA, 15 nt, Mycobacterium bovis subsp bovis AF2122/97
ugguccaaccagcac

SEQ ID NO: 1065111 - RNA, 13 nt, Mycobacterium bovis subsp bovis AF2122/97
ugguccaaccggg

SEQ ID NO: 1065112 - RNA, 13 nt, Mycobacterium bovis subsp bovis AF2122/97
uggucauggccga

SEQ ID NO: 1065113 - RNA, 23 nt, Mycobacterium bovis subsp bovis AF2122/97
uggucauguucggggcgcaccac

SEQ ID NO: 1065114 - RNA, 15 nt, Mycobacterium bovis subsp bovis AF2122/97
ugguccaaccgggcc

SEQ ID NO: 1065115 - RNA, 19 nt, Mycobacterium bovis subsp bovis AF2122/97
ugguccaaccgggccggcu

SEQ ID NO: 1065116 - RNA, 14 nt, Mycobacterium bovis subsp bovis AF2122/97
ugguccacagccgg

SEQ ID NO: 1065117 - RNA, 15 nt, Mycobacterium bovis subsp bovis AF2122/97
uggucaaccgcgccc

SEQ ID NO: 1065118 - RNA, 14 nt, Mycobacterium bovis subsp bovis AF2122/97
uggucaaccgcguc

SEQ ID NO: 1065119 - RNA, 17 nt, Mycobacterium bovis subsp bovis AF2122/97
uggucaagacccgcauc

SEQ ID NO: 1065120 - RNA, 18 nt, Mycobacterium bovis subsp bovis AF2122/97
uggucaaugccggccgcg

SEQ ID NO: 1065121 - RNA, 21 nt, Mycobacterium bovis subsp bovis AF2122/97
uggucaaugcgcuggcgccgc

SEQ ID NO: 1065122 - RNA, 17 nt, Mycobacterium bovis subsp bovis AF2122/97
uggucacacccagcgcg

SEQ ID NO: 1065123 - RNA, 14 nt, Mycobacterium bovis subsp bovis AF2122/97
uggucaccaccugg

SEQ ID NO: 1065124 - RNA, 16 nt, Mycobacterium bovis subsp bovis AF2122/97
uggucaccaccuggug

SEQ ID NO: 1065125 - RNA, 21 nt, Mycobacterium bovis subsp bovis AF2122/97
uggucacccacguugaugaug

SEQ ID NO: 1065126 - RNA, 22 nt, Mycobacterium bovis subsp bovis AF2122/97
ugguagucgcgaccgcgggccg

SEQ ID NO: 1065127 - RNA, 17 nt, Mycobacterium bovis subsp bovis AF2122/97
uggucucgacggcgccg

SEQ ID NO: 1065128 - RNA, 14 nt, Mycobacterium bovis subsp bovis AF2122/97
uggucugcgcggug

SEQ ID NO: 1065129 - RNA, 16 nt, Mycobacterium bovis subsp bovis AF2122/97
uggucccgauggcgau

SEQ ID NO: 1065130 - RNA, 17 nt, Mycobacterium bovis subsp bovis AF2122/97
ugguccgaccagcggcc

SEQ ID NO: 1065131 - RNA, 15 nt, Mycobacterium bovis subsp bovis AF2122/97
uggucccacaccucc

SEQ ID NO: 1065132 - RNA, 15 nt, Mycobacterium bovis subsp bovis AF2122/97
ugguccggccgcgga

SEQ ID NO: 1065133 - RNA, 19 nt, Mycobacterium bovis subsp bovis AF2122/97
uggucuccaccaggugcgc

SEQ ID NO: 1065134 - RNA, 18 nt, Mycobacterium bovis subsp bovis AF2122/97
ugguccgccgucgaccac

SEQ ID NO: 1065135 - RNA, 15 nt, Mycobacterium bovis subsp bovis AF2122/97
uggugacagauccgc

SEQ ID NO: 1065136 - RNA, 21 nt, Mycobacterium bovis subsp bovis AF2122/97
uggugaaggcaaacaccagcc

SEQ ID NO: 1065137 - RNA, 19 nt, Mycobacterium bovis subsp bovis AF2122/97
uggugacaccgaggucggc

SEQ ID NO: 1065138 - RNA, 14 nt, Mycobacterium bovis subsp bovis AF2122/97
uggugacagagcgg

SEQ ID NO: 1065139 - RNA, 23 nt, Mycobacterium bovis subsp bovis AF2122/97
uggugacagagcggguucgacgu

SEQ ID NO: 1065140 - RNA, 18 nt, Mycobacterium bovis subsp bovis AF2122/97
uggugaagccguagacgu

SEQ ID NO: 1065141 - RNA, 19 nt, Mycobacterium bovis subsp bovis AF2122/97
uggucuucggaacgccaua

SEQ ID NO: 1065142 - RNA, 16 nt, Mycobacterium bovis subsp bovis AF2122/97
ugguggacgaccgcgc

SEQ ID NO: 1065143 - RNA, 20 nt, Mycobacterium bovis subsp bovis AF2122/97
ugguggacgcagagucaacg

SEQ ID NO: 1065144 - RNA, 16 nt, Mycobacterium bovis subsp bovis AF2122/97
ugguggagcggcgcgg

SEQ ID NO: 1065145 - RNA, 16 nt, Mycobacterium bovis subsp bovis AF2122/97
ugguggaugagccggu

SEQ ID NO: 1065146 - RNA, 20 nt, Mycobacterium bovis subsp bovis AF2122/97
ugguggaugugugaguccca

SEQ ID NO: 1065147 - RNA, 22 nt, Mycobacterium bovis subsp bovis AF2122/97
ugguggcaacggguccgacggu

SEQ ID NO: 1065148 - RNA, 15 nt, Mycobacterium bovis subsp bovis AF2122/97
ugguggcccgggcca

SEQ ID NO: 1065149 - RNA, 20 nt, Mycobacterium bovis subsp bovis AF2122/97
ugguggcccgggccaccgga

SEQ ID NO: 1065150 - RNA, 22 nt, Mycobacterium bovis subsp bovis AF2122/97
ugguggccgaacgggucggcga

SEQ ID NO: 1065151 - RNA, 17 nt, Mycobacterium bovis subsp bovis AF2122/97
ugguggccggggugccg

SEQ ID NO: 1065152 - RNA, 13 nt, Mycobacterium bovis subsp bovis AF2122/97
ugguggccgccac

SEQ ID NO: 1065153 - RNA, 19 nt, Mycobacterium bovis subsp bovis AF2122/97
ugguggccggggugccggc

SEQ ID NO: 1065154 - RNA, 15 nt, Mycobacterium bovis subsp bovis AF2122/97
ugguggcgaccccgc

SEQ ID NO: 1065155 - RNA, 18 nt, Mycobacterium bovis subsp bovis AF2122/97
ugguggcgccauccccgc

SEQ ID NO: 1065156 - RNA, 23 nt, Mycobacterium bovis subsp bovis AF2122/97
ugguggcgccauccccgccggcg

SEQ ID NO: 1065157 - RNA, 13 nt, Mycobacterium bovis subsp bovis AF2122/97
ugguggcgccggc

SEQ ID NO: 1065158 - RNA, 14 nt, Mycobacterium bovis subsp bovis AF2122/97
uggugggccggacc

SEQ ID NO: 1065159 - RNA, 16 nt, Mycobacterium bovis subsp bovis AF2122/97
ugguggcgguuccggc

SEQ ID NO: 1065160 - RNA, 17 nt, Mycobacterium bovis subsp bovis AF2122/97
uggugggaucgcagcgc

SEQ ID NO: 1065161 - RNA, 19 nt, Mycobacterium bovis subsp bovis AF2122/97
uggugggaucgcagcgcca

SEQ ID NO: 1065162 - RNA, 14 nt, Mycobacterium bovis subsp bovis AF2122/97
ugguggcgggguug

SEQ ID NO: 1065163 - RNA, 23 nt, Mycobacterium bovis subsp bovis AF2122/97
uggugggaggggacccagcggcg

SEQ ID NO: 1065164 - RNA, 15 nt, Mycobacterium bovis subsp bovis AF2122/97
uggugggaucgcagc

SEQ ID NO: 1065165 - RNA, 22 nt, Mycobacterium bovis subsp bovis AF2122/97
uggugccaacugcgccguucgc

SEQ ID NO: 1065166 - RNA, 13 nt, Mycobacterium bovis subsp bovis AF2122/97
uggugccagccgg

SEQ ID NO: 1065167 - RNA, 20 nt, Mycobacterium bovis subsp bovis AF2122/97
uggugccgcggccaccgccg

SEQ ID NO: 1065168 - RNA, 10 nt, Mycobacterium bovis subsp bovis AF2122/97
uggugccggc

SEQ ID NO: 1065169 - RNA, 12 nt, Mycobacterium bovis subsp bovis AF2122/97
uggugccggcgg

SEQ ID NO: 1065170 - RNA, 23 nt, Mycobacterium bovis subsp bovis AF2122/97
uggugccggucaccucgccggcg

SEQ ID NO: 1065171 - RNA, 21 nt, Mycobacterium bovis subsp bovis AF2122/97
uggugccguccggcgcuggcg

SEQ ID NO: 1065172 - RNA, 23 nt, Mycobacterium bovis subsp bovis AF2122/97
uggugcagaauucggcgcgacag

SEQ ID NO: 1065173 - RNA, 13 nt, Mycobacterium bovis subsp bovis AF2122/97
uggugcagaccac

SEQ ID NO: 1065174 - RNA, 23 nt, Mycobacterium bovis subsp bovis AF2122/97
uggugcacggcuuuucgacgcug

SEQ ID NO: 1065175 - RNA, 17 nt, Mycobacterium bovis subsp bovis AF2122/97
uggugcucgucgguguc

SEQ ID NO: 1065176 - RNA, 15 nt, Mycobacterium bovis subsp bovis AF2122/97
uggugcugaccgcgc

SEQ ID NO: 1065177 - RNA, 17 nt, Mycobacterium bovis subsp bovis AF2122/97
uggugcugaccgcgccg

SEQ ID NO: 1065178 - RNA, 23 nt, Mycobacterium bovis subsp bovis AF2122/97
uggugcgggugggcacaccggug

SEQ ID NO: 1065179 - RNA, 13 nt, Mycobacterium bovis subsp bovis AF2122/97
uggugcgggguug

SEQ ID NO: 1065180 - RNA, 21 nt, Mycobacterium bovis subsp bovis AF2122/97
uggugccgacccgccgcgccc

SEQ ID NO: 1065181 - RNA, 15 nt, Mycobacterium bovis subsp bovis AF2122/97
uguagggccggugac

SEQ ID NO: 1065182 - RNA, 14 nt, Mycobacterium bovis subsp bovis AF2122/97
uguaggucagcgcg

SEQ ID NO: 1065183 - RNA, 13 nt, Mycobacterium bovis subsp bovis AF2122/97
aaucaccggcaau

SEQ ID NO: 1065184 - RNA, 23 nt, Mycobacterium bovis subsp bovis AF2122/97
aaucacccgcgagaucgggccgg

SEQ ID NO: 1065185 - RNA, 14 nt, Mycobacterium bovis subsp bovis AF2122/97
aaucaccgccggcg

SEQ ID NO: 1065186 - RNA, 13 nt, Mycobacterium bovis subsp bovis AF2122/97
uguagacggcacc

SEQ ID NO: 1065187 - RNA, 13 nt, Mycobacterium bovis subsp bovis AF2122/97
uguagacggcggc

SEQ ID NO: 1065188 - RNA, 16 nt, Mycobacterium bovis subsp bovis AF2122/97
uguacugcggugccac

SEQ ID NO: 1065189 - RNA, 17 nt, Mycobacterium bovis subsp bovis AF2122/97
uguagcgcaucgccaau

SEQ ID NO: 1065190 - RNA, 14 nt, Mycobacterium bovis subsp bovis AF2122/97
uguagcgcugcggg

SEQ ID NO: 1065191 - RNA, 14 nt, Mycobacterium bovis subsp bovis AF2122/97
uggugggcguggcu

SEQ ID NO: 1065192 - RNA, 16 nt, Mycobacterium bovis subsp bovis AF2122/97
uggugggcagauacga

SEQ ID NO: 1065193 - RNA, 15 nt, Mycobacterium bovis subsp bovis AF2122/97
uggugggucgacgau

SEQ ID NO: 1065194 - RNA, 17 nt, Mycobacterium bovis subsp bovis AF2122/97
uggugggucggggcggc

SEQ ID NO: 1065195 - RNA, 18 nt, Mycobacterium bovis subsp bovis AF2122/97
uggugggucggggcggca

SEQ ID NO: 1065196 - RNA, 14 nt, Mycobacterium bovis subsp bovis AF2122/97
ugguuggaucgcca

SEQ ID NO: 1065197 - RNA, 19 nt, Mycobacterium bovis subsp bovis AF2122/97
ugguugggcgagaccgcga

SEQ ID NO: 1065198 - RNA, 23 nt, Mycobacterium bovis subsp bovis AF2122/97
ugguugaucagccagaccaacau

SEQ ID NO: 1065199 - RNA, 19 nt, Mycobacterium bovis subsp bovis AF2122/97
ugguuguuggugccagccg

SEQ ID NO: 1065200 - RNA, 13 nt, Mycobacterium bovis subsp bovis AF2122/97
ugguuugccggcg

SEQ ID NO: 1065201 - RNA, 23 nt, Mycobacterium bovis subsp bovis AF2122/97
ugguuucggggaccacgccgacg

SEQ ID NO: 1065202 - RNA, 16 nt, Mycobacterium bovis subsp bovis AF2122/97
uguacacuuugcccgc

SEQ ID NO: 1065203 - RNA, 21 nt, Mycobacterium bovis subsp bovis AF2122/97
uguacaacgacacgccgcauc

SEQ ID NO: 1065204 - RNA, 19 nt, Mycobacterium bovis subsp bovis AF2122/97
uguaccagguggaccggcc

SEQ ID NO: 1065205 - RNA, 15 nt, Mycobacterium bovis subsp bovis AF2122/97
uguaccccagcgcca

SEQ ID NO: 1065206 - RNA, 16 nt, Mycobacterium bovis subsp bovis AF2122/97
uguacccgccucgggc

SEQ ID NO: 1065207 - RNA, 17 nt, Mycobacterium bovis subsp bovis AF2122/97
uguacggaucaggcccg

SEQ ID NO: 1065208 - RNA, 21 nt, Mycobacterium bovis subsp bovis AF2122/97
uguaccuccaggaucgccgcu

SEQ ID NO: 1065209 - RNA, 21 nt, Mycobacterium bovis subsp bovis AF2122/97
uguacggggccgucucgccgu

SEQ ID NO: 1065210 - RNA, 20 nt, Mycobacterium bovis subsp bovis AF2122/97
ugggcgauuuugcgucucgc

SEQ ID NO: 1065211 - RNA, 18 nt, Mycobacterium bovis subsp bovis AF2122/97
ugggcgauuuugcgucug

SEQ ID NO: 1065212 - RNA, 23 nt, Mycobacterium bovis subsp bovis AF2122/97
ugggcgauucugugucugcucgc

SEQ ID NO: 1065213 - RNA, 20 nt, Mycobacterium bovis subsp bovis AF2122/97
ugggcgauuuugcgucugcu

SEQ ID NO: 1065214 - RNA, 17 nt, Mycobacterium bovis subsp bovis AF2122/97
ugggcgaugacgccauc

SEQ ID NO: 1065215 - RNA, 17 nt, Mycobacterium bovis subsp bovis AF2122/97
ugggcgauggcaccggc

SEQ ID NO: 1065216 - RNA, 19 nt, Mycobacterium bovis subsp bovis AF2122/97
ugggcgauucugcgucugc

SEQ ID NO: 1065217 - RNA, 20 nt, Mycobacterium bovis subsp bovis AF2122/97
ugggcgauucugcgucugcu

SEQ ID NO: 1065218 - RNA, 23 nt, Mycobacterium bovis subsp bovis AF2122/97
ugggcgccaugcgccaacccggc

SEQ ID NO: 1065219 - RNA, 16 nt, Mycobacterium bovis subsp bovis AF2122/97
ugggcgccgacaccgg

SEQ ID NO: 1065220 - RNA, 18 nt, Mycobacterium bovis subsp bovis AF2122/97
ugggcgccgacaccggcu

SEQ ID NO: 1065221 - RNA, 13 nt, Mycobacterium bovis subsp bovis AF2122/97
ugggcgcaacgcc

SEQ ID NO: 1065222 - RNA, 11 nt, Mycobacterium bovis subsp bovis AF2122/97
ugggcgccggu

SEQ ID NO: 1065223 - RNA, 16 nt, Mycobacterium bovis subsp bovis AF2122/97
ugggcgccgucgccgu

SEQ ID NO: 1065224 - RNA, 16 nt, Mycobacterium bovis subsp bovis AF2122/97
ugggcgcgcucaucga

SEQ ID NO: 1065225 - RNA, 19 nt, Mycobacterium bovis subsp bovis AF2122/97
ugggcgcgggugcgccggc

SEQ ID NO: 1065226 - RNA, 17 nt, Mycobacterium bovis subsp bovis AF2122/97
ugggcgcgcuggcgggc

SEQ ID NO: 1065227 - RNA, 14 nt, Mycobacterium bovis subsp bovis AF2122/97
ugggcgcggcgcca

SEQ ID NO: 1065228 - RNA, 15 nt, Mycobacterium bovis subsp bovis AF2122/97
ugggcgcugucacgu

SEQ ID NO: 1065229 - RNA, 14 nt, Mycobacterium bovis subsp bovis AF2122/97
ugggcgcuucugcu

SEQ ID NO: 1065230 - RNA, 14 nt, Mycobacterium bovis subsp bovis AF2122/97
ugggcggccagcac

SEQ ID NO: 1065231 - RNA, 23 nt, Mycobacterium bovis subsp bovis AF2122/97
ugggcggccuggucggccagguc

SEQ ID NO: 1065232 - RNA, 19 nt, Mycobacterium bovis subsp bovis AF2122/97
ugggcggcauagcucagac

SEQ ID NO: 1065233 - RNA, 23 nt, Mycobacterium bovis subsp bovis AF2122/97
ugggcggcauagcucagaccggc

SEQ ID NO: 1065234 - RNA, 17 nt, Mycobacterium bovis subsp bovis AF2122/97
ugggcggcauuaccaac

SEQ ID NO: 1065235 - RNA, 20 nt, Mycobacterium bovis subsp bovis AF2122/97
aauauugccgccuccggugc

SEQ ID NO: 1065236 - RNA, 22 nt, Mycobacterium bovis subsp bovis AF2122/97
ugggcggaacgaugccggcaag

SEQ ID NO: 1065237 - RNA, 19 nt, Mycobacterium bovis subsp bovis AF2122/97
ugggcgacgucaucgccga

SEQ ID NO: 1065238 - RNA, 19 nt, Mycobacterium bovis subsp bovis AF2122/97
ugggcgacgcggcgccgcc

SEQ ID NO: 1065239 - RNA, 13 nt, Mycobacterium bovis subsp bovis AF2122/97
ugggcgacggcca

SEQ ID NO: 1065240 - RNA, 19 nt, Mycobacterium bovis subsp bovis AF2122/97
ugggcgacggcgaugaucg

SEQ ID NO: 1065241 - RNA, 16 nt, Mycobacterium bovis subsp bovis AF2122/97
ugggcgacgucaucgc

SEQ ID NO: 1065242 - RNA, 23 nt, Mycobacterium bovis subsp bovis AF2122/97
ugggccgcacaaguggucgauga

SEQ ID NO: 1065243 - RNA, 16 nt, Mycobacterium bovis subsp bovis AF2122/97
ugggccgagcgcgccg

SEQ ID NO: 1065244 - RNA, 16 nt, Mycobacterium bovis subsp bovis AF2122/97
ugggcgagucgaucuc

SEQ ID NO: 1065245 - RNA, 19 nt, Mycobacterium bovis subsp bovis AF2122/97
ugggcgauaaggaccgcgc

SEQ ID NO: 1065246 - RNA, 14 nt, Mycobacterium bovis subsp bovis AF2122/97
ugggcgagaccgcg

SEQ ID NO: 1065247 - RNA, 15 nt, Mycobacterium bovis subsp bovis AF2122/97
ugggcgagaccgcga

SEQ ID NO: 1065248 - RNA, 19 nt, Mycobacterium bovis subsp bovis AF2122/97
ugggcccugcacagcagcg

SEQ ID NO: 1065249 - RNA, 15 nt, Mycobacterium bovis subsp bovis AF2122/97
ugggcccgccagccc

SEQ ID NO: 1065250 - RNA, 16 nt, Mycobacterium bovis subsp bovis AF2122/97
ugggcccaucgcgacu

SEQ ID NO: 1065251 - RNA, 14 nt, Mycobacterium bovis subsp bovis AF2122/97
ugggccgacgggac

SEQ ID NO: 1065252 - RNA, 14 nt, Mycobacterium bovis subsp bovis AF2122/97
ugggccgacgugac

SEQ ID NO: 1065253 - RNA, 22 nt, Mycobacterium bovis subsp bovis AF2122/97
ugggccgagagcagccagccac

SEQ ID NO: 1065254 - RNA, 21 nt, Mycobacterium bovis subsp bovis AF2122/97
ugggcccaggagauccaccgg

SEQ ID NO: 1065255 - RNA, 14 nt, Mycobacterium bovis subsp bovis AF2122/97
ugggccccgccgau

SEQ ID NO: 1065256 - RNA, 18 nt, Mycobacterium bovis subsp bovis AF2122/97
ugggccaggucagccgcg

SEQ ID NO: 1065257 - RNA, 21 nt, Mycobacterium bovis subsp bovis AF2122/97
ugggccaggucagccgcgcgg

SEQ ID NO: 1065258 - RNA, 21 nt, Mycobacterium bovis subsp bovis AF2122/97
ugggccagccgcucacccggu

SEQ ID NO: 1065259 - RNA, 15 nt, Mycobacterium bovis subsp bovis AF2122/97
uggcgucggccggca

SEQ ID NO: 1065260 - RNA, 13 nt, Mycobacterium bovis subsp bovis AF2122/97
uggcgucggccag

SEQ ID NO: 1065261 - RNA, 14 nt, Mycobacterium bovis subsp bovis AF2122/97
ugggguccggugac

SEQ ID NO: 1065262 - RNA, 13 nt, Mycobacterium bovis subsp bovis AF2122/97
uggggguggcagc

SEQ ID NO: 1065263 - RNA, 20 nt, Mycobacterium bovis subsp bovis AF2122/97
ugggggugcacgccuugagc

SEQ ID NO: 1065264 - RNA, 15 nt, Mycobacterium bovis subsp bovis AF2122/97
ugggggugcuuccuc

SEQ ID NO: 1065265 - RNA, 18 nt, Mycobacterium bovis subsp bovis AF2122/97
uggggguggcagcgcggc

SEQ ID NO: 1065266 - RNA, 20 nt, Mycobacterium bovis subsp bovis AF2122/97
ugggggugguaccggcggcg

SEQ ID NO: 1065267 - RNA, 18 nt, Mycobacterium bovis subsp bovis AF2122/97
uggggguuguucaacucg

SEQ ID NO: 1065268 - RNA, 20 nt, Mycobacterium bovis subsp bovis AF2122/97
uggggguuguucaacucggg

SEQ ID NO: 1065269 - RNA, 19 nt, Mycobacterium bovis subsp bovis AF2122/97
ugggguggcaucgaacgcc

SEQ ID NO: 1065270 - RNA, 13 nt, Mycobacterium bovis subsp bovis AF2122/97
uggggucguucgc

SEQ ID NO: 1065271 - RNA, 15 nt, Mycobacterium bovis subsp bovis AF2122/97
uggggucugauggcg

SEQ ID NO: 1065272 - RNA, 21 nt, Mycobacterium bovis subsp bovis AF2122/97
uggggguagccgccggcgccg

SEQ ID NO: 1065273 - RNA, 19 nt, Mycobacterium bovis subsp bovis AF2122/97
ugggguuggcucggcgcag

SEQ ID NO: 1065274 - RNA, 12 nt, Mycobacterium bovis subsp bovis AF2122/97
uggggccaccag

SEQ ID NO: 1065275 - RNA, 16 nt, Mycobacterium bovis subsp bovis AF2122/97
ugggggagcggccgcc

SEQ ID NO: 1065276 - RNA, 15 nt, Mycobacterium bovis subsp bovis AF2122/97
uggggguccggcggc

SEQ ID NO: 1065277 - RNA, 16 nt, Mycobacterium bovis subsp bovis AF2122/97
uggggguccggcggcc

SEQ ID NO: 1065278 - RNA, 19 nt, Mycobacterium bovis subsp bovis AF2122/97
uggggguccggcggccgcc

SEQ ID NO: 1065279 - RNA, 19 nt, Mycobacterium bovis subsp bovis AF2122/97
ugggggcuucugcgucugc

SEQ ID NO: 1065280 - RNA, 20 nt, Mycobacterium bovis subsp bovis AF2122/97
ugggggcuucugcgucugcu

SEQ ID NO: 1065281 - RNA, 14 nt, Mycobacterium bovis subsp bovis AF2122/97
uggggcgcgccggc

SEQ ID NO: 1065282 - RNA, 18 nt, Mycobacterium bovis subsp bovis AF2122/97
uggggcggcaugcucacc

SEQ ID NO: 1065283 - RNA, 19 nt, Mycobacterium bovis subsp bovis AF2122/97
uggggccggggucggcccg

SEQ ID NO: 1065284 - RNA, 18 nt, Mycobacterium bovis subsp bovis AF2122/97
uggggcucguaggugggc

SEQ ID NO: 1065285 - RNA, 13 nt, Mycobacterium bovis subsp bovis AF2122/97
uggggcgguggcc

SEQ ID NO: 1065286 - RNA, 16 nt, Mycobacterium bovis subsp bovis AF2122/97
ugggggagccggugac

SEQ ID NO: 1065287 - RNA, 20 nt, Mycobacterium bovis subsp bovis AF2122/97
ugggugccguugcgucugcu

SEQ ID NO: 1065288 - RNA, 20 nt, Mycobacterium bovis subsp bovis AF2122/97
ugggugauggccgcgcccgc

SEQ ID NO: 1065289 - RNA, 23 nt, Mycobacterium bovis subsp bovis AF2122/97
ugggugcagcacguccgcggagc

SEQ ID NO: 1065290 - RNA, 15 nt, Mycobacterium bovis subsp bovis AF2122/97
ugggugaacgccugc

SEQ ID NO: 1065291 - RNA, 15 nt, Mycobacterium bovis subsp bovis AF2122/97
uggguggugcucacc

SEQ ID NO: 1065292 - RNA, 15 nt, Mycobacterium bovis subsp bovis AF2122/97
ugggugcuuggccgc

SEQ ID NO: 1065293 - RNA, 13 nt, Mycobacterium bovis subsp bovis AF2122/97
ugggugggcgccg

SEQ ID NO: 1065294 - RNA, 14 nt, Mycobacterium bovis subsp bovis AF2122/97
ugggugggugcagc

SEQ ID NO: 1065295 - RNA, 13 nt, Mycobacterium bovis subsp bovis AF2122/97
ugggugcgucugg

SEQ ID NO: 1065296 - RNA, 16 nt, Mycobacterium bovis subsp bovis AF2122/97
ugguaggccggugcgu

SEQ ID NO: 1065297 - RNA, 17 nt, Mycobacterium bovis subsp bovis AF2122/97
ugguaggccggugcguc

SEQ ID NO: 1065298 - RNA, 17 nt, Mycobacterium bovis subsp bovis AF2122/97
uggguguugcuggccgc

SEQ ID NO: 1065299 - RNA, 18 nt, Mycobacterium bovis subsp bovis AF2122/97
ugggugguuccgcgcggc

SEQ ID NO: 1065300 - RNA, 18 nt, Mycobacterium bovis subsp bovis AF2122/97
ugggugucaaugugguuc

SEQ ID NO: 1065301 - RNA, 14 nt, Mycobacterium bovis subsp bovis AF2122/97
uggguucgcgguug

SEQ ID NO: 1065302 - RNA, 15 nt, Mycobacterium bovis subsp bovis AF2122/97
uggguugaccgccac

SEQ ID NO: 1065303 - RNA, 19 nt, Mycobacterium bovis subsp bovis AF2122/97
uggguugauuggccccggc

SEQ ID NO: 1065304 - RNA, 23 nt, Mycobacterium bovis subsp bovis AF2122/97
uggggauaaucguuuucggccug

SEQ ID NO: 1065305 - RNA, 19 nt, Mycobacterium bovis subsp bovis AF2122/97
uggggccggaugucgacga

SEQ ID NO: 1065306 - RNA, 13 nt, Mycobacterium bovis subsp bovis AF2122/97
uggggcacgacgc

SEQ ID NO: 1065307 - RNA, 21 nt, Mycobacterium bovis subsp bovis AF2122/97
uggggaggaaggucgaaucgc

SEQ ID NO: 1065308 - RNA, 22 nt, Mycobacterium bovis subsp bovis AF2122/97
ugggcuuuugcgucugcucgcg

SEQ ID NO: 1065309 - RNA, 19 nt, Mycobacterium bovis subsp bovis AF2122/97
uggggaccggcaggccggc

SEQ ID NO: 1065310 - RNA, 22 nt, Mycobacterium bovis subsp bovis AF2122/97
uggggaccuauuggucgcucgc

SEQ ID NO: 1065311 - RNA, 16 nt, Mycobacterium bovis subsp bovis AF2122/97
ugggcuuuugcgucug

SEQ ID NO: 1065312 - RNA, 15 nt, Mycobacterium bovis subsp bovis AF2122/97
ugggcuugccgcgca

SEQ ID NO: 1065313 - RNA, 17 nt, Mycobacterium bovis subsp bovis AF2122/97
ugggcuuuugcgucugc

SEQ ID NO: 1065314 - RNA, 19 nt, Mycobacterium bovis subsp bovis AF2122/97
ugggcuuuugcgucugcuc

SEQ ID NO: 1065315 - RNA, 19 nt, Mycobacterium bovis subsp bovis AF2122/97
ugggcugggauagcgcggu

SEQ ID NO: 1065316 - RNA, 21 nt, Mycobacterium bovis subsp bovis AF2122/97
ugggcuucgaguuuggcgacg

SEQ ID NO: 1065317 - RNA, 17 nt, Mycobacterium bovis subsp bovis AF2122/97
ugggcgguaccucgucg

SEQ ID NO: 1065318 - RNA, 16 nt, Mycobacterium bovis subsp bovis AF2122/97
ugggcgguagccgacg

SEQ ID NO: 1065319 - RNA, 19 nt, Mycobacterium bovis subsp bovis AF2122/97
ugggcgggaaguucgucgg

SEQ ID NO: 1065320 - RNA, 15 nt, Mycobacterium bovis subsp bovis AF2122/97
ugggcggcucgucga

SEQ ID NO: 1065321 - RNA, 20 nt, Mycobacterium bovis subsp bovis AF2122/97
ugggcgggauggccgccgac

SEQ ID NO: 1065322 - RNA, 19 nt, Mycobacterium bovis subsp bovis AF2122/97
ugggcggugucgucgaggu

SEQ ID NO: 1065323 - RNA, 15 nt, Mycobacterium bovis subsp bovis AF2122/97
ugggcgucaagcaag

SEQ ID NO: 1065324 - RNA, 21 nt, Mycobacterium bovis subsp bovis AF2122/97
ugggcgugacguagugcaccg

SEQ ID NO: 1065325 - RNA, 20 nt, Mycobacterium bovis subsp bovis AF2122/97
ugggcgguugaucgccggcc

SEQ ID NO: 1065326 - RNA, 14 nt, Mycobacterium bovis subsp bovis AF2122/97
ugggcgucgaagac

SEQ ID NO: 1065327 - RNA, 19 nt, Mycobacterium bovis subsp bovis AF2122/97
ugggcgucgaagaccgccu

SEQ ID NO: 1065328 - RNA, 14 nt, Mycobacterium bovis subsp bovis AF2122/97
ugggcugccggcca

SEQ ID NO: 1065329 - RNA, 15 nt, Mycobacterium bovis subsp bovis AF2122/97
ugggcugcggccgcg

SEQ ID NO: 1065330 - RNA, 13 nt, Mycobacterium bovis subsp bovis AF2122/97
ugggcucguugug

SEQ ID NO: 1065331 - RNA, 14 nt, Mycobacterium bovis subsp bovis AF2122/97
ugccggccaucgcc

SEQ ID NO: 1065332 - RNA, 15 nt, Mycobacterium bovis subsp bovis AF2122/97
ugccggccggcgggc

SEQ ID NO: 1065333 - RNA, 15 nt, Mycobacterium bovis subsp bovis AF2122/97
ugccggccgcggggc

SEQ ID NO: 1065334 - RNA, 11 nt, Mycobacterium bovis subsp bovis AF2122/97
ugccggccgcg

SEQ ID NO: 1065335 - RNA, 13 nt, Mycobacterium bovis subsp bovis AF2122/97
ugccggccgcaca

SEQ ID NO: 1065336 - RNA, 14 nt, Mycobacterium bovis subsp bovis AF2122/97
ugccggccaccguc

SEQ ID NO: 1065337 - RNA, 15 nt, Mycobacterium bovis subsp bovis AF2122/97
ugccggccagacggu

SEQ ID NO: 1065338 - RNA, 18 nt, Mycobacterium bovis subsp bovis AF2122/97
ugccggccagacucgcgg

SEQ ID NO: 1065339 - RNA, 19 nt, Mycobacterium bovis subsp bovis AF2122/97
ugccggccagacucgcggu

SEQ ID NO: 1065340 - RNA, 16 nt, Mycobacterium bovis subsp bovis AF2122/97
ugccggcagcgguggc

SEQ ID NO: 1065341 - RNA, 17 nt, Mycobacterium bovis subsp bovis AF2122/97
ugccggcagcgguggca

SEQ ID NO: 1065342 - RNA, 23 nt, Mycobacterium bovis subsp bovis AF2122/97
ugccggcaaccugaauccagacc

SEQ ID NO: 1065343 - RNA, 18 nt, Mycobacterium bovis subsp bovis AF2122/97
ugccggcaccaaccaccg

SEQ ID NO: 1065344 - RNA, 23 nt, Mycobacterium bovis subsp bovis AF2122/97
ugccggcacccgucgggugcuga

SEQ ID NO: 1065345 - RNA, 15 nt, Mycobacterium bovis subsp bovis AF2122/97
ugccggaaacgccag

SEQ ID NO: 1065346 - RNA, 23 nt, Mycobacterium bovis subsp bovis AF2122/97
ugccggacaaccuggggccacca

SEQ ID NO: 1065347 - RNA, 23 nt, Mycobacterium bovis subsp bovis AF2122/97
ugccggaguugucgacggccacc

SEQ ID NO: 1065348 - RNA, 21 nt, Mycobacterium bovis subsp bovis AF2122/97
ugccggacuaccgccggcggc

SEQ ID NO: 1065349 - RNA, 14 nt, Mycobacterium bovis subsp bovis AF2122/97
ugccggacugccgc

SEQ ID NO: 1065350 - RNA, 15 nt, Mycobacterium bovis subsp bovis AF2122/97
ugccggacugccgca

SEQ ID NO: 1065351 - RNA, 19 nt, Mycobacterium bovis subsp bovis AF2122/97
ugccggagacacccgccag

SEQ ID NO: 1065352 - RNA, 18 nt, Mycobacterium bovis subsp bovis AF2122/97
ugccggagacgucgccgc

SEQ ID NO: 1065353 - RNA, 21 nt, Mycobacterium bovis subsp bovis AF2122/97
ugccgcugccgaagcggccac

SEQ ID NO: 1065354 - RNA, 16 nt, Mycobacterium bovis subsp bovis AF2122/97
ugccgcugcauccgca

SEQ ID NO: 1065355 - RNA, 17 nt, Mycobacterium bovis subsp bovis AF2122/97
ugccgcugcauccgcag

SEQ ID NO: 1065356 - RNA, 14 nt, Mycobacterium bovis subsp bovis AF2122/97
ugccgcuggucguc

SEQ ID NO: 1065357 - RNA, 13 nt, Mycobacterium bovis subsp bovis AF2122/97
ugccgcugguggc

SEQ ID NO: 1065358 - RNA, 19 nt, Mycobacterium bovis subsp bovis AF2122/97
ugccgcguugccgggguug

SEQ ID NO: 1065359 - RNA, 14 nt, Mycobacterium bovis subsp bovis AF2122/97
ugccgcugacgguu

SEQ ID NO: 1065360 - RNA, 12 nt, Mycobacterium bovis subsp bovis AF2122/97
ugccgacgucgg

SEQ ID NO: 1065361 - RNA, 14 nt, Mycobacterium bovis subsp bovis AF2122/97
ugccgcucgccggu

SEQ ID NO: 1065362 - RNA, 17 nt, Mycobacterium bovis subsp bovis AF2122/97
ugccgacggcgccgaac

SEQ ID NO: 1065363 - RNA, 18 nt, Mycobacterium bovis subsp bovis AF2122/97
ugccgacggcgcccgccc

SEQ ID NO: 1065364 - RNA, 15 nt, Mycobacterium bovis subsp bovis AF2122/97
ugccgacgcgcggcc

SEQ ID NO: 1065365 - RNA, 17 nt, Mycobacterium bovis subsp bovis AF2122/97
ugccgacgcgcggccag

SEQ ID NO: 1065366 - RNA, 20 nt, Mycobacterium bovis subsp bovis AF2122/97
ugccgacgcgcggccagccc

SEQ ID NO: 1065367 - RNA, 14 nt, Mycobacterium bovis subsp bovis AF2122/97
ugccgacgaugacg

SEQ ID NO: 1065368 - RNA, 15 nt, Mycobacterium bovis subsp bovis AF2122/97
ugccgacgccccgau

SEQ ID NO: 1065369 - RNA, 20 nt, Mycobacterium bovis subsp bovis AF2122/97
ugccgacgccccgaucggcc

SEQ ID NO: 1065370 - RNA, 21 nt, Mycobacterium bovis subsp bovis AF2122/97
ugccgacgccccgaucggcca

SEQ ID NO: 1065371 - RNA, 22 nt, Mycobacterium bovis subsp bovis AF2122/97
ugccgacgccccgaucggccac

SEQ ID NO: 1065372 - RNA, 19 nt, Mycobacterium bovis subsp bovis AF2122/97
ugccgacgaggggcgcggg

SEQ ID NO: 1065373 - RNA, 21 nt, Mycobacterium bovis subsp bovis AF2122/97
ugccgacgaggggcgcgggug

SEQ ID NO: 1065374 - RNA, 17 nt, Mycobacterium bovis subsp bovis AF2122/97
ugccgaccgauacaccg

SEQ ID NO: 1065375 - RNA, 15 nt, Mycobacterium bovis subsp bovis AF2122/97
ugccgacccgucgga

SEQ ID NO: 1065376 - RNA, 19 nt, Mycobacterium bovis subsp bovis AF2122/97
ugccgaacaguucggcgag

SEQ ID NO: 1065377 - RNA, 20 nt, Mycobacterium bovis subsp bovis AF2122/97
ugccgaacaguucggcgagc

SEQ ID NO: 1065378 - RNA, 20 nt, Mycobacterium bovis subsp bovis AF2122/97
ugccgaaccacgcgcccgca

SEQ ID NO: 1065379 - RNA, 16 nt, Mycobacterium bovis subsp bovis AF2122/97
ugccgaacccggcgga

SEQ ID NO: 1065380 - RNA, 17 nt, Mycobacterium bovis subsp bovis AF2122/97
ugccgaccaugcaagug

SEQ ID NO: 1065381 - RNA, 17 nt, Mycobacterium bovis subsp bovis AF2122/97
ugccgaaacccgaguuc

SEQ ID NO: 1065382 - RNA, 19 nt, Mycobacterium bovis subsp bovis AF2122/97
ugccgaaacgccgaccgcg

SEQ ID NO: 1065383 - RNA, 20 nt, Mycobacterium bovis subsp bovis AF2122/97
ugccgaaacgccgaccgcgc

SEQ ID NO: 1065384 - RNA, 16 nt, Mycobacterium bovis subsp bovis AF2122/97
ugcccuuggccagcag

SEQ ID NO: 1065385 - RNA, 18 nt, Mycobacterium bovis subsp bovis AF2122/97
ugcccuucuucgaccgcg

SEQ ID NO: 1065386 - RNA, 19 nt, Mycobacterium bovis subsp bovis AF2122/97
ugcccuucuucgaccgcga

SEQ ID NO: 1065387 - RNA, 19 nt, Mycobacterium bovis subsp bovis AF2122/97
ugcccuucgucggcaugac

SEQ ID NO: 1065388 - RNA, 16 nt, Mycobacterium bovis subsp bovis AF2122/97
ugcccuucugacuauc

SEQ ID NO: 1065389 - RNA, 19 nt, Mycobacterium bovis subsp bovis AF2122/97
ugccggcccugcucggcca

SEQ ID NO: 1065390 - RNA, 14 nt, Mycobacterium bovis subsp bovis AF2122/97
ugccggcgacgcua

SEQ ID NO: 1065391 - RNA, 18 nt, Mycobacterium bovis subsp bovis AF2122/97
ugccggcgaagccggccg

SEQ ID NO: 1065392 - RNA, 23 nt, Mycobacterium bovis subsp bovis AF2122/97
ugccggcgacgcuaccgccggag

SEQ ID NO: 1065393 - RNA, 14 nt, Mycobacterium bovis subsp bovis AF2122/97
ugccggcgaacucg

SEQ ID NO: 1065394 - RNA, 15 nt, Mycobacterium bovis subsp bovis AF2122/97
ugccggcgaacucgc

SEQ ID NO: 1065395 - RNA, 12 nt, Mycobacterium bovis subsp bovis AF2122/97
ugccggcgccgc

SEQ ID NO: 1065396 - RNA, 14 nt, Mycobacterium bovis subsp bovis AF2122/97
ugccggcgccgcca

SEQ ID NO: 1065397 - RNA, 15 nt, Mycobacterium bovis subsp bovis AF2122/97
ugccggcgccgccag

SEQ ID NO: 1065398 - RNA, 12 nt, Mycobacterium bovis subsp bovis AF2122/97
ugccggcggaaa

SEQ ID NO: 1065399 - RNA, 18 nt, Mycobacterium bovis subsp bovis AF2122/97
ugccggcggaucugaucg

SEQ ID NO: 1065400 - RNA, 16 nt, Mycobacterium bovis subsp bovis AF2122/97
ugccggcggcgacguc

SEQ ID NO: 1065401 - RNA, 14 nt, Mycobacterium bovis subsp bovis AF2122/97
ugccggcgguggcc

SEQ ID NO: 1065402 - RNA, 18 nt, Mycobacterium bovis subsp bovis AF2122/97
ugccggcgguggccgaca

SEQ ID NO: 1065403 - RNA, 18 nt, Mycobacterium bovis subsp bovis AF2122/97
ugccggcgugcgcgagau

SEQ ID NO: 1065404 - RNA, 18 nt, Mycobacterium bovis subsp bovis AF2122/97
ugccggcgugcggcgagg

SEQ ID NO: 1065405 - RNA, 14 nt, Mycobacterium bovis subsp bovis AF2122/97
ugccggcuagcucg

SEQ ID NO: 1065406 - RNA, 16 nt, Mycobacterium bovis subsp bovis AF2122/97
ugccggcuagcucggc

SEQ ID NO: 1065407 - RNA, 18 nt, Mycobacterium bovis subsp bovis AF2122/97
ugccggcugacgaccaac

SEQ ID NO: 1065408 - RNA, 18 nt, Mycobacterium bovis subsp bovis AF2122/97
ugccgggcaccaccacac

SEQ ID NO: 1065409 - RNA, 22 nt, Mycobacterium bovis subsp bovis AF2122/97
ugccgggaaccaacaccagguc

SEQ ID NO: 1065410 - RNA, 14 nt, Mycobacterium bovis subsp bovis AF2122/97
ugccggcuucggcg

SEQ ID NO: 1065411 - RNA, 19 nt, Mycobacterium bovis subsp bovis AF2122/97
ugccggcgcggagugccca

SEQ ID NO: 1065412 - RNA, 15 nt, Mycobacterium bovis subsp bovis AF2122/97
ugccgggcgacgguu

SEQ ID NO: 1065413 - RNA, 16 nt, Mycobacterium bovis subsp bovis AF2122/97
ugccggggcugccgcc

SEQ ID NO: 1065414 - RNA, 17 nt, Mycobacterium bovis subsp bovis AF2122/97
ugccgggcugaggcggc

SEQ ID NO: 1065415 - RNA, 19 nt, Mycobacterium bovis subsp bovis AF2122/97
ugccggucaggcaguccac

SEQ ID NO: 1065416 - RNA, 17 nt, Mycobacterium bovis subsp bovis AF2122/97
ugccggucacgucgauc

SEQ ID NO: 1065417 - RNA, 23 nt, Mycobacterium bovis subsp bovis AF2122/97
ugccggucaacccucgccacgca

SEQ ID NO: 1065418 - RNA, 20 nt, Mycobacterium bovis subsp bovis AF2122/97
ugccgggcgcuggacggcgg

SEQ ID NO: 1065419 - RNA, 18 nt, Mycobacterium bovis subsp bovis AF2122/97
ugccgggguggcgcgcca

SEQ ID NO: 1065420 - RNA, 15 nt, Mycobacterium bovis subsp bovis AF2122/97
ugccgggucaccgau

SEQ ID NO: 1065421 - RNA, 19 nt, Mycobacterium bovis subsp bovis AF2122/97
ugccgggcgaugcugggcg

SEQ ID NO: 1065422 - RNA, 19 nt, Mycobacterium bovis subsp bovis AF2122/97
ugccgggcgcacgcccgca

SEQ ID NO: 1065423 - RNA, 23 nt, Mycobacterium bovis subsp bovis AF2122/97
ugccgguguugccgccggugccg

SEQ ID NO: 1065424 - RNA, 18 nt, Mycobacterium bovis subsp bovis AF2122/97
ugccgguggugacggcgg

SEQ ID NO: 1065425 - RNA, 19 nt, Mycobacterium bovis subsp bovis AF2122/97
ugccgguguugauuccggc

SEQ ID NO: 1065426 - RNA, 16 nt, Mycobacterium bovis subsp bovis AF2122/97
ugccgguggcggcggc

SEQ ID NO: 1065427 - RNA, 16 nt, Mycobacterium bovis subsp bovis AF2122/97
ugccgguuuccgucug

SEQ ID NO: 1065428 - RNA, 23 nt, Mycobacterium bovis subsp bovis AF2122/97
ugccgguucgauggcaucggcca

SEQ ID NO: 1065429 - RNA, 15 nt, Mycobacterium bovis subsp bovis AF2122/97
ugccgguucggcgau

SEQ ID NO: 1065430 - RNA, 14 nt, Mycobacterium bovis subsp bovis AF2122/97
ugccgguugccacc

SEQ ID NO: 1065431 - RNA, 16 nt, Mycobacterium bovis subsp bovis AF2122/97
ugccgguuuggccgaa

SEQ ID NO: 1065432 - RNA, 14 nt, Mycobacterium bovis subsp bovis AF2122/97
ugccgguuuucggg

SEQ ID NO: 1065433 - RNA, 12 nt, Mycobacterium bovis subsp bovis AF2122/97
ugccggugcuga

SEQ ID NO: 1065434 - RNA, 20 nt, Mycobacterium bovis subsp bovis AF2122/97
ugccggugcgguggugcgca

SEQ ID NO: 1065435 - RNA, 13 nt, Mycobacterium bovis subsp bovis AF2122/97
ugccggugcuccu

SEQ ID NO: 1065436 - RNA, 16 nt, Mycobacterium bovis subsp bovis AF2122/97
ugccggugcuccucgg

SEQ ID NO: 1065437 - RNA, 14 nt, Mycobacterium bovis subsp bovis AF2122/97
ugccggugccgccg

SEQ ID NO: 1065438 - RNA, 18 nt, Mycobacterium bovis subsp bovis AF2122/97
ugccggugccgccgcggc

SEQ ID NO: 1065439 - RNA, 19 nt, Mycobacterium bovis subsp bovis AF2122/97
ugccggugccgccgcggcc

SEQ ID NO: 1065440 - RNA, 17 nt, Mycobacterium bovis subsp bovis AF2122/97
ugccggugauggccgac

SEQ ID NO: 1065441 - RNA, 14 nt, Mycobacterium bovis subsp bovis AF2122/97
ugccggucgagugc

SEQ ID NO: 1065442 - RNA, 19 nt, Mycobacterium bovis subsp bovis AF2122/97
ugccgucgagcaacgugac

SEQ ID NO: 1065443 - RNA, 17 nt, Mycobacterium bovis subsp bovis AF2122/97
ugccgucggagaccagc

SEQ ID NO: 1065444 - RNA, 20 nt, Mycobacterium bovis subsp bovis AF2122/97
ugccgucggagaccagcucg

SEQ ID NO: 1065445 - RNA, 22 nt, Mycobacterium bovis subsp bovis AF2122/97
ugccgucgccgcccuggccgcc

SEQ ID NO: 1065446 - RNA, 14 nt, Mycobacterium bovis subsp bovis AF2122/97
ugccgucgccggau

SEQ ID NO: 1065447 - RNA, 17 nt, Mycobacterium bovis subsp bovis AF2122/97
ugccgucggugccgggg

SEQ ID NO: 1065448 - RNA, 21 nt, Mycobacterium bovis subsp bovis AF2122/97
ugccgucggugccggggcugc

SEQ ID NO: 1065449 - RNA, 13 nt, Mycobacterium bovis subsp bovis AF2122/97
ugccgucugcggu

SEQ ID NO: 1065450 - RNA, 19 nt, Mycobacterium bovis subsp bovis AF2122/97
ugcgccauucccgguggcu

SEQ ID NO: 1065451 - RNA, 22 nt, Mycobacterium bovis subsp bovis AF2122/97
ugcgccaucucgacggugaccg

SEQ ID NO: 1065452 - RNA, 23 nt, Mycobacterium bovis subsp bovis AF2122/97
ugcgcccgacggaguucgacguc

SEQ ID NO: 1065453 - RNA, 16 nt, Mycobacterium bovis subsp bovis AF2122/97
ugcgcccaggugaucg

SEQ ID NO: 1065454 - RNA, 19 nt, Mycobacterium bovis subsp bovis AF2122/97
ugcgccgaccggccacgac

SEQ ID NO: 1065455 - RNA, 23 nt, Mycobacterium bovis subsp bovis AF2122/97
ugcgccgaccggccacgaccucg

SEQ ID NO: 1065456 - RNA, 15 nt, Mycobacterium bovis subsp bovis AF2122/97
ugcgccggcuggcgg

SEQ ID NO: 1065457 - RNA, 13 nt, Mycobacterium bovis subsp bovis AF2122/97
ugcgccgcagcga

SEQ ID NO: 1065458 - RNA, 14 nt, Mycobacterium bovis subsp bovis AF2122/97
ugcgccgcagcgau

SEQ ID NO: 1065459 - RNA, 14 nt, Mycobacterium bovis subsp bovis AF2122/97
ugcgccggcgcugc

SEQ ID NO: 1065460 - RNA, 22 nt, Mycobacterium bovis subsp bovis AF2122/97
ugcgcccggccaagccggcgag

SEQ ID NO: 1065461 - RNA, 14 nt, Mycobacterium bovis subsp bovis AF2122/97
ugcgccgagcuggc

SEQ ID NO: 1065462 - RNA, 21 nt, Mycobacterium bovis subsp bovis AF2122/97
ugcgccgagcuggcaacgccg

SEQ ID NO: 1065463 - RNA, 22 nt, Mycobacterium bovis subsp bovis AF2122/97
ugcgccgcacgccgaccggccc

SEQ ID NO: 1065464 - RNA, 15 nt, Mycobacterium bovis subsp bovis AF2122/97
ugcgccagaucaccg

SEQ ID NO: 1065465 - RNA, 20 nt, Mycobacterium bovis subsp bovis AF2122/97
ugcgccagcgguggaccacc

SEQ ID NO: 1065466 - RNA, 15 nt, Mycobacterium bovis subsp bovis AF2122/97
ugcgcaccauggguc

SEQ ID NO: 1065467 - RNA, 19 nt, Mycobacterium bovis subsp bovis AF2122/97
ugcgcaccugggucgacga

SEQ ID NO: 1065468 - RNA, 20 nt, Mycobacterium bovis subsp bovis AF2122/97
ugcgcaccugggucgacgag

SEQ ID NO: 1065469 - RNA, 21 nt, Mycobacterium bovis subsp bovis AF2122/97
ugcgcaccugggucgacgaga

SEQ ID NO: 1065470 - RNA, 14 nt, Mycobacterium bovis subsp bovis AF2122/97
ugcgcaccgccgcg

SEQ ID NO: 1065471 - RNA, 18 nt, Mycobacterium bovis subsp bovis AF2122/97
ugcgcaccggucaacgug

SEQ ID NO: 1065472 - RNA, 20 nt, Mycobacterium bovis subsp bovis AF2122/97
ugcgcaccagcggcugaccg

SEQ ID NO: 1065473 - RNA, 11 nt, Mycobacterium bovis subsp bovis AF2122/97
ugcgcaccccg

SEQ ID NO: 1065474 - RNA, 18 nt, Mycobacterium bovis subsp bovis AF2122/97
ugcgcacacccugcagcu

SEQ ID NO: 1065475 - RNA, 16 nt, Mycobacterium bovis subsp bovis AF2122/97
ugcgcacaggcgcgau

SEQ ID NO: 1065476 - RNA, 15 nt, Mycobacterium bovis subsp bovis AF2122/97
ugcgcaaggccgcgu

SEQ ID NO: 1065477 - RNA, 14 nt, Mycobacterium bovis subsp bovis AF2122/97
ugcgcaccaaggcc

SEQ ID NO: 1065478 - RNA, 15 nt, Mycobacterium bovis subsp bovis AF2122/97
ugcgcaaugccgacg

SEQ ID NO: 1065479 - RNA, 14 nt, Mycobacterium bovis subsp bovis AF2122/97
ugcgcaccaccgag

SEQ ID NO: 1065480 - RNA, 23 nt, Mycobacterium bovis subsp bovis AF2122/97
ugcgcacgucgggcccgaugucg

SEQ ID NO: 1065481 - RNA, 12 nt, Mycobacterium bovis subsp bovis AF2122/97
ugcgcacgucgg

SEQ ID NO: 1065482 - RNA, 12 nt, Mycobacterium bovis subsp bovis AF2122/97
ugcgcacgaccc

SEQ ID NO: 1065483 - RNA, 13 nt, Mycobacterium bovis subsp bovis AF2122/97
ugcgccacacccg

SEQ ID NO: 1065484 - RNA, 17 nt, Mycobacterium bovis subsp bovis AF2122/97
ugcgcacucuagccggg

SEQ ID NO: 1065485 - RNA, 17 nt, Mycobacterium bovis subsp bovis AF2122/97
ugcgcagaacaccaccg

SEQ ID NO: 1065486 - RNA, 15 nt, Mycobacterium bovis subsp bovis AF2122/97
ugccguuccagcauc

SEQ ID NO: 1065487 - RNA, 14 nt, Mycobacterium bovis subsp bovis AF2122/97
ugccgucggcgugc

SEQ ID NO: 1065488 - RNA, 21 nt, Mycobacterium bovis subsp bovis AF2122/97
ugccuuccucggcaagucgac

SEQ ID NO: 1065489 - RNA, 14 nt, Mycobacterium bovis subsp bovis AF2122/97
ugccuuagcccggc

SEQ ID NO: 1065490 - RNA, 13 nt, Mycobacterium bovis subsp bovis AF2122/97
ugccguucggacc

SEQ ID NO: 1065491 - RNA, 18 nt, Mycobacterium bovis subsp bovis AF2122/97
ugccguucggggcgcggu

SEQ ID NO: 1065492 - RNA, 21 nt, Mycobacterium bovis subsp bovis AF2122/97
ugccugucagaaggaucagcg

SEQ ID NO: 1065493 - RNA, 21 nt, Mycobacterium bovis subsp bovis AF2122/97
ugccuuacacgccuggcuacg

SEQ ID NO: 1065494 - RNA, 15 nt, Mycobacterium bovis subsp bovis AF2122/97
ugcgaagggcaccgg

SEQ ID NO: 1065495 - RNA, 21 nt, Mycobacterium bovis subsp bovis AF2122/97
ugcgaaacgcuggccacucac

SEQ ID NO: 1065496 - RNA, 18 nt, Mycobacterium bovis subsp bovis AF2122/97
ugcgaaacgaauccgcca

SEQ ID NO: 1065497 - RNA, 12 nt, Mycobacterium bovis subsp bovis AF2122/97
ugcgaacaacgc

SEQ ID NO: 1065498 - RNA, 16 nt, Mycobacterium bovis subsp bovis AF2122/97
ugcgaaccggccgucg

SEQ ID NO: 1065499 - RNA, 21 nt, Mycobacterium bovis subsp bovis AF2122/97
ugccuuugggcuguggccgcg

SEQ ID NO: 1065500 - RNA, 18 nt, Mycobacterium bovis subsp bovis AF2122/97
ugcgaaaauccgugccga

SEQ ID NO: 1065501 - RNA, 15 nt, Mycobacterium bovis subsp bovis AF2122/97
ugcgaaacaucucgg

SEQ ID NO: 1065502 - RNA, 14 nt, Mycobacterium bovis subsp bovis AF2122/97
ugccuucggcgagc

SEQ ID NO: 1065503 - RNA, 22 nt, Mycobacterium bovis subsp bovis AF2122/97
ugcgaucggcacuagcgagccg

SEQ ID NO: 1065504 - RNA, 22 nt, Mycobacterium bovis subsp bovis AF2122/97
ugcgaucggcacuuagcccgau

SEQ ID NO: 1065505 - RNA, 12 nt, Mycobacterium bovis subsp bovis AF2122/97
ugcgaucggccg

SEQ ID NO: 1065506 - RNA, 14 nt, Mycobacterium bovis subsp bovis AF2122/97
ugcgagcgacaccg

SEQ ID NO: 1065507 - RNA, 14 nt, Mycobacterium bovis subsp bovis AF2122/97
ugcgagcgcagcgc

SEQ ID NO: 1065508 - RNA, 15 nt, Mycobacterium bovis subsp bovis AF2122/97
ugcgaucgccgcuaa

SEQ ID NO: 1065509 - RNA, 18 nt, Mycobacterium bovis subsp bovis AF2122/97
ugcgaugauuucgucgau

SEQ ID NO: 1065510 - RNA, 15 nt, Mycobacterium bovis subsp bovis AF2122/97
ugcgaugcagcgcgc

SEQ ID NO: 1065511 - RNA, 12 nt, Mycobacterium bovis subsp bovis AF2122/97
ugcgaugcccac

SEQ ID NO: 1065512 - RNA, 12 nt, Mycobacterium bovis subsp bovis AF2122/97
ugcgaugcccgu

SEQ ID NO: 1065513 - RNA, 16 nt, Mycobacterium bovis subsp bovis AF2122/97
ugcgaugcgcgccgau

SEQ ID NO: 1065514 - RNA, 17 nt, Mycobacterium bovis subsp bovis AF2122/97
ugcgaugcugaucaccg

SEQ ID NO: 1065515 - RNA, 12 nt, Mycobacterium bovis subsp bovis AF2122/97
ugcgacggccgg

SEQ ID NO: 1065516 - RNA, 19 nt, Mycobacterium bovis subsp bovis AF2122/97
ugcgagcacccguugaucg

SEQ ID NO: 1065517 - RNA, 18 nt, Mycobacterium bovis subsp bovis AF2122/97
ugcgacguugguugcguc

SEQ ID NO: 1065518 - RNA, 16 nt, Mycobacterium bovis subsp bovis AF2122/97
ugcgacucugcgucug

SEQ ID NO: 1065519 - RNA, 17 nt, Mycobacterium bovis subsp bovis AF2122/97
ugcgacucugcgucugc

SEQ ID NO: 1065520 - RNA, 17 nt, Mycobacterium bovis subsp bovis AF2122/97
ugcgauuccgcgucugc

SEQ ID NO: 1065521 - RNA, 18 nt, Mycobacterium bovis subsp bovis AF2122/97
ugcgauuccgcgucugcu

SEQ ID NO: 1065522 - RNA, 21 nt, Mycobacterium bovis subsp bovis AF2122/97
ugcgauucugcguccugcucg

SEQ ID NO: 1065523 - RNA, 16 nt, Mycobacterium bovis subsp bovis AF2122/97
ugcgauucugcgucug

SEQ ID NO: 1065524 - RNA, 12 nt, Mycobacterium bovis subsp bovis AF2122/97
ugcgauggccga

SEQ ID NO: 1065525 - RNA, 13 nt, Mycobacterium bovis subsp bovis AF2122/97
ugcgauggccgac

SEQ ID NO: 1065526 - RNA, 17 nt, Mycobacterium bovis subsp bovis AF2122/97
ugcgauucugcgucugc

SEQ ID NO: 1065527 - RNA, 18 nt, Mycobacterium bovis subsp bovis AF2122/97
ugcgauucugcgucugcu

SEQ ID NO: 1065528 - RNA, 19 nt, Mycobacterium bovis subsp bovis AF2122/97
ugcgauucugcgucugcuc

SEQ ID NO: 1065529 - RNA, 21 nt, Mycobacterium bovis subsp bovis AF2122/97
ugcgauucugugucugcucgg

SEQ ID NO: 1065530 - RNA, 16 nt, Mycobacterium bovis subsp bovis AF2122/97
ugcgauugcgcacacc

SEQ ID NO: 1065531 - RNA, 18 nt, Mycobacterium bovis subsp bovis AF2122/97
ugcgcaacgcgucgucgg

SEQ ID NO: 1065532 - RNA, 18 nt, Mycobacterium bovis subsp bovis AF2122/97
ugcgcaaccgcggccccg

SEQ ID NO: 1065533 - RNA, 14 nt, Mycobacterium bovis subsp bovis AF2122/97
ugcgcaacuucgac

SEQ ID NO: 1065534 - RNA, 21 nt, Mycobacterium bovis subsp bovis AF2122/97
ugcgcaacuucuucagcagcg

SEQ ID NO: 1065535 - RNA, 17 nt, Mycobacterium bovis subsp bovis AF2122/97
ugcgcaacccagccgcg

SEQ ID NO: 1065536 - RNA, 13 nt, Mycobacterium bovis subsp bovis AF2122/97
ugcgcaaccgcgg

SEQ ID NO: 1065537 - RNA, 20 nt, Mycobacterium bovis subsp bovis AF2122/97
ugcgguggcgcgcagcgcga

SEQ ID NO: 1065538 - RNA, 16 nt, Mycobacterium bovis subsp bovis AF2122/97
ugcggugccguggugg

SEQ ID NO: 1065539 - RNA, 12 nt, Mycobacterium bovis subsp bovis AF2122/97
ugcggugccacg

SEQ ID NO: 1065540 - RNA, 23 nt, Mycobacterium bovis subsp bovis AF2122/97
ugcggugccacggugacccuggu

SEQ ID NO: 1065541 - RNA, 16 nt, Mycobacterium bovis subsp bovis AF2122/97
ugcgguguagggcggc

SEQ ID NO: 1065542 - RNA, 19 nt, Mycobacterium bovis subsp bovis AF2122/97
ugcgguggccagugcgacg

SEQ ID NO: 1065543 - RNA, 18 nt, Mycobacterium bovis subsp bovis AF2122/97
ugcggugugugcaagccg

SEQ ID NO: 1065544 - RNA, 15 nt, Mycobacterium bovis subsp bovis AF2122/97
ugcgguuagcagccg

SEQ ID NO: 1065545 - RNA, 16 nt, Mycobacterium bovis subsp bovis AF2122/97
ugcgguuccgauagcc

SEQ ID NO: 1065546 - RNA, 22 nt, Mycobacterium bovis subsp bovis AF2122/97
ugcggugcaggauucggcgguc

SEQ ID NO: 1065547 - RNA, 18 nt, Mycobacterium bovis subsp bovis AF2122/97
ugcggugcaucgccacca

SEQ ID NO: 1065548 - RNA, 20 nt, Mycobacterium bovis subsp bovis AF2122/97
ugcggugauggacugaucgc

SEQ ID NO: 1065549 - RNA, 19 nt, Mycobacterium bovis subsp bovis AF2122/97
ugcggugaucgaacugggg

SEQ ID NO: 1065550 - RNA, 16 nt, Mycobacterium bovis subsp bovis AF2122/97
ugcgguccucgaucgg

SEQ ID NO: 1065551 - RNA, 18 nt, Mycobacterium bovis subsp bovis AF2122/97
ugcggucucacucaucgg

SEQ ID NO: 1065552 - RNA, 18 nt, Mycobacterium bovis subsp bovis AF2122/97
ugcggugauauccgugaa

SEQ ID NO: 1065553 - RNA, 19 nt, Mycobacterium bovis subsp bovis AF2122/97
ugcgguccaggccggcacc

SEQ ID NO: 1065554 - RNA, 17 nt, Mycobacterium bovis subsp bovis AF2122/97
ugcggucaucgcgucca

SEQ ID NO: 1065555 - RNA, 17 nt, Mycobacterium bovis subsp bovis AF2122/97
ugcggucaucggcgcca

SEQ ID NO: 1065556 - RNA, 23 nt, Mycobacterium bovis subsp bovis AF2122/97
ugcgucugggcaucaucgacgcg

SEQ ID NO: 1065557 - RNA, 20 nt, Mycobacterium bovis subsp bovis AF2122/97
ugcgucugcucggcgcggug

SEQ ID NO: 1065558 - RNA, 16 nt, Mycobacterium bovis subsp bovis AF2122/97
ugcgucugcucgccgu

SEQ ID NO: 1065559 - RNA, 21 nt, Mycobacterium bovis subsp bovis AF2122/97
ugcgucugcucgccguggugg

SEQ ID NO: 1065560 - RNA, 15 nt, Mycobacterium bovis subsp bovis AF2122/97
ugcgucugcucggcg

SEQ ID NO: 1065561 - RNA, 17 nt, Mycobacterium bovis subsp bovis AF2122/97
ugcgucugcucggcgca

SEQ ID NO: 1065562 - RNA, 15 nt, Mycobacterium bovis subsp bovis AF2122/97
ugcgugaacaagauu

SEQ ID NO: 1065563 - RNA, 15 nt, Mycobacterium bovis subsp bovis AF2122/97
ugcgucucgcgcgau

SEQ ID NO: 1065564 - RNA, 18 nt, Mycobacterium bovis subsp bovis AF2122/97
ugcgucguggggaccggc

SEQ ID NO: 1065565 - RNA, 13 nt, Mycobacterium bovis subsp bovis AF2122/97
ugcgucugcucgc

SEQ ID NO: 1065566 - RNA, 14 nt, Mycobacterium bovis subsp bovis AF2122/97
ugcgucggcccggu

SEQ ID NO: 1065567 - RNA, 17 nt, Mycobacterium bovis subsp bovis AF2122/97
ugcgucgaugcgcugcu

SEQ ID NO: 1065568 - RNA, 17 nt, Mycobacterium bovis subsp bovis AF2122/97
ugcgucgauggcgucgg

SEQ ID NO: 1065569 - RNA, 20 nt, Mycobacterium bovis subsp bovis AF2122/97
ugcgucgcggacggugcggu

SEQ ID NO: 1065570 - RNA, 19 nt, Mycobacterium bovis subsp bovis AF2122/97
ugcgggcgggaaccccggc

SEQ ID NO: 1065571 - RNA, 20 nt, Mycobacterium bovis subsp bovis AF2122/97
ugcgggcucaacaccagccg

SEQ ID NO: 1065572 - RNA, 20 nt, Mycobacterium bovis subsp bovis AF2122/97
ugcggggccgggcgaucgcc

SEQ ID NO: 1065573 - RNA, 13 nt, Mycobacterium bovis subsp bovis AF2122/97
ugcgggcucucgg

SEQ ID NO: 1065574 - RNA, 20 nt, Mycobacterium bovis subsp bovis AF2122/97
ugcgggggacgggucgccgc

SEQ ID NO: 1065575 - RNA, 17 nt, Mycobacterium bovis subsp bovis AF2122/97
ugcggggcgccugaugc

SEQ ID NO: 1065576 - RNA, 23 nt, Mycobacterium bovis subsp bovis AF2122/97
ugcggggcgccugaugcggccgg

SEQ ID NO: 1065577 - RNA, 14 nt, Mycobacterium bovis subsp bovis AF2122/97
ugcgggaucgccga

SEQ ID NO: 1065578 - RNA, 20 nt, Mycobacterium bovis subsp bovis AF2122/97
ugcgggcagcacucuucgau

SEQ ID NO: 1065579 - RNA, 15 nt, Mycobacterium bovis subsp bovis AF2122/97
ugcgggcaugccggc

SEQ ID NO: 1065580 - RNA, 15 nt, Mycobacterium bovis subsp bovis AF2122/97
ugcgggcgaucucga

SEQ ID NO: 1065581 - RNA, 21 nt, Mycobacterium bovis subsp bovis AF2122/97
ugcgggccaggcccucgacgg

SEQ ID NO: 1065582 - RNA, 22 nt, Mycobacterium bovis subsp bovis AF2122/97
ugcgggucccaaucgucggcca

SEQ ID NO: 1065583 - RNA, 20 nt, Mycobacterium bovis subsp bovis AF2122/97
ugcggguagccgucgauccc

SEQ ID NO: 1065584 - RNA, 14 nt, Mycobacterium bovis subsp bovis AF2122/97
ugcgggucucgccg

SEQ ID NO: 1065585 - RNA, 21 nt, Mycobacterium bovis subsp bovis AF2122/97
ugcgggucgugccccggcgcg

SEQ ID NO: 1065586 - RNA, 15 nt, Mycobacterium bovis subsp bovis AF2122/97
ugcgggucagcgccg

SEQ ID NO: 1065587 - RNA, 19 nt, Mycobacterium bovis subsp bovis AF2122/97
ugcggguaggugacgacgu

SEQ ID NO: 1065588 - RNA, 20 nt, Mycobacterium bovis subsp bovis AF2122/97
ugcggguaggugacgacguc

SEQ ID NO: 1065589 - RNA, 17 nt, Mycobacterium bovis subsp bovis AF2122/97
ugcggguaaaccaggug

SEQ ID NO: 1065590 - RNA, 15 nt, Mycobacterium bovis subsp bovis AF2122/97
ugcggguaacgauug

SEQ ID NO: 1065591 - RNA, 16 nt, Mycobacterium bovis subsp bovis AF2122/97
ugcggguaaaccaggu

SEQ ID NO: 1065592 - RNA, 18 nt, Mycobacterium bovis subsp bovis AF2122/97
ugcggggguugcggcagc

SEQ ID NO: 1065593 - RNA, 17 nt, Mycobacterium bovis subsp bovis AF2122/97
ugcggggugagugacca

SEQ ID NO: 1065594 - RNA, 16 nt, Mycobacterium bovis subsp bovis AF2122/97
ugcgguaaucgccacc

SEQ ID NO: 1065595 - RNA, 21 nt, Mycobacterium bovis subsp bovis AF2122/97
ugcgguaaucgccaccgcaag

SEQ ID NO: 1065596 - RNA, 20 nt, Mycobacterium bovis subsp bovis AF2122/97
ugcggguucacugccggcca

SEQ ID NO: 1065597 - RNA, 14 nt, Mycobacterium bovis subsp bovis AF2122/97
ugcgguaucgguca

SEQ ID NO: 1065598 - RNA, 17 nt, Mycobacterium bovis subsp bovis AF2122/97
ugcgggugcgucgauga

SEQ ID NO: 1065599 - RNA, 17 nt, Mycobacterium bovis subsp bovis AF2122/97
ugcgggugguccagccu

SEQ ID NO: 1065600 - RNA, 14 nt, Mycobacterium bovis subsp bovis AF2122/97
ugcgggugucgggc

SEQ ID NO: 1065601 - RNA, 19 nt, Mycobacterium bovis subsp bovis AF2122/97
ugcgggugggcacaccggu

SEQ ID NO: 1065602 - RNA, 20 nt, Mycobacterium bovis subsp bovis AF2122/97
ugcgguaagaaucgaagcgg

SEQ ID NO: 1065603 - RNA, 15 nt, Mycobacterium bovis subsp bovis AF2122/97
ugcggcuccggcggc

SEQ ID NO: 1065604 - RNA, 19 nt, Mycobacterium bovis subsp bovis AF2122/97
ugcggcguauugcggccug

SEQ ID NO: 1065605 - RNA, 22 nt, Mycobacterium bovis subsp bovis AF2122/97
ugcggcgucguucgagaccccg

SEQ ID NO: 1065606 - RNA, 13 nt, Mycobacterium bovis subsp bovis AF2122/97
ugcggcgguaugc

SEQ ID NO: 1065607 - RNA, 16 nt, Mycobacterium bovis subsp bovis AF2122/97
ugcggcugcguuggcu

SEQ ID NO: 1065608 - RNA, 16 nt, Mycobacterium bovis subsp bovis AF2122/97
ugcggcuauuggccug

SEQ ID NO: 1065609 - RNA, 23 nt, Mycobacterium bovis subsp bovis AF2122/97
ugcggcugaauucggcgagcgcc

SEQ ID NO: 1065610 - RNA, 23 nt, Mycobacterium bovis subsp bovis AF2122/97
ugcgggaauccggugaugaccgc

SEQ ID NO: 1065611 - RNA, 12 nt, Mycobacterium bovis subsp bovis AF2122/97
ugcggccccguc

SEQ ID NO: 1065612 - RNA, 21 nt, Mycobacterium bovis subsp bovis AF2122/97
ugcggcccucgagcagugccg

SEQ ID NO: 1065613 - RNA, 23 nt, Mycobacterium bovis subsp bovis AF2122/97
ugcggccccgacacagcggcggg

SEQ ID NO: 1065614 - RNA, 14 nt, Mycobacterium bovis subsp bovis AF2122/97
ugcggcaccgcuga

SEQ ID NO: 1065615 - RNA, 20 nt, Mycobacterium bovis subsp bovis AF2122/97
ugcggccccgacauacgucg

SEQ ID NO: 1065616 - RNA, 18 nt, Mycobacterium bovis subsp bovis AF2122/97
ugcggccgacgggugcgc

SEQ ID NO: 1065617 - RNA, 19 nt, Mycobacterium bovis subsp bovis AF2122/97
ugcggcggcccaucgaccg

SEQ ID NO: 1065618 - RNA, 15 nt, Mycobacterium bovis subsp bovis AF2122/97
ugcggccgcgcgccg

SEQ ID NO: 1065619 - RNA, 21 nt, Mycobacterium bovis subsp bovis AF2122/97
ugcggccgcgugccgcccgcc

SEQ ID NO: 1065620 - RNA, 18 nt, Mycobacterium bovis subsp bovis AF2122/97
ugcggcgcuggccagcag

SEQ ID NO: 1065621 - RNA, 14 nt, Mycobacterium bovis subsp bovis AF2122/97
ugcgcuuccaucgc

SEQ ID NO: 1065622 - RNA, 11 nt, Mycobacterium bovis subsp bovis AF2122/97
ugcgccgucag

SEQ ID NO: 1065623 - RNA, 15 nt, Mycobacterium bovis subsp bovis AF2122/97
ugcgccgguccucgu

SEQ ID NO: 1065624 - RNA, 17 nt, Mycobacterium bovis subsp bovis AF2122/97
ugcgccgaucccgccca

SEQ ID NO: 1065625 - RNA, 19 nt, Mycobacterium bovis subsp bovis AF2122/97
ugcgccggugaggugaugc

SEQ ID NO: 1065626 - RNA, 20 nt, Mycobacterium bovis subsp bovis AF2122/97
ugcgccguucgcucccccgc

SEQ ID NO: 1065627 - RNA, 16 nt, Mycobacterium bovis subsp bovis AF2122/97
ugcgccguugccgccg

SEQ ID NO: 1065628 - RNA, 17 nt, Mycobacterium bovis subsp bovis AF2122/97
ugcgccguugccgccgu

SEQ ID NO: 1065629 - RNA, 18 nt, Mycobacterium bovis subsp bovis AF2122/97
ugcggaacaccaccaggc

SEQ ID NO: 1065630 - RNA, 23 nt, Mycobacterium bovis subsp bovis AF2122/97
ugcggaucgauucgucgcggauc

SEQ ID NO: 1065631 - RNA, 15 nt, Mycobacterium bovis subsp bovis AF2122/97
ugcggaucggacaac

SEQ ID NO: 1065632 - RNA, 13 nt, Mycobacterium bovis subsp bovis AF2122/97
ugcggaucggcgg

SEQ ID NO: 1065633 - RNA, 20 nt, Mycobacterium bovis subsp bovis AF2122/97
ugcgcuuggucgaccgccga

SEQ ID NO: 1065634 - RNA, 19 nt, Mycobacterium bovis subsp bovis AF2122/97
ugcggaaacccggccgccg

SEQ ID NO: 1065635 - RNA, 17 nt, Mycobacterium bovis subsp bovis AF2122/97
ugcggcacccagucggc

SEQ ID NO: 1065636 - RNA, 18 nt, Mycobacterium bovis subsp bovis AF2122/97
ugcggcaacgaggucugc

SEQ ID NO: 1065637 - RNA, 15 nt, Mycobacterium bovis subsp bovis AF2122/97
ugcggcacgaucgcc

SEQ ID NO: 1065638 - RNA, 22 nt, Mycobacterium bovis subsp bovis AF2122/97
ugcggcaacgaggucugcggcc

SEQ ID NO: 1065639 - RNA, 14 nt, Mycobacterium bovis subsp bovis AF2122/97
ugcggcaagcgcac

SEQ ID NO: 1065640 - RNA, 16 nt, Mycobacterium bovis subsp bovis AF2122/97
ugcugcuugacuccgc

SEQ ID NO: 1065641 - RNA, 20 nt, Mycobacterium bovis subsp bovis AF2122/97
ugcuguggucggugccagca

SEQ ID NO: 1065642 - RNA, 14 nt, Mycobacterium bovis subsp bovis AF2122/97
ugcuggaucucggu

SEQ ID NO: 1065643 - RNA, 18 nt, Mycobacterium bovis subsp bovis AF2122/97
ugcugcgcgcggcggccg

SEQ ID NO: 1065644 - RNA, 17 nt, Mycobacterium bovis subsp bovis AF2122/97
ugcugcgggaauccggu

SEQ ID NO: 1065645 - RNA, 15 nt, Mycobacterium bovis subsp bovis AF2122/97
ugcugcgcggugccg

SEQ ID NO: 1065646 - RNA, 20 nt, Mycobacterium bovis subsp bovis AF2122/97
ugcugcuccuucucgcggac

SEQ ID NO: 1065647 - RNA, 20 nt, Mycobacterium bovis subsp bovis AF2122/97
ugcuucccggaugccgaccu

SEQ ID NO: 1065648 - RNA, 16 nt, Mycobacterium bovis subsp bovis AF2122/97
ugcuucgaccgccgug

SEQ ID NO: 1065649 - RNA, 14 nt, Mycobacterium bovis subsp bovis AF2122/97
ugcuugcagggcca

SEQ ID NO: 1065650 - RNA, 20 nt, Mycobacterium bovis subsp bovis AF2122/97
ugcuugaaacccaggccgua

SEQ ID NO: 1065651 - RNA, 15 nt, Mycobacterium bovis subsp bovis AF2122/97
ugcuuggucgcccag

SEQ ID NO: 1065652 - RNA, 15 nt, Mycobacterium bovis subsp bovis AF2122/97
ugcuuggcagcggug

SEQ ID NO: 1065653 - RNA, 18 nt, Mycobacterium bovis subsp bovis AF2122/97
ugcuuguguucgugguug

SEQ ID NO: 1065654 - RNA, 22 nt, Mycobacterium bovis subsp bovis AF2122/97
uggaacacgaagucgaacggcu

SEQ ID NO: 1065655 - RNA, 22 nt, Mycobacterium bovis subsp bovis AF2122/97
uggaaagcgcuuuagcggugug

SEQ ID NO: 1065656 - RNA, 12 nt, Mycobacterium bovis subsp bovis AF2122/97
ugcuuugcuggc

SEQ ID NO: 1065657 - RNA, 14 nt, Mycobacterium bovis subsp bovis AF2122/97
ugcuuugcuggcgc

SEQ ID NO: 1065658 - RNA, 15 nt, Mycobacterium bovis subsp bovis AF2122/97
uggaaacccgccgaa

SEQ ID NO: 1065659 - RNA, 14 nt, Mycobacterium bovis subsp bovis AF2122/97
ugcucgcgccggug

SEQ ID NO: 1065660 - RNA, 14 nt, Mycobacterium bovis subsp bovis AF2122/97
ugcucgcgcucguu

SEQ ID NO: 1065661 - RNA, 16 nt, Mycobacterium bovis subsp bovis AF2122/97
ugcucggauccggcca

SEQ ID NO: 1065662 - RNA, 15 nt, Mycobacterium bovis subsp bovis AF2122/97
ugcucgcuggcgcug

SEQ ID NO: 1065663 - RNA, 18 nt, Mycobacterium bovis subsp bovis AF2122/97
ugcucgcuggcgcugaug

SEQ ID NO: 1065664 - RNA, 21 nt, Mycobacterium bovis subsp bovis AF2122/97
ugcugagcugcucgccggcca

SEQ ID NO: 1065665 - RNA, 15 nt, Mycobacterium bovis subsp bovis AF2122/97
ugcugcaccuggcgc

SEQ ID NO: 1065666 - RNA, 19 nt, Mycobacterium bovis subsp bovis AF2122/97
ugcugcaccuggcgcagca

SEQ ID NO: 1065667 - RNA, 19 nt, Mycobacterium bovis subsp bovis AF2122/97
ugcugcacgcucugcgcca

SEQ ID NO: 1065668 - RNA, 23 nt, Mycobacterium bovis subsp bovis AF2122/97
ugcugcagacccguucgccgucg

SEQ ID NO: 1065669 - RNA, 19 nt, Mycobacterium bovis subsp bovis AF2122/97
ugcugaugaaacgccgucg

SEQ ID NO: 1065670 - RNA, 12 nt, Mycobacterium bovis subsp bovis AF2122/97
ugcugaugguga

SEQ ID NO: 1065671 - RNA, 16 nt, Mycobacterium bovis subsp bovis AF2122/97
ugcugaugucgccggu

SEQ ID NO: 1065672 - RNA, 17 nt, Mycobacterium bovis subsp bovis AF2122/97
ugcugaugucgccggug

SEQ ID NO: 1065673 - RNA, 13 nt, Mycobacterium bovis subsp bovis AF2122/97
ugcugcaaccgac

SEQ ID NO: 1065674 - RNA, 18 nt, Mycobacterium bovis subsp bovis AF2122/97
ugcugcaaccgacuucga

SEQ ID NO: 1065675 - RNA, 12 nt, Mycobacterium bovis subsp bovis AF2122/97
ugcucgccgggu

SEQ ID NO: 1065676 - RNA, 14 nt, Mycobacterium bovis subsp bovis AF2122/97
ugcucgccguggug

SEQ ID NO: 1065677 - RNA, 14 nt, Mycobacterium bovis subsp bovis AF2122/97
ugcucgcgcccgcu

SEQ ID NO: 1065678 - RNA, 13 nt, Mycobacterium bovis subsp bovis AF2122/97
ugcucgccgacca

SEQ ID NO: 1065679 - RNA, 21 nt, Mycobacterium bovis subsp bovis AF2122/97
ugcucgccaggcaagccagca

SEQ ID NO: 1065680 - RNA, 22 nt, Mycobacterium bovis subsp bovis AF2122/97
ugcucgccaggcaagccagcac

SEQ ID NO: 1065681 - RNA, 19 nt, Mycobacterium bovis subsp bovis AF2122/97
ugcucgccaggggaacgcu

SEQ ID NO: 1065682 - RNA, 23 nt, Mycobacterium bovis subsp bovis AF2122/97
ugcucgcacagcaccacgugcga

SEQ ID NO: 1065683 - RNA, 22 nt, Mycobacterium bovis subsp bovis AF2122/97
ugcucgaugcgacgaaccucgg

SEQ ID NO: 1065684 - RNA, 16 nt, Mycobacterium bovis subsp bovis AF2122/97
ugcucgacaaccacgg

SEQ ID NO: 1065685 - RNA, 17 nt, Mycobacterium bovis subsp bovis AF2122/97
ugcucgacacuggacgc

SEQ ID NO: 1065686 - RNA, 16 nt, Mycobacterium bovis subsp bovis AF2122/97
ugcuccugcguccaga

SEQ ID NO: 1065687 - RNA, 17 nt, Mycobacterium bovis subsp bovis AF2122/97
ugcuccuucucgcggac

SEQ ID NO: 1065688 - RNA, 19 nt, Mycobacterium bovis subsp bovis AF2122/97
ugcuccucgcgggcggcgu

SEQ ID NO: 1065689 - RNA, 18 nt, Mycobacterium bovis subsp bovis AF2122/97
ugcuccucggucagcggg

SEQ ID NO: 1065690 - RNA, 14 nt, Mycobacterium bovis subsp bovis AF2122/97
ugcucgacgcccgc

SEQ ID NO: 1065691 - RNA, 12 nt, Mycobacterium bovis subsp bovis AF2122/97
ugcucgacgcgc

SEQ ID NO: 1065692 - RNA, 20 nt, Mycobacterium bovis subsp bovis AF2122/97
ugcucgauaucguuggcgac

SEQ ID NO: 1065693 - RNA, 19 nt, Mycobacterium bovis subsp bovis AF2122/97
ugcuccaaaucggcaucgg

SEQ ID NO: 1065694 - RNA, 13 nt, Mycobacterium bovis subsp bovis AF2122/97
ugcuccagcgacg

SEQ ID NO: 1065695 - RNA, 17 nt, Mycobacterium bovis subsp bovis AF2122/97
ugcucccggccgccgag

SEQ ID NO: 1065696 - RNA, 13 nt, Mycobacterium bovis subsp bovis AF2122/97
ugcucccacguga

SEQ ID NO: 1065697 - RNA, 16 nt, Mycobacterium bovis subsp bovis AF2122/97
ugcuccgguuggcgcg

SEQ ID NO: 1065698 - RNA, 12 nt, Mycobacterium bovis subsp bovis AF2122/97
ugcguuacgccg

SEQ ID NO: 1065699 - RNA, 17 nt, Mycobacterium bovis subsp bovis AF2122/97
ugcguuacgccgcgaga

SEQ ID NO: 1065700 - RNA, 21 nt, Mycobacterium bovis subsp bovis AF2122/97
uugauggcguauagcaugccg

SEQ ID NO: 1065701 - RNA, 23 nt, Mycobacterium bovis subsp bovis AF2122/97
uugauguagagcauucgggcgcc

SEQ ID NO: 1065702 - RNA, 18 nt, Mycobacterium bovis subsp bovis AF2122/97
uucuuccgcgcgccggcg

SEQ ID NO: 1065703 - RNA, 15 nt, Mycobacterium bovis subsp bovis AF2122/97
uucuggucgcguacc

SEQ ID NO: 1065704 - RNA, 22 nt, Mycobacterium bovis subsp bovis AF2122/97
uucuguaccggcugguugaccg

SEQ ID NO: 1065705 - RNA, 21 nt, Mycobacterium bovis subsp bovis AF2122/97
uucugugucugcucgcgccgc

SEQ ID NO: 1065706 - RNA, 22 nt, Mycobacterium bovis subsp bovis AF2122/97
uucuggucgaaauugggugccg

SEQ ID NO: 1065707 - RNA, 13 nt, Mycobacterium bovis subsp bovis AF2122/97
uugcaccaggggc

SEQ ID NO: 1065708 - RNA, 18 nt, Mycobacterium bovis subsp bovis AF2122/97
uugcaacaccccgagccg

SEQ ID NO: 1065709 - RNA, 16 nt, Mycobacterium bovis subsp bovis AF2122/97
uugcaggaaaucgucc

SEQ ID NO: 1065710 - RNA, 14 nt, Mycobacterium bovis subsp bovis AF2122/97
uugcagcuucggcc

SEQ ID NO: 1065711 - RNA, 15 nt, Mycobacterium bovis subsp bovis AF2122/97
uugcagcucgauccg

SEQ ID NO: 1065712 - RNA, 16 nt, Mycobacterium bovis subsp bovis AF2122/97
uugcaggcgcagcugg

SEQ ID NO: 1065713 - RNA, 24 nt, Mycobacterium bovis subsp bovis AF2122/97
uugcaggcgucccagccgaucacg

SEQ ID NO: 1065714 - RNA, 24 nt, Mycobacterium bovis subsp bovis AF2122/97
uugcaguaacuucaccggcucguc

SEQ ID NO: 1065715 - RNA, 21 nt, Mycobacterium bovis subsp bovis AF2122/97
uugcaucaaaaacgaacccag

SEQ ID NO: 1065716 - RNA, 19 nt, Mycobacterium bovis subsp bovis AF2122/97
uugcgccaggagcgcggcc

SEQ ID NO: 1065717 - RNA, 15 nt, Mycobacterium bovis subsp bovis AF2122/97
uugccgucugcgguc

SEQ ID NO: 1065718 - RNA, 20 nt, Mycobacterium bovis subsp bovis AF2122/97
uugccgugcucaccggcgcc

SEQ ID NO: 1065719 - RNA, 15 nt, Mycobacterium bovis subsp bovis AF2122/97
uugccggcguugccg

SEQ ID NO: 1065720 - RNA, 17 nt, Mycobacterium bovis subsp bovis AF2122/97
uugccggcuucggcgag

SEQ ID NO: 1065721 - RNA, 17 nt, Mycobacterium bovis subsp bovis AF2122/97
uugccggcgguggccga

SEQ ID NO: 1065722 - RNA, 13 nt, Mycobacterium bovis subsp bovis AF2122/97
uugccggcguugc

SEQ ID NO: 1065723 - RNA, 16 nt, Mycobacterium bovis subsp bovis AF2122/97
uugccggugccgccgc

SEQ ID NO: 1065724 - RNA, 20 nt, Mycobacterium bovis subsp bovis AF2122/97
uugccggugccgccgcggcc

SEQ ID NO: 1065725 - RNA, 19 nt, Mycobacterium bovis subsp bovis AF2122/97
uugccgggcgcacgcccgc

SEQ ID NO: 1065726 - RNA, 17 nt, Mycobacterium bovis subsp bovis AF2122/97
uugccggagacgucgcc

SEQ ID NO: 1065727 - RNA, 11 nt, Mycobacterium bovis subsp bovis AF2122/97
uugccgccguc

SEQ ID NO: 1065728 - RNA, 18 nt, Mycobacterium bovis subsp bovis AF2122/97
uugccgccguuaccgccg

SEQ ID NO: 1065729 - RNA, 20 nt, Mycobacterium bovis subsp bovis AF2122/97
uugccgccggcgccgccggc

SEQ ID NO: 1065730 - RNA, 21 nt, Mycobacterium bovis subsp bovis AF2122/97
uugccgccggcgccgccggcg

SEQ ID NO: 1065731 - RNA, 15 nt, Mycobacterium bovis subsp bovis AF2122/97
uugccgccggugccg

SEQ ID NO: 1065732 - RNA, 21 nt, Mycobacterium bovis subsp bovis AF2122/97
uugccgccugguaccgcggug

SEQ ID NO: 1065733 - RNA, 14 nt, Mycobacterium bovis subsp bovis AF2122/97
uugccgccuuugcc

SEQ ID NO: 1065734 - RNA, 19 nt, Mycobacterium bovis subsp bovis AF2122/97
uugccgcgguugugcuggg

SEQ ID NO: 1065735 - RNA, 20 nt, Mycobacterium bovis subsp bovis AF2122/97
uugccgccgaacgccucugc

SEQ ID NO: 1065736 - RNA, 16 nt, Mycobacterium bovis subsp bovis AF2122/97
uugccgccgcggcgcc

SEQ ID NO: 1065737 - RNA, 21 nt, Mycobacterium bovis subsp bovis AF2122/97
uugccgccggccccgccggcg

SEQ ID NO: 1065738 - RNA, 23 nt, Mycobacterium bovis subsp bovis AF2122/97
uugccgccggccccgccgucgcc

SEQ ID NO: 1065739 - RNA, 20 nt, Mycobacterium bovis subsp bovis AF2122/97
uugccgccgacgccgccggc

SEQ ID NO: 1065740 - RNA, 20 nt, Mycobacterium bovis subsp bovis AF2122/97
uugccgaaccacgcgcccgc

SEQ ID NO: 1065741 - RNA, 18 nt, Mycobacterium bovis subsp bovis AF2122/97
uugccgaacgucgcggcc

SEQ ID NO: 1065742 - RNA, 16 nt, Mycobacterium bovis subsp bovis AF2122/97
uugccgacgcgcggcc

SEQ ID NO: 1065743 - RNA, 14 nt, Mycobacterium bovis subsp bovis AF2122/97
uugcccuagcagca

SEQ ID NO: 1065744 - RNA, 15 nt, Mycobacterium bovis subsp bovis AF2122/97
uugcccgccgcguca

SEQ ID NO: 1065745 - RNA, 19 nt, Mycobacterium bovis subsp bovis AF2122/97
uugccagucgaucgcggcc

SEQ ID NO: 1065746 - RNA, 17 nt, Mycobacterium bovis subsp bovis AF2122/97
uugccaggaccgcgccg

SEQ ID NO: 1065747 - RNA, 16 nt, Mycobacterium bovis subsp bovis AF2122/97
uugccccgccuuggcc

SEQ ID NO: 1065748 - RNA, 22 nt, Mycobacterium bovis subsp bovis AF2122/97
uugcccacggcgaccacgccgc

SEQ ID NO: 1065749 - RNA, 17 nt, Mycobacterium bovis subsp bovis AF2122/97
uugccaccgguaccgcc

SEQ ID NO: 1065750 - RNA, 18 nt, Mycobacterium bovis subsp bovis AF2122/97
uugccaccgguaccgccg

SEQ ID NO: 1065751 - RNA, 18 nt, Mycobacterium bovis subsp bovis AF2122/97
uugccaccggugccggcg

SEQ ID NO: 1065752 - RNA, 14 nt, Mycobacterium bovis subsp bovis AF2122/97
uugccacggcgccu

SEQ ID NO: 1065753 - RNA, 14 nt, Mycobacterium bovis subsp bovis AF2122/97
aauccgcccaccgg

SEQ ID NO: 1065754 - RNA, 16 nt, Mycobacterium bovis subsp bovis AF2122/97
aauccgcccuaaugaa

SEQ ID NO: 1065755 - RNA, 17 nt, Mycobacterium bovis subsp bovis AF2122/97
aauccgaacucgcgggc

SEQ ID NO: 1065756 - RNA, 13 nt, Mycobacterium bovis subsp bovis AF2122/97
aauccgagccgcg

SEQ ID NO: 1065757 - RNA, 16 nt, Mycobacterium bovis subsp bovis AF2122/97
aauccgcacagcgacg

SEQ ID NO: 1065758 - RNA, 15 nt, Mycobacterium bovis subsp bovis AF2122/97
aaucccgcgcccggc

SEQ ID NO: 1065759 - RNA, 14 nt, Mycobacterium bovis subsp bovis AF2122/97
aaucccucggccgc

SEQ ID NO: 1065760 - RNA, 18 nt, Mycobacterium bovis subsp bovis AF2122/97
uuggcgacgucggcggug

SEQ ID NO: 1065761 - RNA, 20 nt, Mycobacterium bovis subsp bovis AF2122/97
uuggcgacgucggcggugac

SEQ ID NO: 1065762 - RNA, 13 nt, Mycobacterium bovis subsp bovis AF2122/97
uuggcgaccaugc

SEQ ID NO: 1065763 - RNA, 20 nt, Mycobacterium bovis subsp bovis AF2122/97
uuggcgacgaagaagaacuc

SEQ ID NO: 1065764 - RNA, 16 nt, Mycobacterium bovis subsp bovis AF2122/97
uuggcgaucagcagcc

SEQ ID NO: 1065765 - RNA, 23 nt, Mycobacterium bovis subsp bovis AF2122/97
uuggcgacuucuucgcgcaacca

SEQ ID NO: 1065766 - RNA, 16 nt, Mycobacterium bovis subsp bovis AF2122/97
uuggcgcccgaagccg

SEQ ID NO: 1065767 - RNA, 12 nt, Mycobacterium bovis subsp bovis AF2122/97
uuggcgcccgcc

SEQ ID NO: 1065768 - RNA, 20 nt, Mycobacterium bovis subsp bovis AF2122/97
uuggcggcaggugcggcggc

SEQ ID NO: 1065769 - RNA, 19 nt, Mycobacterium bovis subsp bovis AF2122/97
uugggggcuucugcgucug

SEQ ID NO: 1065770 - RNA, 20 nt, Mycobacterium bovis subsp bovis AF2122/97
uugggggcuucugcgucugc

SEQ ID NO: 1065771 - RNA, 21 nt, Mycobacterium bovis subsp bovis AF2122/97
uuggcgccguuaccgccguug

SEQ ID NO: 1065772 - RNA, 20 nt, Mycobacterium bovis subsp bovis AF2122/97
uuggcgcccgccggcaaccg

SEQ ID NO: 1065773 - RNA, 14 nt, Mycobacterium bovis subsp bovis AF2122/97
uugguccgccgucg

SEQ ID NO: 1065774 - RNA, 11 nt, Mycobacterium bovis subsp bovis AF2122/97
uuggucgccau

SEQ ID NO: 1065775 - RNA, 13 nt, Mycobacterium bovis subsp bovis AF2122/97
uuggguuucgaca

SEQ ID NO: 1065776 - RNA, 20 nt, Mycobacterium bovis subsp bovis AF2122/97
uugggugccguugcgucugc

SEQ ID NO: 1065777 - RNA, 19 nt, Mycobacterium bovis subsp bovis AF2122/97
uuggguagccugaccagcc

SEQ ID NO: 1065778 - RNA, 13 nt, Mycobacterium bovis subsp bovis AF2122/97
uuggguagcggau

SEQ ID NO: 1065779 - RNA, 17 nt, Mycobacterium bovis subsp bovis AF2122/97
uuggccaccaucgccgc

SEQ ID NO: 1065780 - RNA, 16 nt, Mycobacterium bovis subsp bovis AF2122/97
uuggcaugccgcccgc

SEQ ID NO: 1065781 - RNA, 19 nt, Mycobacterium bovis subsp bovis AF2122/97
uugcgccggaugacaccga

SEQ ID NO: 1065782 - RNA, 16 nt, Mycobacterium bovis subsp bovis AF2122/97
uuggcaccagccggug

SEQ ID NO: 1065783 - RNA, 15 nt, Mycobacterium bovis subsp bovis AF2122/97
uuggcagagccgacu

SEQ ID NO: 1065784 - RNA, 15 nt, Mycobacterium bovis subsp bovis AF2122/97
uuggccaggaagucc

SEQ ID NO: 1065785 - RNA, 16 nt, Mycobacterium bovis subsp bovis AF2122/97
uuggccagcagcgcgg

SEQ ID NO: 1065786 - RNA, 22 nt, Mycobacterium bovis subsp bovis AF2122/97
uuggccaggucggccaccgugg

SEQ ID NO: 1065787 - RNA, 21 nt, Mycobacterium bovis subsp bovis AF2122/97
aauccccugcgcugcagcuga

SEQ ID NO: 1065788 - RNA, 19 nt, Mycobacterium bovis subsp bovis AF2122/97
aauccacuccagcgaaccg

SEQ ID NO: 1065789 - RNA, 17 nt, Mycobacterium bovis subsp bovis AF2122/97
aauccacgcacucgucg

SEQ ID NO: 1065790 - RNA, 23 nt, Mycobacterium bovis subsp bovis AF2122/97
aauccaccagccgguagccgggc

SEQ ID NO: 1065791 - RNA, 16 nt, Mycobacterium bovis subsp bovis AF2122/97
aauccaggccaccccg

SEQ ID NO: 1065792 - RNA, 19 nt, Mycobacterium bovis subsp bovis AF2122/97
aauccagccgcgcgccggc

SEQ ID NO: 1065793 - RNA, 12 nt, Mycobacterium bovis subsp bovis AF2122/97
aauccagcgccg

SEQ ID NO: 1065794 - RNA, 21 nt, Mycobacterium bovis subsp bovis AF2122/97
aaucgauuccgggugcgaucg

SEQ ID NO: 1065795 - RNA, 16 nt, Mycobacterium bovis subsp bovis AF2122/97
aaucgagcgcggcaac

SEQ ID NO: 1065796 - RNA, 18 nt, Mycobacterium bovis subsp bovis AF2122/97
uugucaccggcuucggcc

SEQ ID NO: 1065797 - RNA, 18 nt, Mycobacterium bovis subsp bovis AF2122/97
uugucacgcaccgcggug

SEQ ID NO: 1065798 - RNA, 13 nt, Mycobacterium bovis subsp bovis AF2122/97
uugucacugcggc

SEQ ID NO: 1065799 - RNA, 12 nt, Mycobacterium bovis subsp bovis AF2122/97
aaucgaccgccg

SEQ ID NO: 1065800 - RNA, 13 nt, Mycobacterium bovis subsp bovis AF2122/97
aaucgacucagcc

SEQ ID NO: 1065801 - RNA, 15 nt, Mycobacterium bovis subsp bovis AF2122/97
aaucgacugaucgaa

SEQ ID NO: 1065802 - RNA, 16 nt, Mycobacterium bovis subsp bovis AF2122/97
uuggugaccgggucga

SEQ ID NO: 1065803 - RNA, 22 nt, Mycobacterium bovis subsp bovis AF2122/97
uuggugagguggucagccggug

SEQ ID NO: 1065804 - RNA, 16 nt, Mycobacterium bovis subsp bovis AF2122/97
uuggucgccggcgucg

SEQ ID NO: 1065805 - RNA, 16 nt, Mycobacterium bovis subsp bovis AF2122/97
uuggucuucgccgucg

SEQ ID NO: 1065806 - RNA, 21 nt, Mycobacterium bovis subsp bovis AF2122/97
uuggugauugcggccgccgag

SEQ ID NO: 1065807 - RNA, 11 nt, Mycobacterium bovis subsp bovis AF2122/97
uuggugcuggc

SEQ ID NO: 1065808 - RNA, 22 nt, Mycobacterium bovis subsp bovis AF2122/97
uuggugccgccaccaccggcgc

SEQ ID NO: 1065809 - RNA, 18 nt, Mycobacterium bovis subsp bovis AF2122/97
uugguuagccgcggcccg

SEQ ID NO: 1065810 - RNA, 15 nt, Mycobacterium bovis subsp bovis AF2122/97
uugguggucgccacc

SEQ ID NO: 1065811 - RNA, 13 nt, Mycobacterium bovis subsp bovis AF2122/97
uugguguccacca

SEQ ID NO: 1065812 - RNA, 17 nt, Mycobacterium bovis subsp bovis AF2122/97
uugguguggcccaaccg

SEQ ID NO: 1065813 - RNA, 18 nt, Mycobacterium bovis subsp bovis AF2122/97
uuguaugcugcgcgccgu

SEQ ID NO: 1065814 - RNA, 19 nt, Mycobacterium bovis subsp bovis AF2122/97
uugucggcuggacggcgcc

SEQ ID NO: 1065815 - RNA, 17 nt, Mycobacterium bovis subsp bovis AF2122/97
uugucggccccggccgc

SEQ ID NO: 1065816 - RNA, 11 nt, Mycobacterium bovis subsp bovis AF2122/97
uugucggcgau

SEQ ID NO: 1065817 - RNA, 21 nt, Mycobacterium bovis subsp bovis AF2122/97
uugucggcaacgacccgccgc

SEQ ID NO: 1065818 - RNA, 22 nt, Mycobacterium bovis subsp bovis AF2122/97
uugucgagcaggcccaacgcga

SEQ ID NO: 1065819 - RNA, 19 nt, Mycobacterium bovis subsp bovis AF2122/97
uugucggagcuagacccgu

SEQ ID NO: 1065820 - RNA, 18 nt, Mycobacterium bovis subsp bovis AF2122/97
uugucgucgccggcggcg

SEQ ID NO: 1065821 - RNA, 21 nt, Mycobacterium bovis subsp bovis AF2122/97
uugucugcccgauacccggug

SEQ ID NO: 1065822 - RNA, 23 nt, Mycobacterium bovis subsp bovis AF2122/97
uugucgaucugcccccgccggcc

SEQ ID NO: 1065823 - RNA, 20 nt, Mycobacterium bovis subsp bovis AF2122/97
uugugacaccacaucgggcc

SEQ ID NO: 1065824 - RNA, 22 nt, Mycobacterium bovis subsp bovis AF2122/97
uugugcucgccgauuuggccgu

SEQ ID NO: 1065825 - RNA, 14 nt, Mycobacterium bovis subsp bovis AF2122/97
uugugcggccccgu

SEQ ID NO: 1065826 - RNA, 15 nt, Mycobacterium bovis subsp bovis AF2122/97
uuuccaucgcgaccu

SEQ ID NO: 1065827 - RNA, 12 nt, Mycobacterium bovis subsp bovis AF2122/97
uuuccagccgac

SEQ ID NO: 1065828 - RNA, 19 nt, Mycobacterium bovis subsp bovis AF2122/97
uuugggcgauuuugcgucu

SEQ ID NO: 1065829 - RNA, 14 nt, Mycobacterium bovis subsp bovis AF2122/97
uuugggucggcgau

SEQ ID NO: 1065830 - RNA, 11 nt, Mycobacterium bovis subsp bovis AF2122/97
uuugccggcuu

SEQ ID NO: 1065831 - RNA, 16 nt, Mycobacterium bovis subsp bovis AF2122/97
uuugccaucgggaccg

SEQ ID NO: 1065832 - RNA, 22 nt, Mycobacterium bovis subsp bovis AF2122/97
uuugccgccggcaccgccggug

SEQ ID NO: 1065833 - RNA, 13 nt, Mycobacterium bovis subsp bovis AF2122/97
uuugagcggccac

SEQ ID NO: 1065834 - RNA, 19 nt, Mycobacterium bovis subsp bovis AF2122/97
uuugagcagguaggcgcga

SEQ ID NO: 1065835 - RNA, 15 nt, Mycobacterium bovis subsp bovis AF2122/97
uuugauaggcgcgca

SEQ ID NO: 1065836 - RNA, 18 nt, Mycobacterium bovis subsp bovis AF2122/97
uuugacgcccucggcgac

SEQ ID NO: 1065837 - RNA, 21 nt, Mycobacterium bovis subsp bovis AF2122/97
aaucgcucugugucgccgauc

SEQ ID NO: 1065838 - RNA, 14 nt, Mycobacterium bovis subsp bovis AF2122/97
aaucgcugaccgcg

SEQ ID NO: 1065839 - RNA, 17 nt, Mycobacterium bovis subsp bovis AF2122/97
aaucgcugccgccgauc

SEQ ID NO: 1065840 - RNA, 14 nt, Mycobacterium bovis subsp bovis AF2122/97
aaucggcaucggcg

SEQ ID NO: 1065841 - RNA, 13 nt, Mycobacterium bovis subsp bovis AF2122/97
aaucggccaucau

SEQ ID NO: 1065842 - RNA, 23 nt, Mycobacterium bovis subsp bovis AF2122/97
aaucggcccgugccacagcucgc

SEQ ID NO: 1065843 - RNA, 17 nt, Mycobacterium bovis subsp bovis AF2122/97
aaucggccugccggcag

SEQ ID NO: 1065844 - RNA, 21 nt, Mycobacterium bovis subsp bovis AF2122/97
aaucgcgagcuuggccggcag

SEQ ID NO: 1065845 - RNA, 23 nt, Mycobacterium bovis subsp bovis AF2122/97
aaucgcgaacgaagucgacgaac

SEQ ID NO: 1065846 - RNA, 13 nt, Mycobacterium bovis subsp bovis AF2122/97
aaucgcgucgaga

SEQ ID NO: 1065847 - RNA, 13 nt, Mycobacterium bovis subsp bovis AF2122/97
aaucgcgucgagc

SEQ ID NO: 1065848 - RNA, 20 nt, Mycobacterium bovis subsp bovis AF2122/97
aaucgcgucgagcgccggcc

SEQ ID NO: 1065849 - RNA, 15 nt, Mycobacterium bovis subsp bovis AF2122/97
aaucgccugcgacag

SEQ ID NO: 1065850 - RNA, 22 nt, Mycobacterium bovis subsp bovis AF2122/97
aaucgguggucgauggacaaca

SEQ ID NO: 1065851 - RNA, 13 nt, Mycobacterium bovis subsp bovis AF2122/97
aaucgguggucgu

SEQ ID NO: 1065852 - RNA, 15 nt, Mycobacterium bovis subsp bovis AF2122/97
aaucgguggugcggu

SEQ ID NO: 1065853 - RNA, 22 nt, Mycobacterium bovis subsp bovis AF2122/97
aaucguuccgcagucugacgaa

SEQ ID NO: 1065854 - RNA, 23 nt, Mycobacterium bovis subsp bovis AF2122/97
aaucgugcggguaauacggcgcc

SEQ ID NO: 1065855 - RNA, 13 nt, Mycobacterium bovis subsp bovis AF2122/97
aaugaaccgcacc

SEQ ID NO: 1065856 - RNA, 15 nt, Mycobacterium bovis subsp bovis AF2122/97
aaugaaggcaccgaa

SEQ ID NO: 1065857 - RNA, 22 nt, Mycobacterium bovis subsp bovis AF2122/97
aaugacaucgucgccagggccg

SEQ ID NO: 1065858 - RNA, 17 nt, Mycobacterium bovis subsp bovis AF2122/97
aaugacccacacaccga

SEQ ID NO: 1065859 - RNA, 21 nt, Mycobacterium bovis subsp bovis AF2122/97
aauggccgccgcagcuccccg

SEQ ID NO: 1065860 - RNA, 17 nt, Mycobacterium bovis subsp bovis AF2122/97
aauggcggacagggcgg

SEQ ID NO: 1065861 - RNA, 19 nt, Mycobacterium bovis subsp bovis AF2122/97
aauggcggacagggcggca

SEQ ID NO: 1065862 - RNA, 21 nt, Mycobacterium bovis subsp bovis AF2122/97
aauggcugagcccgccgcgac

SEQ ID NO: 1065863 - RNA, 16 nt, Mycobacterium bovis subsp bovis AF2122/97
aauggcgucgccggca

SEQ ID NO: 1065864 - RNA, 21 nt, Mycobacterium bovis subsp bovis AF2122/97
aauggcgucgccggcaccggc

SEQ ID NO: 1065865 - RNA, 18 nt, Mycobacterium bovis subsp bovis AF2122/97
aauggcgccggccggcag

SEQ ID NO: 1065866 - RNA, 21 nt, Mycobacterium bovis subsp bovis AF2122/97
aauggcgccggccggcgcggu

SEQ ID NO: 1065867 - RNA, 16 nt, Mycobacterium bovis subsp bovis AF2122/97
aauguccaggcgcgca

SEQ ID NO: 1065868 - RNA, 16 nt, Mycobacterium bovis subsp bovis AF2122/97
aaugucgacaccggcg

SEQ ID NO: 1065869 - RNA, 16 nt, Mycobacterium bovis subsp bovis AF2122/97
aaugucgccgccuggc

SEQ ID NO: 1065870 - RNA, 23 nt, Mycobacterium bovis subsp bovis AF2122/97
aaugucggcgaugcguccgccca

SEQ ID NO: 1065871 - RNA, 17 nt, Mycobacterium bovis subsp bovis AF2122/97
aaugucuucgccgucac

SEQ ID NO: 1065872 - RNA, 20 nt, Mycobacterium bovis subsp bovis AF2122/97
aaugucuuuggucgccggac

SEQ ID NO: 1065873 - RNA, 23 nt, Mycobacterium bovis subsp bovis AF2122/97
aaugguggcguccagggcgccga

SEQ ID NO: 1065874 - RNA, 22 nt, Mycobacterium bovis subsp bovis AF2122/97
aaugcgcuggcgccgccggugc

SEQ ID NO: 1065875 - RNA, 22 nt, Mycobacterium bovis subsp bovis AF2122/97
aaugcgcugucgcccucgaucg

SEQ ID NO: 1065876 - RNA, 18 nt, Mycobacterium bovis subsp bovis AF2122/97
aaugcgcuugaugccggc

SEQ ID NO: 1065877 - RNA, 19 nt, Mycobacterium bovis subsp bovis AF2122/97
aaugccuggcccgucggcg

SEQ ID NO: 1065878 - RNA, 14 nt, Mycobacterium bovis subsp bovis AF2122/97
aaugccugcugguc

SEQ ID NO: 1065879 - RNA, 16 nt, Mycobacterium bovis subsp bovis AF2122/97
aauggccagcaccacg

SEQ ID NO: 1065880 - RNA, 16 nt, Mycobacterium bovis subsp bovis AF2122/97
aaugcgguccucgauc

SEQ ID NO: 1065881 - RNA, 22 nt, Mycobacterium bovis subsp bovis AF2122/97
aaugacgucggaccagcugccg

SEQ ID NO: 1065882 - RNA, 17 nt, Mycobacterium bovis subsp bovis AF2122/97
ugugacggcggccacgu

SEQ ID NO: 1065883 - RNA, 19 nt, Mycobacterium bovis subsp bovis AF2122/97
ugugacggaggucggagcg

SEQ ID NO: 1065884 - RNA, 12 nt, Mycobacterium bovis subsp bovis AF2122/97
ugugagcagacc

SEQ ID NO: 1065885 - RNA, 21 nt, Mycobacterium bovis subsp bovis AF2122/97
ugugagggaggccccccgggg

SEQ ID NO: 1065886 - RNA, 19 nt, Mycobacterium bovis subsp bovis AF2122/97
ugugaaucgcacgacgcga

SEQ ID NO: 1065887 - RNA, 14 nt, Mycobacterium bovis subsp bovis AF2122/97
ugugcacggugugc

SEQ ID NO: 1065888 - RNA, 22 nt, Mycobacterium bovis subsp bovis AF2122/97
ugugcagcgagucgggguacag

SEQ ID NO: 1065889 - RNA, 19 nt, Mycobacterium bovis subsp bovis AF2122/97
ugugcagguggccgucgcc

SEQ ID NO: 1065890 - RNA, 23 nt, Mycobacterium bovis subsp bovis AF2122/97
ugugcaacggugaaucgaagccc

SEQ ID NO: 1065891 - RNA, 21 nt, Mycobacterium bovis subsp bovis AF2122/97
ugugcaaugugggcgcgucga

SEQ ID NO: 1065892 - RNA, 16 nt, Mycobacterium bovis subsp bovis AF2122/97
ugucguuguacggggc

SEQ ID NO: 1065893 - RNA, 19 nt, Mycobacterium bovis subsp bovis AF2122/97
ugucugcccgauacccggu

SEQ ID NO: 1065894 - RNA, 20 nt, Mycobacterium bovis subsp bovis AF2122/97
ugucucggugccuagugcca

SEQ ID NO: 1065895 - RNA, 19 nt, Mycobacterium bovis subsp bovis AF2122/97
ugucucccuugccgccauu

SEQ ID NO: 1065896 - RNA, 18 nt, Mycobacterium bovis subsp bovis AF2122/97
ugucuccggcaacagcac

SEQ ID NO: 1065897 - RNA, 20 nt, Mycobacterium bovis subsp bovis AF2122/97
ugucuaccaacaccgcccgc

SEQ ID NO: 1065898 - RNA, 14 nt, Mycobacterium bovis subsp bovis AF2122/97
ugucuuagccagca

SEQ ID NO: 1065899 - RNA, 24 nt, Mycobacterium bovis subsp bovis AF2122/97
ugucgggcucgcauucggcgagcc

SEQ ID NO: 1065900 - RNA, 19 nt, Mycobacterium bovis subsp bovis AF2122/97
ugucggcuggacggcgccg

SEQ ID NO: 1065901 - RNA, 15 nt, Mycobacterium bovis subsp bovis AF2122/97
ugucggcuagcaacg

SEQ ID NO: 1065902 - RNA, 13 nt, Mycobacterium bovis subsp bovis AF2122/97
ugucacccgcccg

SEQ ID NO: 1065903 - RNA, 18 nt, Mycobacterium bovis subsp bovis AF2122/97
ugucagccgguuccgcaa

SEQ ID NO: 1065904 - RNA, 17 nt, Mycobacterium bovis subsp bovis AF2122/97
ugucaccggcuucggcc

SEQ ID NO: 1065905 - RNA, 22 nt, Mycobacterium bovis subsp bovis AF2122/97
ugucaccggcuucggccagcag

SEQ ID NO: 1065906 - RNA, 14 nt, Mycobacterium bovis subsp bovis AF2122/97
ugucacgcgaccac

SEQ ID NO: 1065907 - RNA, 21 nt, Mycobacterium bovis subsp bovis AF2122/97
ugucacgcgaccaccgccgag

SEQ ID NO: 1065908 - RNA, 22 nt, Mycobacterium bovis subsp bovis AF2122/97
ugucaaugacaccggggcagau

SEQ ID NO: 1065909 - RNA, 17 nt, Mycobacterium bovis subsp bovis AF2122/97
uguaguccugcgggccg

SEQ ID NO: 1065910 - RNA, 22 nt, Mycobacterium bovis subsp bovis AF2122/97
ugucaacccggaaguugaucuu

SEQ ID NO: 1065911 - RNA, 13 nt, Mycobacterium bovis subsp bovis AF2122/97
ugucaacggcacc

SEQ ID NO: 1065912 - RNA, 17 nt, Mycobacterium bovis subsp bovis AF2122/97
ugucaaccaagugaccg

SEQ ID NO: 1065913 - RNA, 16 nt, Mycobacterium bovis subsp bovis AF2122/97
ugucgguggccgcggc

SEQ ID NO: 1065914 - RNA, 20 nt, Mycobacterium bovis subsp bovis AF2122/97
ugucggugguaccggcggcg

SEQ ID NO: 1065915 - RNA, 22 nt, Mycobacterium bovis subsp bovis AF2122/97
ugucggugguaccggcggcgcc

SEQ ID NO: 1065916 - RNA, 15 nt, Mycobacterium bovis subsp bovis AF2122/97
ugucggugccgucga

SEQ ID NO: 1065917 - RNA, 14 nt, Mycobacterium bovis subsp bovis AF2122/97
ugucggugcgcggc

SEQ ID NO: 1065918 - RNA, 18 nt, Mycobacterium bovis subsp bovis AF2122/97
ugucggucggaucggcgc

SEQ ID NO: 1065919 - RNA, 23 nt, Mycobacterium bovis subsp bovis AF2122/97
ugucggugacaccaacaccggug

SEQ ID NO: 1065920 - RNA, 20 nt, Mycobacterium bovis subsp bovis AF2122/97
ugucgggggcuuuuacgucu

SEQ ID NO: 1065921 - RNA, 20 nt, Mycobacterium bovis subsp bovis AF2122/97
ugucgggggcuuaugcgucu

SEQ ID NO: 1065922 - RNA, 19 nt, Mycobacterium bovis subsp bovis AF2122/97
ugucggggccgucgucggu

SEQ ID NO: 1065923 - RNA, 20 nt, Mycobacterium bovis subsp bovis AF2122/97
ugucgggguuucaggcggca

SEQ ID NO: 1065924 - RNA, 19 nt, Mycobacterium bovis subsp bovis AF2122/97
ugucgucgcccugacacaa

SEQ ID NO: 1065925 - RNA, 12 nt, Mycobacterium bovis subsp bovis AF2122/97
ugucgucgacga

SEQ ID NO: 1065926 - RNA, 13 nt, Mycobacterium bovis subsp bovis AF2122/97
ugucgucgagcgc

SEQ ID NO: 1065927 - RNA, 13 nt, Mycobacterium bovis subsp bovis AF2122/97
ugucgugggcacc

SEQ ID NO: 1065928 - RNA, 22 nt, Mycobacterium bovis subsp bovis AF2122/97
ugucgugggcaccuuggccggc

SEQ ID NO: 1065929 - RNA, 23 nt, Mycobacterium bovis subsp bovis AF2122/97
ugucgucgguguuccgccgcgcu

SEQ ID NO: 1065930 - RNA, 15 nt, Mycobacterium bovis subsp bovis AF2122/97
ugucgucgucgugua

SEQ ID NO: 1065931 - RNA, 17 nt, Mycobacterium bovis subsp bovis AF2122/97
ugucgucgucguguagg

SEQ ID NO: 1065932 - RNA, 15 nt, Mycobacterium bovis subsp bovis AF2122/97
ugucguagcgcgaga

SEQ ID NO: 1065933 - RNA, 19 nt, Mycobacterium bovis subsp bovis AF2122/97
ugucguaccgcggaucgga

SEQ ID NO: 1065934 - RNA, 15 nt, Mycobacterium bovis subsp bovis AF2122/97
ugucguaggcgccgu

SEQ ID NO: 1065935 - RNA, 22 nt, Mycobacterium bovis subsp bovis AF2122/97
ugucguaacugcccgcggcgga

SEQ ID NO: 1065936 - RNA, 16 nt, Mycobacterium bovis subsp bovis AF2122/97
ugucguaccagccaug

SEQ ID NO: 1065937 - RNA, 15 nt, Mycobacterium bovis subsp bovis AF2122/97
ugugcucggugacgu

SEQ ID NO: 1065938 - RNA, 13 nt, Mycobacterium bovis subsp bovis AF2122/97
ugugcucggugac

SEQ ID NO: 1065939 - RNA, 14 nt, Mycobacterium bovis subsp bovis AF2122/97
ugugcucgaugcga

SEQ ID NO: 1065940 - RNA, 17 nt, Mycobacterium bovis subsp bovis AF2122/97
ugugcguuccugaucga

SEQ ID NO: 1065941 - RNA, 12 nt, Mycobacterium bovis subsp bovis AF2122/97
ugugcggccgac

SEQ ID NO: 1065942 - RNA, 23 nt, Mycobacterium bovis subsp bovis AF2122/97
ugugcugccaccggccggcgcag

SEQ ID NO: 1065943 - RNA, 18 nt, Mycobacterium bovis subsp bovis AF2122/97
ugugcuucgagcaccgac

SEQ ID NO: 1065944 - RNA, 16 nt, Mycobacterium bovis subsp bovis AF2122/97
uguggaaccacggcgc

SEQ ID NO: 1065945 - RNA, 15 nt, Mycobacterium bovis subsp bovis AF2122/97
uguggaacaccgcgg

SEQ ID NO: 1065946 - RNA, 16 nt, Mycobacterium bovis subsp bovis AF2122/97
uguggaacaccgcggc

SEQ ID NO: 1065947 - RNA, 15 nt, Mycobacterium bovis subsp bovis AF2122/97
uguggaccggcuccg

SEQ ID NO: 1065948 - RNA, 12 nt, Mycobacterium bovis subsp bovis AF2122/97
uguggacgcccg

SEQ ID NO: 1065949 - RNA, 22 nt, Mycobacterium bovis subsp bovis AF2122/97
uguggagacguuuugcggcccg

SEQ ID NO: 1065950 - RNA, 19 nt, Mycobacterium bovis subsp bovis AF2122/97
uguggaugccgacggcggg

SEQ ID NO: 1065951 - RNA, 15 nt, Mycobacterium bovis subsp bovis AF2122/97
uguggcacacccgca

SEQ ID NO: 1065952 - RNA, 16 nt, Mycobacterium bovis subsp bovis AF2122/97
uguggcacacccgcac

SEQ ID NO: 1065953 - RNA, 14 nt, Mycobacterium bovis subsp bovis AF2122/97
uguggcacccggcu

SEQ ID NO: 1065954 - RNA, 18 nt, Mycobacterium bovis subsp bovis AF2122/97
uguggcacguggcgaccg

SEQ ID NO: 1065955 - RNA, 14 nt, Mycobacterium bovis subsp bovis AF2122/97
uguggcccgcggug

SEQ ID NO: 1065956 - RNA, 20 nt, Mycobacterium bovis subsp bovis AF2122/97
uguggcccgcggugacgcaa

SEQ ID NO: 1065957 - RNA, 12 nt, Mycobacterium bovis subsp bovis AF2122/97
ugugcgcggaca

SEQ ID NO: 1065958 - RNA, 13 nt, Mycobacterium bovis subsp bovis AF2122/97
ugugcgcggugac

SEQ ID NO: 1065959 - RNA, 14 nt, Mycobacterium bovis subsp bovis AF2122/97
ugugcgcgucgcgc

SEQ ID NO: 1065960 - RNA, 17 nt, Mycobacterium bovis subsp bovis AF2122/97
ugugcgggguugggcgg

SEQ ID NO: 1065961 - RNA, 18 nt, Mycobacterium bovis subsp bovis AF2122/97
ugugcggcauugguaccg

SEQ ID NO: 1065962 - RNA, 14 nt, Mycobacterium bovis subsp bovis AF2122/97
ugugccugcgucuc

SEQ ID NO: 1065963 - RNA, 16 nt, Mycobacterium bovis subsp bovis AF2122/97
ugugccugcgucucga

SEQ ID NO: 1065964 - RNA, 12 nt, Mycobacterium bovis subsp bovis AF2122/97
ugugcgcacccc

SEQ ID NO: 1065965 - RNA, 15 nt, Mycobacterium bovis subsp bovis AF2122/97
ugugcccgccggccc

SEQ ID NO: 1065966 - RNA, 15 nt, Mycobacterium bovis subsp bovis AF2122/97
ugugccgccgcggca

SEQ ID NO: 1065967 - RNA, 13 nt, Mycobacterium bovis subsp bovis AF2122/97
ugugccgccggcg

SEQ ID NO: 1065968 - RNA, 16 nt, Mycobacterium bovis subsp bovis AF2122/97
ugugccgccggcgcca

SEQ ID NO: 1065969 - RNA, 17 nt, Mycobacterium bovis subsp bovis AF2122/97
ugugccgcugcauccgc

SEQ ID NO: 1065970 - RNA, 13 nt, Mycobacterium bovis subsp bovis AF2122/97
ugugccccagggc

SEQ ID NO: 1065971 - RNA, 20 nt, Mycobacterium bovis subsp bovis AF2122/97
ugugcaggaucacgccgccg

SEQ ID NO: 1065972 - RNA, 18 nt, Mycobacterium bovis subsp bovis AF2122/97
ugugccagcagcagcgcc

SEQ ID NO: 1065973 - RNA, 23 nt, Mycobacterium bovis subsp bovis AF2122/97
uguucgggcagcuggcgacggug

SEQ ID NO: 1065974 - RNA, 18 nt, Mycobacterium bovis subsp bovis AF2122/97
uguucgaguucggccgcg

SEQ ID NO: 1065975 - RNA, 17 nt, Mycobacterium bovis subsp bovis AF2122/97
uguucgccacacccgug

SEQ ID NO: 1065976 - RNA, 15 nt, Mycobacterium bovis subsp bovis AF2122/97
uguucgccggagacc

SEQ ID NO: 1065977 - RNA, 22 nt, Mycobacterium bovis subsp bovis AF2122/97
uguucgccgucgcuacccgcca

SEQ ID NO: 1065978 - RNA, 18 nt, Mycobacterium bovis subsp bovis AF2122/97
uguucaacucgggcagcu

SEQ ID NO: 1065979 - RNA, 19 nt, Mycobacterium bovis subsp bovis AF2122/97
uguggggauuccgcacccc

SEQ ID NO: 1065980 - RNA, 11 nt, Mycobacterium bovis subsp bovis AF2122/97
uguggucaccc

SEQ ID NO: 1065981 - RNA, 15 nt, Mycobacterium bovis subsp bovis AF2122/97
ugugguccaucgcgc

SEQ ID NO: 1065982 - RNA, 20 nt, Mycobacterium bovis subsp bovis AF2122/97
uguuagccccgaagccggug

SEQ ID NO: 1065983 - RNA, 16 nt, Mycobacterium bovis subsp bovis AF2122/97
uguuacuccgacggcc

SEQ ID NO: 1065984 - RNA, 12 nt, Mycobacterium bovis subsp bovis AF2122/97
uguggccagcgc

SEQ ID NO: 1065985 - RNA, 17 nt, Mycobacterium bovis subsp bovis AF2122/97
uguggcccaacaccgcc

SEQ ID NO: 1065986 - RNA, 16 nt, Mycobacterium bovis subsp bovis AF2122/97
uguggcccaaccgcau

SEQ ID NO: 1065987 - RNA, 13 nt, Mycobacterium bovis subsp bovis AF2122/97
uguggcgccgccg

SEQ ID NO: 1065988 - RNA, 21 nt, Mycobacterium bovis subsp bovis AF2122/97
uguggcgccgccggcaccgcc

SEQ ID NO: 1065989 - RNA, 15 nt, Mycobacterium bovis subsp bovis AF2122/97
uguggcgcuccggcg

SEQ ID NO: 1065990 - RNA, 18 nt, Mycobacterium bovis subsp bovis AF2122/97
uguggcugaucccggcca

SEQ ID NO: 1065991 - RNA, 21 nt, Mycobacterium bovis subsp bovis AF2122/97
ugugggccccgccgaugcgau

SEQ ID NO: 1065992 - RNA, 15 nt, Mycobacterium bovis subsp bovis AF2122/97
uguugacgccacgac

SEQ ID NO: 1065993 - RNA, 19 nt, Mycobacterium bovis subsp bovis AF2122/97
uguugccccggucggcgac

SEQ ID NO: 1065994 - RNA, 20 nt, Mycobacterium bovis subsp bovis AF2122/97
uguugccccggucggcgacg

SEQ ID NO: 1065995 - RNA, 21 nt, Mycobacterium bovis subsp bovis AF2122/97
uguugcccgaccacaccggga

SEQ ID NO: 1065996 - RNA, 13 nt, Mycobacterium bovis subsp bovis AF2122/97
uguugccgccgcg

SEQ ID NO: 1065997 - RNA, 15 nt, Mycobacterium bovis subsp bovis AF2122/97
uguugccgccggcca

SEQ ID NO: 1065998 - RNA, 14 nt, Mycobacterium bovis subsp bovis AF2122/97
uguugccgccgguc

SEQ ID NO: 1065999 - RNA, 21 nt, Mycobacterium bovis subsp bovis AF2122/97
uguugccgccuggguugaccg

SEQ ID NO: 1066000 - RNA, 22 nt, Mycobacterium bovis subsp bovis AF2122/97
uguugcacgcgggugccgacgu

SEQ ID NO: 1066001 - RNA, 15 nt, Mycobacterium bovis subsp bovis AF2122/97
uguucugcacguuga

SEQ ID NO: 1066002 - RNA, 15 nt, Mycobacterium bovis subsp bovis AF2122/97
uguucuuggugacca

SEQ ID NO: 1066003 - RNA, 11 nt, Mycobacterium bovis subsp bovis AF2122/97
uuacaugcccu

SEQ ID NO: 1066004 - RNA, 15 nt, Mycobacterium bovis subsp bovis AF2122/97
uuagccgcagcuugg

SEQ ID NO: 1066005 - RNA, 17 nt, Mycobacterium bovis subsp bovis AF2122/97
uuacgcucgcgaagccg

SEQ ID NO: 1066006 - RNA, 20 nt, Mycobacterium bovis subsp bovis AF2122/97
uuaggagcuuuugcgucuuc

SEQ ID NO: 1066007 - RNA, 22 nt, Mycobacterium bovis subsp bovis AF2122/97
uuaggcccgcacguuggcggcc

SEQ ID NO: 1066008 - RNA, 16 nt, Mycobacterium bovis subsp bovis AF2122/97
uucggcugccaccgca

SEQ ID NO: 1066009 - RNA, 19 nt, Mycobacterium bovis subsp bovis AF2122/97
uucgggacaaagccgaacg

SEQ ID NO: 1066010 - RNA, 19 nt, Mycobacterium bovis subsp bovis AF2122/97
uucgggagucuucggcgac

SEQ ID NO: 1066011 - RNA, 17 nt, Mycobacterium bovis subsp bovis AF2122/97
uucgggcaacggcagcc

SEQ ID NO: 1066012 - RNA, 18 nt, Mycobacterium bovis subsp bovis AF2122/97
uucggcggcgguggcgaa

SEQ ID NO: 1066013 - RNA, 15 nt, Mycobacterium bovis subsp bovis AF2122/97
uucggcggucgccgc

SEQ ID NO: 1066014 - RNA, 17 nt, Mycobacterium bovis subsp bovis AF2122/97
uucggcagcucccgcca

SEQ ID NO: 1066015 - RNA, 20 nt, Mycobacterium bovis subsp bovis AF2122/97
uucgucgcggaucagcccgc

SEQ ID NO: 1066016 - RNA, 19 nt, Mycobacterium bovis subsp bovis AF2122/97
uucgucggagaacgcccgc

SEQ ID NO: 1066017 - RNA, 16 nt, Mycobacterium bovis subsp bovis AF2122/97
uucgucgacacccgca

SEQ ID NO: 1066018 - RNA, 14 nt, Mycobacterium bovis subsp bovis AF2122/97
uucguccaccgcga

SEQ ID NO: 1066019 - RNA, 21 nt, Mycobacterium bovis subsp bovis AF2122/97
uucgucagucaacucaccguc

SEQ ID NO: 1066020 - RNA, 21 nt, Mycobacterium bovis subsp bovis AF2122/97
uucgggccggagccggugccg

SEQ ID NO: 1066021 - RNA, 16 nt, Mycobacterium bovis subsp bovis AF2122/97
uucgggcgugaguggc

SEQ ID NO: 1066022 - RNA, 18 nt, Mycobacterium bovis subsp bovis AF2122/97
uucgugccggcguugccg

SEQ ID NO: 1066023 - RNA, 20 nt, Mycobacterium bovis subsp bovis AF2122/97
uucgucguggagcucacgug

SEQ ID NO: 1066024 - RNA, 18 nt, Mycobacterium bovis subsp bovis AF2122/97
uucgucguagagauacgg

SEQ ID NO: 1066025 - RNA, 16 nt, Mycobacterium bovis subsp bovis AF2122/97
uucugcgcccacccgc

SEQ ID NO: 1066026 - RNA, 23 nt, Mycobacterium bovis subsp bovis AF2122/97
uucugcggccgcgugccgcccgc

SEQ ID NO: 1066027 - RNA, 21 nt, Mycobacterium bovis subsp bovis AF2122/97
uucugcggucaauguggcgcu

SEQ ID NO: 1066028 - RNA, 15 nt, Mycobacterium bovis subsp bovis AF2122/97
aaucagcccgccgga

SEQ ID NO: 1066029 - RNA, 18 nt, Mycobacterium bovis subsp bovis AF2122/97
uuccgcgcguccgucggc

SEQ ID NO: 1066030 - RNA, 19 nt, Mycobacterium bovis subsp bovis AF2122/97
uuccgccuguacggcggcu

SEQ ID NO: 1066031 - RNA, 15 nt, Mycobacterium bovis subsp bovis AF2122/97
uuccgcccggugcua

SEQ ID NO: 1066032 - RNA, 12 nt, Mycobacterium bovis subsp bovis AF2122/97
uuccgccgccgc

SEQ ID NO: 1066033 - RNA, 13 nt, Mycobacterium bovis subsp bovis AF2122/97
uuccgccgccgcc

SEQ ID NO: 1066034 - RNA, 23 nt, Mycobacterium bovis subsp bovis AF2122/97
uuccgccaggccgaccgcgcaca

SEQ ID NO: 1066035 - RNA, 17 nt, Mycobacterium bovis subsp bovis AF2122/97
uuccgccgccgccgcca

SEQ ID NO: 1066036 - RNA, 19 nt, Mycobacterium bovis subsp bovis AF2122/97
uuccgccgccgccgggucg

SEQ ID NO: 1066037 - RNA, 15 nt, Mycobacterium bovis subsp bovis AF2122/97
uuccuugccaggguc

SEQ ID NO: 1066038 - RNA, 17 nt, Mycobacterium bovis subsp bovis AF2122/97
uucgcccggggaaccgu

SEQ ID NO: 1066039 - RNA, 16 nt, Mycobacterium bovis subsp bovis AF2122/97
uucgcccgucgccaau

SEQ ID NO: 1066040 - RNA, 14 nt, Mycobacterium bovis subsp bovis AF2122/97
uucgccccacccga

SEQ ID NO: 1066041 - RNA, 21 nt, Mycobacterium bovis subsp bovis AF2122/97
uucgaagggguacccgcccuc

SEQ ID NO: 1066042 - RNA, 16 nt, Mycobacterium bovis subsp bovis AF2122/97
uucgaagcgaucgccg

SEQ ID NO: 1066043 - RNA, 16 nt, Mycobacterium bovis subsp bovis AF2122/97
uucgacaggccaccgc

SEQ ID NO: 1066044 - RNA, 16 nt, Mycobacterium bovis subsp bovis AF2122/97
uucgcgggugcgcugc

SEQ ID NO: 1066045 - RNA, 17 nt, Mycobacterium bovis subsp bovis AF2122/97
uucgcgggccgaggccg

SEQ ID NO: 1066046 - RNA, 19 nt, Mycobacterium bovis subsp bovis AF2122/97
uucgcgggagaacgugccg

SEQ ID NO: 1066047 - RNA, 21 nt, Mycobacterium bovis subsp bovis AF2122/97
uucgcggauguccaggagugc

SEQ ID NO: 1066048 - RNA, 21 nt, Mycobacterium bovis subsp bovis AF2122/97
uucgcgccgcgaggcaccgac

SEQ ID NO: 1066049 - RNA, 18 nt, Mycobacterium bovis subsp bovis AF2122/97
uucgcgaugugcgccacc

SEQ ID NO: 1066050 - RNA, 22 nt, Mycobacterium bovis subsp bovis AF2122/97
uucgccgccaccggcgacgccg

SEQ ID NO: 1066051 - RNA, 16 nt, Mycobacterium bovis subsp bovis AF2122/97
uucgcgcagccgccgc

SEQ ID NO: 1066052 - RNA, 17 nt, Mycobacterium bovis subsp bovis AF2122/97
uucgccgccaccggcga

SEQ ID NO: 1066053 - RNA, 16 nt, Mycobacterium bovis subsp bovis AF2122/97
uucgccgaguugaccg

SEQ ID NO: 1066054 - RNA, 15 nt, Mycobacterium bovis subsp bovis AF2122/97
uucggaaaaccgcac

SEQ ID NO: 1066055 - RNA, 20 nt, Mycobacterium bovis subsp bovis AF2122/97
uucgcuggcuugggccagcg

SEQ ID NO: 1066056 - RNA, 22 nt, Mycobacterium bovis subsp bovis AF2122/97
uucgcugguauagcucacggug

SEQ ID NO: 1066057 - RNA, 10 nt, Mycobacterium bovis subsp bovis AF2122/97
uucggcggcg

SEQ ID NO: 1066058 - RNA, 14 nt, Mycobacterium bovis subsp bovis AF2122/97
uucggcggcgauga

SEQ ID NO: 1066059 - RNA, 19 nt, Mycobacterium bovis subsp bovis AF2122/97
uucggcgcugcggcgugcc

SEQ ID NO: 1066060 - RNA, 20 nt, Mycobacterium bovis subsp bovis AF2122/97
uucggcgcugcggcgugccg

SEQ ID NO: 1066061 - RNA, 16 nt, Mycobacterium bovis subsp bovis AF2122/97
uucggaccggcucuuu

SEQ ID NO: 1066062 - RNA, 13 nt, Mycobacterium bovis subsp bovis AF2122/97
uucggagaacacg

SEQ ID NO: 1066063 - RNA, 22 nt, Mycobacterium bovis subsp bovis AF2122/97
uucacuacgggucuggccaacg

SEQ ID NO: 1066064 - RNA, 15 nt, Mycobacterium bovis subsp bovis AF2122/97
uucacguucggcgac

SEQ ID NO: 1066065 - RNA, 13 nt, Mycobacterium bovis subsp bovis AF2122/97
uucacucacgacg

SEQ ID NO: 1066066 - RNA, 16 nt, Mycobacterium bovis subsp bovis AF2122/97
uucacgccagucccac

SEQ ID NO: 1066067 - RNA, 19 nt, Mycobacterium bovis subsp bovis AF2122/97
uucagcuaccuccgccacc

SEQ ID NO: 1066068 - RNA, 21 nt, Mycobacterium bovis subsp bovis AF2122/97
uucagcuaccuccgccaccaa

SEQ ID NO: 1066069 - RNA, 21 nt, Mycobacterium bovis subsp bovis AF2122/97
uucagcacccaccgaagcgaa

SEQ ID NO: 1066070 - RNA, 15 nt, Mycobacterium bovis subsp bovis AF2122/97
uucagggguggcgcg

SEQ ID NO: 1066071 - RNA, 21 nt, Mycobacterium bovis subsp bovis AF2122/97
uucagggcauugacgaugucg

SEQ ID NO: 1066072 - RNA, 18 nt, Mycobacterium bovis subsp bovis AF2122/97
uuccagcucacgaugucg

SEQ ID NO: 1066073 - RNA, 21 nt, Mycobacterium bovis subsp bovis AF2122/97
uuccaggagagaucgucgacc

SEQ ID NO: 1066074 - RNA, 16 nt, Mycobacterium bovis subsp bovis AF2122/97
uuccagggcgacggcc

SEQ ID NO: 1066075 - RNA, 14 nt, Mycobacterium bovis subsp bovis AF2122/97
uucccggcggcgcg

SEQ ID NO: 1066076 - RNA, 15 nt, Mycobacterium bovis subsp bovis AF2122/97
uucccgguagcggcg

SEQ ID NO: 1066077 - RNA, 15 nt, Mycobacterium bovis subsp bovis AF2122/97
uucccgucggcggcg

SEQ ID NO: 1066078 - RNA, 18 nt, Mycobacterium bovis subsp bovis AF2122/97
uuccgcagcgccacccga

SEQ ID NO: 1066079 - RNA, 17 nt, Mycobacterium bovis subsp bovis AF2122/97
uuccgcacccccgucga

SEQ ID NO: 1066080 - RNA, 19 nt, Mycobacterium bovis subsp bovis AF2122/97
uuccgacccaacgaccacc

SEQ ID NO: 1066081 - RNA, 16 nt, Mycobacterium bovis subsp bovis AF2122/97
uuccgaaacccgccgc

SEQ ID NO: 1066082 - RNA, 22 nt, Mycobacterium bovis subsp bovis AF2122/97
uuccaacguauggcggucggcc

SEQ ID NO: 1066083 - RNA, 17 nt, Mycobacterium bovis subsp bovis AF2122/97
uuccaacccaaccgaga

SEQ ID NO: 1066084 - RNA, 17 nt, Mycobacterium bovis subsp bovis AF2122/97
uuccacccggugccgca

SEQ ID NO: 1066085 - RNA, 15 nt, Mycobacterium bovis subsp bovis AF2122/97
uuccagccggugccg

SEQ ID NO: 1066086 - RNA, 21 nt, Mycobacterium bovis subsp bovis AF2122/97
uuccagcaggccacugcguuc

SEQ ID NO: 1066087 - RNA, 17 nt, Mycobacterium bovis subsp bovis AF2122/97
uuccagaaggccgcacc

SEQ ID NO: 1066088 - RNA, 23 nt, Mycobacterium bovis subsp bovis AF2122/97
uuccacuccccagccccacccgc

SEQ ID NO: 1066089 - RNA, 21 nt, Mycobacterium bovis subsp bovis AF2122/97
uuccacgaucggcucacgacu

SEQ ID NO: 1066090 - RNA, 15 nt, Mycobacterium bovis subsp bovis AF2122/97
aaaggccuugggcgg

SEQ ID NO: 1066091 - RNA, 19 nt, Mycobacterium bovis subsp bovis AF2122/97
aaagcugcucgucggcgcc

SEQ ID NO: 1066092 - RNA, 19 nt, Mycobacterium bovis subsp bovis AF2122/97
aaagugguugucgcgguca

SEQ ID NO: 1066093 - RNA, 21 nt, Mycobacterium bovis subsp bovis AF2122/97
aaauacccagcgcagcagcgg

SEQ ID NO: 1066094 - RNA, 20 nt, Mycobacterium bovis subsp bovis AF2122/97
aaauacaggcccggcaccgc

SEQ ID NO: 1066095 - RNA, 18 nt, Mycobacterium bovis subsp bovis AF2122/97
aaauacagggugucacgc

SEQ ID NO: 1066096 - RNA, 13 nt, Mycobacterium bovis subsp bovis AF2122/97
aaacgucggucgg

SEQ ID NO: 1066097 - RNA, 23 nt, Mycobacterium bovis subsp bovis AF2122/97
aaacgagccggugcgcgcggucg

SEQ ID NO: 1066098 - RNA, 22 nt, Mycobacterium bovis subsp bovis AF2122/97
aaacgauccgauaaauggccga

SEQ ID NO: 1066099 - RNA, 17 nt, Mycobacterium bovis subsp bovis AF2122/97
aaacgauggccgggucg

SEQ ID NO: 1066100 - RNA, 19 nt, Mycobacterium bovis subsp bovis AF2122/97
aacagcuucgcgcagccgg

SEQ ID NO: 1066101 - RNA, 19 nt, Mycobacterium bovis subsp bovis AF2122/97
aacaggccgccaccgucac

SEQ ID NO: 1066102 - RNA, 19 nt, Mycobacterium bovis subsp bovis AF2122/97
aacaggccggugugcgggc

SEQ ID NO: 1066103 - RNA, 16 nt, Mycobacterium bovis subsp bovis AF2122/97
aacaggccguggcgga

SEQ ID NO: 1066104 - RNA, 22 nt, Mycobacterium bovis subsp bovis AF2122/97
aacagguaggguucuucgacgc

SEQ ID NO: 1066105 - RNA, 18 nt, Mycobacterium bovis subsp bovis AF2122/97
aacagguccaccggccag

SEQ ID NO: 1066106 - RNA, 16 nt, Mycobacterium bovis subsp bovis AF2122/97
aacagcccaccggugc

SEQ ID NO: 1066107 - RNA, 15 nt, Mycobacterium bovis subsp bovis AF2122/97
aacagcgaaccgccg

SEQ ID NO: 1066108 - RNA, 19 nt, Mycobacterium bovis subsp bovis AF2122/97
aacagcgaaccgccggcac

SEQ ID NO: 1066109 - RNA, 13 nt, Mycobacterium bovis subsp bovis AF2122/97
aacagccggccgg

SEQ ID NO: 1066110 - RNA, 14 nt, Mycobacterium bovis subsp bovis AF2122/97
aacagcucggccag

SEQ ID NO: 1066111 - RNA, 13 nt, Mycobacterium bovis subsp bovis AF2122/97
aacagcgagcggu

SEQ ID NO: 1066112 - RNA, 21 nt, Mycobacterium bovis subsp bovis AF2122/97
aacagcgccaagacgucggcg

SEQ ID NO: 1066113 - RNA, 22 nt, Mycobacterium bovis subsp bovis AF2122/97
aacagcgccaagacgucggcgu

SEQ ID NO: 1066114 - RNA, 16 nt, Mycobacterium bovis subsp bovis AF2122/97
aacaacgccgcgacgu

SEQ ID NO: 1066115 - RNA, 19 nt, Mycobacterium bovis subsp bovis AF2122/97
aaaaggaagaccucggcgu

SEQ ID NO: 1066116 - RNA, 14 nt, Mycobacterium bovis subsp bovis AF2122/97
aaaagcucggcccu

SEQ ID NO: 1066117 - RNA, 14 nt, Mycobacterium bovis subsp bovis AF2122/97
aacagacggggucg

SEQ ID NO: 1066118 - RNA, 20 nt, Mycobacterium bovis subsp bovis AF2122/97
aacaaugccagcuguugcgg

SEQ ID NO: 1066119 - RNA, 23 nt, Mycobacterium bovis subsp bovis AF2122/97
aacacuuugcgcacuaccgccuu

SEQ ID NO: 1066120 - RNA, 22 nt, Mycobacterium bovis subsp bovis AF2122/97
aaaagcccccauuucggcacga

SEQ ID NO: 1066121 - RNA, 13 nt, Mycobacterium bovis subsp bovis AF2122/97
aaauucgcggcgg

SEQ ID NO: 1066122 - RNA, 20 nt, Mycobacterium bovis subsp bovis AF2122/97
aaauggugccguccggcgcu

SEQ ID NO: 1066123 - RNA, 20 nt, Mycobacterium bovis subsp bovis AF2122/97
aaaugggugugcugccaccg

SEQ ID NO: 1066124 - RNA, 22 nt, Mycobacterium bovis subsp bovis AF2122/97
aaccccacacccgggacgaacc

SEQ ID NO: 1066125 - RNA, 23 nt, Mycobacterium bovis subsp bovis AF2122/97
aacccagcaccacaacgucggca

SEQ ID NO: 1066126 - RNA, 15 nt, Mycobacterium bovis subsp bovis AF2122/97
aaccagugguuuugg

SEQ ID NO: 1066127 - RNA, 17 nt, Mycobacterium bovis subsp bovis AF2122/97
aacccaggccgucgcgc

SEQ ID NO: 1066128 - RNA, 21 nt, Mycobacterium bovis subsp bovis AF2122/97
aacccgauuuauccggaucgg

SEQ ID NO: 1066129 - RNA, 17 nt, Mycobacterium bovis subsp bovis AF2122/97
aacccgcaccggaucgg

SEQ ID NO: 1066130 - RNA, 20 nt, Mycobacterium bovis subsp bovis AF2122/97
aacccgcaccggggugugcg

SEQ ID NO: 1066131 - RNA, 19 nt, Mycobacterium bovis subsp bovis AF2122/97
aacccgauguggcgcuguu

SEQ ID NO: 1066132 - RNA, 22 nt, Mycobacterium bovis subsp bovis AF2122/97
aacccgccguugccaccggugc

SEQ ID NO: 1066133 - RNA, 18 nt, Mycobacterium bovis subsp bovis AF2122/97
aacccgcgauucgcggca

SEQ ID NO: 1066134 - RNA, 15 nt, Mycobacterium bovis subsp bovis AF2122/97
aacccgacgucgcgg

SEQ ID NO: 1066135 - RNA, 21 nt, Mycobacterium bovis subsp bovis AF2122/97
aacccgagcguguugaaauug

SEQ ID NO: 1066136 - RNA, 17 nt, Mycobacterium bovis subsp bovis AF2122/97
aaccccgagcugccaac

SEQ ID NO: 1066137 - RNA, 18 nt, Mycobacterium bovis subsp bovis AF2122/97
aacccgagcuugggccgg

SEQ ID NO: 1066138 - RNA, 18 nt, Mycobacterium bovis subsp bovis AF2122/97
aacccgaguucgggccgg

SEQ ID NO: 1066139 - RNA, 20 nt, Mycobacterium bovis subsp bovis AF2122/97
aaccagcugagccgucggcg

SEQ ID NO: 1066140 - RNA, 21 nt, Mycobacterium bovis subsp bovis AF2122/97
aaccagcuugcgccgcagcga

SEQ ID NO: 1066141 - RNA, 20 nt, Mycobacterium bovis subsp bovis AF2122/97
aaccagcguaucggccggca

SEQ ID NO: 1066142 - RNA, 23 nt, Mycobacterium bovis subsp bovis AF2122/97
aaccagcguaucggccggcagau

SEQ ID NO: 1066143 - RNA, 20 nt, Mycobacterium bovis subsp bovis AF2122/97
aaccaggaugguugcgacgg

SEQ ID NO: 1066144 - RNA, 14 nt, Mycobacterium bovis subsp bovis AF2122/97
aaccaugccgccga

SEQ ID NO: 1066145 - RNA, 20 nt, Mycobacterium bovis subsp bovis AF2122/97
aaccgaucggucgaucgaau

SEQ ID NO: 1066146 - RNA, 18 nt, Mycobacterium bovis subsp bovis AF2122/97
aaccgaucggucguccgg

SEQ ID NO: 1066147 - RNA, 23 nt, Mycobacterium bovis subsp bovis AF2122/97
aaccgaucggucguccggaucgg

SEQ ID NO: 1066148 - RNA, 21 nt, Mycobacterium bovis subsp bovis AF2122/97
aaccgagaugcggaccacacc

SEQ ID NO: 1066149 - RNA, 16 nt, Mycobacterium bovis subsp bovis AF2122/97
aaccgacggccagcaa

SEQ ID NO: 1066150 - RNA, 18 nt, Mycobacterium bovis subsp bovis AF2122/97
aaccgaggaugugguugg

SEQ ID NO: 1066151 - RNA, 21 nt, Mycobacterium bovis subsp bovis AF2122/97
aaccgaggaugugguuggugc

SEQ ID NO: 1066152 - RNA, 19 nt, Mycobacterium bovis subsp bovis AF2122/97
aacccugccgcgaugagcg

SEQ ID NO: 1066153 - RNA, 14 nt, Mycobacterium bovis subsp bovis AF2122/97
aaccgacccggccg

SEQ ID NO: 1066154 - RNA, 15 nt, Mycobacterium bovis subsp bovis AF2122/97
aaccgacccggccgc

SEQ ID NO: 1066155 - RNA, 18 nt, Mycobacterium bovis subsp bovis AF2122/97
aaccgcacccugacagcg

SEQ ID NO: 1066156 - RNA, 23 nt, Mycobacterium bovis subsp bovis AF2122/97
aaccgcacccugacagcgagcga

SEQ ID NO: 1066157 - RNA, 16 nt, Mycobacterium bovis subsp bovis AF2122/97
aaccgcaggccgaaga

SEQ ID NO: 1066158 - RNA, 14 nt, Mycobacterium bovis subsp bovis AF2122/97
aaccgcagucgcgg

SEQ ID NO: 1066159 - RNA, 16 nt, Mycobacterium bovis subsp bovis AF2122/97
aaccgcagucgcggca

SEQ ID NO: 1066160 - RNA, 12 nt, Mycobacterium bovis subsp bovis AF2122/97
aacccggcggca

SEQ ID NO: 1066161 - RNA, 22 nt, Mycobacterium bovis subsp bovis AF2122/97
aacccggccuucuccaucgucg

SEQ ID NO: 1066162 - RNA, 22 nt, Mycobacterium bovis subsp bovis AF2122/97
aacccgguauucaucaggccgg

SEQ ID NO: 1066163 - RNA, 19 nt, Mycobacterium bovis subsp bovis AF2122/97
aacccggugucgugggcac

SEQ ID NO: 1066164 - RNA, 12 nt, Mycobacterium bovis subsp bovis AF2122/97
aacccggccucg

SEQ ID NO: 1066165 - RNA, 19 nt, Mycobacterium bovis subsp bovis AF2122/97
aacccggccgccgagacga

SEQ ID NO: 1066166 - RNA, 17 nt, Mycobacterium bovis subsp bovis AF2122/97
aacccgcucggcggucg

SEQ ID NO: 1066167 - RNA, 19 nt, Mycobacterium bovis subsp bovis AF2122/97
aacccggaaccagccgcgg

SEQ ID NO: 1066168 - RNA, 21 nt, Mycobacterium bovis subsp bovis AF2122/97
aacccggaaucgucgcggccg

SEQ ID NO: 1066169 - RNA, 23 nt, Mycobacterium bovis subsp bovis AF2122/97
aacccggacgaacgccgucgacg

SEQ ID NO: 1066170 - RNA, 20 nt, Mycobacterium bovis subsp bovis AF2122/97
aacccgccacguacuccacc

SEQ ID NO: 1066171 - RNA, 21 nt, Mycobacterium bovis subsp bovis AF2122/97
aacccguauggcggcuccaac

SEQ ID NO: 1066172 - RNA, 19 nt, Mycobacterium bovis subsp bovis AF2122/97
aacccguaaaagccgauga

SEQ ID NO: 1066173 - RNA, 16 nt, Mycobacterium bovis subsp bovis AF2122/97
aacccugccgcgauga

SEQ ID NO: 1066174 - RNA, 16 nt, Mycobacterium bovis subsp bovis AF2122/97
aaccaccagcacggcg

SEQ ID NO: 1066175 - RNA, 17 nt, Mycobacterium bovis subsp bovis AF2122/97
aaccacggccgccgcgu

SEQ ID NO: 1066176 - RNA, 15 nt, Mycobacterium bovis subsp bovis AF2122/97
aaccacuuccggcgu

SEQ ID NO: 1066177 - RNA, 23 nt, Mycobacterium bovis subsp bovis AF2122/97
aaccagcauggcuuuugcgccga

SEQ ID NO: 1066178 - RNA, 20 nt, Mycobacterium bovis subsp bovis AF2122/97
aaccagcgagcccagcugcg

SEQ ID NO: 1066179 - RNA, 19 nt, Mycobacterium bovis subsp bovis AF2122/97
aacaugcucacgaucaccc

SEQ ID NO: 1066180 - RNA, 19 nt, Mycobacterium bovis subsp bovis AF2122/97
aaccaagaaucaccggcaa

SEQ ID NO: 1066181 - RNA, 21 nt, Mycobacterium bovis subsp bovis AF2122/97
aacaguggggguccggcggcc

SEQ ID NO: 1066182 - RNA, 20 nt, Mycobacterium bovis subsp bovis AF2122/97
aacagugguuagucggccug

SEQ ID NO: 1066183 - RNA, 14 nt, Mycobacterium bovis subsp bovis AF2122/97
aacaucaccgucgc

SEQ ID NO: 1066184 - RNA, 16 nt, Mycobacterium bovis subsp bovis AF2122/97
aacaucaccucgaugc

SEQ ID NO: 1066185 - RNA, 20 nt, Mycobacterium bovis subsp bovis AF2122/97
aacaucggacagggugcgcu

SEQ ID NO: 1066186 - RNA, 20 nt, Mycobacterium bovis subsp bovis AF2122/97
aacaucgccauaccggccgc

SEQ ID NO: 1066187 - RNA, 18 nt, Mycobacterium bovis subsp bovis AF2122/97
aacaucgucaucgacgag

SEQ ID NO: 1066188 - RNA, 18 nt, Mycobacterium bovis subsp bovis AF2122/97
aacaugauccgccggcaa

SEQ ID NO: 1066189 - RNA, 22 nt, Mycobacterium bovis subsp bovis AF2122/97
aacaugccauggcccgugcggu

SEQ ID NO: 1066190 - RNA, 19 nt, Mycobacterium bovis subsp bovis AF2122/97
aacaucucggcgcagccgg

SEQ ID NO: 1066191 - RNA, 22 nt, Mycobacterium bovis subsp bovis AF2122/97
aacggcgggcgauuucggcgcc

SEQ ID NO: 1066192 - RNA, 12 nt, Mycobacterium bovis subsp bovis AF2122/97
aacggcgguggg

SEQ ID NO: 1066193 - RNA, 17 nt, Mycobacterium bovis subsp bovis AF2122/97
aacggcggugugguggg

SEQ ID NO: 1066194 - RNA, 18 nt, Mycobacterium bovis subsp bovis AF2122/97
aacggcggaucggcggcc

SEQ ID NO: 1066195 - RNA, 20 nt, Mycobacterium bovis subsp bovis AF2122/97
aacggcguuggcgccguuac

SEQ ID NO: 1066196 - RNA, 20 nt, Mycobacterium bovis subsp bovis AF2122/97
aacggaggugccggcgccac

SEQ ID NO: 1066197 - RNA, 20 nt, Mycobacterium bovis subsp bovis AF2122/97
aacggauaacccguggcggu

SEQ ID NO: 1066198 - RNA, 18 nt, Mycobacterium bovis subsp bovis AF2122/97
aacggaugccggucggcg

SEQ ID NO: 1066199 - RNA, 19 nt, Mycobacterium bovis subsp bovis AF2122/97
aacggcggcaggccggcca

SEQ ID NO: 1066200 - RNA, 20 nt, Mycobacterium bovis subsp bovis AF2122/97
aacggcggcaucggcggcaa

SEQ ID NO: 1066201 - RNA, 21 nt, Mycobacterium bovis subsp bovis AF2122/97
aacggcggcaucggcggcaag

SEQ ID NO: 1066202 - RNA, 22 nt, Mycobacterium bovis subsp bovis AF2122/97
aacggcggccauggcgggucgg

SEQ ID NO: 1066203 - RNA, 13 nt, Mycobacterium bovis subsp bovis AF2122/97
aacggcggcgacg

SEQ ID NO: 1066204 - RNA, 16 nt, Mycobacterium bovis subsp bovis AF2122/97
aacggcggcgacggcg

SEQ ID NO: 1066205 - RNA, 17 nt, Mycobacterium bovis subsp bovis AF2122/97
aacggcggcgucgcggu

SEQ ID NO: 1066206 - RNA, 22 nt, Mycobacterium bovis subsp bovis AF2122/97
aacggauucccgcccagcagca

SEQ ID NO: 1066207 - RNA, 19 nt, Mycobacterium bovis subsp bovis AF2122/97
aacggcaccagcgggucgg

SEQ ID NO: 1066208 - RNA, 23 nt, Mycobacterium bovis subsp bovis AF2122/97
aacggcaccagcgggucggcggu

SEQ ID NO: 1066209 - RNA, 18 nt, Mycobacterium bovis subsp bovis AF2122/97
aacgcgcgcacgccaccg

SEQ ID NO: 1066210 - RNA, 17 nt, Mycobacterium bovis subsp bovis AF2122/97
aacgcuuuccggcggug

SEQ ID NO: 1066211 - RNA, 20 nt, Mycobacterium bovis subsp bovis AF2122/97
aacggaaucgguuucgaccu

SEQ ID NO: 1066212 - RNA, 13 nt, Mycobacterium bovis subsp bovis AF2122/97
aacguaugacgcc

SEQ ID NO: 1066213 - RNA, 14 nt, Mycobacterium bovis subsp bovis AF2122/97
aacguaggguggcc

SEQ ID NO: 1066214 - RNA, 16 nt, Mycobacterium bovis subsp bovis AF2122/97
aacgucaaccgggcgg

SEQ ID NO: 1066215 - RNA, 18 nt, Mycobacterium bovis subsp bovis AF2122/97
aacgucacgucgacggcg

SEQ ID NO: 1066216 - RNA, 13 nt, Mycobacterium bovis subsp bovis AF2122/97
aacguagccagca

SEQ ID NO: 1066217 - RNA, 14 nt, Mycobacterium bovis subsp bovis AF2122/97
aacgucgagauccu

SEQ ID NO: 1066218 - RNA, 18 nt, Mycobacterium bovis subsp bovis AF2122/97
aacgucgagauccucguc

SEQ ID NO: 1066219 - RNA, 22 nt, Mycobacterium bovis subsp bovis AF2122/97
aacgucgauguccccggcggca

SEQ ID NO: 1066220 - RNA, 16 nt, Mycobacterium bovis subsp bovis AF2122/97
aacgugacgccggcca

SEQ ID NO: 1066221 - RNA, 17 nt, Mycobacterium bovis subsp bovis AF2122/97
aacgugacgccggccag

SEQ ID NO: 1066222 - RNA, 14 nt, Mycobacterium bovis subsp bovis AF2122/97
aacgucgugauguc

SEQ ID NO: 1066223 - RNA, 21 nt, Mycobacterium bovis subsp bovis AF2122/97
aacgucugccacgucggcgaa

SEQ ID NO: 1066224 - RNA, 13 nt, Mycobacterium bovis subsp bovis AF2122/97
aacgggcugcccc

SEQ ID NO: 1066225 - RNA, 15 nt, Mycobacterium bovis subsp bovis AF2122/97
aacgggacgucaccg

SEQ ID NO: 1066226 - RNA, 20 nt, Mycobacterium bovis subsp bovis AF2122/97
aacggggcgacguccgcgac

SEQ ID NO: 1066227 - RNA, 10 nt, Mycobacterium bovis subsp bovis AF2122/97
aacggugccu

SEQ ID NO: 1066228 - RNA, 21 nt, Mycobacterium bovis subsp bovis AF2122/97
aacggugccucgcagccaacg

SEQ ID NO: 1066229 - RNA, 13 nt, Mycobacterium bovis subsp bovis AF2122/97
aacgguucggccg

SEQ ID NO: 1066230 - RNA, 14 nt, Mycobacterium bovis subsp bovis AF2122/97
aacgguggcgcggu

SEQ ID NO: 1066231 - RNA, 19 nt, Mycobacterium bovis subsp bovis AF2122/97
aacggguugucguugcugg

SEQ ID NO: 1066232 - RNA, 13 nt, Mycobacterium bovis subsp bovis AF2122/97
aacgguagcacgg

SEQ ID NO: 1066233 - RNA, 20 nt, Mycobacterium bovis subsp bovis AF2122/97
aacgguagcacugucgaggu

SEQ ID NO: 1066234 - RNA, 19 nt, Mycobacterium bovis subsp bovis AF2122/97
aacgguacgccgccgcgac

SEQ ID NO: 1066235 - RNA, 20 nt, Mycobacterium bovis subsp bovis AF2122/97
aaccgcggaucgaccgccag

SEQ ID NO: 1066236 - RNA, 23 nt, Mycobacterium bovis subsp bovis AF2122/97
aaccgcggaucgaccgccagcgc

SEQ ID NO: 1066237 - RNA, 13 nt, Mycobacterium bovis subsp bovis AF2122/97
aaccgcggccccg

SEQ ID NO: 1066238 - RNA, 21 nt, Mycobacterium bovis subsp bovis AF2122/97
aaccgcgcgagccucgcgcgu

SEQ ID NO: 1066239 - RNA, 13 nt, Mycobacterium bovis subsp bovis AF2122/97
aaccgcgcggcga

SEQ ID NO: 1066240 - RNA, 21 nt, Mycobacterium bovis subsp bovis AF2122/97
aaccgccgcugccgcgcggcg

SEQ ID NO: 1066241 - RNA, 22 nt, Mycobacterium bovis subsp bovis AF2122/97
aaccgccgcugccgcgcggcga

SEQ ID NO: 1066242 - RNA, 22 nt, Mycobacterium bovis subsp bovis AF2122/97
aaccgccccgugggccucgauc

SEQ ID NO: 1066243 - RNA, 18 nt, Mycobacterium bovis subsp bovis AF2122/97
aaccgccggugccgauga

SEQ ID NO: 1066244 - RNA, 16 nt, Mycobacterium bovis subsp bovis AF2122/97
aaccgcguccgcgcgu

SEQ ID NO: 1066245 - RNA, 19 nt, Mycobacterium bovis subsp bovis AF2122/97
aaccuuugcguugcugagc

SEQ ID NO: 1066246 - RNA, 21 nt, Mycobacterium bovis subsp bovis AF2122/97
aacgauagaacguagcgccca

SEQ ID NO: 1066247 - RNA, 22 nt, Mycobacterium bovis subsp bovis AF2122/97
aacgaucgacaccagggcgugc

SEQ ID NO: 1066248 - RNA, 21 nt, Mycobacterium bovis subsp bovis AF2122/97
aacgaugccggcaagccugcg

SEQ ID NO: 1066249 - RNA, 17 nt, Mycobacterium bovis subsp bovis AF2122/97
aacgaucgacaccaggg

SEQ ID NO: 1066250 - RNA, 14 nt, Mycobacterium bovis subsp bovis AF2122/97
aacgaucgcgccgu

SEQ ID NO: 1066251 - RNA, 16 nt, Mycobacterium bovis subsp bovis AF2122/97
aacgacaggcgcccac

SEQ ID NO: 1066252 - RNA, 14 nt, Mycobacterium bovis subsp bovis AF2122/97
aacgacacgccgca

SEQ ID NO: 1066253 - RNA, 16 nt, Mycobacterium bovis subsp bovis AF2122/97
aacgaagccggcgccg

SEQ ID NO: 1066254 - RNA, 21 nt, Mycobacterium bovis subsp bovis AF2122/97
aacgacaacacccacgugcug

SEQ ID NO: 1066255 - RNA, 18 nt, Mycobacterium bovis subsp bovis AF2122/97
aacgaaccgcucagcgca

SEQ ID NO: 1066256 - RNA, 23 nt, Mycobacterium bovis subsp bovis AF2122/97
aacgcgaauaccagaccggccga

SEQ ID NO: 1066257 - RNA, 16 nt, Mycobacterium bovis subsp bovis AF2122/97
aacgccggguucgccg

SEQ ID NO: 1066258 - RNA, 16 nt, Mycobacterium bovis subsp bovis AF2122/97
aacgcgaacccgcgag

SEQ ID NO: 1066259 - RNA, 23 nt, Mycobacterium bovis subsp bovis AF2122/97
aacgcgaccaucucgacgucggu

SEQ ID NO: 1066260 - RNA, 15 nt, Mycobacterium bovis subsp bovis AF2122/97
aacgccggcaccgac

SEQ ID NO: 1066261 - RNA, 13 nt, Mycobacterium bovis subsp bovis AF2122/97
aacgccgcgccgu

SEQ ID NO: 1066262 - RNA, 13 nt, Mycobacterium bovis subsp bovis AF2122/97
aacgccggcaucg

SEQ ID NO: 1066263 - RNA, 15 nt, Mycobacterium bovis subsp bovis AF2122/97
aacgccgagcgccag

SEQ ID NO: 1066264 - RNA, 22 nt, Mycobacterium bovis subsp bovis AF2122/97
aacgccgccagcgcggugucgg

SEQ ID NO: 1066265 - RNA, 13 nt, Mycobacterium bovis subsp bovis AF2122/97
aacgccgcccgcc

SEQ ID NO: 1066266 - RNA, 17 nt, Mycobacterium bovis subsp bovis AF2122/97
aacgccgcccgcugggc

SEQ ID NO: 1066267 - RNA, 15 nt, Mycobacterium bovis subsp bovis AF2122/97
aacgccaacgccacg

SEQ ID NO: 1066268 - RNA, 14 nt, Mycobacterium bovis subsp bovis AF2122/97
aacgauugcugcgg

SEQ ID NO: 1066269 - RNA, 14 nt, Mycobacterium bovis subsp bovis AF2122/97
aacgcaagcagcgc

SEQ ID NO: 1066270 - RNA, 15 nt, Mycobacterium bovis subsp bovis AF2122/97
aacgauguccgcgcg

SEQ ID NO: 1066271 - RNA, 16 nt, Mycobacterium bovis subsp bovis AF2122/97
aacgauguccgcgcga

SEQ ID NO: 1066272 - RNA, 17 nt, Mycobacterium bovis subsp bovis AF2122/97
aacgauggcgaugaggu

SEQ ID NO: 1066273 - RNA, 18 nt, Mycobacterium bovis subsp bovis AF2122/97
aacgauguccgcgcgaac

SEQ ID NO: 1066274 - RNA, 17 nt, Mycobacterium bovis subsp bovis AF2122/97
aacgcaccgaaacgccg

SEQ ID NO: 1066275 - RNA, 12 nt, Mycobacterium bovis subsp bovis AF2122/97
aagcccaacagc

SEQ ID NO: 1066276 - RNA, 15 nt, Mycobacterium bovis subsp bovis AF2122/97
aagcccgaucggcgg

SEQ ID NO: 1066277 - RNA, 13 nt, Mycobacterium bovis subsp bovis AF2122/97
aagcagccagcaa

SEQ ID NO: 1066278 - RNA, 13 nt, Mycobacterium bovis subsp bovis AF2122/97
aagcccggcggca

SEQ ID NO: 1066279 - RNA, 12 nt, Mycobacterium bovis subsp bovis AF2122/97
aagcccgccgga

SEQ ID NO: 1066280 - RNA, 22 nt, Mycobacterium bovis subsp bovis AF2122/97
aagcccgccggacccgccgggu

SEQ ID NO: 1066281 - RNA, 22 nt, Mycobacterium bovis subsp bovis AF2122/97
aagcccgaguuguucgugccgg

SEQ ID NO: 1066282 - RNA, 17 nt, Mycobacterium bovis subsp bovis AF2122/97
aagccugcgggccggca

SEQ ID NO: 1066283 - RNA, 12 nt, Mycobacterium bovis subsp bovis AF2122/97
aagcgaccgacg

SEQ ID NO: 1066284 - RNA, 16 nt, Mycobacterium bovis subsp bovis AF2122/97
aagcgacucgccggcg

SEQ ID NO: 1066285 - RNA, 17 nt, Mycobacterium bovis subsp bovis AF2122/97
aagcgacucgccggcga

SEQ ID NO: 1066286 - RNA, 18 nt, Mycobacterium bovis subsp bovis AF2122/97
aagcgccgcuuggcgauc

SEQ ID NO: 1066287 - RNA, 13 nt, Mycobacterium bovis subsp bovis AF2122/97
aagcgccggccga

SEQ ID NO: 1066288 - RNA, 19 nt, Mycobacterium bovis subsp bovis AF2122/97
aagcgccgcgcuugcgauc

SEQ ID NO: 1066289 - RNA, 13 nt, Mycobacterium bovis subsp bovis AF2122/97
aagcggccucgac

SEQ ID NO: 1066290 - RNA, 23 nt, Mycobacterium bovis subsp bovis AF2122/97
aagcgucguugcucggucucguc

SEQ ID NO: 1066291 - RNA, 19 nt, Mycobacterium bovis subsp bovis AF2122/97
aagcgugacccgccggcga

SEQ ID NO: 1066292 - RNA, 22 nt, Mycobacterium bovis subsp bovis AF2122/97
aagcgugccugcaguucggcgu

SEQ ID NO: 1066293 - RNA, 18 nt, Mycobacterium bovis subsp bovis AF2122/97
aagcguugaccgcggucu

SEQ ID NO: 1066294 - RNA, 16 nt, Mycobacterium bovis subsp bovis AF2122/97
aagcgcguuguugucg

SEQ ID NO: 1066295 - RNA, 19 nt, Mycobacterium bovis subsp bovis AF2122/97
aagcgcguuguugucgauc

SEQ ID NO: 1066296 - RNA, 22 nt, Mycobacterium bovis subsp bovis AF2122/97
aagcucaagggacacccgcuuu

SEQ ID NO: 1066297 - RNA, 20 nt, Mycobacterium bovis subsp bovis AF2122/97
aagcucgaccgcccggcuag

SEQ ID NO: 1066298 - RNA, 18 nt, Mycobacterium bovis subsp bovis AF2122/97
aagcucgcaaccgagaug

SEQ ID NO: 1066299 - RNA, 12 nt, Mycobacterium bovis subsp bovis AF2122/97
aagcucgccgga

SEQ ID NO: 1066300 - RNA, 19 nt, Mycobacterium bovis subsp bovis AF2122/97
aagcucucggcacccggca

SEQ ID NO: 1066301 - RNA, 16 nt, Mycobacterium bovis subsp bovis AF2122/97
aacuagguucagcgac

SEQ ID NO: 1066302 - RNA, 17 nt, Mycobacterium bovis subsp bovis AF2122/97
aagagcggagccggcgc

SEQ ID NO: 1066303 - RNA, 15 nt, Mycobacterium bovis subsp bovis AF2122/97
aagauaacggcgacc

SEQ ID NO: 1066304 - RNA, 20 nt, Mycobacterium bovis subsp bovis AF2122/97
aagagucgugccgccgcaug

SEQ ID NO: 1066305 - RNA, 17 nt, Mycobacterium bovis subsp bovis AF2122/97
aagaguucgcgcgccgc

SEQ ID NO: 1066306 - RNA, 16 nt, Mycobacterium bovis subsp bovis AF2122/97
aacgugauguggucgg

SEQ ID NO: 1066307 - RNA, 19 nt, Mycobacterium bovis subsp bovis AF2122/97
aacgugcgcaacgcgucgu

SEQ ID NO: 1066308 - RNA, 19 nt, Mycobacterium bovis subsp bovis AF2122/97
aacgugaugcggucgcgga

SEQ ID NO: 1066309 - RNA, 19 nt, Mycobacterium bovis subsp bovis AF2122/97
aacgugaugcguucggccg

SEQ ID NO: 1066310 - RNA, 14 nt, Mycobacterium bovis subsp bovis AF2122/97
aacgugcugguggg

SEQ ID NO: 1066311 - RNA, 12 nt, Mycobacterium bovis subsp bovis AF2122/97
aacgugucgggu

SEQ ID NO: 1066312 - RNA, 14 nt, Mycobacterium bovis subsp bovis AF2122/97
aagcaacggaaucg

SEQ ID NO: 1066313 - RNA, 13 nt, Mycobacterium bovis subsp bovis AF2122/97
aagcaagggcgau

SEQ ID NO: 1066314 - RNA, 20 nt, Mycobacterium bovis subsp bovis AF2122/97
aagcaaggguuugcgggcgu

SEQ ID NO: 1066315 - RNA, 21 nt, Mycobacterium bovis subsp bovis AF2122/97
aagcacagcccggcgacgacc

SEQ ID NO: 1066316 - RNA, 19 nt, Mycobacterium bovis subsp bovis AF2122/97
aagcagaaguccucggcgg

SEQ ID NO: 1066317 - RNA, 14 nt, Mycobacterium bovis subsp bovis AF2122/97
aagcacaccgccag

SEQ ID NO: 1066318 - RNA, 19 nt, Mycobacterium bovis subsp bovis AF2122/97
aagcacaccgccagcggca

SEQ ID NO: 1066319 - RNA, 15 nt, Mycobacterium bovis subsp bovis AF2122/97
aagcacagcccggcg

SEQ ID NO: 1066320 - RNA, 19 nt, Mycobacterium bovis subsp bovis AF2122/97
aagaugaccucggcgacga

SEQ ID NO: 1066321 - RNA, 20 nt, Mycobacterium bovis subsp bovis AF2122/97
aagauggcgcgcugggcugc

SEQ ID NO: 1066322 - RNA, 23 nt, Mycobacterium bovis subsp bovis AF2122/97
aagauuauggcgagcgcgccaau

SEQ ID NO: 1066323 - RNA, 14 nt, Mycobacterium bovis subsp bovis AF2122/97
aagauguccggucc

SEQ ID NO: 1066324 - RNA, 19 nt, Mycobacterium bovis subsp bovis AF2122/97
aagauguugccgccgguca

SEQ ID NO: 1066325 - RNA, 19 nt, Mycobacterium bovis subsp bovis AF2122/97
aagauguugcgacggccgg

SEQ ID NO: 1066326 - RNA, 21 nt, Mycobacterium bovis subsp bovis AF2122/97
aagaucuucaccggccggugc

SEQ ID NO: 1066327 - RNA, 15 nt, Mycobacterium bovis subsp bovis AF2122/97
aagaucacgcgucgu

SEQ ID NO: 1066328 - RNA, 13 nt, Mycobacterium bovis subsp bovis AF2122/97
aagauccagcgca

SEQ ID NO: 1066329 - RNA, 14 nt, Mycobacterium bovis subsp bovis AF2122/97
aaggcgccggucgc

SEQ ID NO: 1066330 - RNA, 12 nt, Mycobacterium bovis subsp bovis AF2122/97
aaggcgccgaac

SEQ ID NO: 1066331 - RNA, 22 nt, Mycobacterium bovis subsp bovis AF2122/97
aaggcgccgauaccggcggcga

SEQ ID NO: 1066332 - RNA, 12 nt, Mycobacterium bovis subsp bovis AF2122/97
aaggcgcgggcg

SEQ ID NO: 1066333 - RNA, 21 nt, Mycobacterium bovis subsp bovis AF2122/97
aaggcgcugccuucuaccgaa

SEQ ID NO: 1066334 - RNA, 20 nt, Mycobacterium bovis subsp bovis AF2122/97
aagggagaccgcggccggcc

SEQ ID NO: 1066335 - RNA, 15 nt, Mycobacterium bovis subsp bovis AF2122/97
aagggaguguuuggg

SEQ ID NO: 1066336 - RNA, 12 nt, Mycobacterium bovis subsp bovis AF2122/97
aagggauccgga

SEQ ID NO: 1066337 - RNA, 14 nt, Mycobacterium bovis subsp bovis AF2122/97
aaggcguucgccgg

SEQ ID NO: 1066338 - RNA, 18 nt, Mycobacterium bovis subsp bovis AF2122/97
aaggcguucgccggggcg

SEQ ID NO: 1066339 - RNA, 23 nt, Mycobacterium bovis subsp bovis AF2122/97
aaggcgugacgcuaacgucgauc

SEQ ID NO: 1066340 - RNA, 21 nt, Mycobacterium bovis subsp bovis AF2122/97
aaggacguggcgcuggaccgg

SEQ ID NO: 1066341 - RNA, 19 nt, Mycobacterium bovis subsp bovis AF2122/97
aaggacguuucagccgggu

SEQ ID NO: 1066342 - RNA, 21 nt, Mycobacterium bovis subsp bovis AF2122/97
aaggaaaaugauagcggcgca

SEQ ID NO: 1066343 - RNA, 12 nt, Mycobacterium bovis subsp bovis AF2122/97
aaggacgcaccg

SEQ ID NO: 1066344 - RNA, 22 nt, Mycobacterium bovis subsp bovis AF2122/97
aagggcugggucagguugucgg

SEQ ID NO: 1066345 - RNA, 22 nt, Mycobacterium bovis subsp bovis AF2122/97
aagggcuggucuacccgcggcg

SEQ ID NO: 1066346 - RNA, 21 nt, Mycobacterium bovis subsp bovis AF2122/97
aagggggucgagcgcuucguc

SEQ ID NO: 1066347 - RNA, 19 nt, Mycobacterium bovis subsp bovis AF2122/97
aaggggcucagcgguggcg

SEQ ID NO: 1066348 - RNA, 13 nt, Mycobacterium bovis subsp bovis AF2122/97
aagguugccgauc

SEQ ID NO: 1066349 - RNA, 21 nt, Mycobacterium bovis subsp bovis AF2122/97
aaguacuggcguugccaccgg

SEQ ID NO: 1066350 - RNA, 19 nt, Mycobacterium bovis subsp bovis AF2122/97
aaguagccgaccggcagcg

SEQ ID NO: 1066351 - RNA, 17 nt, Mycobacterium bovis subsp bovis AF2122/97
aaguagguuuucggcgg

SEQ ID NO: 1066352 - RNA, 16 nt, Mycobacterium bovis subsp bovis AF2122/97
aaguagucggcgccga

SEQ ID NO: 1066353 - RNA, 23 nt, Mycobacterium bovis subsp bovis AF2122/97
aauaccgguggcagccugcugca

SEQ ID NO: 1066354 - RNA, 22 nt, Mycobacterium bovis subsp bovis AF2122/97
aauacagauauuugucggcgcc

SEQ ID NO: 1066355 - RNA, 23 nt, Mycobacterium bovis subsp bovis AF2122/97
aauacaccuuguggacccgccag

SEQ ID NO: 1066356 - RNA, 17 nt, Mycobacterium bovis subsp bovis AF2122/97
aaguccuccacggcggg

SEQ ID NO: 1066357 - RNA, 18 nt, Mycobacterium bovis subsp bovis AF2122/97
aaguccuccacggcggga

SEQ ID NO: 1066358 - RNA, 15 nt, Mycobacterium bovis subsp bovis AF2122/97
aaguccuccgggcug

SEQ ID NO: 1066359 - RNA, 18 nt, Mycobacterium bovis subsp bovis AF2122/97
aaguccgagacgucggcg

SEQ ID NO: 1066360 - RNA, 14 nt, Mycobacterium bovis subsp bovis AF2122/97
aagucacggcggcu

SEQ ID NO: 1066361 - RNA, 14 nt, Mycobacterium bovis subsp bovis AF2122/97
aaguccagcagcga

SEQ ID NO: 1066362 - RNA, 15 nt, Mycobacterium bovis subsp bovis AF2122/97
aagucgacgguggcg

SEQ ID NO: 1066363 - RNA, 18 nt, Mycobacterium bovis subsp bovis AF2122/97
aaguccuucacugcgacc

SEQ ID NO: 1066364 - RNA, 23 nt, Mycobacterium bovis subsp bovis AF2122/97
aagucccgccguugccgccguca

SEQ ID NO: 1066365 - RNA, 19 nt, Mycobacterium bovis subsp bovis AF2122/97
aaugcgaugcggucgucac

SEQ ID NO: 1066366 - RNA, 11 nt, Mycobacterium bovis subsp bovis AF2122/97
aaugcgagcgc

SEQ ID NO: 1066367 - RNA, 15 nt, Mycobacterium bovis subsp bovis AF2122/97
aauggacaccaaccc

SEQ ID NO: 1066368 - RNA, 18 nt, Mycobacterium bovis subsp bovis AF2122/97
aauggcaacacaccgaac

SEQ ID NO: 1066369 - RNA, 12 nt, Mycobacterium bovis subsp bovis AF2122/97
aauggcaccgag

SEQ ID NO: 1066370 - RNA, 16 nt, Mycobacterium bovis subsp bovis AF2122/97
aaugucaccccgccca

SEQ ID NO: 1066371 - RNA, 17 nt, Mycobacterium bovis subsp bovis AF2122/97
aauggccagcaccacgg

SEQ ID NO: 1066372 - RNA, 13 nt, Mycobacterium bovis subsp bovis AF2122/97
aauggccaccggc

SEQ ID NO: 1066373 - RNA, 19 nt, Mycobacterium bovis subsp bovis AF2122/97
aauggcagcacgaccuggu

SEQ ID NO: 1066374 - RNA, 23 nt, Mycobacterium bovis subsp bovis AF2122/97
aaugguucgcacaccuccucgac

SEQ ID NO: 1066375 - RNA, 15 nt, Mycobacterium bovis subsp bovis AF2122/97
aaugguggugucggc

SEQ ID NO: 1066376 - RNA, 13 nt, Mycobacterium bovis subsp bovis AF2122/97
aaugccggccgcg

SEQ ID NO: 1066377 - RNA, 20 nt, Mycobacterium bovis subsp bovis AF2122/97
aaucuucucgagccgccgga

SEQ ID NO: 1066378 - RNA, 19 nt, Mycobacterium bovis subsp bovis AF2122/97
aaucugcuagcuuggcggc

SEQ ID NO: 1066379 - RNA, 19 nt, Mycobacterium bovis subsp bovis AF2122/97
aaugucggcagggccccca

SEQ ID NO: 1066380 - RNA, 14 nt, Mycobacterium bovis subsp bovis AF2122/97
aauuaggucgacca

SEQ ID NO: 1066381 - RNA, 15 nt, Mycobacterium bovis subsp bovis AF2122/97
aauucaacagcaccg

SEQ ID NO: 1066382 - RNA, 19 nt, Mycobacterium bovis subsp bovis AF2122/97
aauucguucagcgccagcg

SEQ ID NO: 1066383 - RNA, 14 nt, Mycobacterium bovis subsp bovis AF2122/97
aauccggucagcgc

SEQ ID NO: 1066384 - RNA, 14 nt, Mycobacterium bovis subsp bovis AF2122/97
aauccggugaugac

SEQ ID NO: 1066385 - RNA, 18 nt, Mycobacterium bovis subsp bovis AF2122/97
aauccgaucaccucggcg

SEQ ID NO: 1066386 - RNA, 15 nt, Mycobacterium bovis subsp bovis AF2122/97
aauccggccagaccc

SEQ ID NO: 1066387 - RNA, 17 nt, Mycobacterium bovis subsp bovis AF2122/97
aauccgcacagcgacga

SEQ ID NO: 1066388 - RNA, 14 nt, Mycobacterium bovis subsp bovis AF2122/97
aauccgcucggucg

SEQ ID NO: 1066389 - RNA, 17 nt, Mycobacterium bovis subsp bovis AF2122/97
aauccgguguugagauc

SEQ ID NO: 1066390 - RNA, 14 nt, Mycobacterium bovis subsp bovis AF2122/97
aauccuccuccgca

SEQ ID NO: 1066391 - RNA, 14 nt, Mycobacterium bovis subsp bovis AF2122/97
aauccguccgacga

SEQ ID NO: 1066392 - RNA, 14 nt, Mycobacterium bovis subsp bovis AF2122/97
aauccuucggcgug

SEQ ID NO: 1066393 - RNA, 19 nt, Mycobacterium bovis subsp bovis AF2122/97
aaucgaaaaggugcaccau

SEQ ID NO: 1066394 - RNA, 13 nt, Mycobacterium bovis subsp bovis AF2122/97
aaucgagcaccgc

SEQ ID NO: 1066395 - RNA, 18 nt, Mycobacterium bovis subsp bovis AF2122/97
aaucgaccgcccgccaac

SEQ ID NO: 1066396 - RNA, 18 nt, Mycobacterium bovis subsp bovis AF2122/97
aaucgcccucgucgcggg

SEQ ID NO: 1066397 - RNA, 12 nt, Mycobacterium bovis subsp bovis AF2122/97
aaucgccgucag

SEQ ID NO: 1066398 - RNA, 18 nt, Mycobacterium bovis subsp bovis AF2122/97
aaucgucaguaccgcacg

SEQ ID NO: 1066399 - RNA, 14 nt, Mycobacterium bovis subsp bovis AF2122/97
aaucgucagcgccg

SEQ ID NO: 1066400 - RNA, 13 nt, Mycobacterium bovis subsp bovis AF2122/97
aaucgucgcggcc

SEQ ID NO: 1066401 - RNA, 12 nt, Mycobacterium bovis subsp bovis AF2122/97
aaucguuugugu

SEQ ID NO: 1066402 - RNA, 23 nt, Mycobacterium bovis subsp bovis AF2122/97
aaucgcucugugucgccgaucac

SEQ ID NO: 1066403 - RNA, 16 nt, Mycobacterium bovis subsp bovis AF2122/97
aaucggaccgaccggc

SEQ ID NO: 1066404 - RNA, 17 nt, Mycobacterium bovis subsp bovis AF2122/97
aaucggagccgucgagc

SEQ ID NO: 1066405 - RNA, 23 nt, Mycobacterium bovis subsp bovis AF2122/97
aaucggagucuucaacgucgaga

SEQ ID NO: 1066406 - RNA, 19 nt, Mycobacterium bovis subsp bovis AF2122/97
aaucgcgcuucaggcauca

SEQ ID NO: 1066407 - RNA, 22 nt, Mycobacterium bovis subsp bovis AF2122/97
aaucgcgucgagcgccggccgc

SEQ ID NO: 1066408 - RNA, 11 nt, Mycobacterium bovis subsp bovis AF2122/97
aaucggcggcg

SEQ ID NO: 1066409 - RNA, 12 nt, Mycobacterium bovis subsp bovis AF2122/97
aaucggcaccgu

SEQ ID NO: 1066410 - RNA, 20 nt, Mycobacterium bovis subsp bovis AF2122/97
aauccaaggcucagcagcgc

SEQ ID NO: 1066411 - RNA, 23 nt, Mycobacterium bovis subsp bovis AF2122/97
aaucaucugcacauucagcgccg

SEQ ID NO: 1066412 - RNA, 15 nt, Mycobacterium bovis subsp bovis AF2122/97
aaucccacgcccggc

SEQ ID NO: 1066413 - RNA, 15 nt, Mycobacterium bovis subsp bovis AF2122/97
aauccacgucgcggc

SEQ ID NO: 1066414 - RNA, 20 nt, Mycobacterium bovis subsp bovis AF2122/97
aaucccgcucccccgccaac

SEQ ID NO: 1066415 - RNA, 13 nt, Mycobacterium bovis subsp bovis AF2122/97
aauccccgcggcg

SEQ ID NO: 1066416 - RNA, 14 nt, Mycobacterium bovis subsp bovis AF2122/97
aauccgaacucgcg

SEQ ID NO: 1066417 - RNA, 16 nt, Mycobacterium bovis subsp bovis AF2122/97
aauccgacgucgacga

SEQ ID NO: 1066418 - RNA, 22 nt, Mycobacterium bovis subsp bovis AF2122/97
aaucccggccaggggcgcagcg

SEQ ID NO: 1066419 - RNA, 16 nt, Mycobacterium bovis subsp bovis AF2122/97
aauagcgacagcagcg

SEQ ID NO: 1066420 - RNA, 17 nt, Mycobacterium bovis subsp bovis AF2122/97
aauagcgacagcagcgc

SEQ ID NO: 1066421 - RNA, 19 nt, Mycobacterium bovis subsp bovis AF2122/97
aauaguccuugcgccagcg

SEQ ID NO: 1066422 - RNA, 18 nt, Mycobacterium bovis subsp bovis AF2122/97
aauagcucgccggcgaac

SEQ ID NO: 1066423 - RNA, 18 nt, Mycobacterium bovis subsp bovis AF2122/97
aauaguugaccaggccga

SEQ ID NO: 1066424 - RNA, 16 nt, Mycobacterium bovis subsp bovis AF2122/97
aauaguuguugcagga

SEQ ID NO: 1066425 - RNA, 14 nt, Mycobacterium bovis subsp bovis AF2122/97
accaccucagcugc

SEQ ID NO: 1066426 - RNA, 18 nt, Mycobacterium bovis subsp bovis AF2122/97
accaccguuaccggggug

SEQ ID NO: 1066427 - RNA, 14 nt, Mycobacterium bovis subsp bovis AF2122/97
accaccgugaccga

SEQ ID NO: 1066428 - RNA, 14 nt, Mycobacterium bovis subsp bovis AF2122/97
accaccggcaccgc

SEQ ID NO: 1066429 - RNA, 21 nt, Mycobacterium bovis subsp bovis AF2122/97
accaccgcgaccucgcggcgc

SEQ ID NO: 1066430 - RNA, 15 nt, Mycobacterium bovis subsp bovis AF2122/97
accaccggcaccgcu

SEQ ID NO: 1066431 - RNA, 15 nt, Mycobacterium bovis subsp bovis AF2122/97
accaccgucucgccg

SEQ ID NO: 1066432 - RNA, 18 nt, Mycobacterium bovis subsp bovis AF2122/97
accaccgucucgccgcgc

SEQ ID NO: 1066433 - RNA, 19 nt, Mycobacterium bovis subsp bovis AF2122/97
accaccgucucgccgcgca

SEQ ID NO: 1066434 - RNA, 14 nt, Mycobacterium bovis subsp bovis AF2122/97
accaccggcacggu

SEQ ID NO: 1066435 - RNA, 19 nt, Mycobacterium bovis subsp bovis AF2122/97
accaccggccccaccggca

SEQ ID NO: 1066436 - RNA, 19 nt, Mycobacterium bovis subsp bovis AF2122/97
accaccgucaccgccggca

SEQ ID NO: 1066437 - RNA, 17 nt, Mycobacterium bovis subsp bovis AF2122/97
accaccgucuccggcgc

SEQ ID NO: 1066438 - RNA, 23 nt, Mycobacterium bovis subsp bovis AF2122/97
accaccgucuccggcgccaccgc

SEQ ID NO: 1066439 - RNA, 20 nt, Mycobacterium bovis subsp bovis AF2122/97
accaccucggugaccaggcc

SEQ ID NO: 1066440 - RNA, 22 nt, Mycobacterium bovis subsp bovis AF2122/97
accaccucggugaccaggccgg

SEQ ID NO: 1066441 - RNA, 15 nt, Mycobacterium bovis subsp bovis AF2122/97
accaccuggccggcc

SEQ ID NO: 1066442 - RNA, 16 nt, Mycobacterium bovis subsp bovis AF2122/97
accacgaccgacaccc

SEQ ID NO: 1066443 - RNA, 17 nt, Mycobacterium bovis subsp bovis AF2122/97
accacgaggcuugcggc

SEQ ID NO: 1066444 - RNA, 19 nt, Mycobacterium bovis subsp bovis AF2122/97
accacgaucaacucgugcg

SEQ ID NO: 1066445 - RNA, 14 nt, Mycobacterium bovis subsp bovis AF2122/97
accacgacguucga

SEQ ID NO: 1066446 - RNA, 12 nt, Mycobacterium bovis subsp bovis AF2122/97
accacgcaccgc

SEQ ID NO: 1066447 - RNA, 17 nt, Mycobacterium bovis subsp bovis AF2122/97
accacgcccgacgagga

SEQ ID NO: 1066448 - RNA, 13 nt, Mycobacterium bovis subsp bovis AF2122/97
accacgucgucgg

SEQ ID NO: 1066449 - RNA, 16 nt, Mycobacterium bovis subsp bovis AF2122/97
accacgugaucgacga

SEQ ID NO: 1066450 - RNA, 17 nt, Mycobacterium bovis subsp bovis AF2122/97
accacgugaucgacgac

SEQ ID NO: 1066451 - RNA, 19 nt, Mycobacterium bovis subsp bovis AF2122/97
accacgguuggccaccagc

SEQ ID NO: 1066452 - RNA, 18 nt, Mycobacterium bovis subsp bovis AF2122/97
accacggucaagccggcg

SEQ ID NO: 1066453 - RNA, 16 nt, Mycobacterium bovis subsp bovis AF2122/97
accacggugaguuggc

SEQ ID NO: 1066454 - RNA, 16 nt, Mycobacterium bovis subsp bovis AF2122/97
accacggucagcacgc

SEQ ID NO: 1066455 - RNA, 16 nt, Mycobacterium bovis subsp bovis AF2122/97
accacggcguugccgc

SEQ ID NO: 1066456 - RNA, 19 nt, Mycobacterium bovis subsp bovis AF2122/97
accacggcguugccgccgg

SEQ ID NO: 1066457 - RNA, 19 nt, Mycobacterium bovis subsp bovis AF2122/97
accacggcgauccggucgg

SEQ ID NO: 1066458 - RNA, 18 nt, Mycobacterium bovis subsp bovis AF2122/97
accacggaggguugccgc

SEQ ID NO: 1066459 - RNA, 21 nt, Mycobacterium bovis subsp bovis AF2122/97
accacggaggguugccgccga

SEQ ID NO: 1066460 - RNA, 23 nt, Mycobacterium bovis subsp bovis AF2122/97
accacgcuuaacagcggguccuu

SEQ ID NO: 1066461 - RNA, 17 nt, Mycobacterium bovis subsp bovis AF2122/97
accacgcuuaacagcgg

SEQ ID NO: 1066462 - RNA, 18 nt, Mycobacterium bovis subsp bovis AF2122/97
accacgcgcgucggugug

SEQ ID NO: 1066463 - RNA, 21 nt, Mycobacterium bovis subsp bovis AF2122/97
accacgcguuucgaaccgcac

SEQ ID NO: 1066464 - RNA, 14 nt, Mycobacterium bovis subsp bovis AF2122/97
accacggccgccgc

SEQ ID NO: 1066465 - RNA, 15 nt, Mycobacterium bovis subsp bovis AF2122/97
accacggcagccaac

SEQ ID NO: 1066466 - RNA, 22 nt, Mycobacterium bovis subsp bovis AF2122/97
accacggcagccaaccggcgca

SEQ ID NO: 1066467 - RNA, 20 nt, Mycobacterium bovis subsp bovis AF2122/97
accacggcaggcagggcagc

SEQ ID NO: 1066468 - RNA, 12 nt, Mycobacterium bovis subsp bovis AF2122/97
accacggccaga

SEQ ID NO: 1066469 - RNA, 12 nt, Mycobacterium bovis subsp bovis AF2122/97
accacgccgacg

SEQ ID NO: 1066470 - RNA, 14 nt, Mycobacterium bovis subsp bovis AF2122/97
accacgccgacgug

SEQ ID NO: 1066471 - RNA, 15 nt, Mycobacterium bovis subsp bovis AF2122/97
accacgccggugacg

SEQ ID NO: 1066472 - RNA, 16 nt, Mycobacterium bovis subsp bovis AF2122/97
accacgccgccggcgc

SEQ ID NO: 1066473 - RNA, 13 nt, Mycobacterium bovis subsp bovis AF2122/97
accacgcgacgcg

SEQ ID NO: 1066474 - RNA, 23 nt, Mycobacterium bovis subsp bovis AF2122/97
accacgcgagggcauccgagcgg

SEQ ID NO: 1066475 - RNA, 13 nt, Mycobacterium bovis subsp bovis AF2122/97
accacgcggcggu

SEQ ID NO: 1066476 - RNA, 19 nt, Mycobacterium bovis subsp bovis AF2122/97
accacaccaaggccgagcg

SEQ ID NO: 1066477 - RNA, 22 nt, Mycobacterium bovis subsp bovis AF2122/97
accaaugcgucgaugcgcugcu

SEQ ID NO: 1066478 - RNA, 16 nt, Mycobacterium bovis subsp bovis AF2122/97
accaaugaccgccagc

SEQ ID NO: 1066479 - RNA, 19 nt, Mycobacterium bovis subsp bovis AF2122/97
accaauucccgcgcggcgu

SEQ ID NO: 1066480 - RNA, 21 nt, Mycobacterium bovis subsp bovis AF2122/97
accacaaccgugagcaccagc

SEQ ID NO: 1066481 - RNA, 15 nt, Mycobacterium bovis subsp bovis AF2122/97
accacaauccacgca

SEQ ID NO: 1066482 - RNA, 15 nt, Mycobacterium bovis subsp bovis AF2122/97
accaccacggccaga

SEQ ID NO: 1066483 - RNA, 21 nt, Mycobacterium bovis subsp bovis AF2122/97
accaccacuucggcgccgcgc

SEQ ID NO: 1066484 - RNA, 13 nt, Mycobacterium bovis subsp bovis AF2122/97
accaccagcgcuc

SEQ ID NO: 1066485 - RNA, 18 nt, Mycobacterium bovis subsp bovis AF2122/97
accaccacuaggucgccg

SEQ ID NO: 1066486 - RNA, 15 nt, Mycobacterium bovis subsp bovis AF2122/97
accaccaccggcaac

SEQ ID NO: 1066487 - RNA, 16 nt, Mycobacterium bovis subsp bovis AF2122/97
accacaugcgagucgc

SEQ ID NO: 1066488 - RNA, 20 nt, Mycobacterium bovis subsp bovis AF2122/97
accacaugcgagucgcacuc

SEQ ID NO: 1066489 - RNA, 17 nt, Mycobacterium bovis subsp bovis AF2122/97
accacaucaugccagcc

SEQ ID NO: 1066490 - RNA, 15 nt, Mycobacterium bovis subsp bovis AF2122/97
accacaucggugcca

SEQ ID NO: 1066491 - RNA, 24 nt, Mycobacterium bovis subsp bovis AF2122/97
accacaucggugccacguucgcgg

SEQ ID NO: 1066492 - RNA, 14 nt, Mycobacterium bovis subsp bovis AF2122/97
accaccaccgccgc

SEQ ID NO: 1066493 - RNA, 15 nt, Mycobacterium bovis subsp bovis AF2122/97
accacccgaccgcca

SEQ ID NO: 1066494 - RNA, 20 nt, Mycobacterium bovis subsp bovis AF2122/97
accaccccguagcggucucc

SEQ ID NO: 1066495 - RNA, 15 nt, Mycobacterium bovis subsp bovis AF2122/97
accaccccggccaac

SEQ ID NO: 1066496 - RNA, 17 nt, Mycobacterium bovis subsp bovis AF2122/97
accacccugcacugcgc

SEQ ID NO: 1066497 - RNA, 15 nt, Mycobacterium bovis subsp bovis AF2122/97
accaccgacagcacc

SEQ ID NO: 1066498 - RNA, 19 nt, Mycobacterium bovis subsp bovis AF2122/97
accaccgacagcacccggc

SEQ ID NO: 1066499 - RNA, 14 nt, Mycobacterium bovis subsp bovis AF2122/97
accacccgggccuc

SEQ ID NO: 1066500 - RNA, 21 nt, Mycobacterium bovis subsp bovis AF2122/97
accacccgggccucggcgccg

SEQ ID NO: 1066501 - RNA, 20 nt, Mycobacterium bovis subsp bovis AF2122/97
accaccgaaauacccagcgc

SEQ ID NO: 1066502 - RNA, 15 nt, Mycobacterium bovis subsp bovis AF2122/97
accaccaccgccgcc

SEQ ID NO: 1066503 - RNA, 21 nt, Mycobacterium bovis subsp bovis AF2122/97
accacccaacagcccaccggu

SEQ ID NO: 1066504 - RNA, 20 nt, Mycobacterium bovis subsp bovis AF2122/97
accaccaggcugucgugggc

SEQ ID NO: 1066505 - RNA, 20 nt, Mycobacterium bovis subsp bovis AF2122/97
accaccagguccaccccgcc

SEQ ID NO: 1066506 - RNA, 14 nt, Mycobacterium bovis subsp bovis AF2122/97
accacccagauugc

SEQ ID NO: 1066507 - RNA, 17 nt, Mycobacterium bovis subsp bovis AF2122/97
accacccaccggccacc

SEQ ID NO: 1066508 - RNA, 16 nt, Mycobacterium bovis subsp bovis AF2122/97
accacccagauugccu

SEQ ID NO: 1066509 - RNA, 13 nt, Mycobacterium bovis subsp bovis AF2122/97
accaccggccgcg

SEQ ID NO: 1066510 - RNA, 12 nt, Mycobacterium bovis subsp bovis AF2122/97
accaccggccgu

SEQ ID NO: 1066511 - RNA, 14 nt, Mycobacterium bovis subsp bovis AF2122/97
accaccggcgccgc

SEQ ID NO: 1066512 - RNA, 19 nt, Mycobacterium bovis subsp bovis AF2122/97
accaccggcgccgccggca

SEQ ID NO: 1066513 - RNA, 22 nt, Mycobacterium bovis subsp bovis AF2122/97
accaccgggauggcucacccag

SEQ ID NO: 1066514 - RNA, 20 nt, Mycobacterium bovis subsp bovis AF2122/97
accaccggcaacaucagcag

SEQ ID NO: 1066515 - RNA, 15 nt, Mycobacterium bovis subsp bovis AF2122/97
accaccggaacgccg

SEQ ID NO: 1066516 - RNA, 15 nt, Mycobacterium bovis subsp bovis AF2122/97
accaccgcggcggcg

SEQ ID NO: 1066517 - RNA, 14 nt, Mycobacterium bovis subsp bovis AF2122/97
accaccgcggcugc

SEQ ID NO: 1066518 - RNA, 14 nt, Mycobacterium bovis subsp bovis AF2122/97
accaccgcggugug

SEQ ID NO: 1066519 - RNA, 15 nt, Mycobacterium bovis subsp bovis AF2122/97
accaccgcgucgggc

SEQ ID NO: 1066520 - RNA, 13 nt, Mycobacterium bovis subsp bovis AF2122/97
accaccgcugccg

SEQ ID NO: 1066521 - RNA, 19 nt, Mycobacterium bovis subsp bovis AF2122/97
accaccgcugccggcgccg

SEQ ID NO: 1066522 - RNA, 18 nt, Mycobacterium bovis subsp bovis AF2122/97
accaccgcucgucguccg

SEQ ID NO: 1066523 - RNA, 17 nt, Mycobacterium bovis subsp bovis AF2122/97
accaccgccuggaucag

SEQ ID NO: 1066524 - RNA, 20 nt, Mycobacterium bovis subsp bovis AF2122/97
accaccgcgaaagcaccgag

SEQ ID NO: 1066525 - RNA, 13 nt, Mycobacterium bovis subsp bovis AF2122/97
accaccgccggcc

SEQ ID NO: 1066526 - RNA, 14 nt, Mycobacterium bovis subsp bovis AF2122/97
accaccgccggugc

SEQ ID NO: 1066527 - RNA, 23 nt, Mycobacterium bovis subsp bovis AF2122/97
accaccgccgccggcaccgccgg

SEQ ID NO: 1066528 - RNA, 14 nt, Mycobacterium bovis subsp bovis AF2122/97
accaccgccgccgg

SEQ ID NO: 1066529 - RNA, 15 nt, Mycobacterium bovis subsp bovis AF2122/97
accaccgccgccgaa

SEQ ID NO: 1066530 - RNA, 16 nt, Mycobacterium bovis subsp bovis AF2122/97
accaccgccccgcgcc

SEQ ID NO: 1066531 - RNA, 17 nt, Mycobacterium bovis subsp bovis AF2122/97
accaccgccgacaggcc

SEQ ID NO: 1066532 - RNA, 21 nt, Mycobacterium bovis subsp bovis AF2122/97
accaccgcauaacgccagucc

SEQ ID NO: 1066533 - RNA, 15 nt, Mycobacterium bovis subsp bovis AF2122/97
accagcaacagcccg

SEQ ID NO: 1066534 - RNA, 22 nt, Mycobacterium bovis subsp bovis AF2122/97
accagcaaccaccccagggcaa

SEQ ID NO: 1066535 - RNA, 16 nt, Mycobacterium bovis subsp bovis AF2122/97
accagaucgucgggca

SEQ ID NO: 1066536 - RNA, 17 nt, Mycobacterium bovis subsp bovis AF2122/97
accagaugcaccucgcc

SEQ ID NO: 1066537 - RNA, 12 nt, Mycobacterium bovis subsp bovis AF2122/97
accagcaccccg

SEQ ID NO: 1066538 - RNA, 13 nt, Mycobacterium bovis subsp bovis AF2122/97
accagcaaugccg

SEQ ID NO: 1066539 - RNA, 17 nt, Mycobacterium bovis subsp bovis AF2122/97
accagaucgucgggcac

SEQ ID NO: 1066540 - RNA, 18 nt, Mycobacterium bovis subsp bovis AF2122/97
accagcaccgccgcgccg

SEQ ID NO: 1066541 - RNA, 14 nt, Mycobacterium bovis subsp bovis AF2122/97
accagcaccgccgc

SEQ ID NO: 1066542 - RNA, 14 nt, Mycobacterium bovis subsp bovis AF2122/97
accagcacgacugc

SEQ ID NO: 1066543 - RNA, 20 nt, Mycobacterium bovis subsp bovis AF2122/97
accagcacggcaaccagcga

SEQ ID NO: 1066544 - RNA, 16 nt, Mycobacterium bovis subsp bovis AF2122/97
accagcagauccaggc

SEQ ID NO: 1066545 - RNA, 10 nt, Mycobacterium bovis subsp bovis AF2122/97
accagcagca

SEQ ID NO: 1066546 - RNA, 17 nt, Mycobacterium bovis subsp bovis AF2122/97
accagcagcacuccggc

SEQ ID NO: 1066547 - RNA, 19 nt, Mycobacterium bovis subsp bovis AF2122/97
accagcagcacuccggcga

SEQ ID NO: 1066548 - RNA, 20 nt, Mycobacterium bovis subsp bovis AF2122/97
accagcauucucgccgacgg

SEQ ID NO: 1066549 - RNA, 18 nt, Mycobacterium bovis subsp bovis AF2122/97
accagcaugccugcgaaa

SEQ ID NO: 1066550 - RNA, 13 nt, Mycobacterium bovis subsp bovis AF2122/97
accagcagcucgu

SEQ ID NO: 1066551 - RNA, 21 nt, Mycobacterium bovis subsp bovis AF2122/97
accagcaggcccuggccaccc

SEQ ID NO: 1066552 - RNA, 14 nt, Mycobacterium bovis subsp bovis AF2122/97
accacuucggcgcc

SEQ ID NO: 1066553 - RNA, 15 nt, Mycobacterium bovis subsp bovis AF2122/97
accagaaacaccgac

SEQ ID NO: 1066554 - RNA, 17 nt, Mycobacterium bovis subsp bovis AF2122/97
accagaaacaccgacga

SEQ ID NO: 1066555 - RNA, 23 nt, Mycobacterium bovis subsp bovis AF2122/97
accagaacgacgccgcggucgug

SEQ ID NO: 1066556 - RNA, 14 nt, Mycobacterium bovis subsp bovis AF2122/97
accagaaccagcga

SEQ ID NO: 1066557 - RNA, 22 nt, Mycobacterium bovis subsp bovis AF2122/97
accagauagaucgugaucgacc

SEQ ID NO: 1066558 - RNA, 17 nt, Mycobacterium bovis subsp bovis AF2122/97
accagacugcagugccg

SEQ ID NO: 1066559 - RNA, 22 nt, Mycobacterium bovis subsp bovis AF2122/97
accagacccacgauggcaaacg

SEQ ID NO: 1066560 - RNA, 22 nt, Mycobacterium bovis subsp bovis AF2122/97
accacguggcccuccucgguga

SEQ ID NO: 1066561 - RNA, 18 nt, Mycobacterium bovis subsp bovis AF2122/97
accacguugugcagcgcg

SEQ ID NO: 1066562 - RNA, 16 nt, Mycobacterium bovis subsp bovis AF2122/97
accacgucgaccgaac

SEQ ID NO: 1066563 - RNA, 21 nt, Mycobacterium bovis subsp bovis AF2122/97
accacuagcggcucaccgcgc

SEQ ID NO: 1066564 - RNA, 19 nt, Mycobacterium bovis subsp bovis AF2122/97
accacuagcggcucaccgc

SEQ ID NO: 1066565 - RNA, 20 nt, Mycobacterium bovis subsp bovis AF2122/97
accacuagcggcucaccgcg

SEQ ID NO: 1066566 - RNA, 16 nt, Mycobacterium bovis subsp bovis AF2122/97
accacuaggucgccgg

SEQ ID NO: 1066567 - RNA, 22 nt, Mycobacterium bovis subsp bovis AF2122/97
accacucgcggauccgggcgug

SEQ ID NO: 1066568 - RNA, 13 nt, Mycobacterium bovis subsp bovis AF2122/97
accacucgagcgc

SEQ ID NO: 1066569 - RNA, 14 nt, Mycobacterium bovis subsp bovis AF2122/97
accacucgccggcg

SEQ ID NO: 1066570 - RNA, 15 nt, Mycobacterium bovis subsp bovis AF2122/97
accacucgccggcgg

SEQ ID NO: 1066571 - RNA, 23 nt, Mycobacterium bovis subsp bovis AF2122/97
accacuguuacggccacaccguc

SEQ ID NO: 1066572 - RNA, 16 nt, Mycobacterium bovis subsp bovis AF2122/97
accacuguuggugccg

SEQ ID NO: 1066573 - RNA, 19 nt, Mycobacterium bovis subsp bovis AF2122/97
accacuguuucugagcgcg

SEQ ID NO: 1066574 - RNA, 18 nt, Mycobacterium bovis subsp bovis AF2122/97
accacugugacacccgag

SEQ ID NO: 1066575 - RNA, 14 nt, Mycobacterium bovis subsp bovis AF2122/97
accacuguuacggc

SEQ ID NO: 1066576 - RNA, 14 nt, Mycobacterium bovis subsp bovis AF2122/97
accagcgccccggc

SEQ ID NO: 1066577 - RNA, 17 nt, Mycobacterium bovis subsp bovis AF2122/97
accagcgccccggcgcg

SEQ ID NO: 1066578 - RNA, 18 nt, Mycobacterium bovis subsp bovis AF2122/97
accagcgccccggcgcgu

SEQ ID NO: 1066579 - RNA, 15 nt, Mycobacterium bovis subsp bovis AF2122/97
accagcgcccggccc

SEQ ID NO: 1066580 - RNA, 19 nt, Mycobacterium bovis subsp bovis AF2122/97
accagcgcccggcccgcca

SEQ ID NO: 1066581 - RNA, 15 nt, Mycobacterium bovis subsp bovis AF2122/97
accagcgcccgucgc

SEQ ID NO: 1066582 - RNA, 19 nt, Mycobacterium bovis subsp bovis AF2122/97
accagcgccgauaccagcc

SEQ ID NO: 1066583 - RNA, 18 nt, Mycobacterium bovis subsp bovis AF2122/97
accagcgccgcacccgcu

SEQ ID NO: 1066584 - RNA, 16 nt, Mycobacterium bovis subsp bovis AF2122/97
accagccgggcaaggc

SEQ ID NO: 1066585 - RNA, 17 nt, Mycobacterium bovis subsp bovis AF2122/97
accagccuuuccggccg

SEQ ID NO: 1066586 - RNA, 18 nt, Mycobacterium bovis subsp bovis AF2122/97
accagccuuuccggccgc

SEQ ID NO: 1066587 - RNA, 21 nt, Mycobacterium bovis subsp bovis AF2122/97
accagccgucguccgcugacc

SEQ ID NO: 1066588 - RNA, 17 nt, Mycobacterium bovis subsp bovis AF2122/97
accagcgaccaggucgc

SEQ ID NO: 1066589 - RNA, 21 nt, Mycobacterium bovis subsp bovis AF2122/97
accagcgaccaggucgccagc

SEQ ID NO: 1066590 - RNA, 14 nt, Mycobacterium bovis subsp bovis AF2122/97
accagcgacgacca

SEQ ID NO: 1066591 - RNA, 14 nt, Mycobacterium bovis subsp bovis AF2122/97
accagcgcagccga

SEQ ID NO: 1066592 - RNA, 13 nt, Mycobacterium bovis subsp bovis AF2122/97
accagcgaggcca

SEQ ID NO: 1066593 - RNA, 16 nt, Mycobacterium bovis subsp bovis AF2122/97
accagcgcacgcucgg

SEQ ID NO: 1066594 - RNA, 20 nt, Mycobacterium bovis subsp bovis AF2122/97
accagcgcagccgaucgucu

SEQ ID NO: 1066595 - RNA, 14 nt, Mycobacterium bovis subsp bovis AF2122/97
accagcgcaucggc

SEQ ID NO: 1066596 - RNA, 16 nt, Mycobacterium bovis subsp bovis AF2122/97
accagcgcaucggcca

SEQ ID NO: 1066597 - RNA, 14 nt, Mycobacterium bovis subsp bovis AF2122/97
accagccgccccgg

SEQ ID NO: 1066598 - RNA, 16 nt, Mycobacterium bovis subsp bovis AF2122/97
accagcccggccgccg

SEQ ID NO: 1066599 - RNA, 17 nt, Mycobacterium bovis subsp bovis AF2122/97
accagcccggccggucg

SEQ ID NO: 1066600 - RNA, 22 nt, Mycobacterium bovis subsp bovis AF2122/97
accagccggugagcgagcgcgc

SEQ ID NO: 1066601 - RNA, 23 nt, Mycobacterium bovis subsp bovis AF2122/97
accagccgguuggcugccggcaa

SEQ ID NO: 1066602 - RNA, 23 nt, Mycobacterium bovis subsp bovis AF2122/97
accagccguggugguugaucagc

SEQ ID NO: 1066603 - RNA, 17 nt, Mycobacterium bovis subsp bovis AF2122/97
accagcccgaugauccc

SEQ ID NO: 1066604 - RNA, 16 nt, Mycobacterium bovis subsp bovis AF2122/97
accagcccaccggcgc

SEQ ID NO: 1066605 - RNA, 14 nt, Mycobacterium bovis subsp bovis AF2122/97
accagccagccugc

SEQ ID NO: 1066606 - RNA, 12 nt, Mycobacterium bovis subsp bovis AF2122/97
accagccaccac

SEQ ID NO: 1066607 - RNA, 15 nt, Mycobacterium bovis subsp bovis AF2122/97
accagccaccaccag

SEQ ID NO: 1066608 - RNA, 16 nt, Mycobacterium bovis subsp bovis AF2122/97
accagccaaaucagcc

SEQ ID NO: 1066609 - RNA, 18 nt, Mycobacterium bovis subsp bovis AF2122/97
accagccaggugauuacc

SEQ ID NO: 1066610 - RNA, 22 nt, Mycobacterium bovis subsp bovis AF2122/97
accagcgcgccguagaccagca

SEQ ID NO: 1066611 - RNA, 17 nt, Mycobacterium bovis subsp bovis AF2122/97
accagcgccuugacgcc

SEQ ID NO: 1066612 - RNA, 15 nt, Mycobacterium bovis subsp bovis AF2122/97
accagcgcguugcgg

SEQ ID NO: 1066613 - RNA, 14 nt, Mycobacterium bovis subsp bovis AF2122/97
accagcggcaccgc

SEQ ID NO: 1066614 - RNA, 21 nt, Mycobacterium bovis subsp bovis AF2122/97
accagcgcuccagcacccgcg

SEQ ID NO: 1066615 - RNA, 17 nt, Mycobacterium bovis subsp bovis AF2122/97
accagcggcaccgcgcc

SEQ ID NO: 1066616 - RNA, 19 nt, Mycobacterium bovis subsp bovis AF2122/97
accagcggcaccgcgccgg

SEQ ID NO: 1066617 - RNA, 13 nt, Mycobacterium bovis subsp bovis AF2122/97
accagcggcggcc

SEQ ID NO: 1066618 - RNA, 20 nt, Mycobacterium bovis subsp bovis AF2122/97
accagcggcggcggcggcaa

SEQ ID NO: 1066619 - RNA, 23 nt, Mycobacterium bovis subsp bovis AF2122/97
accagcggcggcggcggcaagug

SEQ ID NO: 1066620 - RNA, 18 nt, Mycobacterium bovis subsp bovis AF2122/97
accagcggccgaccgcga

SEQ ID NO: 1066621 - RNA, 18 nt, Mycobacterium bovis subsp bovis AF2122/97
accagcggcugaccgggc

SEQ ID NO: 1066622 - RNA, 15 nt, Mycobacterium bovis subsp bovis AF2122/97
accagcgggcaucgc

SEQ ID NO: 1066623 - RNA, 14 nt, Mycobacterium bovis subsp bovis AF2122/97
accagcgucgcacg

SEQ ID NO: 1066624 - RNA, 13 nt, Mycobacterium bovis subsp bovis AF2122/97
accagcggucagc

SEQ ID NO: 1066625 - RNA, 18 nt, Mycobacterium bovis subsp bovis AF2122/97
accagcggucagccggcc

SEQ ID NO: 1066626 - RNA, 21 nt, Mycobacterium bovis subsp bovis AF2122/97
accagcggucggcgaccacca

SEQ ID NO: 1066627 - RNA, 15 nt, Mycobacterium bovis subsp bovis AF2122/97
accagcgucgcggcc

SEQ ID NO: 1066628 - RNA, 16 nt, Mycobacterium bovis subsp bovis AF2122/97
accagcgucgcggcca

SEQ ID NO: 1066629 - RNA, 17 nt, Mycobacterium bovis subsp bovis AF2122/97
accagcgucgcggccac

SEQ ID NO: 1066630 - RNA, 20 nt, Mycobacterium bovis subsp bovis AF2122/97
accagcguaucggccggcag

SEQ ID NO: 1066631 - RNA, 14 nt, Mycobacterium bovis subsp bovis AF2122/97
accagcucagcugc

SEQ ID NO: 1066632 - RNA, 20 nt, Mycobacterium bovis subsp bovis AF2122/97
accagcguguagcgaugccg

SEQ ID NO: 1066633 - RNA, 17 nt, Mycobacterium bovis subsp bovis AF2122/97
accagcucacccugcuc

SEQ ID NO: 1066634 - RNA, 20 nt, Mycobacterium bovis subsp bovis AF2122/97
acauagcgauucgcgcugcu

SEQ ID NO: 1066635 - RNA, 21 nt, Mycobacterium bovis subsp bovis AF2122/97
acauaccggcgcauaccggcg

SEQ ID NO: 1066636 - RNA, 12 nt, Mycobacterium bovis subsp bovis AF2122/97
acauagccgguc

SEQ ID NO: 1066637 - RNA, 19 nt, Mycobacterium bovis subsp bovis AF2122/97
acauagcgauucgcgcugc

SEQ ID NO: 1066638 - RNA, 11 nt, Mycobacterium bovis subsp bovis AF2122/97
acaguggcgcg

SEQ ID NO: 1066639 - RNA, 22 nt, Mycobacterium bovis subsp bovis AF2122/97
acaguggcucgcggaugcucgu

SEQ ID NO: 1066640 - RNA, 19 nt, Mycobacterium bovis subsp bovis AF2122/97
acagugugaagaccaccgc

SEQ ID NO: 1066641 - RNA, 17 nt, Mycobacterium bovis subsp bovis AF2122/97
acagugguuagucggcc

SEQ ID NO: 1066642 - RNA, 12 nt, Mycobacterium bovis subsp bovis AF2122/97
acaucacucgcg

SEQ ID NO: 1066643 - RNA, 14 nt, Mycobacterium bovis subsp bovis AF2122/97
acaucacucgcgcc

SEQ ID NO: 1066644 - RNA, 15 nt, Mycobacterium bovis subsp bovis AF2122/97
acaucaggucggcga

SEQ ID NO: 1066645 - RNA, 12 nt, Mycobacterium bovis subsp bovis AF2122/97
acaucaccgacc

SEQ ID NO: 1066646 - RNA, 15 nt, Mycobacterium bovis subsp bovis AF2122/97
acaucaccggcaugc

SEQ ID NO: 1066647 - RNA, 13 nt, Mycobacterium bovis subsp bovis AF2122/97
acaucaccacgau

SEQ ID NO: 1066648 - RNA, 14 nt, Mycobacterium bovis subsp bovis AF2122/97
acagcugacgagcc

SEQ ID NO: 1066649 - RNA, 18 nt, Mycobacterium bovis subsp bovis AF2122/97
acagcugacgagccggug

SEQ ID NO: 1066650 - RNA, 22 nt, Mycobacterium bovis subsp bovis AF2122/97
acaggaucagcgacuugcuggc

SEQ ID NO: 1066651 - RNA, 14 nt, Mycobacterium bovis subsp bovis AF2122/97
acaguaggccuccg

SEQ ID NO: 1066652 - RNA, 12 nt, Mycobacterium bovis subsp bovis AF2122/97
acagucgcagcc

SEQ ID NO: 1066653 - RNA, 22 nt, Mycobacterium bovis subsp bovis AF2122/97
acaguaucgccggaguuccgcc

SEQ ID NO: 1066654 - RNA, 12 nt, Mycobacterium bovis subsp bovis AF2122/97
acaguccgcgcc

SEQ ID NO: 1066655 - RNA, 15 nt, Mycobacterium bovis subsp bovis AF2122/97
acaguccgcgccggc

SEQ ID NO: 1066656 - RNA, 16 nt, Mycobacterium bovis subsp bovis AF2122/97
acagggccuugaucgg

SEQ ID NO: 1066657 - RNA, 21 nt, Mycobacterium bovis subsp bovis AF2122/97
acaggcuugacugcacaccac

SEQ ID NO: 1066658 - RNA, 16 nt, Mycobacterium bovis subsp bovis AF2122/97
acagggaggucgccgc

SEQ ID NO: 1066659 - RNA, 15 nt, Mycobacterium bovis subsp bovis AF2122/97
acagggccagaucgc

SEQ ID NO: 1066660 - RNA, 18 nt, Mycobacterium bovis subsp bovis AF2122/97
acagggcggcaacggcgg

SEQ ID NO: 1066661 - RNA, 13 nt, Mycobacterium bovis subsp bovis AF2122/97
acagccggcggcu

SEQ ID NO: 1066662 - RNA, 21 nt, Mycobacterium bovis subsp bovis AF2122/97
acagcgccaagacgucggcgu

SEQ ID NO: 1066663 - RNA, 11 nt, Mycobacterium bovis subsp bovis AF2122/97
acagccggcca

SEQ ID NO: 1066664 - RNA, 12 nt, Mycobacterium bovis subsp bovis AF2122/97
acagccgccgac

SEQ ID NO: 1066665 - RNA, 15 nt, Mycobacterium bovis subsp bovis AF2122/97
acagccgccgccggc

SEQ ID NO: 1066666 - RNA, 19 nt, Mycobacterium bovis subsp bovis AF2122/97
acagcccguagcacaccgg

SEQ ID NO: 1066667 - RNA, 15 nt, Mycobacterium bovis subsp bovis AF2122/97
acagcccggcgacga

SEQ ID NO: 1066668 - RNA, 21 nt, Mycobacterium bovis subsp bovis AF2122/97
acagcccggccuugccgccgg

SEQ ID NO: 1066669 - RNA, 22 nt, Mycobacterium bovis subsp bovis AF2122/97
acagcuccuuggcuaacaccgc

SEQ ID NO: 1066670 - RNA, 21 nt, Mycobacterium bovis subsp bovis AF2122/97
acagcgugccgaacagggagg

SEQ ID NO: 1066671 - RNA, 20 nt, Mycobacterium bovis subsp bovis AF2122/97
acagcguccgucgucggcgu

SEQ ID NO: 1066672 - RNA, 20 nt, Mycobacterium bovis subsp bovis AF2122/97
acagcgucgaaaagccgugc

SEQ ID NO: 1066673 - RNA, 13 nt, Mycobacterium bovis subsp bovis AF2122/97
acagcgcggcgcg

SEQ ID NO: 1066674 - RNA, 13 nt, Mycobacterium bovis subsp bovis AF2122/97
acagcccgccggc

SEQ ID NO: 1066675 - RNA, 12 nt, Mycobacterium bovis subsp bovis AF2122/97
acagcccaccgg

SEQ ID NO: 1066676 - RNA, 20 nt, Mycobacterium bovis subsp bovis AF2122/97
acaaagacgccgucggcgcc

SEQ ID NO: 1066677 - RNA, 19 nt, Mycobacterium bovis subsp bovis AF2122/97
acagcaugucgcggacccg

SEQ ID NO: 1066678 - RNA, 20 nt, Mycobacterium bovis subsp bovis AF2122/97
acagcaugucgcggacccgc

SEQ ID NO: 1066679 - RNA, 22 nt, Mycobacterium bovis subsp bovis AF2122/97
acagcaugucgcggacccgcgc

SEQ ID NO: 1066680 - RNA, 21 nt, Mycobacterium bovis subsp bovis AF2122/97
acaaaccgucggggaugccga

SEQ ID NO: 1066681 - RNA, 17 nt, Mycobacterium bovis subsp bovis AF2122/97
acaaaccugcaugccca

SEQ ID NO: 1066682 - RNA, 16 nt, Mycobacterium bovis subsp bovis AF2122/97
acaaacaucgcaccca

SEQ ID NO: 1066683 - RNA, 14 nt, Mycobacterium bovis subsp bovis AF2122/97
acaugaucgagcag

SEQ ID NO: 1066684 - RNA, 17 nt, Mycobacterium bovis subsp bovis AF2122/97
acaugcaagucgaacgg

SEQ ID NO: 1066685 - RNA, 22 nt, Mycobacterium bovis subsp bovis AF2122/97
acaugaccugauccggccgguu

SEQ ID NO: 1066686 - RNA, 19 nt, Mycobacterium bovis subsp bovis AF2122/97
acaugacagccccgccgcc

SEQ ID NO: 1066687 - RNA, 20 nt, Mycobacterium bovis subsp bovis AF2122/97
acaugaauuuccccgguagc

SEQ ID NO: 1066688 - RNA, 15 nt, Mycobacterium bovis subsp bovis AF2122/97
acaugaaccggucga

SEQ ID NO: 1066689 - RNA, 20 nt, Mycobacterium bovis subsp bovis AF2122/97
acaucugacagcugggucgg

SEQ ID NO: 1066690 - RNA, 15 nt, Mycobacterium bovis subsp bovis AF2122/97
acaugguccggccgc

SEQ ID NO: 1066691 - RNA, 21 nt, Mycobacterium bovis subsp bovis AF2122/97
acauggcggugcgcagcuugg

SEQ ID NO: 1066692 - RNA, 16 nt, Mycobacterium bovis subsp bovis AF2122/97
acauggccagcaucag

SEQ ID NO: 1066693 - RNA, 12 nt, Mycobacterium bovis subsp bovis AF2122/97
acaugccggcga

SEQ ID NO: 1066694 - RNA, 23 nt, Mycobacterium bovis subsp bovis AF2122/97
acaugccgguugcggcugcguug

SEQ ID NO: 1066695 - RNA, 14 nt, Mycobacterium bovis subsp bovis AF2122/97
acaugcgcucgcgg

SEQ ID NO: 1066696 - RNA, 17 nt, Mycobacterium bovis subsp bovis AF2122/97
acaugcucacgaucacc

SEQ ID NO: 1066697 - RNA, 15 nt, Mycobacterium bovis subsp bovis AF2122/97
acaugcccugcgcuc

SEQ ID NO: 1066698 - RNA, 17 nt, Mycobacterium bovis subsp bovis AF2122/97
acaugccacagcggcga

SEQ ID NO: 1066699 - RNA, 23 nt, Mycobacterium bovis subsp bovis AF2122/97
acaucggugccacguucgcgggc

SEQ ID NO: 1066700 - RNA, 20 nt, Mycobacterium bovis subsp bovis AF2122/97
acaucggcggcgucgacguc

SEQ ID NO: 1066701 - RNA, 23 nt, Mycobacterium bovis subsp bovis AF2122/97
acaucgguguggcccaacaccgc

SEQ ID NO: 1066702 - RNA, 16 nt, Mycobacterium bovis subsp bovis AF2122/97
acaucgugauccccgc

SEQ ID NO: 1066703 - RNA, 20 nt, Mycobacterium bovis subsp bovis AF2122/97
acaucguucaugaucggcag

SEQ ID NO: 1066704 - RNA, 15 nt, Mycobacterium bovis subsp bovis AF2122/97
acaucgucacugcca

SEQ ID NO: 1066705 - RNA, 18 nt, Mycobacterium bovis subsp bovis AF2122/97
acaucgucacugccaccu

SEQ ID NO: 1066706 - RNA, 15 nt, Mycobacterium bovis subsp bovis AF2122/97
acaucgucgagcgcg

SEQ ID NO: 1066707 - RNA, 18 nt, Mycobacterium bovis subsp bovis AF2122/97
acaucgucgccagggccg

SEQ ID NO: 1066708 - RNA, 17 nt, Mycobacterium bovis subsp bovis AF2122/97
acaucgccauaccggcc

SEQ ID NO: 1066709 - RNA, 21 nt, Mycobacterium bovis subsp bovis AF2122/97
acaucgucggcgggcggcagc

SEQ ID NO: 1066710 - RNA, 18 nt, Mycobacterium bovis subsp bovis AF2122/97
acaucgcgaggcgucacc

SEQ ID NO: 1066711 - RNA, 23 nt, Mycobacterium bovis subsp bovis AF2122/97
acaucggccggguuaucggcagc

SEQ ID NO: 1066712 - RNA, 19 nt, Mycobacterium bovis subsp bovis AF2122/97
acaucggcccgaucaccau

SEQ ID NO: 1066713 - RNA, 11 nt, Mycobacterium bovis subsp bovis AF2122/97
acaucggccgg

SEQ ID NO: 1066714 - RNA, 18 nt, Mycobacterium bovis subsp bovis AF2122/97
acaucggccggcgucagc

SEQ ID NO: 1066715 - RNA, 21 nt, Mycobacterium bovis subsp bovis AF2122/97
acaucgcgggcgugccgacca

SEQ ID NO: 1066716 - RNA, 20 nt, Mycobacterium bovis subsp bovis AF2122/97
acauccagggccgagcagcu

SEQ ID NO: 1066717 - RNA, 16 nt, Mycobacterium bovis subsp bovis AF2122/97
acauccacaccgcggc

SEQ ID NO: 1066718 - RNA, 20 nt, Mycobacterium bovis subsp bovis AF2122/97
acaucccggaccgaugguug

SEQ ID NO: 1066719 - RNA, 12 nt, Mycobacterium bovis subsp bovis AF2122/97
acauccgcggca

SEQ ID NO: 1066720 - RNA, 15 nt, Mycobacterium bovis subsp bovis AF2122/97
acaucgagaucgccg

SEQ ID NO: 1066721 - RNA, 19 nt, Mycobacterium bovis subsp bovis AF2122/97
acaucgcacccaccacacc

SEQ ID NO: 1066722 - RNA, 17 nt, Mycobacterium bovis subsp bovis AF2122/97
acauccuugacgcggcc

SEQ ID NO: 1066723 - RNA, 17 nt, Mycobacterium bovis subsp bovis AF2122/97
acaucgaaaaccgaggc

SEQ ID NO: 1066724 - RNA, 19 nt, Mycobacterium bovis subsp bovis AF2122/97
acaugucgaacgcccccca

SEQ ID NO: 1066725 - RNA, 15 nt, Mycobacterium bovis subsp bovis AF2122/97
acaugugaccggcga

SEQ ID NO: 1066726 - RNA, 19 nt, Mycobacterium bovis subsp bovis AF2122/97
acauugccggccaccagcc

SEQ ID NO: 1066727 - RNA, 19 nt, Mycobacterium bovis subsp bovis AF2122/97
acauugcgcccagcgaccc

SEQ ID NO: 1066728 - RNA, 21 nt, Mycobacterium bovis subsp bovis AF2122/97
acauuggcgaucagcagccgc

SEQ ID NO: 1066729 - RNA, 21 nt, Mycobacterium bovis subsp bovis AF2122/97
accaaaaggaucaacgugcgc

SEQ ID NO: 1066730 - RNA, 20 nt, Mycobacterium bovis subsp bovis AF2122/97
accaaaauccuucgcgcuca

SEQ ID NO: 1066731 - RNA, 17 nt, Mycobacterium bovis subsp bovis AF2122/97
accaacaccgcccgcaa

SEQ ID NO: 1066732 - RNA, 11 nt, Mycobacterium bovis subsp bovis AF2122/97
accaacaccgg

SEQ ID NO: 1066733 - RNA, 16 nt, Mycobacterium bovis subsp bovis AF2122/97
accaacaccgguggcu

SEQ ID NO: 1066734 - RNA, 16 nt, Mycobacterium bovis subsp bovis AF2122/97
accaacccacccccca

SEQ ID NO: 1066735 - RNA, 14 nt, Mycobacterium bovis subsp bovis AF2122/97
accaaccgcgcgag

SEQ ID NO: 1066736 - RNA, 20 nt, Mycobacterium bovis subsp bovis AF2122/97
accaacguuuugggcgccgg

SEQ ID NO: 1066737 - RNA, 15 nt, Mycobacterium bovis subsp bovis AF2122/97
accaacgucgcuccg

SEQ ID NO: 1066738 - RNA, 15 nt, Mycobacterium bovis subsp bovis AF2122/97
accaacucggcgacc

SEQ ID NO: 1066739 - RNA, 17 nt, Mycobacterium bovis subsp bovis AF2122/97
accaaccucaucgcggu

SEQ ID NO: 1066740 - RNA, 16 nt, Mycobacterium bovis subsp bovis AF2122/97
accaaccucaucgcgg

SEQ ID NO: 1066741 - RNA, 22 nt, Mycobacterium bovis subsp bovis AF2122/97
accaacgcaacacgggcgccgg

SEQ ID NO: 1066742 - RNA, 21 nt, Mycobacterium bovis subsp bovis AF2122/97
accaacgccaacgccacggca

SEQ ID NO: 1066743 - RNA, 16 nt, Mycobacterium bovis subsp bovis AF2122/97
accaaggccgagcgcg

SEQ ID NO: 1066744 - RNA, 21 nt, Mycobacterium bovis subsp bovis AF2122/97
accaagcucggccagcacgcc

SEQ ID NO: 1066745 - RNA, 23 nt, Mycobacterium bovis subsp bovis AF2122/97
accaagguuggucggugcugacc

SEQ ID NO: 1066746 - RNA, 17 nt, Mycobacterium bovis subsp bovis AF2122/97
accaagcucggccagca

SEQ ID NO: 1066747 - RNA, 18 nt, Mycobacterium bovis subsp bovis AF2122/97
accaagcucggccagcac

SEQ ID NO: 1066748 - RNA, 14 nt, Mycobacterium bovis subsp bovis AF2122/97
accaagcucggcca

SEQ ID NO: 1066749 - RNA, 15 nt, Mycobacterium bovis subsp bovis AF2122/97
accaagugucgccgc

SEQ ID NO: 1066750 - RNA, 21 nt, Mycobacterium bovis subsp bovis AF2122/97
accaagucaugcccacgcugc

SEQ ID NO: 1066751 - RNA, 15 nt, Mycobacterium bovis subsp bovis AF2122/97
accaauaugcccggg

SEQ ID NO: 1066752 - RNA, 17 nt, Mycobacterium bovis subsp bovis AF2122/97
accaauccaggccaccc

SEQ ID NO: 1066753 - RNA, 18 nt, Mycobacterium bovis subsp bovis AF2122/97
accaauaccgcacccgcu

SEQ ID NO: 1066754 - RNA, 16 nt, Mycobacterium bovis subsp bovis AF2122/97
accgcucgucguccgg

SEQ ID NO: 1066755 - RNA, 19 nt, Mycobacterium bovis subsp bovis AF2122/97
accgcuuugaauugcgcgc

SEQ ID NO: 1066756 - RNA, 23 nt, Mycobacterium bovis subsp bovis AF2122/97
accggaaccagcguaucggccgg

SEQ ID NO: 1066757 - RNA, 14 nt, Mycobacterium bovis subsp bovis AF2122/97
accggaacgccguc

SEQ ID NO: 1066758 - RNA, 21 nt, Mycobacterium bovis subsp bovis AF2122/97
accggaauacgcgccgccggc

SEQ ID NO: 1066759 - RNA, 18 nt, Mycobacterium bovis subsp bovis AF2122/97
accggaauccuggccgcc

SEQ ID NO: 1066760 - RNA, 20 nt, Mycobacterium bovis subsp bovis AF2122/97
accggaauccuggccgccgc

SEQ ID NO: 1066761 - RNA, 22 nt, Mycobacterium bovis subsp bovis AF2122/97
accggaauccccccugucgccg

SEQ ID NO: 1066762 - RNA, 23 nt, Mycobacterium bovis subsp bovis AF2122/97
accggaauccccccugucgccga

SEQ ID NO: 1066763 - RNA, 19 nt, Mycobacterium bovis subsp bovis AF2122/97
accggacaaacaucgcacc

SEQ ID NO: 1066764 - RNA, 20 nt, Mycobacterium bovis subsp bovis AF2122/97
accggacaaagcugcucguc

SEQ ID NO: 1066765 - RNA, 13 nt, Mycobacterium bovis subsp bovis AF2122/97
accgcucgucgcc

SEQ ID NO: 1066766 - RNA, 17 nt, Mycobacterium bovis subsp bovis AF2122/97
accggcacugcccagca

SEQ ID NO: 1066767 - RNA, 13 nt, Mycobacterium bovis subsp bovis AF2122/97
accggaccugacc

SEQ ID NO: 1066768 - RNA, 19 nt, Mycobacterium bovis subsp bovis AF2122/97
accggaccugaccgguggc

SEQ ID NO: 1066769 - RNA, 19 nt, Mycobacterium bovis subsp bovis AF2122/97
accggacgaaacgaucgcg

SEQ ID NO: 1066770 - RNA, 21 nt, Mycobacterium bovis subsp bovis AF2122/97
accggcagcgaugcggugucg

SEQ ID NO: 1066771 - RNA, 14 nt, Mycobacterium bovis subsp bovis AF2122/97
accggcaggccggc

SEQ ID NO: 1066772 - RNA, 18 nt, Mycobacterium bovis subsp bovis AF2122/97
accggcaggccggcgucg

SEQ ID NO: 1066773 - RNA, 20 nt, Mycobacterium bovis subsp bovis AF2122/97
accggcauaacgaucccgug

SEQ ID NO: 1066774 - RNA, 16 nt, Mycobacterium bovis subsp bovis AF2122/97
accggcauacagccgg

SEQ ID NO: 1066775 - RNA, 17 nt, Mycobacterium bovis subsp bovis AF2122/97
accggcauacagccggc

SEQ ID NO: 1066776 - RNA, 13 nt, Mycobacterium bovis subsp bovis AF2122/97
accggcaucgcga

SEQ ID NO: 1066777 - RNA, 19 nt, Mycobacterium bovis subsp bovis AF2122/97
accggcaucgcgaacucgg

SEQ ID NO: 1066778 - RNA, 22 nt, Mycobacterium bovis subsp bovis AF2122/97
accggcaucgcgaacucgggca

SEQ ID NO: 1066779 - RNA, 16 nt, Mycobacterium bovis subsp bovis AF2122/97
accggcaugccgccau

SEQ ID NO: 1066780 - RNA, 18 nt, Mycobacterium bovis subsp bovis AF2122/97
accggcaugccgccaugc

SEQ ID NO: 1066781 - RNA, 17 nt, Mycobacterium bovis subsp bovis AF2122/97
accggcaugcgugccgg

SEQ ID NO: 1066782 - RNA, 18 nt, Mycobacterium bovis subsp bovis AF2122/97
accggcaugcgugccggc

SEQ ID NO: 1066783 - RNA, 15 nt, Mycobacterium bovis subsp bovis AF2122/97
accggcaugccgcca

SEQ ID NO: 1066784 - RNA, 12 nt, Mycobacterium bovis subsp bovis AF2122/97
accggccagccg

SEQ ID NO: 1066785 - RNA, 15 nt, Mycobacterium bovis subsp bovis AF2122/97
accggccagccgacg

SEQ ID NO: 1066786 - RNA, 21 nt, Mycobacterium bovis subsp bovis AF2122/97
accggccaccagggccaccgc

SEQ ID NO: 1066787 - RNA, 12 nt, Mycobacterium bovis subsp bovis AF2122/97
accggccaccag

SEQ ID NO: 1066788 - RNA, 14 nt, Mycobacterium bovis subsp bovis AF2122/97
accggccaccagcc

SEQ ID NO: 1066789 - RNA, 19 nt, Mycobacterium bovis subsp bovis AF2122/97
accggccaacagucgcagc

SEQ ID NO: 1066790 - RNA, 14 nt, Mycobacterium bovis subsp bovis AF2122/97
accggccaacgccg

SEQ ID NO: 1066791 - RNA, 17 nt, Mycobacterium bovis subsp bovis AF2122/97
accggccaacgccgccg

SEQ ID NO: 1066792 - RNA, 20 nt, Mycobacterium bovis subsp bovis AF2122/97
accggccaucgaccguccgg

SEQ ID NO: 1066793 - RNA, 17 nt, Mycobacterium bovis subsp bovis AF2122/97
accggccagccgcggcc

SEQ ID NO: 1066794 - RNA, 20 nt, Mycobacterium bovis subsp bovis AF2122/97
accggccagcggcccgucac

SEQ ID NO: 1066795 - RNA, 14 nt, Mycobacterium bovis subsp bovis AF2122/97
accggccaggccgg

SEQ ID NO: 1066796 - RNA, 16 nt, Mycobacterium bovis subsp bovis AF2122/97
accggccccaccggca

SEQ ID NO: 1066797 - RNA, 15 nt, Mycobacterium bovis subsp bovis AF2122/97
accggcccgaugccg

SEQ ID NO: 1066798 - RNA, 23 nt, Mycobacterium bovis subsp bovis AF2122/97
accggcccagaucgguugaucgg

SEQ ID NO: 1066799 - RNA, 14 nt, Mycobacterium bovis subsp bovis AF2122/97
accggccgacgaac

SEQ ID NO: 1066800 - RNA, 19 nt, Mycobacterium bovis subsp bovis AF2122/97
accggccgacgaacagcgg

SEQ ID NO: 1066801 - RNA, 13 nt, Mycobacterium bovis subsp bovis AF2122/97
accggccgccgac

SEQ ID NO: 1066802 - RNA, 20 nt, Mycobacterium bovis subsp bovis AF2122/97
accggccgcgacgacacgcc

SEQ ID NO: 1066803 - RNA, 14 nt, Mycobacterium bovis subsp bovis AF2122/97
accggccgcgcaga

SEQ ID NO: 1066804 - RNA, 13 nt, Mycobacterium bovis subsp bovis AF2122/97
accggccgcggcg

SEQ ID NO: 1066805 - RNA, 18 nt, Mycobacterium bovis subsp bovis AF2122/97
accggccgccaucaucgc

SEQ ID NO: 1066806 - RNA, 17 nt, Mycobacterium bovis subsp bovis AF2122/97
accggccggccgcgggc

SEQ ID NO: 1066807 - RNA, 23 nt, Mycobacterium bovis subsp bovis AF2122/97
accggccgguggguagccagcgc

SEQ ID NO: 1066808 - RNA, 13 nt, Mycobacterium bovis subsp bovis AF2122/97
accggccgucccg

SEQ ID NO: 1066809 - RNA, 14 nt, Mycobacterium bovis subsp bovis AF2122/97
accggccgucgacg

SEQ ID NO: 1066810 - RNA, 17 nt, Mycobacterium bovis subsp bovis AF2122/97
accggccgugccgccga

SEQ ID NO: 1066811 - RNA, 18 nt, Mycobacterium bovis subsp bovis AF2122/97
accggccgugccgccgac

SEQ ID NO: 1066812 - RNA, 19 nt, Mycobacterium bovis subsp bovis AF2122/97
accggccgggugaaccaau

SEQ ID NO: 1066813 - RNA, 21 nt, Mycobacterium bovis subsp bovis AF2122/97
accggccugcgcgaccgacca

SEQ ID NO: 1066814 - RNA, 19 nt, Mycobacterium bovis subsp bovis AF2122/97
accggccgugccgccgaca

SEQ ID NO: 1066815 - RNA, 23 nt, Mycobacterium bovis subsp bovis AF2122/97
accggccuugcccucaacggcgg

SEQ ID NO: 1066816 - RNA, 17 nt, Mycobacterium bovis subsp bovis AF2122/97
accggcucgccggcgcg

SEQ ID NO: 1066817 - RNA, 15 nt, Mycobacterium bovis subsp bovis AF2122/97
accggcucgccggcg

SEQ ID NO: 1066818 - RNA, 14 nt, Mycobacterium bovis subsp bovis AF2122/97
accggcucgaucuc

SEQ ID NO: 1066819 - RNA, 20 nt, Mycobacterium bovis subsp bovis AF2122/97
accggcguugcguagacgaa

SEQ ID NO: 1066820 - RNA, 15 nt, Mycobacterium bovis subsp bovis AF2122/97
accggcuaugcuggc

SEQ ID NO: 1066821 - RNA, 14 nt, Mycobacterium bovis subsp bovis AF2122/97
accggcugaccggg

SEQ ID NO: 1066822 - RNA, 17 nt, Mycobacterium bovis subsp bovis AF2122/97
accggcugaccggggcg

SEQ ID NO: 1066823 - RNA, 21 nt, Mycobacterium bovis subsp bovis AF2122/97
accggcugaccggggcgcccg

SEQ ID NO: 1066824 - RNA, 13 nt, Mycobacterium bovis subsp bovis AF2122/97
accggcugcaggu

SEQ ID NO: 1066825 - RNA, 14 nt, Mycobacterium bovis subsp bovis AF2122/97
accggcugcaggug

SEQ ID NO: 1066826 - RNA, 15 nt, Mycobacterium bovis subsp bovis AF2122/97
accggcucggcggug

SEQ ID NO: 1066827 - RNA, 20 nt, Mycobacterium bovis subsp bovis AF2122/97
accggcucuuuuucgaucgc

SEQ ID NO: 1066828 - RNA, 14 nt, Mycobacterium bovis subsp bovis AF2122/97
accggcgucgacgu

SEQ ID NO: 1066829 - RNA, 20 nt, Mycobacterium bovis subsp bovis AF2122/97
accggcgggaugcgcgcccg

SEQ ID NO: 1066830 - RNA, 21 nt, Mycobacterium bovis subsp bovis AF2122/97
accggcgggaugcgcgcccga

SEQ ID NO: 1066831 - RNA, 22 nt, Mycobacterium bovis subsp bovis AF2122/97
accggcguccaguccgaucacc

SEQ ID NO: 1066832 - RNA, 23 nt, Mycobacterium bovis subsp bovis AF2122/97
accggcgucgaaggugaccaggc

SEQ ID NO: 1066833 - RNA, 14 nt, Mycobacterium bovis subsp bovis AF2122/97
accggcgucggcgc

SEQ ID NO: 1066834 - RNA, 15 nt, Mycobacterium bovis subsp bovis AF2122/97
accggcgucggcgcg

SEQ ID NO: 1066835 - RNA, 21 nt, Mycobacterium bovis subsp bovis AF2122/97
accggcgucguaggagccguc

SEQ ID NO: 1066836 - RNA, 17 nt, Mycobacterium bovis subsp bovis AF2122/97
accggcgucguugacca

SEQ ID NO: 1066837 - RNA, 17 nt, Mycobacterium bovis subsp bovis AF2122/97
accggcgucugcccgcc

SEQ ID NO: 1066838 - RNA, 15 nt, Mycobacterium bovis subsp bovis AF2122/97
accggcuaccggcgu

SEQ ID NO: 1066839 - RNA, 21 nt, Mycobacterium bovis subsp bovis AF2122/97
accggcuacggcgacacgcca

SEQ ID NO: 1066840 - RNA, 21 nt, Mycobacterium bovis subsp bovis AF2122/97
accggcguucccacuggaggu

SEQ ID NO: 1066841 - RNA, 15 nt, Mycobacterium bovis subsp bovis AF2122/97
accggcgugcugugc

SEQ ID NO: 1066842 - RNA, 18 nt, Mycobacterium bovis subsp bovis AF2122/97
accggcgugucacgucgc

SEQ ID NO: 1066843 - RNA, 16 nt, Mycobacterium bovis subsp bovis AF2122/97
accggcuucggccagc

SEQ ID NO: 1066844 - RNA, 18 nt, Mycobacterium bovis subsp bovis AF2122/97
accggcugggcgccacca

SEQ ID NO: 1066845 - RNA, 19 nt, Mycobacterium bovis subsp bovis AF2122/97
accggcugggcgccaccau

SEQ ID NO: 1066846 - RNA, 22 nt, Mycobacterium bovis subsp bovis AF2122/97
accggcuggugccuuaccaccg

SEQ ID NO: 1066847 - RNA, 20 nt, Mycobacterium bovis subsp bovis AF2122/97
accggcugguucaacaccgg

SEQ ID NO: 1066848 - RNA, 14 nt, Mycobacterium bovis subsp bovis AF2122/97
accggcuugggcca

SEQ ID NO: 1066849 - RNA, 18 nt, Mycobacterium bovis subsp bovis AF2122/97
accggcuugggccaggcc

SEQ ID NO: 1066850 - RNA, 19 nt, Mycobacterium bovis subsp bovis AF2122/97
accggcuuggcgggaccgu

SEQ ID NO: 1066851 - RNA, 17 nt, Mycobacterium bovis subsp bovis AF2122/97
accggcuucgucggcca

SEQ ID NO: 1066852 - RNA, 17 nt, Mycobacterium bovis subsp bovis AF2122/97
accggcuggcccagcga

SEQ ID NO: 1066853 - RNA, 15 nt, Mycobacterium bovis subsp bovis AF2122/97
accggcugcggggcg

SEQ ID NO: 1066854 - RNA, 16 nt, Mycobacterium bovis subsp bovis AF2122/97
accggcuggugccaac

SEQ ID NO: 1066855 - RNA, 14 nt, Mycobacterium bovis subsp bovis AF2122/97
accgggaugugcgg

SEQ ID NO: 1066856 - RNA, 15 nt, Mycobacterium bovis subsp bovis AF2122/97
accgggcaaaucaag

SEQ ID NO: 1066857 - RNA, 19 nt, Mycobacterium bovis subsp bovis AF2122/97
accgggcaaaucaagcaca

SEQ ID NO: 1066858 - RNA, 17 nt, Mycobacterium bovis subsp bovis AF2122/97
accgggauagccgcgac

SEQ ID NO: 1066859 - RNA, 16 nt, Mycobacterium bovis subsp bovis AF2122/97
accgggaggccaccgc

SEQ ID NO: 1066860 - RNA, 18 nt, Mycobacterium bovis subsp bovis AF2122/97
accgggacgaaucccgcg

SEQ ID NO: 1066861 - RNA, 17 nt, Mycobacterium bovis subsp bovis AF2122/97
accgggaaccacgguca

SEQ ID NO: 1066862 - RNA, 18 nt, Mycobacterium bovis subsp bovis AF2122/97
accgggaacccgagcuug

SEQ ID NO: 1066863 - RNA, 22 nt, Mycobacterium bovis subsp bovis AF2122/97
accggcggacaccucgggcgcc

SEQ ID NO: 1066864 - RNA, 10 nt, Mycobacterium bovis subsp bovis AF2122/97
accggcggcg

SEQ ID NO: 1066865 - RNA, 22 nt, Mycobacterium bovis subsp bovis AF2122/97
accggcgcucaaugcggucaac

SEQ ID NO: 1066866 - RNA, 20 nt, Mycobacterium bovis subsp bovis AF2122/97
accggcggauucgcgcuggu

SEQ ID NO: 1066867 - RNA, 15 nt, Mycobacterium bovis subsp bovis AF2122/97
accggcggcgagcgg

SEQ ID NO: 1066868 - RNA, 13 nt, Mycobacterium bovis subsp bovis AF2122/97
accggcggugccg

SEQ ID NO: 1066869 - RNA, 14 nt, Mycobacterium bovis subsp bovis AF2122/97
accggcggugccgg

SEQ ID NO: 1066870 - RNA, 23 nt, Mycobacterium bovis subsp bovis AF2122/97
accggcggcgacggcggcacggg

SEQ ID NO: 1066871 - RNA, 19 nt, Mycobacterium bovis subsp bovis AF2122/97
accggcggcgacggugcca

SEQ ID NO: 1066872 - RNA, 14 nt, Mycobacterium bovis subsp bovis AF2122/97
accggcggcgccgg

SEQ ID NO: 1066873 - RNA, 16 nt, Mycobacterium bovis subsp bovis AF2122/97
accggcggcgccggcc

SEQ ID NO: 1066874 - RNA, 15 nt, Mycobacterium bovis subsp bovis AF2122/97
accggcggcgccggg

SEQ ID NO: 1066875 - RNA, 16 nt, Mycobacterium bovis subsp bovis AF2122/97
accggcguaaccggca

SEQ ID NO: 1066876 - RNA, 18 nt, Mycobacterium bovis subsp bovis AF2122/97
accggcguaaccggcagc

SEQ ID NO: 1066877 - RNA, 21 nt, Mycobacterium bovis subsp bovis AF2122/97
accggcggugccgguggugac

SEQ ID NO: 1066878 - RNA, 22 nt, Mycobacterium bovis subsp bovis AF2122/97
accggcgccgccggcacccgcc

SEQ ID NO: 1066879 - RNA, 14 nt, Mycobacterium bovis subsp bovis AF2122/97
accggcgccgccgu

SEQ ID NO: 1066880 - RNA, 14 nt, Mycobacterium bovis subsp bovis AF2122/97
accggcgccgcgcg

SEQ ID NO: 1066881 - RNA, 13 nt, Mycobacterium bovis subsp bovis AF2122/97
accggcgccgccg

SEQ ID NO: 1066882 - RNA, 14 nt, Mycobacterium bovis subsp bovis AF2122/97
accggcgccgccgg

SEQ ID NO: 1066883 - RNA, 16 nt, Mycobacterium bovis subsp bovis AF2122/97
accggcgccgccggca

SEQ ID NO: 1066884 - RNA, 21 nt, Mycobacterium bovis subsp bovis AF2122/97
accggcgccgccgucgccgcc

SEQ ID NO: 1066885 - RNA, 14 nt, Mycobacterium bovis subsp bovis AF2122/97
accggcgccuccgg

SEQ ID NO: 1066886 - RNA, 16 nt, Mycobacterium bovis subsp bovis AF2122/97
accggcgccggaguug

SEQ ID NO: 1066887 - RNA, 15 nt, Mycobacterium bovis subsp bovis AF2122/97
accggcgcgaccgcg

SEQ ID NO: 1066888 - RNA, 16 nt, Mycobacterium bovis subsp bovis AF2122/97
accggcgcgaccgcgg

SEQ ID NO: 1066889 - RNA, 18 nt, Mycobacterium bovis subsp bovis AF2122/97
accggcgcccagcgccuc

SEQ ID NO: 1066890 - RNA, 22 nt, Mycobacterium bovis subsp bovis AF2122/97
accggcgcccagcgccucgaug

SEQ ID NO: 1066891 - RNA, 20 nt, Mycobacterium bovis subsp bovis AF2122/97
accggcgccaccggcgccgc

SEQ ID NO: 1066892 - RNA, 22 nt, Mycobacterium bovis subsp bovis AF2122/97
accggcgcccucaugucgggca

SEQ ID NO: 1066893 - RNA, 17 nt, Mycobacterium bovis subsp bovis AF2122/97
accggcgacgccggccu

SEQ ID NO: 1066894 - RNA, 15 nt, Mycobacterium bovis subsp bovis AF2122/97
accggcgagcccgca

SEQ ID NO: 1066895 - RNA, 20 nt, Mycobacterium bovis subsp bovis AF2122/97
accggcgaucguguccaccg

SEQ ID NO: 1066896 - RNA, 20 nt, Mycobacterium bovis subsp bovis AF2122/97
accgccauccuucgggguga

SEQ ID NO: 1066897 - RNA, 24 nt, Mycobacterium bovis subsp bovis AF2122/97
accgccaugagguaggucgccgcc

SEQ ID NO: 1066898 - RNA, 14 nt, Mycobacterium bovis subsp bovis AF2122/97
accgccaccacgcc

SEQ ID NO: 1066899 - RNA, 20 nt, Mycobacterium bovis subsp bovis AF2122/97
accgccaccacgccgucgac

SEQ ID NO: 1066900 - RNA, 19 nt, Mycobacterium bovis subsp bovis AF2122/97
accgccacccugaccaaca

SEQ ID NO: 1066901 - RNA, 16 nt, Mycobacterium bovis subsp bovis AF2122/97
accgccaccgccagcg

SEQ ID NO: 1066902 - RNA, 19 nt, Mycobacterium bovis subsp bovis AF2122/97
accgccaguuccggugacg

SEQ ID NO: 1066903 - RNA, 12 nt, Mycobacterium bovis subsp bovis AF2122/97
accgagcagcag

SEQ ID NO: 1066904 - RNA, 17 nt, Mycobacterium bovis subsp bovis AF2122/97
accgagccgcgaugcgc

SEQ ID NO: 1066905 - RNA, 19 nt, Mycobacterium bovis subsp bovis AF2122/97
accgagaucaccgccacca

SEQ ID NO: 1066906 - RNA, 20 nt, Mycobacterium bovis subsp bovis AF2122/97
accgagaucaccgccaccac

SEQ ID NO: 1066907 - RNA, 23 nt, Mycobacterium bovis subsp bovis AF2122/97
accgagcaaacacgccucgccga

SEQ ID NO: 1066908 - RNA, 20 nt, Mycobacterium bovis subsp bovis AF2122/97
accgccacacggggccgcca

SEQ ID NO: 1066909 - RNA, 16 nt, Mycobacterium bovis subsp bovis AF2122/97
accgcauucggacgcc

SEQ ID NO: 1066910 - RNA, 20 nt, Mycobacterium bovis subsp bovis AF2122/97
accgcauucggacgccacgg

SEQ ID NO: 1066911 - RNA, 22 nt, Mycobacterium bovis subsp bovis AF2122/97
accgagcgcaaucgaccacgac

SEQ ID NO: 1066912 - RNA, 15 nt, Mycobacterium bovis subsp bovis AF2122/97
accgcaugguggugg

SEQ ID NO: 1066913 - RNA, 20 nt, Mycobacterium bovis subsp bovis AF2122/97
accgcaugguggugggugau

SEQ ID NO: 1066914 - RNA, 17 nt, Mycobacterium bovis subsp bovis AF2122/97
accgccgccgccgacgc

SEQ ID NO: 1066915 - RNA, 18 nt, Mycobacterium bovis subsp bovis AF2122/97
accgccgccgccgacgcc

SEQ ID NO: 1066916 - RNA, 19 nt, Mycobacterium bovis subsp bovis AF2122/97
accgccgccgccaccggcg

SEQ ID NO: 1066917 - RNA, 20 nt, Mycobacterium bovis subsp bovis AF2122/97
accgccgccgccaccggcgc

SEQ ID NO: 1066918 - RNA, 23 nt, Mycobacterium bovis subsp bovis AF2122/97
accgccgccgccaccggcgccgc

SEQ ID NO: 1066919 - RNA, 22 nt, Mycobacterium bovis subsp bovis AF2122/97
accgccgggcccucgccauggc

SEQ ID NO: 1066920 - RNA, 12 nt, Mycobacterium bovis subsp bovis AF2122/97
accgccgccgaa

SEQ ID NO: 1066921 - RNA, 19 nt, Mycobacterium bovis subsp bovis AF2122/97
accgccgccgaagcgaugc

SEQ ID NO: 1066922 - RNA, 20 nt, Mycobacterium bovis subsp bovis AF2122/97
accgccgccgccgacgccgc

SEQ ID NO: 1066923 - RNA, 21 nt, Mycobacterium bovis subsp bovis AF2122/97
accgccgccgccgacgccgcc

SEQ ID NO: 1066924 - RNA, 15 nt, Mycobacterium bovis subsp bovis AF2122/97
accgccccggcggcg

SEQ ID NO: 1066925 - RNA, 14 nt, Mycobacterium bovis subsp bovis AF2122/97
accgccccgccaac

SEQ ID NO: 1066926 - RNA, 19 nt, Mycobacterium bovis subsp bovis AF2122/97
accgccgacggcgccccgc

SEQ ID NO: 1066927 - RNA, 20 nt, Mycobacterium bovis subsp bovis AF2122/97
accgccgccaccaccgcugc

SEQ ID NO: 1066928 - RNA, 19 nt, Mycobacterium bovis subsp bovis AF2122/97
accgccgccaccagggcgg

SEQ ID NO: 1066929 - RNA, 17 nt, Mycobacterium bovis subsp bovis AF2122/97
accgccuuugccgccgg

SEQ ID NO: 1066930 - RNA, 15 nt, Mycobacterium bovis subsp bovis AF2122/97
accgccuugucggcg

SEQ ID NO: 1066931 - RNA, 15 nt, Mycobacterium bovis subsp bovis AF2122/97
accgccuuggucacc

SEQ ID NO: 1066932 - RNA, 13 nt, Mycobacterium bovis subsp bovis AF2122/97
accgccugugccg

SEQ ID NO: 1066933 - RNA, 15 nt, Mycobacterium bovis subsp bovis AF2122/97
accgccugugccgcc

SEQ ID NO: 1066934 - RNA, 20 nt, Mycobacterium bovis subsp bovis AF2122/97
accgccugugccgccggcgc

SEQ ID NO: 1066935 - RNA, 17 nt, Mycobacterium bovis subsp bovis AF2122/97
accgccugcuggccgcg

SEQ ID NO: 1066936 - RNA, 18 nt, Mycobacterium bovis subsp bovis AF2122/97
accgccugggcggccagc

SEQ ID NO: 1066937 - RNA, 20 nt, Mycobacterium bovis subsp bovis AF2122/97
accgccugggcggccagcac

SEQ ID NO: 1066938 - RNA, 14 nt, Mycobacterium bovis subsp bovis AF2122/97
accgccguugccgc

SEQ ID NO: 1066939 - RNA, 15 nt, Mycobacterium bovis subsp bovis AF2122/97
accgccguugccgcc

SEQ ID NO: 1066940 - RNA, 18 nt, Mycobacterium bovis subsp bovis AF2122/97
accgccguugccgccggc

SEQ ID NO: 1066941 - RNA, 21 nt, Mycobacterium bovis subsp bovis AF2122/97
accgccguugccgccggcgcc

SEQ ID NO: 1066942 - RNA, 21 nt, Mycobacterium bovis subsp bovis AF2122/97
accgccguugccaagcagcug

SEQ ID NO: 1066943 - RNA, 19 nt, Mycobacterium bovis subsp bovis AF2122/97
accgccguugccgaucagc

SEQ ID NO: 1066944 - RNA, 23 nt, Mycobacterium bovis subsp bovis AF2122/97
accgccguugccgaucagcccgg

SEQ ID NO: 1066945 - RNA, 18 nt, Mycobacterium bovis subsp bovis AF2122/97
accgccguugccgaucgc

SEQ ID NO: 1066946 - RNA, 22 nt, Mycobacterium bovis subsp bovis AF2122/97
accgccguugccgaucgcuccg

SEQ ID NO: 1066947 - RNA, 18 nt, Mycobacterium bovis subsp bovis AF2122/97
accgccgugugccacggg

SEQ ID NO: 1066948 - RNA, 17 nt, Mycobacterium bovis subsp bovis AF2122/97
accgccguuaccgacgc

SEQ ID NO: 1066949 - RNA, 20 nt, Mycobacterium bovis subsp bovis AF2122/97
accgccguuaccgacgccgg

SEQ ID NO: 1066950 - RNA, 18 nt, Mycobacterium bovis subsp bovis AF2122/97
accgccgcccccgccggc

SEQ ID NO: 1066951 - RNA, 13 nt, Mycobacterium bovis subsp bovis AF2122/97
accgccgucgcca

SEQ ID NO: 1066952 - RNA, 22 nt, Mycobacterium bovis subsp bovis AF2122/97
accgccggugccgaugaccgaa

SEQ ID NO: 1066953 - RNA, 14 nt, Mycobacterium bovis subsp bovis AF2122/97
accgccggugccgc

SEQ ID NO: 1066954 - RNA, 16 nt, Mycobacterium bovis subsp bovis AF2122/97
accgccggugccgcca

SEQ ID NO: 1066955 - RNA, 18 nt, Mycobacterium bovis subsp bovis AF2122/97
accgccggugccgccauc

SEQ ID NO: 1066956 - RNA, 15 nt, Mycobacterium bovis subsp bovis AF2122/97
accgccggugcggcc

SEQ ID NO: 1066957 - RNA, 13 nt, Mycobacterium bovis subsp bovis AF2122/97
accgccgguggcg

SEQ ID NO: 1066958 - RNA, 22 nt, Mycobacterium bovis subsp bovis AF2122/97
accgcgccgucgucgagcacca

SEQ ID NO: 1066959 - RNA, 23 nt, Mycobacterium bovis subsp bovis AF2122/97
accgcgccguaaagccaacuggu

SEQ ID NO: 1066960 - RNA, 21 nt, Mycobacterium bovis subsp bovis AF2122/97
accgcgccggcggaagcggcg

SEQ ID NO: 1066961 - RNA, 15 nt, Mycobacterium bovis subsp bovis AF2122/97
accgcgccggcggca

SEQ ID NO: 1066962 - RNA, 16 nt, Mycobacterium bovis subsp bovis AF2122/97
accgcgccgucgucgc

SEQ ID NO: 1066963 - RNA, 18 nt, Mycobacterium bovis subsp bovis AF2122/97
accgcgccgucgucgcgc

SEQ ID NO: 1066964 - RNA, 12 nt, Mycobacterium bovis subsp bovis AF2122/97
accgcggccggc

SEQ ID NO: 1066965 - RNA, 13 nt, Mycobacterium bovis subsp bovis AF2122/97
accgcggccggcc

SEQ ID NO: 1066966 - RNA, 16 nt, Mycobacterium bovis subsp bovis AF2122/97
accgcggccggccguc

SEQ ID NO: 1066967 - RNA, 21 nt, Mycobacterium bovis subsp bovis AF2122/97
accgcggccggguggcccggc

SEQ ID NO: 1066968 - RNA, 14 nt, Mycobacterium bovis subsp bovis AF2122/97
accgcggccccgcc

SEQ ID NO: 1066969 - RNA, 17 nt, Mycobacterium bovis subsp bovis AF2122/97
accgcggccccgccguu

SEQ ID NO: 1066970 - RNA, 18 nt, Mycobacterium bovis subsp bovis AF2122/97
accgcggauuccagcgcg

SEQ ID NO: 1066971 - RNA, 20 nt, Mycobacterium bovis subsp bovis AF2122/97
accgcggcaugugacaucgg

SEQ ID NO: 1066972 - RNA, 17 nt, Mycobacterium bovis subsp bovis AF2122/97
accgcggaucgaccgcc

SEQ ID NO: 1066973 - RNA, 17 nt, Mycobacterium bovis subsp bovis AF2122/97
accgcggacccgcagcu

SEQ ID NO: 1066974 - RNA, 19 nt, Mycobacterium bovis subsp bovis AF2122/97
accgcggacccgcagcugc

SEQ ID NO: 1066975 - RNA, 22 nt, Mycobacterium bovis subsp bovis AF2122/97
accgcggagauaccggacccca

SEQ ID NO: 1066976 - RNA, 20 nt, Mycobacterium bovis subsp bovis AF2122/97
accgcgccgucgucgcgcag

SEQ ID NO: 1066977 - RNA, 16 nt, Mycobacterium bovis subsp bovis AF2122/97
accgcgaccagcuggc

SEQ ID NO: 1066978 - RNA, 16 nt, Mycobacterium bovis subsp bovis AF2122/97
accgcgaccaucgcga

SEQ ID NO: 1066979 - RNA, 21 nt, Mycobacterium bovis subsp bovis AF2122/97
accgcgaccaucgcgacggca

SEQ ID NO: 1066980 - RNA, 21 nt, Mycobacterium bovis subsp bovis AF2122/97
accgcgaccagccagcgagga

SEQ ID NO: 1066981 - RNA, 18 nt, Mycobacterium bovis subsp bovis AF2122/97
accgcgaaugugaucacc

SEQ ID NO: 1066982 - RNA, 13 nt, Mycobacterium bovis subsp bovis AF2122/97
accgcgacccggc

SEQ ID NO: 1066983 - RNA, 17 nt, Mycobacterium bovis subsp bovis AF2122/97
accgcgccgaucaccac

SEQ ID NO: 1066984 - RNA, 19 nt, Mycobacterium bovis subsp bovis AF2122/97
accgcgccgaucaccaccg

SEQ ID NO: 1066985 - RNA, 20 nt, Mycobacterium bovis subsp bovis AF2122/97
accgcgccgaucaccaccgg

SEQ ID NO: 1066986 - RNA, 14 nt, Mycobacterium bovis subsp bovis AF2122/97
accgcgacgagcgg

SEQ ID NO: 1066987 - RNA, 12 nt, Mycobacterium bovis subsp bovis AF2122/97
accgcgccggcg

SEQ ID NO: 1066988 - RNA, 21 nt, Mycobacterium bovis subsp bovis AF2122/97
accgcgaaugugaucacccgc

SEQ ID NO: 1066989 - RNA, 23 nt, Mycobacterium bovis subsp bovis AF2122/97
accgccuuugccgccggcaccgc

SEQ ID NO: 1066990 - RNA, 22 nt, Mycobacterium bovis subsp bovis AF2122/97
accgcgaaaaccuccgggucca

SEQ ID NO: 1066991 - RNA, 17 nt, Mycobacterium bovis subsp bovis AF2122/97
accgcgaaaauucgucg

SEQ ID NO: 1066992 - RNA, 20 nt, Mycobacterium bovis subsp bovis AF2122/97
accgcgaaaauucgucgcgu

SEQ ID NO: 1066993 - RNA, 21 nt, Mycobacterium bovis subsp bovis AF2122/97
accgcggccuuggcggccgcg

SEQ ID NO: 1066994 - RNA, 21 nt, Mycobacterium bovis subsp bovis AF2122/97
accgcggcccggacgucggcg

SEQ ID NO: 1066995 - RNA, 22 nt, Mycobacterium bovis subsp bovis AF2122/97
accgcggcccggacgucggcgg

SEQ ID NO: 1066996 - RNA, 12 nt, Mycobacterium bovis subsp bovis AF2122/97
accgcggcggcg

SEQ ID NO: 1066997 - RNA, 20 nt, Mycobacterium bovis subsp bovis AF2122/97
accgcggcggcgcguggugc

SEQ ID NO: 1066998 - RNA, 19 nt, Mycobacterium bovis subsp bovis AF2122/97
accgcgguggggucgacgc

SEQ ID NO: 1066999 - RNA, 13 nt, Mycobacterium bovis subsp bovis AF2122/97
accgcgggccgcc

SEQ ID NO: 1067000 - RNA, 20 nt, Mycobacterium bovis subsp bovis AF2122/97
accgcgggaccuucgagccg

SEQ ID NO: 1067001 - RNA, 22 nt, Mycobacterium bovis subsp bovis AF2122/97
accgcggcugcuccgucgccga

SEQ ID NO: 1067002 - RNA, 20 nt, Mycobacterium bovis subsp bovis AF2122/97
accgcgguggggucgacgca

SEQ ID NO: 1067003 - RNA, 20 nt, Mycobacterium bovis subsp bovis AF2122/97
accgcggugugcgugucacc

SEQ ID NO: 1067004 - RNA, 23 nt, Mycobacterium bovis subsp bovis AF2122/97
accgcguagaccccaaucgaccg

SEQ ID NO: 1067005 - RNA, 18 nt, Mycobacterium bovis subsp bovis AF2122/97
accgcguacaggccggcc

SEQ ID NO: 1067006 - RNA, 21 nt, Mycobacterium bovis subsp bovis AF2122/97
accgcguacaggccggccacc

SEQ ID NO: 1067007 - RNA, 17 nt, Mycobacterium bovis subsp bovis AF2122/97
accgcgucaacgcuguu

SEQ ID NO: 1067008 - RNA, 14 nt, Mycobacterium bovis subsp bovis AF2122/97
accgcgucgaccgg

SEQ ID NO: 1067009 - RNA, 17 nt, Mycobacterium bovis subsp bovis AF2122/97
accgcgucacuucccgg

SEQ ID NO: 1067010 - RNA, 16 nt, Mycobacterium bovis subsp bovis AF2122/97
accgcgucaucaccgg

SEQ ID NO: 1067011 - RNA, 17 nt, Mycobacterium bovis subsp bovis AF2122/97
accgcgucaucaccggu

SEQ ID NO: 1067012 - RNA, 23 nt, Mycobacterium bovis subsp bovis AF2122/97
accgcguuucgcgacgucugcca

SEQ ID NO: 1067013 - RNA, 12 nt, Mycobacterium bovis subsp bovis AF2122/97
accgcgggcaua

SEQ ID NO: 1067014 - RNA, 18 nt, Mycobacterium bovis subsp bovis AF2122/97
accgcgucaucaccggua

SEQ ID NO: 1067015 - RNA, 22 nt, Mycobacterium bovis subsp bovis AF2122/97
accgcucgaugucccgagcccg

SEQ ID NO: 1067016 - RNA, 14 nt, Mycobacterium bovis subsp bovis AF2122/97
accgcucggaguug

SEQ ID NO: 1067017 - RNA, 17 nt, Mycobacterium bovis subsp bovis AF2122/97
accgcuaugaugccgcc

SEQ ID NO: 1067018 - RNA, 18 nt, Mycobacterium bovis subsp bovis AF2122/97
accgcuaugaugccgccg

SEQ ID NO: 1067019 - RNA, 21 nt, Mycobacterium bovis subsp bovis AF2122/97
acccagcaccacaacgucggc

SEQ ID NO: 1067020 - RNA, 16 nt, Mycobacterium bovis subsp bovis AF2122/97
acccagaucggcgacg

SEQ ID NO: 1067021 - RNA, 21 nt, Mycobacterium bovis subsp bovis AF2122/97
acccagaucggcgacgccguc

SEQ ID NO: 1067022 - RNA, 19 nt, Mycobacterium bovis subsp bovis AF2122/97
acccagaauuccggcggag

SEQ ID NO: 1067023 - RNA, 15 nt, Mycobacterium bovis subsp bovis AF2122/97
acccagaccgccgaa

SEQ ID NO: 1067024 - RNA, 22 nt, Mycobacterium bovis subsp bovis AF2122/97
acccagaaugacaucgucgcca

SEQ ID NO: 1067025 - RNA, 15 nt, Mycobacterium bovis subsp bovis AF2122/97
acccagaauuccggc

SEQ ID NO: 1067026 - RNA, 22 nt, Mycobacterium bovis subsp bovis AF2122/97
acccagcaccacaacgucggca

SEQ ID NO: 1067027 - RNA, 14 nt, Mycobacterium bovis subsp bovis AF2122/97
acccagcacgcgcg

SEQ ID NO: 1067028 - RNA, 13 nt, Mycobacterium bovis subsp bovis AF2122/97
acccacuccgccg

SEQ ID NO: 1067029 - RNA, 22 nt, Mycobacterium bovis subsp bovis AF2122/97
acccacugcacggagccgccgg

SEQ ID NO: 1067030 - RNA, 23 nt, Mycobacterium bovis subsp bovis AF2122/97
acccacugcacggagccgccggc

SEQ ID NO: 1067031 - RNA, 17 nt, Mycobacterium bovis subsp bovis AF2122/97
acccacugcccgccgac

SEQ ID NO: 1067032 - RNA, 20 nt, Mycobacterium bovis subsp bovis AF2122/97
acccacuuucgacccgcggc

SEQ ID NO: 1067033 - RNA, 21 nt, Mycobacterium bovis subsp bovis AF2122/97
acccacuuucgacccgcggcg

SEQ ID NO: 1067034 - RNA, 20 nt, Mycobacterium bovis subsp bovis AF2122/97
acccagaaugacaucgucgc

SEQ ID NO: 1067035 - RNA, 18 nt, Mycobacterium bovis subsp bovis AF2122/97
acccaucaacgccggcga

SEQ ID NO: 1067036 - RNA, 16 nt, Mycobacterium bovis subsp bovis AF2122/97
acccagucggcgccgc

SEQ ID NO: 1067037 - RNA, 16 nt, Mycobacterium bovis subsp bovis AF2122/97
acccaguuccacccgg

SEQ ID NO: 1067038 - RNA, 17 nt, Mycobacterium bovis subsp bovis AF2122/97
acccaguuucggcgucg

SEQ ID NO: 1067039 - RNA, 14 nt, Mycobacterium bovis subsp bovis AF2122/97
acccagucggcgcc

SEQ ID NO: 1067040 - RNA, 22 nt, Mycobacterium bovis subsp bovis AF2122/97
acccagucccaacacggcgaca

SEQ ID NO: 1067041 - RNA, 16 nt, Mycobacterium bovis subsp bovis AF2122/97
acccaggugucgcugc

SEQ ID NO: 1067042 - RNA, 13 nt, Mycobacterium bovis subsp bovis AF2122/97
acccaccgugccg

SEQ ID NO: 1067043 - RNA, 14 nt, Mycobacterium bovis subsp bovis AF2122/97
acccaccgugccgg

SEQ ID NO: 1067044 - RNA, 17 nt, Mycobacterium bovis subsp bovis AF2122/97
acccaccgugccgggcg

SEQ ID NO: 1067045 - RNA, 20 nt, Mycobacterium bovis subsp bovis AF2122/97
acccaccguuugggcgccgg

SEQ ID NO: 1067046 - RNA, 19 nt, Mycobacterium bovis subsp bovis AF2122/97
acccaccucccgcagccgg

SEQ ID NO: 1067047 - RNA, 21 nt, Mycobacterium bovis subsp bovis AF2122/97
acccaccucguauacccgggc

SEQ ID NO: 1067048 - RNA, 21 nt, Mycobacterium bovis subsp bovis AF2122/97
acccaccccccagcgccgccg

SEQ ID NO: 1067049 - RNA, 22 nt, Mycobacterium bovis subsp bovis AF2122/97
acccaccccccagcgccgccgc

SEQ ID NO: 1067050 - RNA, 13 nt, Mycobacterium bovis subsp bovis AF2122/97
acccacccgcacc

SEQ ID NO: 1067051 - RNA, 19 nt, Mycobacterium bovis subsp bovis AF2122/97
acccacccgcaccgccggc

SEQ ID NO: 1067052 - RNA, 21 nt, Mycobacterium bovis subsp bovis AF2122/97
acccacaugacgaucgcggcg

SEQ ID NO: 1067053 - RNA, 19 nt, Mycobacterium bovis subsp bovis AF2122/97
acccaccgccccggcggcg

SEQ ID NO: 1067054 - RNA, 17 nt, Mycobacterium bovis subsp bovis AF2122/97
acccaccggaccaccgc

SEQ ID NO: 1067055 - RNA, 16 nt, Mycobacterium bovis subsp bovis AF2122/97
acccacauaccggcgc

SEQ ID NO: 1067056 - RNA, 14 nt, Mycobacterium bovis subsp bovis AF2122/97
acccacagucgccg

SEQ ID NO: 1067057 - RNA, 18 nt, Mycobacterium bovis subsp bovis AF2122/97
acccaacuccaucagcgc

SEQ ID NO: 1067058 - RNA, 15 nt, Mycobacterium bovis subsp bovis AF2122/97
acccaacgaccacca

SEQ ID NO: 1067059 - RNA, 18 nt, Mycobacterium bovis subsp bovis AF2122/97
acccaaccccgccggccg

SEQ ID NO: 1067060 - RNA, 16 nt, Mycobacterium bovis subsp bovis AF2122/97
acccaacccggcggca

SEQ ID NO: 1067061 - RNA, 11 nt, Mycobacterium bovis subsp bovis AF2122/97
acccaacacca

SEQ ID NO: 1067062 - RNA, 15 nt, Mycobacterium bovis subsp bovis AF2122/97
acccaacaccagcag

SEQ ID NO: 1067063 - RNA, 22 nt, Mycobacterium bovis subsp bovis AF2122/97
acccaacagcccaccggugccg

SEQ ID NO: 1067064 - RNA, 22 nt, Mycobacterium bovis subsp bovis AF2122/97
acccacacccagcgugcccgcc

SEQ ID NO: 1067065 - RNA, 23 nt, Mycobacterium bovis subsp bovis AF2122/97
acccacacccagcgugcccgcca

SEQ ID NO: 1067066 - RNA, 14 nt, Mycobacterium bovis subsp bovis AF2122/97
acccaauggagccg

SEQ ID NO: 1067067 - RNA, 22 nt, Mycobacterium bovis subsp bovis AF2122/97
acccaauucacgacgccgagca

SEQ ID NO: 1067068 - RNA, 13 nt, Mycobacterium bovis subsp bovis AF2122/97
accagcugccggc

SEQ ID NO: 1067069 - RNA, 22 nt, Mycobacterium bovis subsp bovis AF2122/97
accagcuccucgugcucggcca

SEQ ID NO: 1067070 - RNA, 21 nt, Mycobacterium bovis subsp bovis AF2122/97
accagcugagccgucggcgcc

SEQ ID NO: 1067071 - RNA, 19 nt, Mycobacterium bovis subsp bovis AF2122/97
accagcugcgagucgucgc

SEQ ID NO: 1067072 - RNA, 15 nt, Mycobacterium bovis subsp bovis AF2122/97
accagcugucgggca

SEQ ID NO: 1067073 - RNA, 16 nt, Mycobacterium bovis subsp bovis AF2122/97
accaggaccaccgcau

SEQ ID NO: 1067074 - RNA, 23 nt, Mycobacterium bovis subsp bovis AF2122/97
accaggauuaagguguggucggc

SEQ ID NO: 1067075 - RNA, 21 nt, Mycobacterium bovis subsp bovis AF2122/97
accccguagcggucuccccag

SEQ ID NO: 1067076 - RNA, 19 nt, Mycobacterium bovis subsp bovis AF2122/97
accccguaggcgccgaacc

SEQ ID NO: 1067077 - RNA, 17 nt, Mycobacterium bovis subsp bovis AF2122/97
accccugcacggugccc

SEQ ID NO: 1067078 - RNA, 15 nt, Mycobacterium bovis subsp bovis AF2122/97
accccuccgaucacg

SEQ ID NO: 1067079 - RNA, 18 nt, Mycobacterium bovis subsp bovis AF2122/97
accccgucagcgggcagc

SEQ ID NO: 1067080 - RNA, 13 nt, Mycobacterium bovis subsp bovis AF2122/97
accccucacccag

SEQ ID NO: 1067081 - RNA, 12 nt, Mycobacterium bovis subsp bovis AF2122/97
accccgccgcca

SEQ ID NO: 1067082 - RNA, 14 nt, Mycobacterium bovis subsp bovis AF2122/97
accccgccggccgg

SEQ ID NO: 1067083 - RNA, 12 nt, Mycobacterium bovis subsp bovis AF2122/97
accccgccgggg

SEQ ID NO: 1067084 - RNA, 15 nt, Mycobacterium bovis subsp bovis AF2122/97
accccgcgcgccagc

SEQ ID NO: 1067085 - RNA, 13 nt, Mycobacterium bovis subsp bovis AF2122/97
accccggcucggc

SEQ ID NO: 1067086 - RNA, 16 nt, Mycobacterium bovis subsp bovis AF2122/97
accccggcucggccac

SEQ ID NO: 1067087 - RNA, 18 nt, Mycobacterium bovis subsp bovis AF2122/97
accccgccaugcggcgcg

SEQ ID NO: 1067088 - RNA, 13 nt, Mycobacterium bovis subsp bovis AF2122/97
accccggucccgc

SEQ ID NO: 1067089 - RNA, 17 nt, Mycobacterium bovis subsp bovis AF2122/97
accccggucggagcggu

SEQ ID NO: 1067090 - RNA, 12 nt, Mycobacterium bovis subsp bovis AF2122/97
accccggugccc

SEQ ID NO: 1067091 - RNA, 18 nt, Mycobacterium bovis subsp bovis AF2122/97
accccggguacgccgggc

SEQ ID NO: 1067092 - RNA, 16 nt, Mycobacterium bovis subsp bovis AF2122/97
accccgaucacccgca

SEQ ID NO: 1067093 - RNA, 14 nt, Mycobacterium bovis subsp bovis AF2122/97
accccauggccagc

SEQ ID NO: 1067094 - RNA, 19 nt, Mycobacterium bovis subsp bovis AF2122/97
accccauggccagcgcuuc

SEQ ID NO: 1067095 - RNA, 21 nt, Mycobacterium bovis subsp bovis AF2122/97
accccgcagcucaccucauga

SEQ ID NO: 1067096 - RNA, 20 nt, Mycobacterium bovis subsp bovis AF2122/97
accccgauucgugucggugc

SEQ ID NO: 1067097 - RNA, 23 nt, Mycobacterium bovis subsp bovis AF2122/97
accccgauucgugucggugcgcg

SEQ ID NO: 1067098 - RNA, 21 nt, Mycobacterium bovis subsp bovis AF2122/97
accccgaugccgugccgggcc

SEQ ID NO: 1067099 - RNA, 15 nt, Mycobacterium bovis subsp bovis AF2122/97
accccgccgaacggc

SEQ ID NO: 1067100 - RNA, 16 nt, Mycobacterium bovis subsp bovis AF2122/97
accccgccgagcgguu

SEQ ID NO: 1067101 - RNA, 15 nt, Mycobacterium bovis subsp bovis AF2122/97
accccgccgaucacc

SEQ ID NO: 1067102 - RNA, 20 nt, Mycobacterium bovis subsp bovis AF2122/97
acccgcagcuguggcccacu

SEQ ID NO: 1067103 - RNA, 15 nt, Mycobacterium bovis subsp bovis AF2122/97
acccgcagaccgcca

SEQ ID NO: 1067104 - RNA, 14 nt, Mycobacterium bovis subsp bovis AF2122/97
acccgcagccgcgc

SEQ ID NO: 1067105 - RNA, 13 nt, Mycobacterium bovis subsp bovis AF2122/97
acccgcagaccgg

SEQ ID NO: 1067106 - RNA, 14 nt, Mycobacterium bovis subsp bovis AF2122/97
acccgcagaccggu

SEQ ID NO: 1067107 - RNA, 17 nt, Mycobacterium bovis subsp bovis AF2122/97
acccgcaccccggccgc

SEQ ID NO: 1067108 - RNA, 14 nt, Mycobacterium bovis subsp bovis AF2122/97
acccgagccgccgu

SEQ ID NO: 1067109 - RNA, 13 nt, Mycobacterium bovis subsp bovis AF2122/97
acccgagcgaugc

SEQ ID NO: 1067110 - RNA, 12 nt, Mycobacterium bovis subsp bovis AF2122/97
acccgcaccggu

SEQ ID NO: 1067111 - RNA, 16 nt, Mycobacterium bovis subsp bovis AF2122/97
acccgcaccggugacg

SEQ ID NO: 1067112 - RNA, 17 nt, Mycobacterium bovis subsp bovis AF2122/97
acccgcacggccuccgg

SEQ ID NO: 1067113 - RNA, 12 nt, Mycobacterium bovis subsp bovis AF2122/97
acccgagccgcc

SEQ ID NO: 1067114 - RNA, 21 nt, Mycobacterium bovis subsp bovis AF2122/97
acccgagcgcucgaucacggc

SEQ ID NO: 1067115 - RNA, 19 nt, Mycobacterium bovis subsp bovis AF2122/97
acccgagcguccggugguc

SEQ ID NO: 1067116 - RNA, 21 nt, Mycobacterium bovis subsp bovis AF2122/97
acccgagcuugggccggugca

SEQ ID NO: 1067117 - RNA, 16 nt, Mycobacterium bovis subsp bovis AF2122/97
acccgagaacgcccga

SEQ ID NO: 1067118 - RNA, 18 nt, Mycobacterium bovis subsp bovis AF2122/97
acccgagcaacggcggca

SEQ ID NO: 1067119 - RNA, 17 nt, Mycobacterium bovis subsp bovis AF2122/97
acccgacaugcgccgag

SEQ ID NO: 1067120 - RNA, 14 nt, Mycobacterium bovis subsp bovis AF2122/97
acccgacgaugccg

SEQ ID NO: 1067121 - RNA, 18 nt, Mycobacterium bovis subsp bovis AF2122/97
acccgaccgucgucgugc

SEQ ID NO: 1067122 - RNA, 21 nt, Mycobacterium bovis subsp bovis AF2122/97
acccgacacggcucgccggcu

SEQ ID NO: 1067123 - RNA, 21 nt, Mycobacterium bovis subsp bovis AF2122/97
acccgaaucccacagcaggag

SEQ ID NO: 1067124 - RNA, 22 nt, Mycobacterium bovis subsp bovis AF2122/97
acccgacaauggcgccagccga

SEQ ID NO: 1067125 - RNA, 16 nt, Mycobacterium bovis subsp bovis AF2122/97
accccuggccgccggc

SEQ ID NO: 1067126 - RNA, 17 nt, Mycobacterium bovis subsp bovis AF2122/97
accccuggccgccggcg

SEQ ID NO: 1067127 - RNA, 20 nt, Mycobacterium bovis subsp bovis AF2122/97
accccuggccgccggcgccg

SEQ ID NO: 1067128 - RNA, 12 nt, Mycobacterium bovis subsp bovis AF2122/97
accccuggcgau

SEQ ID NO: 1067129 - RNA, 21 nt, Mycobacterium bovis subsp bovis AF2122/97
accccuggguugaggaucccg

SEQ ID NO: 1067130 - RNA, 19 nt, Mycobacterium bovis subsp bovis AF2122/97
acccgaacugggcgaucga

SEQ ID NO: 1067131 - RNA, 19 nt, Mycobacterium bovis subsp bovis AF2122/97
acccgaaacaccgucuggc

SEQ ID NO: 1067132 - RNA, 18 nt, Mycobacterium bovis subsp bovis AF2122/97
acccucgggcgucacggu

SEQ ID NO: 1067133 - RNA, 19 nt, Mycobacterium bovis subsp bovis AF2122/97
acccucgggcgucacggug

SEQ ID NO: 1067134 - RNA, 20 nt, Mycobacterium bovis subsp bovis AF2122/97
acccucggguccaaccacga

SEQ ID NO: 1067135 - RNA, 16 nt, Mycobacterium bovis subsp bovis AF2122/97
acccucgggucgucgc

SEQ ID NO: 1067136 - RNA, 19 nt, Mycobacterium bovis subsp bovis AF2122/97
acccugaugaucguccagc

SEQ ID NO: 1067137 - RNA, 23 nt, Mycobacterium bovis subsp bovis AF2122/97
acccugcacccgacccgaugcgu

SEQ ID NO: 1067138 - RNA, 14 nt, Mycobacterium bovis subsp bovis AF2122/97
acccuccccaacgu

SEQ ID NO: 1067139 - RNA, 13 nt, Mycobacterium bovis subsp bovis AF2122/97
acccucagccgcg

SEQ ID NO: 1067140 - RNA, 13 nt, Mycobacterium bovis subsp bovis AF2122/97
acccguucuucgc

SEQ ID NO: 1067141 - RNA, 14 nt, Mycobacterium bovis subsp bovis AF2122/97
acccguugaacucg

SEQ ID NO: 1067142 - RNA, 14 nt, Mycobacterium bovis subsp bovis AF2122/97
acccguuccacgcc

SEQ ID NO: 1067143 - RNA, 18 nt, Mycobacterium bovis subsp bovis AF2122/97
acccguuccacgccggca

SEQ ID NO: 1067144 - RNA, 20 nt, Mycobacterium bovis subsp bovis AF2122/97
acccguguugagggugcccg

SEQ ID NO: 1067145 - RNA, 16 nt, Mycobacterium bovis subsp bovis AF2122/97
acccguuaugcgccgc

SEQ ID NO: 1067146 - RNA, 21 nt, Mycobacterium bovis subsp bovis AF2122/97
acccguugcucccacggcacc

SEQ ID NO: 1067147 - RNA, 22 nt, Mycobacterium bovis subsp bovis AF2122/97
acccguugagcauaugacgucg

SEQ ID NO: 1067148 - RNA, 22 nt, Mycobacterium bovis subsp bovis AF2122/97
acccguuggauguuuuccgguc

SEQ ID NO: 1067149 - RNA, 19 nt, Mycobacterium bovis subsp bovis AF2122/97
acccguuuugggugaucgc

SEQ ID NO: 1067150 - RNA, 18 nt, Mycobacterium bovis subsp bovis AF2122/97
acccuauuggucggucgc

SEQ ID NO: 1067151 - RNA, 14 nt, Mycobacterium bovis subsp bovis AF2122/97
acccguugaucgcg

SEQ ID NO: 1067152 - RNA, 20 nt, Mycobacterium bovis subsp bovis AF2122/97
acccuagggcggugccgccg

SEQ ID NO: 1067153 - RNA, 17 nt, Mycobacterium bovis subsp bovis AF2122/97
acccguaggguggccga

SEQ ID NO: 1067154 - RNA, 23 nt, Mycobacterium bovis subsp bovis AF2122/97
acccgucccacgugugcggaagc

SEQ ID NO: 1067155 - RNA, 14 nt, Mycobacterium bovis subsp bovis AF2122/97
acccgugagcucgu

SEQ ID NO: 1067156 - RNA, 19 nt, Mycobacterium bovis subsp bovis AF2122/97
acccgugcacgaucgcggu

SEQ ID NO: 1067157 - RNA, 23 nt, Mycobacterium bovis subsp bovis AF2122/97
acccguccgccgcagacgccgac

SEQ ID NO: 1067158 - RNA, 21 nt, Mycobacterium bovis subsp bovis AF2122/97
acccguguucgccacacccgu

SEQ ID NO: 1067159 - RNA, 20 nt, Mycobacterium bovis subsp bovis AF2122/97
acccgucaugcccaccgccu

SEQ ID NO: 1067160 - RNA, 15 nt, Mycobacterium bovis subsp bovis AF2122/97
acccgucgaacgcgc

SEQ ID NO: 1067161 - RNA, 13 nt, Mycobacterium bovis subsp bovis AF2122/97
acccggucgccgg

SEQ ID NO: 1067162 - RNA, 15 nt, Mycobacterium bovis subsp bovis AF2122/97
acccggucggcggca

SEQ ID NO: 1067163 - RNA, 15 nt, Mycobacterium bovis subsp bovis AF2122/97
acccggugccgcagc

SEQ ID NO: 1067164 - RNA, 15 nt, Mycobacterium bovis subsp bovis AF2122/97
acccggugaccagca

SEQ ID NO: 1067165 - RNA, 19 nt, Mycobacterium bovis subsp bovis AF2122/97
acccgguggcguuugaugc

SEQ ID NO: 1067166 - RNA, 13 nt, Mycobacterium bovis subsp bovis AF2122/97
acccguaccagcc

SEQ ID NO: 1067167 - RNA, 16 nt, Mycobacterium bovis subsp bovis AF2122/97
acccggugaugguggc

SEQ ID NO: 1067168 - RNA, 21 nt, Mycobacterium bovis subsp bovis AF2122/97
accgacuccugugcggagccg

SEQ ID NO: 1067169 - RNA, 24 nt, Mycobacterium bovis subsp bovis AF2122/97
accgacuccugugcggagccgcca

SEQ ID NO: 1067170 - RNA, 22 nt, Mycobacterium bovis subsp bovis AF2122/97
accgacugcacauaguccgagc

SEQ ID NO: 1067171 - RNA, 13 nt, Mycobacterium bovis subsp bovis AF2122/97
accgacgucgcca

SEQ ID NO: 1067172 - RNA, 15 nt, Mycobacterium bovis subsp bovis AF2122/97
accgacgucgccaag

SEQ ID NO: 1067173 - RNA, 22 nt, Mycobacterium bovis subsp bovis AF2122/97
accgacugcggguucgccgaua

SEQ ID NO: 1067174 - RNA, 18 nt, Mycobacterium bovis subsp bovis AF2122/97
accgacugcugucaccgc

SEQ ID NO: 1067175 - RNA, 17 nt, Mycobacterium bovis subsp bovis AF2122/97
accgagaacaccacgca

SEQ ID NO: 1067176 - RNA, 17 nt, Mycobacterium bovis subsp bovis AF2122/97
accgagaacugcucgau

SEQ ID NO: 1067177 - RNA, 23 nt, Mycobacterium bovis subsp bovis AF2122/97
accgagaagcccaccgucugcug

SEQ ID NO: 1067178 - RNA, 13 nt, Mycobacterium bovis subsp bovis AF2122/97
accgagacggcgu

SEQ ID NO: 1067179 - RNA, 17 nt, Mycobacterium bovis subsp bovis AF2122/97
accgacgcggucggcgg

SEQ ID NO: 1067180 - RNA, 12 nt, Mycobacterium bovis subsp bovis AF2122/97
accgacggccag

SEQ ID NO: 1067181 - RNA, 20 nt, Mycobacterium bovis subsp bovis AF2122/97
accgacggaaugucagccgg

SEQ ID NO: 1067182 - RNA, 21 nt, Mycobacterium bovis subsp bovis AF2122/97
accgacggacuucccgcgcga

SEQ ID NO: 1067183 - RNA, 16 nt, Mycobacterium bovis subsp bovis AF2122/97
accgaacacgagcuca

SEQ ID NO: 1067184 - RNA, 21 nt, Mycobacterium bovis subsp bovis AF2122/97
accgaaauggucguucccgcc

SEQ ID NO: 1067185 - RNA, 20 nt, Mycobacterium bovis subsp bovis AF2122/97
accgaaaccaugccgccgaa

SEQ ID NO: 1067186 - RNA, 22 nt, Mycobacterium bovis subsp bovis AF2122/97
accgaaacggggcgacguccgc

SEQ ID NO: 1067187 - RNA, 22 nt, Mycobacterium bovis subsp bovis AF2122/97
acccuguuguugccccggucgg

SEQ ID NO: 1067188 - RNA, 24 nt, Mycobacterium bovis subsp bovis AF2122/97
acccuguuguugccccggucggcg

SEQ ID NO: 1067189 - RNA, 20 nt, Mycobacterium bovis subsp bovis AF2122/97
acccuugccgauuccggcgu

SEQ ID NO: 1067190 - RNA, 22 nt, Mycobacterium bovis subsp bovis AF2122/97
accgaaaagccguucgcgucgc

SEQ ID NO: 1067191 - RNA, 17 nt, Mycobacterium bovis subsp bovis AF2122/97
accgaaaaguccgccgc

SEQ ID NO: 1067192 - RNA, 20 nt, Mycobacterium bovis subsp bovis AF2122/97
acccugccgcgaugagcggc

SEQ ID NO: 1067193 - RNA, 21 nt, Mycobacterium bovis subsp bovis AF2122/97
acccugcacugcgcgugcucg

SEQ ID NO: 1067194 - RNA, 16 nt, Mycobacterium bovis subsp bovis AF2122/97
acccugcccggcccgc

SEQ ID NO: 1067195 - RNA, 14 nt, Mycobacterium bovis subsp bovis AF2122/97
acccugcggcgucg

SEQ ID NO: 1067196 - RNA, 15 nt, Mycobacterium bovis subsp bovis AF2122/97
acccuggccggugcg

SEQ ID NO: 1067197 - RNA, 19 nt, Mycobacterium bovis subsp bovis AF2122/97
acccuggccuuugagcgcg

SEQ ID NO: 1067198 - RNA, 24 nt, Mycobacterium bovis subsp bovis AF2122/97
acccuggucgaaacgguacgccgc

SEQ ID NO: 1067199 - RNA, 20 nt, Mycobacterium bovis subsp bovis AF2122/97
acccggguagacaccgcgau

SEQ ID NO: 1067200 - RNA, 20 nt, Mycobacterium bovis subsp bovis AF2122/97
acccgggcgugggugucggc

SEQ ID NO: 1067201 - RNA, 21 nt, Mycobacterium bovis subsp bovis AF2122/97
acccgggcugcuugcgcccgg

SEQ ID NO: 1067202 - RNA, 16 nt, Mycobacterium bovis subsp bovis AF2122/97
acccggggacgcccgu

SEQ ID NO: 1067203 - RNA, 17 nt, Mycobacterium bovis subsp bovis AF2122/97
acccggggggccucguu

SEQ ID NO: 1067204 - RNA, 11 nt, Mycobacterium bovis subsp bovis AF2122/97
acccgggucgg

SEQ ID NO: 1067205 - RNA, 14 nt, Mycobacterium bovis subsp bovis AF2122/97
acccgggcguccca

SEQ ID NO: 1067206 - RNA, 15 nt, Mycobacterium bovis subsp bovis AF2122/97
acccgguaacgccau

SEQ ID NO: 1067207 - RNA, 19 nt, Mycobacterium bovis subsp bovis AF2122/97
acccgguaacgccaucguc

SEQ ID NO: 1067208 - RNA, 23 nt, Mycobacterium bovis subsp bovis AF2122/97
acccgguaccucaacaccaggcc

SEQ ID NO: 1067209 - RNA, 15 nt, Mycobacterium bovis subsp bovis AF2122/97
acccgguccggcccg

SEQ ID NO: 1067210 - RNA, 16 nt, Mycobacterium bovis subsp bovis AF2122/97
acccgguccugcucgc

SEQ ID NO: 1067211 - RNA, 20 nt, Mycobacterium bovis subsp bovis AF2122/97
acccgguccugcucgcacag

SEQ ID NO: 1067212 - RNA, 22 nt, Mycobacterium bovis subsp bovis AF2122/97
acccgguccugcucgcacagca

SEQ ID NO: 1067213 - RNA, 16 nt, Mycobacterium bovis subsp bovis AF2122/97
acccgguaguccgcgc

SEQ ID NO: 1067214 - RNA, 18 nt, Mycobacterium bovis subsp bovis AF2122/97
acccggucaacgugaacu

SEQ ID NO: 1067215 - RNA, 16 nt, Mycobacterium bovis subsp bovis AF2122/97
acccgguccagccggu

SEQ ID NO: 1067216 - RNA, 18 nt, Mycobacterium bovis subsp bovis AF2122/97
acccgguccauucguccg

SEQ ID NO: 1067217 - RNA, 18 nt, Mycobacterium bovis subsp bovis AF2122/97
acccggucccccgaagug

SEQ ID NO: 1067218 - RNA, 14 nt, Mycobacterium bovis subsp bovis AF2122/97
acccggucggccau

SEQ ID NO: 1067219 - RNA, 21 nt, Mycobacterium bovis subsp bovis AF2122/97
acccggucgccggucaucgcc

SEQ ID NO: 1067220 - RNA, 12 nt, Mycobacterium bovis subsp bovis AF2122/97
acccggucgagc

SEQ ID NO: 1067221 - RNA, 18 nt, Mycobacterium bovis subsp bovis AF2122/97
acccgggccucggcgccg

SEQ ID NO: 1067222 - RNA, 13 nt, Mycobacterium bovis subsp bovis AF2122/97
acccgguccggcc

SEQ ID NO: 1067223 - RNA, 19 nt, Mycobacterium bovis subsp bovis AF2122/97
acccggucgauucggcuca

SEQ ID NO: 1067224 - RNA, 22 nt, Mycobacterium bovis subsp bovis AF2122/97
acccgggccugggacggcggca

SEQ ID NO: 1067225 - RNA, 13 nt, Mycobacterium bovis subsp bovis AF2122/97
acccgggccgcca

SEQ ID NO: 1067226 - RNA, 16 nt, Mycobacterium bovis subsp bovis AF2122/97
acccgggccgggccga

SEQ ID NO: 1067227 - RNA, 21 nt, Mycobacterium bovis subsp bovis AF2122/97
acccgggccggucggugagcc

SEQ ID NO: 1067228 - RNA, 13 nt, Mycobacterium bovis subsp bovis AF2122/97
acccgggccucgg

SEQ ID NO: 1067229 - RNA, 14 nt, Mycobacterium bovis subsp bovis AF2122/97
acccgggccucggc

SEQ ID NO: 1067230 - RNA, 14 nt, Mycobacterium bovis subsp bovis AF2122/97
acccgggccgcggc

SEQ ID NO: 1067231 - RNA, 15 nt, Mycobacterium bovis subsp bovis AF2122/97
acccgggccgcggcg

SEQ ID NO: 1067232 - RNA, 16 nt, Mycobacterium bovis subsp bovis AF2122/97
acccgggccgcggcgg

SEQ ID NO: 1067233 - RNA, 17 nt, Mycobacterium bovis subsp bovis AF2122/97
acccgggccgcggcggc

SEQ ID NO: 1067234 - RNA, 18 nt, Mycobacterium bovis subsp bovis AF2122/97
acccgggccgcggcggcc

SEQ ID NO: 1067235 - RNA, 16 nt, Mycobacterium bovis subsp bovis AF2122/97
acccgggccacgucga

SEQ ID NO: 1067236 - RNA, 12 nt, Mycobacterium bovis subsp bovis AF2122/97
acccgggaagga

SEQ ID NO: 1067237 - RNA, 19 nt, Mycobacterium bovis subsp bovis AF2122/97
acccgggccacgucgagca

SEQ ID NO: 1067238 - RNA, 17 nt, Mycobacterium bovis subsp bovis AF2122/97
acccgggacgaaccggc

SEQ ID NO: 1067239 - RNA, 18 nt, Mycobacterium bovis subsp bovis AF2122/97
acccggcuucgccgcgcu

SEQ ID NO: 1067240 - RNA, 23 nt, Mycobacterium bovis subsp bovis AF2122/97
acccgggacguuguccaccgcca

SEQ ID NO: 1067241 - RNA, 15 nt, Mycobacterium bovis subsp bovis AF2122/97
acccgggagaugccg

SEQ ID NO: 1067242 - RNA, 19 nt, Mycobacterium bovis subsp bovis AF2122/97
acccgggaugaccaccggu

SEQ ID NO: 1067243 - RNA, 17 nt, Mycobacterium bovis subsp bovis AF2122/97
acccggcuguucucgcc

SEQ ID NO: 1067244 - RNA, 15 nt, Mycobacterium bovis subsp bovis AF2122/97
acccggcuucgccgc

SEQ ID NO: 1067245 - RNA, 18 nt, Mycobacterium bovis subsp bovis AF2122/97
acccggcgccgucgauga

SEQ ID NO: 1067246 - RNA, 22 nt, Mycobacterium bovis subsp bovis AF2122/97
acccggcggugccgucagcggc

SEQ ID NO: 1067247 - RNA, 13 nt, Mycobacterium bovis subsp bovis AF2122/97
acccggcggugcc

SEQ ID NO: 1067248 - RNA, 16 nt, Mycobacterium bovis subsp bovis AF2122/97
acccggcucggguggc

SEQ ID NO: 1067249 - RNA, 23 nt, Mycobacterium bovis subsp bovis AF2122/97
acccggcgucucgcagcaacggc

SEQ ID NO: 1067250 - RNA, 17 nt, Mycobacterium bovis subsp bovis AF2122/97
acccggcccagcgcccc

SEQ ID NO: 1067251 - RNA, 17 nt, Mycobacterium bovis subsp bovis AF2122/97
acccggccagcggcagg

SEQ ID NO: 1067252 - RNA, 11 nt, Mycobacterium bovis subsp bovis AF2122/97
acccggccagc

SEQ ID NO: 1067253 - RNA, 21 nt, Mycobacterium bovis subsp bovis AF2122/97
acccggccgaccucggcaacg

SEQ ID NO: 1067254 - RNA, 13 nt, Mycobacterium bovis subsp bovis AF2122/97
acccggccgcgca

SEQ ID NO: 1067255 - RNA, 18 nt, Mycobacterium bovis subsp bovis AF2122/97
acccggccgcugacgccg

SEQ ID NO: 1067256 - RNA, 22 nt, Mycobacterium bovis subsp bovis AF2122/97
acccggccguugggccaccggc

SEQ ID NO: 1067257 - RNA, 23 nt, Mycobacterium bovis subsp bovis AF2122/97
acccggccguugggccaccggcg

SEQ ID NO: 1067258 - RNA, 14 nt, Mycobacterium bovis subsp bovis AF2122/97
acccggccucggug

SEQ ID NO: 1067259 - RNA, 20 nt, Mycobacterium bovis subsp bovis AF2122/97
acccggcgggcccgccggcc

SEQ ID NO: 1067260 - RNA, 16 nt, Mycobacterium bovis subsp bovis AF2122/97
acccggcgaccacggc

SEQ ID NO: 1067261 - RNA, 19 nt, Mycobacterium bovis subsp bovis AF2122/97
acccggcgaccacggcacc

SEQ ID NO: 1067262 - RNA, 20 nt, Mycobacterium bovis subsp bovis AF2122/97
acccgccgcgguuaucgccg

SEQ ID NO: 1067263 - RNA, 19 nt, Mycobacterium bovis subsp bovis AF2122/97
acccgccgccgcccgggcg

SEQ ID NO: 1067264 - RNA, 17 nt, Mycobacterium bovis subsp bovis AF2122/97
acccgccgaugaugcgg

SEQ ID NO: 1067265 - RNA, 20 nt, Mycobacterium bovis subsp bovis AF2122/97
acccgccgaugaugcggcgc

SEQ ID NO: 1067266 - RNA, 19 nt, Mycobacterium bovis subsp bovis AF2122/97
acccgccgaugcugccgcc

SEQ ID NO: 1067267 - RNA, 21 nt, Mycobacterium bovis subsp bovis AF2122/97
acccgccgaugcugccgccgc

SEQ ID NO: 1067268 - RNA, 22 nt, Mycobacterium bovis subsp bovis AF2122/97
acccgcccuugccgccgagggc

SEQ ID NO: 1067269 - RNA, 23 nt, Mycobacterium bovis subsp bovis AF2122/97
acccgccggccgucggccggaug

SEQ ID NO: 1067270 - RNA, 19 nt, Mycobacterium bovis subsp bovis AF2122/97
acccgccggcgacugcagc

SEQ ID NO: 1067271 - RNA, 17 nt, Mycobacterium bovis subsp bovis AF2122/97
acccgccgcgcccggcg

SEQ ID NO: 1067272 - RNA, 20 nt, Mycobacterium bovis subsp bovis AF2122/97
aaaaugccgcucucggcgau

SEQ ID NO: 1067273 - RNA, 19 nt, Mycobacterium bovis subsp bovis AF2122/97
acccggcagcccggcggcc

SEQ ID NO: 1067274 - RNA, 17 nt, Mycobacterium bovis subsp bovis AF2122/97
acccggcagagcacgcg

SEQ ID NO: 1067275 - RNA, 20 nt, Mycobacterium bovis subsp bovis AF2122/97
acccggauaucgaccaccgg

SEQ ID NO: 1067276 - RNA, 15 nt, Mycobacterium bovis subsp bovis AF2122/97
acugcguuggcgacc

SEQ ID NO: 1067277 - RNA, 13 nt, Mycobacterium bovis subsp bovis AF2122/97
acugcucgauccg

SEQ ID NO: 1067278 - RNA, 15 nt, Mycobacterium bovis subsp bovis AF2122/97
acugcugcggcagcg

SEQ ID NO: 1067279 - RNA, 21 nt, Mycobacterium bovis subsp bovis AF2122/97
acugcugcggcagcgcggcca

SEQ ID NO: 1067280 - RNA, 22 nt, Mycobacterium bovis subsp bovis AF2122/97
acugcgaccgguucggcguaca

SEQ ID NO: 1067281 - RNA, 19 nt, Mycobacterium bovis subsp bovis AF2122/97
acugcgaccgucccggccu

SEQ ID NO: 1067282 - RNA, 18 nt, Mycobacterium bovis subsp bovis AF2122/97
acugccuuaaccgagccg

SEQ ID NO: 1067283 - RNA, 19 nt, Mycobacterium bovis subsp bovis AF2122/97
acugcgaacccugcgcacu

SEQ ID NO: 1067284 - RNA, 20 nt, Mycobacterium bovis subsp bovis AF2122/97
acugcgaacccugcgcacuc

SEQ ID NO: 1067285 - RNA, 14 nt, Mycobacterium bovis subsp bovis AF2122/97
acugcgaaucucgu

SEQ ID NO: 1067286 - RNA, 13 nt, Mycobacterium bovis subsp bovis AF2122/97
acugcgccaccgg

SEQ ID NO: 1067287 - RNA, 14 nt, Mycobacterium bovis subsp bovis AF2122/97
acugcgccaccggu

SEQ ID NO: 1067288 - RNA, 16 nt, Mycobacterium bovis subsp bovis AF2122/97
acugcgccaccgguga

SEQ ID NO: 1067289 - RNA, 15 nt, Mycobacterium bovis subsp bovis AF2122/97
acugcgaucgcgagc

SEQ ID NO: 1067290 - RNA, 12 nt, Mycobacterium bovis subsp bovis AF2122/97
acugcgaucggc

SEQ ID NO: 1067291 - RNA, 12 nt, Mycobacterium bovis subsp bovis AF2122/97
acugcgagcgca

SEQ ID NO: 1067292 - RNA, 16 nt, Mycobacterium bovis subsp bovis AF2122/97
acugcgagcgccggcu

SEQ ID NO: 1067293 - RNA, 17 nt, Mycobacterium bovis subsp bovis AF2122/97
acugcgagggcacgcgc

SEQ ID NO: 1067294 - RNA, 20 nt, Mycobacterium bovis subsp bovis AF2122/97
acugcgagggcacgcgcaca

SEQ ID NO: 1067295 - RNA, 22 nt, Mycobacterium bovis subsp bovis AF2122/97
acucuucagcuaccuccgccac

SEQ ID NO: 1067296 - RNA, 15 nt, Mycobacterium bovis subsp bovis AF2122/97
acucugcguccacca

SEQ ID NO: 1067297 - RNA, 17 nt, Mycobacterium bovis subsp bovis AF2122/97
acucugcgacaccacga

SEQ ID NO: 1067298 - RNA, 16 nt, Mycobacterium bovis subsp bovis AF2122/97
acugccguucggggcg

SEQ ID NO: 1067299 - RNA, 15 nt, Mycobacterium bovis subsp bovis AF2122/97
acucguugccgacca

SEQ ID NO: 1067300 - RNA, 17 nt, Mycobacterium bovis subsp bovis AF2122/97
acucguugaccggccgg

SEQ ID NO: 1067301 - RNA, 17 nt, Mycobacterium bovis subsp bovis AF2122/97
acucucggugaacgccg

SEQ ID NO: 1067302 - RNA, 17 nt, Mycobacterium bovis subsp bovis AF2122/97
acucucgcgacaucacc

SEQ ID NO: 1067303 - RNA, 17 nt, Mycobacterium bovis subsp bovis AF2122/97
acugggccucagacaac

SEQ ID NO: 1067304 - RNA, 21 nt, Mycobacterium bovis subsp bovis AF2122/97
acugggcgaucgacaccguga

SEQ ID NO: 1067305 - RNA, 12 nt, Mycobacterium bovis subsp bovis AF2122/97
acugggcggccu

SEQ ID NO: 1067306 - RNA, 18 nt, Mycobacterium bovis subsp bovis AF2122/97
acugggcgcccaagcgcg

SEQ ID NO: 1067307 - RNA, 18 nt, Mycobacterium bovis subsp bovis AF2122/97
acugguugacgucgaugu

SEQ ID NO: 1067308 - RNA, 15 nt, Mycobacterium bovis subsp bovis AF2122/97
acugguugggcgaga

SEQ ID NO: 1067309 - RNA, 21 nt, Mycobacterium bovis subsp bovis AF2122/97
acugggggccggcacugccga

SEQ ID NO: 1067310 - RNA, 15 nt, Mycobacterium bovis subsp bovis AF2122/97
acugggcaccggcgg

SEQ ID NO: 1067311 - RNA, 19 nt, Mycobacterium bovis subsp bovis AF2122/97
acugggccaaagcgcgggc

SEQ ID NO: 1067312 - RNA, 17 nt, Mycobacterium bovis subsp bovis AF2122/97
acugggccaggucggcg

SEQ ID NO: 1067313 - RNA, 15 nt, Mycobacterium bovis subsp bovis AF2122/97
acugggccgagcgcg

SEQ ID NO: 1067314 - RNA, 15 nt, Mycobacterium bovis subsp bovis AF2122/97
acuggcugaucggcg

SEQ ID NO: 1067315 - RNA, 19 nt, Mycobacterium bovis subsp bovis AF2122/97
acuggcgguccgaugcgcg

SEQ ID NO: 1067316 - RNA, 12 nt, Mycobacterium bovis subsp bovis AF2122/97
acuggcggugca

SEQ ID NO: 1067317 - RNA, 18 nt, Mycobacterium bovis subsp bovis AF2122/97
acuggcauccgccccgcc

SEQ ID NO: 1067318 - RNA, 14 nt, Mycobacterium bovis subsp bovis AF2122/97
acugcucggauccg

SEQ ID NO: 1067319 - RNA, 21 nt, Mycobacterium bovis subsp bovis AF2122/97
acugcuugcgcaucgccgaca

SEQ ID NO: 1067320 - RNA, 22 nt, Mycobacterium bovis subsp bovis AF2122/97
acugcuuccauaacgacucgcg

SEQ ID NO: 1067321 - RNA, 19 nt, Mycobacterium bovis subsp bovis AF2122/97
acuggcacacggucaccgg

SEQ ID NO: 1067322 - RNA, 13 nt, Mycobacterium bovis subsp bovis AF2122/97
acuggcaccgcca

SEQ ID NO: 1067323 - RNA, 23 nt, Mycobacterium bovis subsp bovis AF2122/97
acuguccgggugggcgcugucac

SEQ ID NO: 1067324 - RNA, 17 nt, Mycobacterium bovis subsp bovis AF2122/97
acuucauauaccgcucg

SEQ ID NO: 1067325 - RNA, 23 nt, Mycobacterium bovis subsp bovis AF2122/97
acuucgcuuucccgucggcggcg

SEQ ID NO: 1067326 - RNA, 12 nt, Mycobacterium bovis subsp bovis AF2122/97
acuucggcgaag

SEQ ID NO: 1067327 - RNA, 16 nt, Mycobacterium bovis subsp bovis AF2122/97
acuucggcgccgcgcc

SEQ ID NO: 1067328 - RNA, 19 nt, Mycobacterium bovis subsp bovis AF2122/97
acuucucgucgaacgacgc

SEQ ID NO: 1067329 - RNA, 17 nt, Mycobacterium bovis subsp bovis AF2122/97
acuugccgaguggccgc

SEQ ID NO: 1067330 - RNA, 21 nt, Mycobacterium bovis subsp bovis AF2122/97
acuugcugcuccuucucgcgg

SEQ ID NO: 1067331 - RNA, 18 nt, Mycobacterium bovis subsp bovis AF2122/97
acuuggcgucgacaucgg

SEQ ID NO: 1067332 - RNA, 17 nt, Mycobacterium bovis subsp bovis AF2122/97
acuugggauugcgggcc

SEQ ID NO: 1067333 - RNA, 14 nt, Mycobacterium bovis subsp bovis AF2122/97
acuuggcaucgcga

SEQ ID NO: 1067334 - RNA, 24 nt, Mycobacterium bovis subsp bovis AF2122/97
acuugcucgacgaucugcagcacu

SEQ ID NO: 1067335 - RNA, 23 nt, Mycobacterium bovis subsp bovis AF2122/97
acuugugccgggcgaugcugggc

SEQ ID NO: 1067336 - RNA, 17 nt, Mycobacterium bovis subsp bovis AF2122/97
acuuggugauccgagac

SEQ ID NO: 1067337 - RNA, 16 nt, Mycobacterium bovis subsp bovis AF2122/97
acuugauuucgaucgc

SEQ ID NO: 1067338 - RNA, 16 nt, Mycobacterium bovis subsp bovis AF2122/97
acuugaugcucgaugc

SEQ ID NO: 1067339 - RNA, 14 nt, Mycobacterium bovis subsp bovis AF2122/97
acuugccgccgcac

SEQ ID NO: 1067340 - RNA, 17 nt, Mycobacterium bovis subsp bovis AF2122/97
acuugccuagcgcgggc

SEQ ID NO: 1067341 - RNA, 12 nt, Mycobacterium bovis subsp bovis AF2122/97
acuugcgagccg

SEQ ID NO: 1067342 - RNA, 16 nt, Mycobacterium bovis subsp bovis AF2122/97
acuugcccgucggcgc

SEQ ID NO: 1067343 - RNA, 17 nt, Mycobacterium bovis subsp bovis AF2122/97
acuugcccgucggcgcc

SEQ ID NO: 1067344 - RNA, 20 nt, Mycobacterium bovis subsp bovis AF2122/97
acuccucggugugcucgccg

SEQ ID NO: 1067345 - RNA, 13 nt, Mycobacterium bovis subsp bovis AF2122/97
acuccguccgccg

SEQ ID NO: 1067346 - RNA, 22 nt, Mycobacterium bovis subsp bovis AF2122/97
acuccgugcuuccauucgcggu

SEQ ID NO: 1067347 - RNA, 13 nt, Mycobacterium bovis subsp bovis AF2122/97
acuccggucccgc

SEQ ID NO: 1067348 - RNA, 23 nt, Mycobacterium bovis subsp bovis AF2122/97
acucgaagcgggcuugagcgccg

SEQ ID NO: 1067349 - RNA, 17 nt, Mycobacterium bovis subsp bovis AF2122/97
acucgaacaaccccggu

SEQ ID NO: 1067350 - RNA, 17 nt, Mycobacterium bovis subsp bovis AF2122/97
acuccuuaucgucgacg

SEQ ID NO: 1067351 - RNA, 15 nt, Mycobacterium bovis subsp bovis AF2122/97
acuccggucagcgcg

SEQ ID NO: 1067352 - RNA, 18 nt, Mycobacterium bovis subsp bovis AF2122/97
acuccggucagcgcggcg

SEQ ID NO: 1067353 - RNA, 22 nt, Mycobacterium bovis subsp bovis AF2122/97
acuccggucagcgcggcgaccu

SEQ ID NO: 1067354 - RNA, 19 nt, Mycobacterium bovis subsp bovis AF2122/97
acuccgggcucggcgucgc

SEQ ID NO: 1067355 - RNA, 21 nt, Mycobacterium bovis subsp bovis AF2122/97
acuccgggcucggcgucgccg

SEQ ID NO: 1067356 - RNA, 22 nt, Mycobacterium bovis subsp bovis AF2122/97
acuccgggcucggcgucgccgc

SEQ ID NO: 1067357 - RNA, 13 nt, Mycobacterium bovis subsp bovis AF2122/97
acuccggcgacga

SEQ ID NO: 1067358 - RNA, 12 nt, Mycobacterium bovis subsp bovis AF2122/97
acuccggcggcu

SEQ ID NO: 1067359 - RNA, 21 nt, Mycobacterium bovis subsp bovis AF2122/97
acuccggcaagcacaccgcca

SEQ ID NO: 1067360 - RNA, 22 nt, Mycobacterium bovis subsp bovis AF2122/97
acuccggcaagcacaccgccag

SEQ ID NO: 1067361 - RNA, 15 nt, Mycobacterium bovis subsp bovis AF2122/97
acuccggcaccggca

SEQ ID NO: 1067362 - RNA, 12 nt, Mycobacterium bovis subsp bovis AF2122/97
acuccggcaggc

SEQ ID NO: 1067363 - RNA, 16 nt, Mycobacterium bovis subsp bovis AF2122/97
acuccgcgcgcugggc

SEQ ID NO: 1067364 - RNA, 15 nt, Mycobacterium bovis subsp bovis AF2122/97
acuccgcgagcccgg

SEQ ID NO: 1067365 - RNA, 17 nt, Mycobacterium bovis subsp bovis AF2122/97
acucgccgacgucgacg

SEQ ID NO: 1067366 - RNA, 22 nt, Mycobacterium bovis subsp bovis AF2122/97
acucgccgacgucgacgccggc

SEQ ID NO: 1067367 - RNA, 15 nt, Mycobacterium bovis subsp bovis AF2122/97
acucgcccaagcgca

SEQ ID NO: 1067368 - RNA, 21 nt, Mycobacterium bovis subsp bovis AF2122/97
acucgcccaagcgcagccugg

SEQ ID NO: 1067369 - RNA, 15 nt, Mycobacterium bovis subsp bovis AF2122/97
acucgccaccgcggc

SEQ ID NO: 1067370 - RNA, 18 nt, Mycobacterium bovis subsp bovis AF2122/97
acucgccacucagcccga

SEQ ID NO: 1067371 - RNA, 20 nt, Mycobacterium bovis subsp bovis AF2122/97
acucgccacucagcccgaca

SEQ ID NO: 1067372 - RNA, 15 nt, Mycobacterium bovis subsp bovis AF2122/97
acucgaucaccggca

SEQ ID NO: 1067373 - RNA, 15 nt, Mycobacterium bovis subsp bovis AF2122/97
acucgagcgcucaca

SEQ ID NO: 1067374 - RNA, 13 nt, Mycobacterium bovis subsp bovis AF2122/97
acucgaccgcgac

SEQ ID NO: 1067375 - RNA, 14 nt, Mycobacterium bovis subsp bovis AF2122/97
acucgaccgcgacg

SEQ ID NO: 1067376 - RNA, 16 nt, Mycobacterium bovis subsp bovis AF2122/97
acucgaccgcgacggc

SEQ ID NO: 1067377 - RNA, 21 nt, Mycobacterium bovis subsp bovis AF2122/97
acucgacgucgucgucgacgg

SEQ ID NO: 1067378 - RNA, 17 nt, Mycobacterium bovis subsp bovis AF2122/97
acucgaggucgagcgcc

SEQ ID NO: 1067379 - RNA, 23 nt, Mycobacterium bovis subsp bovis AF2122/97
acucgaggucgagcgccgcggac

SEQ ID NO: 1067380 - RNA, 16 nt, Mycobacterium bovis subsp bovis AF2122/97
acucgaauccggccca

SEQ ID NO: 1067381 - RNA, 17 nt, Mycobacterium bovis subsp bovis AF2122/97
acucgacaccgacucgc

SEQ ID NO: 1067382 - RNA, 15 nt, Mycobacterium bovis subsp bovis AF2122/97
acucgaccaccgccg

SEQ ID NO: 1067383 - RNA, 18 nt, Mycobacterium bovis subsp bovis AF2122/97
acucgaccaccgccggcc

SEQ ID NO: 1067384 - RNA, 19 nt, Mycobacterium bovis subsp bovis AF2122/97
acucgaccaccgccggccc

SEQ ID NO: 1067385 - RNA, 20 nt, Mycobacterium bovis subsp bovis AF2122/97
acucgggauucggcagcggc

SEQ ID NO: 1067386 - RNA, 18 nt, Mycobacterium bovis subsp bovis AF2122/97
acucggcgucgugguggc

SEQ ID NO: 1067387 - RNA, 23 nt, Mycobacterium bovis subsp bovis AF2122/97
acucggcgucgugguggccacgg

SEQ ID NO: 1067388 - RNA, 21 nt, Mycobacterium bovis subsp bovis AF2122/97
acucggcgaugacaucaccga

SEQ ID NO: 1067389 - RNA, 16 nt, Mycobacterium bovis subsp bovis AF2122/97
acucggcggccaccau

SEQ ID NO: 1067390 - RNA, 13 nt, Mycobacterium bovis subsp bovis AF2122/97
acucggcggccag

SEQ ID NO: 1067391 - RNA, 14 nt, Mycobacterium bovis subsp bovis AF2122/97
acucggcggccagc

SEQ ID NO: 1067392 - RNA, 22 nt, Mycobacterium bovis subsp bovis AF2122/97
acucggcggccagcgagaucag

SEQ ID NO: 1067393 - RNA, 24 nt, Mycobacterium bovis subsp bovis AF2122/97
acucggucguugccgcggucggcg

SEQ ID NO: 1067394 - RNA, 19 nt, Mycobacterium bovis subsp bovis AF2122/97
acucggucucauagugcag

SEQ ID NO: 1067395 - RNA, 13 nt, Mycobacterium bovis subsp bovis AF2122/97
acucggucucgau

SEQ ID NO: 1067396 - RNA, 23 nt, Mycobacterium bovis subsp bovis AF2122/97
acucgggcaaugucgacaccggc

SEQ ID NO: 1067397 - RNA, 14 nt, Mycobacterium bovis subsp bovis AF2122/97
acucgggcagcgcg

SEQ ID NO: 1067398 - RNA, 20 nt, Mycobacterium bovis subsp bovis AF2122/97
acucgggcagcgcggccagu

SEQ ID NO: 1067399 - RNA, 21 nt, Mycobacterium bovis subsp bovis AF2122/97
acucgggcagcuucaacaccg

SEQ ID NO: 1067400 - RNA, 20 nt, Mycobacterium bovis subsp bovis AF2122/97
acucgguucgccccugcaca

SEQ ID NO: 1067401 - RNA, 20 nt, Mycobacterium bovis subsp bovis AF2122/97
acucggugaucgcgguggcu

SEQ ID NO: 1067402 - RNA, 12 nt, Mycobacterium bovis subsp bovis AF2122/97
acucggugcggu

SEQ ID NO: 1067403 - RNA, 20 nt, Mycobacterium bovis subsp bovis AF2122/97
acucguggaacuccguccgc

SEQ ID NO: 1067404 - RNA, 15 nt, Mycobacterium bovis subsp bovis AF2122/97
acucgucgaugcggu

SEQ ID NO: 1067405 - RNA, 13 nt, Mycobacterium bovis subsp bovis AF2122/97
acucgucgcugcc

SEQ ID NO: 1067406 - RNA, 17 nt, Mycobacterium bovis subsp bovis AF2122/97
acucgugcaccgucggg

SEQ ID NO: 1067407 - RNA, 13 nt, Mycobacterium bovis subsp bovis AF2122/97
acucggccgggcu

SEQ ID NO: 1067408 - RNA, 15 nt, Mycobacterium bovis subsp bovis AF2122/97
acucggcccggguga

SEQ ID NO: 1067409 - RNA, 14 nt, Mycobacterium bovis subsp bovis AF2122/97
acucggcaccugga

SEQ ID NO: 1067410 - RNA, 15 nt, Mycobacterium bovis subsp bovis AF2122/97
acucggcauucaccg

SEQ ID NO: 1067411 - RNA, 17 nt, Mycobacterium bovis subsp bovis AF2122/97
acucggcauucaccgcg

SEQ ID NO: 1067412 - RNA, 17 nt, Mycobacterium bovis subsp bovis AF2122/97
acucggccaacgacggc

SEQ ID NO: 1067413 - RNA, 19 nt, Mycobacterium bovis subsp bovis AF2122/97
acucggccaacgacggccg

SEQ ID NO: 1067414 - RNA, 23 nt, Mycobacterium bovis subsp bovis AF2122/97
acucgcgcgucgucgcgcugaac

SEQ ID NO: 1067415 - RNA, 17 nt, Mycobacterium bovis subsp bovis AF2122/97
acucggaauucggcguc

SEQ ID NO: 1067416 - RNA, 22 nt, Mycobacterium bovis subsp bovis AF2122/97
acucgccgucauagcaggccuc

SEQ ID NO: 1067417 - RNA, 13 nt, Mycobacterium bovis subsp bovis AF2122/97
acucgccgcuggc

SEQ ID NO: 1067418 - RNA, 21 nt, Mycobacterium bovis subsp bovis AF2122/97
acucgcguggcaccgacagca

SEQ ID NO: 1067419 - RNA, 20 nt, Mycobacterium bovis subsp bovis AF2122/97
acucgcuccgaccgguggcg

SEQ ID NO: 1067420 - RNA, 23 nt, Mycobacterium bovis subsp bovis AF2122/97
acucgcgggcgaccaccgcggca

SEQ ID NO: 1067421 - RNA, 14 nt, Mycobacterium bovis subsp bovis AF2122/97
acucgcggccggcg

SEQ ID NO: 1067422 - RNA, 22 nt, Mycobacterium bovis subsp bovis AF2122/97
acucgccugcacccggcgauug

SEQ ID NO: 1067423 - RNA, 21 nt, Mycobacterium bovis subsp bovis AF2122/97
acucccucgaucacggcggcc

SEQ ID NO: 1067424 - RNA, 22 nt, Mycobacterium bovis subsp bovis AF2122/97
acuccgccaacaucuccgcguc

SEQ ID NO: 1067425 - RNA, 14 nt, Mycobacterium bovis subsp bovis AF2122/97
acucccgcgcgggc

SEQ ID NO: 1067426 - RNA, 16 nt, Mycobacterium bovis subsp bovis AF2122/97
acucccgcgcgggcgg

SEQ ID NO: 1067427 - RNA, 14 nt, Mycobacterium bovis subsp bovis AF2122/97
acucccgcgaucgc

SEQ ID NO: 1067428 - RNA, 18 nt, Mycobacterium bovis subsp bovis AF2122/97
acucccggcucggccagc

SEQ ID NO: 1067429 - RNA, 14 nt, Mycobacterium bovis subsp bovis AF2122/97
acuccccgccgggc

SEQ ID NO: 1067430 - RNA, 15 nt, Mycobacterium bovis subsp bovis AF2122/97
acuccccggucgccg

SEQ ID NO: 1067431 - RNA, 22 nt, Mycobacterium bovis subsp bovis AF2122/97
acuccaucaccacaccggcagc

SEQ ID NO: 1067432 - RNA, 13 nt, Mycobacterium bovis subsp bovis AF2122/97
acuccagcgcccg

SEQ ID NO: 1067433 - RNA, 19 nt, Mycobacterium bovis subsp bovis AF2122/97
acuccagcgaaccgacccg

SEQ ID NO: 1067434 - RNA, 21 nt, Mycobacterium bovis subsp bovis AF2122/97
acuccacgcagcccgucggcg

SEQ ID NO: 1067435 - RNA, 13 nt, Mycobacterium bovis subsp bovis AF2122/97
acuccagcaccag

SEQ ID NO: 1067436 - RNA, 15 nt, Mycobacterium bovis subsp bovis AF2122/97
acuccagcaccagca

SEQ ID NO: 1067437 - RNA, 18 nt, Mycobacterium bovis subsp bovis AF2122/97
acuccagcaccagcacgg

SEQ ID NO: 1067438 - RNA, 19 nt, Mycobacterium bovis subsp bovis AF2122/97
acuccacgaucggcccagc

SEQ ID NO: 1067439 - RNA, 12 nt, Mycobacterium bovis subsp bovis AF2122/97
acuccaccgcgc

SEQ ID NO: 1067440 - RNA, 22 nt, Mycobacterium bovis subsp bovis AF2122/97
acuccaacugaucccguagccg

SEQ ID NO: 1067441 - RNA, 14 nt, Mycobacterium bovis subsp bovis AF2122/97
acuccaagaugccg

SEQ ID NO: 1067442 - RNA, 17 nt, Mycobacterium bovis subsp bovis AF2122/97
acuccaagucacagcuc

SEQ ID NO: 1067443 - RNA, 19 nt, Mycobacterium bovis subsp bovis AF2122/97
acucaggaucccgguggca

SEQ ID NO: 1067444 - RNA, 19 nt, Mycobacterium bovis subsp bovis AF2122/97
acucaggccgguaccggga

SEQ ID NO: 1067445 - RNA, 16 nt, Mycobacterium bovis subsp bovis AF2122/97
acucagguacggcggg

SEQ ID NO: 1067446 - RNA, 15 nt, Mycobacterium bovis subsp bovis AF2122/97
acucagguccgcaac

SEQ ID NO: 1067447 - RNA, 18 nt, Mycobacterium bovis subsp bovis AF2122/97
acucaucgugguaaccau

SEQ ID NO: 1067448 - RNA, 12 nt, Mycobacterium bovis subsp bovis AF2122/97
acucaucgccgg

SEQ ID NO: 1067449 - RNA, 14 nt, Mycobacterium bovis subsp bovis AF2122/97
acucaucaccgaug

SEQ ID NO: 1067450 - RNA, 20 nt, Mycobacterium bovis subsp bovis AF2122/97
acucauuacgguagacguug

SEQ ID NO: 1067451 - RNA, 22 nt, Mycobacterium bovis subsp bovis AF2122/97
acucacgaggcacaaucaccgc

SEQ ID NO: 1067452 - RNA, 20 nt, Mycobacterium bovis subsp bovis AF2122/97
acucagcccgacaccgaucg

SEQ ID NO: 1067453 - RNA, 14 nt, Mycobacterium bovis subsp bovis AF2122/97
acucagcccggcac

SEQ ID NO: 1067454 - RNA, 16 nt, Mycobacterium bovis subsp bovis AF2122/97
acucaccagcaccccg

SEQ ID NO: 1067455 - RNA, 15 nt, Mycobacterium bovis subsp bovis AF2122/97
acucacccacccgca

SEQ ID NO: 1067456 - RNA, 20 nt, Mycobacterium bovis subsp bovis AF2122/97
acucacccacccgcaccgcg

SEQ ID NO: 1067457 - RNA, 15 nt, Mycobacterium bovis subsp bovis AF2122/97
acucaacccgccguc

SEQ ID NO: 1067458 - RNA, 17 nt, Mycobacterium bovis subsp bovis AF2122/97
acucaagauaacggcga

SEQ ID NO: 1067459 - RNA, 20 nt, Mycobacterium bovis subsp bovis AF2122/97
acucaagauaacggcgaccg

SEQ ID NO: 1067460 - RNA, 16 nt, Mycobacterium bovis subsp bovis AF2122/97
acguugcggacggcgu

SEQ ID NO: 1067461 - RNA, 15 nt, Mycobacterium bovis subsp bovis AF2122/97
acguugccgaucccg

SEQ ID NO: 1067462 - RNA, 18 nt, Mycobacterium bovis subsp bovis AF2122/97
acguugccaacaccggcg

SEQ ID NO: 1067463 - RNA, 15 nt, Mycobacterium bovis subsp bovis AF2122/97
acguugcagccggca

SEQ ID NO: 1067464 - RNA, 20 nt, Mycobacterium bovis subsp bovis AF2122/97
acguugcgcauaggcgaucg

SEQ ID NO: 1067465 - RNA, 15 nt, Mycobacterium bovis subsp bovis AF2122/97
acgucgggaucgcca

SEQ ID NO: 1067466 - RNA, 14 nt, Mycobacterium bovis subsp bovis AF2122/97
acgucgggcccgau

SEQ ID NO: 1067467 - RNA, 20 nt, Mycobacterium bovis subsp bovis AF2122/97
acgucgggcccgaugucguc

SEQ ID NO: 1067468 - RNA, 18 nt, Mycobacterium bovis subsp bovis AF2122/97
acgucggcguggucgcgc

SEQ ID NO: 1067469 - RNA, 15 nt, Mycobacterium bovis subsp bovis AF2122/97
acgucggugaagucc

SEQ ID NO: 1067470 - RNA, 23 nt, Mycobacterium bovis subsp bovis AF2122/97
acgucggguugcacggcgauugc

SEQ ID NO: 1067471 - RNA, 18 nt, Mycobacterium bovis subsp bovis AF2122/97
acgucgguaagcgccaag

SEQ ID NO: 1067472 - RNA, 18 nt, Mycobacterium bovis subsp bovis AF2122/97
acgucggcucgucgcucg

SEQ ID NO: 1067473 - RNA, 18 nt, Mycobacterium bovis subsp bovis AF2122/97
acgucggugaccucggcg

SEQ ID NO: 1067474 - RNA, 18 nt, Mycobacterium bovis subsp bovis AF2122/97
acgucugcagccucgaug

SEQ ID NO: 1067475 - RNA, 12 nt, Mycobacterium bovis subsp bovis AF2122/97
acgucggcggcu

SEQ ID NO: 1067476 - RNA, 21 nt, Mycobacterium bovis subsp bovis AF2122/97
acgucggcggugacggugccg

SEQ ID NO: 1067477 - RNA, 22 nt, Mycobacterium bovis subsp bovis AF2122/97
acgucggcccauaacagcuggc

SEQ ID NO: 1067478 - RNA, 17 nt, Mycobacterium bovis subsp bovis AF2122/97
acgucggccgcaucgcc

SEQ ID NO: 1067479 - RNA, 16 nt, Mycobacterium bovis subsp bovis AF2122/97
acgucgacuuguuggg

SEQ ID NO: 1067480 - RNA, 23 nt, Mycobacterium bovis subsp bovis AF2122/97
acgucggcgaacggauucccgcc

SEQ ID NO: 1067481 - RNA, 19 nt, Mycobacterium bovis subsp bovis AF2122/97
acgucggcgaauccgccgc

SEQ ID NO: 1067482 - RNA, 20 nt, Mycobacterium bovis subsp bovis AF2122/97
acgucggcgaauccgccgcc

SEQ ID NO: 1067483 - RNA, 14 nt, Mycobacterium bovis subsp bovis AF2122/97
acgucggccagugc

SEQ ID NO: 1067484 - RNA, 19 nt, Mycobacterium bovis subsp bovis AF2122/97
acgucgaucucggcgcagg

SEQ ID NO: 1067485 - RNA, 21 nt, Mycobacterium bovis subsp bovis AF2122/97
acgucgagcgccuugucgauc

SEQ ID NO: 1067486 - RNA, 16 nt, Mycobacterium bovis subsp bovis AF2122/97
acgucgagcagcgcca

SEQ ID NO: 1067487 - RNA, 19 nt, Mycobacterium bovis subsp bovis AF2122/97
acgucgacuucagcggccg

SEQ ID NO: 1067488 - RNA, 17 nt, Mycobacterium bovis subsp bovis AF2122/97
acgucgagcacccgcuc

SEQ ID NO: 1067489 - RNA, 18 nt, Mycobacterium bovis subsp bovis AF2122/97
acgucgacgccggccagc

SEQ ID NO: 1067490 - RNA, 17 nt, Mycobacterium bovis subsp bovis AF2122/97
acgucgacggcgauggc

SEQ ID NO: 1067491 - RNA, 21 nt, Mycobacterium bovis subsp bovis AF2122/97
acgucgaccgugucaccgccg

SEQ ID NO: 1067492 - RNA, 22 nt, Mycobacterium bovis subsp bovis AF2122/97
acgucgaccgugucaccgccgg

SEQ ID NO: 1067493 - RNA, 16 nt, Mycobacterium bovis subsp bovis AF2122/97
acgucgacccccugcc

SEQ ID NO: 1067494 - RNA, 16 nt, Mycobacterium bovis subsp bovis AF2122/97
acgucgacggcgaugg

SEQ ID NO: 1067495 - RNA, 17 nt, Mycobacterium bovis subsp bovis AF2122/97
acgucgaccucggcaac

SEQ ID NO: 1067496 - RNA, 16 nt, Mycobacterium bovis subsp bovis AF2122/97
acguccgcggucgcag

SEQ ID NO: 1067497 - RNA, 17 nt, Mycobacterium bovis subsp bovis AF2122/97
acguccucagccgugcc

SEQ ID NO: 1067498 - RNA, 19 nt, Mycobacterium bovis subsp bovis AF2122/97
acgucgacaacgaucgcgc

SEQ ID NO: 1067499 - RNA, 21 nt, Mycobacterium bovis subsp bovis AF2122/97
acguccugcccgucgucggca

SEQ ID NO: 1067500 - RNA, 22 nt, Mycobacterium bovis subsp bovis AF2122/97
acguccugcccgucgucggcaa

SEQ ID NO: 1067501 - RNA, 16 nt, Mycobacterium bovis subsp bovis AF2122/97
acgugguagccggcga

SEQ ID NO: 1067502 - RNA, 16 nt, Mycobacterium bovis subsp bovis AF2122/97
acgugcggcggccucg

SEQ ID NO: 1067503 - RNA, 17 nt, Mycobacterium bovis subsp bovis AF2122/97
acguggucggagcgggu

SEQ ID NO: 1067504 - RNA, 17 nt, Mycobacterium bovis subsp bovis AF2122/97
acgugcgagcccaccug

SEQ ID NO: 1067505 - RNA, 13 nt, Mycobacterium bovis subsp bovis AF2122/97
acguggucggcca

SEQ ID NO: 1067506 - RNA, 15 nt, Mycobacterium bovis subsp bovis AF2122/97
acguggucggccacc

SEQ ID NO: 1067507 - RNA, 16 nt, Mycobacterium bovis subsp bovis AF2122/97
acguggucggccaccc

SEQ ID NO: 1067508 - RNA, 17 nt, Mycobacterium bovis subsp bovis AF2122/97
acgugguguaucgacgg

SEQ ID NO: 1067509 - RNA, 16 nt, Mycobacterium bovis subsp bovis AF2122/97
acguucucaccaccag

SEQ ID NO: 1067510 - RNA, 22 nt, Mycobacterium bovis subsp bovis AF2122/97
acgugucaucacggucagccgu

SEQ ID NO: 1067511 - RNA, 22 nt, Mycobacterium bovis subsp bovis AF2122/97
acgugucguaacugcccgcggc

SEQ ID NO: 1067512 - RNA, 16 nt, Mycobacterium bovis subsp bovis AF2122/97
acguggugggcgcaga

SEQ ID NO: 1067513 - RNA, 15 nt, Mycobacterium bovis subsp bovis AF2122/97
acgugucaucacggu

SEQ ID NO: 1067514 - RNA, 19 nt, Mycobacterium bovis subsp bovis AF2122/97
acgucuuggaacacggccg

SEQ ID NO: 1067515 - RNA, 17 nt, Mycobacterium bovis subsp bovis AF2122/97
acgucuucacucacgac

SEQ ID NO: 1067516 - RNA, 17 nt, Mycobacterium bovis subsp bovis AF2122/97
acgucugccacgucggc

SEQ ID NO: 1067517 - RNA, 22 nt, Mycobacterium bovis subsp bovis AF2122/97
acgucugccaggcgcagcuggu

SEQ ID NO: 1067518 - RNA, 19 nt, Mycobacterium bovis subsp bovis AF2122/97
acgugaacugagggcggaa

SEQ ID NO: 1067519 - RNA, 22 nt, Mycobacterium bovis subsp bovis AF2122/97
acgugaccagcuucggcuggcg

SEQ ID NO: 1067520 - RNA, 16 nt, Mycobacterium bovis subsp bovis AF2122/97
acgugaccgacgccgu

SEQ ID NO: 1067521 - RNA, 18 nt, Mycobacterium bovis subsp bovis AF2122/97
acgugacgguccacgacg

SEQ ID NO: 1067522 - RNA, 23 nt, Mycobacterium bovis subsp bovis AF2122/97
acgugaauuaaggugaccacggc

SEQ ID NO: 1067523 - RNA, 17 nt, Mycobacterium bovis subsp bovis AF2122/97
acgugacaacugcgccg

SEQ ID NO: 1067524 - RNA, 21 nt, Mycobacterium bovis subsp bovis AF2122/97
acgugacaacugcgccggugc

SEQ ID NO: 1067525 - RNA, 23 nt, Mycobacterium bovis subsp bovis AF2122/97
acgugacaacugcgccggugccg

SEQ ID NO: 1067526 - RNA, 16 nt, Mycobacterium bovis subsp bovis AF2122/97
acgugcccgcgcggcg

SEQ ID NO: 1067527 - RNA, 17 nt, Mycobacterium bovis subsp bovis AF2122/97
acgugcccgcgcggcgc

SEQ ID NO: 1067528 - RNA, 18 nt, Mycobacterium bovis subsp bovis AF2122/97
acgugcccugacgccccg

SEQ ID NO: 1067529 - RNA, 20 nt, Mycobacterium bovis subsp bovis AF2122/97
acgugcccugacgccccgcc

SEQ ID NO: 1067530 - RNA, 17 nt, Mycobacterium bovis subsp bovis AF2122/97
acgugccccaugcgcag

SEQ ID NO: 1067531 - RNA, 21 nt, Mycobacterium bovis subsp bovis AF2122/97
acgugccgaacgccagaccgc

SEQ ID NO: 1067532 - RNA, 22 nt, Mycobacterium bovis subsp bovis AF2122/97
acgugccgaacgccagaccgcc

SEQ ID NO: 1067533 - RNA, 15 nt, Mycobacterium bovis subsp bovis AF2122/97
acgugccgguccccc

SEQ ID NO: 1067534 - RNA, 14 nt, Mycobacterium bovis subsp bovis AF2122/97
acgugcgcgccaag

SEQ ID NO: 1067535 - RNA, 18 nt, Mycobacterium bovis subsp bovis AF2122/97
acgugccucucuccgcgc

SEQ ID NO: 1067536 - RNA, 20 nt, Mycobacterium bovis subsp bovis AF2122/97
acgugaggucccggcuggga

SEQ ID NO: 1067537 - RNA, 21 nt, Mycobacterium bovis subsp bovis AF2122/97
acgugcgaaucgagacggcca

SEQ ID NO: 1067538 - RNA, 15 nt, Mycobacterium bovis subsp bovis AF2122/97
acggugaauucacga

SEQ ID NO: 1067539 - RNA, 17 nt, Mycobacterium bovis subsp bovis AF2122/97
acgggguugaccgccac

SEQ ID NO: 1067540 - RNA, 18 nt, Mycobacterium bovis subsp bovis AF2122/97
acgggguugaccgccacc

SEQ ID NO: 1067541 - RNA, 22 nt, Mycobacterium bovis subsp bovis AF2122/97
acggggucaaucccacgcccgg

SEQ ID NO: 1067542 - RNA, 13 nt, Mycobacterium bovis subsp bovis AF2122/97
acggggucgccgg

SEQ ID NO: 1067543 - RNA, 16 nt, Mycobacterium bovis subsp bovis AF2122/97
acggggucgccggcac

SEQ ID NO: 1067544 - RNA, 20 nt, Mycobacterium bovis subsp bovis AF2122/97
acggggucgccggcaccgga

SEQ ID NO: 1067545 - RNA, 13 nt, Mycobacterium bovis subsp bovis AF2122/97
acggggugguggu

SEQ ID NO: 1067546 - RNA, 19 nt, Mycobacterium bovis subsp bovis AF2122/97
acgggguggugguggaguu

SEQ ID NO: 1067547 - RNA, 13 nt, Mycobacterium bovis subsp bovis AF2122/97
acggugaccacgc

SEQ ID NO: 1067548 - RNA, 21 nt, Mycobacterium bovis subsp bovis AF2122/97
acggugagggcgucgucgagu

SEQ ID NO: 1067549 - RNA, 14 nt, Mycobacterium bovis subsp bovis AF2122/97
acggugccggcacc

SEQ ID NO: 1067550 - RNA, 13 nt, Mycobacterium bovis subsp bovis AF2122/97
acggugcagcucc

SEQ ID NO: 1067551 - RNA, 15 nt, Mycobacterium bovis subsp bovis AF2122/97
acggugccaccgcga

SEQ ID NO: 1067552 - RNA, 19 nt, Mycobacterium bovis subsp bovis AF2122/97
acggugccaccgcgacggc

SEQ ID NO: 1067553 - RNA, 20 nt, Mycobacterium bovis subsp bovis AF2122/97
acggugaugggggagccggu

SEQ ID NO: 1067554 - RNA, 23 nt, Mycobacterium bovis subsp bovis AF2122/97
acggugacuaccgugcauaccgc

SEQ ID NO: 1067555 - RNA, 16 nt, Mycobacterium bovis subsp bovis AF2122/97
acggugaucgccggcu

SEQ ID NO: 1067556 - RNA, 23 nt, Mycobacterium bovis subsp bovis AF2122/97
acggugaucagccaccgggugga

SEQ ID NO: 1067557 - RNA, 15 nt, Mycobacterium bovis subsp bovis AF2122/97
acggugagaucgggu

SEQ ID NO: 1067558 - RNA, 17 nt, Mycobacterium bovis subsp bovis AF2122/97
acggugcugaucggucc

SEQ ID NO: 1067559 - RNA, 13 nt, Mycobacterium bovis subsp bovis AF2122/97
acggugcgguugc

SEQ ID NO: 1067560 - RNA, 21 nt, Mycobacterium bovis subsp bovis AF2122/97
acggugcgggcuaggcggcgu

SEQ ID NO: 1067561 - RNA, 15 nt, Mycobacterium bovis subsp bovis AF2122/97
acgguggccgcugcc

SEQ ID NO: 1067562 - RNA, 21 nt, Mycobacterium bovis subsp bovis AF2122/97
acgguggccggcaacggcgcg

SEQ ID NO: 1067563 - RNA, 15 nt, Mycobacterium bovis subsp bovis AF2122/97
acgguggccgagccg

SEQ ID NO: 1067564 - RNA, 20 nt, Mycobacterium bovis subsp bovis AF2122/97
acgguggccgagccgcgguc

SEQ ID NO: 1067565 - RNA, 14 nt, Mycobacterium bovis subsp bovis AF2122/97
acgguggccgcacg

SEQ ID NO: 1067566 - RNA, 18 nt, Mycobacterium bovis subsp bovis AF2122/97
acggugccggcacccgag

SEQ ID NO: 1067567 - RNA, 19 nt, Mycobacterium bovis subsp bovis AF2122/97
acggugccgucggugccgc

SEQ ID NO: 1067568 - RNA, 15 nt, Mycobacterium bovis subsp bovis AF2122/97
acguaccacggcgau

SEQ ID NO: 1067569 - RNA, 12 nt, Mycobacterium bovis subsp bovis AF2122/97
acguaacccagu

SEQ ID NO: 1067570 - RNA, 19 nt, Mycobacterium bovis subsp bovis AF2122/97
acguccagccguggcggcg

SEQ ID NO: 1067571 - RNA, 19 nt, Mycobacterium bovis subsp bovis AF2122/97
acguccaguggcagccagc

SEQ ID NO: 1067572 - RNA, 15 nt, Mycobacterium bovis subsp bovis AF2122/97
acguccgcgccgagc

SEQ ID NO: 1067573 - RNA, 21 nt, Mycobacterium bovis subsp bovis AF2122/97
acgucccagagaaucagcgug

SEQ ID NO: 1067574 - RNA, 16 nt, Mycobacterium bovis subsp bovis AF2122/97
acgucacgucgacggc

SEQ ID NO: 1067575 - RNA, 18 nt, Mycobacterium bovis subsp bovis AF2122/97
acgucacguggucggcca

SEQ ID NO: 1067576 - RNA, 20 nt, Mycobacterium bovis subsp bovis AF2122/97
acgucacguggucggccacc

SEQ ID NO: 1067577 - RNA, 11 nt, Mycobacterium bovis subsp bovis AF2122/97
acgucaccggg

SEQ ID NO: 1067578 - RNA, 20 nt, Mycobacterium bovis subsp bovis AF2122/97
acgucagcguugaccgcauc

SEQ ID NO: 1067579 - RNA, 21 nt, Mycobacterium bovis subsp bovis AF2122/97
acgucaggcagcuccgccgcc

SEQ ID NO: 1067580 - RNA, 18 nt, Mycobacterium bovis subsp bovis AF2122/97
acgucacgcgcggcggcg

SEQ ID NO: 1067581 - RNA, 17 nt, Mycobacterium bovis subsp bovis AF2122/97
acguagaagucgaucgc

SEQ ID NO: 1067582 - RNA, 16 nt, Mycobacterium bovis subsp bovis AF2122/97
acguagaagucgaucg

SEQ ID NO: 1067583 - RNA, 17 nt, Mycobacterium bovis subsp bovis AF2122/97
acguaccgucauggcga

SEQ ID NO: 1067584 - RNA, 15 nt, Mycobacterium bovis subsp bovis AF2122/97
acguacugggcgaua

SEQ ID NO: 1067585 - RNA, 15 nt, Mycobacterium bovis subsp bovis AF2122/97
acguacgccgccgau

SEQ ID NO: 1067586 - RNA, 14 nt, Mycobacterium bovis subsp bovis AF2122/97
acguagcagcagac

SEQ ID NO: 1067587 - RNA, 19 nt, Mycobacterium bovis subsp bovis AF2122/97
acguacuccaccgcgccgu

SEQ ID NO: 1067588 - RNA, 21 nt, Mycobacterium bovis subsp bovis AF2122/97
acguaugacgcccaccgacaa

SEQ ID NO: 1067589 - RNA, 12 nt, Mycobacterium bovis subsp bovis AF2122/97
acggcgucgaaa

SEQ ID NO: 1067590 - RNA, 16 nt, Mycobacterium bovis subsp bovis AF2122/97
acggcgcuguggcggg

SEQ ID NO: 1067591 - RNA, 13 nt, Mycobacterium bovis subsp bovis AF2122/97
acggcgucggcca

SEQ ID NO: 1067592 - RNA, 15 nt, Mycobacterium bovis subsp bovis AF2122/97
acggcgucggccacc

SEQ ID NO: 1067593 - RNA, 17 nt, Mycobacterium bovis subsp bovis AF2122/97
acggcgucgaugucguc

SEQ ID NO: 1067594 - RNA, 20 nt, Mycobacterium bovis subsp bovis AF2122/97
acggcgucggcuucucgauc

SEQ ID NO: 1067595 - RNA, 16 nt, Mycobacterium bovis subsp bovis AF2122/97
acggcgucgaccucgc

SEQ ID NO: 1067596 - RNA, 22 nt, Mycobacterium bovis subsp bovis AF2122/97
acggcgucgacugcgugccgca

SEQ ID NO: 1067597 - RNA, 17 nt, Mycobacterium bovis subsp bovis AF2122/97
acggcgucugcgguggc

SEQ ID NO: 1067598 - RNA, 15 nt, Mycobacterium bovis subsp bovis AF2122/97
acggcgucgggccgu

SEQ ID NO: 1067599 - RNA, 13 nt, Mycobacterium bovis subsp bovis AF2122/97
acggcgcgagccg

SEQ ID NO: 1067600 - RNA, 16 nt, Mycobacterium bovis subsp bovis AF2122/97
acggcgcgagccgcac

SEQ ID NO: 1067601 - RNA, 13 nt, Mycobacterium bovis subsp bovis AF2122/97
acggcgcggcgga

SEQ ID NO: 1067602 - RNA, 14 nt, Mycobacterium bovis subsp bovis AF2122/97
acggcgcggcggag

SEQ ID NO: 1067603 - RNA, 22 nt, Mycobacterium bovis subsp bovis AF2122/97
acggcgcggcggagugcauguc

SEQ ID NO: 1067604 - RNA, 23 nt, Mycobacterium bovis subsp bovis AF2122/97
acggcgcgggccaccacgcgccg

SEQ ID NO: 1067605 - RNA, 18 nt, Mycobacterium bovis subsp bovis AF2122/97
acggcgcgggccaccacg

SEQ ID NO: 1067606 - RNA, 20 nt, Mycobacterium bovis subsp bovis AF2122/97
acggcucuaccgguccguca

SEQ ID NO: 1067607 - RNA, 20 nt, Mycobacterium bovis subsp bovis AF2122/97
acggcucgggaacuucgccg

SEQ ID NO: 1067608 - RNA, 13 nt, Mycobacterium bovis subsp bovis AF2122/97
acggcugaccggg

SEQ ID NO: 1067609 - RNA, 23 nt, Mycobacterium bovis subsp bovis AF2122/97
acggcugaccggggucggccugc

SEQ ID NO: 1067610 - RNA, 16 nt, Mycobacterium bovis subsp bovis AF2122/97
acggcugcagaggcgc

SEQ ID NO: 1067611 - RNA, 12 nt, Mycobacterium bovis subsp bovis AF2122/97
acggcgucgagu

SEQ ID NO: 1067612 - RNA, 23 nt, Mycobacterium bovis subsp bovis AF2122/97
acggcucagcgugcgcuggcuga

SEQ ID NO: 1067613 - RNA, 18 nt, Mycobacterium bovis subsp bovis AF2122/97
acggcguggaugcccggu

SEQ ID NO: 1067614 - RNA, 16 nt, Mycobacterium bovis subsp bovis AF2122/97
acggcguggucggcaa

SEQ ID NO: 1067615 - RNA, 18 nt, Mycobacterium bovis subsp bovis AF2122/97
acggcguuacguggugga

SEQ ID NO: 1067616 - RNA, 20 nt, Mycobacterium bovis subsp bovis AF2122/97
acggcgucuuccucggccac

SEQ ID NO: 1067617 - RNA, 21 nt, Mycobacterium bovis subsp bovis AF2122/97
acggcgucuuccucggccacc

SEQ ID NO: 1067618 - RNA, 22 nt, Mycobacterium bovis subsp bovis AF2122/97
acggcgugaaaaacgcccgcgc

SEQ ID NO: 1067619 - RNA, 14 nt, Mycobacterium bovis subsp bovis AF2122/97
acggcguugccgcc

SEQ ID NO: 1067620 - RNA, 17 nt, Mycobacterium bovis subsp bovis AF2122/97
acggcguugccgccggc

SEQ ID NO: 1067621 - RNA, 20 nt, Mycobacterium bovis subsp bovis AF2122/97
acggcguugccgccggcucc

SEQ ID NO: 1067622 - RNA, 14 nt, Mycobacterium bovis subsp bovis AF2122/97
acggcguugucgac

SEQ ID NO: 1067623 - RNA, 16 nt, Mycobacterium bovis subsp bovis AF2122/97
acggcguugucgacga

SEQ ID NO: 1067624 - RNA, 14 nt, Mycobacterium bovis subsp bovis AF2122/97
acggcuaccaccgc

SEQ ID NO: 1067625 - RNA, 17 nt, Mycobacterium bovis subsp bovis AF2122/97
acggcuaccaccgcacc

SEQ ID NO: 1067626 - RNA, 12 nt, Mycobacterium bovis subsp bovis AF2122/97
acgggccaccgu

SEQ ID NO: 1067627 - RNA, 16 nt, Mycobacterium bovis subsp bovis AF2122/97
acggcuuugcggcgcg

SEQ ID NO: 1067628 - RNA, 16 nt, Mycobacterium bovis subsp bovis AF2122/97
acgggaaacuccgcgg

SEQ ID NO: 1067629 - RNA, 19 nt, Mycobacterium bovis subsp bovis AF2122/97
acggcuugcgauuggcugg

SEQ ID NO: 1067630 - RNA, 15 nt, Mycobacterium bovis subsp bovis AF2122/97
acggcugcgccgaac

SEQ ID NO: 1067631 - RNA, 21 nt, Mycobacterium bovis subsp bovis AF2122/97
acggcuucgcgguuggcggcg

SEQ ID NO: 1067632 - RNA, 15 nt, Mycobacterium bovis subsp bovis AF2122/97
acggcuucggcgagc

SEQ ID NO: 1067633 - RNA, 16 nt, Mycobacterium bovis subsp bovis AF2122/97
acggcuucggcgagcg

SEQ ID NO: 1067634 - RNA, 24 nt, Mycobacterium bovis subsp bovis AF2122/97
acgggccauggguagccgcccagc

SEQ ID NO: 1067635 - RNA, 17 nt, Mycobacterium bovis subsp bovis AF2122/97
acgggccuucagcucac

SEQ ID NO: 1067636 - RNA, 15 nt, Mycobacterium bovis subsp bovis AF2122/97
acgggccuucgccac

SEQ ID NO: 1067637 - RNA, 13 nt, Mycobacterium bovis subsp bovis AF2122/97
acgggccggccga

SEQ ID NO: 1067638 - RNA, 18 nt, Mycobacterium bovis subsp bovis AF2122/97
acgggccggccgagcgca

SEQ ID NO: 1067639 - RNA, 17 nt, Mycobacterium bovis subsp bovis AF2122/97
acgggccgucgccgucc

SEQ ID NO: 1067640 - RNA, 17 nt, Mycobacterium bovis subsp bovis AF2122/97
acggggauggagccggu

SEQ ID NO: 1067641 - RNA, 20 nt, Mycobacterium bovis subsp bovis AF2122/97
acggggaugggggagccggu

SEQ ID NO: 1067642 - RNA, 17 nt, Mycobacterium bovis subsp bovis AF2122/97
acggggcugaccgccac

SEQ ID NO: 1067643 - RNA, 21 nt, Mycobacterium bovis subsp bovis AF2122/97
acggggcugaccgccaccccg

SEQ ID NO: 1067644 - RNA, 17 nt, Mycobacterium bovis subsp bovis AF2122/97
acgggggcuguccaccg

SEQ ID NO: 1067645 - RNA, 12 nt, Mycobacterium bovis subsp bovis AF2122/97
acggcgacccag

SEQ ID NO: 1067646 - RNA, 16 nt, Mycobacterium bovis subsp bovis AF2122/97
acggcgaccacgccgc

SEQ ID NO: 1067647 - RNA, 21 nt, Mycobacterium bovis subsp bovis AF2122/97
acggcgaccacgccgccggcg

SEQ ID NO: 1067648 - RNA, 20 nt, Mycobacterium bovis subsp bovis AF2122/97
acggcgaagucgagugccgc

SEQ ID NO: 1067649 - RNA, 16 nt, Mycobacterium bovis subsp bovis AF2122/97
acggcgaaaguccugc

SEQ ID NO: 1067650 - RNA, 14 nt, Mycobacterium bovis subsp bovis AF2122/97
acggcgaaacucgu

SEQ ID NO: 1067651 - RNA, 21 nt, Mycobacterium bovis subsp bovis AF2122/97
acggcgaaccggcccaccgac

SEQ ID NO: 1067652 - RNA, 23 nt, Mycobacterium bovis subsp bovis AF2122/97
acggcgauccggucggccaggcc

SEQ ID NO: 1067653 - RNA, 14 nt, Mycobacterium bovis subsp bovis AF2122/97
acggcgaugcgguc

SEQ ID NO: 1067654 - RNA, 13 nt, Mycobacterium bovis subsp bovis AF2122/97
acggcgaggccga

SEQ ID NO: 1067655 - RNA, 24 nt, Mycobacterium bovis subsp bovis AF2122/97
acggcgauauaggacgccgcgccg

SEQ ID NO: 1067656 - RNA, 19 nt, Mycobacterium bovis subsp bovis AF2122/97
acggcgaucaccgagaugg

SEQ ID NO: 1067657 - RNA, 15 nt, Mycobacterium bovis subsp bovis AF2122/97
acggcgaccgccauc

SEQ ID NO: 1067658 - RNA, 18 nt, Mycobacterium bovis subsp bovis AF2122/97
acggcgaccgccaucacg

SEQ ID NO: 1067659 - RNA, 17 nt, Mycobacterium bovis subsp bovis AF2122/97
acggcgacauacccgau

SEQ ID NO: 1067660 - RNA, 13 nt, Mycobacterium bovis subsp bovis AF2122/97
acggcgacaucgg

SEQ ID NO: 1067661 - RNA, 19 nt, Mycobacterium bovis subsp bovis AF2122/97
acggcgacaucggcccgau

SEQ ID NO: 1067662 - RNA, 18 nt, Mycobacterium bovis subsp bovis AF2122/97
acggcgacgaucucggcg

SEQ ID NO: 1067663 - RNA, 20 nt, Mycobacterium bovis subsp bovis AF2122/97
acggcgcaacaccucguaug

SEQ ID NO: 1067664 - RNA, 15 nt, Mycobacterium bovis subsp bovis AF2122/97
acggcgauggcgcgc

SEQ ID NO: 1067665 - RNA, 16 nt, Mycobacterium bovis subsp bovis AF2122/97
acggcgauggcgcgca

SEQ ID NO: 1067666 - RNA, 16 nt, Mycobacterium bovis subsp bovis AF2122/97
acggcgcaguagaugc

SEQ ID NO: 1067667 - RNA, 18 nt, Mycobacterium bovis subsp bovis AF2122/97
acggcgcaguuggcacca

SEQ ID NO: 1067668 - RNA, 22 nt, Mycobacterium bovis subsp bovis AF2122/97
acggcgcaguuggcaccagccg

SEQ ID NO: 1067669 - RNA, 12 nt, Mycobacterium bovis subsp bovis AF2122/97
acggcgccgaac

SEQ ID NO: 1067670 - RNA, 21 nt, Mycobacterium bovis subsp bovis AF2122/97
acggcgccggcaucggucagc

SEQ ID NO: 1067671 - RNA, 17 nt, Mycobacterium bovis subsp bovis AF2122/97
acggcgccuacaccggc

SEQ ID NO: 1067672 - RNA, 20 nt, Mycobacterium bovis subsp bovis AF2122/97
acggcgccgguuucgaggcg

SEQ ID NO: 1067673 - RNA, 20 nt, Mycobacterium bovis subsp bovis AF2122/97
acggcgccgcccacggggcg

SEQ ID NO: 1067674 - RNA, 23 nt, Mycobacterium bovis subsp bovis AF2122/97
acggcgccgucguugugccgguc

SEQ ID NO: 1067675 - RNA, 15 nt, Mycobacterium bovis subsp bovis AF2122/97
acggccgacaacccg

SEQ ID NO: 1067676 - RNA, 21 nt, Mycobacterium bovis subsp bovis AF2122/97
acggccgacaacccggccggg

SEQ ID NO: 1067677 - RNA, 16 nt, Mycobacterium bovis subsp bovis AF2122/97
acggccgccagcagcu

SEQ ID NO: 1067678 - RNA, 17 nt, Mycobacterium bovis subsp bovis AF2122/97
acggccggcaagcaguc

SEQ ID NO: 1067679 - RNA, 16 nt, Mycobacterium bovis subsp bovis AF2122/97
acggccggccgcugcc

SEQ ID NO: 1067680 - RNA, 22 nt, Mycobacterium bovis subsp bovis AF2122/97
acggccggcggucgggcccggc

SEQ ID NO: 1067681 - RNA, 16 nt, Mycobacterium bovis subsp bovis AF2122/97
acggccgggacggcga

SEQ ID NO: 1067682 - RNA, 17 nt, Mycobacterium bovis subsp bovis AF2122/97
acggccgggacggcgau

SEQ ID NO: 1067683 - RNA, 22 nt, Mycobacterium bovis subsp bovis AF2122/97
acggccgucgauugcaggucgg

SEQ ID NO: 1067684 - RNA, 14 nt, Mycobacterium bovis subsp bovis AF2122/97
acggccgucgacga

SEQ ID NO: 1067685 - RNA, 13 nt, Mycobacterium bovis subsp bovis AF2122/97
acggccugcaacg

SEQ ID NO: 1067686 - RNA, 18 nt, Mycobacterium bovis subsp bovis AF2122/97
acggccugcuaaccacgg

SEQ ID NO: 1067687 - RNA, 18 nt, Mycobacterium bovis subsp bovis AF2122/97
acggccuggccaccuggu

SEQ ID NO: 1067688 - RNA, 21 nt, Mycobacterium bovis subsp bovis AF2122/97
acggccuggggcagccgggcg

SEQ ID NO: 1067689 - RNA, 21 nt, Mycobacterium bovis subsp bovis AF2122/97
acggcccuuguggaguacggc

SEQ ID NO: 1067690 - RNA, 13 nt, Mycobacterium bovis subsp bovis AF2122/97
acggcccgauccc

SEQ ID NO: 1067691 - RNA, 16 nt, Mycobacterium bovis subsp bovis AF2122/97
acgcuggucggcggcu

SEQ ID NO: 1067692 - RNA, 13 nt, Mycobacterium bovis subsp bovis AF2122/97
aaaccagcgucca

SEQ ID NO: 1067693 - RNA, 19 nt, Mycobacterium bovis subsp bovis AF2122/97
acgcuggcgguguagccgc

SEQ ID NO: 1067694 - RNA, 13 nt, Mycobacterium bovis subsp bovis AF2122/97
aaaccaagcgcgc

SEQ ID NO: 1067695 - RNA, 13 nt, Mycobacterium bovis subsp bovis AF2122/97
acgccgucgacgc

SEQ ID NO: 1067696 - RNA, 16 nt, Mycobacterium bovis subsp bovis AF2122/97
acgccgucgacgcggc

SEQ ID NO: 1067697 - RNA, 21 nt, Mycobacterium bovis subsp bovis AF2122/97
acgccgucgacgcggccggcc

SEQ ID NO: 1067698 - RNA, 15 nt, Mycobacterium bovis subsp bovis AF2122/97
acgccgucgacgucg

SEQ ID NO: 1067699 - RNA, 14 nt, Mycobacterium bovis subsp bovis AF2122/97
acgccguaucggcg

SEQ ID NO: 1067700 - RNA, 23 nt, Mycobacterium bovis subsp bovis AF2122/97
acgccguaucggcgugucucguc

SEQ ID NO: 1067701 - RNA, 15 nt, Mycobacterium bovis subsp bovis AF2122/97
acgccgucagcggcc

SEQ ID NO: 1067702 - RNA, 17 nt, Mycobacterium bovis subsp bovis AF2122/97
acgccguccacgccgac

SEQ ID NO: 1067703 - RNA, 21 nt, Mycobacterium bovis subsp bovis AF2122/97
acgccguccacgccgacggca

SEQ ID NO: 1067704 - RNA, 12 nt, Mycobacterium bovis subsp bovis AF2122/97
acgccgucgccu

SEQ ID NO: 1067705 - RNA, 15 nt, Mycobacterium bovis subsp bovis AF2122/97
acgccgucgccugca

SEQ ID NO: 1067706 - RNA, 12 nt, Mycobacterium bovis subsp bovis AF2122/97
acgccgucgagc

SEQ ID NO: 1067707 - RNA, 15 nt, Mycobacterium bovis subsp bovis AF2122/97
acgccgucgaccggc

SEQ ID NO: 1067708 - RNA, 17 nt, Mycobacterium bovis subsp bovis AF2122/97
acgccgucgaccggcgg

SEQ ID NO: 1067709 - RNA, 13 nt, Mycobacterium bovis subsp bovis AF2122/97
acgccgucgaugu

SEQ ID NO: 1067710 - RNA, 18 nt, Mycobacterium bovis subsp bovis AF2122/97
acgccgucgauguggcgc

SEQ ID NO: 1067711 - RNA, 16 nt, Mycobacterium bovis subsp bovis AF2122/97
acgccguggcccgcuc

SEQ ID NO: 1067712 - RNA, 11 nt, Mycobacterium bovis subsp bovis AF2122/97
acgccguccgg

SEQ ID NO: 1067713 - RNA, 14 nt, Mycobacterium bovis subsp bovis AF2122/97
acgccgucggcgcg

SEQ ID NO: 1067714 - RNA, 22 nt, Mycobacterium bovis subsp bovis AF2122/97
acgccugaaacgauugcugcgg

SEQ ID NO: 1067715 - RNA, 13 nt, Mycobacterium bovis subsp bovis AF2122/97
acgccguugccgc

SEQ ID NO: 1067716 - RNA, 17 nt, Mycobacterium bovis subsp bovis AF2122/97
acgccucaccgacgucg

SEQ ID NO: 1067717 - RNA, 16 nt, Mycobacterium bovis subsp bovis AF2122/97
acgccucgacacccag

SEQ ID NO: 1067718 - RNA, 20 nt, Mycobacterium bovis subsp bovis AF2122/97
acgccucgccggccaccagc

SEQ ID NO: 1067719 - RNA, 23 nt, Mycobacterium bovis subsp bovis AF2122/97
acgccggccucgccgaagcgggc

SEQ ID NO: 1067720 - RNA, 14 nt, Mycobacterium bovis subsp bovis AF2122/97
acgccggcgacggc

SEQ ID NO: 1067721 - RNA, 12 nt, Mycobacterium bovis subsp bovis AF2122/97
acgccggccgcg

SEQ ID NO: 1067722 - RNA, 19 nt, Mycobacterium bovis subsp bovis AF2122/97
acgccggcaucgucgacgc

SEQ ID NO: 1067723 - RNA, 21 nt, Mycobacterium bovis subsp bovis AF2122/97
acgccggcaugccagccacga

SEQ ID NO: 1067724 - RNA, 21 nt, Mycobacterium bovis subsp bovis AF2122/97
acgccgcuggagaucacgccg

SEQ ID NO: 1067725 - RNA, 22 nt, Mycobacterium bovis subsp bovis AF2122/97
acgccgcuggagaucacgccga

SEQ ID NO: 1067726 - RNA, 20 nt, Mycobacterium bovis subsp bovis AF2122/97
acgccgcuggagaucacgcc

SEQ ID NO: 1067727 - RNA, 19 nt, Mycobacterium bovis subsp bovis AF2122/97
acgccggacccggucgccg

SEQ ID NO: 1067728 - RNA, 15 nt, Mycobacterium bovis subsp bovis AF2122/97
acgccggcaccgacg

SEQ ID NO: 1067729 - RNA, 14 nt, Mycobacterium bovis subsp bovis AF2122/97
acgccgggugccgc

SEQ ID NO: 1067730 - RNA, 16 nt, Mycobacterium bovis subsp bovis AF2122/97
acgccggguucgccgg

SEQ ID NO: 1067731 - RNA, 21 nt, Mycobacterium bovis subsp bovis AF2122/97
acgccgggcuguucggccaug

SEQ ID NO: 1067732 - RNA, 23 nt, Mycobacterium bovis subsp bovis AF2122/97
acgccgggcuguucggccauggc

SEQ ID NO: 1067733 - RNA, 24 nt, Mycobacterium bovis subsp bovis AF2122/97
acgccggggaaccuugaccgacca

SEQ ID NO: 1067734 - RNA, 19 nt, Mycobacterium bovis subsp bovis AF2122/97
acgccggauggucggccac

SEQ ID NO: 1067735 - RNA, 20 nt, Mycobacterium bovis subsp bovis AF2122/97
acgccgggcaaggccaccgu

SEQ ID NO: 1067736 - RNA, 15 nt, Mycobacterium bovis subsp bovis AF2122/97
acgccguagccggcc

SEQ ID NO: 1067737 - RNA, 16 nt, Mycobacterium bovis subsp bovis AF2122/97
acgccguagccggccg

SEQ ID NO: 1067738 - RNA, 18 nt, Mycobacterium bovis subsp bovis AF2122/97
acgccguagccggccggc

SEQ ID NO: 1067739 - RNA, 20 nt, Mycobacterium bovis subsp bovis AF2122/97
acgccguagcgcagcgccuc

SEQ ID NO: 1067740 - RNA, 15 nt, Mycobacterium bovis subsp bovis AF2122/97
acgccggugccggcc

SEQ ID NO: 1067741 - RNA, 23 nt, Mycobacterium bovis subsp bovis AF2122/97
acgccggugccggccagacucgc

SEQ ID NO: 1067742 - RNA, 20 nt, Mycobacterium bovis subsp bovis AF2122/97
acgccgguggcagagccgcc

SEQ ID NO: 1067743 - RNA, 14 nt, Mycobacterium bovis subsp bovis AF2122/97
acgccgacggcacc

SEQ ID NO: 1067744 - RNA, 20 nt, Mycobacterium bovis subsp bovis AF2122/97
acgccgagaccgccgcugcc

SEQ ID NO: 1067745 - RNA, 18 nt, Mycobacterium bovis subsp bovis AF2122/97
acgccgagaugcugcacc

SEQ ID NO: 1067746 - RNA, 18 nt, Mycobacterium bovis subsp bovis AF2122/97
acgccgaauacggcugcc

SEQ ID NO: 1067747 - RNA, 14 nt, Mycobacterium bovis subsp bovis AF2122/97
acgccgaccgcgcc

SEQ ID NO: 1067748 - RNA, 15 nt, Mycobacterium bovis subsp bovis AF2122/97
acgccgagcacacgu

SEQ ID NO: 1067749 - RNA, 22 nt, Mycobacterium bovis subsp bovis AF2122/97
acgccgaggucuccggugcgca

SEQ ID NO: 1067750 - RNA, 13 nt, Mycobacterium bovis subsp bovis AF2122/97
acgccgaugcggu

SEQ ID NO: 1067751 - RNA, 23 nt, Mycobacterium bovis subsp bovis AF2122/97
acgccgaucugguaagucagcuc

SEQ ID NO: 1067752 - RNA, 23 nt, Mycobacterium bovis subsp bovis AF2122/97
acgccgaugccgaacuccgcgga

SEQ ID NO: 1067753 - RNA, 17 nt, Mycobacterium bovis subsp bovis AF2122/97
acgccgaugcggugcgg

SEQ ID NO: 1067754 - RNA, 13 nt, Mycobacterium bovis subsp bovis AF2122/97
acgccgauccggu

SEQ ID NO: 1067755 - RNA, 23 nt, Mycobacterium bovis subsp bovis AF2122/97
acgccgauccgguggcuggccgc

SEQ ID NO: 1067756 - RNA, 21 nt, Mycobacterium bovis subsp bovis AF2122/97
acgccgaucaacaugccgguc

SEQ ID NO: 1067757 - RNA, 23 nt, Mycobacterium bovis subsp bovis AF2122/97
acgccgauacuaaacaggccgcc

SEQ ID NO: 1067758 - RNA, 16 nt, Mycobacterium bovis subsp bovis AF2122/97
acgccgaacgugcggu

SEQ ID NO: 1067759 - RNA, 19 nt, Mycobacterium bovis subsp bovis AF2122/97
acgccgaacgugcgguggc

SEQ ID NO: 1067760 - RNA, 18 nt, Mycobacterium bovis subsp bovis AF2122/97
acgccgaccaucucaccg

SEQ ID NO: 1067761 - RNA, 19 nt, Mycobacterium bovis subsp bovis AF2122/97
acgccgaccaucucaccgg

SEQ ID NO: 1067762 - RNA, 18 nt, Mycobacterium bovis subsp bovis AF2122/97
acgccgaccacccggaug

SEQ ID NO: 1067763 - RNA, 14 nt, Mycobacterium bovis subsp bovis AF2122/97
acgccgaccagcac

SEQ ID NO: 1067764 - RNA, 16 nt, Mycobacterium bovis subsp bovis AF2122/97
acgccgaccagcaccc

SEQ ID NO: 1067765 - RNA, 19 nt, Mycobacterium bovis subsp bovis AF2122/97
acgccgaccagcacccgcu

SEQ ID NO: 1067766 - RNA, 18 nt, Mycobacterium bovis subsp bovis AF2122/97
acgccgaccuucggcccg

SEQ ID NO: 1067767 - RNA, 19 nt, Mycobacterium bovis subsp bovis AF2122/97
acgccgaccuucggcccgc

SEQ ID NO: 1067768 - RNA, 19 nt, Mycobacterium bovis subsp bovis AF2122/97
acgcccuggaaugccgcca

SEQ ID NO: 1067769 - RNA, 19 nt, Mycobacterium bovis subsp bovis AF2122/97
acgcccuggugucgaucgu

SEQ ID NO: 1067770 - RNA, 15 nt, Mycobacterium bovis subsp bovis AF2122/97
acgcccuguucuccg

SEQ ID NO: 1067771 - RNA, 20 nt, Mycobacterium bovis subsp bovis AF2122/97
acgccgaaaaugccgcccag

SEQ ID NO: 1067772 - RNA, 17 nt, Mycobacterium bovis subsp bovis AF2122/97
acgccgaacaccgccgc

SEQ ID NO: 1067773 - RNA, 15 nt, Mycobacterium bovis subsp bovis AF2122/97
acgccgccgcgacgc

SEQ ID NO: 1067774 - RNA, 13 nt, Mycobacterium bovis subsp bovis AF2122/97
acgccgccgcugc

SEQ ID NO: 1067775 - RNA, 12 nt, Mycobacterium bovis subsp bovis AF2122/97
acgccgccggcc

SEQ ID NO: 1067776 - RNA, 22 nt, Mycobacterium bovis subsp bovis AF2122/97
acgccgccggccccgccgaugc

SEQ ID NO: 1067777 - RNA, 23 nt, Mycobacterium bovis subsp bovis AF2122/97
acgccgccggccccgccgaugcc

SEQ ID NO: 1067778 - RNA, 13 nt, Mycobacterium bovis subsp bovis AF2122/97
acgccgccggccg

SEQ ID NO: 1067779 - RNA, 14 nt, Mycobacterium bovis subsp bovis AF2122/97
acgccgccggccgc

SEQ ID NO: 1067780 - RNA, 12 nt, Mycobacterium bovis subsp bovis AF2122/97
acgccgccggcg

SEQ ID NO: 1067781 - RNA, 15 nt, Mycobacterium bovis subsp bovis AF2122/97
acgccgccggugucg

SEQ ID NO: 1067782 - RNA, 20 nt, Mycobacterium bovis subsp bovis AF2122/97
acgccgcgagagccggcggc

SEQ ID NO: 1067783 - RNA, 16 nt, Mycobacterium bovis subsp bovis AF2122/97
acgccgcgcagccggc

SEQ ID NO: 1067784 - RNA, 17 nt, Mycobacterium bovis subsp bovis AF2122/97
acgccgcgcagccggcc

SEQ ID NO: 1067785 - RNA, 21 nt, Mycobacterium bovis subsp bovis AF2122/97
acgccgcgcagccggcccguc

SEQ ID NO: 1067786 - RNA, 23 nt, Mycobacterium bovis subsp bovis AF2122/97
acgccgccggcgccaccguugcc

SEQ ID NO: 1067787 - RNA, 21 nt, Mycobacterium bovis subsp bovis AF2122/97
acgccgcgccgaaucgcgggc

SEQ ID NO: 1067788 - RNA, 14 nt, Mycobacterium bovis subsp bovis AF2122/97
acgccgcgccggcg

SEQ ID NO: 1067789 - RNA, 13 nt, Mycobacterium bovis subsp bovis AF2122/97
acgccgcgccguu

SEQ ID NO: 1067790 - RNA, 11 nt, Mycobacterium bovis subsp bovis AF2122/97
acgccgccgac

SEQ ID NO: 1067791 - RNA, 13 nt, Mycobacterium bovis subsp bovis AF2122/97
acgccgcccgccg

SEQ ID NO: 1067792 - RNA, 13 nt, Mycobacterium bovis subsp bovis AF2122/97
acgccgcccgcug

SEQ ID NO: 1067793 - RNA, 15 nt, Mycobacterium bovis subsp bovis AF2122/97
acgccgccgaucacc

SEQ ID NO: 1067794 - RNA, 20 nt, Mycobacterium bovis subsp bovis AF2122/97
acgccgauggcuuggugccc

SEQ ID NO: 1067795 - RNA, 18 nt, Mycobacterium bovis subsp bovis AF2122/97
acgccgcaauggaccgaa

SEQ ID NO: 1067796 - RNA, 22 nt, Mycobacterium bovis subsp bovis AF2122/97
acgccgccagguccgccggugc

SEQ ID NO: 1067797 - RNA, 23 nt, Mycobacterium bovis subsp bovis AF2122/97
acgccgccagcaccucggccagc

SEQ ID NO: 1067798 - RNA, 15 nt, Mycobacterium bovis subsp bovis AF2122/97
acgccgccacccggc

SEQ ID NO: 1067799 - RNA, 19 nt, Mycobacterium bovis subsp bovis AF2122/97
acgccgcagcguccgcgga

SEQ ID NO: 1067800 - RNA, 13 nt, Mycobacterium bovis subsp bovis AF2122/97
acgcggaucgcgc

SEQ ID NO: 1067801 - RNA, 16 nt, Mycobacterium bovis subsp bovis AF2122/97
acgcggaucgggcacc

SEQ ID NO: 1067802 - RNA, 21 nt, Mycobacterium bovis subsp bovis AF2122/97
acgcggaucgggcaccccgac

SEQ ID NO: 1067803 - RNA, 14 nt, Mycobacterium bovis subsp bovis AF2122/97
acgcgccggucagc

SEQ ID NO: 1067804 - RNA, 13 nt, Mycobacterium bovis subsp bovis AF2122/97
acgcggccgggcg

SEQ ID NO: 1067805 - RNA, 20 nt, Mycobacterium bovis subsp bovis AF2122/97
acgcggccgggcguccucgu

SEQ ID NO: 1067806 - RNA, 15 nt, Mycobacterium bovis subsp bovis AF2122/97
acgcggccgaggucg

SEQ ID NO: 1067807 - RNA, 23 nt, Mycobacterium bovis subsp bovis AF2122/97
acgcggccgggcguccucgucga

SEQ ID NO: 1067808 - RNA, 17 nt, Mycobacterium bovis subsp bovis AF2122/97
acgcggccuugcgcaca

SEQ ID NO: 1067809 - RNA, 21 nt, Mycobacterium bovis subsp bovis AF2122/97
acgcggccuugcgcacaggcg

SEQ ID NO: 1067810 - RNA, 17 nt, Mycobacterium bovis subsp bovis AF2122/97
acgcggccgaggucacc

SEQ ID NO: 1067811 - RNA, 13 nt, Mycobacterium bovis subsp bovis AF2122/97
acgcggccaccga

SEQ ID NO: 1067812 - RNA, 14 nt, Mycobacterium bovis subsp bovis AF2122/97
acgcggccaccgac

SEQ ID NO: 1067813 - RNA, 18 nt, Mycobacterium bovis subsp bovis AF2122/97
acgcggccaccgaccgca

SEQ ID NO: 1067814 - RNA, 15 nt, Mycobacterium bovis subsp bovis AF2122/97
acgccugggcacggc

SEQ ID NO: 1067815 - RNA, 24 nt, Mycobacterium bovis subsp bovis AF2122/97
acgccuuccagcccgagcagaaac

SEQ ID NO: 1067816 - RNA, 14 nt, Mycobacterium bovis subsp bovis AF2122/97
acgcgagcaacacc

SEQ ID NO: 1067817 - RNA, 15 nt, Mycobacterium bovis subsp bovis AF2122/97
acgcgacucggcggu

SEQ ID NO: 1067818 - RNA, 19 nt, Mycobacterium bovis subsp bovis AF2122/97
acgcgacgggccgcgaaug

SEQ ID NO: 1067819 - RNA, 14 nt, Mycobacterium bovis subsp bovis AF2122/97
acgcgaucagcgcg

SEQ ID NO: 1067820 - RNA, 13 nt, Mycobacterium bovis subsp bovis AF2122/97
acgcgaucaggcg

SEQ ID NO: 1067821 - RNA, 13 nt, Mycobacterium bovis subsp bovis AF2122/97
acgcgaugguggc

SEQ ID NO: 1067822 - RNA, 13 nt, Mycobacterium bovis subsp bovis AF2122/97
acgcgacgccguc

SEQ ID NO: 1067823 - RNA, 14 nt, Mycobacterium bovis subsp bovis AF2122/97
acgcgaucggcguc

SEQ ID NO: 1067824 - RNA, 17 nt, Mycobacterium bovis subsp bovis AF2122/97
acgcgcccgcaccaccg

SEQ ID NO: 1067825 - RNA, 22 nt, Mycobacterium bovis subsp bovis AF2122/97
acgcgcccgcaccaccggcccc

SEQ ID NO: 1067826 - RNA, 15 nt, Mycobacterium bovis subsp bovis AF2122/97
acgcgcccgcaccac

SEQ ID NO: 1067827 - RNA, 14 nt, Mycobacterium bovis subsp bovis AF2122/97
acgcgcccgacgaa

SEQ ID NO: 1067828 - RNA, 13 nt, Mycobacterium bovis subsp bovis AF2122/97
acgcgcccgcacc

SEQ ID NO: 1067829 - RNA, 14 nt, Mycobacterium bovis subsp bovis AF2122/97
acgcgcccgcacca

SEQ ID NO: 1067830 - RNA, 23 nt, Mycobacterium bovis subsp bovis AF2122/97
acgcuggcgcccccgacgacggc

SEQ ID NO: 1067831 - RNA, 20 nt, Mycobacterium bovis subsp bovis AF2122/97
acgcugaauuccacugcgcc

SEQ ID NO: 1067832 - RNA, 23 nt, Mycobacterium bovis subsp bovis AF2122/97
acgcugaauuccacugcgccaca

SEQ ID NO: 1067833 - RNA, 18 nt, Mycobacterium bovis subsp bovis AF2122/97
acgcugaccaacggggca

SEQ ID NO: 1067834 - RNA, 14 nt, Mycobacterium bovis subsp bovis AF2122/97
acgcuggccucguc

SEQ ID NO: 1067835 - RNA, 20 nt, Mycobacterium bovis subsp bovis AF2122/97
acgcugggcggcuacccaug

SEQ ID NO: 1067836 - RNA, 20 nt, Mycobacterium bovis subsp bovis AF2122/97
acgcucggugcugcgccgau

SEQ ID NO: 1067837 - RNA, 23 nt, Mycobacterium bovis subsp bovis AF2122/97
acgcucggucgccaccgccggca

SEQ ID NO: 1067838 - RNA, 20 nt, Mycobacterium bovis subsp bovis AF2122/97
acgcguuucgucgaccgcgc

SEQ ID NO: 1067839 - RNA, 13 nt, Mycobacterium bovis subsp bovis AF2122/97
acgcuagccgaca

SEQ ID NO: 1067840 - RNA, 15 nt, Mycobacterium bovis subsp bovis AF2122/97
acgcgucgccgacgc

SEQ ID NO: 1067841 - RNA, 20 nt, Mycobacterium bovis subsp bovis AF2122/97
acgcgucccgccgcaccgcc

SEQ ID NO: 1067842 - RNA, 17 nt, Mycobacterium bovis subsp bovis AF2122/97
acgcgucagcggcgagc

SEQ ID NO: 1067843 - RNA, 17 nt, Mycobacterium bovis subsp bovis AF2122/97
acgcguccagcgcggcc

SEQ ID NO: 1067844 - RNA, 13 nt, Mycobacterium bovis subsp bovis AF2122/97
acgcguaucccag

SEQ ID NO: 1067845 - RNA, 16 nt, Mycobacterium bovis subsp bovis AF2122/97
acgcguauucggcauc

SEQ ID NO: 1067846 - RNA, 20 nt, Mycobacterium bovis subsp bovis AF2122/97
acgcguauucggcaucgccg

SEQ ID NO: 1067847 - RNA, 21 nt, Mycobacterium bovis subsp bovis AF2122/97
acgcguauucggcaucgccga

SEQ ID NO: 1067848 - RNA, 17 nt, Mycobacterium bovis subsp bovis AF2122/97
acgcguagagccgauca

SEQ ID NO: 1067849 - RNA, 17 nt, Mycobacterium bovis subsp bovis AF2122/97
acgcguagcggucccgc

SEQ ID NO: 1067850 - RNA, 16 nt, Mycobacterium bovis subsp bovis AF2122/97
acgcggcgaccgucga

SEQ ID NO: 1067851 - RNA, 23 nt, Mycobacterium bovis subsp bovis AF2122/97
acgcggcgcgcugaaaugccguc

SEQ ID NO: 1067852 - RNA, 13 nt, Mycobacterium bovis subsp bovis AF2122/97
acgcgguucacca

SEQ ID NO: 1067853 - RNA, 12 nt, Mycobacterium bovis subsp bovis AF2122/97
acgcgugcugag

SEQ ID NO: 1067854 - RNA, 20 nt, Mycobacterium bovis subsp bovis AF2122/97
acgcgucuucggucgcggcc

SEQ ID NO: 1067855 - RNA, 18 nt, Mycobacterium bovis subsp bovis AF2122/97
acgcgucguugucgucgc

SEQ ID NO: 1067856 - RNA, 16 nt, Mycobacterium bovis subsp bovis AF2122/97
acgcgucguggucggc

SEQ ID NO: 1067857 - RNA, 15 nt, Mycobacterium bovis subsp bovis AF2122/97
acgcgucgccggccg

SEQ ID NO: 1067858 - RNA, 20 nt, Mycobacterium bovis subsp bovis AF2122/97
acgcguugugcccgccggcc

SEQ ID NO: 1067859 - RNA, 21 nt, Mycobacterium bovis subsp bovis AF2122/97
acgcguugugcccgccggccc

SEQ ID NO: 1067860 - RNA, 18 nt, Mycobacterium bovis subsp bovis AF2122/97
acgcguugcacagcagcg

SEQ ID NO: 1067861 - RNA, 20 nt, Mycobacterium bovis subsp bovis AF2122/97
acgcguugcacagcagcggu

SEQ ID NO: 1067862 - RNA, 12 nt, Mycobacterium bovis subsp bovis AF2122/97
acgcgugugcgc

SEQ ID NO: 1067863 - RNA, 15 nt, Mycobacterium bovis subsp bovis AF2122/97
acgcguucaacaccg

SEQ ID NO: 1067864 - RNA, 21 nt, Mycobacterium bovis subsp bovis AF2122/97
acgcguucaacaccgccgacc

SEQ ID NO: 1067865 - RNA, 14 nt, Mycobacterium bovis subsp bovis AF2122/97
acgcguucaacgaa

SEQ ID NO: 1067866 - RNA, 21 nt, Mycobacterium bovis subsp bovis AF2122/97
acgcguuccauggcccgcucg

SEQ ID NO: 1067867 - RNA, 16 nt, Mycobacterium bovis subsp bovis AF2122/97
acgaucucggcggccg

SEQ ID NO: 1067868 - RNA, 17 nt, Mycobacterium bovis subsp bovis AF2122/97
acgaugaaccgggcagc

SEQ ID NO: 1067869 - RNA, 23 nt, Mycobacterium bovis subsp bovis AF2122/97
acgaugaccggaaaugucuccuc

SEQ ID NO: 1067870 - RNA, 24 nt, Mycobacterium bovis subsp bovis AF2122/97
acgaucaccccgccaugcggcgcg

SEQ ID NO: 1067871 - RNA, 23 nt, Mycobacterium bovis subsp bovis AF2122/97
acgaucagcuugugggcgacggc

SEQ ID NO: 1067872 - RNA, 19 nt, Mycobacterium bovis subsp bovis AF2122/97
acgaucauauggccgccga

SEQ ID NO: 1067873 - RNA, 22 nt, Mycobacterium bovis subsp bovis AF2122/97
acgaucaggccgucgccggagu

SEQ ID NO: 1067874 - RNA, 23 nt, Mycobacterium bovis subsp bovis AF2122/97
acgaucaucucgucgucgcggcc

SEQ ID NO: 1067875 - RNA, 19 nt, Mycobacterium bovis subsp bovis AF2122/97
acgaucucgccgccagcgc

SEQ ID NO: 1067876 - RNA, 16 nt, Mycobacterium bovis subsp bovis AF2122/97
acgaucucgccggcga

SEQ ID NO: 1067877 - RNA, 22 nt, Mycobacterium bovis subsp bovis AF2122/97
acgaucauugcacccaccccga

SEQ ID NO: 1067878 - RNA, 15 nt, Mycobacterium bovis subsp bovis AF2122/97
acgaucgucgcggcc

SEQ ID NO: 1067879 - RNA, 16 nt, Mycobacterium bovis subsp bovis AF2122/97
acgaucagcacgucgc

SEQ ID NO: 1067880 - RNA, 19 nt, Mycobacterium bovis subsp bovis AF2122/97
acgaucagcacgucgcggc

SEQ ID NO: 1067881 - RNA, 16 nt, Mycobacterium bovis subsp bovis AF2122/97
acgaucagcagcgucg

SEQ ID NO: 1067882 - RNA, 14 nt, Mycobacterium bovis subsp bovis AF2122/97
acgagcggccgcgc

SEQ ID NO: 1067883 - RNA, 15 nt, Mycobacterium bovis subsp bovis AF2122/97
acgagcggccgcgcg

SEQ ID NO: 1067884 - RNA, 19 nt, Mycobacterium bovis subsp bovis AF2122/97
acgagcggguccgacgggc

SEQ ID NO: 1067885 - RNA, 17 nt, Mycobacterium bovis subsp bovis AF2122/97
acgagcgucagauccgg

SEQ ID NO: 1067886 - RNA, 23 nt, Mycobacterium bovis subsp bovis AF2122/97
acgagccagggaggggccgucag

SEQ ID NO: 1067887 - RNA, 15 nt, Mycobacterium bovis subsp bovis AF2122/97
acgagccaccaccgc

SEQ ID NO: 1067888 - RNA, 16 nt, Mycobacterium bovis subsp bovis AF2122/97
acgagccaccaccgcc

SEQ ID NO: 1067889 - RNA, 18 nt, Mycobacterium bovis subsp bovis AF2122/97
acgagccaccaccgccga

SEQ ID NO: 1067890 - RNA, 19 nt, Mycobacterium bovis subsp bovis AF2122/97
acgagccaccaccgccgac

SEQ ID NO: 1067891 - RNA, 20 nt, Mycobacterium bovis subsp bovis AF2122/97
acgagccacggcuucgccgc

SEQ ID NO: 1067892 - RNA, 22 nt, Mycobacterium bovis subsp bovis AF2122/97
accuugaccgggucgaugacgc

SEQ ID NO: 1067893 - RNA, 16 nt, Mycobacterium bovis subsp bovis AF2122/97
acgagauccagcgccu

SEQ ID NO: 1067894 - RNA, 16 nt, Mycobacterium bovis subsp bovis AF2122/97
acgagauugccgggcc

SEQ ID NO: 1067895 - RNA, 19 nt, Mycobacterium bovis subsp bovis AF2122/97
acgagcaccauccgguccc

SEQ ID NO: 1067896 - RNA, 14 nt, Mycobacterium bovis subsp bovis AF2122/97
acgagcaccgcgcc

SEQ ID NO: 1067897 - RNA, 18 nt, Mycobacterium bovis subsp bovis AF2122/97
acgagcaccgcgccgcgc

SEQ ID NO: 1067898 - RNA, 15 nt, Mycobacterium bovis subsp bovis AF2122/97
accuucgucgcggcc

SEQ ID NO: 1067899 - RNA, 12 nt, Mycobacterium bovis subsp bovis AF2122/97
accuucucggcg

SEQ ID NO: 1067900 - RNA, 22 nt, Mycobacterium bovis subsp bovis AF2122/97
accuucaccgcguguaccgcga

SEQ ID NO: 1067901 - RNA, 15 nt, Mycobacterium bovis subsp bovis AF2122/97
accuucccgucgacg

SEQ ID NO: 1067902 - RNA, 17 nt, Mycobacterium bovis subsp bovis AF2122/97
accuucgacaaguccgc

SEQ ID NO: 1067903 - RNA, 20 nt, Mycobacterium bovis subsp bovis AF2122/97
accuucgacaaguccgcgau

SEQ ID NO: 1067904 - RNA, 12 nt, Mycobacterium bovis subsp bovis AF2122/97
accugugcggcc

SEQ ID NO: 1067905 - RNA, 14 nt, Mycobacterium bovis subsp bovis AF2122/97
accugugcggccga

SEQ ID NO: 1067906 - RNA, 20 nt, Mycobacterium bovis subsp bovis AF2122/97
accugucgguaccgcccagu

SEQ ID NO: 1067907 - RNA, 20 nt, Mycobacterium bovis subsp bovis AF2122/97
accugucguccucgcuggau

SEQ ID NO: 1067908 - RNA, 18 nt, Mycobacterium bovis subsp bovis AF2122/97
accuguuggcaugccgcc

SEQ ID NO: 1067909 - RNA, 20 nt, Mycobacterium bovis subsp bovis AF2122/97
accuuagcgccguugccgcc

SEQ ID NO: 1067910 - RNA, 21 nt, Mycobacterium bovis subsp bovis AF2122/97
accuuagcgcuugccgcugag

SEQ ID NO: 1067911 - RNA, 17 nt, Mycobacterium bovis subsp bovis AF2122/97
accugcgggcccacgcc

SEQ ID NO: 1067912 - RNA, 15 nt, Mycobacterium bovis subsp bovis AF2122/97
accugcuggggcauc

SEQ ID NO: 1067913 - RNA, 13 nt, Mycobacterium bovis subsp bovis AF2122/97
accugcuggcgca

SEQ ID NO: 1067914 - RNA, 19 nt, Mycobacterium bovis subsp bovis AF2122/97
accugcuggaagccgucuc

SEQ ID NO: 1067915 - RNA, 18 nt, Mycobacterium bovis subsp bovis AF2122/97
accugcgucaucgcgggu

SEQ ID NO: 1067916 - RNA, 16 nt, Mycobacterium bovis subsp bovis AF2122/97
accugcucgauacggc

SEQ ID NO: 1067917 - RNA, 19 nt, Mycobacterium bovis subsp bovis AF2122/97
accugcucauccaccucga

SEQ ID NO: 1067918 - RNA, 20 nt, Mycobacterium bovis subsp bovis AF2122/97
accugcggcagcggaccgcu

SEQ ID NO: 1067919 - RNA, 18 nt, Mycobacterium bovis subsp bovis AF2122/97
accgggcaccagucgccc

SEQ ID NO: 1067920 - RNA, 14 nt, Mycobacterium bovis subsp bovis AF2122/97
accgggcccgccgg

SEQ ID NO: 1067921 - RNA, 16 nt, Mycobacterium bovis subsp bovis AF2122/97
accgggcccgccggcc

SEQ ID NO: 1067922 - RNA, 17 nt, Mycobacterium bovis subsp bovis AF2122/97
accgggcccgccggccc

SEQ ID NO: 1067923 - RNA, 15 nt, Mycobacterium bovis subsp bovis AF2122/97
accgggcccgacgac

SEQ ID NO: 1067924 - RNA, 17 nt, Mycobacterium bovis subsp bovis AF2122/97
accgggcccgacgacga

SEQ ID NO: 1067925 - RNA, 16 nt, Mycobacterium bovis subsp bovis AF2122/97
accgggcaacggcggg

SEQ ID NO: 1067926 - RNA, 19 nt, Mycobacterium bovis subsp bovis AF2122/97
accgggcaacggcggggcc

SEQ ID NO: 1067927 - RNA, 17 nt, Mycobacterium bovis subsp bovis AF2122/97
accgggcaccagucgcc

SEQ ID NO: 1067928 - RNA, 14 nt, Mycobacterium bovis subsp bovis AF2122/97
accugcccgucccg

SEQ ID NO: 1067929 - RNA, 22 nt, Mycobacterium bovis subsp bovis AF2122/97
accugcccgucccgcucgagca

SEQ ID NO: 1067930 - RNA, 17 nt, Mycobacterium bovis subsp bovis AF2122/97
accugcgcgcggccgcg

SEQ ID NO: 1067931 - RNA, 14 nt, Mycobacterium bovis subsp bovis AF2122/97
accugcgcggcgau

SEQ ID NO: 1067932 - RNA, 13 nt, Mycobacterium bovis subsp bovis AF2122/97
accugcgagaucg

SEQ ID NO: 1067933 - RNA, 17 nt, Mycobacterium bovis subsp bovis AF2122/97
accugccgggccacggc

SEQ ID NO: 1067934 - RNA, 13 nt, Mycobacterium bovis subsp bovis AF2122/97
accugccguuccg

SEQ ID NO: 1067935 - RNA, 22 nt, Mycobacterium bovis subsp bovis AF2122/97
accugccgacucaucggccgcg

SEQ ID NO: 1067936 - RNA, 17 nt, Mycobacterium bovis subsp bovis AF2122/97
accugccgaucgggcuc

SEQ ID NO: 1067937 - RNA, 14 nt, Mycobacterium bovis subsp bovis AF2122/97
accugggcggcgcg

SEQ ID NO: 1067938 - RNA, 15 nt, Mycobacterium bovis subsp bovis AF2122/97
accugggcggcgcga

SEQ ID NO: 1067939 - RNA, 16 nt, Mycobacterium bovis subsp bovis AF2122/97
accugggacaggacga

SEQ ID NO: 1067940 - RNA, 20 nt, Mycobacterium bovis subsp bovis AF2122/97
accuggguuugcacggcgcg

SEQ ID NO: 1067941 - RNA, 22 nt, Mycobacterium bovis subsp bovis AF2122/97
accuggguuugcacggcgcgcc

SEQ ID NO: 1067942 - RNA, 13 nt, Mycobacterium bovis subsp bovis AF2122/97
accuggggccgca

SEQ ID NO: 1067943 - RNA, 14 nt, Mycobacterium bovis subsp bovis AF2122/97
accuggggccgcac

SEQ ID NO: 1067944 - RNA, 21 nt, Mycobacterium bovis subsp bovis AF2122/97
accuggucgcguccacccacg

SEQ ID NO: 1067945 - RNA, 21 nt, Mycobacterium bovis subsp bovis AF2122/97
accugguucgacucaugccga

SEQ ID NO: 1067946 - RNA, 22 nt, Mycobacterium bovis subsp bovis AF2122/97
accuggccugcggcaggugcgg

SEQ ID NO: 1067947 - RNA, 13 nt, Mycobacterium bovis subsp bovis AF2122/97
accuggcgacgcg

SEQ ID NO: 1067948 - RNA, 16 nt, Mycobacterium bovis subsp bovis AF2122/97
accuggcggugccggc

SEQ ID NO: 1067949 - RNA, 15 nt, Mycobacterium bovis subsp bovis AF2122/97
accuggcuaucgcag

SEQ ID NO: 1067950 - RNA, 19 nt, Mycobacterium bovis subsp bovis AF2122/97
accuggcgugucgccgcca

SEQ ID NO: 1067951 - RNA, 16 nt, Mycobacterium bovis subsp bovis AF2122/97
accuggacaaccucgu

SEQ ID NO: 1067952 - RNA, 13 nt, Mycobacterium bovis subsp bovis AF2122/97
accuggaccucgu

SEQ ID NO: 1067953 - RNA, 22 nt, Mycobacterium bovis subsp bovis AF2122/97
accuggagccgugcggucgcgc

SEQ ID NO: 1067954 - RNA, 22 nt, Mycobacterium bovis subsp bovis AF2122/97
accuggagcuaugucauagcgc

SEQ ID NO: 1067955 - RNA, 23 nt, Mycobacterium bovis subsp bovis AF2122/97
accuggcccgccacgaugucguc

SEQ ID NO: 1067956 - RNA, 16 nt, Mycobacterium bovis subsp bovis AF2122/97
acgcccggcacacggc

SEQ ID NO: 1067957 - RNA, 12 nt, Mycobacterium bovis subsp bovis AF2122/97
acgcccggcacc

SEQ ID NO: 1067958 - RNA, 23 nt, Mycobacterium bovis subsp bovis AF2122/97
acgcccgcucggagaucgccacu

SEQ ID NO: 1067959 - RNA, 15 nt, Mycobacterium bovis subsp bovis AF2122/97
acgcccgcuccgcgg

SEQ ID NO: 1067960 - RNA, 16 nt, Mycobacterium bovis subsp bovis AF2122/97
acgcccgcuccgcggc

SEQ ID NO: 1067961 - RNA, 14 nt, Mycobacterium bovis subsp bovis AF2122/97
acgcccggcacccc

SEQ ID NO: 1067962 - RNA, 19 nt, Mycobacterium bovis subsp bovis AF2122/97
acgcccggccccgcggcca

SEQ ID NO: 1067963 - RNA, 23 nt, Mycobacterium bovis subsp bovis AF2122/97
acgcccggcgcaccaucgcggcc

SEQ ID NO: 1067964 - RNA, 13 nt, Mycobacterium bovis subsp bovis AF2122/97
acgcccuccuggc

SEQ ID NO: 1067965 - RNA, 16 nt, Mycobacterium bovis subsp bovis AF2122/97
acgcccucgacgccgc

SEQ ID NO: 1067966 - RNA, 21 nt, Mycobacterium bovis subsp bovis AF2122/97
acgcccucgacgcgcucgggc

SEQ ID NO: 1067967 - RNA, 20 nt, Mycobacterium bovis subsp bovis AF2122/97
acgcccgugcggcucgccgg

SEQ ID NO: 1067968 - RNA, 16 nt, Mycobacterium bovis subsp bovis AF2122/97
acgcccgggcaccggc

SEQ ID NO: 1067969 - RNA, 19 nt, Mycobacterium bovis subsp bovis AF2122/97
acgcccgggcaccggccgg

SEQ ID NO: 1067970 - RNA, 13 nt, Mycobacterium bovis subsp bovis AF2122/97
acgcccgcaucgc

SEQ ID NO: 1067971 - RNA, 19 nt, Mycobacterium bovis subsp bovis AF2122/97
acgccccggcgcggccagc

SEQ ID NO: 1067972 - RNA, 23 nt, Mycobacterium bovis subsp bovis AF2122/97
acgcccgacgaggaugucgauga

SEQ ID NO: 1067973 - RNA, 13 nt, Mycobacterium bovis subsp bovis AF2122/97
acgcccgagucgu

SEQ ID NO: 1067974 - RNA, 21 nt, Mycobacterium bovis subsp bovis AF2122/97
acgcccgauacgccaccggca

SEQ ID NO: 1067975 - RNA, 17 nt, Mycobacterium bovis subsp bovis AF2122/97
acgccccgaucggccac

SEQ ID NO: 1067976 - RNA, 23 nt, Mycobacterium bovis subsp bovis AF2122/97
acgcccgaagaaugggauggcac

SEQ ID NO: 1067977 - RNA, 19 nt, Mycobacterium bovis subsp bovis AF2122/97
acgcccaggcgaccgcuga

SEQ ID NO: 1067978 - RNA, 23 nt, Mycobacterium bovis subsp bovis AF2122/97
acgccagccccauugccgucgcg

SEQ ID NO: 1067979 - RNA, 15 nt, Mycobacterium bovis subsp bovis AF2122/97
acgccagcaaugccc

SEQ ID NO: 1067980 - RNA, 12 nt, Mycobacterium bovis subsp bovis AF2122/97
acgccaccgcga

SEQ ID NO: 1067981 - RNA, 16 nt, Mycobacterium bovis subsp bovis AF2122/97
acgccaccgcggucac

SEQ ID NO: 1067982 - RNA, 21 nt, Mycobacterium bovis subsp bovis AF2122/97
acgccacgcgucuucggucgc

SEQ ID NO: 1067983 - RNA, 20 nt, Mycobacterium bovis subsp bovis AF2122/97
acgccacggacgugacgucg

SEQ ID NO: 1067984 - RNA, 14 nt, Mycobacterium bovis subsp bovis AF2122/97
acgccacugccagc

SEQ ID NO: 1067985 - RNA, 13 nt, Mycobacterium bovis subsp bovis AF2122/97
acgccagccgcgc

SEQ ID NO: 1067986 - RNA, 17 nt, Mycobacterium bovis subsp bovis AF2122/97
acgccagcccguccggc

SEQ ID NO: 1067987 - RNA, 16 nt, Mycobacterium bovis subsp bovis AF2122/97
acgccagcucgccggc

SEQ ID NO: 1067988 - RNA, 18 nt, Mycobacterium bovis subsp bovis AF2122/97
acgccagcucgccggccg

SEQ ID NO: 1067989 - RNA, 21 nt, Mycobacterium bovis subsp bovis AF2122/97
acgccagcuuggcaaccuguu

SEQ ID NO: 1067990 - RNA, 19 nt, Mycobacterium bovis subsp bovis AF2122/97
acgccaggagcgugucggc

SEQ ID NO: 1067991 - RNA, 15 nt, Mycobacterium bovis subsp bovis AF2122/97
acgccaguguugcgc

SEQ ID NO: 1067992 - RNA, 19 nt, Mycobacterium bovis subsp bovis AF2122/97
acgccaugagcgcgcccaa

SEQ ID NO: 1067993 - RNA, 12 nt, Mycobacterium bovis subsp bovis AF2122/97
acgccaugcccg

SEQ ID NO: 1067994 - RNA, 21 nt, Mycobacterium bovis subsp bovis AF2122/97
acgccaucuucgggccgacgg

SEQ ID NO: 1067995 - RNA, 23 nt, Mycobacterium bovis subsp bovis AF2122/97
acgcccaccacgcgacgcggggc

SEQ ID NO: 1067996 - RNA, 13 nt, Mycobacterium bovis subsp bovis AF2122/97
acgcccaccgaca

SEQ ID NO: 1067997 - RNA, 23 nt, Mycobacterium bovis subsp bovis AF2122/97
acgccauuggccugucaggcggc

SEQ ID NO: 1067998 - RNA, 20 nt, Mycobacterium bovis subsp bovis AF2122/97
acgccauuguugggccgcca

SEQ ID NO: 1067999 - RNA, 15 nt, Mycobacterium bovis subsp bovis AF2122/97
acgccaugucgaugu

SEQ ID NO: 1068000 - RNA, 17 nt, Mycobacterium bovis subsp bovis AF2122/97
acgccaugucgaugucc

SEQ ID NO: 1068001 - RNA, 18 nt, Mycobacterium bovis subsp bovis AF2122/97
acgaugcuggcggccucg

SEQ ID NO: 1068002 - RNA, 21 nt, Mycobacterium bovis subsp bovis AF2122/97
acgaugcgggcgaucucgaug

SEQ ID NO: 1068003 - RNA, 15 nt, Mycobacterium bovis subsp bovis AF2122/97
acgaugccucggcgg

SEQ ID NO: 1068004 - RNA, 13 nt, Mycobacterium bovis subsp bovis AF2122/97
acgaugccgccgg

SEQ ID NO: 1068005 - RNA, 14 nt, Mycobacterium bovis subsp bovis AF2122/97
acgaugccgccggc

SEQ ID NO: 1068006 - RNA, 16 nt, Mycobacterium bovis subsp bovis AF2122/97
acgaugccgccggcgg

SEQ ID NO: 1068007 - RNA, 14 nt, Mycobacterium bovis subsp bovis AF2122/97
acgauggccgccgc

SEQ ID NO: 1068008 - RNA, 17 nt, Mycobacterium bovis subsp bovis AF2122/97
acgauggccgccgcgag

SEQ ID NO: 1068009 - RNA, 13 nt, Mycobacterium bovis subsp bovis AF2122/97
acgauggccgucg

SEQ ID NO: 1068010 - RNA, 17 nt, Mycobacterium bovis subsp bovis AF2122/97
acgcagcccgucggcgc

SEQ ID NO: 1068011 - RNA, 14 nt, Mycobacterium bovis subsp bovis AF2122/97
acgcagugcccgau

SEQ ID NO: 1068012 - RNA, 18 nt, Mycobacterium bovis subsp bovis AF2122/97
acgcaguucggucagcgc

SEQ ID NO: 1068013 - RNA, 14 nt, Mycobacterium bovis subsp bovis AF2122/97
acgcagccagcgcc

SEQ ID NO: 1068014 - RNA, 18 nt, Mycobacterium bovis subsp bovis AF2122/97
acgcagccgaugucgcgc

SEQ ID NO: 1068015 - RNA, 19 nt, Mycobacterium bovis subsp bovis AF2122/97
acgcagcuugcccgacggc

SEQ ID NO: 1068016 - RNA, 21 nt, Mycobacterium bovis subsp bovis AF2122/97
acgcaggaaaaccccggccac

SEQ ID NO: 1068017 - RNA, 14 nt, Mycobacterium bovis subsp bovis AF2122/97
acgccacgaccgcc

SEQ ID NO: 1068018 - RNA, 12 nt, Mycobacterium bovis subsp bovis AF2122/97
acgccacgacgc

SEQ ID NO: 1068019 - RNA, 22 nt, Mycobacterium bovis subsp bovis AF2122/97
acgccaccgcggucaccgacgc

SEQ ID NO: 1068020 - RNA, 13 nt, Mycobacterium bovis subsp bovis AF2122/97
acgccaccggcaa

SEQ ID NO: 1068021 - RNA, 22 nt, Mycobacterium bovis subsp bovis AF2122/97
acgccaccggcaaucggcggca

SEQ ID NO: 1068022 - RNA, 20 nt, Mycobacterium bovis subsp bovis AF2122/97
acgccaccugacgugcggcg

SEQ ID NO: 1068023 - RNA, 19 nt, Mycobacterium bovis subsp bovis AF2122/97
acgccaccauccccggcaa

SEQ ID NO: 1068024 - RNA, 22 nt, Mycobacterium bovis subsp bovis AF2122/97
acgccacccccaaccgccggcc

SEQ ID NO: 1068025 - RNA, 20 nt, Mycobacterium bovis subsp bovis AF2122/97
acgccaccgagaucggacag

SEQ ID NO: 1068026 - RNA, 23 nt, Mycobacterium bovis subsp bovis AF2122/97
acgccaccgccaccacccaggcc

SEQ ID NO: 1068027 - RNA, 13 nt, Mycobacterium bovis subsp bovis AF2122/97
acgccaccaccuc

SEQ ID NO: 1068028 - RNA, 23 nt, Mycobacterium bovis subsp bovis AF2122/97
acgccaacgugacgccggccagu

SEQ ID NO: 1068029 - RNA, 19 nt, Mycobacterium bovis subsp bovis AF2122/97
acgccaacguugcgccagc

SEQ ID NO: 1068030 - RNA, 14 nt, Mycobacterium bovis subsp bovis AF2122/97
acgccaacgccagc

SEQ ID NO: 1068031 - RNA, 19 nt, Mycobacterium bovis subsp bovis AF2122/97
acgccaacgugacgccggc

SEQ ID NO: 1068032 - RNA, 21 nt, Mycobacterium bovis subsp bovis AF2122/97
acgccaacgugacgccggcca

SEQ ID NO: 1068033 - RNA, 12 nt, Mycobacterium bovis subsp bovis AF2122/97
acgccaacaccg

SEQ ID NO: 1068034 - RNA, 15 nt, Mycobacterium bovis subsp bovis AF2122/97
acgccaacaccggca

SEQ ID NO: 1068035 - RNA, 22 nt, Mycobacterium bovis subsp bovis AF2122/97
acgccaaguacgcgaccgcgau

SEQ ID NO: 1068036 - RNA, 18 nt, Mycobacterium bovis subsp bovis AF2122/97
acgccaaguccgcucacc

SEQ ID NO: 1068037 - RNA, 15 nt, Mycobacterium bovis subsp bovis AF2122/97
acgccaagcucggcc

SEQ ID NO: 1068038 - RNA, 17 nt, Mycobacterium bovis subsp bovis AF2122/97
acgccaagcucggccca

SEQ ID NO: 1068039 - RNA, 18 nt, Mycobacterium bovis subsp bovis AF2122/97
acgccaaguacgcgaccg

SEQ ID NO: 1068040 - RNA, 21 nt, Mycobacterium bovis subsp bovis AF2122/97
acgccaaguacgcgaccgcga

SEQ ID NO: 1068041 - RNA, 15 nt, Mycobacterium bovis subsp bovis AF2122/97
acgcauaaccggcgc

SEQ ID NO: 1068042 - RNA, 20 nt, Mycobacterium bovis subsp bovis AF2122/97
acgcauaagcccccgcacgc

SEQ ID NO: 1068043 - RNA, 20 nt, Mycobacterium bovis subsp bovis AF2122/97
acgcaucccgaauggccgau

SEQ ID NO: 1068044 - RNA, 13 nt, Mycobacterium bovis subsp bovis AF2122/97
acgcaucgucagc

SEQ ID NO: 1068045 - RNA, 15 nt, Mycobacterium bovis subsp bovis AF2122/97
acgcaucgccgucaa

SEQ ID NO: 1068046 - RNA, 13 nt, Mycobacterium bovis subsp bovis AF2122/97
acgcaugucgggc

SEQ ID NO: 1068047 - RNA, 18 nt, Mycobacterium bovis subsp bovis AF2122/97
acgcaugucgggccaggc

SEQ ID NO: 1068048 - RNA, 17 nt, Mycobacterium bovis subsp bovis AF2122/97
acgcaugggccagguca

SEQ ID NO: 1068049 - RNA, 23 nt, Mycobacterium bovis subsp bovis AF2122/97
acgcaugggccaggucagccgcg

SEQ ID NO: 1068050 - RNA, 23 nt, Mycobacterium bovis subsp bovis AF2122/97
acgcauuguccugaaaacaccgc

SEQ ID NO: 1068051 - RNA, 17 nt, Mycobacterium bovis subsp bovis AF2122/97
acgcauuccagcaggcc

SEQ ID NO: 1068052 - RNA, 13 nt, Mycobacterium bovis subsp bovis AF2122/97
agcgcgcccgaca

SEQ ID NO: 1068053 - RNA, 22 nt, Mycobacterium bovis subsp bovis AF2122/97
agcgcgcccgcggccgccagcg

SEQ ID NO: 1068054 - RNA, 21 nt, Mycobacterium bovis subsp bovis AF2122/97
agcgcgccgaucacggugggc

SEQ ID NO: 1068055 - RNA, 19 nt, Mycobacterium bovis subsp bovis AF2122/97
agcgcgccgaaggccgcca

SEQ ID NO: 1068056 - RNA, 12 nt, Mycobacterium bovis subsp bovis AF2122/97
agcgcgccggcc

SEQ ID NO: 1068057 - RNA, 15 nt, Mycobacterium bovis subsp bovis AF2122/97
agcgcgccgucgggu

SEQ ID NO: 1068058 - RNA, 14 nt, Mycobacterium bovis subsp bovis AF2122/97
agcgcgccguugcc

SEQ ID NO: 1068059 - RNA, 16 nt, Mycobacterium bovis subsp bovis AF2122/97
agcgcgccguugccgc

SEQ ID NO: 1068060 - RNA, 17 nt, Mycobacterium bovis subsp bovis AF2122/97
agcgcgccguugccgcc

SEQ ID NO: 1068061 - RNA, 15 nt, Mycobacterium bovis subsp bovis AF2122/97
agcgcgccucgccca

SEQ ID NO: 1068062 - RNA, 18 nt, Mycobacterium bovis subsp bovis AF2122/97
agcgcgcgccgagcccgg

SEQ ID NO: 1068063 - RNA, 22 nt, Mycobacterium bovis subsp bovis AF2122/97
agcgcgcuggccagcccgguca

SEQ ID NO: 1068064 - RNA, 19 nt, Mycobacterium bovis subsp bovis AF2122/97
agcgcggcaacuccgguca

SEQ ID NO: 1068065 - RNA, 21 nt, Mycobacterium bovis subsp bovis AF2122/97
agcgcggcaacuccggucaac

SEQ ID NO: 1068066 - RNA, 20 nt, Mycobacterium bovis subsp bovis AF2122/97
agcgcggcaagcucguccgg

SEQ ID NO: 1068067 - RNA, 12 nt, Mycobacterium bovis subsp bovis AF2122/97
agcgcggcacca

SEQ ID NO: 1068068 - RNA, 22 nt, Mycobacterium bovis subsp bovis AF2122/97
agcgcgcgcgggugcaaccgga

SEQ ID NO: 1068069 - RNA, 14 nt, Mycobacterium bovis subsp bovis AF2122/97
agcgcgcggguggc

SEQ ID NO: 1068070 - RNA, 14 nt, Mycobacterium bovis subsp bovis AF2122/97
agcgcgcucagguc

SEQ ID NO: 1068071 - RNA, 21 nt, Mycobacterium bovis subsp bovis AF2122/97
agcgcgaucgauuccgcucgu

SEQ ID NO: 1068072 - RNA, 16 nt, Mycobacterium bovis subsp bovis AF2122/97
agcgcgaucgauuccg

SEQ ID NO: 1068073 - RNA, 13 nt, Mycobacterium bovis subsp bovis AF2122/97
agcgcgaucaccg

SEQ ID NO: 1068074 - RNA, 14 nt, Mycobacterium bovis subsp bovis AF2122/97
agcgcgaucaccga

SEQ ID NO: 1068075 - RNA, 23 nt, Mycobacterium bovis subsp bovis AF2122/97
agcgcgagaucagccggcagcga

SEQ ID NO: 1068076 - RNA, 20 nt, Mycobacterium bovis subsp bovis AF2122/97
agcgcgacccguagcuuggc

SEQ ID NO: 1068077 - RNA, 12 nt, Mycobacterium bovis subsp bovis AF2122/97
agcgcgauggcc

SEQ ID NO: 1068078 - RNA, 22 nt, Mycobacterium bovis subsp bovis AF2122/97
agcgcgaucgggccggcgcggu

SEQ ID NO: 1068079 - RNA, 20 nt, Mycobacterium bovis subsp bovis AF2122/97
agcgcgaugaccucggcgau

SEQ ID NO: 1068080 - RNA, 20 nt, Mycobacterium bovis subsp bovis AF2122/97
agcgcgaugcagugcgaccc

SEQ ID NO: 1068081 - RNA, 15 nt, Mycobacterium bovis subsp bovis AF2122/97
agcgcgccaaucgcc

SEQ ID NO: 1068082 - RNA, 16 nt, Mycobacterium bovis subsp bovis AF2122/97
agcgcgccaaucgccc

SEQ ID NO: 1068083 - RNA, 17 nt, Mycobacterium bovis subsp bovis AF2122/97
agcgcgccacccagcac

SEQ ID NO: 1068084 - RNA, 19 nt, Mycobacterium bovis subsp bovis AF2122/97
agcgcgaaagcgccgaaac

SEQ ID NO: 1068085 - RNA, 18 nt, Mycobacterium bovis subsp bovis AF2122/97
agcgcgaaccugcucggc

SEQ ID NO: 1068086 - RNA, 13 nt, Mycobacterium bovis subsp bovis AF2122/97
agcgcgaaagcgc

SEQ ID NO: 1068087 - RNA, 18 nt, Mycobacterium bovis subsp bovis AF2122/97
agcgcgaaagcgccgaaa

SEQ ID NO: 1068088 - RNA, 15 nt, Mycobacterium bovis subsp bovis AF2122/97
agcgcgaacaccaug

SEQ ID NO: 1068089 - RNA, 16 nt, Mycobacterium bovis subsp bovis AF2122/97
agcgccuugucgaucu

SEQ ID NO: 1068090 - RNA, 21 nt, Mycobacterium bovis subsp bovis AF2122/97
agcgccuuguuggcgaagucg

SEQ ID NO: 1068091 - RNA, 20 nt, Mycobacterium bovis subsp bovis AF2122/97
agcgccuuucggucacgcgu

SEQ ID NO: 1068092 - RNA, 13 nt, Mycobacterium bovis subsp bovis AF2122/97
agcgcccggucac

SEQ ID NO: 1068093 - RNA, 12 nt, Mycobacterium bovis subsp bovis AF2122/97
agcgcccggaug

SEQ ID NO: 1068094 - RNA, 23 nt, Mycobacterium bovis subsp bovis AF2122/97
agcgcccggauguccgccgacgu

SEQ ID NO: 1068095 - RNA, 22 nt, Mycobacterium bovis subsp bovis AF2122/97
agcgcccggcccgccaccccgu

SEQ ID NO: 1068096 - RNA, 13 nt, Mycobacterium bovis subsp bovis AF2122/97
agcgcccgucgcu

SEQ ID NO: 1068097 - RNA, 19 nt, Mycobacterium bovis subsp bovis AF2122/97
agcgccgaaacagcaccca

SEQ ID NO: 1068098 - RNA, 19 nt, Mycobacterium bovis subsp bovis AF2122/97
agcgccgacagccgauccg

SEQ ID NO: 1068099 - RNA, 16 nt, Mycobacterium bovis subsp bovis AF2122/97
agcgccgagagcaccg

SEQ ID NO: 1068100 - RNA, 16 nt, Mycobacterium bovis subsp bovis AF2122/97
agcgccaggucagcuc

SEQ ID NO: 1068101 - RNA, 12 nt, Mycobacterium bovis subsp bovis AF2122/97
agcgcagcgccu

SEQ ID NO: 1068102 - RNA, 15 nt, Mycobacterium bovis subsp bovis AF2122/97
agcgcagcgccuccu

SEQ ID NO: 1068103 - RNA, 16 nt, Mycobacterium bovis subsp bovis AF2122/97
agcgcaggagcgcgau

SEQ ID NO: 1068104 - RNA, 17 nt, Mycobacterium bovis subsp bovis AF2122/97
agcgcaggagcgcgaug

SEQ ID NO: 1068105 - RNA, 20 nt, Mycobacterium bovis subsp bovis AF2122/97
agcgcaggauucugcugacc

SEQ ID NO: 1068106 - RNA, 13 nt, Mycobacterium bovis subsp bovis AF2122/97
agcgccaggccgc

SEQ ID NO: 1068107 - RNA, 11 nt, Mycobacterium bovis subsp bovis AF2122/97
agcgccaggcc

SEQ ID NO: 1068108 - RNA, 18 nt, Mycobacterium bovis subsp bovis AF2122/97
agcgccaggccgcacagc

SEQ ID NO: 1068109 - RNA, 19 nt, Mycobacterium bovis subsp bovis AF2122/97
agcgccaggccgcacagca

SEQ ID NO: 1068110 - RNA, 20 nt, Mycobacterium bovis subsp bovis AF2122/97
agcgcaggguucgucgggac

SEQ ID NO: 1068111 - RNA, 17 nt, Mycobacterium bovis subsp bovis AF2122/97
agcgccgccgccgacga

SEQ ID NO: 1068112 - RNA, 17 nt, Mycobacterium bovis subsp bovis AF2122/97
agcgccgccgcgagcgc

SEQ ID NO: 1068113 - RNA, 17 nt, Mycobacterium bovis subsp bovis AF2122/97
agcgccgccggaagcgc

SEQ ID NO: 1068114 - RNA, 13 nt, Mycobacterium bovis subsp bovis AF2122/97
agcgccgccggcg

SEQ ID NO: 1068115 - RNA, 18 nt, Mycobacterium bovis subsp bovis AF2122/97
agcgccgccggcgccggc

SEQ ID NO: 1068116 - RNA, 23 nt, Mycobacterium bovis subsp bovis AF2122/97
agcgccuccacucuucgggcggc

SEQ ID NO: 1068117 - RNA, 19 nt, Mycobacterium bovis subsp bovis AF2122/97
agcgccguugccgccacgc

SEQ ID NO: 1068118 - RNA, 16 nt, Mycobacterium bovis subsp bovis AF2122/97
agcgccuaccagcacc

SEQ ID NO: 1068119 - RNA, 13 nt, Mycobacterium bovis subsp bovis AF2122/97
agcgccgccaccg

SEQ ID NO: 1068120 - RNA, 20 nt, Mycobacterium bovis subsp bovis AF2122/97
agcgccgauguggccggcga

SEQ ID NO: 1068121 - RNA, 23 nt, Mycobacterium bovis subsp bovis AF2122/97
agcgccgauguggccggcgaugg

SEQ ID NO: 1068122 - RNA, 15 nt, Mycobacterium bovis subsp bovis AF2122/97
agcgccgcacccgcu

SEQ ID NO: 1068123 - RNA, 12 nt, Mycobacterium bovis subsp bovis AF2122/97
agcgccgccacc

SEQ ID NO: 1068124 - RNA, 22 nt, Mycobacterium bovis subsp bovis AF2122/97
agcgccgccaccgaagccgccg

SEQ ID NO: 1068125 - RNA, 18 nt, Mycobacterium bovis subsp bovis AF2122/97
agcgccucgggaggcagc

SEQ ID NO: 1068126 - RNA, 13 nt, Mycobacterium bovis subsp bovis AF2122/97
agcgccucgccgg

SEQ ID NO: 1068127 - RNA, 16 nt, Mycobacterium bovis subsp bovis AF2122/97
agcgccucgccggcca

SEQ ID NO: 1068128 - RNA, 19 nt, Mycobacterium bovis subsp bovis AF2122/97
agcgccucaagcucgccgg

SEQ ID NO: 1068129 - RNA, 22 nt, Mycobacterium bovis subsp bovis AF2122/97
agcgccucgaccugacugguca

SEQ ID NO: 1068130 - RNA, 20 nt, Mycobacterium bovis subsp bovis AF2122/97
agcgccugcggcagcacccg

SEQ ID NO: 1068131 - RNA, 15 nt, Mycobacterium bovis subsp bovis AF2122/97
agccuggcuguccgc

SEQ ID NO: 1068132 - RNA, 16 nt, Mycobacterium bovis subsp bovis AF2122/97
agccuggcuguccgcg

SEQ ID NO: 1068133 - RNA, 16 nt, Mycobacterium bovis subsp bovis AF2122/97
agccuggccucgccau

SEQ ID NO: 1068134 - RNA, 22 nt, Mycobacterium bovis subsp bovis AF2122/97
agccugguguccgagcggcccu

SEQ ID NO: 1068135 - RNA, 20 nt, Mycobacterium bovis subsp bovis AF2122/97
agccguugccgccacgggcg

SEQ ID NO: 1068136 - RNA, 21 nt, Mycobacterium bovis subsp bovis AF2122/97
agccugcugcacaucgcaucc

SEQ ID NO: 1068137 - RNA, 18 nt, Mycobacterium bovis subsp bovis AF2122/97
agccugcuggccgcggcc

SEQ ID NO: 1068138 - RNA, 21 nt, Mycobacterium bovis subsp bovis AF2122/97
agccugcuggccgcggccucg

SEQ ID NO: 1068139 - RNA, 16 nt, Mycobacterium bovis subsp bovis AF2122/97
agccuggaucacaccc

SEQ ID NO: 1068140 - RNA, 23 nt, Mycobacterium bovis subsp bovis AF2122/97
agccuggaucacacccacgucga

SEQ ID NO: 1068141 - RNA, 23 nt, Mycobacterium bovis subsp bovis AF2122/97
agccuggcaaccacguccgcaac

SEQ ID NO: 1068142 - RNA, 17 nt, Mycobacterium bovis subsp bovis AF2122/97
agccguucgcgucgccg

SEQ ID NO: 1068143 - RNA, 14 nt, Mycobacterium bovis subsp bovis AF2122/97
agccguucccggug

SEQ ID NO: 1068144 - RNA, 14 nt, Mycobacterium bovis subsp bovis AF2122/97
agccguucgcagcu

SEQ ID NO: 1068145 - RNA, 19 nt, Mycobacterium bovis subsp bovis AF2122/97
agccguugcgggccaggcc

SEQ ID NO: 1068146 - RNA, 16 nt, Mycobacterium bovis subsp bovis AF2122/97
agccguucugucccgg

SEQ ID NO: 1068147 - RNA, 16 nt, Mycobacterium bovis subsp bovis AF2122/97
agccguucucgcccac

SEQ ID NO: 1068148 - RNA, 18 nt, Mycobacterium bovis subsp bovis AF2122/97
agccgugucaaccggucg

SEQ ID NO: 1068149 - RNA, 19 nt, Mycobacterium bovis subsp bovis AF2122/97
agccgugucaaccggucgg

SEQ ID NO: 1068150 - RNA, 19 nt, Mycobacterium bovis subsp bovis AF2122/97
agccguggcagucgcacgg

SEQ ID NO: 1068151 - RNA, 18 nt, Mycobacterium bovis subsp bovis AF2122/97
agccguggcagucgcacg

SEQ ID NO: 1068152 - RNA, 15 nt, Mycobacterium bovis subsp bovis AF2122/97
agccguggccggacc

SEQ ID NO: 1068153 - RNA, 16 nt, Mycobacterium bovis subsp bovis AF2122/97
agccguggcgcgacgu

SEQ ID NO: 1068154 - RNA, 14 nt, Mycobacterium bovis subsp bovis AF2122/97
agccguggcggcgg

SEQ ID NO: 1068155 - RNA, 15 nt, Mycobacterium bovis subsp bovis AF2122/97
agccgugggccacga

SEQ ID NO: 1068156 - RNA, 18 nt, Mycobacterium bovis subsp bovis AF2122/97
agccgugggccacgauga

SEQ ID NO: 1068157 - RNA, 17 nt, Mycobacterium bovis subsp bovis AF2122/97
agccgugccgccagcaa

SEQ ID NO: 1068158 - RNA, 19 nt, Mycobacterium bovis subsp bovis AF2122/97
agccgugcgggccggucgu

SEQ ID NO: 1068159 - RNA, 18 nt, Mycobacterium bovis subsp bovis AF2122/97
agccgugcuuguugcgcg

SEQ ID NO: 1068160 - RNA, 13 nt, Mycobacterium bovis subsp bovis AF2122/97
agccguccgacca

SEQ ID NO: 1068161 - RNA, 15 nt, Mycobacterium bovis subsp bovis AF2122/97
agccguccaauuccg

SEQ ID NO: 1068162 - RNA, 18 nt, Mycobacterium bovis subsp bovis AF2122/97
agccguaguaguggccgc

SEQ ID NO: 1068163 - RNA, 15 nt, Mycobacterium bovis subsp bovis AF2122/97
agccguaucggugug

SEQ ID NO: 1068164 - RNA, 13 nt, Mycobacterium bovis subsp bovis AF2122/97
agccgucacgccg

SEQ ID NO: 1068165 - RNA, 15 nt, Mycobacterium bovis subsp bovis AF2122/97
agccgucacgccgga

SEQ ID NO: 1068166 - RNA, 13 nt, Mycobacterium bovis subsp bovis AF2122/97
agccguagccgcc

SEQ ID NO: 1068167 - RNA, 14 nt, Mycobacterium bovis subsp bovis AF2122/97
agccguagccgccg

SEQ ID NO: 1068168 - RNA, 13 nt, Mycobacterium bovis subsp bovis AF2122/97
agccguagcgguc

SEQ ID NO: 1068169 - RNA, 19 nt, Mycobacterium bovis subsp bovis AF2122/97
agccgguuggcugccggca

SEQ ID NO: 1068170 - RNA, 18 nt, Mycobacterium bovis subsp bovis AF2122/97
agccgguugucgcagcgc

SEQ ID NO: 1068171 - RNA, 15 nt, Mycobacterium bovis subsp bovis AF2122/97
agccggugccggcgu

SEQ ID NO: 1068172 - RNA, 15 nt, Mycobacterium bovis subsp bovis AF2122/97
agccgguucgcccag

SEQ ID NO: 1068173 - RNA, 14 nt, Mycobacterium bovis subsp bovis AF2122/97
agccgguggucgcg

SEQ ID NO: 1068174 - RNA, 15 nt, Mycobacterium bovis subsp bovis AF2122/97
agccgguggucgcgc

SEQ ID NO: 1068175 - RNA, 11 nt, Mycobacterium bovis subsp bovis AF2122/97
agccgguggca

SEQ ID NO: 1068176 - RNA, 15 nt, Mycobacterium bovis subsp bovis AF2122/97
agccggugccggcgc

SEQ ID NO: 1068177 - RNA, 12 nt, Mycobacterium bovis subsp bovis AF2122/97
agccggugccgc

SEQ ID NO: 1068178 - RNA, 13 nt, Mycobacterium bovis subsp bovis AF2122/97
agccggugccgcg

SEQ ID NO: 1068179 - RNA, 18 nt, Mycobacterium bovis subsp bovis AF2122/97
agccggugccgacggcgc

SEQ ID NO: 1068180 - RNA, 16 nt, Mycobacterium bovis subsp bovis AF2122/97
agccggugccacugcc

SEQ ID NO: 1068181 - RNA, 22 nt, Mycobacterium bovis subsp bovis AF2122/97
agccgguccagacccagcucgu

SEQ ID NO: 1068182 - RNA, 18 nt, Mycobacterium bovis subsp bovis AF2122/97
agccggugagcgagcgcg

SEQ ID NO: 1068183 - RNA, 19 nt, Mycobacterium bovis subsp bovis AF2122/97
agccggugacaaguggugc

SEQ ID NO: 1068184 - RNA, 23 nt, Mycobacterium bovis subsp bovis AF2122/97
agccggugacaaguggugcccuu

SEQ ID NO: 1068185 - RNA, 14 nt, Mycobacterium bovis subsp bovis AF2122/97
agccggugaccgcg

SEQ ID NO: 1068186 - RNA, 17 nt, Mycobacterium bovis subsp bovis AF2122/97
agccggugagcgagcgc

SEQ ID NO: 1068187 - RNA, 17 nt, Mycobacterium bovis subsp bovis AF2122/97
agccgguagaucagcgc

SEQ ID NO: 1068188 - RNA, 23 nt, Mycobacterium bovis subsp bovis AF2122/97
agccgguagaucagcgccugguc

SEQ ID NO: 1068189 - RNA, 15 nt, Mycobacterium bovis subsp bovis AF2122/97
agccgguagccgggc

SEQ ID NO: 1068190 - RNA, 19 nt, Mycobacterium bovis subsp bovis AF2122/97
agccgggguucaccgucga

SEQ ID NO: 1068191 - RNA, 23 nt, Mycobacterium bovis subsp bovis AF2122/97
agccgggcuggccgacucgaggu

SEQ ID NO: 1068192 - RNA, 23 nt, Mycobacterium bovis subsp bovis AF2122/97
agccgggugaggcgggucgccgc

SEQ ID NO: 1068193 - RNA, 20 nt, Mycobacterium bovis subsp bovis AF2122/97
agccggguguuggggaucgc

SEQ ID NO: 1068194 - RNA, 23 nt, Mycobacterium bovis subsp bovis AF2122/97
agccggguguuggggaucgcacc

SEQ ID NO: 1068195 - RNA, 15 nt, Mycobacterium bovis subsp bovis AF2122/97
agccgguaaccgcgu

SEQ ID NO: 1068196 - RNA, 22 nt, Mycobacterium bovis subsp bovis AF2122/97
agccgggugggagcagccgaac

SEQ ID NO: 1068197 - RNA, 23 nt, Mycobacterium bovis subsp bovis AF2122/97
agccgggugggagcagccgaacc

SEQ ID NO: 1068198 - RNA, 23 nt, Mycobacterium bovis subsp bovis AF2122/97
agccgcuccacguacgcggcugc

SEQ ID NO: 1068199 - RNA, 21 nt, Mycobacterium bovis subsp bovis AF2122/97
agccggguuuggugcagccgc

SEQ ID NO: 1068200 - RNA, 15 nt, Mycobacterium bovis subsp bovis AF2122/97
agccgcucgauggcc

SEQ ID NO: 1068201 - RNA, 16 nt, Mycobacterium bovis subsp bovis AF2122/97
agccgcuccgcccauu

SEQ ID NO: 1068202 - RNA, 17 nt, Mycobacterium bovis subsp bovis AF2122/97
agccgcuccacguacgc

SEQ ID NO: 1068203 - RNA, 16 nt, Mycobacterium bovis subsp bovis AF2122/97
agccgcucacccgguc

SEQ ID NO: 1068204 - RNA, 22 nt, Mycobacterium bovis subsp bovis AF2122/97
agccgcucacccggucgcacuu

SEQ ID NO: 1068205 - RNA, 23 nt, Mycobacterium bovis subsp bovis AF2122/97
agccgcuacguuacgccgagaug

SEQ ID NO: 1068206 - RNA, 20 nt, Mycobacterium bovis subsp bovis AF2122/97
agccgcuaggaucggauggc

SEQ ID NO: 1068207 - RNA, 14 nt, Mycobacterium bovis subsp bovis AF2122/97
agcgacuccagcgc

SEQ ID NO: 1068208 - RNA, 16 nt, Mycobacterium bovis subsp bovis AF2122/97
agcgacuccagcgccc

SEQ ID NO: 1068209 - RNA, 12 nt, Mycobacterium bovis subsp bovis AF2122/97
agcgagccggcg

SEQ ID NO: 1068210 - RNA, 18 nt, Mycobacterium bovis subsp bovis AF2122/97
agcgagccguaucggacg

SEQ ID NO: 1068211 - RNA, 14 nt, Mycobacterium bovis subsp bovis AF2122/97
agcgacggucccgg

SEQ ID NO: 1068212 - RNA, 20 nt, Mycobacterium bovis subsp bovis AF2122/97
agcgagcgcaaaucgauugc

SEQ ID NO: 1068213 - RNA, 21 nt, Mycobacterium bovis subsp bovis AF2122/97
agcgagcgcaaaucgauugcg

SEQ ID NO: 1068214 - RNA, 13 nt, Mycobacterium bovis subsp bovis AF2122/97
agcgacucgccgg

SEQ ID NO: 1068215 - RNA, 23 nt, Mycobacterium bovis subsp bovis AF2122/97
agcgagcucagcgaugcggcccu

SEQ ID NO: 1068216 - RNA, 19 nt, Mycobacterium bovis subsp bovis AF2122/97
agcgaggaauuccgcuacc

SEQ ID NO: 1068217 - RNA, 18 nt, Mycobacterium bovis subsp bovis AF2122/97
agcgaggacaagcccgcu

SEQ ID NO: 1068218 - RNA, 13 nt, Mycobacterium bovis subsp bovis AF2122/97
agcgaggccagcg

SEQ ID NO: 1068219 - RNA, 18 nt, Mycobacterium bovis subsp bovis AF2122/97
agcgcaaucgaccacgac

SEQ ID NO: 1068220 - RNA, 16 nt, Mycobacterium bovis subsp bovis AF2122/97
agcgcaaugcggcccg

SEQ ID NO: 1068221 - RNA, 13 nt, Mycobacterium bovis subsp bovis AF2122/97
agcgcaccacggc

SEQ ID NO: 1068222 - RNA, 16 nt, Mycobacterium bovis subsp bovis AF2122/97
agcgcaccacggcggu

SEQ ID NO: 1068223 - RNA, 18 nt, Mycobacterium bovis subsp bovis AF2122/97
agcgcacaaacgacucgc

SEQ ID NO: 1068224 - RNA, 15 nt, Mycobacterium bovis subsp bovis AF2122/97
agcgagucgacgucg

SEQ ID NO: 1068225 - RNA, 12 nt, Mycobacterium bovis subsp bovis AF2122/97
agcgaggccagc

SEQ ID NO: 1068226 - RNA, 16 nt, Mycobacterium bovis subsp bovis AF2122/97
agcgcaaggucgacgg

SEQ ID NO: 1068227 - RNA, 22 nt, Mycobacterium bovis subsp bovis AF2122/97
agcgcaagguugccaacgccuu

SEQ ID NO: 1068228 - RNA, 17 nt, Mycobacterium bovis subsp bovis AF2122/97
agcgcacacuaccgccg

SEQ ID NO: 1068229 - RNA, 12 nt, Mycobacterium bovis subsp bovis AF2122/97
agcgcaccgcga

SEQ ID NO: 1068230 - RNA, 14 nt, Mycobacterium bovis subsp bovis AF2122/97
agcgcaccgcgaaa

SEQ ID NO: 1068231 - RNA, 19 nt, Mycobacterium bovis subsp bovis AF2122/97
agcgcaccgcugaccgcaa

SEQ ID NO: 1068232 - RNA, 16 nt, Mycobacterium bovis subsp bovis AF2122/97
agcgcagccugcagcg

SEQ ID NO: 1068233 - RNA, 18 nt, Mycobacterium bovis subsp bovis AF2122/97
agcgcagccuggucgcgc

SEQ ID NO: 1068234 - RNA, 20 nt, Mycobacterium bovis subsp bovis AF2122/97
agcgcacccggucggcggca

SEQ ID NO: 1068235 - RNA, 18 nt, Mycobacterium bovis subsp bovis AF2122/97
agcgcaccggcguucacc

SEQ ID NO: 1068236 - RNA, 20 nt, Mycobacterium bovis subsp bovis AF2122/97
agcgacagcgcggcgcgaca

SEQ ID NO: 1068237 - RNA, 21 nt, Mycobacterium bovis subsp bovis AF2122/97
agcgaccaauagguccccaca

SEQ ID NO: 1068238 - RNA, 16 nt, Mycobacterium bovis subsp bovis AF2122/97
agcgacgcggccagcg

SEQ ID NO: 1068239 - RNA, 12 nt, Mycobacterium bovis subsp bovis AF2122/97
agcgacggcaaa

SEQ ID NO: 1068240 - RNA, 18 nt, Mycobacterium bovis subsp bovis AF2122/97
agcgacggccgccagcag

SEQ ID NO: 1068241 - RNA, 20 nt, Mycobacterium bovis subsp bovis AF2122/97
agcgacggccgccagcagcu

SEQ ID NO: 1068242 - RNA, 21 nt, Mycobacterium bovis subsp bovis AF2122/97
agcgacgcuaggacggcugcc

SEQ ID NO: 1068243 - RNA, 22 nt, Mycobacterium bovis subsp bovis AF2122/97
agcgacgcuaggacggcugccg

SEQ ID NO: 1068244 - RNA, 16 nt, Mycobacterium bovis subsp bovis AF2122/97
agcgacggcgcucggc

SEQ ID NO: 1068245 - RNA, 17 nt, Mycobacterium bovis subsp bovis AF2122/97
agcgaauccaggccgua

SEQ ID NO: 1068246 - RNA, 22 nt, Mycobacterium bovis subsp bovis AF2122/97
aaacgcgaugguggccgccacc

SEQ ID NO: 1068247 - RNA, 20 nt, Mycobacterium bovis subsp bovis AF2122/97
agcggcaucgcgggcggcgc

SEQ ID NO: 1068248 - RNA, 18 nt, Mycobacterium bovis subsp bovis AF2122/97
agcggcaucggccagccg

SEQ ID NO: 1068249 - RNA, 21 nt, Mycobacterium bovis subsp bovis AF2122/97
agcggcaucggccagccguuc

SEQ ID NO: 1068250 - RNA, 17 nt, Mycobacterium bovis subsp bovis AF2122/97
agcggcauugccagccg

SEQ ID NO: 1068251 - RNA, 16 nt, Mycobacterium bovis subsp bovis AF2122/97
agcggccaccgaggcg

SEQ ID NO: 1068252 - RNA, 16 nt, Mycobacterium bovis subsp bovis AF2122/97
agcggccaccgccgcc

SEQ ID NO: 1068253 - RNA, 20 nt, Mycobacterium bovis subsp bovis AF2122/97
agcggccaccgccgccgcca

SEQ ID NO: 1068254 - RNA, 23 nt, Mycobacterium bovis subsp bovis AF2122/97
agcggccaccgccgccgccaccg

SEQ ID NO: 1068255 - RNA, 21 nt, Mycobacterium bovis subsp bovis AF2122/97
agcggccagcccagccgggag

SEQ ID NO: 1068256 - RNA, 12 nt, Mycobacterium bovis subsp bovis AF2122/97
agcggccagcag

SEQ ID NO: 1068257 - RNA, 19 nt, Mycobacterium bovis subsp bovis AF2122/97
agcggccagcagugcggua

SEQ ID NO: 1068258 - RNA, 16 nt, Mycobacterium bovis subsp bovis AF2122/97
agcggcagcggcgucg

SEQ ID NO: 1068259 - RNA, 18 nt, Mycobacterium bovis subsp bovis AF2122/97
agcggcagcggcgucguc

SEQ ID NO: 1068260 - RNA, 22 nt, Mycobacterium bovis subsp bovis AF2122/97
agcggcgccaguauggccgcca

SEQ ID NO: 1068261 - RNA, 23 nt, Mycobacterium bovis subsp bovis AF2122/97
agcggcgccaguauggccgccac

SEQ ID NO: 1068262 - RNA, 13 nt, Mycobacterium bovis subsp bovis AF2122/97
agcggcgcccgcc

SEQ ID NO: 1068263 - RNA, 18 nt, Mycobacterium bovis subsp bovis AF2122/97
agcggcggcaacccugcc

SEQ ID NO: 1068264 - RNA, 14 nt, Mycobacterium bovis subsp bovis AF2122/97
agcggcugaccggg

SEQ ID NO: 1068265 - RNA, 15 nt, Mycobacterium bovis subsp bovis AF2122/97
agcggcugaccgggc

SEQ ID NO: 1068266 - RNA, 17 nt, Mycobacterium bovis subsp bovis AF2122/97
agcggcucggcggcgcg

SEQ ID NO: 1068267 - RNA, 14 nt, Mycobacterium bovis subsp bovis AF2122/97
agcggcucggcggg

SEQ ID NO: 1068268 - RNA, 21 nt, Mycobacterium bovis subsp bovis AF2122/97
agcggcucuauccggcgcagg

SEQ ID NO: 1068269 - RNA, 16 nt, Mycobacterium bovis subsp bovis AF2122/97
agcggcugcugcgcgg

SEQ ID NO: 1068270 - RNA, 17 nt, Mycobacterium bovis subsp bovis AF2122/97
agcggcugcugcgcggu

SEQ ID NO: 1068271 - RNA, 20 nt, Mycobacterium bovis subsp bovis AF2122/97
agcggcugcccgagaucgcg

SEQ ID NO: 1068272 - RNA, 18 nt, Mycobacterium bovis subsp bovis AF2122/97
agcggguccccaccgguu

SEQ ID NO: 1068273 - RNA, 21 nt, Mycobacterium bovis subsp bovis AF2122/97
agcggggucuugacggcgcca

SEQ ID NO: 1068274 - RNA, 17 nt, Mycobacterium bovis subsp bovis AF2122/97
agcgggggagcgaacgg

SEQ ID NO: 1068275 - RNA, 19 nt, Mycobacterium bovis subsp bovis AF2122/97
agcgggggagcgaacggcg

SEQ ID NO: 1068276 - RNA, 16 nt, Mycobacterium bovis subsp bovis AF2122/97
agcgggggcagcgcga

SEQ ID NO: 1068277 - RNA, 16 nt, Mycobacterium bovis subsp bovis AF2122/97
agcggggucuugacgg

SEQ ID NO: 1068278 - RNA, 21 nt, Mycobacterium bovis subsp bovis AF2122/97
agcggcugcugcgcggugccg

SEQ ID NO: 1068279 - RNA, 15 nt, Mycobacterium bovis subsp bovis AF2122/97
agcggcuuggccggg

SEQ ID NO: 1068280 - RNA, 17 nt, Mycobacterium bovis subsp bovis AF2122/97
agcggcuuggccgggag

SEQ ID NO: 1068281 - RNA, 18 nt, Mycobacterium bovis subsp bovis AF2122/97
agcggcuugggauuuggg

SEQ ID NO: 1068282 - RNA, 23 nt, Mycobacterium bovis subsp bovis AF2122/97
agcgggugccagcccguugcagg

SEQ ID NO: 1068283 - RNA, 19 nt, Mycobacterium bovis subsp bovis AF2122/97
agcggguucaacgcgcgca

SEQ ID NO: 1068284 - RNA, 13 nt, Mycobacterium bovis subsp bovis AF2122/97
agcggguccgacg

SEQ ID NO: 1068285 - RNA, 17 nt, Mycobacterium bovis subsp bovis AF2122/97
agcggguugcggucacc

SEQ ID NO: 1068286 - RNA, 17 nt, Mycobacterium bovis subsp bovis AF2122/97
agcggguuugccgggcg

SEQ ID NO: 1068287 - RNA, 22 nt, Mycobacterium bovis subsp bovis AF2122/97
agcgguaaugccagcggcacac

SEQ ID NO: 1068288 - RNA, 21 nt, Mycobacterium bovis subsp bovis AF2122/97
agcgguaaugccagcggcaca

SEQ ID NO: 1068289 - RNA, 23 nt, Mycobacterium bovis subsp bovis AF2122/97
agcgguaucccccagccgcggcg

SEQ ID NO: 1068290 - RNA, 18 nt, Mycobacterium bovis subsp bovis AF2122/97
agcgguacguaaucgagc

SEQ ID NO: 1068291 - RNA, 20 nt, Mycobacterium bovis subsp bovis AF2122/97
agcgcggccaauugcgccgc

SEQ ID NO: 1068292 - RNA, 21 nt, Mycobacterium bovis subsp bovis AF2122/97
agcgcggccaccagaucgcac

SEQ ID NO: 1068293 - RNA, 18 nt, Mycobacterium bovis subsp bovis AF2122/97
agcgcggccagagccgcg

SEQ ID NO: 1068294 - RNA, 22 nt, Mycobacterium bovis subsp bovis AF2122/97
agcgcggccaccagaucgcaca

SEQ ID NO: 1068295 - RNA, 17 nt, Mycobacterium bovis subsp bovis AF2122/97
agcgcggccacgccgau

SEQ ID NO: 1068296 - RNA, 12 nt, Mycobacterium bovis subsp bovis AF2122/97
agcgcggccagc

SEQ ID NO: 1068297 - RNA, 19 nt, Mycobacterium bovis subsp bovis AF2122/97
agcgcggccagcagcagau

SEQ ID NO: 1068298 - RNA, 17 nt, Mycobacterium bovis subsp bovis AF2122/97
agcgcggccagcagcag

SEQ ID NO: 1068299 - RNA, 15 nt, Mycobacterium bovis subsp bovis AF2122/97
agcgcggccgauacg

SEQ ID NO: 1068300 - RNA, 17 nt, Mycobacterium bovis subsp bovis AF2122/97
agcgcgggacacgucgc

SEQ ID NO: 1068301 - RNA, 15 nt, Mycobacterium bovis subsp bovis AF2122/97
agcgcggccccgaau

SEQ ID NO: 1068302 - RNA, 21 nt, Mycobacterium bovis subsp bovis AF2122/97
agcgcgggacacgucgcgcca

SEQ ID NO: 1068303 - RNA, 18 nt, Mycobacterium bovis subsp bovis AF2122/97
agcgcgggcucgguggcg

SEQ ID NO: 1068304 - RNA, 15 nt, Mycobacterium bovis subsp bovis AF2122/97
agcgcggguggcagc

SEQ ID NO: 1068305 - RNA, 19 nt, Mycobacterium bovis subsp bovis AF2122/97
agcgcggguggcagcggcg

SEQ ID NO: 1068306 - RNA, 21 nt, Mycobacterium bovis subsp bovis AF2122/97
agcgcgguccaucccgagcuc

SEQ ID NO: 1068307 - RNA, 16 nt, Mycobacterium bovis subsp bovis AF2122/97
agcgcgguuucggcga

SEQ ID NO: 1068308 - RNA, 17 nt, Mycobacterium bovis subsp bovis AF2122/97
agcgcgguuucggcgau

SEQ ID NO: 1068309 - RNA, 21 nt, Mycobacterium bovis subsp bovis AF2122/97
agcgcggguggcucggguggu

SEQ ID NO: 1068310 - RNA, 13 nt, Mycobacterium bovis subsp bovis AF2122/97
agcgcggugccgc

SEQ ID NO: 1068311 - RNA, 18 nt, Mycobacterium bovis subsp bovis AF2122/97
agcgcggugccgccaccg

SEQ ID NO: 1068312 - RNA, 15 nt, Mycobacterium bovis subsp bovis AF2122/97
agcgcguagcgggcg

SEQ ID NO: 1068313 - RNA, 14 nt, Mycobacterium bovis subsp bovis AF2122/97
agcgcguaguccgc

SEQ ID NO: 1068314 - RNA, 15 nt, Mycobacterium bovis subsp bovis AF2122/97
agcgcguucggcacc

SEQ ID NO: 1068315 - RNA, 23 nt, Mycobacterium bovis subsp bovis AF2122/97
agcgcgugcugcagaucggccgg

SEQ ID NO: 1068316 - RNA, 13 nt, Mycobacterium bovis subsp bovis AF2122/97
agcgcuagccggg

SEQ ID NO: 1068317 - RNA, 18 nt, Mycobacterium bovis subsp bovis AF2122/97
agcgcuauaggccgcaug

SEQ ID NO: 1068318 - RNA, 22 nt, Mycobacterium bovis subsp bovis AF2122/97
agcgcucaaugaucgcggcggc

SEQ ID NO: 1068319 - RNA, 15 nt, Mycobacterium bovis subsp bovis AF2122/97
agcgcucaccggcgu

SEQ ID NO: 1068320 - RNA, 16 nt, Mycobacterium bovis subsp bovis AF2122/97
agcgcuccagccgcgc

SEQ ID NO: 1068321 - RNA, 18 nt, Mycobacterium bovis subsp bovis AF2122/97
agcggauccaggccucgc

SEQ ID NO: 1068322 - RNA, 13 nt, Mycobacterium bovis subsp bovis AF2122/97
agcggaucgcggu

SEQ ID NO: 1068323 - RNA, 12 nt, Mycobacterium bovis subsp bovis AF2122/97
agcggaucccgc

SEQ ID NO: 1068324 - RNA, 22 nt, Mycobacterium bovis subsp bovis AF2122/97
agcggaucgucguugucagcga

SEQ ID NO: 1068325 - RNA, 20 nt, Mycobacterium bovis subsp bovis AF2122/97
agcggacccgaccgucgucg

SEQ ID NO: 1068326 - RNA, 19 nt, Mycobacterium bovis subsp bovis AF2122/97
agcggagccacucggcccg

SEQ ID NO: 1068327 - RNA, 14 nt, Mycobacterium bovis subsp bovis AF2122/97
agcggagccgccga

SEQ ID NO: 1068328 - RNA, 15 nt, Mycobacterium bovis subsp bovis AF2122/97
agcggaucaagcgca

SEQ ID NO: 1068329 - RNA, 17 nt, Mycobacterium bovis subsp bovis AF2122/97
agcggaucaagcgcaca

SEQ ID NO: 1068330 - RNA, 14 nt, Mycobacterium bovis subsp bovis AF2122/97
agcggcagcaccgc

SEQ ID NO: 1068331 - RNA, 18 nt, Mycobacterium bovis subsp bovis AF2122/97
agcggcagcaccgcacgg

SEQ ID NO: 1068332 - RNA, 22 nt, Mycobacterium bovis subsp bovis AF2122/97
agcggcagaugaauugccgggc

SEQ ID NO: 1068333 - RNA, 23 nt, Mycobacterium bovis subsp bovis AF2122/97
agcggcagaugaauugccgggcg

SEQ ID NO: 1068334 - RNA, 15 nt, Mycobacterium bovis subsp bovis AF2122/97
agcggcacgaucggc

SEQ ID NO: 1068335 - RNA, 21 nt, Mycobacterium bovis subsp bovis AF2122/97
agcggcaccgcgccggcggaa

SEQ ID NO: 1068336 - RNA, 15 nt, Mycobacterium bovis subsp bovis AF2122/97
agcggaucgcgguca

SEQ ID NO: 1068337 - RNA, 15 nt, Mycobacterium bovis subsp bovis AF2122/97
agcggcaccgcggcc

SEQ ID NO: 1068338 - RNA, 19 nt, Mycobacterium bovis subsp bovis AF2122/97
agcgcuucaaagaucgccu

SEQ ID NO: 1068339 - RNA, 19 nt, Mycobacterium bovis subsp bovis AF2122/97
agcgcuucggcggucgccg

SEQ ID NO: 1068340 - RNA, 23 nt, Mycobacterium bovis subsp bovis AF2122/97
agcgcuucggcggucgccgcgcg

SEQ ID NO: 1068341 - RNA, 13 nt, Mycobacterium bovis subsp bovis AF2122/97
agcggaccugcga

SEQ ID NO: 1068342 - RNA, 22 nt, Mycobacterium bovis subsp bovis AF2122/97
agcgcuugaccccgccgaacgg

SEQ ID NO: 1068343 - RNA, 15 nt, Mycobacterium bovis subsp bovis AF2122/97
agcgcuugacccgcg

SEQ ID NO: 1068344 - RNA, 20 nt, Mycobacterium bovis subsp bovis AF2122/97
agcgcuugacccgcggaccg

SEQ ID NO: 1068345 - RNA, 22 nt, Mycobacterium bovis subsp bovis AF2122/97
agcggaccccacgaguagccgg

SEQ ID NO: 1068346 - RNA, 21 nt, Mycobacterium bovis subsp bovis AF2122/97
agcggacccgacagccgcugc

SEQ ID NO: 1068347 - RNA, 17 nt, Mycobacterium bovis subsp bovis AF2122/97
agcggacccgaccgucg

SEQ ID NO: 1068348 - RNA, 22 nt, Mycobacterium bovis subsp bovis AF2122/97
agcgcuucgucggccggcaccc

SEQ ID NO: 1068349 - RNA, 15 nt, Mycobacterium bovis subsp bovis AF2122/97
agcgcuucgucgccg

SEQ ID NO: 1068350 - RNA, 17 nt, Mycobacterium bovis subsp bovis AF2122/97
agcgcuucgucggccgg

SEQ ID NO: 1068351 - RNA, 16 nt, Mycobacterium bovis subsp bovis AF2122/97
agcgugaccaccgccg

SEQ ID NO: 1068352 - RNA, 19 nt, Mycobacterium bovis subsp bovis AF2122/97
agcgugaaccuggcgacgc

SEQ ID NO: 1068353 - RNA, 22 nt, Mycobacterium bovis subsp bovis AF2122/97
agcgugaaccuuacgacgccgu

SEQ ID NO: 1068354 - RNA, 16 nt, Mycobacterium bovis subsp bovis AF2122/97
agcgucugagcgccgg

SEQ ID NO: 1068355 - RNA, 20 nt, Mycobacterium bovis subsp bovis AF2122/97
agcgucuggccgucgcuggu

SEQ ID NO: 1068356 - RNA, 21 nt, Mycobacterium bovis subsp bovis AF2122/97
agcgucuggucagccgcggcg

SEQ ID NO: 1068357 - RNA, 19 nt, Mycobacterium bovis subsp bovis AF2122/97
agcgucgcacccagggcgu

SEQ ID NO: 1068358 - RNA, 13 nt, Mycobacterium bovis subsp bovis AF2122/97
agcgucgaucacc

SEQ ID NO: 1068359 - RNA, 22 nt, Mycobacterium bovis subsp bovis AF2122/97
agcgucgaucaccugccagugg

SEQ ID NO: 1068360 - RNA, 17 nt, Mycobacterium bovis subsp bovis AF2122/97
agcgucgaucacgucgu

SEQ ID NO: 1068361 - RNA, 15 nt, Mycobacterium bovis subsp bovis AF2122/97
agcguccgucgucgg

SEQ ID NO: 1068362 - RNA, 17 nt, Mycobacterium bovis subsp bovis AF2122/97
agcgucgaacacgucgg

SEQ ID NO: 1068363 - RNA, 19 nt, Mycobacterium bovis subsp bovis AF2122/97
agcgucgacacacccaccg

SEQ ID NO: 1068364 - RNA, 16 nt, Mycobacterium bovis subsp bovis AF2122/97
agcguccgcgcccgag

SEQ ID NO: 1068365 - RNA, 15 nt, Mycobacterium bovis subsp bovis AF2122/97
agcgguggccuccca

SEQ ID NO: 1068366 - RNA, 13 nt, Mycobacterium bovis subsp bovis AF2122/97
agcggugccggcg

SEQ ID NO: 1068367 - RNA, 16 nt, Mycobacterium bovis subsp bovis AF2122/97
agcgguccagcgucgc

SEQ ID NO: 1068368 - RNA, 17 nt, Mycobacterium bovis subsp bovis AF2122/97
agcgguagccgagcucg

SEQ ID NO: 1068369 - RNA, 16 nt, Mycobacterium bovis subsp bovis AF2122/97
agcggucagccggcca

SEQ ID NO: 1068370 - RNA, 19 nt, Mycobacterium bovis subsp bovis AF2122/97
agcgguccagcgucgccgc

SEQ ID NO: 1068371 - RNA, 17 nt, Mycobacterium bovis subsp bovis AF2122/97
agcggucggucaccaug

SEQ ID NO: 1068372 - RNA, 12 nt, Mycobacterium bovis subsp bovis AF2122/97
agcggucgaucu

SEQ ID NO: 1068373 - RNA, 19 nt, Mycobacterium bovis subsp bovis AF2122/97
agcggucugugcugcgcug

SEQ ID NO: 1068374 - RNA, 12 nt, Mycobacterium bovis subsp bovis AF2122/97
agcguggcuggc

SEQ ID NO: 1068375 - RNA, 23 nt, Mycobacterium bovis subsp bovis AF2122/97
agcguggacguacugucgucgcc

SEQ ID NO: 1068376 - RNA, 21 nt, Mycobacterium bovis subsp bovis AF2122/97
agcguggagcgcaaguugagc

SEQ ID NO: 1068377 - RNA, 14 nt, Mycobacterium bovis subsp bovis AF2122/97
agcguggcaacgag

SEQ ID NO: 1068378 - RNA, 21 nt, Mycobacterium bovis subsp bovis AF2122/97
agcguggccaauccggcggcg

SEQ ID NO: 1068379 - RNA, 19 nt, Mycobacterium bovis subsp bovis AF2122/97
agcgugcgcugguggcggc

SEQ ID NO: 1068380 - RNA, 22 nt, Mycobacterium bovis subsp bovis AF2122/97
agcgugcagcggcgggcgauga

SEQ ID NO: 1068381 - RNA, 21 nt, Mycobacterium bovis subsp bovis AF2122/97
agcgugcccgccaccggcgcg

SEQ ID NO: 1068382 - RNA, 22 nt, Mycobacterium bovis subsp bovis AF2122/97
agcgugcccgccaccggcgcga

SEQ ID NO: 1068383 - RNA, 14 nt, Mycobacterium bovis subsp bovis AF2122/97
agcgugagugcagc

SEQ ID NO: 1068384 - RNA, 21 nt, Mycobacterium bovis subsp bovis AF2122/97
agcgugauuucaacgucgcgu

SEQ ID NO: 1068385 - RNA, 16 nt, Mycobacterium bovis subsp bovis AF2122/97
agcgugcacacccgca

SEQ ID NO: 1068386 - RNA, 15 nt, Mycobacterium bovis subsp bovis AF2122/97
agcguugaccgcggu

SEQ ID NO: 1068387 - RNA, 22 nt, Mycobacterium bovis subsp bovis AF2122/97
agcguucuucagccaggguccc

SEQ ID NO: 1068388 - RNA, 17 nt, Mycobacterium bovis subsp bovis AF2122/97
agcguuggccgcugucg

SEQ ID NO: 1068389 - RNA, 16 nt, Mycobacterium bovis subsp bovis AF2122/97
agcguucccgccggcu

SEQ ID NO: 1068390 - RNA, 23 nt, Mycobacterium bovis subsp bovis AF2122/97
agcuagcccucagcuagcgcggg

SEQ ID NO: 1068391 - RNA, 21 nt, Mycobacterium bovis subsp bovis AF2122/97
agcuaucccaggggcaccgag

SEQ ID NO: 1068392 - RNA, 15 nt, Mycobacterium bovis subsp bovis AF2122/97
agcugcuccacccga

SEQ ID NO: 1068393 - RNA, 21 nt, Mycobacterium bovis subsp bovis AF2122/97
agcugcgguaagaaucgaagc

SEQ ID NO: 1068394 - RNA, 11 nt, Mycobacterium bovis subsp bovis AF2122/97
agcugaucacg

SEQ ID NO: 1068395 - RNA, 13 nt, Mycobacterium bovis subsp bovis AF2122/97
agcugagcggccg

SEQ ID NO: 1068396 - RNA, 12 nt, Mycobacterium bovis subsp bovis AF2122/97
agcugagccguc

SEQ ID NO: 1068397 - RNA, 15 nt, Mycobacterium bovis subsp bovis AF2122/97
agcugagcggccagc

SEQ ID NO: 1068398 - RNA, 18 nt, Mycobacterium bovis subsp bovis AF2122/97
agcugacgccgagcuggu

SEQ ID NO: 1068399 - RNA, 14 nt, Mycobacterium bovis subsp bovis AF2122/97
agcugacgcugcuc

SEQ ID NO: 1068400 - RNA, 21 nt, Mycobacterium bovis subsp bovis AF2122/97
agcugacgucaccacgaucgc

SEQ ID NO: 1068401 - RNA, 15 nt, Mycobacterium bovis subsp bovis AF2122/97
agcugcucgccggcc

SEQ ID NO: 1068402 - RNA, 16 nt, Mycobacterium bovis subsp bovis AF2122/97
agcugcucgccggcca

SEQ ID NO: 1068403 - RNA, 21 nt, Mycobacterium bovis subsp bovis AF2122/97
agcugcucgccggccaacugg

SEQ ID NO: 1068404 - RNA, 19 nt, Mycobacterium bovis subsp bovis AF2122/97
agcugcucggucaggcggc

SEQ ID NO: 1068405 - RNA, 15 nt, Mycobacterium bovis subsp bovis AF2122/97
agcugcucgucggcg

SEQ ID NO: 1068406 - RNA, 20 nt, Mycobacterium bovis subsp bovis AF2122/97
agcugcucgucggcgccggc

SEQ ID NO: 1068407 - RNA, 21 nt, Mycobacterium bovis subsp bovis AF2122/97
agcugcucgucggcgccggcg

SEQ ID NO: 1068408 - RNA, 15 nt, Mycobacterium bovis subsp bovis AF2122/97
agcugcucgucuugg

SEQ ID NO: 1068409 - RNA, 16 nt, Mycobacterium bovis subsp bovis AF2122/97
agcugcucgucuuggc

SEQ ID NO: 1068410 - RNA, 20 nt, Mycobacterium bovis subsp bovis AF2122/97
agcugcucgucuuggcggcg

SEQ ID NO: 1068411 - RNA, 21 nt, Mycobacterium bovis subsp bovis AF2122/97
agcugcucgucuuggcggcgg

SEQ ID NO: 1068412 - RNA, 17 nt, Mycobacterium bovis subsp bovis AF2122/97
agcugcucuccgucgcg

SEQ ID NO: 1068413 - RNA, 21 nt, Mycobacterium bovis subsp bovis AF2122/97
agcugcuggaugucgucgacg

SEQ ID NO: 1068414 - RNA, 15 nt, Mycobacterium bovis subsp bovis AF2122/97
agcugcugaugcggu

SEQ ID NO: 1068415 - RNA, 12 nt, Mycobacterium bovis subsp bovis AF2122/97
agcucgucgagg

SEQ ID NO: 1068416 - RNA, 20 nt, Mycobacterium bovis subsp bovis AF2122/97
agcucguaguguuccaacac

SEQ ID NO: 1068417 - RNA, 14 nt, Mycobacterium bovis subsp bovis AF2122/97
agcucgugaccgcc

SEQ ID NO: 1068418 - RNA, 15 nt, Mycobacterium bovis subsp bovis AF2122/97
agcucgucgacgucg

SEQ ID NO: 1068419 - RNA, 23 nt, Mycobacterium bovis subsp bovis AF2122/97
agcucggugcuguugcgcggucg

SEQ ID NO: 1068420 - RNA, 17 nt, Mycobacterium bovis subsp bovis AF2122/97
agcucggugcacggcgc

SEQ ID NO: 1068421 - RNA, 20 nt, Mycobacterium bovis subsp bovis AF2122/97
agcucgcgcugugccgugcg

SEQ ID NO: 1068422 - RNA, 20 nt, Mycobacterium bovis subsp bovis AF2122/97
agcucgcugauaguggcgcg

SEQ ID NO: 1068423 - RNA, 15 nt, Mycobacterium bovis subsp bovis AF2122/97
agcucgcggcgcagg

SEQ ID NO: 1068424 - RNA, 12 nt, Mycobacterium bovis subsp bovis AF2122/97
agcucgccggca

SEQ ID NO: 1068425 - RNA, 16 nt, Mycobacterium bovis subsp bovis AF2122/97
agcucgcgcacgucga

SEQ ID NO: 1068426 - RNA, 22 nt, Mycobacterium bovis subsp bovis AF2122/97
agcucgcgcucgcucacgccgu

SEQ ID NO: 1068427 - RNA, 18 nt, Mycobacterium bovis subsp bovis AF2122/97
agcucgcgcucgcucacg

SEQ ID NO: 1068428 - RNA, 18 nt, Mycobacterium bovis subsp bovis AF2122/97
agcucacgugcugccgau

SEQ ID NO: 1068429 - RNA, 19 nt, Mycobacterium bovis subsp bovis AF2122/97
agcucacuucacgccgccc

SEQ ID NO: 1068430 - RNA, 14 nt, Mycobacterium bovis subsp bovis AF2122/97
agcucacggcggaa

SEQ ID NO: 1068431 - RNA, 18 nt, Mycobacterium bovis subsp bovis AF2122/97
agcucaccuuccucgaaa

SEQ ID NO: 1068432 - RNA, 13 nt, Mycobacterium bovis subsp bovis AF2122/97
agcucacgccggg

SEQ ID NO: 1068433 - RNA, 15 nt, Mycobacterium bovis subsp bovis AF2122/97
agcucagaccggcgc

SEQ ID NO: 1068434 - RNA, 21 nt, Mycobacterium bovis subsp bovis AF2122/97
agcucaauuccaugcaguugu

SEQ ID NO: 1068435 - RNA, 13 nt, Mycobacterium bovis subsp bovis AF2122/97
agcucaccgacgg

SEQ ID NO: 1068436 - RNA, 14 nt, Mycobacterium bovis subsp bovis AF2122/97
agcucaccgucgag

SEQ ID NO: 1068437 - RNA, 15 nt, Mycobacterium bovis subsp bovis AF2122/97
agcucaccgucgagg

SEQ ID NO: 1068438 - RNA, 13 nt, Mycobacterium bovis subsp bovis AF2122/97
agcuccgccgccg

SEQ ID NO: 1068439 - RNA, 19 nt, Mycobacterium bovis subsp bovis AF2122/97
agcucccgccacgucgccg

SEQ ID NO: 1068440 - RNA, 13 nt, Mycobacterium bovis subsp bovis AF2122/97
agcuccgcgcagc

SEQ ID NO: 1068441 - RNA, 19 nt, Mycobacterium bovis subsp bovis AF2122/97
agcucccugggcgucgacc

SEQ ID NO: 1068442 - RNA, 14 nt, Mycobacterium bovis subsp bovis AF2122/97
agcuccgucgcggc

SEQ ID NO: 1068443 - RNA, 16 nt, Mycobacterium bovis subsp bovis AF2122/97
agcuccgggucgacga

SEQ ID NO: 1068444 - RNA, 17 nt, Mycobacterium bovis subsp bovis AF2122/97
agcucccgccacgucgc

SEQ ID NO: 1068445 - RNA, 17 nt, Mycobacterium bovis subsp bovis AF2122/97
agcuccccgaccgaacc

SEQ ID NO: 1068446 - RNA, 15 nt, Mycobacterium bovis subsp bovis AF2122/97
agcagcgacgcugcc

SEQ ID NO: 1068447 - RNA, 15 nt, Mycobacterium bovis subsp bovis AF2122/97
agcagccgaaccggc

SEQ ID NO: 1068448 - RNA, 18 nt, Mycobacterium bovis subsp bovis AF2122/97
agcagccgaaccggcacc

SEQ ID NO: 1068449 - RNA, 14 nt, Mycobacterium bovis subsp bovis AF2122/97
agcagccgaugcug

SEQ ID NO: 1068450 - RNA, 20 nt, Mycobacterium bovis subsp bovis AF2122/97
agcagcgaaaaccgucgcag

SEQ ID NO: 1068451 - RNA, 20 nt, Mycobacterium bovis subsp bovis AF2122/97
agcagcgcuucggcggucgc

SEQ ID NO: 1068452 - RNA, 17 nt, Mycobacterium bovis subsp bovis AF2122/97
agcagcggcggcgacga

SEQ ID NO: 1068453 - RNA, 18 nt, Mycobacterium bovis subsp bovis AF2122/97
agcagcgugaccaccgcc

SEQ ID NO: 1068454 - RNA, 16 nt, Mycobacterium bovis subsp bovis AF2122/97
agcagcuguuggcgug

SEQ ID NO: 1068455 - RNA, 17 nt, Mycobacterium bovis subsp bovis AF2122/97
agcagcggugcagcccg

SEQ ID NO: 1068456 - RNA, 16 nt, Mycobacterium bovis subsp bovis AF2122/97
agcagcgucggugcca

SEQ ID NO: 1068457 - RNA, 16 nt, Mycobacterium bovis subsp bovis AF2122/97
agcagcggcucggcgg

SEQ ID NO: 1068458 - RNA, 21 nt, Mycobacterium bovis subsp bovis AF2122/97
agcagcggcucggcggcgcgu

SEQ ID NO: 1068459 - RNA, 20 nt, Mycobacterium bovis subsp bovis AF2122/97
agcaggacgaugaugaucac

SEQ ID NO: 1068460 - RNA, 19 nt, Mycobacterium bovis subsp bovis AF2122/97
agcaggcccuggccaccca

SEQ ID NO: 1068461 - RNA, 20 nt, Mycobacterium bovis subsp bovis AF2122/97
agcaggaugcgaucgucacg

SEQ ID NO: 1068462 - RNA, 15 nt, Mycobacterium bovis subsp bovis AF2122/97
agcaggaucggcagc

SEQ ID NO: 1068463 - RNA, 19 nt, Mycobacterium bovis subsp bovis AF2122/97
agcaggucgccugcccccg

SEQ ID NO: 1068464 - RNA, 17 nt, Mycobacterium bovis subsp bovis AF2122/97
agcagguccgcggccgc

SEQ ID NO: 1068465 - RNA, 14 nt, Mycobacterium bovis subsp bovis AF2122/97
agcagguacucgcc

SEQ ID NO: 1068466 - RNA, 16 nt, Mycobacterium bovis subsp bovis AF2122/97
agcagguacucgcccc

SEQ ID NO: 1068467 - RNA, 16 nt, Mycobacterium bovis subsp bovis AF2122/97
agcaguagaucggauc

SEQ ID NO: 1068468 - RNA, 23 nt, Mycobacterium bovis subsp bovis AF2122/97
agcaguagcugcucaucgcgccc

SEQ ID NO: 1068469 - RNA, 15 nt, Mycobacterium bovis subsp bovis AF2122/97
agcaguacaccgccc

SEQ ID NO: 1068470 - RNA, 17 nt, Mycobacterium bovis subsp bovis AF2122/97
agcagguugccgaaguu

SEQ ID NO: 1068471 - RNA, 15 nt, Mycobacterium bovis subsp bovis AF2122/97
agcagguuggucacc

SEQ ID NO: 1068472 - RNA, 20 nt, Mycobacterium bovis subsp bovis AF2122/97
agcaguacuaacaacaccac

SEQ ID NO: 1068473 - RNA, 16 nt, Mycobacterium bovis subsp bovis AF2122/97
agcagugccucggcga

SEQ ID NO: 1068474 - RNA, 16 nt, Mycobacterium bovis subsp bovis AF2122/97
agcaguggaguauccg

SEQ ID NO: 1068475 - RNA, 12 nt, Mycobacterium bovis subsp bovis AF2122/97
agccaggccagu

SEQ ID NO: 1068476 - RNA, 19 nt, Mycobacterium bovis subsp bovis AF2122/97
agccaggccagugccaccu

SEQ ID NO: 1068477 - RNA, 16 nt, Mycobacterium bovis subsp bovis AF2122/97
agccaggcacguccga

SEQ ID NO: 1068478 - RNA, 17 nt, Mycobacterium bovis subsp bovis AF2122/97
agccaggcaaccgguca

SEQ ID NO: 1068479 - RNA, 13 nt, Mycobacterium bovis subsp bovis AF2122/97
agccagccaccga

SEQ ID NO: 1068480 - RNA, 13 nt, Mycobacterium bovis subsp bovis AF2122/97
agccagccaccgg

SEQ ID NO: 1068481 - RNA, 17 nt, Mycobacterium bovis subsp bovis AF2122/97
agccagcagcggcgagc

SEQ ID NO: 1068482 - RNA, 12 nt, Mycobacterium bovis subsp bovis AF2122/97
agccagcaacac

SEQ ID NO: 1068483 - RNA, 22 nt, Mycobacterium bovis subsp bovis AF2122/97
agccagcacccgcagccgcgag

SEQ ID NO: 1068484 - RNA, 13 nt, Mycobacterium bovis subsp bovis AF2122/97
agccaccgaucga

SEQ ID NO: 1068485 - RNA, 18 nt, Mycobacterium bovis subsp bovis AF2122/97
agccaccgcacguucggc

SEQ ID NO: 1068486 - RNA, 23 nt, Mycobacterium bovis subsp bovis AF2122/97
agccaccccggguacgccgggca

SEQ ID NO: 1068487 - RNA, 17 nt, Mycobacterium bovis subsp bovis AF2122/97
agccacucgaucaccgg

SEQ ID NO: 1068488 - RNA, 22 nt, Mycobacterium bovis subsp bovis AF2122/97
agccagaccaacaugaacguca

SEQ ID NO: 1068489 - RNA, 19 nt, Mycobacterium bovis subsp bovis AF2122/97
agccaccagcgacgaccac

SEQ ID NO: 1068490 - RNA, 12 nt, Mycobacterium bovis subsp bovis AF2122/97
agccaccaacac

SEQ ID NO: 1068491 - RNA, 21 nt, Mycobacterium bovis subsp bovis AF2122/97
agccaccacaucgcgggcgug

SEQ ID NO: 1068492 - RNA, 14 nt, Mycobacterium bovis subsp bovis AF2122/97
agccaccagccggg

SEQ ID NO: 1068493 - RNA, 15 nt, Mycobacterium bovis subsp bovis AF2122/97
agccaccagccgggc

SEQ ID NO: 1068494 - RNA, 16 nt, Mycobacterium bovis subsp bovis AF2122/97
agccaccagccgggca

SEQ ID NO: 1068495 - RNA, 19 nt, Mycobacterium bovis subsp bovis AF2122/97
agccacaaaggcgccgggu

SEQ ID NO: 1068496 - RNA, 18 nt, Mycobacterium bovis subsp bovis AF2122/97
agccaaugucuacgcauc

SEQ ID NO: 1068497 - RNA, 15 nt, Mycobacterium bovis subsp bovis AF2122/97
agcauucucgccgac

SEQ ID NO: 1068498 - RNA, 20 nt, Mycobacterium bovis subsp bovis AF2122/97
agcaucagcucgaugccgug

SEQ ID NO: 1068499 - RNA, 20 nt, Mycobacterium bovis subsp bovis AF2122/97
agcaucaguuugacgccgau

SEQ ID NO: 1068500 - RNA, 21 nt, Mycobacterium bovis subsp bovis AF2122/97
agcaucggguggcgaggcagc

SEQ ID NO: 1068501 - RNA, 14 nt, Mycobacterium bovis subsp bovis AF2122/97
agcaucgggcgagc

SEQ ID NO: 1068502 - RNA, 15 nt, Mycobacterium bovis subsp bovis AF2122/97
agcaucggcagcagc

SEQ ID NO: 1068503 - RNA, 22 nt, Mycobacterium bovis subsp bovis AF2122/97
agcaucucggccuugacgcacg

SEQ ID NO: 1068504 - RNA, 15 nt, Mycobacterium bovis subsp bovis AF2122/97
agcaucucggcggcc

SEQ ID NO: 1068505 - RNA, 16 nt, Mycobacterium bovis subsp bovis AF2122/97
agcaucuuuggcggcc

SEQ ID NO: 1068506 - RNA, 13 nt, Mycobacterium bovis subsp bovis AF2122/97
agcaucgucgcca

SEQ ID NO: 1068507 - RNA, 16 nt, Mycobacterium bovis subsp bovis AF2122/97
agcauggugcggcggc

SEQ ID NO: 1068508 - RNA, 17 nt, Mycobacterium bovis subsp bovis AF2122/97
agcauggugcggcggcg

SEQ ID NO: 1068509 - RNA, 17 nt, Mycobacterium bovis subsp bovis AF2122/97
agcccggccgcgcccca

SEQ ID NO: 1068510 - RNA, 18 nt, Mycobacterium bovis subsp bovis AF2122/97
agcccgcgcagcgguccg

SEQ ID NO: 1068511 - RNA, 21 nt, Mycobacterium bovis subsp bovis AF2122/97
agcccggccuugccgccggcg

SEQ ID NO: 1068512 - RNA, 13 nt, Mycobacterium bovis subsp bovis AF2122/97
agcccggcggcgg

SEQ ID NO: 1068513 - RNA, 19 nt, Mycobacterium bovis subsp bovis AF2122/97
agcccggcgacgacccggg

SEQ ID NO: 1068514 - RNA, 16 nt, Mycobacterium bovis subsp bovis AF2122/97
agcccggcgcgccgag

SEQ ID NO: 1068515 - RNA, 16 nt, Mycobacterium bovis subsp bovis AF2122/97
agcccgggccguacgg

SEQ ID NO: 1068516 - RNA, 12 nt, Mycobacterium bovis subsp bovis AF2122/97
agcccgccgggc

SEQ ID NO: 1068517 - RNA, 19 nt, Mycobacterium bovis subsp bovis AF2122/97
agcccgccggacccgccgg

SEQ ID NO: 1068518 - RNA, 21 nt, Mycobacterium bovis subsp bovis AF2122/97
agcccgccgcgaccacgcacc

SEQ ID NO: 1068519 - RNA, 13 nt, Mycobacterium bovis subsp bovis AF2122/97
agcccgcgaucac

SEQ ID NO: 1068520 - RNA, 14 nt, Mycobacterium bovis subsp bovis AF2122/97
agcccgcgaucucg

SEQ ID NO: 1068521 - RNA, 22 nt, Mycobacterium bovis subsp bovis AF2122/97
agcccgccgaucgggcuucggc

SEQ ID NO: 1068522 - RNA, 17 nt, Mycobacterium bovis subsp bovis AF2122/97
agcccgaaccaccgcgu

SEQ ID NO: 1068523 - RNA, 21 nt, Mycobacterium bovis subsp bovis AF2122/97
agcccgaacgaggcgcccagc

SEQ ID NO: 1068524 - RNA, 17 nt, Mycobacterium bovis subsp bovis AF2122/97
agcccgaagacggggug

SEQ ID NO: 1068525 - RNA, 18 nt, Mycobacterium bovis subsp bovis AF2122/97
agcccgacaccguccagc

SEQ ID NO: 1068526 - RNA, 17 nt, Mycobacterium bovis subsp bovis AF2122/97
agccccugaaggccagc

SEQ ID NO: 1068527 - RNA, 12 nt, Mycobacterium bovis subsp bovis AF2122/97
agccccugccga

SEQ ID NO: 1068528 - RNA, 15 nt, Mycobacterium bovis subsp bovis AF2122/97
agccccuccgcgccg

SEQ ID NO: 1068529 - RNA, 18 nt, Mycobacterium bovis subsp bovis AF2122/97
agccccucaccucggcuu

SEQ ID NO: 1068530 - RNA, 13 nt, Mycobacterium bovis subsp bovis AF2122/97
agccccgucgacc

SEQ ID NO: 1068531 - RNA, 18 nt, Mycobacterium bovis subsp bovis AF2122/97
agccccgucgaccuccac

SEQ ID NO: 1068532 - RNA, 19 nt, Mycobacterium bovis subsp bovis AF2122/97
agccccgcuggucgaccgg

SEQ ID NO: 1068533 - RNA, 17 nt, Mycobacterium bovis subsp bovis AF2122/97
agcccaugucgagcacg

SEQ ID NO: 1068534 - RNA, 21 nt, Mycobacterium bovis subsp bovis AF2122/97
agccccgcgcguucggcgagc

SEQ ID NO: 1068535 - RNA, 19 nt, Mycobacterium bovis subsp bovis AF2122/97
agcccaccggcgccgccgg

SEQ ID NO: 1068536 - RNA, 13 nt, Mycobacterium bovis subsp bovis AF2122/97
agcccacccgggu

SEQ ID NO: 1068537 - RNA, 15 nt, Mycobacterium bovis subsp bovis AF2122/97
agcccacccgggugg

SEQ ID NO: 1068538 - RNA, 12 nt, Mycobacterium bovis subsp bovis AF2122/97
agcccaccgucg

SEQ ID NO: 1068539 - RNA, 22 nt, Mycobacterium bovis subsp bovis AF2122/97
agcccaccgucugcuggccggg

SEQ ID NO: 1068540 - RNA, 17 nt, Mycobacterium bovis subsp bovis AF2122/97
agcccacgacgaagucg

SEQ ID NO: 1068541 - RNA, 14 nt, Mycobacterium bovis subsp bovis AF2122/97
agcccacgcgccac

SEQ ID NO: 1068542 - RNA, 19 nt, Mycobacterium bovis subsp bovis AF2122/97
agcccagccguucgucgcg

SEQ ID NO: 1068543 - RNA, 14 nt, Mycobacterium bovis subsp bovis AF2122/97
agcccagccgggca

SEQ ID NO: 1068544 - RNA, 17 nt, Mycobacterium bovis subsp bovis AF2122/97
agcccagccgcgggccg

SEQ ID NO: 1068545 - RNA, 21 nt, Mycobacterium bovis subsp bovis AF2122/97
agcccaggcgaucgcccggcc

SEQ ID NO: 1068546 - RNA, 14 nt, Mycobacterium bovis subsp bovis AF2122/97
agccaggucgauac

SEQ ID NO: 1068547 - RNA, 20 nt, Mycobacterium bovis subsp bovis AF2122/97
agccaggucgauaccggcgu

SEQ ID NO: 1068548 - RNA, 15 nt, Mycobacterium bovis subsp bovis AF2122/97
agccagggccgcaua

SEQ ID NO: 1068549 - RNA, 21 nt, Mycobacterium bovis subsp bovis AF2122/97
agccaggccuuggugcggccg

SEQ ID NO: 1068550 - RNA, 11 nt, Mycobacterium bovis subsp bovis AF2122/97
agccaggcgaa

SEQ ID NO: 1068551 - RNA, 11 nt, Mycobacterium bovis subsp bovis AF2122/97
agccaggcggu

SEQ ID NO: 1068552 - RNA, 19 nt, Mycobacterium bovis subsp bovis AF2122/97
agccaggcggcaaggacgg

SEQ ID NO: 1068553 - RNA, 19 nt, Mycobacterium bovis subsp bovis AF2122/97
agccauuuccuuggcgcug

SEQ ID NO: 1068554 - RNA, 16 nt, Mycobacterium bovis subsp bovis AF2122/97
agccaguaccagguac

SEQ ID NO: 1068555 - RNA, 17 nt, Mycobacterium bovis subsp bovis AF2122/97
agcccaaaaacggcagc

SEQ ID NO: 1068556 - RNA, 18 nt, Mycobacterium bovis subsp bovis AF2122/97
agcccaaaaagaccgccg

SEQ ID NO: 1068557 - RNA, 20 nt, Mycobacterium bovis subsp bovis AF2122/97
agcccaaaucccagagcauc

SEQ ID NO: 1068558 - RNA, 16 nt, Mycobacterium bovis subsp bovis AF2122/97
agccaguccagcgcgc

SEQ ID NO: 1068559 - RNA, 17 nt, Mycobacterium bovis subsp bovis AF2122/97
agcccaacucggccagc

SEQ ID NO: 1068560 - RNA, 17 nt, Mycobacterium bovis subsp bovis AF2122/97
agcccaagccgaucggu

SEQ ID NO: 1068561 - RNA, 21 nt, Mycobacterium bovis subsp bovis AF2122/97
agcccaauccgcaacagcucg

SEQ ID NO: 1068562 - RNA, 15 nt, Mycobacterium bovis subsp bovis AF2122/97
agcccaaggggcagc

SEQ ID NO: 1068563 - RNA, 21 nt, Mycobacterium bovis subsp bovis AF2122/97
agcccaaggggcagcgacggc

SEQ ID NO: 1068564 - RNA, 18 nt, Mycobacterium bovis subsp bovis AF2122/97
agcccguagccgaucagu

SEQ ID NO: 1068565 - RNA, 20 nt, Mycobacterium bovis subsp bovis AF2122/97
agcccggucgcugauccggg

SEQ ID NO: 1068566 - RNA, 18 nt, Mycobacterium bovis subsp bovis AF2122/97
agcccggugcuaccggcu

SEQ ID NO: 1068567 - RNA, 18 nt, Mycobacterium bovis subsp bovis AF2122/97
agcccgguacgccgcgcc

SEQ ID NO: 1068568 - RNA, 18 nt, Mycobacterium bovis subsp bovis AF2122/97
agcccgguaucgucccgg

SEQ ID NO: 1068569 - RNA, 23 nt, Mycobacterium bovis subsp bovis AF2122/97
agcccgggugaaacgauggcgau

SEQ ID NO: 1068570 - RNA, 17 nt, Mycobacterium bovis subsp bovis AF2122/97
agcccgucagcuccccg

SEQ ID NO: 1068571 - RNA, 22 nt, Mycobacterium bovis subsp bovis AF2122/97
agcccguccaggcgcugcagca

SEQ ID NO: 1068572 - RNA, 15 nt, Mycobacterium bovis subsp bovis AF2122/97
agccgaagcgcccgg

SEQ ID NO: 1068573 - RNA, 19 nt, Mycobacterium bovis subsp bovis AF2122/97
agccgaagcgcccguuggc

SEQ ID NO: 1068574 - RNA, 15 nt, Mycobacterium bovis subsp bovis AF2122/97
agccgaccguaccga

SEQ ID NO: 1068575 - RNA, 22 nt, Mycobacterium bovis subsp bovis AF2122/97
agccgaccguaccgauccaguu

SEQ ID NO: 1068576 - RNA, 12 nt, Mycobacterium bovis subsp bovis AF2122/97
agccgacccgac

SEQ ID NO: 1068577 - RNA, 14 nt, Mycobacterium bovis subsp bovis AF2122/97
agccgacccgacgc

SEQ ID NO: 1068578 - RNA, 16 nt, Mycobacterium bovis subsp bovis AF2122/97
agccgacccgcccgaa

SEQ ID NO: 1068579 - RNA, 19 nt, Mycobacterium bovis subsp bovis AF2122/97
agccgacagcucaucgauc

SEQ ID NO: 1068580 - RNA, 17 nt, Mycobacterium bovis subsp bovis AF2122/97
agccgaccaggaccacc

SEQ ID NO: 1068581 - RNA, 16 nt, Mycobacterium bovis subsp bovis AF2122/97
agccgacgaacgacgg

SEQ ID NO: 1068582 - RNA, 17 nt, Mycobacterium bovis subsp bovis AF2122/97
agccgacgaacgacggg

SEQ ID NO: 1068583 - RNA, 16 nt, Mycobacterium bovis subsp bovis AF2122/97
agccgacgaccagcag

SEQ ID NO: 1068584 - RNA, 22 nt, Mycobacterium bovis subsp bovis AF2122/97
agccgacgcacgugaugcccug

SEQ ID NO: 1068585 - RNA, 15 nt, Mycobacterium bovis subsp bovis AF2122/97
agccgacgccggugc

SEQ ID NO: 1068586 - RNA, 16 nt, Mycobacterium bovis subsp bovis AF2122/97
agccgacgccggugcc

SEQ ID NO: 1068587 - RNA, 17 nt, Mycobacterium bovis subsp bovis AF2122/97
agccgacgccggugccg

SEQ ID NO: 1068588 - RNA, 18 nt, Mycobacterium bovis subsp bovis AF2122/97
agccgacgccggugccgg

SEQ ID NO: 1068589 - RNA, 17 nt, Mycobacterium bovis subsp bovis AF2122/97
agccgacgugcggcggc

SEQ ID NO: 1068590 - RNA, 18 nt, Mycobacterium bovis subsp bovis AF2122/97
agccgacgugcggcggcc

SEQ ID NO: 1068591 - RNA, 15 nt, Mycobacterium bovis subsp bovis AF2122/97
agccgagaccacgcg

SEQ ID NO: 1068592 - RNA, 18 nt, Mycobacterium bovis subsp bovis AF2122/97
agccgagaccacgcgcgu

SEQ ID NO: 1068593 - RNA, 14 nt, Mycobacterium bovis subsp bovis AF2122/97
agccgacgucgccg

SEQ ID NO: 1068594 - RNA, 15 nt, Mycobacterium bovis subsp bovis AF2122/97
agccgacgucgccga

SEQ ID NO: 1068595 - RNA, 19 nt, Mycobacterium bovis subsp bovis AF2122/97
agccgcaaaaucgaugacg

SEQ ID NO: 1068596 - RNA, 13 nt, Mycobacterium bovis subsp bovis AF2122/97
agccgagcaucag

SEQ ID NO: 1068597 - RNA, 16 nt, Mycobacterium bovis subsp bovis AF2122/97
agccgagcgcccgcaa

SEQ ID NO: 1068598 - RNA, 15 nt, Mycobacterium bovis subsp bovis AF2122/97
agccgagcggcggca

SEQ ID NO: 1068599 - RNA, 15 nt, Mycobacterium bovis subsp bovis AF2122/97
agccgcaccgcuguu

SEQ ID NO: 1068600 - RNA, 20 nt, Mycobacterium bovis subsp bovis AF2122/97
agccgcaccaguggcgccca

SEQ ID NO: 1068601 - RNA, 12 nt, Mycobacterium bovis subsp bovis AF2122/97
agccgccggccc

SEQ ID NO: 1068602 - RNA, 22 nt, Mycobacterium bovis subsp bovis AF2122/97
agccgccggccccgccagcgcc

SEQ ID NO: 1068603 - RNA, 23 nt, Mycobacterium bovis subsp bovis AF2122/97
agccgccggccccgccagcgccg

SEQ ID NO: 1068604 - RNA, 12 nt, Mycobacterium bovis subsp bovis AF2122/97
agccgccggcgc

SEQ ID NO: 1068605 - RNA, 16 nt, Mycobacterium bovis subsp bovis AF2122/97
agccgccggcgccagc

SEQ ID NO: 1068606 - RNA, 19 nt, Mycobacterium bovis subsp bovis AF2122/97
agccgccggcgccagcgcc

SEQ ID NO: 1068607 - RNA, 23 nt, Mycobacterium bovis subsp bovis AF2122/97
agccgccggcgccagcgccgcca

SEQ ID NO: 1068608 - RNA, 13 nt, Mycobacterium bovis subsp bovis AF2122/97
agccgccggcggu

SEQ ID NO: 1068609 - RNA, 14 nt, Mycobacterium bovis subsp bovis AF2122/97
agccgccggugccg

SEQ ID NO: 1068610 - RNA, 21 nt, Mycobacterium bovis subsp bovis AF2122/97
agccgccggugccgccggugc

SEQ ID NO: 1068611 - RNA, 23 nt, Mycobacterium bovis subsp bovis AF2122/97
agccgccgggugcgccguugccg

SEQ ID NO: 1068612 - RNA, 20 nt, Mycobacterium bovis subsp bovis AF2122/97
agccgcacgaugccgggaac

SEQ ID NO: 1068613 - RNA, 15 nt, Mycobacterium bovis subsp bovis AF2122/97
agccgcacgguugcc

SEQ ID NO: 1068614 - RNA, 13 nt, Mycobacterium bovis subsp bovis AF2122/97
agccgccguugcc

SEQ ID NO: 1068615 - RNA, 20 nt, Mycobacterium bovis subsp bovis AF2122/97
agccgccguugccgccggcg

SEQ ID NO: 1068616 - RNA, 23 nt, Mycobacterium bovis subsp bovis AF2122/97
agccgccguugccgccggcgccg

SEQ ID NO: 1068617 - RNA, 23 nt, Mycobacterium bovis subsp bovis AF2122/97
agccgccuaggacuucggugagc

SEQ ID NO: 1068618 - RNA, 18 nt, Mycobacterium bovis subsp bovis AF2122/97
agccgccguggauacgca

SEQ ID NO: 1068619 - RNA, 15 nt, Mycobacterium bovis subsp bovis AF2122/97
agccgccgucgccgg

SEQ ID NO: 1068620 - RNA, 19 nt, Mycobacterium bovis subsp bovis AF2122/97
agccgccgucgccggugcc

SEQ ID NO: 1068621 - RNA, 20 nt, Mycobacterium bovis subsp bovis AF2122/97
agccgccgucgccggugccg

SEQ ID NO: 1068622 - RNA, 23 nt, Mycobacterium bovis subsp bovis AF2122/97
agccgccguggaacacgaagucg

SEQ ID NO: 1068623 - RNA, 17 nt, Mycobacterium bovis subsp bovis AF2122/97
aaacgagccggugcgcg

SEQ ID NO: 1068624 - RNA, 16 nt, Mycobacterium bovis subsp bovis AF2122/97
aaaccguggccgcgau

SEQ ID NO: 1068625 - RNA, 21 nt, Mycobacterium bovis subsp bovis AF2122/97
agccgcgaaauuacuucggcc

SEQ ID NO: 1068626 - RNA, 21 nt, Mycobacterium bovis subsp bovis AF2122/97
agcacccggcuguucucgccg

SEQ ID NO: 1068627 - RNA, 15 nt, Mycobacterium bovis subsp bovis AF2122/97
agcacccggcuucgc

SEQ ID NO: 1068628 - RNA, 23 nt, Mycobacterium bovis subsp bovis AF2122/97
agcacccgcgccaguaacgccca

SEQ ID NO: 1068629 - RNA, 22 nt, Mycobacterium bovis subsp bovis AF2122/97
agcacccgcuccagcucggcgg

SEQ ID NO: 1068630 - RNA, 22 nt, Mycobacterium bovis subsp bovis AF2122/97
agcacccgcucggccgccgggu

SEQ ID NO: 1068631 - RNA, 15 nt, Mycobacterium bovis subsp bovis AF2122/97
agcacccgaaccggg

SEQ ID NO: 1068632 - RNA, 14 nt, Mycobacterium bovis subsp bovis AF2122/97
agcaccccgccggg

SEQ ID NO: 1068633 - RNA, 15 nt, Mycobacterium bovis subsp bovis AF2122/97
agcaccccgccgggg

SEQ ID NO: 1068634 - RNA, 17 nt, Mycobacterium bovis subsp bovis AF2122/97
agcacccaccgaagcga

SEQ ID NO: 1068635 - RNA, 18 nt, Mycobacterium bovis subsp bovis AF2122/97
agcacccacgccgguggc

SEQ ID NO: 1068636 - RNA, 14 nt, Mycobacterium bovis subsp bovis AF2122/97
agcacccacggcga

SEQ ID NO: 1068637 - RNA, 20 nt, Mycobacterium bovis subsp bovis AF2122/97
agcaccaguuugugccgccg

SEQ ID NO: 1068638 - RNA, 15 nt, Mycobacterium bovis subsp bovis AF2122/97
agcacccaacccggc

SEQ ID NO: 1068639 - RNA, 13 nt, Mycobacterium bovis subsp bovis AF2122/97
agcaccagguugu

SEQ ID NO: 1068640 - RNA, 21 nt, Mycobacterium bovis subsp bovis AF2122/97
agcaccaguuugugccgccgc

SEQ ID NO: 1068641 - RNA, 17 nt, Mycobacterium bovis subsp bovis AF2122/97
agcaccagcagcaccaa

SEQ ID NO: 1068642 - RNA, 13 nt, Mycobacterium bovis subsp bovis AF2122/97
agcaccagccacg

SEQ ID NO: 1068643 - RNA, 13 nt, Mycobacterium bovis subsp bovis AF2122/97
agcaccagccagc

SEQ ID NO: 1068644 - RNA, 14 nt, Mycobacterium bovis subsp bovis AF2122/97
agcaccagccagcc

SEQ ID NO: 1068645 - RNA, 16 nt, Mycobacterium bovis subsp bovis AF2122/97
agcaccacggccagcg

SEQ ID NO: 1068646 - RNA, 21 nt, Mycobacterium bovis subsp bovis AF2122/97
agcacaugcucgacgcccgcc

SEQ ID NO: 1068647 - RNA, 13 nt, Mycobacterium bovis subsp bovis AF2122/97
agcaccacggcgc

SEQ ID NO: 1068648 - RNA, 22 nt, Mycobacterium bovis subsp bovis AF2122/97
agcaccaccccagcggccaccg

SEQ ID NO: 1068649 - RNA, 14 nt, Mycobacterium bovis subsp bovis AF2122/97
agcacagcccggcg

SEQ ID NO: 1068650 - RNA, 15 nt, Mycobacterium bovis subsp bovis AF2122/97
agcacagcccggcga

SEQ ID NO: 1068651 - RNA, 17 nt, Mycobacterium bovis subsp bovis AF2122/97
agcacagcccggcgacg

SEQ ID NO: 1068652 - RNA, 15 nt, Mycobacterium bovis subsp bovis AF2122/97
agcacaccgucgacg

SEQ ID NO: 1068653 - RNA, 16 nt, Mycobacterium bovis subsp bovis AF2122/97
agcaccaaaugccccg

SEQ ID NO: 1068654 - RNA, 17 nt, Mycobacterium bovis subsp bovis AF2122/97
agcaccaagaccguucg

SEQ ID NO: 1068655 - RNA, 22 nt, Mycobacterium bovis subsp bovis AF2122/97
agcacaugguccaaccagcacc

SEQ ID NO: 1068656 - RNA, 14 nt, Mycobacterium bovis subsp bovis AF2122/97
agcaccgccgcgcc

SEQ ID NO: 1068657 - RNA, 15 nt, Mycobacterium bovis subsp bovis AF2122/97
agcaccgccgcgccg

SEQ ID NO: 1068658 - RNA, 13 nt, Mycobacterium bovis subsp bovis AF2122/97
agcaccgccggcg

SEQ ID NO: 1068659 - RNA, 15 nt, Mycobacterium bovis subsp bovis AF2122/97
agcaccgccggugcg

SEQ ID NO: 1068660 - RNA, 12 nt, Mycobacterium bovis subsp bovis AF2122/97
agcaccgcgccg

SEQ ID NO: 1068661 - RNA, 21 nt, Mycobacterium bovis subsp bovis AF2122/97
agcaccgcgaacauggugcgg

SEQ ID NO: 1068662 - RNA, 15 nt, Mycobacterium bovis subsp bovis AF2122/97
agcaccgacaccggc

SEQ ID NO: 1068663 - RNA, 18 nt, Mycobacterium bovis subsp bovis AF2122/97
agcaccgacaccggccgc

SEQ ID NO: 1068664 - RNA, 18 nt, Mycobacterium bovis subsp bovis AF2122/97
agcaccgcagcgaccacc

SEQ ID NO: 1068665 - RNA, 19 nt, Mycobacterium bovis subsp bovis AF2122/97
agcaccgcagcgaccaccg

SEQ ID NO: 1068666 - RNA, 18 nt, Mycobacterium bovis subsp bovis AF2122/97
agcaccgaauuacgcacc

SEQ ID NO: 1068667 - RNA, 19 nt, Mycobacterium bovis subsp bovis AF2122/97
agcacccucaggcaaucgc

SEQ ID NO: 1068668 - RNA, 15 nt, Mycobacterium bovis subsp bovis AF2122/97
agcaccgaacccgcc

SEQ ID NO: 1068669 - RNA, 19 nt, Mycobacterium bovis subsp bovis AF2122/97
agcaccgaacccgccaccg

SEQ ID NO: 1068670 - RNA, 15 nt, Mycobacterium bovis subsp bovis AF2122/97
agcaccgggaagucg

SEQ ID NO: 1068671 - RNA, 22 nt, Mycobacterium bovis subsp bovis AF2122/97
agcaccgcucgguccagccggu

SEQ ID NO: 1068672 - RNA, 15 nt, Mycobacterium bovis subsp bovis AF2122/97
agcaccgcuggcagc

SEQ ID NO: 1068673 - RNA, 22 nt, Mycobacterium bovis subsp bovis AF2122/97
agcaccgggcucagacuuucgc

SEQ ID NO: 1068674 - RNA, 22 nt, Mycobacterium bovis subsp bovis AF2122/97
agcaccgacuucagcaacgcau

SEQ ID NO: 1068675 - RNA, 20 nt, Mycobacterium bovis subsp bovis AF2122/97
agcaccggggacagcccggc

SEQ ID NO: 1068676 - RNA, 20 nt, Mycobacterium bovis subsp bovis AF2122/97
agcaccguucgcagcaccac

SEQ ID NO: 1068677 - RNA, 22 nt, Mycobacterium bovis subsp bovis AF2122/97
agcaccucagaaaguccccgca

SEQ ID NO: 1068678 - RNA, 18 nt, Mycobacterium bovis subsp bovis AF2122/97
agcaccuccaccgcgccg

SEQ ID NO: 1068679 - RNA, 19 nt, Mycobacterium bovis subsp bovis AF2122/97
agcaccuccaccgcgccgg

SEQ ID NO: 1068680 - RNA, 18 nt, Mycobacterium bovis subsp bovis AF2122/97
agcaacggcggcgucgcg

SEQ ID NO: 1068681 - RNA, 19 nt, Mycobacterium bovis subsp bovis AF2122/97
agcaacggcggcgucgcgg

SEQ ID NO: 1068682 - RNA, 20 nt, Mycobacterium bovis subsp bovis AF2122/97
agcaacgcccaacgucgcca

SEQ ID NO: 1068683 - RNA, 20 nt, Mycobacterium bovis subsp bovis AF2122/97
agcaacgaagccggcgccgg

SEQ ID NO: 1068684 - RNA, 22 nt, Mycobacterium bovis subsp bovis AF2122/97
agcaacgacccgaagccgaccg

SEQ ID NO: 1068685 - RNA, 16 nt, Mycobacterium bovis subsp bovis AF2122/97
agcaacgaagccggcg

SEQ ID NO: 1068686 - RNA, 18 nt, Mycobacterium bovis subsp bovis AF2122/97
agcaacaccagaugcacc

SEQ ID NO: 1068687 - RNA, 13 nt, Mycobacterium bovis subsp bovis AF2122/97
agcaaagccagcg

SEQ ID NO: 1068688 - RNA, 12 nt, Mycobacterium bovis subsp bovis AF2122/97
agcaaaccgcgc

SEQ ID NO: 1068689 - RNA, 21 nt, Mycobacterium bovis subsp bovis AF2122/97
agcaaacaucgcaggcacccc

SEQ ID NO: 1068690 - RNA, 18 nt, Mycobacterium bovis subsp bovis AF2122/97
agcaaaaaccagcgucca

SEQ ID NO: 1068691 - RNA, 13 nt, Mycobacterium bovis subsp bovis AF2122/97
acuuuccggccga

SEQ ID NO: 1068692 - RNA, 23 nt, Mycobacterium bovis subsp bovis AF2122/97
acuuucacgcucguuugcgagca

SEQ ID NO: 1068693 - RNA, 16 nt, Mycobacterium bovis subsp bovis AF2122/97
agcacaccgacagcac

SEQ ID NO: 1068694 - RNA, 13 nt, Mycobacterium bovis subsp bovis AF2122/97
agcacaccgccag

SEQ ID NO: 1068695 - RNA, 15 nt, Mycobacterium bovis subsp bovis AF2122/97
agcacaccgcccgca

SEQ ID NO: 1068696 - RNA, 15 nt, Mycobacterium bovis subsp bovis AF2122/97
agcaaugcccgcacc

SEQ ID NO: 1068697 - RNA, 22 nt, Mycobacterium bovis subsp bovis AF2122/97
agcaauacggcggcgccgccca

SEQ ID NO: 1068698 - RNA, 21 nt, Mycobacterium bovis subsp bovis AF2122/97
agcaauccgcacagcgacgag

SEQ ID NO: 1068699 - RNA, 13 nt, Mycobacterium bovis subsp bovis AF2122/97
agcaaugccaacg

SEQ ID NO: 1068700 - RNA, 15 nt, Mycobacterium bovis subsp bovis AF2122/97
agcaauccgcacagc

SEQ ID NO: 1068701 - RNA, 22 nt, Mycobacterium bovis subsp bovis AF2122/97
agcaacggcggcaggccggcca

SEQ ID NO: 1068702 - RNA, 17 nt, Mycobacterium bovis subsp bovis AF2122/97
agcaacucguccagcag

SEQ ID NO: 1068703 - RNA, 23 nt, Mycobacterium bovis subsp bovis AF2122/97
agcaagacgaugacagacaucgc

SEQ ID NO: 1068704 - RNA, 14 nt, Mycobacterium bovis subsp bovis AF2122/97
agcaagagccgcag

SEQ ID NO: 1068705 - RNA, 12 nt, Mycobacterium bovis subsp bovis AF2122/97
agcaagucugcc

SEQ ID NO: 1068706 - RNA, 13 nt, Mycobacterium bovis subsp bovis AF2122/97
agcaagucgccga

SEQ ID NO: 1068707 - RNA, 15 nt, Mycobacterium bovis subsp bovis AF2122/97
agcaaggcccgaaac

SEQ ID NO: 1068708 - RNA, 12 nt, Mycobacterium bovis subsp bovis AF2122/97
agcagccacgau

SEQ ID NO: 1068709 - RNA, 21 nt, Mycobacterium bovis subsp bovis AF2122/97
agcagccacgauccuuggcgu

SEQ ID NO: 1068710 - RNA, 23 nt, Mycobacterium bovis subsp bovis AF2122/97
agcagcccgggugaaacgauggc

SEQ ID NO: 1068711 - RNA, 15 nt, Mycobacterium bovis subsp bovis AF2122/97
agcagcagcccgaca

SEQ ID NO: 1068712 - RNA, 16 nt, Mycobacterium bovis subsp bovis AF2122/97
agcagcagcggcggcg

SEQ ID NO: 1068713 - RNA, 19 nt, Mycobacterium bovis subsp bovis AF2122/97
agcagcaucggcacgucgu

SEQ ID NO: 1068714 - RNA, 13 nt, Mycobacterium bovis subsp bovis AF2122/97
agcagcagguaca

SEQ ID NO: 1068715 - RNA, 20 nt, Mycobacterium bovis subsp bovis AF2122/97
agcagcagguacaucaccac

SEQ ID NO: 1068716 - RNA, 13 nt, Mycobacterium bovis subsp bovis AF2122/97
agcagcagcgccg

SEQ ID NO: 1068717 - RNA, 22 nt, Mycobacterium bovis subsp bovis AF2122/97
agcagcagcgugaccaccgccg

SEQ ID NO: 1068718 - RNA, 13 nt, Mycobacterium bovis subsp bovis AF2122/97
agcagcagacgac

SEQ ID NO: 1068719 - RNA, 18 nt, Mycobacterium bovis subsp bovis AF2122/97
agcagcaccugcaccgca

SEQ ID NO: 1068720 - RNA, 17 nt, Mycobacterium bovis subsp bovis AF2122/97
agcagcaagaccgcgcc

SEQ ID NO: 1068721 - RNA, 19 nt, Mycobacterium bovis subsp bovis AF2122/97
agcagcaauccaaggcuca

SEQ ID NO: 1068722 - RNA, 23 nt, Mycobacterium bovis subsp bovis AF2122/97
agcagcaauccaaggcucagcag

SEQ ID NO: 1068723 - RNA, 14 nt, Mycobacterium bovis subsp bovis AF2122/97
agcagcaacgcggu

SEQ ID NO: 1068724 - RNA, 14 nt, Mycobacterium bovis subsp bovis AF2122/97
agcagcaccgacgu

SEQ ID NO: 1068725 - RNA, 21 nt, Mycobacterium bovis subsp bovis AF2122/97
agcagcaacgcggugccggga

SEQ ID NO: 1068726 - RNA, 23 nt, Mycobacterium bovis subsp bovis AF2122/97
agcagcaccaacugaauggcacc

SEQ ID NO: 1068727 - RNA, 22 nt, Mycobacterium bovis subsp bovis AF2122/97
agcagauggguacccgaucacu

SEQ ID NO: 1068728 - RNA, 23 nt, Mycobacterium bovis subsp bovis AF2122/97
aaaccggcgguuuuggggugcuu

SEQ ID NO: 1068729 - RNA, 22 nt, Mycobacterium bovis subsp bovis AF2122/97
aaaccggugguagcgacgaugu

SEQ ID NO: 1068730 - RNA, 16 nt, Mycobacterium bovis subsp bovis AF2122/97
aaaccgauaucgcugc

SEQ ID NO: 1068731 - RNA, 14 nt, Mycobacterium bovis subsp bovis AF2122/97
aaaccgcagcgcga

SEQ ID NO: 1068732 - RNA, 12 nt, Mycobacterium bovis subsp bovis AF2122/97
aaaccgcaccgu

SEQ ID NO: 1068733 - RNA, 20 nt, Mycobacterium bovis subsp bovis AF2122/97
agcagacgcaaaagcccccu

SEQ ID NO: 1068734 - RNA, 17 nt, Mycobacterium bovis subsp bovis AF2122/97
agcagacgcaaaauccc

SEQ ID NO: 1068735 - RNA, 21 nt, Mycobacterium bovis subsp bovis AF2122/97
agcagacgcaaaauccccucg

SEQ ID NO: 1068736 - RNA, 18 nt, Mycobacterium bovis subsp bovis AF2122/97
agcagacgcaaaaucgca

SEQ ID NO: 1068737 - RNA, 22 nt, Mycobacterium bovis subsp bovis AF2122/97
agcagacgacgaucagccccag

SEQ ID NO: 1068738 - RNA, 20 nt, Mycobacterium bovis subsp bovis AF2122/97
agcagacgcaaaaucgcacg

SEQ ID NO: 1068739 - RNA, 13 nt, Mycobacterium bovis subsp bovis AF2122/97
agcagacgcagaa

SEQ ID NO: 1068740 - RNA, 18 nt, Mycobacterium bovis subsp bovis AF2122/97
agcagacgcagaaucgca

SEQ ID NO: 1068741 - RNA, 19 nt, Mycobacterium bovis subsp bovis AF2122/97
agcagacgcagaaucgcac

SEQ ID NO: 1068742 - RNA, 20 nt, Mycobacterium bovis subsp bovis AF2122/97
agcagacgcagaaucgcacg

SEQ ID NO: 1068743 - RNA, 20 nt, Mycobacterium bovis subsp bovis AF2122/97
agcagacgcagaaucgcaug

SEQ ID NO: 1068744 - RNA, 20 nt, Mycobacterium bovis subsp bovis AF2122/97
agcagacgcagaaucgcauu

SEQ ID NO: 1068745 - RNA, 21 nt, Mycobacterium bovis subsp bovis AF2122/97
agcagacgccguagccggccg

SEQ ID NO: 1068746 - RNA, 17 nt, Mycobacterium bovis subsp bovis AF2122/97
agcagacgcgaaauccc

SEQ ID NO: 1068747 - RNA, 19 nt, Mycobacterium bovis subsp bovis AF2122/97
agcagacgcggaaucgcac

SEQ ID NO: 1068748 - RNA, 21 nt, Mycobacterium bovis subsp bovis AF2122/97
agcagacgcggaaucgcaucg

SEQ ID NO: 1068749 - RNA, 20 nt, Mycobacterium bovis subsp bovis AF2122/97
agcagacgcuaaagcccccg

SEQ ID NO: 1068750 - RNA, 18 nt, Mycobacterium bovis subsp bovis AF2122/97
agcagacgcagaaucgcc

SEQ ID NO: 1068751 - RNA, 20 nt, Mycobacterium bovis subsp bovis AF2122/97
agcagacgcagaaucgccca

SEQ ID NO: 1068752 - RNA, 20 nt, Mycobacterium bovis subsp bovis AF2122/97
agcagacgcagaaucgccua

SEQ ID NO: 1068753 - RNA, 20 nt, Mycobacterium bovis subsp bovis AF2122/97
agcagacgcagagucgcacu

SEQ ID NO: 1068754 - RNA, 16 nt, Mycobacterium bovis subsp bovis AF2122/97
agcagacgcagccacg

SEQ ID NO: 1068755 - RNA, 20 nt, Mycobacterium bovis subsp bovis AF2122/97
agcagacgcauaagcccccg

SEQ ID NO: 1068756 - RNA, 18 nt, Mycobacterium bovis subsp bovis AF2122/97
agcagacgucaugcggau

SEQ ID NO: 1068757 - RNA, 20 nt, Mycobacterium bovis subsp bovis AF2122/97
agcagacguaaaagcccccg

SEQ ID NO: 1068758 - RNA, 20 nt, Mycobacterium bovis subsp bovis AF2122/97
agcagacgcggaaucgcauc

SEQ ID NO: 1068759 - RNA, 20 nt, Mycobacterium bovis subsp bovis AF2122/97
agcagacguaaaagccccca

SEQ ID NO: 1068760 - RNA, 18 nt, Mycobacterium bovis subsp bovis AF2122/97
agcagagacaugccggcg

SEQ ID NO: 1068761 - RNA, 14 nt, Mycobacterium bovis subsp bovis AF2122/97
agcacggcuucgac

SEQ ID NO: 1068762 - RNA, 17 nt, Mycobacterium bovis subsp bovis AF2122/97
agcacgggcacgaucgu

SEQ ID NO: 1068763 - RNA, 17 nt, Mycobacterium bovis subsp bovis AF2122/97
agcacggggaccgggcu

SEQ ID NO: 1068764 - RNA, 17 nt, Mycobacterium bovis subsp bovis AF2122/97
agcacggguagcgucca

SEQ ID NO: 1068765 - RNA, 14 nt, Mycobacterium bovis subsp bovis AF2122/97
agcacgcugcugcg

SEQ ID NO: 1068766 - RNA, 22 nt, Mycobacterium bovis subsp bovis AF2122/97
agcacgucacgcgcggcggcgu

SEQ ID NO: 1068767 - RNA, 16 nt, Mycobacterium bovis subsp bovis AF2122/97
agcacguaucgaagcu

SEQ ID NO: 1068768 - RNA, 15 nt, Mycobacterium bovis subsp bovis AF2122/97
agcacggugagccgg

SEQ ID NO: 1068769 - RNA, 17 nt, Mycobacterium bovis subsp bovis AF2122/97
agcacgguggccgagcc

SEQ ID NO: 1068770 - RNA, 22 nt, Mycobacterium bovis subsp bovis AF2122/97
agcacgguggccgagccgcggu

SEQ ID NO: 1068771 - RNA, 12 nt, Mycobacterium bovis subsp bovis AF2122/97
agcacgucccgg

SEQ ID NO: 1068772 - RNA, 11 nt, Mycobacterium bovis subsp bovis AF2122/97
agcacguccgc

SEQ ID NO: 1068773 - RNA, 15 nt, Mycobacterium bovis subsp bovis AF2122/97
agcacuaaucggcca

SEQ ID NO: 1068774 - RNA, 20 nt, Mycobacterium bovis subsp bovis AF2122/97
agcacuccaccgcuggcccg

SEQ ID NO: 1068775 - RNA, 15 nt, Mycobacterium bovis subsp bovis AF2122/97
agcacguucaccgcg

SEQ ID NO: 1068776 - RNA, 15 nt, Mycobacterium bovis subsp bovis AF2122/97
agcacguugcacagc

SEQ ID NO: 1068777 - RNA, 15 nt, Mycobacterium bovis subsp bovis AF2122/97
agcacgucgaacucg

SEQ ID NO: 1068778 - RNA, 14 nt, Mycobacterium bovis subsp bovis AF2122/97
agcacgucgucgcg

SEQ ID NO: 1068779 - RNA, 21 nt, Mycobacterium bovis subsp bovis AF2122/97
agcacucgggauucggcagcg

SEQ ID NO: 1068780 - RNA, 15 nt, Mycobacterium bovis subsp bovis AF2122/97
agcacuccggcgacg

SEQ ID NO: 1068781 - RNA, 18 nt, Mycobacterium bovis subsp bovis AF2122/97
agcacuccgucguaguug

SEQ ID NO: 1068782 - RNA, 23 nt, Mycobacterium bovis subsp bovis AF2122/97
agcacuuggacccggccggcccg

SEQ ID NO: 1068783 - RNA, 19 nt, Mycobacterium bovis subsp bovis AF2122/97
agcacggugagccgguggc

SEQ ID NO: 1068784 - RNA, 16 nt, Mycobacterium bovis subsp bovis AF2122/97
agcacugggcuggcca

SEQ ID NO: 1068785 - RNA, 22 nt, Mycobacterium bovis subsp bovis AF2122/97
agcagaccaagcccuagcgcau

SEQ ID NO: 1068786 - RNA, 21 nt, Mycobacterium bovis subsp bovis AF2122/97
agcagacgacgaucagcccca

SEQ ID NO: 1068787 - RNA, 20 nt, Mycobacterium bovis subsp bovis AF2122/97
agcagacacagaaucgcacg

SEQ ID NO: 1068788 - RNA, 18 nt, Mycobacterium bovis subsp bovis AF2122/97
agcagacacagaaucgcc

SEQ ID NO: 1068789 - RNA, 19 nt, Mycobacterium bovis subsp bovis AF2122/97
agcagacacagaaucgccc

SEQ ID NO: 1068790 - RNA, 19 nt, Mycobacterium bovis subsp bovis AF2122/97
agcagacacagaaucgcac

SEQ ID NO: 1068791 - RNA, 19 nt, Mycobacterium bovis subsp bovis AF2122/97
agcagacacuaaagcccuc

SEQ ID NO: 1068792 - RNA, 14 nt, Mycobacterium bovis subsp bovis AF2122/97
agcagaaggccagc

SEQ ID NO: 1068793 - RNA, 15 nt, Mycobacterium bovis subsp bovis AF2122/97
agcagaaggccagcg

SEQ ID NO: 1068794 - RNA, 15 nt, Mycobacterium bovis subsp bovis AF2122/97
agcagaaacaucgac

SEQ ID NO: 1068795 - RNA, 18 nt, Mycobacterium bovis subsp bovis AF2122/97
agcacgacgugcgucggc

SEQ ID NO: 1068796 - RNA, 21 nt, Mycobacterium bovis subsp bovis AF2122/97
agcacgacgugcgucggcccg

SEQ ID NO: 1068797 - RNA, 17 nt, Mycobacterium bovis subsp bovis AF2122/97
agcaccucgucgaucgc

SEQ ID NO: 1068798 - RNA, 16 nt, Mycobacterium bovis subsp bovis AF2122/97
agcaccuugcgauugc

SEQ ID NO: 1068799 - RNA, 14 nt, Mycobacterium bovis subsp bovis AF2122/97
agcaccugcaccgc

SEQ ID NO: 1068800 - RNA, 21 nt, Mycobacterium bovis subsp bovis AF2122/97
agcacgaaagucaaucgcguc

SEQ ID NO: 1068801 - RNA, 14 nt, Mycobacterium bovis subsp bovis AF2122/97
agcaccugggcgcg

SEQ ID NO: 1068802 - RNA, 18 nt, Mycobacterium bovis subsp bovis AF2122/97
agcacgcccucgacgcgc

SEQ ID NO: 1068803 - RNA, 15 nt, Mycobacterium bovis subsp bovis AF2122/97
agcacgccagcccca

SEQ ID NO: 1068804 - RNA, 20 nt, Mycobacterium bovis subsp bovis AF2122/97
agcacgaugucgaugccgug

SEQ ID NO: 1068805 - RNA, 15 nt, Mycobacterium bovis subsp bovis AF2122/97
agcacgacgacgucg

SEQ ID NO: 1068806 - RNA, 16 nt, Mycobacterium bovis subsp bovis AF2122/97
agcacgacgacgucgg

SEQ ID NO: 1068807 - RNA, 19 nt, Mycobacterium bovis subsp bovis AF2122/97
agcacgccgagcccgccgg

SEQ ID NO: 1068808 - RNA, 17 nt, Mycobacterium bovis subsp bovis AF2122/97
agcacgccgccggccgc

SEQ ID NO: 1068809 - RNA, 14 nt, Mycobacterium bovis subsp bovis AF2122/97
agcacggcgcggcg

SEQ ID NO: 1068810 - RNA, 22 nt, Mycobacterium bovis subsp bovis AF2122/97
agcacggcgacgaucucggcgg

SEQ ID NO: 1068811 - RNA, 11 nt, Mycobacterium bovis subsp bovis AF2122/97
agcacggcgau

SEQ ID NO: 1068812 - RNA, 14 nt, Mycobacterium bovis subsp bovis AF2122/97
agcacgcgcggcgu

SEQ ID NO: 1068813 - RNA, 15 nt, Mycobacterium bovis subsp bovis AF2122/97
agcacgcugaccaca

SEQ ID NO: 1068814 - RNA, 16 nt, Mycobacterium bovis subsp bovis AF2122/97
aggcgcccaacaggcg

SEQ ID NO: 1068815 - RNA, 21 nt, Mycobacterium bovis subsp bovis AF2122/97
aggcgcccagcgacaacacca

SEQ ID NO: 1068816 - RNA, 14 nt, Mycobacterium bovis subsp bovis AF2122/97
aggcgcagcugguu

SEQ ID NO: 1068817 - RNA, 16 nt, Mycobacterium bovis subsp bovis AF2122/97
aggcgccgaugucguc

SEQ ID NO: 1068818 - RNA, 20 nt, Mycobacterium bovis subsp bovis AF2122/97
aggcgccgcagggccgcgcg

SEQ ID NO: 1068819 - RNA, 14 nt, Mycobacterium bovis subsp bovis AF2122/97
aggcgccgcuaucg

SEQ ID NO: 1068820 - RNA, 17 nt, Mycobacterium bovis subsp bovis AF2122/97
aggcgccgucucgcggu

SEQ ID NO: 1068821 - RNA, 13 nt, Mycobacterium bovis subsp bovis AF2122/97
aggcgcgccgcac

SEQ ID NO: 1068822 - RNA, 21 nt, Mycobacterium bovis subsp bovis AF2122/97
aggcgcgacguagacgacguc

SEQ ID NO: 1068823 - RNA, 19 nt, Mycobacterium bovis subsp bovis AF2122/97
aggcgcgaucgcgcccgcu

SEQ ID NO: 1068824 - RNA, 13 nt, Mycobacterium bovis subsp bovis AF2122/97
aggcgccgcgaca

SEQ ID NO: 1068825 - RNA, 16 nt, Mycobacterium bovis subsp bovis AF2122/97
aggcgcuggcccgcca

SEQ ID NO: 1068826 - RNA, 15 nt, Mycobacterium bovis subsp bovis AF2122/97
aggcggaccaggccg

SEQ ID NO: 1068827 - RNA, 20 nt, Mycobacterium bovis subsp bovis AF2122/97
aggcgcuucgccacaccaug

SEQ ID NO: 1068828 - RNA, 22 nt, Mycobacterium bovis subsp bovis AF2122/97
aggcgcugaacgcgagcaacac

SEQ ID NO: 1068829 - RNA, 14 nt, Mycobacterium bovis subsp bovis AF2122/97
aggcgcugaacgcg

SEQ ID NO: 1068830 - RNA, 18 nt, Mycobacterium bovis subsp bovis AF2122/97
aggcgcugaacgcgagca

SEQ ID NO: 1068831 - RNA, 22 nt, Mycobacterium bovis subsp bovis AF2122/97
aggcgcggcgacaagccgagcc

SEQ ID NO: 1068832 - RNA, 12 nt, Mycobacterium bovis subsp bovis AF2122/97
aggcgcgggcga

SEQ ID NO: 1068833 - RNA, 16 nt, Mycobacterium bovis subsp bovis AF2122/97
aggcgcggucaccgcg

SEQ ID NO: 1068834 - RNA, 20 nt, Mycobacterium bovis subsp bovis AF2122/97
aggcgcgggcgacgucuugg

SEQ ID NO: 1068835 - RNA, 19 nt, Mycobacterium bovis subsp bovis AF2122/97
aggcgcucacccgccgcgg

SEQ ID NO: 1068836 - RNA, 20 nt, Mycobacterium bovis subsp bovis AF2122/97
aggcgcucagcgcggccacg

SEQ ID NO: 1068837 - RNA, 20 nt, Mycobacterium bovis subsp bovis AF2122/97
aggcgaccccggccccgacg

SEQ ID NO: 1068838 - RNA, 19 nt, Mycobacterium bovis subsp bovis AF2122/97
aggcgacccgcugggucga

SEQ ID NO: 1068839 - RNA, 17 nt, Mycobacterium bovis subsp bovis AF2122/97
aggcgacaucaccaccg

SEQ ID NO: 1068840 - RNA, 18 nt, Mycobacterium bovis subsp bovis AF2122/97
aggcgacaucaccaccga

SEQ ID NO: 1068841 - RNA, 17 nt, Mycobacterium bovis subsp bovis AF2122/97
aggcgaagguccgugcc

SEQ ID NO: 1068842 - RNA, 20 nt, Mycobacterium bovis subsp bovis AF2122/97
aggcgaagguccgugccgau

SEQ ID NO: 1068843 - RNA, 14 nt, Mycobacterium bovis subsp bovis AF2122/97
aggcgaaccgcucc

SEQ ID NO: 1068844 - RNA, 15 nt, Mycobacterium bovis subsp bovis AF2122/97
aggcgagaagcgucg

SEQ ID NO: 1068845 - RNA, 22 nt, Mycobacterium bovis subsp bovis AF2122/97
aggcgacgccgaaaaugccgcc

SEQ ID NO: 1068846 - RNA, 16 nt, Mycobacterium bovis subsp bovis AF2122/97
aggcgagaagcgucgc

SEQ ID NO: 1068847 - RNA, 13 nt, Mycobacterium bovis subsp bovis AF2122/97
aggcgagccggcg

SEQ ID NO: 1068848 - RNA, 15 nt, Mycobacterium bovis subsp bovis AF2122/97
aggcgagccggcgcg

SEQ ID NO: 1068849 - RNA, 19 nt, Mycobacterium bovis subsp bovis AF2122/97
aggcgaucugcuaccagag

SEQ ID NO: 1068850 - RNA, 21 nt, Mycobacterium bovis subsp bovis AF2122/97
aggcgaucgcccggccccgca

SEQ ID NO: 1068851 - RNA, 19 nt, Mycobacterium bovis subsp bovis AF2122/97
aggcgagucaccgggucca

SEQ ID NO: 1068852 - RNA, 20 nt, Mycobacterium bovis subsp bovis AF2122/97
aggcgaguuaggccgccagc

SEQ ID NO: 1068853 - RNA, 17 nt, Mycobacterium bovis subsp bovis AF2122/97
aggcgauaucgaucgga

SEQ ID NO: 1068854 - RNA, 18 nt, Mycobacterium bovis subsp bovis AF2122/97
aggcgauaucgcacaugg

SEQ ID NO: 1068855 - RNA, 13 nt, Mycobacterium bovis subsp bovis AF2122/97
aggcgauaucgcc

SEQ ID NO: 1068856 - RNA, 18 nt, Mycobacterium bovis subsp bovis AF2122/97
aggcgauaucgcccggaa

SEQ ID NO: 1068857 - RNA, 23 nt, Mycobacterium bovis subsp bovis AF2122/97
aggcgauaucgcccggaacgaau

SEQ ID NO: 1068858 - RNA, 14 nt, Mycobacterium bovis subsp bovis AF2122/97
aggcgaucaccgcg

SEQ ID NO: 1068859 - RNA, 17 nt, Mycobacterium bovis subsp bovis AF2122/97
aggcgaucaccgcgccg

SEQ ID NO: 1068860 - RNA, 12 nt, Mycobacterium bovis subsp bovis AF2122/97
aggcgaucagga

SEQ ID NO: 1068861 - RNA, 14 nt, Mycobacterium bovis subsp bovis AF2122/97
aggcgaucaggaug

SEQ ID NO: 1068862 - RNA, 22 nt, Mycobacterium bovis subsp bovis AF2122/97
aggcgauggucuccucggucac

SEQ ID NO: 1068863 - RNA, 19 nt, Mycobacterium bovis subsp bovis AF2122/97
aggcgauucugcgucugcu

SEQ ID NO: 1068864 - RNA, 20 nt, Mycobacterium bovis subsp bovis AF2122/97
aggcgauucugcgucugcuc

SEQ ID NO: 1068865 - RNA, 14 nt, Mycobacterium bovis subsp bovis AF2122/97
aggcgauugcccgc

SEQ ID NO: 1068866 - RNA, 22 nt, Mycobacterium bovis subsp bovis AF2122/97
aggcgauugucggggccgcagg

SEQ ID NO: 1068867 - RNA, 18 nt, Mycobacterium bovis subsp bovis AF2122/97
aggcgcaagaaugccgcc

SEQ ID NO: 1068868 - RNA, 21 nt, Mycobacterium bovis subsp bovis AF2122/97
aggccuccgcugccgcccgcg

SEQ ID NO: 1068869 - RNA, 15 nt, Mycobacterium bovis subsp bovis AF2122/97
aggccucggcagcaa

SEQ ID NO: 1068870 - RNA, 15 nt, Mycobacterium bovis subsp bovis AF2122/97
aggccuaccaggcgc

SEQ ID NO: 1068871 - RNA, 14 nt, Mycobacterium bovis subsp bovis AF2122/97
aggccuagcgcggc

SEQ ID NO: 1068872 - RNA, 15 nt, Mycobacterium bovis subsp bovis AF2122/97
aggccguggucgagg

SEQ ID NO: 1068873 - RNA, 21 nt, Mycobacterium bovis subsp bovis AF2122/97
aggccguugcuauucgccagc

SEQ ID NO: 1068874 - RNA, 19 nt, Mycobacterium bovis subsp bovis AF2122/97
aggccguggcggacggcgu

SEQ ID NO: 1068875 - RNA, 15 nt, Mycobacterium bovis subsp bovis AF2122/97
aggccuucgccgacu

SEQ ID NO: 1068876 - RNA, 16 nt, Mycobacterium bovis subsp bovis AF2122/97
aggccuucgccgacua

SEQ ID NO: 1068877 - RNA, 20 nt, Mycobacterium bovis subsp bovis AF2122/97
aggccuugacguagaagucg

SEQ ID NO: 1068878 - RNA, 18 nt, Mycobacterium bovis subsp bovis AF2122/97
aggccuugcucagccggc

SEQ ID NO: 1068879 - RNA, 14 nt, Mycobacterium bovis subsp bovis AF2122/97
aggccuucagcggu

SEQ ID NO: 1068880 - RNA, 22 nt, Mycobacterium bovis subsp bovis AF2122/97
aggcgaaauagcccaagccgau

SEQ ID NO: 1068881 - RNA, 17 nt, Mycobacterium bovis subsp bovis AF2122/97
aggccucggcgccgccc

SEQ ID NO: 1068882 - RNA, 23 nt, Mycobacterium bovis subsp bovis AF2122/97
aggccucggcgccgcccagcauc

SEQ ID NO: 1068883 - RNA, 13 nt, Mycobacterium bovis subsp bovis AF2122/97
aggccucggcggc

SEQ ID NO: 1068884 - RNA, 21 nt, Mycobacterium bovis subsp bovis AF2122/97
aggccugagcgugucuggcga

SEQ ID NO: 1068885 - RNA, 16 nt, Mycobacterium bovis subsp bovis AF2122/97
aggccugcccccggcg

SEQ ID NO: 1068886 - RNA, 18 nt, Mycobacterium bovis subsp bovis AF2122/97
aggccugcccccggcgcg

SEQ ID NO: 1068887 - RNA, 16 nt, Mycobacterium bovis subsp bovis AF2122/97
aggccgcgcucgucga

SEQ ID NO: 1068888 - RNA, 15 nt, Mycobacterium bovis subsp bovis AF2122/97
aggccgcgcggcggc

SEQ ID NO: 1068889 - RNA, 20 nt, Mycobacterium bovis subsp bovis AF2122/97
aggccgcgcggcggcgccgg

SEQ ID NO: 1068890 - RNA, 22 nt, Mycobacterium bovis subsp bovis AF2122/97
aggccgcgcggcggcgccggcg

SEQ ID NO: 1068891 - RNA, 23 nt, Mycobacterium bovis subsp bovis AF2122/97
aggccgcguugccggucgcaugg

SEQ ID NO: 1068892 - RNA, 16 nt, Mycobacterium bovis subsp bovis AF2122/97
aggccgccgccgucgg

SEQ ID NO: 1068893 - RNA, 15 nt, Mycobacterium bovis subsp bovis AF2122/97
aggccgccggccagc

SEQ ID NO: 1068894 - RNA, 12 nt, Mycobacterium bovis subsp bovis AF2122/97
aggccgccgaga

SEQ ID NO: 1068895 - RNA, 21 nt, Mycobacterium bovis subsp bovis AF2122/97
aggccgcgcgacaacccggcg

SEQ ID NO: 1068896 - RNA, 16 nt, Mycobacterium bovis subsp bovis AF2122/97
aggccgagccgcccgc

SEQ ID NO: 1068897 - RNA, 21 nt, Mycobacterium bovis subsp bovis AF2122/97
aggcccggucuuacggucggc

SEQ ID NO: 1068898 - RNA, 23 nt, Mycobacterium bovis subsp bovis AF2122/97
aggccgaccuguaugccgcggug

SEQ ID NO: 1068899 - RNA, 13 nt, Mycobacterium bovis subsp bovis AF2122/97
aggccgaccgcgc

SEQ ID NO: 1068900 - RNA, 13 nt, Mycobacterium bovis subsp bovis AF2122/97
aggcccgggcggc

SEQ ID NO: 1068901 - RNA, 17 nt, Mycobacterium bovis subsp bovis AF2122/97
aggcccgggcggccagc

SEQ ID NO: 1068902 - RNA, 23 nt, Mycobacterium bovis subsp bovis AF2122/97
aggccgagcucguugcuggcggc

SEQ ID NO: 1068903 - RNA, 13 nt, Mycobacterium bovis subsp bovis AF2122/97
aggccgccgcgcc

SEQ ID NO: 1068904 - RNA, 14 nt, Mycobacterium bovis subsp bovis AF2122/97
aggccgccgcggcg

SEQ ID NO: 1068905 - RNA, 20 nt, Mycobacterium bovis subsp bovis AF2122/97
aggccggccgcgauccagcg

SEQ ID NO: 1068906 - RNA, 12 nt, Mycobacterium bovis subsp bovis AF2122/97
aggccggcggcg

SEQ ID NO: 1068907 - RNA, 15 nt, Mycobacterium bovis subsp bovis AF2122/97
aggccggcgucgauc

SEQ ID NO: 1068908 - RNA, 22 nt, Mycobacterium bovis subsp bovis AF2122/97
aggccggcgucgaucaacaaca

SEQ ID NO: 1068909 - RNA, 19 nt, Mycobacterium bovis subsp bovis AF2122/97
aggccgggacagcgccggg

SEQ ID NO: 1068910 - RNA, 20 nt, Mycobacterium bovis subsp bovis AF2122/97
aggccgggacagcgccgggg

SEQ ID NO: 1068911 - RNA, 23 nt, Mycobacterium bovis subsp bovis AF2122/97
aggccggcuaccgcgcucccggc

SEQ ID NO: 1068912 - RNA, 17 nt, Mycobacterium bovis subsp bovis AF2122/97
aggccggcucgccgacc

SEQ ID NO: 1068913 - RNA, 15 nt, Mycobacterium bovis subsp bovis AF2122/97
aggccggcggucagc

SEQ ID NO: 1068914 - RNA, 19 nt, Mycobacterium bovis subsp bovis AF2122/97
aggccggcggucagcagcg

SEQ ID NO: 1068915 - RNA, 18 nt, Mycobacterium bovis subsp bovis AF2122/97
aggccggagucgacgacg

SEQ ID NO: 1068916 - RNA, 17 nt, Mycobacterium bovis subsp bovis AF2122/97
aggccggaagauccggg

SEQ ID NO: 1068917 - RNA, 14 nt, Mycobacterium bovis subsp bovis AF2122/97
aggccggccaccga

SEQ ID NO: 1068918 - RNA, 21 nt, Mycobacterium bovis subsp bovis AF2122/97
aggccggccaccgagucgauc

SEQ ID NO: 1068919 - RNA, 16 nt, Mycobacterium bovis subsp bovis AF2122/97
aggccggcauggcggc

SEQ ID NO: 1068920 - RNA, 20 nt, Mycobacterium bovis subsp bovis AF2122/97
aggccggccaccaccgcgcc

SEQ ID NO: 1068921 - RNA, 11 nt, Mycobacterium bovis subsp bovis AF2122/97
aggccggugaa

SEQ ID NO: 1068922 - RNA, 23 nt, Mycobacterium bovis subsp bovis AF2122/97
aggccggugaacggcagcacggu

SEQ ID NO: 1068923 - RNA, 18 nt, Mycobacterium bovis subsp bovis AF2122/97
aggccggugaacgguagc

SEQ ID NO: 1068924 - RNA, 18 nt, Mycobacterium bovis subsp bovis AF2122/97
aggccgguuugcacgcac

SEQ ID NO: 1068925 - RNA, 23 nt, Mycobacterium bovis subsp bovis AF2122/97
aggccgguuugcacgcaccacaa

SEQ ID NO: 1068926 - RNA, 22 nt, Mycobacterium bovis subsp bovis AF2122/97
aggccggugcgucacagccggg

SEQ ID NO: 1068927 - RNA, 23 nt, Mycobacterium bovis subsp bovis AF2122/97
aggccggugcgucacagccgggu

SEQ ID NO: 1068928 - RNA, 16 nt, Mycobacterium bovis subsp bovis AF2122/97
aggccgggccggccac

SEQ ID NO: 1068929 - RNA, 21 nt, Mycobacterium bovis subsp bovis AF2122/97
aggccggguggccacgcccag

SEQ ID NO: 1068930 - RNA, 14 nt, Mycobacterium bovis subsp bovis AF2122/97
aggccgucaggcgu

SEQ ID NO: 1068931 - RNA, 18 nt, Mycobacterium bovis subsp bovis AF2122/97
aggccguccucggucagc

SEQ ID NO: 1068932 - RNA, 13 nt, Mycobacterium bovis subsp bovis AF2122/97
aggccgucgccgg

SEQ ID NO: 1068933 - RNA, 19 nt, Mycobacterium bovis subsp bovis AF2122/97
aggccgucguugccggcga

SEQ ID NO: 1068934 - RNA, 16 nt, Mycobacterium bovis subsp bovis AF2122/97
aggccguagcccacga

SEQ ID NO: 1068935 - RNA, 19 nt, Mycobacterium bovis subsp bovis AF2122/97
aggccguagcccacgacga

SEQ ID NO: 1068936 - RNA, 13 nt, Mycobacterium bovis subsp bovis AF2122/97
aggccgucaccga

SEQ ID NO: 1068937 - RNA, 16 nt, Mycobacterium bovis subsp bovis AF2122/97
aggccgucaccgacgc

SEQ ID NO: 1068938 - RNA, 16 nt, Mycobacterium bovis subsp bovis AF2122/97
aggccguaguggccgg

SEQ ID NO: 1068939 - RNA, 16 nt, Mycobacterium bovis subsp bovis AF2122/97
aggcaguccaccgcgc

SEQ ID NO: 1068940 - RNA, 15 nt, Mycobacterium bovis subsp bovis AF2122/97
aggcaggccggcucg

SEQ ID NO: 1068941 - RNA, 15 nt, Mycobacterium bovis subsp bovis AF2122/97
aggcagcuccgccgc

SEQ ID NO: 1068942 - RNA, 18 nt, Mycobacterium bovis subsp bovis AF2122/97
aggcagcuccgccgccga

SEQ ID NO: 1068943 - RNA, 18 nt, Mycobacterium bovis subsp bovis AF2122/97
agcuggcaacgccgcgcc

SEQ ID NO: 1068944 - RNA, 15 nt, Mycobacterium bovis subsp bovis AF2122/97
agcuggccaccgcau

SEQ ID NO: 1068945 - RNA, 14 nt, Mycobacterium bovis subsp bovis AF2122/97
agcuggaccuccga

SEQ ID NO: 1068946 - RNA, 13 nt, Mycobacterium bovis subsp bovis AF2122/97
agcuggacuccgg

SEQ ID NO: 1068947 - RNA, 22 nt, Mycobacterium bovis subsp bovis AF2122/97
agcuggccgauguaguccggcc

SEQ ID NO: 1068948 - RNA, 18 nt, Mycobacterium bovis subsp bovis AF2122/97
agcuggcgauacagcgac

SEQ ID NO: 1068949 - RNA, 21 nt, Mycobacterium bovis subsp bovis AF2122/97
agcuggcgaccuggucgcugg

SEQ ID NO: 1068950 - RNA, 15 nt, Mycobacterium bovis subsp bovis AF2122/97
aggcacugcgaucgc

SEQ ID NO: 1068951 - RNA, 17 nt, Mycobacterium bovis subsp bovis AF2122/97
aggccagcgcgcccgcg

SEQ ID NO: 1068952 - RNA, 18 nt, Mycobacterium bovis subsp bovis AF2122/97
aggccagcacggcgacga

SEQ ID NO: 1068953 - RNA, 18 nt, Mycobacterium bovis subsp bovis AF2122/97
aggcccagcggaucgaca

SEQ ID NO: 1068954 - RNA, 11 nt, Mycobacterium bovis subsp bovis AF2122/97
aggcccagcua

SEQ ID NO: 1068955 - RNA, 15 nt, Mycobacterium bovis subsp bovis AF2122/97
aggccagcgaaucgc

SEQ ID NO: 1068956 - RNA, 21 nt, Mycobacterium bovis subsp bovis AF2122/97
aggccagcgaaucgcugguga

SEQ ID NO: 1068957 - RNA, 23 nt, Mycobacterium bovis subsp bovis AF2122/97
aggccagcaugucgggccgcucg

SEQ ID NO: 1068958 - RNA, 23 nt, Mycobacterium bovis subsp bovis AF2122/97
aggcccgcgcgagagccuccaug

SEQ ID NO: 1068959 - RNA, 14 nt, Mycobacterium bovis subsp bovis AF2122/97
aggcccgcaccgcu

SEQ ID NO: 1068960 - RNA, 18 nt, Mycobacterium bovis subsp bovis AF2122/97
aggccccuggccgccgca

SEQ ID NO: 1068961 - RNA, 13 nt, Mycobacterium bovis subsp bovis AF2122/97
aggccccgccagc

SEQ ID NO: 1068962 - RNA, 19 nt, Mycobacterium bovis subsp bovis AF2122/97
aggccccgccagcgccggu

SEQ ID NO: 1068963 - RNA, 12 nt, Mycobacterium bovis subsp bovis AF2122/97
aggcccaugccg

SEQ ID NO: 1068964 - RNA, 20 nt, Mycobacterium bovis subsp bovis AF2122/97
aggcccaucucgggcaggcc

SEQ ID NO: 1068965 - RNA, 20 nt, Mycobacterium bovis subsp bovis AF2122/97
aggccagagucgcccgcaca

SEQ ID NO: 1068966 - RNA, 21 nt, Mycobacterium bovis subsp bovis AF2122/97
aggccagaguuugcgaugccc

SEQ ID NO: 1068967 - RNA, 22 nt, Mycobacterium bovis subsp bovis AF2122/97
aggccacguagcagcgccggca

SEQ ID NO: 1068968 - RNA, 12 nt, Mycobacterium bovis subsp bovis AF2122/97
aggccacugcgu

SEQ ID NO: 1068969 - RNA, 21 nt, Mycobacterium bovis subsp bovis AF2122/97
aggccaccuccgaggccgcca

SEQ ID NO: 1068970 - RNA, 21 nt, Mycobacterium bovis subsp bovis AF2122/97
aggccacgccagcucgccggc

SEQ ID NO: 1068971 - RNA, 22 nt, Mycobacterium bovis subsp bovis AF2122/97
agggcgauuuccaucgcgaccu

SEQ ID NO: 1068972 - RNA, 19 nt, Mycobacterium bovis subsp bovis AF2122/97
agggcgccgacgacuccgg

SEQ ID NO: 1068973 - RNA, 18 nt, Mycobacterium bovis subsp bovis AF2122/97
agggcgccacugaccgcg

SEQ ID NO: 1068974 - RNA, 14 nt, Mycobacterium bovis subsp bovis AF2122/97
agggcgcccgcccc

SEQ ID NO: 1068975 - RNA, 13 nt, Mycobacterium bovis subsp bovis AF2122/97
aggcugucgcggg

SEQ ID NO: 1068976 - RNA, 20 nt, Mycobacterium bovis subsp bovis AF2122/97
aggcugugccccagggcagu

SEQ ID NO: 1068977 - RNA, 14 nt, Mycobacterium bovis subsp bovis AF2122/97
aggcugguccgggu

SEQ ID NO: 1068978 - RNA, 14 nt, Mycobacterium bovis subsp bovis AF2122/97
aggcugugccggcc

SEQ ID NO: 1068979 - RNA, 15 nt, Mycobacterium bovis subsp bovis AF2122/97
aggcugugccggcca

SEQ ID NO: 1068980 - RNA, 16 nt, Mycobacterium bovis subsp bovis AF2122/97
aggcugugccggccau

SEQ ID NO: 1068981 - RNA, 18 nt, Mycobacterium bovis subsp bovis AF2122/97
agggccagcggcagccug

SEQ ID NO: 1068982 - RNA, 14 nt, Mycobacterium bovis subsp bovis AF2122/97
aggggcaccagcga

SEQ ID NO: 1068983 - RNA, 15 nt, Mycobacterium bovis subsp bovis AF2122/97
aggggcagcacguca

SEQ ID NO: 1068984 - RNA, 20 nt, Mycobacterium bovis subsp bovis AF2122/97
aggggcgucugcagcgggcg

SEQ ID NO: 1068985 - RNA, 20 nt, Mycobacterium bovis subsp bovis AF2122/97
agggucgaguucgcagucga

SEQ ID NO: 1068986 - RNA, 19 nt, Mycobacterium bovis subsp bovis AF2122/97
agggucgaguucgcagucg

SEQ ID NO: 1068987 - RNA, 18 nt, Mycobacterium bovis subsp bovis AF2122/97
aggggcucagcgguggcg

SEQ ID NO: 1068988 - RNA, 14 nt, Mycobacterium bovis subsp bovis AF2122/97
agggcucgguggcg

SEQ ID NO: 1068989 - RNA, 19 nt, Mycobacterium bovis subsp bovis AF2122/97
agggcucgguggcgccggg

SEQ ID NO: 1068990 - RNA, 16 nt, Mycobacterium bovis subsp bovis AF2122/97
agggcugcgaugcggu

SEQ ID NO: 1068991 - RNA, 16 nt, Mycobacterium bovis subsp bovis AF2122/97
agggcuuccagggcga

SEQ ID NO: 1068992 - RNA, 23 nt, Mycobacterium bovis subsp bovis AF2122/97
agggcuggucuacccgcggcgcg

SEQ ID NO: 1068993 - RNA, 19 nt, Mycobacterium bovis subsp bovis AF2122/97
agggcuugcaccugcaacc

SEQ ID NO: 1068994 - RNA, 15 nt, Mycobacterium bovis subsp bovis AF2122/97
aggggacccggggcc

SEQ ID NO: 1068995 - RNA, 13 nt, Mycobacterium bovis subsp bovis AF2122/97
agggcgccgcgcg

SEQ ID NO: 1068996 - RNA, 16 nt, Mycobacterium bovis subsp bovis AF2122/97
agggcgcgcaucugcu

SEQ ID NO: 1068997 - RNA, 14 nt, Mycobacterium bovis subsp bovis AF2122/97
agggcgucgccgcc

SEQ ID NO: 1068998 - RNA, 15 nt, Mycobacterium bovis subsp bovis AF2122/97
agggcgucgccgccg

SEQ ID NO: 1068999 - RNA, 14 nt, Mycobacterium bovis subsp bovis AF2122/97
agggcucggcggcc

SEQ ID NO: 1069000 - RNA, 16 nt, Mycobacterium bovis subsp bovis AF2122/97
agggcucggcggcccg

SEQ ID NO: 1069001 - RNA, 22 nt, Mycobacterium bovis subsp bovis AF2122/97
agggcguuggcggcuucgcccc

SEQ ID NO: 1069002 - RNA, 22 nt, Mycobacterium bovis subsp bovis AF2122/97
agggcuaucguggcggcgucga

SEQ ID NO: 1069003 - RNA, 13 nt, Mycobacterium bovis subsp bovis AF2122/97
aggcggccagcau

SEQ ID NO: 1069004 - RNA, 21 nt, Mycobacterium bovis subsp bovis AF2122/97
aggcggccggguucgcgucug

SEQ ID NO: 1069005 - RNA, 16 nt, Mycobacterium bovis subsp bovis AF2122/97
aggcggccgucgucgg

SEQ ID NO: 1069006 - RNA, 19 nt, Mycobacterium bovis subsp bovis AF2122/97
aggcggccgucgucggcca

SEQ ID NO: 1069007 - RNA, 19 nt, Mycobacterium bovis subsp bovis AF2122/97
aggcggcgacgaccgucgg

SEQ ID NO: 1069008 - RNA, 12 nt, Mycobacterium bovis subsp bovis AF2122/97
aggcggcgacgc

SEQ ID NO: 1069009 - RNA, 24 nt, Mycobacterium bovis subsp bovis AF2122/97
aggcggccuugccgggccgcgcgg

SEQ ID NO: 1069010 - RNA, 14 nt, Mycobacterium bovis subsp bovis AF2122/97
aggcggcgacgccg

SEQ ID NO: 1069011 - RNA, 14 nt, Mycobacterium bovis subsp bovis AF2122/97
aggcggcgccgcac

SEQ ID NO: 1069012 - RNA, 16 nt, Mycobacterium bovis subsp bovis AF2122/97
aggcggcgcgggucgg

SEQ ID NO: 1069013 - RNA, 16 nt, Mycobacterium bovis subsp bovis AF2122/97
aggcggcggacccgcu

SEQ ID NO: 1069014 - RNA, 14 nt, Mycobacterium bovis subsp bovis AF2122/97
aggcggcggccagc

SEQ ID NO: 1069015 - RNA, 13 nt, Mycobacterium bovis subsp bovis AF2122/97
aggcggcggcccg

SEQ ID NO: 1069016 - RNA, 20 nt, Mycobacterium bovis subsp bovis AF2122/97
aggcgguaguggcgaucugc

SEQ ID NO: 1069017 - RNA, 11 nt, Mycobacterium bovis subsp bovis AF2122/97
aggcggucacc

SEQ ID NO: 1069018 - RNA, 20 nt, Mycobacterium bovis subsp bovis AF2122/97
aggcggucaccaccguggcg

SEQ ID NO: 1069019 - RNA, 13 nt, Mycobacterium bovis subsp bovis AF2122/97
aggcggugacccg

SEQ ID NO: 1069020 - RNA, 15 nt, Mycobacterium bovis subsp bovis AF2122/97
aggcggucgccgaau

SEQ ID NO: 1069021 - RNA, 13 nt, Mycobacterium bovis subsp bovis AF2122/97
aggcggcugaacg

SEQ ID NO: 1069022 - RNA, 18 nt, Mycobacterium bovis subsp bovis AF2122/97
aggcggcugaacggcagc

SEQ ID NO: 1069023 - RNA, 20 nt, Mycobacterium bovis subsp bovis AF2122/97
aggcggcuggcccgcaugcc

SEQ ID NO: 1069024 - RNA, 21 nt, Mycobacterium bovis subsp bovis AF2122/97
aggcguacaccagggugccgg

SEQ ID NO: 1069025 - RNA, 18 nt, Mycobacterium bovis subsp bovis AF2122/97
aggcguaaucaagcagcg

SEQ ID NO: 1069026 - RNA, 20 nt, Mycobacterium bovis subsp bovis AF2122/97
aggcuaauagcucgccggcg

SEQ ID NO: 1069027 - RNA, 22 nt, Mycobacterium bovis subsp bovis AF2122/97
aggcguuuggcgugccgucgcc

SEQ ID NO: 1069028 - RNA, 18 nt, Mycobacterium bovis subsp bovis AF2122/97
aggcucgcguggccgccg

SEQ ID NO: 1069029 - RNA, 17 nt, Mycobacterium bovis subsp bovis AF2122/97
aggcucguggcgacggc

SEQ ID NO: 1069030 - RNA, 17 nt, Mycobacterium bovis subsp bovis AF2122/97
aggcuaguugccaacac

SEQ ID NO: 1069031 - RNA, 17 nt, Mycobacterium bovis subsp bovis AF2122/97
aggcuccuggucgccgu

SEQ ID NO: 1069032 - RNA, 17 nt, Mycobacterium bovis subsp bovis AF2122/97
aggcucgaaccgacgcg

SEQ ID NO: 1069033 - RNA, 18 nt, Mycobacterium bovis subsp bovis AF2122/97
aggcucauccgccgggcc

SEQ ID NO: 1069034 - RNA, 24 nt, Mycobacterium bovis subsp bovis AF2122/97
aggcucauccgccgggccaggccg

SEQ ID NO: 1069035 - RNA, 16 nt, Mycobacterium bovis subsp bovis AF2122/97
aggcucagcagcgccg

SEQ ID NO: 1069036 - RNA, 19 nt, Mycobacterium bovis subsp bovis AF2122/97
aggucgagcuuuucgaccu

SEQ ID NO: 1069037 - RNA, 14 nt, Mycobacterium bovis subsp bovis AF2122/97
aggucgagcgaccc

SEQ ID NO: 1069038 - RNA, 21 nt, Mycobacterium bovis subsp bovis AF2122/97
aggucgagcgccuuugcccga

SEQ ID NO: 1069039 - RNA, 15 nt, Mycobacterium bovis subsp bovis AF2122/97
aggucgaucaggggc

SEQ ID NO: 1069040 - RNA, 18 nt, Mycobacterium bovis subsp bovis AF2122/97
aggucgacggaaucgucg

SEQ ID NO: 1069041 - RNA, 16 nt, Mycobacterium bovis subsp bovis AF2122/97
aggucgacgccgacca

SEQ ID NO: 1069042 - RNA, 23 nt, Mycobacterium bovis subsp bovis AF2122/97
aggucgacauaggccaccuccga

SEQ ID NO: 1069043 - RNA, 17 nt, Mycobacterium bovis subsp bovis AF2122/97
agguccugcgccgcacg

SEQ ID NO: 1069044 - RNA, 16 nt, Mycobacterium bovis subsp bovis AF2122/97
aggucgaaccgccggc

SEQ ID NO: 1069045 - RNA, 15 nt, Mycobacterium bovis subsp bovis AF2122/97
aggucgguccgcacu

SEQ ID NO: 1069046 - RNA, 19 nt, Mycobacterium bovis subsp bovis AF2122/97
aggucgggcccccggcagc

SEQ ID NO: 1069047 - RNA, 13 nt, Mycobacterium bovis subsp bovis AF2122/97
aggucggcggcgc

SEQ ID NO: 1069048 - RNA, 14 nt, Mycobacterium bovis subsp bovis AF2122/97
aggucggcgaucug

SEQ ID NO: 1069049 - RNA, 15 nt, Mycobacterium bovis subsp bovis AF2122/97
aggucggcgaucugc

SEQ ID NO: 1069050 - RNA, 17 nt, Mycobacterium bovis subsp bovis AF2122/97
aggugacaaaucggcca

SEQ ID NO: 1069051 - RNA, 15 nt, Mycobacterium bovis subsp bovis AF2122/97
aggugacgacgucgu

SEQ ID NO: 1069052 - RNA, 21 nt, Mycobacterium bovis subsp bovis AF2122/97
aggugacgaucaggucgccga

SEQ ID NO: 1069053 - RNA, 20 nt, Mycobacterium bovis subsp bovis AF2122/97
aggugaccgagaucgucgcg

SEQ ID NO: 1069054 - RNA, 19 nt, Mycobacterium bovis subsp bovis AF2122/97
aggugaacgcugucccagc

SEQ ID NO: 1069055 - RNA, 16 nt, Mycobacterium bovis subsp bovis AF2122/97
agguccaccggccagu

SEQ ID NO: 1069056 - RNA, 20 nt, Mycobacterium bovis subsp bovis AF2122/97
aggucagcgguugggcgaaa

SEQ ID NO: 1069057 - RNA, 15 nt, Mycobacterium bovis subsp bovis AF2122/97
aggucagcagggccg

SEQ ID NO: 1069058 - RNA, 14 nt, Mycobacterium bovis subsp bovis AF2122/97
aggucagcgcugcc

SEQ ID NO: 1069059 - RNA, 15 nt, Mycobacterium bovis subsp bovis AF2122/97
aggucaucaugucga

SEQ ID NO: 1069060 - RNA, 13 nt, Mycobacterium bovis subsp bovis AF2122/97
aggucaucgggca

SEQ ID NO: 1069061 - RNA, 15 nt, Mycobacterium bovis subsp bovis AF2122/97
agguccucgucgucg

SEQ ID NO: 1069062 - RNA, 21 nt, Mycobacterium bovis subsp bovis AF2122/97
agguccgucgcgcgggcgagc

SEQ ID NO: 1069063 - RNA, 20 nt, Mycobacterium bovis subsp bovis AF2122/97
agguccggggaaagccgcag

SEQ ID NO: 1069064 - RNA, 18 nt, Mycobacterium bovis subsp bovis AF2122/97
agguccgccggugccgcc

SEQ ID NO: 1069065 - RNA, 22 nt, Mycobacterium bovis subsp bovis AF2122/97
agguccaaguccuccacggcgg

SEQ ID NO: 1069066 - RNA, 22 nt, Mycobacterium bovis subsp bovis AF2122/97
aggucccgugcgcgcgcagcug

SEQ ID NO: 1069067 - RNA, 18 nt, Mycobacterium bovis subsp bovis AF2122/97
agguccgcacgaucugca

SEQ ID NO: 1069068 - RNA, 16 nt, Mycobacterium bovis subsp bovis AF2122/97
agguccaucuggcgcg

SEQ ID NO: 1069069 - RNA, 17 nt, Mycobacterium bovis subsp bovis AF2122/97
agggugaccaacgucga

SEQ ID NO: 1069070 - RNA, 22 nt, Mycobacterium bovis subsp bovis AF2122/97
agggugaccaggccgagcucgu

SEQ ID NO: 1069071 - RNA, 19 nt, Mycobacterium bovis subsp bovis AF2122/97
agggugaagacaccggcgu

SEQ ID NO: 1069072 - RNA, 18 nt, Mycobacterium bovis subsp bovis AF2122/97
agggugaaguggcgcagc

SEQ ID NO: 1069073 - RNA, 23 nt, Mycobacterium bovis subsp bovis AF2122/97
agggucugcgccgccggcggcgg

SEQ ID NO: 1069074 - RNA, 18 nt, Mycobacterium bovis subsp bovis AF2122/97
aggucaccggucaccgcg

SEQ ID NO: 1069075 - RNA, 23 nt, Mycobacterium bovis subsp bovis AF2122/97
aggucaagaaggagaucgaucga

SEQ ID NO: 1069076 - RNA, 19 nt, Mycobacterium bovis subsp bovis AF2122/97
aggucacccaucaacgccg

SEQ ID NO: 1069077 - RNA, 19 nt, Mycobacterium bovis subsp bovis AF2122/97
agggugccggcgccgcccu

SEQ ID NO: 1069078 - RNA, 13 nt, Mycobacterium bovis subsp bovis AF2122/97
agguaugcccgga

SEQ ID NO: 1069079 - RNA, 19 nt, Mycobacterium bovis subsp bovis AF2122/97
aggugauucgcgcagcgcg

SEQ ID NO: 1069080 - RNA, 14 nt, Mycobacterium bovis subsp bovis AF2122/97
aggugaugccgccg

SEQ ID NO: 1069081 - RNA, 18 nt, Mycobacterium bovis subsp bovis AF2122/97
aggugauuggucacaccc

SEQ ID NO: 1069082 - RNA, 19 nt, Mycobacterium bovis subsp bovis AF2122/97
aggugauuggucacaccca

SEQ ID NO: 1069083 - RNA, 15 nt, Mycobacterium bovis subsp bovis AF2122/97
aggugcaugucgaug

SEQ ID NO: 1069084 - RNA, 19 nt, Mycobacterium bovis subsp bovis AF2122/97
aggugccaaacgccgcccg

SEQ ID NO: 1069085 - RNA, 17 nt, Mycobacterium bovis subsp bovis AF2122/97
aggugccaaccgcggcg

SEQ ID NO: 1069086 - RNA, 13 nt, Mycobacterium bovis subsp bovis AF2122/97
aggugcggcggca

SEQ ID NO: 1069087 - RNA, 13 nt, Mycobacterium bovis subsp bovis AF2122/97
agguugccgucgg

SEQ ID NO: 1069088 - RNA, 15 nt, Mycobacterium bovis subsp bovis AF2122/97
aggugcgcuggguga

SEQ ID NO: 1069089 - RNA, 14 nt, Mycobacterium bovis subsp bovis AF2122/97
aggugccuucuucg

SEQ ID NO: 1069090 - RNA, 18 nt, Mycobacterium bovis subsp bovis AF2122/97
aggugccgcgcagcugcc

SEQ ID NO: 1069091 - RNA, 19 nt, Mycobacterium bovis subsp bovis AF2122/97
aggugccgcgcagcugccg

SEQ ID NO: 1069092 - RNA, 17 nt, Mycobacterium bovis subsp bovis AF2122/97
agguuguaguccgcgcc

SEQ ID NO: 1069093 - RNA, 18 nt, Mycobacterium bovis subsp bovis AF2122/97
agguuguaguccgcgccg

SEQ ID NO: 1069094 - RNA, 14 nt, Mycobacterium bovis subsp bovis AF2122/97
agguugucggcgau

SEQ ID NO: 1069095 - RNA, 18 nt, Mycobacterium bovis subsp bovis AF2122/97
agguugugugacagcccg

SEQ ID NO: 1069096 - RNA, 21 nt, Mycobacterium bovis subsp bovis AF2122/97
aggugauguuggccgccacac

SEQ ID NO: 1069097 - RNA, 16 nt, Mycobacterium bovis subsp bovis AF2122/97
agguugcgccgaccgg

SEQ ID NO: 1069098 - RNA, 19 nt, Mycobacterium bovis subsp bovis AF2122/97
aguaucgccggccgcgggc

SEQ ID NO: 1069099 - RNA, 19 nt, Mycobacterium bovis subsp bovis AF2122/97
aguagaagauggcaccgcc

SEQ ID NO: 1069100 - RNA, 13 nt, Mycobacterium bovis subsp bovis AF2122/97
aguagaucggauc

SEQ ID NO: 1069101 - RNA, 13 nt, Mycobacterium bovis subsp bovis AF2122/97
aguaguggccgcc

SEQ ID NO: 1069102 - RNA, 19 nt, Mycobacterium bovis subsp bovis AF2122/97
aguacuggcguugccaccg

SEQ ID NO: 1069103 - RNA, 21 nt, Mycobacterium bovis subsp bovis AF2122/97
aguacuuuuggguucgucgac

SEQ ID NO: 1069104 - RNA, 13 nt, Mycobacterium bovis subsp bovis AF2122/97
aguacgucgauca

SEQ ID NO: 1069105 - RNA, 20 nt, Mycobacterium bovis subsp bovis AF2122/97
aguacggcgaugcggucggc

SEQ ID NO: 1069106 - RNA, 15 nt, Mycobacterium bovis subsp bovis AF2122/97
aguacgggagccggc

SEQ ID NO: 1069107 - RNA, 14 nt, Mycobacterium bovis subsp bovis AF2122/97
aguugcgcgacggc

SEQ ID NO: 1069108 - RNA, 22 nt, Mycobacterium bovis subsp bovis AF2122/97
aguugcgggcuuugagcgcccg

SEQ ID NO: 1069109 - RNA, 22 nt, Mycobacterium bovis subsp bovis AF2122/97
aguugcaacggguacacccgcu

SEQ ID NO: 1069110 - RNA, 16 nt, Mycobacterium bovis subsp bovis AF2122/97
aguugcagcgggccac

SEQ ID NO: 1069111 - RNA, 14 nt, Mycobacterium bovis subsp bovis AF2122/97
aguucguggcuggc

SEQ ID NO: 1069112 - RNA, 15 nt, Mycobacterium bovis subsp bovis AF2122/97
aguugagcgccaacc

SEQ ID NO: 1069113 - RNA, 15 nt, Mycobacterium bovis subsp bovis AF2122/97
aguugacgcagcccg

SEQ ID NO: 1069114 - RNA, 16 nt, Mycobacterium bovis subsp bovis AF2122/97
aguugagcaugucguc

SEQ ID NO: 1069115 - RNA, 15 nt, Mycobacterium bovis subsp bovis AF2122/97
aguugaccaggccga

SEQ ID NO: 1069116 - RNA, 14 nt, Mycobacterium bovis subsp bovis AF2122/97
aguucugcgaucac

SEQ ID NO: 1069117 - RNA, 21 nt, Mycobacterium bovis subsp bovis AF2122/97
aguugaacguucccucggcac

SEQ ID NO: 1069118 - RNA, 14 nt, Mycobacterium bovis subsp bovis AF2122/97
aguucggcggccag

SEQ ID NO: 1069119 - RNA, 18 nt, Mycobacterium bovis subsp bovis AF2122/97
aguucggcggccgccgcg

SEQ ID NO: 1069120 - RNA, 19 nt, Mycobacterium bovis subsp bovis AF2122/97
aguucggcgucguccgcgc

SEQ ID NO: 1069121 - RNA, 18 nt, Mycobacterium bovis subsp bovis AF2122/97
aguucgggcaacggcagc

SEQ ID NO: 1069122 - RNA, 21 nt, Mycobacterium bovis subsp bovis AF2122/97
aguucgggcaacggcagcccg

SEQ ID NO: 1069123 - RNA, 13 nt, Mycobacterium bovis subsp bovis AF2122/97
aguguggccgaaa

SEQ ID NO: 1069124 - RNA, 16 nt, Mycobacterium bovis subsp bovis AF2122/97
agugugacggcggcca

SEQ ID NO: 1069125 - RNA, 15 nt, Mycobacterium bovis subsp bovis AF2122/97
agugguugcggccgu

SEQ ID NO: 1069126 - RNA, 15 nt, Mycobacterium bovis subsp bovis AF2122/97
agugucggcgucugu

SEQ ID NO: 1069127 - RNA, 15 nt, Mycobacterium bovis subsp bovis AF2122/97
agugucguaggcgau

SEQ ID NO: 1069128 - RNA, 19 nt, Mycobacterium bovis subsp bovis AF2122/97
agugguucgaaccguugcg

SEQ ID NO: 1069129 - RNA, 14 nt, Mycobacterium bovis subsp bovis AF2122/97
aguguacaccgcgc

SEQ ID NO: 1069130 - RNA, 15 nt, Mycobacterium bovis subsp bovis AF2122/97
aguguccccccgcgc

SEQ ID NO: 1069131 - RNA, 16 nt, Mycobacterium bovis subsp bovis AF2122/97
aguggcagcccgucgg

SEQ ID NO: 1069132 - RNA, 15 nt, Mycobacterium bovis subsp bovis AF2122/97
aguggugaccgacgc

SEQ ID NO: 1069133 - RNA, 19 nt, Mycobacterium bovis subsp bovis AF2122/97
aguggugaccgacgcggac

SEQ ID NO: 1069134 - RNA, 23 nt, Mycobacterium bovis subsp bovis AF2122/97
aguggugaccgacgcggacagga

SEQ ID NO: 1069135 - RNA, 20 nt, Mycobacterium bovis subsp bovis AF2122/97
aguuccuugaugcggccgcg

SEQ ID NO: 1069136 - RNA, 12 nt, Mycobacterium bovis subsp bovis AF2122/97
aguuccgcugcg

SEQ ID NO: 1069137 - RNA, 18 nt, Mycobacterium bovis subsp bovis AF2122/97
aguuccgcaccgaacgug

SEQ ID NO: 1069138 - RNA, 20 nt, Mycobacterium bovis subsp bovis AF2122/97
aguuccuugagacgccgggg

SEQ ID NO: 1069139 - RNA, 16 nt, Mycobacterium bovis subsp bovis AF2122/97
aguucgcgccguggcg

SEQ ID NO: 1069140 - RNA, 21 nt, Mycobacterium bovis subsp bovis AF2122/97
aguucgacggugccgucugcg

SEQ ID NO: 1069141 - RNA, 16 nt, Mycobacterium bovis subsp bovis AF2122/97
aguucgcagucgauga

SEQ ID NO: 1069142 - RNA, 18 nt, Mycobacterium bovis subsp bovis AF2122/97
aguggaucuggcgcagca

SEQ ID NO: 1069143 - RNA, 22 nt, Mycobacterium bovis subsp bovis AF2122/97
aguggauccggcagcagccggc

SEQ ID NO: 1069144 - RNA, 18 nt, Mycobacterium bovis subsp bovis AF2122/97
aguggacgugucaucacg

SEQ ID NO: 1069145 - RNA, 17 nt, Mycobacterium bovis subsp bovis AF2122/97
aguggaaacccgccgaa

SEQ ID NO: 1069146 - RNA, 17 nt, Mycobacterium bovis subsp bovis AF2122/97
aguggaacagucgaggu

SEQ ID NO: 1069147 - RNA, 19 nt, Mycobacterium bovis subsp bovis AF2122/97
agugcgggcaugccggcga

SEQ ID NO: 1069148 - RNA, 13 nt, Mycobacterium bovis subsp bovis AF2122/97
agugcgggcggcg

SEQ ID NO: 1069149 - RNA, 15 nt, Mycobacterium bovis subsp bovis AF2122/97
agugcggcugcaacg

SEQ ID NO: 1069150 - RNA, 13 nt, Mycobacterium bovis subsp bovis AF2122/97
agugcucgccggc

SEQ ID NO: 1069151 - RNA, 13 nt, Mycobacterium bovis subsp bovis AF2122/97
agugcucgcagcc

SEQ ID NO: 1069152 - RNA, 17 nt, Mycobacterium bovis subsp bovis AF2122/97
agugaggcgcuggcccg

SEQ ID NO: 1069153 - RNA, 20 nt, Mycobacterium bovis subsp bovis AF2122/97
agugacgccacgaccgccga

SEQ ID NO: 1069154 - RNA, 14 nt, Mycobacterium bovis subsp bovis AF2122/97
agugcgacggcgac

SEQ ID NO: 1069155 - RNA, 18 nt, Mycobacterium bovis subsp bovis AF2122/97
agugcgacucugcgucug

SEQ ID NO: 1069156 - RNA, 20 nt, Mycobacterium bovis subsp bovis AF2122/97
agugcgacucugcgucugcu

SEQ ID NO: 1069157 - RNA, 22 nt, Mycobacterium bovis subsp bovis AF2122/97
agugccuuccucggcaagucga

SEQ ID NO: 1069158 - RNA, 20 nt, Mycobacterium bovis subsp bovis AF2122/97
agugcgacugcgaaugcugg

SEQ ID NO: 1069159 - RNA, 21 nt, Mycobacterium bovis subsp bovis AF2122/97
agugcggccuuggcgacgucg

SEQ ID NO: 1069160 - RNA, 20 nt, Mycobacterium bovis subsp bovis AF2122/97
agugcggcacgaucgccaac

SEQ ID NO: 1069161 - RNA, 14 nt, Mycobacterium bovis subsp bovis AF2122/97
agugcgcggcgucg

SEQ ID NO: 1069162 - RNA, 21 nt, Mycobacterium bovis subsp bovis AF2122/97
agugacucaccgugaaccgcc

SEQ ID NO: 1069163 - RNA, 15 nt, Mycobacterium bovis subsp bovis AF2122/97
agugaccacgcugcu

SEQ ID NO: 1069164 - RNA, 16 nt, Mycobacterium bovis subsp bovis AF2122/97
agugaccucgucggcg

SEQ ID NO: 1069165 - RNA, 15 nt, Mycobacterium bovis subsp bovis AF2122/97
agucugggcgaucgc

SEQ ID NO: 1069166 - RNA, 15 nt, Mycobacterium bovis subsp bovis AF2122/97
agucuucaacgucga

SEQ ID NO: 1069167 - RNA, 19 nt, Mycobacterium bovis subsp bovis AF2122/97
agugaaagacaguggcgcg

SEQ ID NO: 1069168 - RNA, 20 nt, Mycobacterium bovis subsp bovis AF2122/97
agucacgcacucccgagcca

SEQ ID NO: 1069169 - RNA, 13 nt, Mycobacterium bovis subsp bovis AF2122/97
agucacggcggcu

SEQ ID NO: 1069170 - RNA, 12 nt, Mycobacterium bovis subsp bovis AF2122/97
agucacggucgu

SEQ ID NO: 1069171 - RNA, 16 nt, Mycobacterium bovis subsp bovis AF2122/97
agucagaacggcggca

SEQ ID NO: 1069172 - RNA, 14 nt, Mycobacterium bovis subsp bovis AF2122/97
agucucccggccgc

SEQ ID NO: 1069173 - RNA, 15 nt, Mycobacterium bovis subsp bovis AF2122/97
agucuccggcgucgg

SEQ ID NO: 1069174 - RNA, 17 nt, Mycobacterium bovis subsp bovis AF2122/97
agucaacgaacgauggg

SEQ ID NO: 1069175 - RNA, 15 nt, Mycobacterium bovis subsp bovis AF2122/97
agucaacucaccguc

SEQ ID NO: 1069176 - RNA, 17 nt, Mycobacterium bovis subsp bovis AF2122/97
agucaacuucgacaacg

SEQ ID NO: 1069177 - RNA, 11 nt, Mycobacterium bovis subsp bovis AF2122/97
aguauggccgc

SEQ ID NO: 1069178 - RNA, 16 nt, Mycobacterium bovis subsp bovis AF2122/97
agucaacaccgcggcc

SEQ ID NO: 1069179 - RNA, 23 nt, Mycobacterium bovis subsp bovis AF2122/97
auaccggcggcgagcggccucca

SEQ ID NO: 1069180 - RNA, 20 nt, Mycobacterium bovis subsp bovis AF2122/97
auaccggcggcgagcggccu

SEQ ID NO: 1069181 - RNA, 14 nt, Mycobacterium bovis subsp bovis AF2122/97
auaccgguggcagc

SEQ ID NO: 1069182 - RNA, 19 nt, Mycobacterium bovis subsp bovis AF2122/97
auaccgcugggucgccguu

SEQ ID NO: 1069183 - RNA, 15 nt, Mycobacterium bovis subsp bovis AF2122/97
auaccgccgcgcagc

SEQ ID NO: 1069184 - RNA, 18 nt, Mycobacterium bovis subsp bovis AF2122/97
auaccgccagcgccaccg

SEQ ID NO: 1069185 - RNA, 12 nt, Mycobacterium bovis subsp bovis AF2122/97
auacccgggcgg

SEQ ID NO: 1069186 - RNA, 21 nt, Mycobacterium bovis subsp bovis AF2122/97
auacgccaccggcaaucggcg

SEQ ID NO: 1069187 - RNA, 20 nt, Mycobacterium bovis subsp bovis AF2122/97
auacgcaccgguaccgacgg

SEQ ID NO: 1069188 - RNA, 18 nt, Mycobacterium bovis subsp bovis AF2122/97
auacgaacucaccgccau

SEQ ID NO: 1069189 - RNA, 14 nt, Mycobacterium bovis subsp bovis AF2122/97
auaccucgccgccc

SEQ ID NO: 1069190 - RNA, 12 nt, Mycobacterium bovis subsp bovis AF2122/97
auaccucggcga

SEQ ID NO: 1069191 - RNA, 16 nt, Mycobacterium bovis subsp bovis AF2122/97
auaccuuccagaucgc

SEQ ID NO: 1069192 - RNA, 17 nt, Mycobacterium bovis subsp bovis AF2122/97
auaccaagcgcgguggu

SEQ ID NO: 1069193 - RNA, 14 nt, Mycobacterium bovis subsp bovis AF2122/97
auaacuccgcggcg

SEQ ID NO: 1069194 - RNA, 13 nt, Mycobacterium bovis subsp bovis AF2122/97
aguuuggcggcgc

SEQ ID NO: 1069195 - RNA, 14 nt, Mycobacterium bovis subsp bovis AF2122/97
aguuuucaccgcga

SEQ ID NO: 1069196 - RNA, 19 nt, Mycobacterium bovis subsp bovis AF2122/97
auacucgaguggcgaacgg

SEQ ID NO: 1069197 - RNA, 15 nt, Mycobacterium bovis subsp bovis AF2122/97
auacucaccgacgcg

SEQ ID NO: 1069198 - RNA, 23 nt, Mycobacterium bovis subsp bovis AF2122/97
auacugggaccauuaccgugggu

SEQ ID NO: 1069199 - RNA, 20 nt, Mycobacterium bovis subsp bovis AF2122/97
auacgcguugugcccgccgg

SEQ ID NO: 1069200 - RNA, 22 nt, Mycobacterium bovis subsp bovis AF2122/97
auacuaauggcgccaccggccg

SEQ ID NO: 1069201 - RNA, 21 nt, Mycobacterium bovis subsp bovis AF2122/97
auagccacucgaucaccggca

SEQ ID NO: 1069202 - RNA, 19 nt, Mycobacterium bovis subsp bovis AF2122/97
auagccgacgucgccgacg

SEQ ID NO: 1069203 - RNA, 20 nt, Mycobacterium bovis subsp bovis AF2122/97
auagccaagugagcgaucgg

SEQ ID NO: 1069204 - RNA, 22 nt, Mycobacterium bovis subsp bovis AF2122/97
auagaccgcagucgcugggugg

SEQ ID NO: 1069205 - RNA, 15 nt, Mycobacterium bovis subsp bovis AF2122/97
auagaagcacgucgu

SEQ ID NO: 1069206 - RNA, 22 nt, Mycobacterium bovis subsp bovis AF2122/97
auaucgcccaccacgaacacgu

SEQ ID NO: 1069207 - RNA, 12 nt, Mycobacterium bovis subsp bovis AF2122/97
auaucggcggcu

SEQ ID NO: 1069208 - RNA, 20 nt, Mycobacterium bovis subsp bovis AF2122/97
auaucgaagcgucgggucgc

SEQ ID NO: 1069209 - RNA, 12 nt, Mycobacterium bovis subsp bovis AF2122/97
auaucgaugcgg

SEQ ID NO: 1069210 - RNA, 23 nt, Mycobacterium bovis subsp bovis AF2122/97
auaggccggcggucagcagcgcc

SEQ ID NO: 1069211 - RNA, 17 nt, Mycobacterium bovis subsp bovis AF2122/97
auaggcgcggucaccgc

SEQ ID NO: 1069212 - RNA, 18 nt, Mycobacterium bovis subsp bovis AF2122/97
auagggcuuugucaccgg

SEQ ID NO: 1069213 - RNA, 18 nt, Mycobacterium bovis subsp bovis AF2122/97
auaggcggccaucgacga

SEQ ID NO: 1069214 - RNA, 15 nt, Mycobacterium bovis subsp bovis AF2122/97
auagccgguggucgc

SEQ ID NO: 1069215 - RNA, 21 nt, Mycobacterium bovis subsp bovis AF2122/97
auagccucggcggcgccgaag

SEQ ID NO: 1069216 - RNA, 18 nt, Mycobacterium bovis subsp bovis AF2122/97
auagccuuacgcggguga

SEQ ID NO: 1069217 - RNA, 13 nt, Mycobacterium bovis subsp bovis AF2122/97
auagcgaccgcgg

SEQ ID NO: 1069218 - RNA, 21 nt, Mycobacterium bovis subsp bovis AF2122/97
auaggacaccgucaugccguu

SEQ ID NO: 1069219 - RNA, 18 nt, Mycobacterium bovis subsp bovis AF2122/97
auagcggcaaagccgggu

SEQ ID NO: 1069220 - RNA, 17 nt, Mycobacterium bovis subsp bovis AF2122/97
auagcgcgugugcgucg

SEQ ID NO: 1069221 - RNA, 12 nt, Mycobacterium bovis subsp bovis AF2122/97
auagcgcacugc

SEQ ID NO: 1069222 - RNA, 18 nt, Mycobacterium bovis subsp bovis AF2122/97
aucaacaggaccgggauc

SEQ ID NO: 1069223 - RNA, 16 nt, Mycobacterium bovis subsp bovis AF2122/97
aucacacccacgucga

SEQ ID NO: 1069224 - RNA, 14 nt, Mycobacterium bovis subsp bovis AF2122/97
aucaauugcccggc

SEQ ID NO: 1069225 - RNA, 19 nt, Mycobacterium bovis subsp bovis AF2122/97
aucaccacccgaccgccau

SEQ ID NO: 1069226 - RNA, 12 nt, Mycobacterium bovis subsp bovis AF2122/97
aucacauagccg

SEQ ID NO: 1069227 - RNA, 23 nt, Mycobacterium bovis subsp bovis AF2122/97
aucacaucgcccggaaccggcgu

SEQ ID NO: 1069228 - RNA, 21 nt, Mycobacterium bovis subsp bovis AF2122/97
aucaagccuucgucgaugcgg

SEQ ID NO: 1069229 - RNA, 20 nt, Mycobacterium bovis subsp bovis AF2122/97
aucaacucgggcagcgcggc

SEQ ID NO: 1069230 - RNA, 16 nt, Mycobacterium bovis subsp bovis AF2122/97
aucaagcacagcccgg

SEQ ID NO: 1069231 - RNA, 15 nt, Mycobacterium bovis subsp bovis AF2122/97
aucaccucgaugccg

SEQ ID NO: 1069232 - RNA, 15 nt, Mycobacterium bovis subsp bovis AF2122/97
aucaccucggugccg

SEQ ID NO: 1069233 - RNA, 19 nt, Mycobacterium bovis subsp bovis AF2122/97
aucaccucggugccggccg

SEQ ID NO: 1069234 - RNA, 13 nt, Mycobacterium bovis subsp bovis AF2122/97
aucaccugcagca

SEQ ID NO: 1069235 - RNA, 20 nt, Mycobacterium bovis subsp bovis AF2122/97
aucaccugcagcacgacgug

SEQ ID NO: 1069236 - RNA, 14 nt, Mycobacterium bovis subsp bovis AF2122/97
aucaccgaccaacg

SEQ ID NO: 1069237 - RNA, 21 nt, Mycobacterium bovis subsp bovis AF2122/97
aucaccuggcgugucgccgcc

SEQ ID NO: 1069238 - RNA, 15 nt, Mycobacterium bovis subsp bovis AF2122/97
aucaccuucggccga

SEQ ID NO: 1069239 - RNA, 19 nt, Mycobacterium bovis subsp bovis AF2122/97
aucaccuucggccgaccgg

SEQ ID NO: 1069240 - RNA, 21 nt, Mycobacterium bovis subsp bovis AF2122/97
aucaccuucggccgaccgggc

SEQ ID NO: 1069241 - RNA, 14 nt, Mycobacterium bovis subsp bovis AF2122/97
aucaccuucgucgc

SEQ ID NO: 1069242 - RNA, 20 nt, Mycobacterium bovis subsp bovis AF2122/97
aucaccuucgucgcggccgc

SEQ ID NO: 1069243 - RNA, 23 nt, Mycobacterium bovis subsp bovis AF2122/97
aucaccuucgucgcggccgcggc

SEQ ID NO: 1069244 - RNA, 18 nt, Mycobacterium bovis subsp bovis AF2122/97
aucacguggugcggccgg

SEQ ID NO: 1069245 - RNA, 23 nt, Mycobacterium bovis subsp bovis AF2122/97
aucacguggugcggccgggucgc

SEQ ID NO: 1069246 - RNA, 18 nt, Mycobacterium bovis subsp bovis AF2122/97
aucaccaccggcaccgcu

SEQ ID NO: 1069247 - RNA, 21 nt, Mycobacterium bovis subsp bovis AF2122/97
aucaccacuggacccgcccag

SEQ ID NO: 1069248 - RNA, 13 nt, Mycobacterium bovis subsp bovis AF2122/97
aucaccaccggca

SEQ ID NO: 1069249 - RNA, 15 nt, Mycobacterium bovis subsp bovis AF2122/97
aucaccaccggcacc

SEQ ID NO: 1069250 - RNA, 22 nt, Mycobacterium bovis subsp bovis AF2122/97
aucaccacgaaugaucgucccg

SEQ ID NO: 1069251 - RNA, 18 nt, Mycobacterium bovis subsp bovis AF2122/97
aucaccacggcguugccg

SEQ ID NO: 1069252 - RNA, 19 nt, Mycobacterium bovis subsp bovis AF2122/97
aucacccuguuugcccaac

SEQ ID NO: 1069253 - RNA, 15 nt, Mycobacterium bovis subsp bovis AF2122/97
aucaccccggcggcc

SEQ ID NO: 1069254 - RNA, 14 nt, Mycobacterium bovis subsp bovis AF2122/97
aucaccccggccgg

SEQ ID NO: 1069255 - RNA, 14 nt, Mycobacterium bovis subsp bovis AF2122/97
aucaccgccaccac

SEQ ID NO: 1069256 - RNA, 22 nt, Mycobacterium bovis subsp bovis AF2122/97
aucaccgccaccaccagggcaa

SEQ ID NO: 1069257 - RNA, 14 nt, Mycobacterium bovis subsp bovis AF2122/97
aucacccgccgcgu

SEQ ID NO: 1069258 - RNA, 18 nt, Mycobacterium bovis subsp bovis AF2122/97
aucaccgacaccgugccg

SEQ ID NO: 1069259 - RNA, 20 nt, Mycobacterium bovis subsp bovis AF2122/97
aucaccgccagcugggcagc

SEQ ID NO: 1069260 - RNA, 17 nt, Mycobacterium bovis subsp bovis AF2122/97
aucaccucccgcggcac

SEQ ID NO: 1069261 - RNA, 14 nt, Mycobacterium bovis subsp bovis AF2122/97
aucagcgcgaacgc

SEQ ID NO: 1069262 - RNA, 20 nt, Mycobacterium bovis subsp bovis AF2122/97
aucagcgacuccaccccacc

SEQ ID NO: 1069263 - RNA, 22 nt, Mycobacterium bovis subsp bovis AF2122/97
aucagcgaguggucccguucgc

SEQ ID NO: 1069264 - RNA, 22 nt, Mycobacterium bovis subsp bovis AF2122/97
aucagcagcagcgugaccaccg

SEQ ID NO: 1069265 - RNA, 12 nt, Mycobacterium bovis subsp bovis AF2122/97
aucagcaccgug

SEQ ID NO: 1069266 - RNA, 17 nt, Mycobacterium bovis subsp bovis AF2122/97
aucagcagagccccggc

SEQ ID NO: 1069267 - RNA, 16 nt, Mycobacterium bovis subsp bovis AF2122/97
aucagaggacccgugc

SEQ ID NO: 1069268 - RNA, 18 nt, Mycobacterium bovis subsp bovis AF2122/97
augaauucauguggcgcg

SEQ ID NO: 1069269 - RNA, 19 nt, Mycobacterium bovis subsp bovis AF2122/97
augaauucuuuggggcgcg

SEQ ID NO: 1069270 - RNA, 15 nt, Mycobacterium bovis subsp bovis AF2122/97
augaauugccgggcg

SEQ ID NO: 1069271 - RNA, 23 nt, Mycobacterium bovis subsp bovis AF2122/97
augaccgguauuaccgccguggc

SEQ ID NO: 1069272 - RNA, 18 nt, Mycobacterium bovis subsp bovis AF2122/97
augaccguauagccgacg

SEQ ID NO: 1069273 - RNA, 18 nt, Mycobacterium bovis subsp bovis AF2122/97
augaccgacaggugcucg

SEQ ID NO: 1069274 - RNA, 17 nt, Mycobacterium bovis subsp bovis AF2122/97
augaucagcgccguggc

SEQ ID NO: 1069275 - RNA, 15 nt, Mycobacterium bovis subsp bovis AF2122/97
augauaccugcccac

SEQ ID NO: 1069276 - RNA, 22 nt, Mycobacterium bovis subsp bovis AF2122/97
augaucagggucagcgccgcgc

SEQ ID NO: 1069277 - RNA, 15 nt, Mycobacterium bovis subsp bovis AF2122/97
augauccgccggcaa

SEQ ID NO: 1069278 - RNA, 16 nt, Mycobacterium bovis subsp bovis AF2122/97
augauagcggcgcagc

SEQ ID NO: 1069279 - RNA, 14 nt, Mycobacterium bovis subsp bovis AF2122/97
augaccgggcuggc

SEQ ID NO: 1069280 - RNA, 14 nt, Mycobacterium bovis subsp bovis AF2122/97
augaccucggcgau

SEQ ID NO: 1069281 - RNA, 15 nt, Mycobacterium bovis subsp bovis AF2122/97
augaccugauccggc

SEQ ID NO: 1069282 - RNA, 15 nt, Mycobacterium bovis subsp bovis AF2122/97
augacgguggugacg

SEQ ID NO: 1069283 - RNA, 15 nt, Mycobacterium bovis subsp bovis AF2122/97
augacggucgggcgg

SEQ ID NO: 1069284 - RNA, 22 nt, Mycobacterium bovis subsp bovis AF2122/97
augacguacggggucgccggca

SEQ ID NO: 1069285 - RNA, 12 nt, Mycobacterium bovis subsp bovis AF2122/97
augacgucggac

SEQ ID NO: 1069286 - RNA, 16 nt, Mycobacterium bovis subsp bovis AF2122/97
augacuugcgacccgu

SEQ ID NO: 1069287 - RNA, 19 nt, Mycobacterium bovis subsp bovis AF2122/97
aucuguuccuugugacccc

SEQ ID NO: 1069288 - RNA, 21 nt, Mycobacterium bovis subsp bovis AF2122/97
aucugugagauaccgacgcgc

SEQ ID NO: 1069289 - RNA, 17 nt, Mycobacterium bovis subsp bovis AF2122/97
aucugucagcgcggcgc

SEQ ID NO: 1069290 - RNA, 16 nt, Mycobacterium bovis subsp bovis AF2122/97
aucuucucgagccgcc

SEQ ID NO: 1069291 - RNA, 22 nt, Mycobacterium bovis subsp bovis AF2122/97
aucuucgggaguguaguagagc

SEQ ID NO: 1069292 - RNA, 19 nt, Mycobacterium bovis subsp bovis AF2122/97
aucucgaaggccgccaacc

SEQ ID NO: 1069293 - RNA, 24 nt, Mycobacterium bovis subsp bovis AF2122/97
aucucgaccucgucggccgacacc

SEQ ID NO: 1069294 - RNA, 16 nt, Mycobacterium bovis subsp bovis AF2122/97
aucucgacaucggcca

SEQ ID NO: 1069295 - RNA, 23 nt, Mycobacterium bovis subsp bovis AF2122/97
aucuccucuugcaccagggccuc

SEQ ID NO: 1069296 - RNA, 20 nt, Mycobacterium bovis subsp bovis AF2122/97
aucuccggcuggcccaccuc

SEQ ID NO: 1069297 - RNA, 21 nt, Mycobacterium bovis subsp bovis AF2122/97
aucuccucgaguugcgcggca

SEQ ID NO: 1069298 - RNA, 21 nt, Mycobacterium bovis subsp bovis AF2122/97
aucugcggaggcgaccccggc

SEQ ID NO: 1069299 - RNA, 16 nt, Mycobacterium bovis subsp bovis AF2122/97
aucucgauuaucgcgc

SEQ ID NO: 1069300 - RNA, 13 nt, Mycobacterium bovis subsp bovis AF2122/97
aucucgcaccgcg

SEQ ID NO: 1069301 - RNA, 17 nt, Mycobacterium bovis subsp bovis AF2122/97
aucucgcaccgcgccgu

SEQ ID NO: 1069302 - RNA, 15 nt, Mycobacterium bovis subsp bovis AF2122/97
aucugcgcgucaggc

SEQ ID NO: 1069303 - RNA, 18 nt, Mycobacterium bovis subsp bovis AF2122/97
aucucgccggugagccgg

SEQ ID NO: 1069304 - RNA, 20 nt, Mycobacterium bovis subsp bovis AF2122/97
aucugcuccucggucagcgg

SEQ ID NO: 1069305 - RNA, 14 nt, Mycobacterium bovis subsp bovis AF2122/97
aucugcucggcauc

SEQ ID NO: 1069306 - RNA, 16 nt, Mycobacterium bovis subsp bovis AF2122/97
aucugcuagcuuggcg

SEQ ID NO: 1069307 - RNA, 13 nt, Mycobacterium bovis subsp bovis AF2122/97
aucugcuccgcag

SEQ ID NO: 1069308 - RNA, 18 nt, Mycobacterium bovis subsp bovis AF2122/97
aucugcucggcaucgagc

SEQ ID NO: 1069309 - RNA, 23 nt, Mycobacterium bovis subsp bovis AF2122/97
aucugcucguagcggcggcgccc

SEQ ID NO: 1069310 - RNA, 21 nt, Mycobacterium bovis subsp bovis AF2122/97
aucugcuugccaccgccgccg

SEQ ID NO: 1069311 - RNA, 18 nt, Mycobacterium bovis subsp bovis AF2122/97
aucugcuuggugaccuga

SEQ ID NO: 1069312 - RNA, 22 nt, Mycobacterium bovis subsp bovis AF2122/97
aucugcugugucguacccggca

SEQ ID NO: 1069313 - RNA, 17 nt, Mycobacterium bovis subsp bovis AF2122/97
aucugguggaccuccgg

SEQ ID NO: 1069314 - RNA, 17 nt, Mycobacterium bovis subsp bovis AF2122/97
aucuggucaagacccgc

SEQ ID NO: 1069315 - RNA, 15 nt, Mycobacterium bovis subsp bovis AF2122/97
aucggaucggcaccc

SEQ ID NO: 1069316 - RNA, 14 nt, Mycobacterium bovis subsp bovis AF2122/97
aucggaugaccagu

SEQ ID NO: 1069317 - RNA, 16 nt, Mycobacterium bovis subsp bovis AF2122/97
aucggcaaugagcuac

SEQ ID NO: 1069318 - RNA, 15 nt, Mycobacterium bovis subsp bovis AF2122/97
aucggcaaucagguc

SEQ ID NO: 1069319 - RNA, 15 nt, Mycobacterium bovis subsp bovis AF2122/97
aucggcaccgucucg

SEQ ID NO: 1069320 - RNA, 18 nt, Mycobacterium bovis subsp bovis AF2122/97
aucggcacaggcggccag

SEQ ID NO: 1069321 - RNA, 22 nt, Mycobacterium bovis subsp bovis AF2122/97
aucggcauacccaucaacaucg

SEQ ID NO: 1069322 - RNA, 20 nt, Mycobacterium bovis subsp bovis AF2122/97
aucggcagcguggacaucgg

SEQ ID NO: 1069323 - RNA, 20 nt, Mycobacterium bovis subsp bovis AF2122/97
aucggcagccccugccgauc

SEQ ID NO: 1069324 - RNA, 20 nt, Mycobacterium bovis subsp bovis AF2122/97
aucggcacuagcgagccggc

SEQ ID NO: 1069325 - RNA, 18 nt, Mycobacterium bovis subsp bovis AF2122/97
aucggcacuuagcccgau

SEQ ID NO: 1069326 - RNA, 17 nt, Mycobacterium bovis subsp bovis AF2122/97
aucggcagaauccgguc

SEQ ID NO: 1069327 - RNA, 21 nt, Mycobacterium bovis subsp bovis AF2122/97
aucggccggguuaucggcagc

SEQ ID NO: 1069328 - RNA, 22 nt, Mycobacterium bovis subsp bovis AF2122/97
aucggccggguuaucggcagca

SEQ ID NO: 1069329 - RNA, 18 nt, Mycobacterium bovis subsp bovis AF2122/97
aucggccgcggucggcca

SEQ ID NO: 1069330 - RNA, 21 nt, Mycobacterium bovis subsp bovis AF2122/97
aucggccuguccaccgaugcc

SEQ ID NO: 1069331 - RNA, 15 nt, Mycobacterium bovis subsp bovis AF2122/97
aucggccuguucgcc

SEQ ID NO: 1069332 - RNA, 18 nt, Mycobacterium bovis subsp bovis AF2122/97
aucggccuguucgccguc

SEQ ID NO: 1069333 - RNA, 12 nt, Mycobacterium bovis subsp bovis AF2122/97
aucggcccgauc

SEQ ID NO: 1069334 - RNA, 15 nt, Mycobacterium bovis subsp bovis AF2122/97
aucggcccgaucacc

SEQ ID NO: 1069335 - RNA, 18 nt, Mycobacterium bovis subsp bovis AF2122/97
aucggcccccaacgcggu

SEQ ID NO: 1069336 - RNA, 20 nt, Mycobacterium bovis subsp bovis AF2122/97
aucggcagucccagcgccgc

SEQ ID NO: 1069337 - RNA, 19 nt, Mycobacterium bovis subsp bovis AF2122/97
aucggcaucggcgacgaac

SEQ ID NO: 1069338 - RNA, 22 nt, Mycobacterium bovis subsp bovis AF2122/97
aucggcacggucacacgccagc

SEQ ID NO: 1069339 - RNA, 21 nt, Mycobacterium bovis subsp bovis AF2122/97
aucggcauguuccuugcggcc

SEQ ID NO: 1069340 - RNA, 22 nt, Mycobacterium bovis subsp bovis AF2122/97
aucggcauguuccuugcggccg

SEQ ID NO: 1069341 - RNA, 20 nt, Mycobacterium bovis subsp bovis AF2122/97
aucggccaucaugagcgacc

SEQ ID NO: 1069342 - RNA, 17 nt, Mycobacterium bovis subsp bovis AF2122/97
aucggccaccaucgccc

SEQ ID NO: 1069343 - RNA, 14 nt, Mycobacterium bovis subsp bovis AF2122/97
aucggccaccuguu

SEQ ID NO: 1069344 - RNA, 18 nt, Mycobacterium bovis subsp bovis AF2122/97
aucggccacuugacaggc

SEQ ID NO: 1069345 - RNA, 17 nt, Mycobacterium bovis subsp bovis AF2122/97
aucggcgccuugguccg

SEQ ID NO: 1069346 - RNA, 21 nt, Mycobacterium bovis subsp bovis AF2122/97
aucggccuguucgccgucgcu

SEQ ID NO: 1069347 - RNA, 21 nt, Mycobacterium bovis subsp bovis AF2122/97
aucggcgauccgacgaccucg

SEQ ID NO: 1069348 - RNA, 16 nt, Mycobacterium bovis subsp bovis AF2122/97
aucggcgaggccucgg

SEQ ID NO: 1069349 - RNA, 12 nt, Mycobacterium bovis subsp bovis AF2122/97
aucggcgacgaa

SEQ ID NO: 1069350 - RNA, 13 nt, Mycobacterium bovis subsp bovis AF2122/97
aucggcgcgccga

SEQ ID NO: 1069351 - RNA, 15 nt, Mycobacterium bovis subsp bovis AF2122/97
aucggcggaccgcag

SEQ ID NO: 1069352 - RNA, 16 nt, Mycobacterium bovis subsp bovis AF2122/97
aucggcggaccgcagc

SEQ ID NO: 1069353 - RNA, 15 nt, Mycobacterium bovis subsp bovis AF2122/97
aucggcggccggcac

SEQ ID NO: 1069354 - RNA, 15 nt, Mycobacterium bovis subsp bovis AF2122/97
aucggcgcgccgauc

SEQ ID NO: 1069355 - RNA, 21 nt, Mycobacterium bovis subsp bovis AF2122/97
aucggcggaugaugcaacgcc

SEQ ID NO: 1069356 - RNA, 15 nt, Mycobacterium bovis subsp bovis AF2122/97
aucggcggcaacggc

SEQ ID NO: 1069357 - RNA, 19 nt, Mycobacterium bovis subsp bovis AF2122/97
aucggcggcgcgccgaucg

SEQ ID NO: 1069358 - RNA, 17 nt, Mycobacterium bovis subsp bovis AF2122/97
aucggcggcguccagca

SEQ ID NO: 1069359 - RNA, 15 nt, Mycobacterium bovis subsp bovis AF2122/97
aucggcggcgucgac

SEQ ID NO: 1069360 - RNA, 17 nt, Mycobacterium bovis subsp bovis AF2122/97
aucggcggcgucgacgu

SEQ ID NO: 1069361 - RNA, 19 nt, Mycobacterium bovis subsp bovis AF2122/97
aucggcggcgucuucgucg

SEQ ID NO: 1069362 - RNA, 15 nt, Mycobacterium bovis subsp bovis AF2122/97
aucggcgguggcggu

SEQ ID NO: 1069363 - RNA, 13 nt, Mycobacterium bovis subsp bovis AF2122/97
aucggcgucacga

SEQ ID NO: 1069364 - RNA, 14 nt, Mycobacterium bovis subsp bovis AF2122/97
aucggcguccauca

SEQ ID NO: 1069365 - RNA, 20 nt, Mycobacterium bovis subsp bovis AF2122/97
aucggcguuagucgaucacg

SEQ ID NO: 1069366 - RNA, 14 nt, Mycobacterium bovis subsp bovis AF2122/97
aucggcguuaucga

SEQ ID NO: 1069367 - RNA, 19 nt, Mycobacterium bovis subsp bovis AF2122/97
aucgggaccggggacgcgc

SEQ ID NO: 1069368 - RNA, 20 nt, Mycobacterium bovis subsp bovis AF2122/97
aucggcuugggaaacccggc

SEQ ID NO: 1069369 - RNA, 20 nt, Mycobacterium bovis subsp bovis AF2122/97
aucggcuaccuaacccgcgc

SEQ ID NO: 1069370 - RNA, 15 nt, Mycobacterium bovis subsp bovis AF2122/97
aucggcuaggccggc

SEQ ID NO: 1069371 - RNA, 13 nt, Mycobacterium bovis subsp bovis AF2122/97
aucggcuccgccg

SEQ ID NO: 1069372 - RNA, 20 nt, Mycobacterium bovis subsp bovis AF2122/97
aucgggucacccccggccag

SEQ ID NO: 1069373 - RNA, 21 nt, Mycobacterium bovis subsp bovis AF2122/97
aucgggucagcaccaccagca

SEQ ID NO: 1069374 - RNA, 22 nt, Mycobacterium bovis subsp bovis AF2122/97
aucgggguggucgcaccgccgg

SEQ ID NO: 1069375 - RNA, 24 nt, Mycobacterium bovis subsp bovis AF2122/97
aucggggucgaacaugauccgccg

SEQ ID NO: 1069376 - RNA, 18 nt, Mycobacterium bovis subsp bovis AF2122/97
aucgggacgccuugaucg

SEQ ID NO: 1069377 - RNA, 15 nt, Mycobacterium bovis subsp bovis AF2122/97
aucgggcuucggcca

SEQ ID NO: 1069378 - RNA, 16 nt, Mycobacterium bovis subsp bovis AF2122/97
aucggggcaccgugcg

SEQ ID NO: 1069379 - RNA, 17 nt, Mycobacterium bovis subsp bovis AF2122/97
aucggggcaccgugcgg

SEQ ID NO: 1069380 - RNA, 13 nt, Mycobacterium bovis subsp bovis AF2122/97
aucggggcgacga

SEQ ID NO: 1069381 - RNA, 15 nt, Mycobacterium bovis subsp bovis AF2122/97
aucgucgaaccggau

SEQ ID NO: 1069382 - RNA, 18 nt, Mycobacterium bovis subsp bovis AF2122/97
aucgucgggcgucccggc

SEQ ID NO: 1069383 - RNA, 17 nt, Mycobacterium bovis subsp bovis AF2122/97
aucgucgucaacccggu

SEQ ID NO: 1069384 - RNA, 18 nt, Mycobacterium bovis subsp bovis AF2122/97
aucgucgucgcugccgcc

SEQ ID NO: 1069385 - RNA, 18 nt, Mycobacterium bovis subsp bovis AF2122/97
aucgucgugucgccgccg

SEQ ID NO: 1069386 - RNA, 23 nt, Mycobacterium bovis subsp bovis AF2122/97
aucgucgugucgccgccguugcc

SEQ ID NO: 1069387 - RNA, 17 nt, Mycobacterium bovis subsp bovis AF2122/97
aucgucgugucgccgcc

SEQ ID NO: 1069388 - RNA, 17 nt, Mycobacterium bovis subsp bovis AF2122/97
aucgucagcgaccacgu

SEQ ID NO: 1069389 - RNA, 14 nt, Mycobacterium bovis subsp bovis AF2122/97
aucguccacgcaga

SEQ ID NO: 1069390 - RNA, 15 nt, Mycobacterium bovis subsp bovis AF2122/97
aucgucagccagcgu

SEQ ID NO: 1069391 - RNA, 19 nt, Mycobacterium bovis subsp bovis AF2122/97
aucgugaacacgucgcggu

SEQ ID NO: 1069392 - RNA, 21 nt, Mycobacterium bovis subsp bovis AF2122/97
aucgugagacgccgucgacgu

SEQ ID NO: 1069393 - RNA, 17 nt, Mycobacterium bovis subsp bovis AF2122/97
aucguuccaggccgcgu

SEQ ID NO: 1069394 - RNA, 18 nt, Mycobacterium bovis subsp bovis AF2122/97
aucguuguugaccaccac

SEQ ID NO: 1069395 - RNA, 22 nt, Mycobacterium bovis subsp bovis AF2122/97
aucguucgcgugccagcgcccc

SEQ ID NO: 1069396 - RNA, 15 nt, Mycobacterium bovis subsp bovis AF2122/97
aucguugccggugcc

SEQ ID NO: 1069397 - RNA, 16 nt, Mycobacterium bovis subsp bovis AF2122/97
aucguugccucgucgc

SEQ ID NO: 1069398 - RNA, 19 nt, Mycobacterium bovis subsp bovis AF2122/97
aucguugccucgucgccgc

SEQ ID NO: 1069399 - RNA, 14 nt, Mycobacterium bovis subsp bovis AF2122/97
aucguugugcaccc

SEQ ID NO: 1069400 - RNA, 20 nt, Mycobacterium bovis subsp bovis AF2122/97
aucguuggccgggcacgcga

SEQ ID NO: 1069401 - RNA, 16 nt, Mycobacterium bovis subsp bovis AF2122/97
aucuccgggucgaugu

SEQ ID NO: 1069402 - RNA, 19 nt, Mycobacterium bovis subsp bovis AF2122/97
aucuccgggucgaugucgg

SEQ ID NO: 1069403 - RNA, 16 nt, Mycobacterium bovis subsp bovis AF2122/97
aucuccgucggccagg

SEQ ID NO: 1069404 - RNA, 12 nt, Mycobacterium bovis subsp bovis AF2122/97
aucucaccacga

SEQ ID NO: 1069405 - RNA, 13 nt, Mycobacterium bovis subsp bovis AF2122/97
aucgccucgacgc

SEQ ID NO: 1069406 - RNA, 18 nt, Mycobacterium bovis subsp bovis AF2122/97
aucgccuccucgacgucg

SEQ ID NO: 1069407 - RNA, 14 nt, Mycobacterium bovis subsp bovis AF2122/97
aucgccucgacgcg

SEQ ID NO: 1069408 - RNA, 15 nt, Mycobacterium bovis subsp bovis AF2122/97
aucgccucgacgcgg

SEQ ID NO: 1069409 - RNA, 16 nt, Mycobacterium bovis subsp bovis AF2122/97
aucgccucaccacguc

SEQ ID NO: 1069410 - RNA, 24 nt, Mycobacterium bovis subsp bovis AF2122/97
aucgccuccagccggcgaaugcgg

SEQ ID NO: 1069411 - RNA, 22 nt, Mycobacterium bovis subsp bovis AF2122/97
aucgccuccaggcgccacccga

SEQ ID NO: 1069412 - RNA, 16 nt, Mycobacterium bovis subsp bovis AF2122/97
aucgccugagcgccgc

SEQ ID NO: 1069413 - RNA, 23 nt, Mycobacterium bovis subsp bovis AF2122/97
aucgccuggaugccgaucgggag

SEQ ID NO: 1069414 - RNA, 20 nt, Mycobacterium bovis subsp bovis AF2122/97
aucgccugggcuuggcgacg

SEQ ID NO: 1069415 - RNA, 13 nt, Mycobacterium bovis subsp bovis AF2122/97
aucgcgcaccgca

SEQ ID NO: 1069416 - RNA, 24 nt, Mycobacterium bovis subsp bovis AF2122/97
aucgcgcagauggcauugcgccca

SEQ ID NO: 1069417 - RNA, 17 nt, Mycobacterium bovis subsp bovis AF2122/97
aucgcgacacgcggccc

SEQ ID NO: 1069418 - RNA, 18 nt, Mycobacterium bovis subsp bovis AF2122/97
aucgcgacacgcggcccg

SEQ ID NO: 1069419 - RNA, 15 nt, Mycobacterium bovis subsp bovis AF2122/97
aucgcgacacggcca

SEQ ID NO: 1069420 - RNA, 16 nt, Mycobacterium bovis subsp bovis AF2122/97
aucgcgacacggccau

SEQ ID NO: 1069421 - RNA, 19 nt, Mycobacterium bovis subsp bovis AF2122/97
aucgcgacacggccauccg

SEQ ID NO: 1069422 - RNA, 13 nt, Mycobacterium bovis subsp bovis AF2122/97
aucgcgacaucgg

SEQ ID NO: 1069423 - RNA, 18 nt, Mycobacterium bovis subsp bovis AF2122/97
aucgcgacaucgguggcg

SEQ ID NO: 1069424 - RNA, 13 nt, Mycobacterium bovis subsp bovis AF2122/97
aucgcgaaaccgg

SEQ ID NO: 1069425 - RNA, 17 nt, Mycobacterium bovis subsp bovis AF2122/97
aucgcgaacaucgccag

SEQ ID NO: 1069426 - RNA, 14 nt, Mycobacterium bovis subsp bovis AF2122/97
aucgccuugcccag

SEQ ID NO: 1069427 - RNA, 23 nt, Mycobacterium bovis subsp bovis AF2122/97
aucgcgacggggucgcgaugcuc

SEQ ID NO: 1069428 - RNA, 15 nt, Mycobacterium bovis subsp bovis AF2122/97
aucgcgacggcaagc

SEQ ID NO: 1069429 - RNA, 20 nt, Mycobacterium bovis subsp bovis AF2122/97
aucgcgacggcaagcacggu

SEQ ID NO: 1069430 - RNA, 24 nt, Mycobacterium bovis subsp bovis AF2122/97
aucgcgagcugcgacgaugccgcc

SEQ ID NO: 1069431 - RNA, 20 nt, Mycobacterium bovis subsp bovis AF2122/97
aucgcgacuagacgccgccg

SEQ ID NO: 1069432 - RNA, 16 nt, Mycobacterium bovis subsp bovis AF2122/97
aucgcgauccacccgg

SEQ ID NO: 1069433 - RNA, 18 nt, Mycobacterium bovis subsp bovis AF2122/97
aucgcgauccacccggca

SEQ ID NO: 1069434 - RNA, 22 nt, Mycobacterium bovis subsp bovis AF2122/97
aucgccgccgcgcguucggcgc

SEQ ID NO: 1069435 - RNA, 15 nt, Mycobacterium bovis subsp bovis AF2122/97
aucgccgccguugcc

SEQ ID NO: 1069436 - RNA, 13 nt, Mycobacterium bovis subsp bovis AF2122/97
aucgccgcgauca

SEQ ID NO: 1069437 - RNA, 16 nt, Mycobacterium bovis subsp bovis AF2122/97
aucgccgcgauggcgg

SEQ ID NO: 1069438 - RNA, 17 nt, Mycobacterium bovis subsp bovis AF2122/97
aucgccgcgauggcggu

SEQ ID NO: 1069439 - RNA, 16 nt, Mycobacterium bovis subsp bovis AF2122/97
aucgccgcuaccguca

SEQ ID NO: 1069440 - RNA, 16 nt, Mycobacterium bovis subsp bovis AF2122/97
aucgccgcuggccagc

SEQ ID NO: 1069441 - RNA, 21 nt, Mycobacterium bovis subsp bovis AF2122/97
aucgccgucagcaccgcuacg

SEQ ID NO: 1069442 - RNA, 17 nt, Mycobacterium bovis subsp bovis AF2122/97
aucgccggggacgccgc

SEQ ID NO: 1069443 - RNA, 18 nt, Mycobacterium bovis subsp bovis AF2122/97
aucgccggggacgccgcg

SEQ ID NO: 1069444 - RNA, 19 nt, Mycobacterium bovis subsp bovis AF2122/97
aucgccgggaacaucccag

SEQ ID NO: 1069445 - RNA, 14 nt, Mycobacterium bovis subsp bovis AF2122/97
aucgccggccgcgu

SEQ ID NO: 1069446 - RNA, 12 nt, Mycobacterium bovis subsp bovis AF2122/97
aucgccgggaac

SEQ ID NO: 1069447 - RNA, 19 nt, Mycobacterium bovis subsp bovis AF2122/97
aucgccggaccgguguggc

SEQ ID NO: 1069448 - RNA, 14 nt, Mycobacterium bovis subsp bovis AF2122/97
aucgccgcccccgu

SEQ ID NO: 1069449 - RNA, 18 nt, Mycobacterium bovis subsp bovis AF2122/97
aucgccgacuacgaagac

SEQ ID NO: 1069450 - RNA, 19 nt, Mycobacterium bovis subsp bovis AF2122/97
aucgccgagaaccagcgaa

SEQ ID NO: 1069451 - RNA, 22 nt, Mycobacterium bovis subsp bovis AF2122/97
aucgccgacgcccaggcauggc

SEQ ID NO: 1069452 - RNA, 23 nt, Mycobacterium bovis subsp bovis AF2122/97
aucgccgccaaccacuuuccggc

SEQ ID NO: 1069453 - RNA, 17 nt, Mycobacterium bovis subsp bovis AF2122/97
aucgcccucgucgcggg

SEQ ID NO: 1069454 - RNA, 13 nt, Mycobacterium bovis subsp bovis AF2122/97
aucgcccgggcgg

SEQ ID NO: 1069455 - RNA, 13 nt, Mycobacterium bovis subsp bovis AF2122/97
aucgcccggcccc

SEQ ID NO: 1069456 - RNA, 16 nt, Mycobacterium bovis subsp bovis AF2122/97
aucgcccggccccgca

SEQ ID NO: 1069457 - RNA, 16 nt, Mycobacterium bovis subsp bovis AF2122/97
aucgcccugacccgga

SEQ ID NO: 1069458 - RNA, 20 nt, Mycobacterium bovis subsp bovis AF2122/97
aucgccgaaucucaccguca

SEQ ID NO: 1069459 - RNA, 16 nt, Mycobacterium bovis subsp bovis AF2122/97
aucgccgaaucggcag

SEQ ID NO: 1069460 - RNA, 15 nt, Mycobacterium bovis subsp bovis AF2122/97
aucgccgacgccaga

SEQ ID NO: 1069461 - RNA, 20 nt, Mycobacterium bovis subsp bovis AF2122/97
aucgcggcgaacaucaccgu

SEQ ID NO: 1069462 - RNA, 16 nt, Mycobacterium bovis subsp bovis AF2122/97
aucgcggcgcccagga

SEQ ID NO: 1069463 - RNA, 22 nt, Mycobacterium bovis subsp bovis AF2122/97
aucgcggcgccgucgucagcgg

SEQ ID NO: 1069464 - RNA, 23 nt, Mycobacterium bovis subsp bovis AF2122/97
aucgcggcguugugaccgccgau

SEQ ID NO: 1069465 - RNA, 24 nt, Mycobacterium bovis subsp bovis AF2122/97
aucgcgggugaucuccaccggcga

SEQ ID NO: 1069466 - RNA, 21 nt, Mycobacterium bovis subsp bovis AF2122/97
aucgcgggcgugccgaccagc

SEQ ID NO: 1069467 - RNA, 16 nt, Mycobacterium bovis subsp bovis AF2122/97
aucgcgguccaacagc

SEQ ID NO: 1069468 - RNA, 17 nt, Mycobacterium bovis subsp bovis AF2122/97
aucgcggucgccaccgu

SEQ ID NO: 1069469 - RNA, 18 nt, Mycobacterium bovis subsp bovis AF2122/97
aucgcguacguacugcuu

SEQ ID NO: 1069470 - RNA, 14 nt, Mycobacterium bovis subsp bovis AF2122/97
aucgcgguggcggu

SEQ ID NO: 1069471 - RNA, 22 nt, Mycobacterium bovis subsp bovis AF2122/97
aucgcgguggcggugucggcgc

SEQ ID NO: 1069472 - RNA, 14 nt, Mycobacterium bovis subsp bovis AF2122/97
aucgcgucgagcgc

SEQ ID NO: 1069473 - RNA, 16 nt, Mycobacterium bovis subsp bovis AF2122/97
aucgcgguccgagcgg

SEQ ID NO: 1069474 - RNA, 16 nt, Mycobacterium bovis subsp bovis AF2122/97
aucgcguccgccucgg

SEQ ID NO: 1069475 - RNA, 12 nt, Mycobacterium bovis subsp bovis AF2122/97
aucgcgucggcg

SEQ ID NO: 1069476 - RNA, 15 nt, Mycobacterium bovis subsp bovis AF2122/97
aucgcgucggcgaug

SEQ ID NO: 1069477 - RNA, 22 nt, Mycobacterium bovis subsp bovis AF2122/97
aucgcgccuuugagcccgcgau

SEQ ID NO: 1069478 - RNA, 16 nt, Mycobacterium bovis subsp bovis AF2122/97
aucgcgccgucggcga

SEQ ID NO: 1069479 - RNA, 18 nt, Mycobacterium bovis subsp bovis AF2122/97
aucgcgccgucggcgaug

SEQ ID NO: 1069480 - RNA, 17 nt, Mycobacterium bovis subsp bovis AF2122/97
aucgcgcgagcgauggg

SEQ ID NO: 1069481 - RNA, 20 nt, Mycobacterium bovis subsp bovis AF2122/97
aucgcgcggcugugcccgau

SEQ ID NO: 1069482 - RNA, 14 nt, Mycobacterium bovis subsp bovis AF2122/97
aucgcggagccagg

SEQ ID NO: 1069483 - RNA, 21 nt, Mycobacterium bovis subsp bovis AF2122/97
aucgcggagccaggacgacgc

SEQ ID NO: 1069484 - RNA, 21 nt, Mycobacterium bovis subsp bovis AF2122/97
aucgcggcccggcccuccggg

SEQ ID NO: 1069485 - RNA, 12 nt, Mycobacterium bovis subsp bovis AF2122/97
aucgcggccgaa

SEQ ID NO: 1069486 - RNA, 18 nt, Mycobacterium bovis subsp bovis AF2122/97
aucgcggcaucgacgcgg

SEQ ID NO: 1069487 - RNA, 15 nt, Mycobacterium bovis subsp bovis AF2122/97
aucgcgcuggcgccc

SEQ ID NO: 1069488 - RNA, 15 nt, Mycobacterium bovis subsp bovis AF2122/97
aucgcggaaccguac

SEQ ID NO: 1069489 - RNA, 22 nt, Mycobacterium bovis subsp bovis AF2122/97
aucgcggaagcgggcgaugccg

SEQ ID NO: 1069490 - RNA, 19 nt, Mycobacterium bovis subsp bovis AF2122/97
aucgcugccagcggccggg

SEQ ID NO: 1069491 - RNA, 14 nt, Mycobacterium bovis subsp bovis AF2122/97
aucgcugaccgcgu

SEQ ID NO: 1069492 - RNA, 22 nt, Mycobacterium bovis subsp bovis AF2122/97
aucgcucauucgugcccgggcg

SEQ ID NO: 1069493 - RNA, 23 nt, Mycobacterium bovis subsp bovis AF2122/97
aucgcuccgcggcgcagcacggc

SEQ ID NO: 1069494 - RNA, 17 nt, Mycobacterium bovis subsp bovis AF2122/97
aucgcuaggaccgcggu

SEQ ID NO: 1069495 - RNA, 13 nt, Mycobacterium bovis subsp bovis AF2122/97
aucgcuacgucga

SEQ ID NO: 1069496 - RNA, 17 nt, Mycobacterium bovis subsp bovis AF2122/97
aucgcuacgucgaccga

SEQ ID NO: 1069497 - RNA, 16 nt, Mycobacterium bovis subsp bovis AF2122/97
aucgcguggaucgcgc

SEQ ID NO: 1069498 - RNA, 13 nt, Mycobacterium bovis subsp bovis AF2122/97
aucgcguggcgca

SEQ ID NO: 1069499 - RNA, 17 nt, Mycobacterium bovis subsp bovis AF2122/97
aucgcgucgggcucggc

SEQ ID NO: 1069500 - RNA, 16 nt, Mycobacterium bovis subsp bovis AF2122/97
aucgcgugcggugccg

SEQ ID NO: 1069501 - RNA, 23 nt, Mycobacterium bovis subsp bovis AF2122/97
aucgcgugcggugccguggugga

SEQ ID NO: 1069502 - RNA, 15 nt, Mycobacterium bovis subsp bovis AF2122/97
aucgcuucccggaag

SEQ ID NO: 1069503 - RNA, 22 nt, Mycobacterium bovis subsp bovis AF2122/97
aucggagucuucaacgucgaga

SEQ ID NO: 1069504 - RNA, 19 nt, Mycobacterium bovis subsp bovis AF2122/97
aucggacagcgccuggccg

SEQ ID NO: 1069505 - RNA, 15 nt, Mycobacterium bovis subsp bovis AF2122/97
aucggaggaaccccg

SEQ ID NO: 1069506 - RNA, 21 nt, Mycobacterium bovis subsp bovis AF2122/97
aucggaaacggagccgagccg

SEQ ID NO: 1069507 - RNA, 23 nt, Mycobacterium bovis subsp bovis AF2122/97
aucggaaccguuugacgcgcucg

SEQ ID NO: 1069508 - RNA, 17 nt, Mycobacterium bovis subsp bovis AF2122/97
aucggaagagucgacgc

SEQ ID NO: 1069509 - RNA, 20 nt, Mycobacterium bovis subsp bovis AF2122/97
aucgccacgacaggucgccc

SEQ ID NO: 1069510 - RNA, 13 nt, Mycobacterium bovis subsp bovis AF2122/97
aucgccaccgcgu

SEQ ID NO: 1069511 - RNA, 13 nt, Mycobacterium bovis subsp bovis AF2122/97
aucgccaccaccc

SEQ ID NO: 1069512 - RNA, 21 nt, Mycobacterium bovis subsp bovis AF2122/97
aucgccacagucgucgagcgc

SEQ ID NO: 1069513 - RNA, 19 nt, Mycobacterium bovis subsp bovis AF2122/97
aucgccaaauccggugccc

SEQ ID NO: 1069514 - RNA, 15 nt, Mycobacterium bovis subsp bovis AF2122/97
aucgccaaauccggu

SEQ ID NO: 1069515 - RNA, 15 nt, Mycobacterium bovis subsp bovis AF2122/97
aucgccagccggcga

SEQ ID NO: 1069516 - RNA, 15 nt, Mycobacterium bovis subsp bovis AF2122/97
aucgcccaacaacgc

SEQ ID NO: 1069517 - RNA, 20 nt, Mycobacterium bovis subsp bovis AF2122/97
aucgccauguaucugggcga

SEQ ID NO: 1069518 - RNA, 14 nt, Mycobacterium bovis subsp bovis AF2122/97
aucgcccgaugcgc

SEQ ID NO: 1069519 - RNA, 17 nt, Mycobacterium bovis subsp bovis AF2122/97
aucgcccgcugagcacu

SEQ ID NO: 1069520 - RNA, 22 nt, Mycobacterium bovis subsp bovis AF2122/97
aucgccaucgguugacccggca

SEQ ID NO: 1069521 - RNA, 18 nt, Mycobacterium bovis subsp bovis AF2122/97
aucgcaggcaccccgauc

SEQ ID NO: 1069522 - RNA, 13 nt, Mycobacterium bovis subsp bovis AF2122/97
aucgcauccccag

SEQ ID NO: 1069523 - RNA, 12 nt, Mycobacterium bovis subsp bovis AF2122/97
aucgcauccgcg

SEQ ID NO: 1069524 - RNA, 17 nt, Mycobacterium bovis subsp bovis AF2122/97
aucgcauggucuucgcg

SEQ ID NO: 1069525 - RNA, 18 nt, Mycobacterium bovis subsp bovis AF2122/97
aucgcauggucuucgcgg

SEQ ID NO: 1069526 - RNA, 14 nt, Mycobacterium bovis subsp bovis AF2122/97
aucgcagauggcga

SEQ ID NO: 1069527 - RNA, 21 nt, Mycobacterium bovis subsp bovis AF2122/97
aucgcagaacggaccucggcg

SEQ ID NO: 1069528 - RNA, 19 nt, Mycobacterium bovis subsp bovis AF2122/97
aucgcagacacugcugcgg

SEQ ID NO: 1069529 - RNA, 13 nt, Mycobacterium bovis subsp bovis AF2122/97
aucgcacgccagc

SEQ ID NO: 1069530 - RNA, 17 nt, Mycobacterium bovis subsp bovis AF2122/97
aucgcacgcugcucgac

SEQ ID NO: 1069531 - RNA, 20 nt, Mycobacterium bovis subsp bovis AF2122/97
aucgaucagcaacucggcca

SEQ ID NO: 1069532 - RNA, 23 nt, Mycobacterium bovis subsp bovis AF2122/97
aucgaucgaauuaaagccaccag

SEQ ID NO: 1069533 - RNA, 12 nt, Mycobacterium bovis subsp bovis AF2122/97
aucgaucggauc

SEQ ID NO: 1069534 - RNA, 22 nt, Mycobacterium bovis subsp bovis AF2122/97
aucgaugaccuuugagucgaga

SEQ ID NO: 1069535 - RNA, 21 nt, Mycobacterium bovis subsp bovis AF2122/97
aucgcaagcgcggcgaagccg

SEQ ID NO: 1069536 - RNA, 14 nt, Mycobacterium bovis subsp bovis AF2122/97
aucgauuccgccgc

SEQ ID NO: 1069537 - RNA, 17 nt, Mycobacterium bovis subsp bovis AF2122/97
aucgauuccgccgcacu

SEQ ID NO: 1069538 - RNA, 19 nt, Mycobacterium bovis subsp bovis AF2122/97
aucgcaaugaccugcagcg

SEQ ID NO: 1069539 - RNA, 20 nt, Mycobacterium bovis subsp bovis AF2122/97
aucgcaaugaccugcagcgc

SEQ ID NO: 1069540 - RNA, 17 nt, Mycobacterium bovis subsp bovis AF2122/97
aucgcaaugggcucaca

SEQ ID NO: 1069541 - RNA, 15 nt, Mycobacterium bovis subsp bovis AF2122/97
aucgcacaccaacac

SEQ ID NO: 1069542 - RNA, 18 nt, Mycobacterium bovis subsp bovis AF2122/97
aucgcacaccaacaccgc

SEQ ID NO: 1069543 - RNA, 16 nt, Mycobacterium bovis subsp bovis AF2122/97
aucgcacagcgcaggg

SEQ ID NO: 1069544 - RNA, 23 nt, Mycobacterium bovis subsp bovis AF2122/97
aucgcacagcgcaggguucgucg

SEQ ID NO: 1069545 - RNA, 15 nt, Mycobacterium bovis subsp bovis AF2122/97
aucgcacagcgcgau

SEQ ID NO: 1069546 - RNA, 15 nt, Mycobacterium bovis subsp bovis AF2122/97
aucaggccgaugcgg

SEQ ID NO: 1069547 - RNA, 22 nt, Mycobacterium bovis subsp bovis AF2122/97
aucgacagugugaagaccaccg

SEQ ID NO: 1069548 - RNA, 17 nt, Mycobacterium bovis subsp bovis AF2122/97
aucgacaucaccaccgc

SEQ ID NO: 1069549 - RNA, 14 nt, Mycobacterium bovis subsp bovis AF2122/97
aucaggccgucgcc

SEQ ID NO: 1069550 - RNA, 16 nt, Mycobacterium bovis subsp bovis AF2122/97
aucaggccgacgucga

SEQ ID NO: 1069551 - RNA, 20 nt, Mycobacterium bovis subsp bovis AF2122/97
aucaggccgaugacgaugcc

SEQ ID NO: 1069552 - RNA, 22 nt, Mycobacterium bovis subsp bovis AF2122/97
aucgacgagccgcggucggcgu

SEQ ID NO: 1069553 - RNA, 21 nt, Mycobacterium bovis subsp bovis AF2122/97
aucgaccaccggguagccggc

SEQ ID NO: 1069554 - RNA, 20 nt, Mycobacterium bovis subsp bovis AF2122/97
aucgaccaauucgaccgcgc

SEQ ID NO: 1069555 - RNA, 17 nt, Mycobacterium bovis subsp bovis AF2122/97
aucgaccgcuggaucgc

SEQ ID NO: 1069556 - RNA, 20 nt, Mycobacterium bovis subsp bovis AF2122/97
aucgaccgcccgccagcgau

SEQ ID NO: 1069557 - RNA, 21 nt, Mycobacterium bovis subsp bovis AF2122/97
aucgaccgccuccucgauagc

SEQ ID NO: 1069558 - RNA, 14 nt, Mycobacterium bovis subsp bovis AF2122/97
aucgaccuggccac

SEQ ID NO: 1069559 - RNA, 14 nt, Mycobacterium bovis subsp bovis AF2122/97
aucgacgaccguca

SEQ ID NO: 1069560 - RNA, 23 nt, Mycobacterium bovis subsp bovis AF2122/97
aucgagacgcacggccaccgcgc

SEQ ID NO: 1069561 - RNA, 19 nt, Mycobacterium bovis subsp bovis AF2122/97
aucgagacuucuucgacgc

SEQ ID NO: 1069562 - RNA, 14 nt, Mycobacterium bovis subsp bovis AF2122/97
aucgagaucgccgu

SEQ ID NO: 1069563 - RNA, 22 nt, Mycobacterium bovis subsp bovis AF2122/97
aucgagaucgccguugccggcg

SEQ ID NO: 1069564 - RNA, 15 nt, Mycobacterium bovis subsp bovis AF2122/97
aucgagagccgaccg

SEQ ID NO: 1069565 - RNA, 22 nt, Mycobacterium bovis subsp bovis AF2122/97
aucgacugaucgccacccgguc

SEQ ID NO: 1069566 - RNA, 15 nt, Mycobacterium bovis subsp bovis AF2122/97
aucgacugccagcgc

SEQ ID NO: 1069567 - RNA, 15 nt, Mycobacterium bovis subsp bovis AF2122/97
aucgacugaucgcca

SEQ ID NO: 1069568 - RNA, 17 nt, Mycobacterium bovis subsp bovis AF2122/97
aucgacugaucgccacc

SEQ ID NO: 1069569 - RNA, 19 nt, Mycobacterium bovis subsp bovis AF2122/97
aucgacuucggcgucggac

SEQ ID NO: 1069570 - RNA, 14 nt, Mycobacterium bovis subsp bovis AF2122/97
aucgagccgacccg

SEQ ID NO: 1069571 - RNA, 13 nt, Mycobacterium bovis subsp bovis AF2122/97
aucgagcaggccg

SEQ ID NO: 1069572 - RNA, 20 nt, Mycobacterium bovis subsp bovis AF2122/97
aucgagcaccgcaaccacgc

SEQ ID NO: 1069573 - RNA, 15 nt, Mycobacterium bovis subsp bovis AF2122/97
aucgagcaggccgcc

SEQ ID NO: 1069574 - RNA, 17 nt, Mycobacterium bovis subsp bovis AF2122/97
aucgagcaggccgccca

SEQ ID NO: 1069575 - RNA, 18 nt, Mycobacterium bovis subsp bovis AF2122/97
aucgagcaguggccgccg

SEQ ID NO: 1069576 - RNA, 17 nt, Mycobacterium bovis subsp bovis AF2122/97
aucgaggaacucggacc

SEQ ID NO: 1069577 - RNA, 16 nt, Mycobacterium bovis subsp bovis AF2122/97
aucgagcugaccuggu

SEQ ID NO: 1069578 - RNA, 15 nt, Mycobacterium bovis subsp bovis AF2122/97
aucgagcgccagcgc

SEQ ID NO: 1069579 - RNA, 21 nt, Mycobacterium bovis subsp bovis AF2122/97
aucgaucccuugucgaaguac

SEQ ID NO: 1069580 - RNA, 21 nt, Mycobacterium bovis subsp bovis AF2122/97
aucgaucaacaccaaucgggu

SEQ ID NO: 1069581 - RNA, 23 nt, Mycobacterium bovis subsp bovis AF2122/97
aucgaggccacgccagcucgccg

SEQ ID NO: 1069582 - RNA, 15 nt, Mycobacterium bovis subsp bovis AF2122/97
aucgagucgaagaac

SEQ ID NO: 1069583 - RNA, 15 nt, Mycobacterium bovis subsp bovis AF2122/97
aucgaguuccgcauc

SEQ ID NO: 1069584 - RNA, 17 nt, Mycobacterium bovis subsp bovis AF2122/97
aucgaggagaugccgac

SEQ ID NO: 1069585 - RNA, 19 nt, Mycobacterium bovis subsp bovis AF2122/97
aucgaggagaugccgacga

SEQ ID NO: 1069586 - RNA, 20 nt, Mycobacterium bovis subsp bovis AF2122/97
aucgaggaggcggucgauca

SEQ ID NO: 1069587 - RNA, 18 nt, Mycobacterium bovis subsp bovis AF2122/97
aucgaggaguuggugcag

SEQ ID NO: 1069588 - RNA, 17 nt, Mycobacterium bovis subsp bovis AF2122/97
auguccuauuugcagcc

SEQ ID NO: 1069589 - RNA, 14 nt, Mycobacterium bovis subsp bovis AF2122/97
auguccgcggccac

SEQ ID NO: 1069590 - RNA, 21 nt, Mycobacterium bovis subsp bovis AF2122/97
auguccgcagcaccgucgggc

SEQ ID NO: 1069591 - RNA, 17 nt, Mycobacterium bovis subsp bovis AF2122/97
augucccaugcacggcc

SEQ ID NO: 1069592 - RNA, 18 nt, Mycobacterium bovis subsp bovis AF2122/97
auguccgacgccaccgcc

SEQ ID NO: 1069593 - RNA, 19 nt, Mycobacterium bovis subsp bovis AF2122/97
auguagagcucaccgucga

SEQ ID NO: 1069594 - RNA, 15 nt, Mycobacterium bovis subsp bovis AF2122/97
auguccauagccggc

SEQ ID NO: 1069595 - RNA, 16 nt, Mycobacterium bovis subsp bovis AF2122/97
augucggccaggucgg

SEQ ID NO: 1069596 - RNA, 15 nt, Mycobacterium bovis subsp bovis AF2122/97
augucggccggggcc

SEQ ID NO: 1069597 - RNA, 20 nt, Mycobacterium bovis subsp bovis AF2122/97
augucgaagacguuggcgcg

SEQ ID NO: 1069598 - RNA, 20 nt, Mycobacterium bovis subsp bovis AF2122/97
augucgaaacccacguacgc

SEQ ID NO: 1069599 - RNA, 17 nt, Mycobacterium bovis subsp bovis AF2122/97
augucgaacaggaucag

SEQ ID NO: 1069600 - RNA, 19 nt, Mycobacterium bovis subsp bovis AF2122/97
auguccugggccgccgccc

SEQ ID NO: 1069601 - RNA, 18 nt, Mycobacterium bovis subsp bovis AF2122/97
augucgaagaaccggccg

SEQ ID NO: 1069602 - RNA, 21 nt, Mycobacterium bovis subsp bovis AF2122/97
augucgaagaaccggccgacg

SEQ ID NO: 1069603 - RNA, 18 nt, Mycobacterium bovis subsp bovis AF2122/97
augucggcucggcccccg

SEQ ID NO: 1069604 - RNA, 20 nt, Mycobacterium bovis subsp bovis AF2122/97
augucggggccgucgucggu

SEQ ID NO: 1069605 - RNA, 22 nt, Mycobacterium bovis subsp bovis AF2122/97
augucggggccgucgucgguca

SEQ ID NO: 1069606 - RNA, 17 nt, Mycobacterium bovis subsp bovis AF2122/97
augucggugcguccggu

SEQ ID NO: 1069607 - RNA, 13 nt, Mycobacterium bovis subsp bovis AF2122/97
augucggugauca

SEQ ID NO: 1069608 - RNA, 14 nt, Mycobacterium bovis subsp bovis AF2122/97
augucguaggccgc

SEQ ID NO: 1069609 - RNA, 20 nt, Mycobacterium bovis subsp bovis AF2122/97
augucguaguagcggaucag

SEQ ID NO: 1069610 - RNA, 16 nt, Mycobacterium bovis subsp bovis AF2122/97
augucguugcccgcga

SEQ ID NO: 1069611 - RNA, 14 nt, Mycobacterium bovis subsp bovis AF2122/97
augucgucaccgug

SEQ ID NO: 1069612 - RNA, 12 nt, Mycobacterium bovis subsp bovis AF2122/97
augucgucgaca

SEQ ID NO: 1069613 - RNA, 13 nt, Mycobacterium bovis subsp bovis AF2122/97
augucgucgauga

SEQ ID NO: 1069614 - RNA, 17 nt, Mycobacterium bovis subsp bovis AF2122/97
augucucggcaccacag

SEQ ID NO: 1069615 - RNA, 23 nt, Mycobacterium bovis subsp bovis AF2122/97
augucugcgcagguggucgauca

SEQ ID NO: 1069616 - RNA, 22 nt, Mycobacterium bovis subsp bovis AF2122/97
auggucgacgaacaccccgggc

SEQ ID NO: 1069617 - RNA, 14 nt, Mycobacterium bovis subsp bovis AF2122/97
augggcagccgccc

SEQ ID NO: 1069618 - RNA, 20 nt, Mycobacterium bovis subsp bovis AF2122/97
augggcccagcggccgcgau

SEQ ID NO: 1069619 - RNA, 15 nt, Mycobacterium bovis subsp bovis AF2122/97
auggucgggcggcgu

SEQ ID NO: 1069620 - RNA, 20 nt, Mycobacterium bovis subsp bovis AF2122/97
auggugaugggggagccggu

SEQ ID NO: 1069621 - RNA, 15 nt, Mycobacterium bovis subsp bovis AF2122/97
auggugccgacccgc

SEQ ID NO: 1069622 - RNA, 21 nt, Mycobacterium bovis subsp bovis AF2122/97
auggugaauaucucgccguac

SEQ ID NO: 1069623 - RNA, 18 nt, Mycobacterium bovis subsp bovis AF2122/97
auggugaacgcgaauacc

SEQ ID NO: 1069624 - RNA, 15 nt, Mycobacterium bovis subsp bovis AF2122/97
auggugguggcccgg

SEQ ID NO: 1069625 - RNA, 18 nt, Mycobacterium bovis subsp bovis AF2122/97
auguacacuuugcccgcc

SEQ ID NO: 1069626 - RNA, 15 nt, Mycobacterium bovis subsp bovis AF2122/97
auguaccgaccgcgu

SEQ ID NO: 1069627 - RNA, 19 nt, Mycobacterium bovis subsp bovis AF2122/97
auguaccugguugcugacg

SEQ ID NO: 1069628 - RNA, 17 nt, Mycobacterium bovis subsp bovis AF2122/97
auggugggugccggcgu

SEQ ID NO: 1069629 - RNA, 16 nt, Mycobacterium bovis subsp bovis AF2122/97
augguggugccgucag

SEQ ID NO: 1069630 - RNA, 13 nt, Mycobacterium bovis subsp bovis AF2122/97
augguggcgccga

SEQ ID NO: 1069631 - RNA, 14 nt, Mycobacterium bovis subsp bovis AF2122/97
augguggcgccgac

SEQ ID NO: 1069632 - RNA, 20 nt, Mycobacterium bovis subsp bovis AF2122/97
augguggacgaggcggucga

SEQ ID NO: 1069633 - RNA, 21 nt, Mycobacterium bovis subsp bovis AF2122/97
auggugaugggggagccggug

SEQ ID NO: 1069634 - RNA, 22 nt, Mycobacterium bovis subsp bovis AF2122/97
auggugcggcccaaccggucgu

SEQ ID NO: 1069635 - RNA, 14 nt, Mycobacterium bovis subsp bovis AF2122/97
auggugcggcggcg

SEQ ID NO: 1069636 - RNA, 18 nt, Mycobacterium bovis subsp bovis AF2122/97
auggugcggucuggcgac

SEQ ID NO: 1069637 - RNA, 15 nt, Mycobacterium bovis subsp bovis AF2122/97
auggugcgccgggcg

SEQ ID NO: 1069638 - RNA, 16 nt, Mycobacterium bovis subsp bovis AF2122/97
auggugcgccgggcgu

SEQ ID NO: 1069639 - RNA, 21 nt, Mycobacterium bovis subsp bovis AF2122/97
auggugcgccgggcguccgcc

SEQ ID NO: 1069640 - RNA, 13 nt, Mycobacterium bovis subsp bovis AF2122/97
auggcggccacca

SEQ ID NO: 1069641 - RNA, 20 nt, Mycobacterium bovis subsp bovis AF2122/97
auggcggccaccgucagcgc

SEQ ID NO: 1069642 - RNA, 22 nt, Mycobacterium bovis subsp bovis AF2122/97
auggcggccaccgucagcgcga

SEQ ID NO: 1069643 - RNA, 24 nt, Mycobacterium bovis subsp bovis AF2122/97
auggcgcugggauguucgaucagc

SEQ ID NO: 1069644 - RNA, 20 nt, Mycobacterium bovis subsp bovis AF2122/97
auggcgacgaacgccgucag

SEQ ID NO: 1069645 - RNA, 15 nt, Mycobacterium bovis subsp bovis AF2122/97
auggcggcgacccgu

SEQ ID NO: 1069646 - RNA, 22 nt, Mycobacterium bovis subsp bovis AF2122/97
auggcggcgcguucgucgucgc

SEQ ID NO: 1069647 - RNA, 24 nt, Mycobacterium bovis subsp bovis AF2122/97
auggcggcgcaccuugaccgucgc

SEQ ID NO: 1069648 - RNA, 12 nt, Mycobacterium bovis subsp bovis AF2122/97
auggcggcgccg

SEQ ID NO: 1069649 - RNA, 23 nt, Mycobacterium bovis subsp bovis AF2122/97
auggcgucggccaggaucaaccg

SEQ ID NO: 1069650 - RNA, 14 nt, Mycobacterium bovis subsp bovis AF2122/97
auggcgucgccggc

SEQ ID NO: 1069651 - RNA, 20 nt, Mycobacterium bovis subsp bovis AF2122/97
auggcgucgccggccccgcc

SEQ ID NO: 1069652 - RNA, 21 nt, Mycobacterium bovis subsp bovis AF2122/97
auggcgucgccggccccgccg

SEQ ID NO: 1069653 - RNA, 23 nt, Mycobacterium bovis subsp bovis AF2122/97
auggcgucgccggccccgccggc

SEQ ID NO: 1069654 - RNA, 18 nt, Mycobacterium bovis subsp bovis AF2122/97
auggcgugcagacccggu

SEQ ID NO: 1069655 - RNA, 15 nt, Mycobacterium bovis subsp bovis AF2122/97
auggcguuugccggc

SEQ ID NO: 1069656 - RNA, 14 nt, Mycobacterium bovis subsp bovis AF2122/97
auggcuccggccgc

SEQ ID NO: 1069657 - RNA, 14 nt, Mycobacterium bovis subsp bovis AF2122/97
auggcucgccgaaa

SEQ ID NO: 1069658 - RNA, 23 nt, Mycobacterium bovis subsp bovis AF2122/97
augggauucggccagacgcucuu

SEQ ID NO: 1069659 - RNA, 16 nt, Mycobacterium bovis subsp bovis AF2122/97
auggcuugcucugcgc

SEQ ID NO: 1069660 - RNA, 17 nt, Mycobacterium bovis subsp bovis AF2122/97
auggcuuggaccagcgu

SEQ ID NO: 1069661 - RNA, 23 nt, Mycobacterium bovis subsp bovis AF2122/97
auggcuuggugcccaaggcagac

SEQ ID NO: 1069662 - RNA, 16 nt, Mycobacterium bovis subsp bovis AF2122/97
auggcugagcccgccg

SEQ ID NO: 1069663 - RNA, 23 nt, Mycobacterium bovis subsp bovis AF2122/97
auggccguccgaccgauaacacc

SEQ ID NO: 1069664 - RNA, 17 nt, Mycobacterium bovis subsp bovis AF2122/97
auggcccgaucgaccgc

SEQ ID NO: 1069665 - RNA, 18 nt, Mycobacterium bovis subsp bovis AF2122/97
auggcccgaucgaccgcu

SEQ ID NO: 1069666 - RNA, 22 nt, Mycobacterium bovis subsp bovis AF2122/97
auggccguugaggaacuccgcg

SEQ ID NO: 1069667 - RNA, 21 nt, Mycobacterium bovis subsp bovis AF2122/97
auggccguugccaacaacauc

SEQ ID NO: 1069668 - RNA, 20 nt, Mycobacterium bovis subsp bovis AF2122/97
auggccaucuggccgcgggc

SEQ ID NO: 1069669 - RNA, 14 nt, Mycobacterium bovis subsp bovis AF2122/97
auggccaccggcgg

SEQ ID NO: 1069670 - RNA, 23 nt, Mycobacterium bovis subsp bovis AF2122/97
auggccccugucauguccugggc

SEQ ID NO: 1069671 - RNA, 15 nt, Mycobacterium bovis subsp bovis AF2122/97
auggccuugcugcgc

SEQ ID NO: 1069672 - RNA, 22 nt, Mycobacterium bovis subsp bovis AF2122/97
auggccuugcugcgcgauggcc

SEQ ID NO: 1069673 - RNA, 22 nt, Mycobacterium bovis subsp bovis AF2122/97
auggcgaccacccccggcaggc

SEQ ID NO: 1069674 - RNA, 13 nt, Mycobacterium bovis subsp bovis AF2122/97
auggaccagcgcc

SEQ ID NO: 1069675 - RNA, 15 nt, Mycobacterium bovis subsp bovis AF2122/97
auggccagcaccacg

SEQ ID NO: 1069676 - RNA, 21 nt, Mycobacterium bovis subsp bovis AF2122/97
auggccagcaccacggccagc

SEQ ID NO: 1069677 - RNA, 14 nt, Mycobacterium bovis subsp bovis AF2122/97
auggccagcaccac

SEQ ID NO: 1069678 - RNA, 19 nt, Mycobacterium bovis subsp bovis AF2122/97
auggccaggcuggcgucac

SEQ ID NO: 1069679 - RNA, 17 nt, Mycobacterium bovis subsp bovis AF2122/97
auggccagcaucagcgc

SEQ ID NO: 1069680 - RNA, 19 nt, Mycobacterium bovis subsp bovis AF2122/97
auggacagcugcggguuca

SEQ ID NO: 1069681 - RNA, 17 nt, Mycobacterium bovis subsp bovis AF2122/97
auggacaccagccagau

SEQ ID NO: 1069682 - RNA, 18 nt, Mycobacterium bovis subsp bovis AF2122/97
auggaaguaaggcacggg

SEQ ID NO: 1069683 - RNA, 17 nt, Mycobacterium bovis subsp bovis AF2122/97
augcgcaccagcaccug

SEQ ID NO: 1069684 - RNA, 21 nt, Mycobacterium bovis subsp bovis AF2122/97
augcgcaacaccucaccgcgg

SEQ ID NO: 1069685 - RNA, 19 nt, Mycobacterium bovis subsp bovis AF2122/97
augcgauucugcguccugc

SEQ ID NO: 1069686 - RNA, 21 nt, Mycobacterium bovis subsp bovis AF2122/97
augcgauucugcguccugcuc

SEQ ID NO: 1069687 - RNA, 17 nt, Mycobacterium bovis subsp bovis AF2122/97
augcgauucugcgucug

SEQ ID NO: 1069688 - RNA, 19 nt, Mycobacterium bovis subsp bovis AF2122/97
augcgauucugcgucugcu

SEQ ID NO: 1069689 - RNA, 12 nt, Mycobacterium bovis subsp bovis AF2122/97
augcgaugcggu

SEQ ID NO: 1069690 - RNA, 19 nt, Mycobacterium bovis subsp bovis AF2122/97
augcgauuccgcgucugcu

SEQ ID NO: 1069691 - RNA, 14 nt, Mycobacterium bovis subsp bovis AF2122/97
augcgcacucccgg

SEQ ID NO: 1069692 - RNA, 20 nt, Mycobacterium bovis subsp bovis AF2122/97
augcgcagaaacgccgagcg

SEQ ID NO: 1069693 - RNA, 21 nt, Mycobacterium bovis subsp bovis AF2122/97
augcgcguuacccaucgccac

SEQ ID NO: 1069694 - RNA, 19 nt, Mycobacterium bovis subsp bovis AF2122/97
augcgcucggccugcugcu

SEQ ID NO: 1069695 - RNA, 14 nt, Mycobacterium bovis subsp bovis AF2122/97
augcgcucacugca

SEQ ID NO: 1069696 - RNA, 13 nt, Mycobacterium bovis subsp bovis AF2122/97
augcgcugccgcc

SEQ ID NO: 1069697 - RNA, 16 nt, Mycobacterium bovis subsp bovis AF2122/97
augcgcugcucacgca

SEQ ID NO: 1069698 - RNA, 16 nt, Mycobacterium bovis subsp bovis AF2122/97
augcgcuggcgccgcc

SEQ ID NO: 1069699 - RNA, 19 nt, Mycobacterium bovis subsp bovis AF2122/97
augcggaacgccgagcacg

SEQ ID NO: 1069700 - RNA, 21 nt, Mycobacterium bovis subsp bovis AF2122/97
augcggaacgccgagcacgcc

SEQ ID NO: 1069701 - RNA, 21 nt, Mycobacterium bovis subsp bovis AF2122/97
augcgggcugugaacagcgcg

SEQ ID NO: 1069702 - RNA, 22 nt, Mycobacterium bovis subsp bovis AF2122/97
augcgggcugugaacagcgcgu

SEQ ID NO: 1069703 - RNA, 19 nt, Mycobacterium bovis subsp bovis AF2122/97
augcgggcuuugccaacaa

SEQ ID NO: 1069704 - RNA, 19 nt, Mycobacterium bovis subsp bovis AF2122/97
augcgggucugcggucauc

SEQ ID NO: 1069705 - RNA, 21 nt, Mycobacterium bovis subsp bovis AF2122/97
augcgggucugacaucggcca

SEQ ID NO: 1069706 - RNA, 21 nt, Mycobacterium bovis subsp bovis AF2122/97
augcggucgucacggaccgcc

SEQ ID NO: 1069707 - RNA, 16 nt, Mycobacterium bovis subsp bovis AF2122/97
augcgguagucgccga

SEQ ID NO: 1069708 - RNA, 18 nt, Mycobacterium bovis subsp bovis AF2122/97
augcguugacgucgagca

SEQ ID NO: 1069709 - RNA, 19 nt, Mycobacterium bovis subsp bovis AF2122/97
augcgucugcucgccgggc

SEQ ID NO: 1069710 - RNA, 15 nt, Mycobacterium bovis subsp bovis AF2122/97
augcguccgcccagc

SEQ ID NO: 1069711 - RNA, 13 nt, Mycobacterium bovis subsp bovis AF2122/97
augcgugccggca

SEQ ID NO: 1069712 - RNA, 19 nt, Mycobacterium bovis subsp bovis AF2122/97
augcgguguagggcggcgu

SEQ ID NO: 1069713 - RNA, 22 nt, Mycobacterium bovis subsp bovis AF2122/97
augcggugucgggcuggguggc

SEQ ID NO: 1069714 - RNA, 14 nt, Mycobacterium bovis subsp bovis AF2122/97
augcggugcccgcc

SEQ ID NO: 1069715 - RNA, 15 nt, Mycobacterium bovis subsp bovis AF2122/97
augcggugcccgccc

SEQ ID NO: 1069716 - RNA, 17 nt, Mycobacterium bovis subsp bovis AF2122/97
augcgguccucgaucgg

SEQ ID NO: 1069717 - RNA, 14 nt, Mycobacterium bovis subsp bovis AF2122/97
augcgguuugccgg

SEQ ID NO: 1069718 - RNA, 16 nt, Mycobacterium bovis subsp bovis AF2122/97
augcgguucucgagcu

SEQ ID NO: 1069719 - RNA, 18 nt, Mycobacterium bovis subsp bovis AF2122/97
augcgguucucgagcucg

SEQ ID NO: 1069720 - RNA, 20 nt, Mycobacterium bovis subsp bovis AF2122/97
augcgguugcauaccgccgg

SEQ ID NO: 1069721 - RNA, 23 nt, Mycobacterium bovis subsp bovis AF2122/97
augcguagacauuggcuccgaac

SEQ ID NO: 1069722 - RNA, 16 nt, Mycobacterium bovis subsp bovis AF2122/97
augcguagugcggcgu

SEQ ID NO: 1069723 - RNA, 24 nt, Mycobacterium bovis subsp bovis AF2122/97
augcugucagacggcgucugcggu

SEQ ID NO: 1069724 - RNA, 20 nt, Mycobacterium bovis subsp bovis AF2122/97
augccgcggaggcggccagc

SEQ ID NO: 1069725 - RNA, 20 nt, Mycobacterium bovis subsp bovis AF2122/97
augccgcggccaguacgucg

SEQ ID NO: 1069726 - RNA, 23 nt, Mycobacterium bovis subsp bovis AF2122/97
augccgcgguggaugcgaugcgc

SEQ ID NO: 1069727 - RNA, 19 nt, Mycobacterium bovis subsp bovis AF2122/97
augccgcgguggaugcgau

SEQ ID NO: 1069728 - RNA, 21 nt, Mycobacterium bovis subsp bovis AF2122/97
augccgcggccaguacgucga

SEQ ID NO: 1069729 - RNA, 16 nt, Mycobacterium bovis subsp bovis AF2122/97
augccggacagcucgc

SEQ ID NO: 1069730 - RNA, 21 nt, Mycobacterium bovis subsp bovis AF2122/97
augccggacgccaugcccgca

SEQ ID NO: 1069731 - RNA, 22 nt, Mycobacterium bovis subsp bovis AF2122/97
augccggacgccaugcccgcac

SEQ ID NO: 1069732 - RNA, 17 nt, Mycobacterium bovis subsp bovis AF2122/97
augccgcucucggcgau

SEQ ID NO: 1069733 - RNA, 18 nt, Mycobacterium bovis subsp bovis AF2122/97
augccggacgccaugccc

SEQ ID NO: 1069734 - RNA, 18 nt, Mycobacterium bovis subsp bovis AF2122/97
augccgggcugaggcggc

SEQ ID NO: 1069735 - RNA, 15 nt, Mycobacterium bovis subsp bovis AF2122/97
augccgggucgcggg

SEQ ID NO: 1069736 - RNA, 15 nt, Mycobacterium bovis subsp bovis AF2122/97
augccgucgccgguc

SEQ ID NO: 1069737 - RNA, 19 nt, Mycobacterium bovis subsp bovis AF2122/97
augccgugcugggccgacg

SEQ ID NO: 1069738 - RNA, 20 nt, Mycobacterium bovis subsp bovis AF2122/97
augccgugcugggccgacgg

SEQ ID NO: 1069739 - RNA, 17 nt, Mycobacterium bovis subsp bovis AF2122/97
augccgugcgccacggc

SEQ ID NO: 1069740 - RNA, 18 nt, Mycobacterium bovis subsp bovis AF2122/97
augccgucuuugucacgc

SEQ ID NO: 1069741 - RNA, 22 nt, Mycobacterium bovis subsp bovis AF2122/97
augccguaguaaggagccgggc

SEQ ID NO: 1069742 - RNA, 16 nt, Mycobacterium bovis subsp bovis AF2122/97
augccugcgcgaugcg

SEQ ID NO: 1069743 - RNA, 16 nt, Mycobacterium bovis subsp bovis AF2122/97
augccgaugucgaugc

SEQ ID NO: 1069744 - RNA, 17 nt, Mycobacterium bovis subsp bovis AF2122/97
augccgaugucgaugcc

SEQ ID NO: 1069745 - RNA, 19 nt, Mycobacterium bovis subsp bovis AF2122/97
augccgaugucgaugccgc

SEQ ID NO: 1069746 - RNA, 20 nt, Mycobacterium bovis subsp bovis AF2122/97
augccgauuacggugaucgc

SEQ ID NO: 1069747 - RNA, 16 nt, Mycobacterium bovis subsp bovis AF2122/97
augccgaugaccgccu

SEQ ID NO: 1069748 - RNA, 15 nt, Mycobacterium bovis subsp bovis AF2122/97
augccgaucggccug

SEQ ID NO: 1069749 - RNA, 12 nt, Mycobacterium bovis subsp bovis AF2122/97
augccgaugccc

SEQ ID NO: 1069750 - RNA, 18 nt, Mycobacterium bovis subsp bovis AF2122/97
augccgagcgaccguccc

SEQ ID NO: 1069751 - RNA, 19 nt, Mycobacterium bovis subsp bovis AF2122/97
augaucugccaccgcgggc

SEQ ID NO: 1069752 - RNA, 13 nt, Mycobacterium bovis subsp bovis AF2122/97
augaugaccggca

SEQ ID NO: 1069753 - RNA, 10 nt, Mycobacterium bovis subsp bovis AF2122/97
augaugccgg

SEQ ID NO: 1069754 - RNA, 13 nt, Mycobacterium bovis subsp bovis AF2122/97
augaugccggcgu

SEQ ID NO: 1069755 - RNA, 22 nt, Mycobacterium bovis subsp bovis AF2122/97
augaugccgucgucgucgcugu

SEQ ID NO: 1069756 - RNA, 17 nt, Mycobacterium bovis subsp bovis AF2122/97
augaugccuaccgggcc

SEQ ID NO: 1069757 - RNA, 15 nt, Mycobacterium bovis subsp bovis AF2122/97
augaugcgcucggcc

SEQ ID NO: 1069758 - RNA, 23 nt, Mycobacterium bovis subsp bovis AF2122/97
augauggccgucagccaggugcc

SEQ ID NO: 1069759 - RNA, 19 nt, Mycobacterium bovis subsp bovis AF2122/97
augauggcuccggccgcgu

SEQ ID NO: 1069760 - RNA, 13 nt, Mycobacterium bovis subsp bovis AF2122/97
augaugcucgaug

SEQ ID NO: 1069761 - RNA, 18 nt, Mycobacterium bovis subsp bovis AF2122/97
auugccucccgcgccggc

SEQ ID NO: 1069762 - RNA, 17 nt, Mycobacterium bovis subsp bovis AF2122/97
auugcgaccgcgccaac

SEQ ID NO: 1069763 - RNA, 20 nt, Mycobacterium bovis subsp bovis AF2122/97
auugcgaagggcaccggcga

SEQ ID NO: 1069764 - RNA, 21 nt, Mycobacterium bovis subsp bovis AF2122/97
auugccggccaccagccuggc

SEQ ID NO: 1069765 - RNA, 20 nt, Mycobacterium bovis subsp bovis AF2122/97
auugccggcgauuaccggca

SEQ ID NO: 1069766 - RNA, 17 nt, Mycobacterium bovis subsp bovis AF2122/97
auugccgggccgccgag

SEQ ID NO: 1069767 - RNA, 18 nt, Mycobacterium bovis subsp bovis AF2122/97
auugccgggccgccgagc

SEQ ID NO: 1069768 - RNA, 18 nt, Mycobacterium bovis subsp bovis AF2122/97
auugccgggcgcacgccc

SEQ ID NO: 1069769 - RNA, 21 nt, Mycobacterium bovis subsp bovis AF2122/97
auugccugccacccggccagg

SEQ ID NO: 1069770 - RNA, 22 nt, Mycobacterium bovis subsp bovis AF2122/97
auugccgucgugaucggcgaac

SEQ ID NO: 1069771 - RNA, 21 nt, Mycobacterium bovis subsp bovis AF2122/97
auugccguccgguggaccgcc

SEQ ID NO: 1069772 - RNA, 19 nt, Mycobacterium bovis subsp bovis AF2122/97
auugccgucgugaucggcg

SEQ ID NO: 1069773 - RNA, 17 nt, Mycobacterium bovis subsp bovis AF2122/97
auugcacccaccccgaa

SEQ ID NO: 1069774 - RNA, 23 nt, Mycobacterium bovis subsp bovis AF2122/97
auugccgcgguugugcugggugc

SEQ ID NO: 1069775 - RNA, 21 nt, Mycobacterium bovis subsp bovis AF2122/97
auugccgccguugccgccguu

SEQ ID NO: 1069776 - RNA, 18 nt, Mycobacterium bovis subsp bovis AF2122/97
auugcaccuucuccaccg

SEQ ID NO: 1069777 - RNA, 17 nt, Mycobacterium bovis subsp bovis AF2122/97
auugauacugcccgcgu

SEQ ID NO: 1069778 - RNA, 14 nt, Mycobacterium bovis subsp bovis AF2122/97
auugaugcugcccg

SEQ ID NO: 1069779 - RNA, 15 nt, Mycobacterium bovis subsp bovis AF2122/97
auuggacgcgcaugc

SEQ ID NO: 1069780 - RNA, 21 nt, Mycobacterium bovis subsp bovis AF2122/97
auuggacgcgcaugccccgac

SEQ ID NO: 1069781 - RNA, 22 nt, Mycobacterium bovis subsp bovis AF2122/97
auugcuugggugccucgccaac

SEQ ID NO: 1069782 - RNA, 14 nt, Mycobacterium bovis subsp bovis AF2122/97
auugggcgaugcgg

SEQ ID NO: 1069783 - RNA, 20 nt, Mycobacterium bovis subsp bovis AF2122/97
auugggcgauuuugcgucug

SEQ ID NO: 1069784 - RNA, 22 nt, Mycobacterium bovis subsp bovis AF2122/97
auugggcgauuuugcgucugcu

SEQ ID NO: 1069785 - RNA, 14 nt, Mycobacterium bovis subsp bovis AF2122/97
auucgaagccgagc

SEQ ID NO: 1069786 - RNA, 20 nt, Mycobacterium bovis subsp bovis AF2122/97
auucgaagggguacccgccc

SEQ ID NO: 1069787 - RNA, 20 nt, Mycobacterium bovis subsp bovis AF2122/97
auucgaaggucgguacccca

SEQ ID NO: 1069788 - RNA, 14 nt, Mycobacterium bovis subsp bovis AF2122/97
auucaugccggugu

SEQ ID NO: 1069789 - RNA, 12 nt, Mycobacterium bovis subsp bovis AF2122/97
auucggccggcg

SEQ ID NO: 1069790 - RNA, 16 nt, Mycobacterium bovis subsp bovis AF2122/97
auucggccggcgcggc

SEQ ID NO: 1069791 - RNA, 16 nt, Mycobacterium bovis subsp bovis AF2122/97
auucggccguaucguc

SEQ ID NO: 1069792 - RNA, 16 nt, Mycobacterium bovis subsp bovis AF2122/97
auucggcucaucccga

SEQ ID NO: 1069793 - RNA, 15 nt, Mycobacterium bovis subsp bovis AF2122/97
auucggccaucgcga

SEQ ID NO: 1069794 - RNA, 20 nt, Mycobacterium bovis subsp bovis AF2122/97
auucggugccagcaggccga

SEQ ID NO: 1069795 - RNA, 16 nt, Mycobacterium bovis subsp bovis AF2122/97
auucggugcgcuggcg

SEQ ID NO: 1069796 - RNA, 15 nt, Mycobacterium bovis subsp bovis AF2122/97
auucgcucaccaccg

SEQ ID NO: 1069797 - RNA, 17 nt, Mycobacterium bovis subsp bovis AF2122/97
auucggcugccaccgca

SEQ ID NO: 1069798 - RNA, 15 nt, Mycobacterium bovis subsp bovis AF2122/97
auucgggcgugcucg

SEQ ID NO: 1069799 - RNA, 18 nt, Mycobacterium bovis subsp bovis AF2122/97
auucgggcgugcucgccg

SEQ ID NO: 1069800 - RNA, 14 nt, Mycobacterium bovis subsp bovis AF2122/97
auucgggcuucucc

SEQ ID NO: 1069801 - RNA, 15 nt, Mycobacterium bovis subsp bovis AF2122/97
auucgguguggccgu

SEQ ID NO: 1069802 - RNA, 16 nt, Mycobacterium bovis subsp bovis AF2122/97
auucugacgaccggcu

SEQ ID NO: 1069803 - RNA, 17 nt, Mycobacterium bovis subsp bovis AF2122/97
auugacgccguugccgc

SEQ ID NO: 1069804 - RNA, 19 nt, Mycobacterium bovis subsp bovis AF2122/97
auugacgccguugccgccg

SEQ ID NO: 1069805 - RNA, 13 nt, Mycobacterium bovis subsp bovis AF2122/97
auugacccauccg

SEQ ID NO: 1069806 - RNA, 20 nt, Mycobacterium bovis subsp bovis AF2122/97
auugacccccuagaccgggc

SEQ ID NO: 1069807 - RNA, 23 nt, Mycobacterium bovis subsp bovis AF2122/97
auugagcccggggagacgagcac

SEQ ID NO: 1069808 - RNA, 20 nt, Mycobacterium bovis subsp bovis AF2122/97
auucuuggucgaggucggcg

SEQ ID NO: 1069809 - RNA, 18 nt, Mycobacterium bovis subsp bovis AF2122/97
auucuugacgccgaugug

SEQ ID NO: 1069810 - RNA, 20 nt, Mycobacterium bovis subsp bovis AF2122/97
augugcgaccacaucaugcc

SEQ ID NO: 1069811 - RNA, 18 nt, Mycobacterium bovis subsp bovis AF2122/97
augugcgagaagcaggga

SEQ ID NO: 1069812 - RNA, 19 nt, Mycobacterium bovis subsp bovis AF2122/97
augugcggcugcaccggcu

SEQ ID NO: 1069813 - RNA, 12 nt, Mycobacterium bovis subsp bovis AF2122/97
auguggccgccg

SEQ ID NO: 1069814 - RNA, 16 nt, Mycobacterium bovis subsp bovis AF2122/97
augugaacgcacccga

SEQ ID NO: 1069815 - RNA, 19 nt, Mycobacterium bovis subsp bovis AF2122/97
augugacaucgggccgccg

SEQ ID NO: 1069816 - RNA, 17 nt, Mycobacterium bovis subsp bovis AF2122/97
augucuugugguggaaa

SEQ ID NO: 1069817 - RNA, 17 nt, Mycobacterium bovis subsp bovis AF2122/97
augucuuuggucgccgg

SEQ ID NO: 1069818 - RNA, 22 nt, Mycobacterium bovis subsp bovis AF2122/97
augugcacggugugcacggcga

SEQ ID NO: 1069819 - RNA, 23 nt, Mycobacterium bovis subsp bovis AF2122/97
auguguuugaucaccgugguggc

SEQ ID NO: 1069820 - RNA, 17 nt, Mycobacterium bovis subsp bovis AF2122/97
augugguggcgccggcc

SEQ ID NO: 1069821 - RNA, 18 nt, Mycobacterium bovis subsp bovis AF2122/97
augugguggcgccggccg

SEQ ID NO: 1069822 - RNA, 18 nt, Mycobacterium bovis subsp bovis AF2122/97
augugggcgcgucgacaa

SEQ ID NO: 1069823 - RNA, 22 nt, Mycobacterium bovis subsp bovis AF2122/97
auguggggucagugcgggcggc

SEQ ID NO: 1069824 - RNA, 15 nt, Mycobacterium bovis subsp bovis AF2122/97
auguucacgccgccg

SEQ ID NO: 1069825 - RNA, 15 nt, Mycobacterium bovis subsp bovis AF2122/97
auguugccgccgcgg

SEQ ID NO: 1069826 - RNA, 17 nt, Mycobacterium bovis subsp bovis AF2122/97
auguugccgccgcggcg

SEQ ID NO: 1069827 - RNA, 15 nt, Mycobacterium bovis subsp bovis AF2122/97
auguugcgacggccg

SEQ ID NO: 1069828 - RNA, 18 nt, Mycobacterium bovis subsp bovis AF2122/97
auguuggcagggccagcg

SEQ ID NO: 1069829 - RNA, 23 nt, Mycobacterium bovis subsp bovis AF2122/97
auguucccgaaaccuguaccgcc

SEQ ID NO: 1069830 - RNA, 16 nt, Mycobacterium bovis subsp bovis AF2122/97
auguucucgaccgcgu

SEQ ID NO: 1069831 - RNA, 17 nt, Mycobacterium bovis subsp bovis AF2122/97
auguugguuugccggcg

SEQ ID NO: 1069832 - RNA, 19 nt, Mycobacterium bovis subsp bovis AF2122/97
auguuggccgccacaccgc

SEQ ID NO: 1069833 - RNA, 13 nt, Mycobacterium bovis subsp bovis AF2122/97
auguugucgacgg

SEQ ID NO: 1069834 - RNA, 23 nt, Mycobacterium bovis subsp bovis AF2122/97
cacccgggacguuguccaccgcc

SEQ ID NO: 1069835 - RNA, 17 nt, Mycobacterium bovis subsp bovis AF2122/97
cacccuguuugcccaac

SEQ ID NO: 1069836 - RNA, 20 nt, Mycobacterium bovis subsp bovis AF2122/97
cacccuuggcccggugcagc

SEQ ID NO: 1069837 - RNA, 17 nt, Mycobacterium bovis subsp bovis AF2122/97
cacccugccagagauca

SEQ ID NO: 1069838 - RNA, 14 nt, Mycobacterium bovis subsp bovis AF2122/97
cacccugcgggccg

SEQ ID NO: 1069839 - RNA, 15 nt, Mycobacterium bovis subsp bovis AF2122/97
cacccugcgggccga

SEQ ID NO: 1069840 - RNA, 21 nt, Mycobacterium bovis subsp bovis AF2122/97
cacccugcucgaacgcugagg

SEQ ID NO: 1069841 - RNA, 16 nt, Mycobacterium bovis subsp bovis AF2122/97
cacccuggucgaaacg

SEQ ID NO: 1069842 - RNA, 13 nt, Mycobacterium bovis subsp bovis AF2122/97
cacccugucgcgc

SEQ ID NO: 1069843 - RNA, 23 nt, Mycobacterium bovis subsp bovis AF2122/97
cacccucgguguccucgaccguc

SEQ ID NO: 1069844 - RNA, 22 nt, Mycobacterium bovis subsp bovis AF2122/97
cacccucgcguagggccagcgc

SEQ ID NO: 1069845 - RNA, 20 nt, Mycobacterium bovis subsp bovis AF2122/97
cacccguugcgacaccuccg

SEQ ID NO: 1069846 - RNA, 13 nt, Mycobacterium bovis subsp bovis AF2122/97
cacccuccgccgg

SEQ ID NO: 1069847 - RNA, 21 nt, Mycobacterium bovis subsp bovis AF2122/97
cacccuauuggucggucgcgc

SEQ ID NO: 1069848 - RNA, 17 nt, Mycobacterium bovis subsp bovis AF2122/97
caccgaacccgccaccg

SEQ ID NO: 1069849 - RNA, 23 nt, Mycobacterium bovis subsp bovis AF2122/97
caccgaacagucgagugaagccg

SEQ ID NO: 1069850 - RNA, 18 nt, Mycobacterium bovis subsp bovis AF2122/97
caccgaacagucgcagcc

SEQ ID NO: 1069851 - RNA, 21 nt, Mycobacterium bovis subsp bovis AF2122/97
caccgaaauacccagcgcagc

SEQ ID NO: 1069852 - RNA, 14 nt, Mycobacterium bovis subsp bovis AF2122/97
caccgaacacggcg

SEQ ID NO: 1069853 - RNA, 16 nt, Mycobacterium bovis subsp bovis AF2122/97
caccgaaaaguccgcc

SEQ ID NO: 1069854 - RNA, 18 nt, Mycobacterium bovis subsp bovis AF2122/97
caccgaaaccaugccgcc

SEQ ID NO: 1069855 - RNA, 17 nt, Mycobacterium bovis subsp bovis AF2122/97
caccgaaacgaugcggc

SEQ ID NO: 1069856 - RNA, 16 nt, Mycobacterium bovis subsp bovis AF2122/97
caccgaaacgccgacc

SEQ ID NO: 1069857 - RNA, 13 nt, Mycobacterium bovis subsp bovis AF2122/97
caccgaacgcgau

SEQ ID NO: 1069858 - RNA, 15 nt, Mycobacterium bovis subsp bovis AF2122/97
caccgaacgcgaugc

SEQ ID NO: 1069859 - RNA, 12 nt, Mycobacterium bovis subsp bovis AF2122/97
caccgaacgcgg

SEQ ID NO: 1069860 - RNA, 13 nt, Mycobacterium bovis subsp bovis AF2122/97
caccgaacgcggc

SEQ ID NO: 1069861 - RNA, 17 nt, Mycobacterium bovis subsp bovis AF2122/97
caccgaacgcggccacc

SEQ ID NO: 1069862 - RNA, 20 nt, Mycobacterium bovis subsp bovis AF2122/97
caccgaacgcggccaccgac

SEQ ID NO: 1069863 - RNA, 13 nt, Mycobacterium bovis subsp bovis AF2122/97
caccgaacgcacc

SEQ ID NO: 1069864 - RNA, 23 nt, Mycobacterium bovis subsp bovis AF2122/97
caccgaacuccuuaucgucgacg

SEQ ID NO: 1069865 - RNA, 15 nt, Mycobacterium bovis subsp bovis AF2122/97
caccgaauaccgccg

SEQ ID NO: 1069866 - RNA, 19 nt, Mycobacterium bovis subsp bovis AF2122/97
caccgaauaccgccgcgca

SEQ ID NO: 1069867 - RNA, 21 nt, Mycobacterium bovis subsp bovis AF2122/97
caccgaauaccgccgcgcagc

SEQ ID NO: 1069868 - RNA, 15 nt, Mycobacterium bovis subsp bovis AF2122/97
caccgaagccgccgg

SEQ ID NO: 1069869 - RNA, 22 nt, Mycobacterium bovis subsp bovis AF2122/97
caccgaagccgccgggugcgcc

SEQ ID NO: 1069870 - RNA, 18 nt, Mycobacterium bovis subsp bovis AF2122/97
caccgaaugcacgacggu

SEQ ID NO: 1069871 - RNA, 22 nt, Mycobacterium bovis subsp bovis AF2122/97
caccgaagauggccagcgcggc

SEQ ID NO: 1069872 - RNA, 23 nt, Mycobacterium bovis subsp bovis AF2122/97
caccgaauaccgccgcgcagccg

SEQ ID NO: 1069873 - RNA, 20 nt, Mycobacterium bovis subsp bovis AF2122/97
caccgacaauucaacacacg

SEQ ID NO: 1069874 - RNA, 23 nt, Mycobacterium bovis subsp bovis AF2122/97
caccgacaauucaacacacggcg

SEQ ID NO: 1069875 - RNA, 15 nt, Mycobacterium bovis subsp bovis AF2122/97
caccgaaugcggguc

SEQ ID NO: 1069876 - RNA, 18 nt, Mycobacterium bovis subsp bovis AF2122/97
cacccggggugcccggcc

SEQ ID NO: 1069877 - RNA, 19 nt, Mycobacterium bovis subsp bovis AF2122/97
cacccggggugcccggccg

SEQ ID NO: 1069878 - RNA, 12 nt, Mycobacterium bovis subsp bovis AF2122/97
cacccgggccgc

SEQ ID NO: 1069879 - RNA, 18 nt, Mycobacterium bovis subsp bovis AF2122/97
cacccgggccacgucgag

SEQ ID NO: 1069880 - RNA, 13 nt, Mycobacterium bovis subsp bovis AF2122/97
cacccgggcgugg

SEQ ID NO: 1069881 - RNA, 16 nt, Mycobacterium bovis subsp bovis AF2122/97
cacccggguggcacgc

SEQ ID NO: 1069882 - RNA, 16 nt, Mycobacterium bovis subsp bovis AF2122/97
cacccgguccggcccg

SEQ ID NO: 1069883 - RNA, 18 nt, Mycobacterium bovis subsp bovis AF2122/97
cacccguguucgccacac

SEQ ID NO: 1069884 - RNA, 20 nt, Mycobacterium bovis subsp bovis AF2122/97
cacccgucacaagcugacac

SEQ ID NO: 1069885 - RNA, 21 nt, Mycobacterium bovis subsp bovis AF2122/97
cacccgucaugcccaccgccu

SEQ ID NO: 1069886 - RNA, 23 nt, Mycobacterium bovis subsp bovis AF2122/97
cacccgucaugcccaccgccugg

SEQ ID NO: 1069887 - RNA, 14 nt, Mycobacterium bovis subsp bovis AF2122/97
cacccguccggccg

SEQ ID NO: 1069888 - RNA, 15 nt, Mycobacterium bovis subsp bovis AF2122/97
cacccguccggccgg

SEQ ID NO: 1069889 - RNA, 15 nt, Mycobacterium bovis subsp bovis AF2122/97
cacccgguugugcgc

SEQ ID NO: 1069890 - RNA, 23 nt, Mycobacterium bovis subsp bovis AF2122/97
cacccgguggcugaucaccguug

SEQ ID NO: 1069891 - RNA, 14 nt, Mycobacterium bovis subsp bovis AF2122/97
cacccggugccgca

SEQ ID NO: 1069892 - RNA, 11 nt, Mycobacterium bovis subsp bovis AF2122/97
cacccggucgg

SEQ ID NO: 1069893 - RNA, 15 nt, Mycobacterium bovis subsp bovis AF2122/97
cacccggcgggcggu

SEQ ID NO: 1069894 - RNA, 22 nt, Mycobacterium bovis subsp bovis AF2122/97
cacccggcgggcggugggcagc

SEQ ID NO: 1069895 - RNA, 13 nt, Mycobacterium bovis subsp bovis AF2122/97
cacccggccguug

SEQ ID NO: 1069896 - RNA, 14 nt, Mycobacterium bovis subsp bovis AF2122/97
cacccggccguugg

SEQ ID NO: 1069897 - RNA, 22 nt, Mycobacterium bovis subsp bovis AF2122/97
cacccgggacgaaccggccgac

SEQ ID NO: 1069898 - RNA, 21 nt, Mycobacterium bovis subsp bovis AF2122/97
cacccgggacguuguccaccg

SEQ ID NO: 1069899 - RNA, 13 nt, Mycobacterium bovis subsp bovis AF2122/97
cacccggcgcgaa

SEQ ID NO: 1069900 - RNA, 22 nt, Mycobacterium bovis subsp bovis AF2122/97
cacccggcuucgccgcgcuugc

SEQ ID NO: 1069901 - RNA, 12 nt, Mycobacterium bovis subsp bovis AF2122/97
cacccggccgac

SEQ ID NO: 1069902 - RNA, 23 nt, Mycobacterium bovis subsp bovis AF2122/97
cacccggccgaccucggcaacga

SEQ ID NO: 1069903 - RNA, 13 nt, Mycobacterium bovis subsp bovis AF2122/97
cacccggccgccg

SEQ ID NO: 1069904 - RNA, 12 nt, Mycobacterium bovis subsp bovis AF2122/97
cacccggccgcg

SEQ ID NO: 1069905 - RNA, 22 nt, Mycobacterium bovis subsp bovis AF2122/97
cacccggacauagccgcgcucg

SEQ ID NO: 1069906 - RNA, 13 nt, Mycobacterium bovis subsp bovis AF2122/97
cacccgcugcacg

SEQ ID NO: 1069907 - RNA, 16 nt, Mycobacterium bovis subsp bovis AF2122/97
cacccgcugcacgccg

SEQ ID NO: 1069908 - RNA, 16 nt, Mycobacterium bovis subsp bovis AF2122/97
cacccgcucggccgcc

SEQ ID NO: 1069909 - RNA, 17 nt, Mycobacterium bovis subsp bovis AF2122/97
cacccgcuggucgagca

SEQ ID NO: 1069910 - RNA, 17 nt, Mycobacterium bovis subsp bovis AF2122/97
cacccgcucgcccgccg

SEQ ID NO: 1069911 - RNA, 23 nt, Mycobacterium bovis subsp bovis AF2122/97
cacccgcucgcccgccgccacca

SEQ ID NO: 1069912 - RNA, 16 nt, Mycobacterium bovis subsp bovis AF2122/97
caccgacgcgucggcg

SEQ ID NO: 1069913 - RNA, 19 nt, Mycobacterium bovis subsp bovis AF2122/97
caccgacgcggucggcggc

SEQ ID NO: 1069914 - RNA, 21 nt, Mycobacterium bovis subsp bovis AF2122/97
caccgacgcggucggcggccg

SEQ ID NO: 1069915 - RNA, 13 nt, Mycobacterium bovis subsp bovis AF2122/97
caccgacgcgucg

SEQ ID NO: 1069916 - RNA, 13 nt, Mycobacterium bovis subsp bovis AF2122/97
caccgaccggguc

SEQ ID NO: 1069917 - RNA, 21 nt, Mycobacterium bovis subsp bovis AF2122/97
caccgaccgggucgcaaccgc

SEQ ID NO: 1069918 - RNA, 16 nt, Mycobacterium bovis subsp bovis AF2122/97
caccgacgacaucggu

SEQ ID NO: 1069919 - RNA, 13 nt, Mycobacterium bovis subsp bovis AF2122/97
caccgacgccgcc

SEQ ID NO: 1069920 - RNA, 22 nt, Mycobacterium bovis subsp bovis AF2122/97
caccgacgccgccagguccgcc

SEQ ID NO: 1069921 - RNA, 22 nt, Mycobacterium bovis subsp bovis AF2122/97
caccgacgacggcgacggcgcc

SEQ ID NO: 1069922 - RNA, 17 nt, Mycobacterium bovis subsp bovis AF2122/97
caccgacgacggcgacg

SEQ ID NO: 1069923 - RNA, 21 nt, Mycobacterium bovis subsp bovis AF2122/97
caccgacgacggcgacggcgc

SEQ ID NO: 1069924 - RNA, 22 nt, Mycobacterium bovis subsp bovis AF2122/97
caccgaccgcaccgugccgacg

SEQ ID NO: 1069925 - RNA, 22 nt, Mycobacterium bovis subsp bovis AF2122/97
caccgacgggauauccggucgc

SEQ ID NO: 1069926 - RNA, 19 nt, Mycobacterium bovis subsp bovis AF2122/97
caccgacggaaugucagcc

SEQ ID NO: 1069927 - RNA, 17 nt, Mycobacterium bovis subsp bovis AF2122/97
caccgacgcgaacgcgg

SEQ ID NO: 1069928 - RNA, 20 nt, Mycobacterium bovis subsp bovis AF2122/97
caccgacgcgaacgcggcca

SEQ ID NO: 1069929 - RNA, 14 nt, Mycobacterium bovis subsp bovis AF2122/97
caccgacgucaggc

SEQ ID NO: 1069930 - RNA, 15 nt, Mycobacterium bovis subsp bovis AF2122/97
caccgauacccccgg

SEQ ID NO: 1069931 - RNA, 17 nt, Mycobacterium bovis subsp bovis AF2122/97
caccgauacccccggca

SEQ ID NO: 1069932 - RNA, 17 nt, Mycobacterium bovis subsp bovis AF2122/97
caccgaucggugccggc

SEQ ID NO: 1069933 - RNA, 19 nt, Mycobacterium bovis subsp bovis AF2122/97
caccgaucggugccggccu

SEQ ID NO: 1069934 - RNA, 17 nt, Mycobacterium bovis subsp bovis AF2122/97
caccgaucccgcggccg

SEQ ID NO: 1069935 - RNA, 15 nt, Mycobacterium bovis subsp bovis AF2122/97
caccgauccggccgc

SEQ ID NO: 1069936 - RNA, 20 nt, Mycobacterium bovis subsp bovis AF2122/97
caccgauaccgucagcgccg

SEQ ID NO: 1069937 - RNA, 15 nt, Mycobacterium bovis subsp bovis AF2122/97
caccgauauggccgg

SEQ ID NO: 1069938 - RNA, 18 nt, Mycobacterium bovis subsp bovis AF2122/97
caccgauauggccggguc

SEQ ID NO: 1069939 - RNA, 12 nt, Mycobacterium bovis subsp bovis AF2122/97
caccgaucggca

SEQ ID NO: 1069940 - RNA, 19 nt, Mycobacterium bovis subsp bovis AF2122/97
caccgaucucgaccagcgc

SEQ ID NO: 1069941 - RNA, 21 nt, Mycobacterium bovis subsp bovis AF2122/97
caccgaucucgaccagcgccg

SEQ ID NO: 1069942 - RNA, 23 nt, Mycobacterium bovis subsp bovis AF2122/97
caccgaugcgauaacccgcaucg

SEQ ID NO: 1069943 - RNA, 13 nt, Mycobacterium bovis subsp bovis AF2122/97
caccgaugcgccg

SEQ ID NO: 1069944 - RNA, 17 nt, Mycobacterium bovis subsp bovis AF2122/97
caccgauggcgcaccgg

SEQ ID NO: 1069945 - RNA, 13 nt, Mycobacterium bovis subsp bovis AF2122/97
caccgauucggcc

SEQ ID NO: 1069946 - RNA, 16 nt, Mycobacterium bovis subsp bovis AF2122/97
caccgauucggccagc

SEQ ID NO: 1069947 - RNA, 13 nt, Mycobacterium bovis subsp bovis AF2122/97
caccgccaccgcg

SEQ ID NO: 1069948 - RNA, 21 nt, Mycobacterium bovis subsp bovis AF2122/97
caccgaugcugacgaugcggu

SEQ ID NO: 1069949 - RNA, 16 nt, Mycobacterium bovis subsp bovis AF2122/97
caccgccaccacgccg

SEQ ID NO: 1069950 - RNA, 14 nt, Mycobacterium bovis subsp bovis AF2122/97
caccgccaccacgg

SEQ ID NO: 1069951 - RNA, 21 nt, Mycobacterium bovis subsp bovis AF2122/97
caccgcauucguggagccggc

SEQ ID NO: 1069952 - RNA, 23 nt, Mycobacterium bovis subsp bovis AF2122/97
caccgcauucguggagccggccg

SEQ ID NO: 1069953 - RNA, 14 nt, Mycobacterium bovis subsp bovis AF2122/97
caccgcccggcccg

SEQ ID NO: 1069954 - RNA, 16 nt, Mycobacterium bovis subsp bovis AF2122/97
caccgcccggcccggc

SEQ ID NO: 1069955 - RNA, 17 nt, Mycobacterium bovis subsp bovis AF2122/97
caccgccgacgcccgac

SEQ ID NO: 1069956 - RNA, 20 nt, Mycobacterium bovis subsp bovis AF2122/97
caccgccgagcagacgcgga

SEQ ID NO: 1069957 - RNA, 22 nt, Mycobacterium bovis subsp bovis AF2122/97
caccgccgaacagugucgauag

SEQ ID NO: 1069958 - RNA, 12 nt, Mycobacterium bovis subsp bovis AF2122/97
caccgccgacau

SEQ ID NO: 1069959 - RNA, 22 nt, Mycobacterium bovis subsp bovis AF2122/97
caccgcccuugccgccggcccc

SEQ ID NO: 1069960 - RNA, 15 nt, Mycobacterium bovis subsp bovis AF2122/97
caccgccggcggcgg

SEQ ID NO: 1069961 - RNA, 12 nt, Mycobacterium bovis subsp bovis AF2122/97
caccgccggcgg

SEQ ID NO: 1069962 - RNA, 18 nt, Mycobacterium bovis subsp bovis AF2122/97
caccgccgcccccgccgg

SEQ ID NO: 1069963 - RNA, 21 nt, Mycobacterium bovis subsp bovis AF2122/97
caccgccgcccccgccggccg

SEQ ID NO: 1069964 - RNA, 22 nt, Mycobacterium bovis subsp bovis AF2122/97
caccgccgcccccgccggccgc

SEQ ID NO: 1069965 - RNA, 22 nt, Mycobacterium bovis subsp bovis AF2122/97
caccgccgcacgcuagccgaca

SEQ ID NO: 1069966 - RNA, 15 nt, Mycobacterium bovis subsp bovis AF2122/97
caccgccgcaucguu

SEQ ID NO: 1069967 - RNA, 20 nt, Mycobacterium bovis subsp bovis AF2122/97
caccgccgccaagcucggcc

SEQ ID NO: 1069968 - RNA, 23 nt, Mycobacterium bovis subsp bovis AF2122/97
caccgccgccaagcucggccacc

SEQ ID NO: 1069969 - RNA, 20 nt, Mycobacterium bovis subsp bovis AF2122/97
caccgccgccaccaccgcug

SEQ ID NO: 1069970 - RNA, 10 nt, Mycobacterium bovis subsp bovis AF2122/97
caccgccggu

SEQ ID NO: 1069971 - RNA, 14 nt, Mycobacterium bovis subsp bovis AF2122/97
caccgccugcgccg

SEQ ID NO: 1069972 - RNA, 16 nt, Mycobacterium bovis subsp bovis AF2122/97
caccgccugcgccgcc

SEQ ID NO: 1069973 - RNA, 21 nt, Mycobacterium bovis subsp bovis AF2122/97
caccgccugcgccgcccgcgc

SEQ ID NO: 1069974 - RNA, 18 nt, Mycobacterium bovis subsp bovis AF2122/97
caccgccguugccgccgg

SEQ ID NO: 1069975 - RNA, 20 nt, Mycobacterium bovis subsp bovis AF2122/97
caccgccguugccgccggcg

SEQ ID NO: 1069976 - RNA, 22 nt, Mycobacterium bovis subsp bovis AF2122/97
caccgccguugccgccggcgcc

SEQ ID NO: 1069977 - RNA, 16 nt, Mycobacterium bovis subsp bovis AF2122/97
caccgccgucggguug

SEQ ID NO: 1069978 - RNA, 21 nt, Mycobacterium bovis subsp bovis AF2122/97
caccgccgucggguugcgacg

SEQ ID NO: 1069979 - RNA, 22 nt, Mycobacterium bovis subsp bovis AF2122/97
caccgccgccgaagcgaugccg

SEQ ID NO: 1069980 - RNA, 18 nt, Mycobacterium bovis subsp bovis AF2122/97
caccgccguugccgaucg

SEQ ID NO: 1069981 - RNA, 14 nt, Mycobacterium bovis subsp bovis AF2122/97
caccgccgggcugu

SEQ ID NO: 1069982 - RNA, 15 nt, Mycobacterium bovis subsp bovis AF2122/97
caccgccguugccgc

SEQ ID NO: 1069983 - RNA, 17 nt, Mycobacterium bovis subsp bovis AF2122/97
caccgccguugccgccg

SEQ ID NO: 1069984 - RNA, 22 nt, Mycobacterium bovis subsp bovis AF2122/97
caccgccuggaucagcgcguug

SEQ ID NO: 1069985 - RNA, 17 nt, Mycobacterium bovis subsp bovis AF2122/97
caccgccugugccgccg

SEQ ID NO: 1069986 - RNA, 16 nt, Mycobacterium bovis subsp bovis AF2122/97
caccgccugcucggcg

SEQ ID NO: 1069987 - RNA, 21 nt, Mycobacterium bovis subsp bovis AF2122/97
caccgccuggaucagcgcguu

SEQ ID NO: 1069988 - RNA, 14 nt, Mycobacterium bovis subsp bovis AF2122/97
caccgccugggcgg

SEQ ID NO: 1069989 - RNA, 20 nt, Mycobacterium bovis subsp bovis AF2122/97
caccgccugggcggccagca

SEQ ID NO: 1069990 - RNA, 18 nt, Mycobacterium bovis subsp bovis AF2122/97
caccgccugugccgccgg

SEQ ID NO: 1069991 - RNA, 21 nt, Mycobacterium bovis subsp bovis AF2122/97
caccgccugugccgccggcgc

SEQ ID NO: 1069992 - RNA, 15 nt, Mycobacterium bovis subsp bovis AF2122/97
caccgccuuggucac

SEQ ID NO: 1069993 - RNA, 15 nt, Mycobacterium bovis subsp bovis AF2122/97
caccgccuuugccgc

SEQ ID NO: 1069994 - RNA, 17 nt, Mycobacterium bovis subsp bovis AF2122/97
caccgccuuugccgccg

SEQ ID NO: 1069995 - RNA, 14 nt, Mycobacterium bovis subsp bovis AF2122/97
caccggcaccgccu

SEQ ID NO: 1069996 - RNA, 20 nt, Mycobacterium bovis subsp bovis AF2122/97
caccggcaccgccugcgccg

SEQ ID NO: 1069997 - RNA, 14 nt, Mycobacterium bovis subsp bovis AF2122/97
caccggcaccggcc

SEQ ID NO: 1069998 - RNA, 17 nt, Mycobacterium bovis subsp bovis AF2122/97
caccggcagcgcgaucg

SEQ ID NO: 1069999 - RNA, 15 nt, Mycobacterium bovis subsp bovis AF2122/97
caccggcacgucgcc

SEQ ID NO: 1070000 - RNA, 22 nt, Mycobacterium bovis subsp bovis AF2122/97
caccggauucuucggugaagaa

SEQ ID NO: 1070001 - RNA, 21 nt, Mycobacterium bovis subsp bovis AF2122/97
caccggaguucucgcugauca

SEQ ID NO: 1070002 - RNA, 16 nt, Mycobacterium bovis subsp bovis AF2122/97
caccggauacagccac

SEQ ID NO: 1070003 - RNA, 17 nt, Mycobacterium bovis subsp bovis AF2122/97
caccggauacagccacg

SEQ ID NO: 1070004 - RNA, 20 nt, Mycobacterium bovis subsp bovis AF2122/97
caccggauacagccacgcaa

SEQ ID NO: 1070005 - RNA, 19 nt, Mycobacterium bovis subsp bovis AF2122/97
caccggaucgccgucggcg

SEQ ID NO: 1070006 - RNA, 17 nt, Mycobacterium bovis subsp bovis AF2122/97
caccggaucggcuaccu

SEQ ID NO: 1070007 - RNA, 22 nt, Mycobacterium bovis subsp bovis AF2122/97
caccggcaagccacgccggucg

SEQ ID NO: 1070008 - RNA, 23 nt, Mycobacterium bovis subsp bovis AF2122/97
caccggaucgucgaacagcaccg

SEQ ID NO: 1070009 - RNA, 18 nt, Mycobacterium bovis subsp bovis AF2122/97
caccggcaccacgaucaa

SEQ ID NO: 1070010 - RNA, 17 nt, Mycobacterium bovis subsp bovis AF2122/97
caccggccaggccggcg

SEQ ID NO: 1070011 - RNA, 20 nt, Mycobacterium bovis subsp bovis AF2122/97
caccggccccaccggcaccc

SEQ ID NO: 1070012 - RNA, 16 nt, Mycobacterium bovis subsp bovis AF2122/97
caccggccccaccgac

SEQ ID NO: 1070013 - RNA, 20 nt, Mycobacterium bovis subsp bovis AF2122/97
caccggccccaccgacagcc

SEQ ID NO: 1070014 - RNA, 16 nt, Mycobacterium bovis subsp bovis AF2122/97
caccggccccaccggc

SEQ ID NO: 1070015 - RNA, 18 nt, Mycobacterium bovis subsp bovis AF2122/97
caccggccccaccggcac

SEQ ID NO: 1070016 - RNA, 15 nt, Mycobacterium bovis subsp bovis AF2122/97
caccggccgccgaca

SEQ ID NO: 1070017 - RNA, 14 nt, Mycobacterium bovis subsp bovis AF2122/97
caccggccgcggcg

SEQ ID NO: 1070018 - RNA, 13 nt, Mycobacterium bovis subsp bovis AF2122/97
caccggccguccc

SEQ ID NO: 1070019 - RNA, 17 nt, Mycobacterium bovis subsp bovis AF2122/97
caccggccgugccgccg

SEQ ID NO: 1070020 - RNA, 13 nt, Mycobacterium bovis subsp bovis AF2122/97
caccggccagugg

SEQ ID NO: 1070021 - RNA, 21 nt, Mycobacterium bovis subsp bovis AF2122/97
caccggccaccagggccaccg

SEQ ID NO: 1070022 - RNA, 15 nt, Mycobacterium bovis subsp bovis AF2122/97
caccggccaggccgg

SEQ ID NO: 1070023 - RNA, 17 nt, Mycobacterium bovis subsp bovis AF2122/97
caccggccacucgggac

SEQ ID NO: 1070024 - RNA, 13 nt, Mycobacterium bovis subsp bovis AF2122/97
caccggcaccgcc

SEQ ID NO: 1070025 - RNA, 19 nt, Mycobacterium bovis subsp bovis AF2122/97
caccggccaccagggccac

SEQ ID NO: 1070026 - RNA, 14 nt, Mycobacterium bovis subsp bovis AF2122/97
caccggcaggcggg

SEQ ID NO: 1070027 - RNA, 15 nt, Mycobacterium bovis subsp bovis AF2122/97
caccggccaccagcc

SEQ ID NO: 1070028 - RNA, 17 nt, Mycobacterium bovis subsp bovis AF2122/97
caccggcaugcgugccg

SEQ ID NO: 1070029 - RNA, 22 nt, Mycobacterium bovis subsp bovis AF2122/97
caccggcaugcgugccggcagc

SEQ ID NO: 1070030 - RNA, 14 nt, Mycobacterium bovis subsp bovis AF2122/97
caccgcugcggcac

SEQ ID NO: 1070031 - RNA, 21 nt, Mycobacterium bovis subsp bovis AF2122/97
caccgcugucagccgaccgac

SEQ ID NO: 1070032 - RNA, 19 nt, Mycobacterium bovis subsp bovis AF2122/97
caccgcuguucuuggugac

SEQ ID NO: 1070033 - RNA, 22 nt, Mycobacterium bovis subsp bovis AF2122/97
caccgcuguucuuggugaccaa

SEQ ID NO: 1070034 - RNA, 16 nt, Mycobacterium bovis subsp bovis AF2122/97
caccggagucgcccgg

SEQ ID NO: 1070035 - RNA, 18 nt, Mycobacterium bovis subsp bovis AF2122/97
caccggagucggcgucga

SEQ ID NO: 1070036 - RNA, 17 nt, Mycobacterium bovis subsp bovis AF2122/97
caccgcugccggcagcg

SEQ ID NO: 1070037 - RNA, 15 nt, Mycobacterium bovis subsp bovis AF2122/97
caccgcugccggcgc

SEQ ID NO: 1070038 - RNA, 16 nt, Mycobacterium bovis subsp bovis AF2122/97
caccgcugccggcgcc

SEQ ID NO: 1070039 - RNA, 13 nt, Mycobacterium bovis subsp bovis AF2122/97
caccgcugccggc

SEQ ID NO: 1070040 - RNA, 15 nt, Mycobacterium bovis subsp bovis AF2122/97
caccgcugccggcac

SEQ ID NO: 1070041 - RNA, 17 nt, Mycobacterium bovis subsp bovis AF2122/97
caccgcugaccccggca

SEQ ID NO: 1070042 - RNA, 19 nt, Mycobacterium bovis subsp bovis AF2122/97
caccgcugccgcugccgaa

SEQ ID NO: 1070043 - RNA, 22 nt, Mycobacterium bovis subsp bovis AF2122/97
caccgcuacgaccaauagcacg

SEQ ID NO: 1070044 - RNA, 17 nt, Mycobacterium bovis subsp bovis AF2122/97
caccgcguuggccacac

SEQ ID NO: 1070045 - RNA, 14 nt, Mycobacterium bovis subsp bovis AF2122/97
caccgcguuucgcg

SEQ ID NO: 1070046 - RNA, 23 nt, Mycobacterium bovis subsp bovis AF2122/97
caccgcguuucgcgacgucugcc

SEQ ID NO: 1070047 - RNA, 15 nt, Mycobacterium bovis subsp bovis AF2122/97
caccgcucgguccag

SEQ ID NO: 1070048 - RNA, 16 nt, Mycobacterium bovis subsp bovis AF2122/97
caccgcguaguccagg

SEQ ID NO: 1070049 - RNA, 19 nt, Mycobacterium bovis subsp bovis AF2122/97
caccgcguaguccaggccg

SEQ ID NO: 1070050 - RNA, 12 nt, Mycobacterium bovis subsp bovis AF2122/97
caccgcgucacc

SEQ ID NO: 1070051 - RNA, 23 nt, Mycobacterium bovis subsp bovis AF2122/97
caccgcgacgacgaggucgguca

SEQ ID NO: 1070052 - RNA, 23 nt, Mycobacterium bovis subsp bovis AF2122/97
caccgccuuugccgccggcaccg

SEQ ID NO: 1070053 - RNA, 22 nt, Mycobacterium bovis subsp bovis AF2122/97
caccgcgucaccggaggccgcc

SEQ ID NO: 1070054 - RNA, 20 nt, Mycobacterium bovis subsp bovis AF2122/97
caccgcguccaggugcgccg

SEQ ID NO: 1070055 - RNA, 21 nt, Mycobacterium bovis subsp bovis AF2122/97
caccgcguugaugaccgccgc

SEQ ID NO: 1070056 - RNA, 23 nt, Mycobacterium bovis subsp bovis AF2122/97
caccgcguugaugaccgccgccg

SEQ ID NO: 1070057 - RNA, 16 nt, Mycobacterium bovis subsp bovis AF2122/97
caccgcguuggccaca

SEQ ID NO: 1070058 - RNA, 20 nt, Mycobacterium bovis subsp bovis AF2122/97
caccgcgucguagccacgca

SEQ ID NO: 1070059 - RNA, 21 nt, Mycobacterium bovis subsp bovis AF2122/97
caccgccuuugccgccggcac

SEQ ID NO: 1070060 - RNA, 21 nt, Mycobacterium bovis subsp bovis AF2122/97
caccgcgaccgcgcacggcug

SEQ ID NO: 1070061 - RNA, 21 nt, Mycobacterium bovis subsp bovis AF2122/97
caccgcgaacuugcugacgaa

SEQ ID NO: 1070062 - RNA, 19 nt, Mycobacterium bovis subsp bovis AF2122/97
caccgcgaccaucgcgacg

SEQ ID NO: 1070063 - RNA, 19 nt, Mycobacterium bovis subsp bovis AF2122/97
caccgugcaccagcucacc

SEQ ID NO: 1070064 - RNA, 16 nt, Mycobacterium bovis subsp bovis AF2122/97
caccgugacagcggca

SEQ ID NO: 1070065 - RNA, 17 nt, Mycobacterium bovis subsp bovis AF2122/97
caccgugaaccgcccgc

SEQ ID NO: 1070066 - RNA, 22 nt, Mycobacterium bovis subsp bovis AF2122/97
caccgugaagcccuggccagcg

SEQ ID NO: 1070067 - RNA, 18 nt, Mycobacterium bovis subsp bovis AF2122/97
caccgugaccgccgcgcc

SEQ ID NO: 1070068 - RNA, 14 nt, Mycobacterium bovis subsp bovis AF2122/97
caccgugccgggcg

SEQ ID NO: 1070069 - RNA, 15 nt, Mycobacterium bovis subsp bovis AF2122/97
caccgugccgggcga

SEQ ID NO: 1070070 - RNA, 13 nt, Mycobacterium bovis subsp bovis AF2122/97
caccgugucgucg

SEQ ID NO: 1070071 - RNA, 12 nt, Mycobacterium bovis subsp bovis AF2122/97
caccgugucgac

SEQ ID NO: 1070072 - RNA, 19 nt, Mycobacterium bovis subsp bovis AF2122/97
caccgugucacgcgaccac

SEQ ID NO: 1070073 - RNA, 14 nt, Mycobacterium bovis subsp bovis AF2122/97
caccgugcccuggg

SEQ ID NO: 1070074 - RNA, 14 nt, Mycobacterium bovis subsp bovis AF2122/97
caccgugccgacgc

SEQ ID NO: 1070075 - RNA, 13 nt, Mycobacterium bovis subsp bovis AF2122/97
caccgugguggac

SEQ ID NO: 1070076 - RNA, 20 nt, Mycobacterium bovis subsp bovis AF2122/97
caccguguugcacgcgggug

SEQ ID NO: 1070077 - RNA, 16 nt, Mycobacterium bovis subsp bovis AF2122/97
caccguguugcugucg

SEQ ID NO: 1070078 - RNA, 14 nt, Mycobacterium bovis subsp bovis AF2122/97
caccguuaccgccg

SEQ ID NO: 1070079 - RNA, 17 nt, Mycobacterium bovis subsp bovis AF2122/97
caccguuaccgccgucg

SEQ ID NO: 1070080 - RNA, 22 nt, Mycobacterium bovis subsp bovis AF2122/97
caccgucccugugucgccgucg

SEQ ID NO: 1070081 - RNA, 16 nt, Mycobacterium bovis subsp bovis AF2122/97
caccgucacgccaccg

SEQ ID NO: 1070082 - RNA, 20 nt, Mycobacterium bovis subsp bovis AF2122/97
caccgucgagccggacaggc

SEQ ID NO: 1070083 - RNA, 22 nt, Mycobacterium bovis subsp bovis AF2122/97
caccgucgagguacacgccgag

SEQ ID NO: 1070084 - RNA, 16 nt, Mycobacterium bovis subsp bovis AF2122/97
caccgucugcuggccg

SEQ ID NO: 1070085 - RNA, 16 nt, Mycobacterium bovis subsp bovis AF2122/97
caccgucugcggaccg

SEQ ID NO: 1070086 - RNA, 18 nt, Mycobacterium bovis subsp bovis AF2122/97
caccgucugcggaccggc

SEQ ID NO: 1070087 - RNA, 16 nt, Mycobacterium bovis subsp bovis AF2122/97
caccgucaugccgacg

SEQ ID NO: 1070088 - RNA, 21 nt, Mycobacterium bovis subsp bovis AF2122/97
caccgucaugccgacgacaac

SEQ ID NO: 1070089 - RNA, 16 nt, Mycobacterium bovis subsp bovis AF2122/97
caccgucaugccguug

SEQ ID NO: 1070090 - RNA, 20 nt, Mycobacterium bovis subsp bovis AF2122/97
caccguccaauagcugacac

SEQ ID NO: 1070091 - RNA, 14 nt, Mycobacterium bovis subsp bovis AF2122/97
caccguccagcagc

SEQ ID NO: 1070092 - RNA, 23 nt, Mycobacterium bovis subsp bovis AF2122/97
caccguccagcagcucggggcga

SEQ ID NO: 1070093 - RNA, 20 nt, Mycobacterium bovis subsp bovis AF2122/97
caccgucccugugucgccgu

SEQ ID NO: 1070094 - RNA, 22 nt, Mycobacterium bovis subsp bovis AF2122/97
caccgucaggggaguugcgacg

SEQ ID NO: 1070095 - RNA, 16 nt, Mycobacterium bovis subsp bovis AF2122/97
caccgucagcgcgacc

SEQ ID NO: 1070096 - RNA, 11 nt, Mycobacterium bovis subsp bovis AF2122/97
caccgucacgg

SEQ ID NO: 1070097 - RNA, 21 nt, Mycobacterium bovis subsp bovis AF2122/97
caccgguaccgacggggaugg

SEQ ID NO: 1070098 - RNA, 16 nt, Mycobacterium bovis subsp bovis AF2122/97
caccgucacggucgcg

SEQ ID NO: 1070099 - RNA, 20 nt, Mycobacterium bovis subsp bovis AF2122/97
caccgucacggucgcggauc

SEQ ID NO: 1070100 - RNA, 20 nt, Mycobacterium bovis subsp bovis AF2122/97
caccggccgugccgccgaca

SEQ ID NO: 1070101 - RNA, 16 nt, Mycobacterium bovis subsp bovis AF2122/97
caccggccugcgcgac

SEQ ID NO: 1070102 - RNA, 20 nt, Mycobacterium bovis subsp bovis AF2122/97
caccggccugcgcgaccgac

SEQ ID NO: 1070103 - RNA, 22 nt, Mycobacterium bovis subsp bovis AF2122/97
caccggccugcgcgaccgacca

SEQ ID NO: 1070104 - RNA, 19 nt, Mycobacterium bovis subsp bovis AF2122/97
caccggcgcaccgucgcgg

SEQ ID NO: 1070105 - RNA, 19 nt, Mycobacterium bovis subsp bovis AF2122/97
caccggcgcaccggagucg

SEQ ID NO: 1070106 - RNA, 14 nt, Mycobacterium bovis subsp bovis AF2122/97
caccggcgaucacc

SEQ ID NO: 1070107 - RNA, 19 nt, Mycobacterium bovis subsp bovis AF2122/97
caccggcgaucguguccac

SEQ ID NO: 1070108 - RNA, 20 nt, Mycobacterium bovis subsp bovis AF2122/97
caccggcgccuccggcaccu

SEQ ID NO: 1070109 - RNA, 12 nt, Mycobacterium bovis subsp bovis AF2122/97
caccggcgccgc

SEQ ID NO: 1070110 - RNA, 13 nt, Mycobacterium bovis subsp bovis AF2122/97
caccggcgccgcc

SEQ ID NO: 1070111 - RNA, 20 nt, Mycobacterium bovis subsp bovis AF2122/97
caccggcgccgugucaccgg

SEQ ID NO: 1070112 - RNA, 14 nt, Mycobacterium bovis subsp bovis AF2122/97
caccggcgccgccc

SEQ ID NO: 1070113 - RNA, 15 nt, Mycobacterium bovis subsp bovis AF2122/97
caccggcgccgcccg

SEQ ID NO: 1070114 - RNA, 16 nt, Mycobacterium bovis subsp bovis AF2122/97
caccggcgccguguca

SEQ ID NO: 1070115 - RNA, 21 nt, Mycobacterium bovis subsp bovis AF2122/97
caccggcgcccucaugucggg

SEQ ID NO: 1070116 - RNA, 19 nt, Mycobacterium bovis subsp bovis AF2122/97
caccggcgccaccggcgcc

SEQ ID NO: 1070117 - RNA, 16 nt, Mycobacterium bovis subsp bovis AF2122/97
caccgggcccgacgac

SEQ ID NO: 1070118 - RNA, 17 nt, Mycobacterium bovis subsp bovis AF2122/97
caccgggcccgacgacg

SEQ ID NO: 1070119 - RNA, 12 nt, Mycobacterium bovis subsp bovis AF2122/97
caccggguccgg

SEQ ID NO: 1070120 - RNA, 21 nt, Mycobacterium bovis subsp bovis AF2122/97
caccggguuggaagccgcacc

SEQ ID NO: 1070121 - RNA, 20 nt, Mycobacterium bovis subsp bovis AF2122/97
caccggguugagccgccgcg

SEQ ID NO: 1070122 - RNA, 19 nt, Mycobacterium bovis subsp bovis AF2122/97
caccggguuggaagccgca

SEQ ID NO: 1070123 - RNA, 18 nt, Mycobacterium bovis subsp bovis AF2122/97
caccgguaacgccaacac

SEQ ID NO: 1070124 - RNA, 22 nt, Mycobacterium bovis subsp bovis AF2122/97
caccgguaacgccaacaccggc

SEQ ID NO: 1070125 - RNA, 21 nt, Mycobacterium bovis subsp bovis AF2122/97
caccgguaacgcgacaagguc

SEQ ID NO: 1070126 - RNA, 12 nt, Mycobacterium bovis subsp bovis AF2122/97
caccgguaccga

SEQ ID NO: 1070127 - RNA, 16 nt, Mycobacterium bovis subsp bovis AF2122/97
caccgggugcaccggc

SEQ ID NO: 1070128 - RNA, 16 nt, Mycobacterium bovis subsp bovis AF2122/97
caccggguagccggcg

SEQ ID NO: 1070129 - RNA, 16 nt, Mycobacterium bovis subsp bovis AF2122/97
caccggguccaccgca

SEQ ID NO: 1070130 - RNA, 17 nt, Mycobacterium bovis subsp bovis AF2122/97
caccggguccaccgcac

SEQ ID NO: 1070131 - RNA, 18 nt, Mycobacterium bovis subsp bovis AF2122/97
caccggguccaccgcacg

SEQ ID NO: 1070132 - RNA, 23 nt, Mycobacterium bovis subsp bovis AF2122/97
caccggggugugcgggcggugca

SEQ ID NO: 1070133 - RNA, 18 nt, Mycobacterium bovis subsp bovis AF2122/97
caccgggcgucgucggug

SEQ ID NO: 1070134 - RNA, 21 nt, Mycobacterium bovis subsp bovis AF2122/97
caccgggcgucgucggugauc

SEQ ID NO: 1070135 - RNA, 19 nt, Mycobacterium bovis subsp bovis AF2122/97
caccgggcccgccggcccc

SEQ ID NO: 1070136 - RNA, 13 nt, Mycobacterium bovis subsp bovis AF2122/97
caccgggcggcgg

SEQ ID NO: 1070137 - RNA, 14 nt, Mycobacterium bovis subsp bovis AF2122/97
caccgggcggcggc

SEQ ID NO: 1070138 - RNA, 12 nt, Mycobacterium bovis subsp bovis AF2122/97
caccggggcaga

SEQ ID NO: 1070139 - RNA, 19 nt, Mycobacterium bovis subsp bovis AF2122/97
caccggggccuucggcccg

SEQ ID NO: 1070140 - RNA, 14 nt, Mycobacterium bovis subsp bovis AF2122/97
caccggggcggccg

SEQ ID NO: 1070141 - RNA, 15 nt, Mycobacterium bovis subsp bovis AF2122/97
caccggggcggccga

SEQ ID NO: 1070142 - RNA, 14 nt, Mycobacterium bovis subsp bovis AF2122/97
caccggggucaccu

SEQ ID NO: 1070143 - RNA, 16 nt, Mycobacterium bovis subsp bovis AF2122/97
caccggggcggccgac

SEQ ID NO: 1070144 - RNA, 17 nt, Mycobacterium bovis subsp bovis AF2122/97
caccggggcggccgacc

SEQ ID NO: 1070145 - RNA, 17 nt, Mycobacterium bovis subsp bovis AF2122/97
caccccccagcgccgcc

SEQ ID NO: 1070146 - RNA, 13 nt, Mycobacterium bovis subsp bovis AF2122/97
cacccccgacgag

SEQ ID NO: 1070147 - RNA, 16 nt, Mycobacterium bovis subsp bovis AF2122/97
cacccaaaccggcccg

SEQ ID NO: 1070148 - RNA, 16 nt, Mycobacterium bovis subsp bovis AF2122/97
caccccgaccucccgg

SEQ ID NO: 1070149 - RNA, 20 nt, Mycobacterium bovis subsp bovis AF2122/97
caccccgaagcucaucaccg

SEQ ID NO: 1070150 - RNA, 18 nt, Mycobacterium bovis subsp bovis AF2122/97
caccccgauccgccacga

SEQ ID NO: 1070151 - RNA, 16 nt, Mycobacterium bovis subsp bovis AF2122/97
caccccgaggccgacc

SEQ ID NO: 1070152 - RNA, 16 nt, Mycobacterium bovis subsp bovis AF2122/97
caccccgccaugcggc

SEQ ID NO: 1070153 - RNA, 21 nt, Mycobacterium bovis subsp bovis AF2122/97
caccccgauucgugucggugc

SEQ ID NO: 1070154 - RNA, 16 nt, Mycobacterium bovis subsp bovis AF2122/97
caccccgcccgacgug

SEQ ID NO: 1070155 - RNA, 20 nt, Mycobacterium bovis subsp bovis AF2122/97
caccccugcgguccgcugcc

SEQ ID NO: 1070156 - RNA, 24 nt, Mycobacterium bovis subsp bovis AF2122/97
caccccuggguugaggaucccggc

SEQ ID NO: 1070157 - RNA, 15 nt, Mycobacterium bovis subsp bovis AF2122/97
caccccuucgccagc

SEQ ID NO: 1070158 - RNA, 17 nt, Mycobacterium bovis subsp bovis AF2122/97
caccccuucgccagcgc

SEQ ID NO: 1070159 - RNA, 21 nt, Mycobacterium bovis subsp bovis AF2122/97
caccccuucgccagcgccacu

SEQ ID NO: 1070160 - RNA, 14 nt, Mycobacterium bovis subsp bovis AF2122/97
cacccgaaacaccg

SEQ ID NO: 1070161 - RNA, 22 nt, Mycobacterium bovis subsp bovis AF2122/97
caccaucaccgccuuugccgcc

SEQ ID NO: 1070162 - RNA, 23 nt, Mycobacterium bovis subsp bovis AF2122/97
caccauguauuucucccagccca

SEQ ID NO: 1070163 - RNA, 16 nt, Mycobacterium bovis subsp bovis AF2122/97
caccaugucggccacc

SEQ ID NO: 1070164 - RNA, 15 nt, Mycobacterium bovis subsp bovis AF2122/97
caccauggcgccgcg

SEQ ID NO: 1070165 - RNA, 19 nt, Mycobacterium bovis subsp bovis AF2122/97
caccauggcgccgcgccga

SEQ ID NO: 1070166 - RNA, 23 nt, Mycobacterium bovis subsp bovis AF2122/97
caccauuggccuaggacaccggc

SEQ ID NO: 1070167 - RNA, 14 nt, Mycobacterium bovis subsp bovis AF2122/97
cacccgcaggucga

SEQ ID NO: 1070168 - RNA, 21 nt, Mycobacterium bovis subsp bovis AF2122/97
cacccgcaggucgaucugcgc

SEQ ID NO: 1070169 - RNA, 15 nt, Mycobacterium bovis subsp bovis AF2122/97
cacccgccagggcgg

SEQ ID NO: 1070170 - RNA, 16 nt, Mycobacterium bovis subsp bovis AF2122/97
cacccgccagggcggc

SEQ ID NO: 1070171 - RNA, 20 nt, Mycobacterium bovis subsp bovis AF2122/97
cacccgccagggcggcaucc

SEQ ID NO: 1070172 - RNA, 13 nt, Mycobacterium bovis subsp bovis AF2122/97
cacccgccaacgc

SEQ ID NO: 1070173 - RNA, 13 nt, Mycobacterium bovis subsp bovis AF2122/97
cacccgccagaug

SEQ ID NO: 1070174 - RNA, 11 nt, Mycobacterium bovis subsp bovis AF2122/97
cacccgccagg

SEQ ID NO: 1070175 - RNA, 14 nt, Mycobacterium bovis subsp bovis AF2122/97
cacccgccaggccg

SEQ ID NO: 1070176 - RNA, 15 nt, Mycobacterium bovis subsp bovis AF2122/97
cacccgccaggccgc

SEQ ID NO: 1070177 - RNA, 13 nt, Mycobacterium bovis subsp bovis AF2122/97
cacccgcccgggc

SEQ ID NO: 1070178 - RNA, 15 nt, Mycobacterium bovis subsp bovis AF2122/97
cacccgcccgggcgu

SEQ ID NO: 1070179 - RNA, 14 nt, Mycobacterium bovis subsp bovis AF2122/97
cacccgcgaacgcg

SEQ ID NO: 1070180 - RNA, 12 nt, Mycobacterium bovis subsp bovis AF2122/97
cacccgcgccgc

SEQ ID NO: 1070181 - RNA, 22 nt, Mycobacterium bovis subsp bovis AF2122/97
cacccgcaggucgaucugcgcc

SEQ ID NO: 1070182 - RNA, 14 nt, Mycobacterium bovis subsp bovis AF2122/97
cacccgcggcgaac

SEQ ID NO: 1070183 - RNA, 23 nt, Mycobacterium bovis subsp bovis AF2122/97
cacccgcgagaucgggccggccg

SEQ ID NO: 1070184 - RNA, 15 nt, Mycobacterium bovis subsp bovis AF2122/97
cacccgcgccuaccc

SEQ ID NO: 1070185 - RNA, 16 nt, Mycobacterium bovis subsp bovis AF2122/97
cacccgcuccagcucg

SEQ ID NO: 1070186 - RNA, 20 nt, Mycobacterium bovis subsp bovis AF2122/97
cacccgcggugccugcagcu

SEQ ID NO: 1070187 - RNA, 22 nt, Mycobacterium bovis subsp bovis AF2122/97
cacccgcgucaguccucaucga

SEQ ID NO: 1070188 - RNA, 14 nt, Mycobacterium bovis subsp bovis AF2122/97
cacccgcgucgagu

SEQ ID NO: 1070189 - RNA, 22 nt, Mycobacterium bovis subsp bovis AF2122/97
cacccgcgggucguccggcggc

SEQ ID NO: 1070190 - RNA, 23 nt, Mycobacterium bovis subsp bovis AF2122/97
cacccgcgcgaugcuggcgaacu

SEQ ID NO: 1070191 - RNA, 17 nt, Mycobacterium bovis subsp bovis AF2122/97
cacccgcggcgccguug

SEQ ID NO: 1070192 - RNA, 17 nt, Mycobacterium bovis subsp bovis AF2122/97
cacccgcagccgcgcgg

SEQ ID NO: 1070193 - RNA, 14 nt, Mycobacterium bovis subsp bovis AF2122/97
cacccgcaccgccg

SEQ ID NO: 1070194 - RNA, 16 nt, Mycobacterium bovis subsp bovis AF2122/97
cacccgcagaccgguu

SEQ ID NO: 1070195 - RNA, 16 nt, Mycobacterium bovis subsp bovis AF2122/97
cacccgcaccaccggc

SEQ ID NO: 1070196 - RNA, 13 nt, Mycobacterium bovis subsp bovis AF2122/97
cacccgcaccgcg

SEQ ID NO: 1070197 - RNA, 18 nt, Mycobacterium bovis subsp bovis AF2122/97
cacccgcaccggaucggc

SEQ ID NO: 1070198 - RNA, 23 nt, Mycobacterium bovis subsp bovis AF2122/97
cacccgcaccggugacgcacagc

SEQ ID NO: 1070199 - RNA, 14 nt, Mycobacterium bovis subsp bovis AF2122/97
cacccgcacggccu

SEQ ID NO: 1070200 - RNA, 12 nt, Mycobacterium bovis subsp bovis AF2122/97
cacccgcaccac

SEQ ID NO: 1070201 - RNA, 13 nt, Mycobacterium bovis subsp bovis AF2122/97
cacccgcaccacc

SEQ ID NO: 1070202 - RNA, 16 nt, Mycobacterium bovis subsp bovis AF2122/97
cacccgauuggccaac

SEQ ID NO: 1070203 - RNA, 13 nt, Mycobacterium bovis subsp bovis AF2122/97
cacccgaucgggc

SEQ ID NO: 1070204 - RNA, 19 nt, Mycobacterium bovis subsp bovis AF2122/97
cacccgagccaucaccgca

SEQ ID NO: 1070205 - RNA, 21 nt, Mycobacterium bovis subsp bovis AF2122/97
cacccgagcgaugcgaccgac

SEQ ID NO: 1070206 - RNA, 16 nt, Mycobacterium bovis subsp bovis AF2122/97
cacccgacacggcucg

SEQ ID NO: 1070207 - RNA, 16 nt, Mycobacterium bovis subsp bovis AF2122/97
cacccgacaugcgccg

SEQ ID NO: 1070208 - RNA, 19 nt, Mycobacterium bovis subsp bovis AF2122/97
cacccgaauuugucggcga

SEQ ID NO: 1070209 - RNA, 16 nt, Mycobacterium bovis subsp bovis AF2122/97
caccaggggcgcguca

SEQ ID NO: 1070210 - RNA, 19 nt, Mycobacterium bovis subsp bovis AF2122/97
caccaggguggcccgggga

SEQ ID NO: 1070211 - RNA, 19 nt, Mycobacterium bovis subsp bovis AF2122/97
caccaggucauugccggcg

SEQ ID NO: 1070212 - RNA, 18 nt, Mycobacterium bovis subsp bovis AF2122/97
caccagguccaccccgcc

SEQ ID NO: 1070213 - RNA, 18 nt, Mycobacterium bovis subsp bovis AF2122/97
caccaguuugugccgccg

SEQ ID NO: 1070214 - RNA, 22 nt, Mycobacterium bovis subsp bovis AF2122/97
caccaguuugugccgccgcggc

SEQ ID NO: 1070215 - RNA, 19 nt, Mycobacterium bovis subsp bovis AF2122/97
caccagggccuccacccgc

SEQ ID NO: 1070216 - RNA, 19 nt, Mycobacterium bovis subsp bovis AF2122/97
caccagggccucgaccgcc

SEQ ID NO: 1070217 - RNA, 22 nt, Mycobacterium bovis subsp bovis AF2122/97
caccagggccucgaccgccagc

SEQ ID NO: 1070218 - RNA, 23 nt, Mycobacterium bovis subsp bovis AF2122/97
caccagggcaacggccgcuagcg

SEQ ID NO: 1070219 - RNA, 19 nt, Mycobacterium bovis subsp bovis AF2122/97
caccagggcacguucggcg

SEQ ID NO: 1070220 - RNA, 20 nt, Mycobacterium bovis subsp bovis AF2122/97
caccagggcacguucggcgc

SEQ ID NO: 1070221 - RNA, 18 nt, Mycobacterium bovis subsp bovis AF2122/97
caccagggcgugcgcgaa

SEQ ID NO: 1070222 - RNA, 22 nt, Mycobacterium bovis subsp bovis AF2122/97
caccagggcgcggaucugcagc

SEQ ID NO: 1070223 - RNA, 22 nt, Mycobacterium bovis subsp bovis AF2122/97
caccaggggcgcgucauggcga

SEQ ID NO: 1070224 - RNA, 13 nt, Mycobacterium bovis subsp bovis AF2122/97
caccaggcugcag

SEQ ID NO: 1070225 - RNA, 16 nt, Mycobacterium bovis subsp bovis AF2122/97
caccagcugcucgucg

SEQ ID NO: 1070226 - RNA, 18 nt, Mycobacterium bovis subsp bovis AF2122/97
caccacgguggccgcugc

SEQ ID NO: 1070227 - RNA, 16 nt, Mycobacterium bovis subsp bovis AF2122/97
caccacggugccgacg

SEQ ID NO: 1070228 - RNA, 23 nt, Mycobacterium bovis subsp bovis AF2122/97
caccacuaggucgccggccacga

SEQ ID NO: 1070229 - RNA, 15 nt, Mycobacterium bovis subsp bovis AF2122/97
caccacgucgucggg

SEQ ID NO: 1070230 - RNA, 16 nt, Mycobacterium bovis subsp bovis AF2122/97
caccacgucgaccgaa

SEQ ID NO: 1070231 - RNA, 14 nt, Mycobacterium bovis subsp bovis AF2122/97
caccacgucgacga

SEQ ID NO: 1070232 - RNA, 11 nt, Mycobacterium bovis subsp bovis AF2122/97
caccagcccgg

SEQ ID NO: 1070233 - RNA, 22 nt, Mycobacterium bovis subsp bovis AF2122/97
caccagccggucgucgcgcagu

SEQ ID NO: 1070234 - RNA, 15 nt, Mycobacterium bovis subsp bovis AF2122/97
caccagcggucggcg

SEQ ID NO: 1070235 - RNA, 23 nt, Mycobacterium bovis subsp bovis AF2122/97
caccagcgucgcggccacgguca

SEQ ID NO: 1070236 - RNA, 18 nt, Mycobacterium bovis subsp bovis AF2122/97
caccagcgucgcacgcgc

SEQ ID NO: 1070237 - RNA, 21 nt, Mycobacterium bovis subsp bovis AF2122/97
caccagcgucgcacgcgcgca

SEQ ID NO: 1070238 - RNA, 14 nt, Mycobacterium bovis subsp bovis AF2122/97
caccagcgucgcgg

SEQ ID NO: 1070239 - RNA, 15 nt, Mycobacterium bovis subsp bovis AF2122/97
caccagcguguagcg

SEQ ID NO: 1070240 - RNA, 21 nt, Mycobacterium bovis subsp bovis AF2122/97
caccagcguguggagcucgcg

SEQ ID NO: 1070241 - RNA, 13 nt, Mycobacterium bovis subsp bovis AF2122/97
caccagcgggucg

SEQ ID NO: 1070242 - RNA, 15 nt, Mycobacterium bovis subsp bovis AF2122/97
caccagcgggcaucg

SEQ ID NO: 1070243 - RNA, 14 nt, Mycobacterium bovis subsp bovis AF2122/97
caccacgccgaccg

SEQ ID NO: 1070244 - RNA, 16 nt, Mycobacterium bovis subsp bovis AF2122/97
caccagcggcugaccg

SEQ ID NO: 1070245 - RNA, 15 nt, Mycobacterium bovis subsp bovis AF2122/97
caccagcgcccgucg

SEQ ID NO: 1070246 - RNA, 14 nt, Mycobacterium bovis subsp bovis AF2122/97
caccagcgccgacc

SEQ ID NO: 1070247 - RNA, 15 nt, Mycobacterium bovis subsp bovis AF2122/97
caccagcggcggcaa

SEQ ID NO: 1070248 - RNA, 15 nt, Mycobacterium bovis subsp bovis AF2122/97
caccagcggcggccc

SEQ ID NO: 1070249 - RNA, 13 nt, Mycobacterium bovis subsp bovis AF2122/97
caccagcgcaucg

SEQ ID NO: 1070250 - RNA, 17 nt, Mycobacterium bovis subsp bovis AF2122/97
caccagcgcccggcccg

SEQ ID NO: 1070251 - RNA, 13 nt, Mycobacterium bovis subsp bovis AF2122/97
caccagcgcccgu

SEQ ID NO: 1070252 - RNA, 18 nt, Mycobacterium bovis subsp bovis AF2122/97
caccagcgaauccagccg

SEQ ID NO: 1070253 - RNA, 19 nt, Mycobacterium bovis subsp bovis AF2122/97
caccagcgaauccagccgc

SEQ ID NO: 1070254 - RNA, 17 nt, Mycobacterium bovis subsp bovis AF2122/97
cacauacagcaggccgc

SEQ ID NO: 1070255 - RNA, 18 nt, Mycobacterium bovis subsp bovis AF2122/97
cacauacgauuucgacga

SEQ ID NO: 1070256 - RNA, 17 nt, Mycobacterium bovis subsp bovis AF2122/97
cacauaccaccacgugg

SEQ ID NO: 1070257 - RNA, 13 nt, Mycobacterium bovis subsp bovis AF2122/97
cacauacaccggc

SEQ ID NO: 1070258 - RNA, 18 nt, Mycobacterium bovis subsp bovis AF2122/97
cacauagcgauucgcgcu

SEQ ID NO: 1070259 - RNA, 14 nt, Mycobacterium bovis subsp bovis AF2122/97
cacaguggcucgcg

SEQ ID NO: 1070260 - RNA, 19 nt, Mycobacterium bovis subsp bovis AF2122/97
cacaguggcucgcggaugc

SEQ ID NO: 1070261 - RNA, 19 nt, Mycobacterium bovis subsp bovis AF2122/97
cacaguuaucagccgcgcg

SEQ ID NO: 1070262 - RNA, 13 nt, Mycobacterium bovis subsp bovis AF2122/97
cacaugcgccgaa

SEQ ID NO: 1070263 - RNA, 14 nt, Mycobacterium bovis subsp bovis AF2122/97
cacaugcgccgaaa

SEQ ID NO: 1070264 - RNA, 13 nt, Mycobacterium bovis subsp bovis AF2122/97
cacaugcucggcc

SEQ ID NO: 1070265 - RNA, 15 nt, Mycobacterium bovis subsp bovis AF2122/97
cacauggcggcccgg

SEQ ID NO: 1070266 - RNA, 19 nt, Mycobacterium bovis subsp bovis AF2122/97
cacaugggagccguucggu

SEQ ID NO: 1070267 - RNA, 12 nt, Mycobacterium bovis subsp bovis AF2122/97
cacaugaucgag

SEQ ID NO: 1070268 - RNA, 12 nt, Mycobacterium bovis subsp bovis AF2122/97
cacauccacgca

SEQ ID NO: 1070269 - RNA, 23 nt, Mycobacterium bovis subsp bovis AF2122/97
cacaugcaagccgacaucggcgg

SEQ ID NO: 1070270 - RNA, 18 nt, Mycobacterium bovis subsp bovis AF2122/97
cacauccagggugccggu

SEQ ID NO: 1070271 - RNA, 14 nt, Mycobacterium bovis subsp bovis AF2122/97
cacaucaugccagc

SEQ ID NO: 1070272 - RNA, 18 nt, Mycobacterium bovis subsp bovis AF2122/97
cacaucaaagucggcguc

SEQ ID NO: 1070273 - RNA, 18 nt, Mycobacterium bovis subsp bovis AF2122/97
cacaucaaaacggcggug

SEQ ID NO: 1070274 - RNA, 19 nt, Mycobacterium bovis subsp bovis AF2122/97
cacaucaaaacggcggugg

SEQ ID NO: 1070275 - RNA, 14 nt, Mycobacterium bovis subsp bovis AF2122/97
cacaggcgcgaucg

SEQ ID NO: 1070276 - RNA, 15 nt, Mycobacterium bovis subsp bovis AF2122/97
cacagccgcgccgac

SEQ ID NO: 1070277 - RNA, 14 nt, Mycobacterium bovis subsp bovis AF2122/97
cacaggaucaccca

SEQ ID NO: 1070278 - RNA, 17 nt, Mycobacterium bovis subsp bovis AF2122/97
cacaggcaucguccgcc

SEQ ID NO: 1070279 - RNA, 14 nt, Mycobacterium bovis subsp bovis AF2122/97
cacagccgcgccga

SEQ ID NO: 1070280 - RNA, 14 nt, Mycobacterium bovis subsp bovis AF2122/97
cacagccgaccucg

SEQ ID NO: 1070281 - RNA, 21 nt, Mycobacterium bovis subsp bovis AF2122/97
cacagcuugagcacacguccg

SEQ ID NO: 1070282 - RNA, 22 nt, Mycobacterium bovis subsp bovis AF2122/97
cacagcuugagcacacguccgg

SEQ ID NO: 1070283 - RNA, 21 nt, Mycobacterium bovis subsp bovis AF2122/97
cacagcuugcaauugcgcggc

SEQ ID NO: 1070284 - RNA, 19 nt, Mycobacterium bovis subsp bovis AF2122/97
cacagcuugcccgagccca

SEQ ID NO: 1070285 - RNA, 12 nt, Mycobacterium bovis subsp bovis AF2122/97
cacagccggguu

SEQ ID NO: 1070286 - RNA, 14 nt, Mycobacterium bovis subsp bovis AF2122/97
cacagccgguggca

SEQ ID NO: 1070287 - RNA, 14 nt, Mycobacterium bovis subsp bovis AF2122/97
cacagcccggcgac

SEQ ID NO: 1070288 - RNA, 16 nt, Mycobacterium bovis subsp bovis AF2122/97
cacagcccggcgacga

SEQ ID NO: 1070289 - RNA, 21 nt, Mycobacterium bovis subsp bovis AF2122/97
cacagcccggcgacgacccgg

SEQ ID NO: 1070290 - RNA, 19 nt, Mycobacterium bovis subsp bovis AF2122/97
cacagcccacaggcggcgc

SEQ ID NO: 1070291 - RNA, 17 nt, Mycobacterium bovis subsp bovis AF2122/97
cacagcauuguccggcg

SEQ ID NO: 1070292 - RNA, 14 nt, Mycobacterium bovis subsp bovis AF2122/97
cacagcaggcucga

SEQ ID NO: 1070293 - RNA, 15 nt, Mycobacterium bovis subsp bovis AF2122/97
cacaaacccaguuuc

SEQ ID NO: 1070294 - RNA, 18 nt, Mycobacterium bovis subsp bovis AF2122/97
caccacgcccgacgagga

SEQ ID NO: 1070295 - RNA, 13 nt, Mycobacterium bovis subsp bovis AF2122/97
caccacgccgguc

SEQ ID NO: 1070296 - RNA, 14 nt, Mycobacterium bovis subsp bovis AF2122/97
caccacgccguagc

SEQ ID NO: 1070297 - RNA, 19 nt, Mycobacterium bovis subsp bovis AF2122/97
caccacgccguagcgcagc

SEQ ID NO: 1070298 - RNA, 14 nt, Mycobacterium bovis subsp bovis AF2122/97
caccacgccagccc

SEQ ID NO: 1070299 - RNA, 23 nt, Mycobacterium bovis subsp bovis AF2122/97
caccacgccagcccguccggccc

SEQ ID NO: 1070300 - RNA, 15 nt, Mycobacterium bovis subsp bovis AF2122/97
caccacgcccgacga

SEQ ID NO: 1070301 - RNA, 14 nt, Mycobacterium bovis subsp bovis AF2122/97
caccacggccgccg

SEQ ID NO: 1070302 - RNA, 22 nt, Mycobacterium bovis subsp bovis AF2122/97
caccacgcggcggucguugccg

SEQ ID NO: 1070303 - RNA, 14 nt, Mycobacterium bovis subsp bovis AF2122/97
caccacgcgccgca

SEQ ID NO: 1070304 - RNA, 13 nt, Mycobacterium bovis subsp bovis AF2122/97
caccacggccagc

SEQ ID NO: 1070305 - RNA, 14 nt, Mycobacterium bovis subsp bovis AF2122/97
caccacggcggcca

SEQ ID NO: 1070306 - RNA, 15 nt, Mycobacterium bovis subsp bovis AF2122/97
caccacggcgcgcgc

SEQ ID NO: 1070307 - RNA, 22 nt, Mycobacterium bovis subsp bovis AF2122/97
caccacggcgcgcgcgccggcu

SEQ ID NO: 1070308 - RNA, 19 nt, Mycobacterium bovis subsp bovis AF2122/97
caccacggucaagccggcg

SEQ ID NO: 1070309 - RNA, 22 nt, Mycobacterium bovis subsp bovis AF2122/97
caccacggucaagccggcgccc

SEQ ID NO: 1070310 - RNA, 14 nt, Mycobacterium bovis subsp bovis AF2122/97
caccacggcguugc

SEQ ID NO: 1070311 - RNA, 16 nt, Mycobacterium bovis subsp bovis AF2122/97
caccacggcguugccg

SEQ ID NO: 1070312 - RNA, 18 nt, Mycobacterium bovis subsp bovis AF2122/97
caccacggcguugccgcc

SEQ ID NO: 1070313 - RNA, 20 nt, Mycobacterium bovis subsp bovis AF2122/97
caccacggcguugccgccgg

SEQ ID NO: 1070314 - RNA, 16 nt, Mycobacterium bovis subsp bovis AF2122/97
caccaccgcgccgucg

SEQ ID NO: 1070315 - RNA, 18 nt, Mycobacterium bovis subsp bovis AF2122/97
caccaccgcugccggcgc

SEQ ID NO: 1070316 - RNA, 14 nt, Mycobacterium bovis subsp bovis AF2122/97
caccaccgcgccgu

SEQ ID NO: 1070317 - RNA, 20 nt, Mycobacterium bovis subsp bovis AF2122/97
caccaccgcucgucguccgg

SEQ ID NO: 1070318 - RNA, 12 nt, Mycobacterium bovis subsp bovis AF2122/97
caccaccggcgc

SEQ ID NO: 1070319 - RNA, 19 nt, Mycobacterium bovis subsp bovis AF2122/97
caccaccggcgccgccguu

SEQ ID NO: 1070320 - RNA, 21 nt, Mycobacterium bovis subsp bovis AF2122/97
caccaccggcgccgccguugc

SEQ ID NO: 1070321 - RNA, 20 nt, Mycobacterium bovis subsp bovis AF2122/97
caccaccggcucccgggggc

SEQ ID NO: 1070322 - RNA, 21 nt, Mycobacterium bovis subsp bovis AF2122/97
caccaccggcaacaucagcag

SEQ ID NO: 1070323 - RNA, 14 nt, Mycobacterium bovis subsp bovis AF2122/97
caccaccggcaccc

SEQ ID NO: 1070324 - RNA, 18 nt, Mycobacterium bovis subsp bovis AF2122/97
caccaccggcacccgcug

SEQ ID NO: 1070325 - RNA, 13 nt, Mycobacterium bovis subsp bovis AF2122/97
caccaccggcccc

SEQ ID NO: 1070326 - RNA, 20 nt, Mycobacterium bovis subsp bovis AF2122/97
caccacgaucgcgagcccau

SEQ ID NO: 1070327 - RNA, 12 nt, Mycobacterium bovis subsp bovis AF2122/97
caccacgaucgc

SEQ ID NO: 1070328 - RNA, 14 nt, Mycobacterium bovis subsp bovis AF2122/97
caccacgaucgcag

SEQ ID NO: 1070329 - RNA, 13 nt, Mycobacterium bovis subsp bovis AF2122/97
caccacgaucgcg

SEQ ID NO: 1070330 - RNA, 14 nt, Mycobacterium bovis subsp bovis AF2122/97
caccacgaucgcga

SEQ ID NO: 1070331 - RNA, 15 nt, Mycobacterium bovis subsp bovis AF2122/97
caccaccgccggggu

SEQ ID NO: 1070332 - RNA, 16 nt, Mycobacterium bovis subsp bovis AF2122/97
caccaccgccgccacc

SEQ ID NO: 1070333 - RNA, 21 nt, Mycobacterium bovis subsp bovis AF2122/97
caccaccgccgccggcaccgc

SEQ ID NO: 1070334 - RNA, 14 nt, Mycobacterium bovis subsp bovis AF2122/97
caccaccgccgcca

SEQ ID NO: 1070335 - RNA, 21 nt, Mycobacterium bovis subsp bovis AF2122/97
caccaccagggcaacggccgc

SEQ ID NO: 1070336 - RNA, 19 nt, Mycobacterium bovis subsp bovis AF2122/97
caccaccaggcugucgugg

SEQ ID NO: 1070337 - RNA, 19 nt, Mycobacterium bovis subsp bovis AF2122/97
caccaacccguguggcacg

SEQ ID NO: 1070338 - RNA, 14 nt, Mycobacterium bovis subsp bovis AF2122/97
caccaccacgccga

SEQ ID NO: 1070339 - RNA, 14 nt, Mycobacterium bovis subsp bovis AF2122/97
caccaccaccgccg

SEQ ID NO: 1070340 - RNA, 13 nt, Mycobacterium bovis subsp bovis AF2122/97
caccaccaccgcc

SEQ ID NO: 1070341 - RNA, 15 nt, Mycobacterium bovis subsp bovis AF2122/97
caccaccacgugauc

SEQ ID NO: 1070342 - RNA, 14 nt, Mycobacterium bovis subsp bovis AF2122/97
caccaccacggcca

SEQ ID NO: 1070343 - RNA, 11 nt, Mycobacterium bovis subsp bovis AF2122/97
caccaccagca

SEQ ID NO: 1070344 - RNA, 12 nt, Mycobacterium bovis subsp bovis AF2122/97
caccaccagcac

SEQ ID NO: 1070345 - RNA, 22 nt, Mycobacterium bovis subsp bovis AF2122/97
caccaccagagacgaucaucuc

SEQ ID NO: 1070346 - RNA, 14 nt, Mycobacterium bovis subsp bovis AF2122/97
caccaacccacccc

SEQ ID NO: 1070347 - RNA, 15 nt, Mycobacterium bovis subsp bovis AF2122/97
caccaacccaccccc

SEQ ID NO: 1070348 - RNA, 20 nt, Mycobacterium bovis subsp bovis AF2122/97
caccaacaccagcgcguugc

SEQ ID NO: 1070349 - RNA, 18 nt, Mycobacterium bovis subsp bovis AF2122/97
caccaaaaggaucaacgu

SEQ ID NO: 1070350 - RNA, 21 nt, Mycobacterium bovis subsp bovis AF2122/97
cacauugaccaggugcccgcc

SEQ ID NO: 1070351 - RNA, 14 nt, Mycobacterium bovis subsp bovis AF2122/97
cacauugccaccgu

SEQ ID NO: 1070352 - RNA, 17 nt, Mycobacterium bovis subsp bovis AF2122/97
cacauuggccaggucgg

SEQ ID NO: 1070353 - RNA, 22 nt, Mycobacterium bovis subsp bovis AF2122/97
cacauuggccaggucggccacc

SEQ ID NO: 1070354 - RNA, 22 nt, Mycobacterium bovis subsp bovis AF2122/97
cacauuggugauggccgacguc

SEQ ID NO: 1070355 - RNA, 15 nt, Mycobacterium bovis subsp bovis AF2122/97
cacauuucaccaccg

SEQ ID NO: 1070356 - RNA, 19 nt, Mycobacterium bovis subsp bovis AF2122/97
cacauggcccggaggccgc

SEQ ID NO: 1070357 - RNA, 19 nt, Mycobacterium bovis subsp bovis AF2122/97
cacauguugucgacggucg

SEQ ID NO: 1070358 - RNA, 17 nt, Mycobacterium bovis subsp bovis AF2122/97
caagacgucggcguggu

SEQ ID NO: 1070359 - RNA, 19 nt, Mycobacterium bovis subsp bovis AF2122/97
caagacgucggcguggucg

SEQ ID NO: 1070360 - RNA, 22 nt, Mycobacterium bovis subsp bovis AF2122/97
caagacgaugcuggcggccucg

SEQ ID NO: 1070361 - RNA, 16 nt, Mycobacterium bovis subsp bovis AF2122/97
caagaccgcgccaacu

SEQ ID NO: 1070362 - RNA, 14 nt, Mycobacterium bovis subsp bovis AF2122/97
caacugcgccggug

SEQ ID NO: 1070363 - RNA, 20 nt, Mycobacterium bovis subsp bovis AF2122/97
caacugcgccggugccggcc

SEQ ID NO: 1070364 - RNA, 15 nt, Mycobacterium bovis subsp bovis AF2122/97
caacugcucgacgag

SEQ ID NO: 1070365 - RNA, 19 nt, Mycobacterium bovis subsp bovis AF2122/97
caagacaaagccgucgacg

SEQ ID NO: 1070366 - RNA, 13 nt, Mycobacterium bovis subsp bovis AF2122/97
caagccggccacg

SEQ ID NO: 1070367 - RNA, 15 nt, Mycobacterium bovis subsp bovis AF2122/97
caagccggccacgca

SEQ ID NO: 1070368 - RNA, 11 nt, Mycobacterium bovis subsp bovis AF2122/97
caagccgccgg

SEQ ID NO: 1070369 - RNA, 16 nt, Mycobacterium bovis subsp bovis AF2122/97
caagccgcgagucgcc

SEQ ID NO: 1070370 - RNA, 14 nt, Mycobacterium bovis subsp bovis AF2122/97
caagccgaucggug

SEQ ID NO: 1070371 - RNA, 22 nt, Mycobacterium bovis subsp bovis AF2122/97
caagaucaccuucgucgcggcc

SEQ ID NO: 1070372 - RNA, 23 nt, Mycobacterium bovis subsp bovis AF2122/97
caagaucagacccagcgcggcaa

SEQ ID NO: 1070373 - RNA, 15 nt, Mycobacterium bovis subsp bovis AF2122/97
caagccggcgcccgc

SEQ ID NO: 1070374 - RNA, 19 nt, Mycobacterium bovis subsp bovis AF2122/97
caagccggcgcccgccgcg

SEQ ID NO: 1070375 - RNA, 19 nt, Mycobacterium bovis subsp bovis AF2122/97
caagccggggaacuuaccg

SEQ ID NO: 1070376 - RNA, 20 nt, Mycobacterium bovis subsp bovis AF2122/97
caagccggggaacuuaccga

SEQ ID NO: 1070377 - RNA, 11 nt, Mycobacterium bovis subsp bovis AF2122/97
caagccguggc

SEQ ID NO: 1070378 - RNA, 19 nt, Mycobacterium bovis subsp bovis AF2122/97
caagccguguucgaccgca

SEQ ID NO: 1070379 - RNA, 13 nt, Mycobacterium bovis subsp bovis AF2122/97
caagcucgacaac

SEQ ID NO: 1070380 - RNA, 14 nt, Mycobacterium bovis subsp bovis AF2122/97
caagcgugcugccg

SEQ ID NO: 1070381 - RNA, 21 nt, Mycobacterium bovis subsp bovis AF2122/97
caagcucagggugggcgacgu

SEQ ID NO: 1070382 - RNA, 22 nt, Mycobacterium bovis subsp bovis AF2122/97
caagcguuguaguccugcgggc

SEQ ID NO: 1070383 - RNA, 14 nt, Mycobacterium bovis subsp bovis AF2122/97
caagcuaccggccc

SEQ ID NO: 1070384 - RNA, 14 nt, Mycobacterium bovis subsp bovis AF2122/97
caagccugccgaac

SEQ ID NO: 1070385 - RNA, 24 nt, Mycobacterium bovis subsp bovis AF2122/97
caagccguucugucccggcgcgcc

SEQ ID NO: 1070386 - RNA, 18 nt, Mycobacterium bovis subsp bovis AF2122/97
caagccguugcacggccg

SEQ ID NO: 1070387 - RNA, 19 nt, Mycobacterium bovis subsp bovis AF2122/97
caagccguugcacggccgg

SEQ ID NO: 1070388 - RNA, 21 nt, Mycobacterium bovis subsp bovis AF2122/97
caaggccgcguugccggucgc

SEQ ID NO: 1070389 - RNA, 20 nt, Mycobacterium bovis subsp bovis AF2122/97
caaggccgccgccgucggcg

SEQ ID NO: 1070390 - RNA, 13 nt, Mycobacterium bovis subsp bovis AF2122/97
caaggccgccugc

SEQ ID NO: 1070391 - RNA, 15 nt, Mycobacterium bovis subsp bovis AF2122/97
caaggcccgcaccgc

SEQ ID NO: 1070392 - RNA, 17 nt, Mycobacterium bovis subsp bovis AF2122/97
caaggcauccaacgcgg

SEQ ID NO: 1070393 - RNA, 16 nt, Mycobacterium bovis subsp bovis AF2122/97
caaggacgcaccgcca

SEQ ID NO: 1070394 - RNA, 15 nt, Mycobacterium bovis subsp bovis AF2122/97
caaggccaccggcgg

SEQ ID NO: 1070395 - RNA, 14 nt, Mycobacterium bovis subsp bovis AF2122/97
caaggcguguagcc

SEQ ID NO: 1070396 - RNA, 20 nt, Mycobacterium bovis subsp bovis AF2122/97
caaggcuuccuccgacgcga

SEQ ID NO: 1070397 - RNA, 20 nt, Mycobacterium bovis subsp bovis AF2122/97
caaggcgccgauaccggcgg

SEQ ID NO: 1070398 - RNA, 20 nt, Mycobacterium bovis subsp bovis AF2122/97
caaggcgcgcugggcgccgu

SEQ ID NO: 1070399 - RNA, 20 nt, Mycobacterium bovis subsp bovis AF2122/97
caaggcgcucccggagcaca

SEQ ID NO: 1070400 - RNA, 17 nt, Mycobacterium bovis subsp bovis AF2122/97
caaggcccgcaccgcug

SEQ ID NO: 1070401 - RNA, 17 nt, Mycobacterium bovis subsp bovis AF2122/97
caaggcggucaccaccg

SEQ ID NO: 1070402 - RNA, 17 nt, Mycobacterium bovis subsp bovis AF2122/97
caaggcggcggccagcc

SEQ ID NO: 1070403 - RNA, 19 nt, Mycobacterium bovis subsp bovis AF2122/97
caaggaagccgcggccacg

SEQ ID NO: 1070404 - RNA, 18 nt, Mycobacterium bovis subsp bovis AF2122/97
caaggacguuucagccgg

SEQ ID NO: 1070405 - RNA, 20 nt, Mycobacterium bovis subsp bovis AF2122/97
caaggacucggacgcgccgg

SEQ ID NO: 1070406 - RNA, 22 nt, Mycobacterium bovis subsp bovis AF2122/97
caaggacucggacgcgccggcg

SEQ ID NO: 1070407 - RNA, 15 nt, Mycobacterium bovis subsp bovis AF2122/97
caaggaccgcucugc

SEQ ID NO: 1070408 - RNA, 14 nt, Mycobacterium bovis subsp bovis AF2122/97
caaggaagccgcgg

SEQ ID NO: 1070409 - RNA, 15 nt, Mycobacterium bovis subsp bovis AF2122/97
caagcugaccgccag

SEQ ID NO: 1070410 - RNA, 12 nt, Mycobacterium bovis subsp bovis AF2122/97
caagcucggcca

SEQ ID NO: 1070411 - RNA, 13 nt, Mycobacterium bovis subsp bovis AF2122/97
caagcugucggcg

SEQ ID NO: 1070412 - RNA, 19 nt, Mycobacterium bovis subsp bovis AF2122/97
caagcugucgucgccccgg

SEQ ID NO: 1070413 - RNA, 15 nt, Mycobacterium bovis subsp bovis AF2122/97
caacgggugucggcg

SEQ ID NO: 1070414 - RNA, 16 nt, Mycobacterium bovis subsp bovis AF2122/97
caacggguugucguug

SEQ ID NO: 1070415 - RNA, 19 nt, Mycobacterium bovis subsp bovis AF2122/97
caacggucucaacgcaucg

SEQ ID NO: 1070416 - RNA, 22 nt, Mycobacterium bovis subsp bovis AF2122/97
caacgguaguugcgcggcaucc

SEQ ID NO: 1070417 - RNA, 23 nt, Mycobacterium bovis subsp bovis AF2122/97
caacgggccauggguagccgccc

SEQ ID NO: 1070418 - RNA, 24 nt, Mycobacterium bovis subsp bovis AF2122/97
caacgggccauggguagccgccca

SEQ ID NO: 1070419 - RNA, 22 nt, Mycobacterium bovis subsp bovis AF2122/97
caacggguaguucuuggucagg

SEQ ID NO: 1070420 - RNA, 16 nt, Mycobacterium bovis subsp bovis AF2122/97
caacgggggcgccgga

SEQ ID NO: 1070421 - RNA, 14 nt, Mycobacterium bovis subsp bovis AF2122/97
caacggguacaccc

SEQ ID NO: 1070422 - RNA, 17 nt, Mycobacterium bovis subsp bovis AF2122/97
caacgggauccgcgcgc

SEQ ID NO: 1070423 - RNA, 17 nt, Mycobacterium bovis subsp bovis AF2122/97
caacgggaugccggcga

SEQ ID NO: 1070424 - RNA, 16 nt, Mycobacterium bovis subsp bovis AF2122/97
caacgggaacaacggc

SEQ ID NO: 1070425 - RNA, 14 nt, Mycobacterium bovis subsp bovis AF2122/97
caacggcggcgucg

SEQ ID NO: 1070426 - RNA, 22 nt, Mycobacterium bovis subsp bovis AF2122/97
caacggcggggccggcggcucg

SEQ ID NO: 1070427 - RNA, 20 nt, Mycobacterium bovis subsp bovis AF2122/97
caacggcggugaagugggcg

SEQ ID NO: 1070428 - RNA, 16 nt, Mycobacterium bovis subsp bovis AF2122/97
caacggcuccgggcgc

SEQ ID NO: 1070429 - RNA, 20 nt, Mycobacterium bovis subsp bovis AF2122/97
caacggcguaaucgggaagu

SEQ ID NO: 1070430 - RNA, 15 nt, Mycobacterium bovis subsp bovis AF2122/97
caacggcccccccca

SEQ ID NO: 1070431 - RNA, 13 nt, Mycobacterium bovis subsp bovis AF2122/97
caacggcagcccg

SEQ ID NO: 1070432 - RNA, 15 nt, Mycobacterium bovis subsp bovis AF2122/97
caacggcgcgccgac

SEQ ID NO: 1070433 - RNA, 16 nt, Mycobacterium bovis subsp bovis AF2122/97
caacggcgcggcaagg

SEQ ID NO: 1070434 - RNA, 22 nt, Mycobacterium bovis subsp bovis AF2122/97
caacggcggaucggcggccggc

SEQ ID NO: 1070435 - RNA, 14 nt, Mycobacterium bovis subsp bovis AF2122/97
caacggcggcaacg

SEQ ID NO: 1070436 - RNA, 15 nt, Mycobacterium bovis subsp bovis AF2122/97
caacggcggcaacgg

SEQ ID NO: 1070437 - RNA, 19 nt, Mycobacterium bovis subsp bovis AF2122/97
caacggcggcaacggcggc

SEQ ID NO: 1070438 - RNA, 16 nt, Mycobacterium bovis subsp bovis AF2122/97
caacggcggcaggccg

SEQ ID NO: 1070439 - RNA, 19 nt, Mycobacterium bovis subsp bovis AF2122/97
caacggcggcaggccggcc

SEQ ID NO: 1070440 - RNA, 14 nt, Mycobacterium bovis subsp bovis AF2122/97
caacggcggcaucg

SEQ ID NO: 1070441 - RNA, 15 nt, Mycobacterium bovis subsp bovis AF2122/97
caacggcggcaucgg

SEQ ID NO: 1070442 - RNA, 20 nt, Mycobacterium bovis subsp bovis AF2122/97
caacggcggcaucggcggca

SEQ ID NO: 1070443 - RNA, 13 nt, Mycobacterium bovis subsp bovis AF2122/97
caacggcacccga

SEQ ID NO: 1070444 - RNA, 20 nt, Mycobacterium bovis subsp bovis AF2122/97
caacggcacuagcccgaccg

SEQ ID NO: 1070445 - RNA, 21 nt, Mycobacterium bovis subsp bovis AF2122/97
caacggcagaucccacgccag

SEQ ID NO: 1070446 - RNA, 18 nt, Mycobacterium bovis subsp bovis AF2122/97
caacggcacccgaaaacu

SEQ ID NO: 1070447 - RNA, 17 nt, Mycobacterium bovis subsp bovis AF2122/97
caacggcacccugcggc

SEQ ID NO: 1070448 - RNA, 22 nt, Mycobacterium bovis subsp bovis AF2122/97
caacgcggcaccuucggcccau

SEQ ID NO: 1070449 - RNA, 19 nt, Mycobacterium bovis subsp bovis AF2122/97
caacggaacaucgucaucg

SEQ ID NO: 1070450 - RNA, 16 nt, Mycobacterium bovis subsp bovis AF2122/97
caacggaggugccggc

SEQ ID NO: 1070451 - RNA, 18 nt, Mycobacterium bovis subsp bovis AF2122/97
caacggaggugccggcgc

SEQ ID NO: 1070452 - RNA, 23 nt, Mycobacterium bovis subsp bovis AF2122/97
caacggagugucgaugcgcgccg

SEQ ID NO: 1070453 - RNA, 23 nt, Mycobacterium bovis subsp bovis AF2122/97
caacgcuucggcacgcuugaugu

SEQ ID NO: 1070454 - RNA, 15 nt, Mycobacterium bovis subsp bovis AF2122/97
caacgcuucggcgug

SEQ ID NO: 1070455 - RNA, 20 nt, Mycobacterium bovis subsp bovis AF2122/97
caacgucuucacucacgacg

SEQ ID NO: 1070456 - RNA, 17 nt, Mycobacterium bovis subsp bovis AF2122/97
caacgucugcagccucg

SEQ ID NO: 1070457 - RNA, 21 nt, Mycobacterium bovis subsp bovis AF2122/97
caacgucuugcuggucgaugg

SEQ ID NO: 1070458 - RNA, 19 nt, Mycobacterium bovis subsp bovis AF2122/97
caacgucgauguccccggc

SEQ ID NO: 1070459 - RNA, 22 nt, Mycobacterium bovis subsp bovis AF2122/97
caacgucgauguccccggcggc

SEQ ID NO: 1070460 - RNA, 22 nt, Mycobacterium bovis subsp bovis AF2122/97
caacgucgcuccgaugugccga

SEQ ID NO: 1070461 - RNA, 12 nt, Mycobacterium bovis subsp bovis AF2122/97
caacgucgcuga

SEQ ID NO: 1070462 - RNA, 14 nt, Mycobacterium bovis subsp bovis AF2122/97
caacgucggcaccg

SEQ ID NO: 1070463 - RNA, 19 nt, Mycobacterium bovis subsp bovis AF2122/97
caacgugaugcguucggcc

SEQ ID NO: 1070464 - RNA, 18 nt, Mycobacterium bovis subsp bovis AF2122/97
caacgugccgaacgccag

SEQ ID NO: 1070465 - RNA, 19 nt, Mycobacterium bovis subsp bovis AF2122/97
caacgugcgcaacgcgucg

SEQ ID NO: 1070466 - RNA, 14 nt, Mycobacterium bovis subsp bovis AF2122/97
caacgucacgucga

SEQ ID NO: 1070467 - RNA, 20 nt, Mycobacterium bovis subsp bovis AF2122/97
caacguagccagcagcggcu

SEQ ID NO: 1070468 - RNA, 20 nt, Mycobacterium bovis subsp bovis AF2122/97
caacgucgacuucagcggcc

SEQ ID NO: 1070469 - RNA, 21 nt, Mycobacterium bovis subsp bovis AF2122/97
caacgucgagauccucgucga

SEQ ID NO: 1070470 - RNA, 13 nt, Mycobacterium bovis subsp bovis AF2122/97
caacguugcaccg

SEQ ID NO: 1070471 - RNA, 20 nt, Mycobacterium bovis subsp bovis AF2122/97
caacguggucaguugugcgu

SEQ ID NO: 1070472 - RNA, 15 nt, Mycobacterium bovis subsp bovis AF2122/97
caacguucggcacaa

SEQ ID NO: 1070473 - RNA, 20 nt, Mycobacterium bovis subsp bovis AF2122/97
caaucaccgccgcgaccgcc

SEQ ID NO: 1070474 - RNA, 12 nt, Mycobacterium bovis subsp bovis AF2122/97
caaucaccaacg

SEQ ID NO: 1070475 - RNA, 16 nt, Mycobacterium bovis subsp bovis AF2122/97
caauaucuuuagcgcg

SEQ ID NO: 1070476 - RNA, 18 nt, Mycobacterium bovis subsp bovis AF2122/97
caauccgcccuugccgcc

SEQ ID NO: 1070477 - RNA, 14 nt, Mycobacterium bovis subsp bovis AF2122/97
caauccggcugcgg

SEQ ID NO: 1070478 - RNA, 14 nt, Mycobacterium bovis subsp bovis AF2122/97
caaucgaccacgac

SEQ ID NO: 1070479 - RNA, 15 nt, Mycobacterium bovis subsp bovis AF2122/97
caaucagaacgucgg

SEQ ID NO: 1070480 - RNA, 13 nt, Mycobacterium bovis subsp bovis AF2122/97
caaucccuccgcc

SEQ ID NO: 1070481 - RNA, 13 nt, Mycobacterium bovis subsp bovis AF2122/97
caauccgcucggu

SEQ ID NO: 1070482 - RNA, 15 nt, Mycobacterium bovis subsp bovis AF2122/97
caauccgcucggucg

SEQ ID NO: 1070483 - RNA, 17 nt, Mycobacterium bovis subsp bovis AF2122/97
caauccgcucggucgcc

SEQ ID NO: 1070484 - RNA, 14 nt, Mycobacterium bovis subsp bovis AF2122/97
caauccgcacagcg

SEQ ID NO: 1070485 - RNA, 19 nt, Mycobacterium bovis subsp bovis AF2122/97
caauagaagcacgucgucg

SEQ ID NO: 1070486 - RNA, 20 nt, Mycobacterium bovis subsp bovis AF2122/97
caauagaagcacgucgucgc

SEQ ID NO: 1070487 - RNA, 22 nt, Mycobacterium bovis subsp bovis AF2122/97
caauagaagcacgucgucgcgg

SEQ ID NO: 1070488 - RNA, 16 nt, Mycobacterium bovis subsp bovis AF2122/97
caauagcugcgcgaag

SEQ ID NO: 1070489 - RNA, 21 nt, Mycobacterium bovis subsp bovis AF2122/97
caauaggugucgacgcgggcg

SEQ ID NO: 1070490 - RNA, 22 nt, Mycobacterium bovis subsp bovis AF2122/97
caauaggcuccagcgcgcgccg

SEQ ID NO: 1070491 - RNA, 15 nt, Mycobacterium bovis subsp bovis AF2122/97
caaguccagcagcga

SEQ ID NO: 1070492 - RNA, 21 nt, Mycobacterium bovis subsp bovis AF2122/97
caagucagaacggcggcagcg

SEQ ID NO: 1070493 - RNA, 16 nt, Mycobacterium bovis subsp bovis AF2122/97
caagucaaacgccguc

SEQ ID NO: 1070494 - RNA, 16 nt, Mycobacterium bovis subsp bovis AF2122/97
caagucaacaccgcgg

SEQ ID NO: 1070495 - RNA, 17 nt, Mycobacterium bovis subsp bovis AF2122/97
caagucaacaccgcggc

SEQ ID NO: 1070496 - RNA, 20 nt, Mycobacterium bovis subsp bovis AF2122/97
caagucaacaccgcggccga

SEQ ID NO: 1070497 - RNA, 16 nt, Mycobacterium bovis subsp bovis AF2122/97
caagucaccauagcuc

SEQ ID NO: 1070498 - RNA, 19 nt, Mycobacterium bovis subsp bovis AF2122/97
caagucgaccaugagccgg

SEQ ID NO: 1070499 - RNA, 22 nt, Mycobacterium bovis subsp bovis AF2122/97
caauacgugauguagcugcagg

SEQ ID NO: 1070500 - RNA, 11 nt, Mycobacterium bovis subsp bovis AF2122/97
caagucgacgc

SEQ ID NO: 1070501 - RNA, 14 nt, Mycobacterium bovis subsp bovis AF2122/97
caagucgacgccgc

SEQ ID NO: 1070502 - RNA, 20 nt, Mycobacterium bovis subsp bovis AF2122/97
caagucgacgccgcagcguc

SEQ ID NO: 1070503 - RNA, 21 nt, Mycobacterium bovis subsp bovis AF2122/97
caagguguccagcaccugccg

SEQ ID NO: 1070504 - RNA, 19 nt, Mycobacterium bovis subsp bovis AF2122/97
caagggccccuccggccac

SEQ ID NO: 1070505 - RNA, 16 nt, Mycobacterium bovis subsp bovis AF2122/97
caagggcggcaacggg

SEQ ID NO: 1070506 - RNA, 22 nt, Mycobacterium bovis subsp bovis AF2122/97
caaguagccgucgucgucgaga

SEQ ID NO: 1070507 - RNA, 14 nt, Mycobacterium bovis subsp bovis AF2122/97
caaguacgcgaccg

SEQ ID NO: 1070508 - RNA, 18 nt, Mycobacterium bovis subsp bovis AF2122/97
caaguacgcgucggugac

SEQ ID NO: 1070509 - RNA, 19 nt, Mycobacterium bovis subsp bovis AF2122/97
caaguacgcgucggugacc

SEQ ID NO: 1070510 - RNA, 16 nt, Mycobacterium bovis subsp bovis AF2122/97
caauugaacgcaccaa

SEQ ID NO: 1070511 - RNA, 14 nt, Mycobacterium bovis subsp bovis AF2122/97
caauucgaccgcgc

SEQ ID NO: 1070512 - RNA, 15 nt, Mycobacterium bovis subsp bovis AF2122/97
caauucgcaaucggc

SEQ ID NO: 1070513 - RNA, 14 nt, Mycobacterium bovis subsp bovis AF2122/97
caauuccagccccc

SEQ ID NO: 1070514 - RNA, 16 nt, Mycobacterium bovis subsp bovis AF2122/97
caauucagcggcaacg

SEQ ID NO: 1070515 - RNA, 13 nt, Mycobacterium bovis subsp bovis AF2122/97
caaugcgucgaug

SEQ ID NO: 1070516 - RNA, 21 nt, Mycobacterium bovis subsp bovis AF2122/97
caauggcuucgaagcgaucgc

SEQ ID NO: 1070517 - RNA, 15 nt, Mycobacterium bovis subsp bovis AF2122/97
caauggccugcagcg

SEQ ID NO: 1070518 - RNA, 23 nt, Mycobacterium bovis subsp bovis AF2122/97
caauggcucugaggucaccggcg

SEQ ID NO: 1070519 - RNA, 18 nt, Mycobacterium bovis subsp bovis AF2122/97
caauggccugcagcgcga

SEQ ID NO: 1070520 - RNA, 22 nt, Mycobacterium bovis subsp bovis AF2122/97
caauggccugcagcgcgacccg

SEQ ID NO: 1070521 - RNA, 15 nt, Mycobacterium bovis subsp bovis AF2122/97
caauggcgccagccg

SEQ ID NO: 1070522 - RNA, 21 nt, Mycobacterium bovis subsp bovis AF2122/97
caaugcccgaccggucuggcg

SEQ ID NO: 1070523 - RNA, 15 nt, Mycobacterium bovis subsp bovis AF2122/97
caaugcccgcaccgc

SEQ ID NO: 1070524 - RNA, 20 nt, Mycobacterium bovis subsp bovis AF2122/97
caaugcguugacgucgagca

SEQ ID NO: 1070525 - RNA, 19 nt, Mycobacterium bovis subsp bovis AF2122/97
caaugcuucggcguccagg

SEQ ID NO: 1070526 - RNA, 17 nt, Mycobacterium bovis subsp bovis AF2122/97
caauggccagcaccacg

SEQ ID NO: 1070527 - RNA, 16 nt, Mycobacterium bovis subsp bovis AF2122/97
caauggacaccaaccc

SEQ ID NO: 1070528 - RNA, 14 nt, Mycobacterium bovis subsp bovis AF2122/97
caauggaccgaacg

SEQ ID NO: 1070529 - RNA, 17 nt, Mycobacterium bovis subsp bovis AF2122/97
caaugaucgcggcggcg

SEQ ID NO: 1070530 - RNA, 20 nt, Mycobacterium bovis subsp bovis AF2122/97
caaugcacaccgggcaccag

SEQ ID NO: 1070531 - RNA, 17 nt, Mycobacterium bovis subsp bovis AF2122/97
caaugcacaccgggcac

SEQ ID NO: 1070532 - RNA, 12 nt, Mycobacterium bovis subsp bovis AF2122/97
caaugauucggc

SEQ ID NO: 1070533 - RNA, 16 nt, Mycobacterium bovis subsp bovis AF2122/97
caaugauucggcacgc

SEQ ID NO: 1070534 - RNA, 20 nt, Mycobacterium bovis subsp bovis AF2122/97
caaucuucucgagccgccgg

SEQ ID NO: 1070535 - RNA, 14 nt, Mycobacterium bovis subsp bovis AF2122/97
caaucucggccgca

SEQ ID NO: 1070536 - RNA, 14 nt, Mycobacterium bovis subsp bovis AF2122/97
caaucucggcguug

SEQ ID NO: 1070537 - RNA, 20 nt, Mycobacterium bovis subsp bovis AF2122/97
caaucgugguucggcgucga

SEQ ID NO: 1070538 - RNA, 14 nt, Mycobacterium bovis subsp bovis AF2122/97
caaucguuggccau

SEQ ID NO: 1070539 - RNA, 16 nt, Mycobacterium bovis subsp bovis AF2122/97
caaucguuuucguguc

SEQ ID NO: 1070540 - RNA, 14 nt, Mycobacterium bovis subsp bovis AF2122/97
caaucgucggccag

SEQ ID NO: 1070541 - RNA, 17 nt, Mycobacterium bovis subsp bovis AF2122/97
caaucgacugaucgaag

SEQ ID NO: 1070542 - RNA, 23 nt, Mycobacterium bovis subsp bovis AF2122/97
caaucgcaaugaccugcagcgca

SEQ ID NO: 1070543 - RNA, 22 nt, Mycobacterium bovis subsp bovis AF2122/97
caaccgguuggcgauccgcggc

SEQ ID NO: 1070544 - RNA, 23 nt, Mycobacterium bovis subsp bovis AF2122/97
caaccgguggaugaacaccucau

SEQ ID NO: 1070545 - RNA, 22 nt, Mycobacterium bovis subsp bovis AF2122/97
caaccggucgguguagcaacgg

SEQ ID NO: 1070546 - RNA, 19 nt, Mycobacterium bovis subsp bovis AF2122/97
caaccgguggaugaacacc

SEQ ID NO: 1070547 - RNA, 17 nt, Mycobacterium bovis subsp bovis AF2122/97
caaccgggugugcgucg

SEQ ID NO: 1070548 - RNA, 18 nt, Mycobacterium bovis subsp bovis AF2122/97
caaccggucaaacgcgcg

SEQ ID NO: 1070549 - RNA, 12 nt, Mycobacterium bovis subsp bovis AF2122/97
caaccgguccag

SEQ ID NO: 1070550 - RNA, 19 nt, Mycobacterium bovis subsp bovis AF2122/97
caaccgguaucgccgcuac

SEQ ID NO: 1070551 - RNA, 22 nt, Mycobacterium bovis subsp bovis AF2122/97
caaccgggccggcuagggcagc

SEQ ID NO: 1070552 - RNA, 17 nt, Mycobacterium bovis subsp bovis AF2122/97
caaccggcgcaguagcc

SEQ ID NO: 1070553 - RNA, 17 nt, Mycobacterium bovis subsp bovis AF2122/97
caaccggcgugucgagg

SEQ ID NO: 1070554 - RNA, 15 nt, Mycobacterium bovis subsp bovis AF2122/97
caaccggcgugucga

SEQ ID NO: 1070555 - RNA, 20 nt, Mycobacterium bovis subsp bovis AF2122/97
caaccggauugagcacgcgc

SEQ ID NO: 1070556 - RNA, 18 nt, Mycobacterium bovis subsp bovis AF2122/97
caaccggacgcccucacg

SEQ ID NO: 1070557 - RNA, 20 nt, Mycobacterium bovis subsp bovis AF2122/97
caaccgcgugcgucagcgcc

SEQ ID NO: 1070558 - RNA, 14 nt, Mycobacterium bovis subsp bovis AF2122/97
caaccgcucggcga

SEQ ID NO: 1070559 - RNA, 21 nt, Mycobacterium bovis subsp bovis AF2122/97
caaccgcuuugaauugcgcgc

SEQ ID NO: 1070560 - RNA, 17 nt, Mycobacterium bovis subsp bovis AF2122/97
caaccgcugucaccgua

SEQ ID NO: 1070561 - RNA, 17 nt, Mycobacterium bovis subsp bovis AF2122/97
caaccgguggccggucg

SEQ ID NO: 1070562 - RNA, 16 nt, Mycobacterium bovis subsp bovis AF2122/97
caaccucaugcacgcc

SEQ ID NO: 1070563 - RNA, 22 nt, Mycobacterium bovis subsp bovis AF2122/97
caaccgugaacucgcgcgucgu

SEQ ID NO: 1070564 - RNA, 18 nt, Mycobacterium bovis subsp bovis AF2122/97
caaccgugagcaccagca

SEQ ID NO: 1070565 - RNA, 23 nt, Mycobacterium bovis subsp bovis AF2122/97
caaccgugccgcaucacccggga

SEQ ID NO: 1070566 - RNA, 23 nt, Mycobacterium bovis subsp bovis AF2122/97
caaccgucggugaaauucgcggc

SEQ ID NO: 1070567 - RNA, 13 nt, Mycobacterium bovis subsp bovis AF2122/97
caaccguccccgg

SEQ ID NO: 1070568 - RNA, 22 nt, Mycobacterium bovis subsp bovis AF2122/97
caaccguccggggccgcggccc

SEQ ID NO: 1070569 - RNA, 18 nt, Mycobacterium bovis subsp bovis AF2122/97
caaccucgccgucgucga

SEQ ID NO: 1070570 - RNA, 14 nt, Mycobacterium bovis subsp bovis AF2122/97
caaccucgccgucg

SEQ ID NO: 1070571 - RNA, 15 nt, Mycobacterium bovis subsp bovis AF2122/97
caaccucgccgucgu

SEQ ID NO: 1070572 - RNA, 21 nt, Mycobacterium bovis subsp bovis AF2122/97
caaccucggaucgccaggccg

SEQ ID NO: 1070573 - RNA, 23 nt, Mycobacterium bovis subsp bovis AF2122/97
caaccucgguugguccucggcgg

SEQ ID NO: 1070574 - RNA, 18 nt, Mycobacterium bovis subsp bovis AF2122/97
caaccucgucgucaucga

SEQ ID NO: 1070575 - RNA, 12 nt, Mycobacterium bovis subsp bovis AF2122/97
caaccucuggcg

SEQ ID NO: 1070576 - RNA, 14 nt, Mycobacterium bovis subsp bovis AF2122/97
caaccucuggcggc

SEQ ID NO: 1070577 - RNA, 16 nt, Mycobacterium bovis subsp bovis AF2122/97
caaccugaagccagcg

SEQ ID NO: 1070578 - RNA, 21 nt, Mycobacterium bovis subsp bovis AF2122/97
caaccugagcaucuccucgcc

SEQ ID NO: 1070579 - RNA, 19 nt, Mycobacterium bovis subsp bovis AF2122/97
caaccugcgaccaggcgcg

SEQ ID NO: 1070580 - RNA, 23 nt, Mycobacterium bovis subsp bovis AF2122/97
caaccugcgaccaggcgcggcga

SEQ ID NO: 1070581 - RNA, 22 nt, Mycobacterium bovis subsp bovis AF2122/97
caaccgcgcuuucgagugcagc

SEQ ID NO: 1070582 - RNA, 14 nt, Mycobacterium bovis subsp bovis AF2122/97
caaccgcgcgagcc

SEQ ID NO: 1070583 - RNA, 21 nt, Mycobacterium bovis subsp bovis AF2122/97
caaccgcauucggacgccacg

SEQ ID NO: 1070584 - RNA, 15 nt, Mycobacterium bovis subsp bovis AF2122/97
caaccgccgccacca

SEQ ID NO: 1070585 - RNA, 21 nt, Mycobacterium bovis subsp bovis AF2122/97
caaccgccgccaccagggcgg

SEQ ID NO: 1070586 - RNA, 14 nt, Mycobacterium bovis subsp bovis AF2122/97
caaccgccgcucca

SEQ ID NO: 1070587 - RNA, 19 nt, Mycobacterium bovis subsp bovis AF2122/97
caaccgccaucgucgaaga

SEQ ID NO: 1070588 - RNA, 18 nt, Mycobacterium bovis subsp bovis AF2122/97
caacccggcgucgacgau

SEQ ID NO: 1070589 - RNA, 15 nt, Mycobacterium bovis subsp bovis AF2122/97
caacccgucgagccg

SEQ ID NO: 1070590 - RNA, 17 nt, Mycobacterium bovis subsp bovis AF2122/97
caacccgucgagccgug

SEQ ID NO: 1070591 - RNA, 18 nt, Mycobacterium bovis subsp bovis AF2122/97
caacccgucuuaucggcg

SEQ ID NO: 1070592 - RNA, 23 nt, Mycobacterium bovis subsp bovis AF2122/97
caacccuagggcggugccgccgg

SEQ ID NO: 1070593 - RNA, 14 nt, Mycobacterium bovis subsp bovis AF2122/97
caaccgaucggucg

SEQ ID NO: 1070594 - RNA, 18 nt, Mycobacterium bovis subsp bovis AF2122/97
caaccgaucggucguccg

SEQ ID NO: 1070595 - RNA, 14 nt, Mycobacterium bovis subsp bovis AF2122/97
caaccgaugacgcg

SEQ ID NO: 1070596 - RNA, 18 nt, Mycobacterium bovis subsp bovis AF2122/97
caacccggacgaacgccg

SEQ ID NO: 1070597 - RNA, 21 nt, Mycobacterium bovis subsp bovis AF2122/97
caacccggacgaacgccgucg

SEQ ID NO: 1070598 - RNA, 13 nt, Mycobacterium bovis subsp bovis AF2122/97
caacccggcgucg

SEQ ID NO: 1070599 - RNA, 22 nt, Mycobacterium bovis subsp bovis AF2122/97
caacccgcgauucgcggcagcc

SEQ ID NO: 1070600 - RNA, 16 nt, Mycobacterium bovis subsp bovis AF2122/97
caaccccggugcagau

SEQ ID NO: 1070601 - RNA, 14 nt, Mycobacterium bovis subsp bovis AF2122/97
caaccccguccucg

SEQ ID NO: 1070602 - RNA, 16 nt, Mycobacterium bovis subsp bovis AF2122/97
caaccccuggggugcu

SEQ ID NO: 1070603 - RNA, 21 nt, Mycobacterium bovis subsp bovis AF2122/97
caaccccuggggugcucgggc

SEQ ID NO: 1070604 - RNA, 19 nt, Mycobacterium bovis subsp bovis AF2122/97
caacccauuucgucagcga

SEQ ID NO: 1070605 - RNA, 17 nt, Mycobacterium bovis subsp bovis AF2122/97
caacgcgcaccuggcgc

SEQ ID NO: 1070606 - RNA, 18 nt, Mycobacterium bovis subsp bovis AF2122/97
caacgcgcaccuggcgcg

SEQ ID NO: 1070607 - RNA, 13 nt, Mycobacterium bovis subsp bovis AF2122/97
caacgcgcaacca

SEQ ID NO: 1070608 - RNA, 15 nt, Mycobacterium bovis subsp bovis AF2122/97
caacgcgcaaccagc

SEQ ID NO: 1070609 - RNA, 14 nt, Mycobacterium bovis subsp bovis AF2122/97
caacgcgacgccgc

SEQ ID NO: 1070610 - RNA, 21 nt, Mycobacterium bovis subsp bovis AF2122/97
caacgcgacgccgcucccgca

SEQ ID NO: 1070611 - RNA, 16 nt, Mycobacterium bovis subsp bovis AF2122/97
caacgcgauguccagg

SEQ ID NO: 1070612 - RNA, 14 nt, Mycobacterium bovis subsp bovis AF2122/97
caacgcgaaccggc

SEQ ID NO: 1070613 - RNA, 18 nt, Mycobacterium bovis subsp bovis AF2122/97
caacgcgaaccggccauc

SEQ ID NO: 1070614 - RNA, 18 nt, Mycobacterium bovis subsp bovis AF2122/97
caacgccucugcucagcc

SEQ ID NO: 1070615 - RNA, 13 nt, Mycobacterium bovis subsp bovis AF2122/97
caacgccugcgag

SEQ ID NO: 1070616 - RNA, 13 nt, Mycobacterium bovis subsp bovis AF2122/97
caacgccgcgccg

SEQ ID NO: 1070617 - RNA, 14 nt, Mycobacterium bovis subsp bovis AF2122/97
caacgccgcgccgu

SEQ ID NO: 1070618 - RNA, 14 nt, Mycobacterium bovis subsp bovis AF2122/97
caacgcccgggcga

SEQ ID NO: 1070619 - RNA, 17 nt, Mycobacterium bovis subsp bovis AF2122/97
caacgccgccagccugg

SEQ ID NO: 1070620 - RNA, 18 nt, Mycobacterium bovis subsp bovis AF2122/97
caacgcggugacgauugc

SEQ ID NO: 1070621 - RNA, 19 nt, Mycobacterium bovis subsp bovis AF2122/97
caacgcggugccgggaucg

SEQ ID NO: 1070622 - RNA, 19 nt, Mycobacterium bovis subsp bovis AF2122/97
caacgcgguggaccgcucg

SEQ ID NO: 1070623 - RNA, 19 nt, Mycobacterium bovis subsp bovis AF2122/97
caacgcgggaacgaugccg

SEQ ID NO: 1070624 - RNA, 16 nt, Mycobacterium bovis subsp bovis AF2122/97
caacgcccguguugaa

SEQ ID NO: 1070625 - RNA, 22 nt, Mycobacterium bovis subsp bovis AF2122/97
caacgcggcgcgagccugcucu

SEQ ID NO: 1070626 - RNA, 20 nt, Mycobacterium bovis subsp bovis AF2122/97
caacgcggcgaagugcaccc

SEQ ID NO: 1070627 - RNA, 20 nt, Mycobacterium bovis subsp bovis AF2122/97
caacgcgcagagcguuccgc

SEQ ID NO: 1070628 - RNA, 14 nt, Mycobacterium bovis subsp bovis AF2122/97
caacgcgcggcucg

SEQ ID NO: 1070629 - RNA, 15 nt, Mycobacterium bovis subsp bovis AF2122/97
caacgcgcggcucga

SEQ ID NO: 1070630 - RNA, 17 nt, Mycobacterium bovis subsp bovis AF2122/97
caacgcgcggcucgaau

SEQ ID NO: 1070631 - RNA, 23 nt, Mycobacterium bovis subsp bovis AF2122/97
caacgcgguggaccgcucgaugu

SEQ ID NO: 1070632 - RNA, 18 nt, Mycobacterium bovis subsp bovis AF2122/97
caacgcggugggcacagc

SEQ ID NO: 1070633 - RNA, 19 nt, Mycobacterium bovis subsp bovis AF2122/97
caacgcguauucggcaucg

SEQ ID NO: 1070634 - RNA, 23 nt, Mycobacterium bovis subsp bovis AF2122/97
caacgcgucccgccgcaccgccg

SEQ ID NO: 1070635 - RNA, 22 nt, Mycobacterium bovis subsp bovis AF2122/97
caacgcugcggcaggucgaugc

SEQ ID NO: 1070636 - RNA, 13 nt, Mycobacterium bovis subsp bovis AF2122/97
caacgcuggaggc

SEQ ID NO: 1070637 - RNA, 20 nt, Mycobacterium bovis subsp bovis AF2122/97
caacgcuggaggcgaucugc

SEQ ID NO: 1070638 - RNA, 19 nt, Mycobacterium bovis subsp bovis AF2122/97
caacgaaaauuugacgacg

SEQ ID NO: 1070639 - RNA, 14 nt, Mycobacterium bovis subsp bovis AF2122/97
caacgaaaccgacc

SEQ ID NO: 1070640 - RNA, 19 nt, Mycobacterium bovis subsp bovis AF2122/97
caacgacaugagcgccacg

SEQ ID NO: 1070641 - RNA, 18 nt, Mycobacterium bovis subsp bovis AF2122/97
caacgacauugccacggc

SEQ ID NO: 1070642 - RNA, 15 nt, Mycobacterium bovis subsp bovis AF2122/97
caacgaccaccacca

SEQ ID NO: 1070643 - RNA, 16 nt, Mycobacterium bovis subsp bovis AF2122/97
caacgaccaccaccaa

SEQ ID NO: 1070644 - RNA, 13 nt, Mycobacterium bovis subsp bovis AF2122/97
caacgacaccaga

SEQ ID NO: 1070645 - RNA, 23 nt, Mycobacterium bovis subsp bovis AF2122/97
caacgacaccagaucguuccagg

SEQ ID NO: 1070646 - RNA, 20 nt, Mycobacterium bovis subsp bovis AF2122/97
caacgacaccauaggccgac

SEQ ID NO: 1070647 - RNA, 16 nt, Mycobacterium bovis subsp bovis AF2122/97
caacgaagagggcgcc

SEQ ID NO: 1070648 - RNA, 17 nt, Mycobacterium bovis subsp bovis AF2122/97
caacgaagagggcgccg

SEQ ID NO: 1070649 - RNA, 21 nt, Mycobacterium bovis subsp bovis AF2122/97
caacgaagagggcgccgcgcg

SEQ ID NO: 1070650 - RNA, 13 nt, Mycobacterium bovis subsp bovis AF2122/97
caacgaagccggc

SEQ ID NO: 1070651 - RNA, 14 nt, Mycobacterium bovis subsp bovis AF2122/97
caacgacguugauc

SEQ ID NO: 1070652 - RNA, 20 nt, Mycobacterium bovis subsp bovis AF2122/97
caacgacucacccacccgca

SEQ ID NO: 1070653 - RNA, 15 nt, Mycobacterium bovis subsp bovis AF2122/97
caacgacuccuggcg

SEQ ID NO: 1070654 - RNA, 16 nt, Mycobacterium bovis subsp bovis AF2122/97
caacgacucucaucaa

SEQ ID NO: 1070655 - RNA, 14 nt, Mycobacterium bovis subsp bovis AF2122/97
caacgacugcauga

SEQ ID NO: 1070656 - RNA, 14 nt, Mycobacterium bovis subsp bovis AF2122/97
caacgacggcaagc

SEQ ID NO: 1070657 - RNA, 15 nt, Mycobacterium bovis subsp bovis AF2122/97
caacgacacgccgca

SEQ ID NO: 1070658 - RNA, 21 nt, Mycobacterium bovis subsp bovis AF2122/97
caacgagauucggagucacca

SEQ ID NO: 1070659 - RNA, 15 nt, Mycobacterium bovis subsp bovis AF2122/97
caacgagcgcgcugc

SEQ ID NO: 1070660 - RNA, 20 nt, Mycobacterium bovis subsp bovis AF2122/97
caacgacgucgccgacccgg

SEQ ID NO: 1070661 - RNA, 19 nt, Mycobacterium bovis subsp bovis AF2122/97
caacgacuguggcgccgcc

SEQ ID NO: 1070662 - RNA, 21 nt, Mycobacterium bovis subsp bovis AF2122/97
caacgacuguggcgccgccgg

SEQ ID NO: 1070663 - RNA, 18 nt, Mycobacterium bovis subsp bovis AF2122/97
caacgacuuucaucgcga

SEQ ID NO: 1070664 - RNA, 16 nt, Mycobacterium bovis subsp bovis AF2122/97
caacgcaacacgggcg

SEQ ID NO: 1070665 - RNA, 23 nt, Mycobacterium bovis subsp bovis AF2122/97
caacgcaacacgggcgccggaac

SEQ ID NO: 1070666 - RNA, 23 nt, Mycobacterium bovis subsp bovis AF2122/97
caacgcaaugccaaucgcacugg

SEQ ID NO: 1070667 - RNA, 17 nt, Mycobacterium bovis subsp bovis AF2122/97
caacgaggucugcggcc

SEQ ID NO: 1070668 - RNA, 18 nt, Mycobacterium bovis subsp bovis AF2122/97
caacgaggucugcggccg

SEQ ID NO: 1070669 - RNA, 17 nt, Mycobacterium bovis subsp bovis AF2122/97
caacgaucgcgccgucg

SEQ ID NO: 1070670 - RNA, 14 nt, Mycobacterium bovis subsp bovis AF2122/97
caacgaucgcgcga

SEQ ID NO: 1070671 - RNA, 16 nt, Mycobacterium bovis subsp bovis AF2122/97
caacgcaacggugauc

SEQ ID NO: 1070672 - RNA, 20 nt, Mycobacterium bovis subsp bovis AF2122/97
caacgcaauauccuccagca

SEQ ID NO: 1070673 - RNA, 16 nt, Mycobacterium bovis subsp bovis AF2122/97
caacgcaaucgacuga

SEQ ID NO: 1070674 - RNA, 18 nt, Mycobacterium bovis subsp bovis AF2122/97
caacgccaucaccccggc

SEQ ID NO: 1070675 - RNA, 20 nt, Mycobacterium bovis subsp bovis AF2122/97
caacgcccccauccggucga

SEQ ID NO: 1070676 - RNA, 22 nt, Mycobacterium bovis subsp bovis AF2122/97
caacgcccccauccggucgaug

SEQ ID NO: 1070677 - RNA, 15 nt, Mycobacterium bovis subsp bovis AF2122/97
caacgcccgcaucgc

SEQ ID NO: 1070678 - RNA, 17 nt, Mycobacterium bovis subsp bovis AF2122/97
caacgcccgcaucgccu

SEQ ID NO: 1070679 - RNA, 20 nt, Mycobacterium bovis subsp bovis AF2122/97
caacgcccgcaucgccucga

SEQ ID NO: 1070680 - RNA, 13 nt, Mycobacterium bovis subsp bovis AF2122/97
caacgccacgccg

SEQ ID NO: 1070681 - RNA, 16 nt, Mycobacterium bovis subsp bovis AF2122/97
caacgccacgccgaug

SEQ ID NO: 1070682 - RNA, 16 nt, Mycobacterium bovis subsp bovis AF2122/97
caacgccaacgccacg

SEQ ID NO: 1070683 - RNA, 18 nt, Mycobacterium bovis subsp bovis AF2122/97
caacgccaaaacggucga

SEQ ID NO: 1070684 - RNA, 18 nt, Mycobacterium bovis subsp bovis AF2122/97
caacgcaucgaugcgugc

SEQ ID NO: 1070685 - RNA, 19 nt, Mycobacterium bovis subsp bovis AF2122/97
caacgcaucgguggcacgc

SEQ ID NO: 1070686 - RNA, 12 nt, Mycobacterium bovis subsp bovis AF2122/97
caacaggccggc

SEQ ID NO: 1070687 - RNA, 16 nt, Mycobacterium bovis subsp bovis AF2122/97
caacaggccggugugc

SEQ ID NO: 1070688 - RNA, 14 nt, Mycobacterium bovis subsp bovis AF2122/97
caacaggccgucga

SEQ ID NO: 1070689 - RNA, 16 nt, Mycobacterium bovis subsp bovis AF2122/97
caacaggcgcgucggu

SEQ ID NO: 1070690 - RNA, 20 nt, Mycobacterium bovis subsp bovis AF2122/97
caacagcugggucaugccgu

SEQ ID NO: 1070691 - RNA, 19 nt, Mycobacterium bovis subsp bovis AF2122/97
caacagcuuggagaucgcc

SEQ ID NO: 1070692 - RNA, 14 nt, Mycobacterium bovis subsp bovis AF2122/97
caacagggccagga

SEQ ID NO: 1070693 - RNA, 19 nt, Mycobacterium bovis subsp bovis AF2122/97
caacagggccaggacaacc

SEQ ID NO: 1070694 - RNA, 16 nt, Mycobacterium bovis subsp bovis AF2122/97
caacagggcgccgacg

SEQ ID NO: 1070695 - RNA, 22 nt, Mycobacterium bovis subsp bovis AF2122/97
caacaggaccgggaucgucagg

SEQ ID NO: 1070696 - RNA, 13 nt, Mycobacterium bovis subsp bovis AF2122/97
caacagucgcagc

SEQ ID NO: 1070697 - RNA, 22 nt, Mycobacterium bovis subsp bovis AF2122/97
caacagucgcagcacggcuucg

SEQ ID NO: 1070698 - RNA, 15 nt, Mycobacterium bovis subsp bovis AF2122/97
caacaucccggaccg

SEQ ID NO: 1070699 - RNA, 19 nt, Mycobacterium bovis subsp bovis AF2122/97
caacaucccggaccgaugg

SEQ ID NO: 1070700 - RNA, 19 nt, Mycobacterium bovis subsp bovis AF2122/97
caacaucagcgacagcgga

SEQ ID NO: 1070701 - RNA, 22 nt, Mycobacterium bovis subsp bovis AF2122/97
caacagccgcucgcacagccgc

SEQ ID NO: 1070702 - RNA, 14 nt, Mycobacterium bovis subsp bovis AF2122/97
caacagcgccagua

SEQ ID NO: 1070703 - RNA, 20 nt, Mycobacterium bovis subsp bovis AF2122/97
caacagcggggugugcgguu

SEQ ID NO: 1070704 - RNA, 18 nt, Mycobacterium bovis subsp bovis AF2122/97
caacagcgcuccagccgc

SEQ ID NO: 1070705 - RNA, 20 nt, Mycobacterium bovis subsp bovis AF2122/97
caacagcgcuccagccgcgc

SEQ ID NO: 1070706 - RNA, 12 nt, Mycobacterium bovis subsp bovis AF2122/97
caacacgccggc

SEQ ID NO: 1070707 - RNA, 14 nt, Mycobacterium bovis subsp bovis AF2122/97
caacacgccggccc

SEQ ID NO: 1070708 - RNA, 22 nt, Mycobacterium bovis subsp bovis AF2122/97
caacagcccaccggugccgccc

SEQ ID NO: 1070709 - RNA, 13 nt, Mycobacterium bovis subsp bovis AF2122/97
caacagccgaacu

SEQ ID NO: 1070710 - RNA, 19 nt, Mycobacterium bovis subsp bovis AF2122/97
caacaccucguaugccgug

SEQ ID NO: 1070711 - RNA, 14 nt, Mycobacterium bovis subsp bovis AF2122/97
caacaccucaccgc

SEQ ID NO: 1070712 - RNA, 14 nt, Mycobacterium bovis subsp bovis AF2122/97
caacacgagcgcau

SEQ ID NO: 1070713 - RNA, 20 nt, Mycobacterium bovis subsp bovis AF2122/97
caacccaauugggacgcgcg

SEQ ID NO: 1070714 - RNA, 21 nt, Mycobacterium bovis subsp bovis AF2122/97
caacccacacgcccucgacgc

SEQ ID NO: 1070715 - RNA, 21 nt, Mycobacterium bovis subsp bovis AF2122/97
caaccaugcgguuagcagccg

SEQ ID NO: 1070716 - RNA, 22 nt, Mycobacterium bovis subsp bovis AF2122/97
caaccaugcgguuagcagccgc

SEQ ID NO: 1070717 - RNA, 17 nt, Mycobacterium bovis subsp bovis AF2122/97
caaccaugcugucggug

SEQ ID NO: 1070718 - RNA, 17 nt, Mycobacterium bovis subsp bovis AF2122/97
caaccagcccggccgcc

SEQ ID NO: 1070719 - RNA, 22 nt, Mycobacterium bovis subsp bovis AF2122/97
caaccagcccggccgccgagga

SEQ ID NO: 1070720 - RNA, 19 nt, Mycobacterium bovis subsp bovis AF2122/97
caaccaggccgcgacaaug

SEQ ID NO: 1070721 - RNA, 18 nt, Mycobacterium bovis subsp bovis AF2122/97
caaccagccuuuccggcc

SEQ ID NO: 1070722 - RNA, 16 nt, Mycobacterium bovis subsp bovis AF2122/97
caaccaccucgccaac

SEQ ID NO: 1070723 - RNA, 20 nt, Mycobacterium bovis subsp bovis AF2122/97
caaccacggccgccgcgucg

SEQ ID NO: 1070724 - RNA, 17 nt, Mycobacterium bovis subsp bovis AF2122/97
caaccacggcggcauca

SEQ ID NO: 1070725 - RNA, 18 nt, Mycobacterium bovis subsp bovis AF2122/97
caaccacuuuccggccga

SEQ ID NO: 1070726 - RNA, 23 nt, Mycobacterium bovis subsp bovis AF2122/97
caacaugccggucauccgggcga

SEQ ID NO: 1070727 - RNA, 17 nt, Mycobacterium bovis subsp bovis AF2122/97
caacaugcccgucagcg

SEQ ID NO: 1070728 - RNA, 20 nt, Mycobacterium bovis subsp bovis AF2122/97
caacaugcccgucagcggac

SEQ ID NO: 1070729 - RNA, 21 nt, Mycobacterium bovis subsp bovis AF2122/97
caacaucuugccgucggccgg

SEQ ID NO: 1070730 - RNA, 22 nt, Mycobacterium bovis subsp bovis AF2122/97
caacauccgguggugcucgucg

SEQ ID NO: 1070731 - RNA, 19 nt, Mycobacterium bovis subsp bovis AF2122/97
caacaucgccauaccggcc

SEQ ID NO: 1070732 - RNA, 20 nt, Mycobacterium bovis subsp bovis AF2122/97
caacaucgccauaccggccg

SEQ ID NO: 1070733 - RNA, 13 nt, Mycobacterium bovis subsp bovis AF2122/97
caacaucggcccg

SEQ ID NO: 1070734 - RNA, 16 nt, Mycobacterium bovis subsp bovis AF2122/97
caacauguugucgucg

SEQ ID NO: 1070735 - RNA, 17 nt, Mycobacterium bovis subsp bovis AF2122/97
caacauccugggcaagu

SEQ ID NO: 1070736 - RNA, 20 nt, Mycobacterium bovis subsp bovis AF2122/97
caacauguugucgucgccgc

SEQ ID NO: 1070737 - RNA, 18 nt, Mycobacterium bovis subsp bovis AF2122/97
caacauugugcucgccga

SEQ ID NO: 1070738 - RNA, 19 nt, Mycobacterium bovis subsp bovis AF2122/97
caacaugucaccugcaucg

SEQ ID NO: 1070739 - RNA, 16 nt, Mycobacterium bovis subsp bovis AF2122/97
caacauuuucgcccgc

SEQ ID NO: 1070740 - RNA, 14 nt, Mycobacterium bovis subsp bovis AF2122/97
caaccaaagcgacg

SEQ ID NO: 1070741 - RNA, 23 nt, Mycobacterium bovis subsp bovis AF2122/97
caaccaaccggucacgucgauga

SEQ ID NO: 1070742 - RNA, 19 nt, Mycobacterium bovis subsp bovis AF2122/97
caaagccgucgcgacgucg

SEQ ID NO: 1070743 - RNA, 14 nt, Mycobacterium bovis subsp bovis AF2122/97
caaagcccgacaug

SEQ ID NO: 1070744 - RNA, 17 nt, Mycobacterium bovis subsp bovis AF2122/97
caaagcgacagcgcggc

SEQ ID NO: 1070745 - RNA, 19 nt, Mycobacterium bovis subsp bovis AF2122/97
caaagcgacagcgcggcgc

SEQ ID NO: 1070746 - RNA, 13 nt, Mycobacterium bovis subsp bovis AF2122/97
caaagcggccucg

SEQ ID NO: 1070747 - RNA, 23 nt, Mycobacterium bovis subsp bovis AF2122/97
caaagcugcucgucggcgccggc

SEQ ID NO: 1070748 - RNA, 17 nt, Mycobacterium bovis subsp bovis AF2122/97
caaaguuggccgcccga

SEQ ID NO: 1070749 - RNA, 11 nt, Mycobacterium bovis subsp bovis AF2122/97
caaagcagcgc

SEQ ID NO: 1070750 - RNA, 12 nt, Mycobacterium bovis subsp bovis AF2122/97
caacaccggcgu

SEQ ID NO: 1070751 - RNA, 14 nt, Mycobacterium bovis subsp bovis AF2122/97
caacaccggcgugg

SEQ ID NO: 1070752 - RNA, 14 nt, Mycobacterium bovis subsp bovis AF2122/97
caacaccggcaucg

SEQ ID NO: 1070753 - RNA, 15 nt, Mycobacterium bovis subsp bovis AF2122/97
caacaccggcaucgg

SEQ ID NO: 1070754 - RNA, 18 nt, Mycobacterium bovis subsp bovis AF2122/97
caacaccggcgaucaccg

SEQ ID NO: 1070755 - RNA, 23 nt, Mycobacterium bovis subsp bovis AF2122/97
caacaccgguaacgccaacaccg

SEQ ID NO: 1070756 - RNA, 20 nt, Mycobacterium bovis subsp bovis AF2122/97
caacaccggugucggccagc

SEQ ID NO: 1070757 - RNA, 17 nt, Mycobacterium bovis subsp bovis AF2122/97
caacaccgugcaccagc

SEQ ID NO: 1070758 - RNA, 13 nt, Mycobacterium bovis subsp bovis AF2122/97
caacaccgcgccg

SEQ ID NO: 1070759 - RNA, 13 nt, Mycobacterium bovis subsp bovis AF2122/97
caacaccgcccgc

SEQ ID NO: 1070760 - RNA, 14 nt, Mycobacterium bovis subsp bovis AF2122/97
caacaccgcccgca

SEQ ID NO: 1070761 - RNA, 14 nt, Mycobacterium bovis subsp bovis AF2122/97
caacaacuccagca

SEQ ID NO: 1070762 - RNA, 20 nt, Mycobacterium bovis subsp bovis AF2122/97
caacaagaugccugacacga

SEQ ID NO: 1070763 - RNA, 22 nt, Mycobacterium bovis subsp bovis AF2122/97
caacaagaugccugacacgaug

SEQ ID NO: 1070764 - RNA, 13 nt, Mycobacterium bovis subsp bovis AF2122/97
caacaacagccgc

SEQ ID NO: 1070765 - RNA, 22 nt, Mycobacterium bovis subsp bovis AF2122/97
caacaaaggccggguggccacg

SEQ ID NO: 1070766 - RNA, 13 nt, Mycobacterium bovis subsp bovis AF2122/97
caaaucggcaucg

SEQ ID NO: 1070767 - RNA, 15 nt, Mycobacterium bovis subsp bovis AF2122/97
caaaugaaccgcacc

SEQ ID NO: 1070768 - RNA, 17 nt, Mycobacterium bovis subsp bovis AF2122/97
cacgucgcccccggcca

SEQ ID NO: 1070769 - RNA, 20 nt, Mycobacterium bovis subsp bovis AF2122/97
cacgucgcccccggccaugg

SEQ ID NO: 1070770 - RNA, 12 nt, Mycobacterium bovis subsp bovis AF2122/97
cacgucgcccag

SEQ ID NO: 1070771 - RNA, 15 nt, Mycobacterium bovis subsp bovis AF2122/97
cacgucgcgguaggc

SEQ ID NO: 1070772 - RNA, 13 nt, Mycobacterium bovis subsp bovis AF2122/97
cacgucggccagu

SEQ ID NO: 1070773 - RNA, 15 nt, Mycobacterium bovis subsp bovis AF2122/97
cacgucggcgggcgu

SEQ ID NO: 1070774 - RNA, 22 nt, Mycobacterium bovis subsp bovis AF2122/97
cacgucuugcugcacgcucugc

SEQ ID NO: 1070775 - RNA, 17 nt, Mycobacterium bovis subsp bovis AF2122/97
cacgucuaacacgcggu

SEQ ID NO: 1070776 - RNA, 16 nt, Mycobacterium bovis subsp bovis AF2122/97
cacgucuaucggcgaa

SEQ ID NO: 1070777 - RNA, 17 nt, Mycobacterium bovis subsp bovis AF2122/97
cacgucuccuucggcga

SEQ ID NO: 1070778 - RNA, 17 nt, Mycobacterium bovis subsp bovis AF2122/97
cacgugcugccgauagc

SEQ ID NO: 1070779 - RNA, 21 nt, Mycobacterium bovis subsp bovis AF2122/97
cacgugcugccgauagcgcgg

SEQ ID NO: 1070780 - RNA, 20 nt, Mycobacterium bovis subsp bovis AF2122/97
cacgugccaaaugaugacga

SEQ ID NO: 1070781 - RNA, 18 nt, Mycobacterium bovis subsp bovis AF2122/97
cacgucgucgcgggaaaa

SEQ ID NO: 1070782 - RNA, 22 nt, Mycobacterium bovis subsp bovis AF2122/97
cacgugaugcccuggggguggc

SEQ ID NO: 1070783 - RNA, 20 nt, Mycobacterium bovis subsp bovis AF2122/97
cacgugauagcuugcgucgc

SEQ ID NO: 1070784 - RNA, 17 nt, Mycobacterium bovis subsp bovis AF2122/97
cacgugaucagaucggg

SEQ ID NO: 1070785 - RNA, 17 nt, Mycobacterium bovis subsp bovis AF2122/97
cacgugaaggcgauggc

SEQ ID NO: 1070786 - RNA, 13 nt, Mycobacterium bovis subsp bovis AF2122/97
cacguggucggcc

SEQ ID NO: 1070787 - RNA, 16 nt, Mycobacterium bovis subsp bovis AF2122/97
cacguggucggccacc

SEQ ID NO: 1070788 - RNA, 17 nt, Mycobacterium bovis subsp bovis AF2122/97
cacguggucggccaccc

SEQ ID NO: 1070789 - RNA, 16 nt, Mycobacterium bovis subsp bovis AF2122/97
cacguggaccggcacg

SEQ ID NO: 1070790 - RNA, 14 nt, Mycobacterium bovis subsp bovis AF2122/97
cacgugguccaacc

SEQ ID NO: 1070791 - RNA, 19 nt, Mycobacterium bovis subsp bovis AF2122/97
cacguggucgagcaggcga

SEQ ID NO: 1070792 - RNA, 16 nt, Mycobacterium bovis subsp bovis AF2122/97
cacguggaccacggcg

SEQ ID NO: 1070793 - RNA, 16 nt, Mycobacterium bovis subsp bovis AF2122/97
cacguggugcggccgg

SEQ ID NO: 1070794 - RNA, 19 nt, Mycobacterium bovis subsp bovis AF2122/97
cacguggugcggccggguc

SEQ ID NO: 1070795 - RNA, 15 nt, Mycobacterium bovis subsp bovis AF2122/97
cacguggugggcgca

SEQ ID NO: 1070796 - RNA, 20 nt, Mycobacterium bovis subsp bovis AF2122/97
cacguagaaguaggcggcga

SEQ ID NO: 1070797 - RNA, 15 nt, Mycobacterium bovis subsp bovis AF2122/97
cacguagcagcgccg

SEQ ID NO: 1070798 - RNA, 16 nt, Mycobacterium bovis subsp bovis AF2122/97
cacguagcgaccgcgg

SEQ ID NO: 1070799 - RNA, 17 nt, Mycobacterium bovis subsp bovis AF2122/97
cacguagcgaccgcggu

SEQ ID NO: 1070800 - RNA, 18 nt, Mycobacterium bovis subsp bovis AF2122/97
cacgucacgcgcggcggc

SEQ ID NO: 1070801 - RNA, 20 nt, Mycobacterium bovis subsp bovis AF2122/97
cacgucagcggaugggcuga

SEQ ID NO: 1070802 - RNA, 17 nt, Mycobacterium bovis subsp bovis AF2122/97
cacguauccacggucga

SEQ ID NO: 1070803 - RNA, 13 nt, Mycobacterium bovis subsp bovis AF2122/97
cacguccaacucg

SEQ ID NO: 1070804 - RNA, 17 nt, Mycobacterium bovis subsp bovis AF2122/97
cacgucccaggacuccg

SEQ ID NO: 1070805 - RNA, 21 nt, Mycobacterium bovis subsp bovis AF2122/97
cacgucccaggacuccggccg

SEQ ID NO: 1070806 - RNA, 23 nt, Mycobacterium bovis subsp bovis AF2122/97
cacgucccaggacuccggccgca

SEQ ID NO: 1070807 - RNA, 18 nt, Mycobacterium bovis subsp bovis AF2122/97
cacguccaagccguagac

SEQ ID NO: 1070808 - RNA, 17 nt, Mycobacterium bovis subsp bovis AF2122/97
cacguccgcaaccucgc

SEQ ID NO: 1070809 - RNA, 14 nt, Mycobacterium bovis subsp bovis AF2122/97
cacguccgcgcacc

SEQ ID NO: 1070810 - RNA, 14 nt, Mycobacterium bovis subsp bovis AF2122/97
cacguccggcgaug

SEQ ID NO: 1070811 - RNA, 17 nt, Mycobacterium bovis subsp bovis AF2122/97
cacgucgagcgugaacc

SEQ ID NO: 1070812 - RNA, 15 nt, Mycobacterium bovis subsp bovis AF2122/97
cacguccugcccguc

SEQ ID NO: 1070813 - RNA, 20 nt, Mycobacterium bovis subsp bovis AF2122/97
cacgucgagcagccgcgaca

SEQ ID NO: 1070814 - RNA, 22 nt, Mycobacterium bovis subsp bovis AF2122/97
cacgucgaucagugcaagaccg

SEQ ID NO: 1070815 - RNA, 19 nt, Mycobacterium bovis subsp bovis AF2122/97
cacgucgaucucccaguga

SEQ ID NO: 1070816 - RNA, 16 nt, Mycobacterium bovis subsp bovis AF2122/97
cacgucgacggcggcc

SEQ ID NO: 1070817 - RNA, 13 nt, Mycobacterium bovis subsp bovis AF2122/97
cacgucgaccgaa

SEQ ID NO: 1070818 - RNA, 23 nt, Mycobacterium bovis subsp bovis AF2122/97
cacgucgaccgaacccgacgucg

SEQ ID NO: 1070819 - RNA, 17 nt, Mycobacterium bovis subsp bovis AF2122/97
cacgucgaccucggcaa

SEQ ID NO: 1070820 - RNA, 20 nt, Mycobacterium bovis subsp bovis AF2122/97
cacgucgaccucggcaacca

SEQ ID NO: 1070821 - RNA, 17 nt, Mycobacterium bovis subsp bovis AF2122/97
cacgucgacaccgagga

SEQ ID NO: 1070822 - RNA, 15 nt, Mycobacterium bovis subsp bovis AF2122/97
cacugccgugccggu

SEQ ID NO: 1070823 - RNA, 16 nt, Mycobacterium bovis subsp bovis AF2122/97
cacugccguugccgcc

SEQ ID NO: 1070824 - RNA, 17 nt, Mycobacterium bovis subsp bovis AF2122/97
cacugccguugccgccg

SEQ ID NO: 1070825 - RNA, 20 nt, Mycobacterium bovis subsp bovis AF2122/97
cacugccguugccgccggug

SEQ ID NO: 1070826 - RNA, 18 nt, Mycobacterium bovis subsp bovis AF2122/97
cacugccuuaaccgagcc

SEQ ID NO: 1070827 - RNA, 22 nt, Mycobacterium bovis subsp bovis AF2122/97
cacugccuuaaccgagccgacc

SEQ ID NO: 1070828 - RNA, 15 nt, Mycobacterium bovis subsp bovis AF2122/97
cacugcccucaacga

SEQ ID NO: 1070829 - RNA, 21 nt, Mycobacterium bovis subsp bovis AF2122/97
cacugcccucaacgaucgcgc

SEQ ID NO: 1070830 - RNA, 20 nt, Mycobacterium bovis subsp bovis AF2122/97
cacugccgagcacgacgacg

SEQ ID NO: 1070831 - RNA, 14 nt, Mycobacterium bovis subsp bovis AF2122/97
cacugacgggccgu

SEQ ID NO: 1070832 - RNA, 15 nt, Mycobacterium bovis subsp bovis AF2122/97
cacugagucugaugg

SEQ ID NO: 1070833 - RNA, 18 nt, Mycobacterium bovis subsp bovis AF2122/97
cacugccggacagccacg

SEQ ID NO: 1070834 - RNA, 13 nt, Mycobacterium bovis subsp bovis AF2122/97
cacugccggcacg

SEQ ID NO: 1070835 - RNA, 15 nt, Mycobacterium bovis subsp bovis AF2122/97
cacugccggcacgcc

SEQ ID NO: 1070836 - RNA, 17 nt, Mycobacterium bovis subsp bovis AF2122/97
cacugccggcacgccga

SEQ ID NO: 1070837 - RNA, 21 nt, Mycobacterium bovis subsp bovis AF2122/97
cacugccggcacgccgaccgg

SEQ ID NO: 1070838 - RNA, 16 nt, Mycobacterium bovis subsp bovis AF2122/97
cacuggggucugaugg

SEQ ID NO: 1070839 - RNA, 20 nt, Mycobacterium bovis subsp bovis AF2122/97
cacugggcuggccagcacgc

SEQ ID NO: 1070840 - RNA, 18 nt, Mycobacterium bovis subsp bovis AF2122/97
cacuggggaggccaaccc

SEQ ID NO: 1070841 - RNA, 19 nt, Mycobacterium bovis subsp bovis AF2122/97
cacuggcgauaucggcccc

SEQ ID NO: 1070842 - RNA, 19 nt, Mycobacterium bovis subsp bovis AF2122/97
cacuggcgccggugccgcc

SEQ ID NO: 1070843 - RNA, 20 nt, Mycobacterium bovis subsp bovis AF2122/97
cacuggcgccggugccgccg

SEQ ID NO: 1070844 - RNA, 15 nt, Mycobacterium bovis subsp bovis AF2122/97
cacuggcgcugaucg

SEQ ID NO: 1070845 - RNA, 15 nt, Mycobacterium bovis subsp bovis AF2122/97
cacuggcggaccggu

SEQ ID NO: 1070846 - RNA, 19 nt, Mycobacterium bovis subsp bovis AF2122/97
cacuggcgguguaacccgg

SEQ ID NO: 1070847 - RNA, 21 nt, Mycobacterium bovis subsp bovis AF2122/97
cacuggcgucuuggggcguug

SEQ ID NO: 1070848 - RNA, 13 nt, Mycobacterium bovis subsp bovis AF2122/97
cacuggccgucgg

SEQ ID NO: 1070849 - RNA, 14 nt, Mycobacterium bovis subsp bovis AF2122/97
cacuggccgucggc

SEQ ID NO: 1070850 - RNA, 17 nt, Mycobacterium bovis subsp bovis AF2122/97
cacugcgaucgcgaccc

SEQ ID NO: 1070851 - RNA, 18 nt, Mycobacterium bovis subsp bovis AF2122/97
cacugcgaucgcgacccg

SEQ ID NO: 1070852 - RNA, 12 nt, Mycobacterium bovis subsp bovis AF2122/97
cacugccgggug

SEQ ID NO: 1070853 - RNA, 18 nt, Mycobacterium bovis subsp bovis AF2122/97
cacugcgaaucuccgcgc

SEQ ID NO: 1070854 - RNA, 10 nt, Mycobacterium bovis subsp bovis AF2122/97
cacugcgagc

SEQ ID NO: 1070855 - RNA, 14 nt, Mycobacterium bovis subsp bovis AF2122/97
cacucgucgucggu

SEQ ID NO: 1070856 - RNA, 23 nt, Mycobacterium bovis subsp bovis AF2122/97
cacucggucguugccgcggucgg

SEQ ID NO: 1070857 - RNA, 22 nt, Mycobacterium bovis subsp bovis AF2122/97
cacucuggcgagggcuaccggc

SEQ ID NO: 1070858 - RNA, 16 nt, Mycobacterium bovis subsp bovis AF2122/97
cacucguugaccggcc

SEQ ID NO: 1070859 - RNA, 18 nt, Mycobacterium bovis subsp bovis AF2122/97
cacucguugaccggccgg

SEQ ID NO: 1070860 - RNA, 14 nt, Mycobacterium bovis subsp bovis AF2122/97
cacucuagccgggu

SEQ ID NO: 1070861 - RNA, 20 nt, Mycobacterium bovis subsp bovis AF2122/97
cacugcccgccgacgccaga

SEQ ID NO: 1070862 - RNA, 22 nt, Mycobacterium bovis subsp bovis AF2122/97
cacugcccgggguccaucgggg

SEQ ID NO: 1070863 - RNA, 16 nt, Mycobacterium bovis subsp bovis AF2122/97
cacugaccccgccgcc

SEQ ID NO: 1070864 - RNA, 16 nt, Mycobacterium bovis subsp bovis AF2122/97
cacugaacaggccggu

SEQ ID NO: 1070865 - RNA, 13 nt, Mycobacterium bovis subsp bovis AF2122/97
cacucgccggcgg

SEQ ID NO: 1070866 - RNA, 17 nt, Mycobacterium bovis subsp bovis AF2122/97
cacucgcccgauccgga

SEQ ID NO: 1070867 - RNA, 16 nt, Mycobacterium bovis subsp bovis AF2122/97
cacucgccacucagcc

SEQ ID NO: 1070868 - RNA, 12 nt, Mycobacterium bovis subsp bovis AF2122/97
cacucggaaucg

SEQ ID NO: 1070869 - RNA, 16 nt, Mycobacterium bovis subsp bovis AF2122/97
cacucgccagggccau

SEQ ID NO: 1070870 - RNA, 15 nt, Mycobacterium bovis subsp bovis AF2122/97
cacucggcccggcag

SEQ ID NO: 1070871 - RNA, 21 nt, Mycobacterium bovis subsp bovis AF2122/97
cacucgacgucgucgucgacg

SEQ ID NO: 1070872 - RNA, 23 nt, Mycobacterium bovis subsp bovis AF2122/97
cacucgaugcuuucguauucggc

SEQ ID NO: 1070873 - RNA, 13 nt, Mycobacterium bovis subsp bovis AF2122/97
cacucgacgucgu

SEQ ID NO: 1070874 - RNA, 16 nt, Mycobacterium bovis subsp bovis AF2122/97
cacuagcccgaccggu

SEQ ID NO: 1070875 - RNA, 16 nt, Mycobacterium bovis subsp bovis AF2122/97
cacuagcgagccggcg

SEQ ID NO: 1070876 - RNA, 24 nt, Mycobacterium bovis subsp bovis AF2122/97
cacuacgggucuggccaacgccgg

SEQ ID NO: 1070877 - RNA, 18 nt, Mycobacterium bovis subsp bovis AF2122/97
cacuagcuucgcuugccg

SEQ ID NO: 1070878 - RNA, 22 nt, Mycobacterium bovis subsp bovis AF2122/97
cacucgaccaggaccggcugca

SEQ ID NO: 1070879 - RNA, 16 nt, Mycobacterium bovis subsp bovis AF2122/97
cacuacggccuggcca

SEQ ID NO: 1070880 - RNA, 22 nt, Mycobacterium bovis subsp bovis AF2122/97
cacuacggccuggccaccuggu

SEQ ID NO: 1070881 - RNA, 18 nt, Mycobacterium bovis subsp bovis AF2122/97
cacuaccgccgcgaccgc

SEQ ID NO: 1070882 - RNA, 22 nt, Mycobacterium bovis subsp bovis AF2122/97
cacguugacggcgaacccgccg

SEQ ID NO: 1070883 - RNA, 12 nt, Mycobacterium bovis subsp bovis AF2122/97
cacguucggcgu

SEQ ID NO: 1070884 - RNA, 19 nt, Mycobacterium bovis subsp bovis AF2122/97
cacguucggcgcacagcga

SEQ ID NO: 1070885 - RNA, 13 nt, Mycobacterium bovis subsp bovis AF2122/97
cacguucggcgcu

SEQ ID NO: 1070886 - RNA, 15 nt, Mycobacterium bovis subsp bovis AF2122/97
cacguucggcgucgu

SEQ ID NO: 1070887 - RNA, 19 nt, Mycobacterium bovis subsp bovis AF2122/97
cacguucgguggagggcga

SEQ ID NO: 1070888 - RNA, 22 nt, Mycobacterium bovis subsp bovis AF2122/97
cacguucggcgacgcgccgguu

SEQ ID NO: 1070889 - RNA, 20 nt, Mycobacterium bovis subsp bovis AF2122/97
cacguucaguuccgcggcga

SEQ ID NO: 1070890 - RNA, 12 nt, Mycobacterium bovis subsp bovis AF2122/97
cacguucaccgc

SEQ ID NO: 1070891 - RNA, 17 nt, Mycobacterium bovis subsp bovis AF2122/97
cacguucagcccaugcc

SEQ ID NO: 1070892 - RNA, 20 nt, Mycobacterium bovis subsp bovis AF2122/97
cagacgccguagccggccgg

SEQ ID NO: 1070893 - RNA, 18 nt, Mycobacterium bovis subsp bovis AF2122/97
cagacgcguuucgucgac

SEQ ID NO: 1070894 - RNA, 19 nt, Mycobacterium bovis subsp bovis AF2122/97
cagacgcuaaagcccccgc

SEQ ID NO: 1070895 - RNA, 19 nt, Mycobacterium bovis subsp bovis AF2122/97
cagacgcgaaagcacccca

SEQ ID NO: 1070896 - RNA, 13 nt, Mycobacterium bovis subsp bovis AF2122/97
cagacgaccaggg

SEQ ID NO: 1070897 - RNA, 17 nt, Mycobacterium bovis subsp bovis AF2122/97
cagacgaccagggcggu

SEQ ID NO: 1070898 - RNA, 15 nt, Mycobacterium bovis subsp bovis AF2122/97
cagaccggcgccgua

SEQ ID NO: 1070899 - RNA, 12 nt, Mycobacterium bovis subsp bovis AF2122/97
cagaccgggccc

SEQ ID NO: 1070900 - RNA, 16 nt, Mycobacterium bovis subsp bovis AF2122/97
cagaccggcucgucgg

SEQ ID NO: 1070901 - RNA, 22 nt, Mycobacterium bovis subsp bovis AF2122/97
cagaccgguuucuucggccagc

SEQ ID NO: 1070902 - RNA, 17 nt, Mycobacterium bovis subsp bovis AF2122/97
cagaccguagcggccgg

SEQ ID NO: 1070903 - RNA, 14 nt, Mycobacterium bovis subsp bovis AF2122/97
cagaccguccagca

SEQ ID NO: 1070904 - RNA, 19 nt, Mycobacterium bovis subsp bovis AF2122/97
cagaccggugcugucgacg

SEQ ID NO: 1070905 - RNA, 19 nt, Mycobacterium bovis subsp bovis AF2122/97
cagaccuagcaccgcgccg

SEQ ID NO: 1070906 - RNA, 20 nt, Mycobacterium bovis subsp bovis AF2122/97
cagaccuagcaccgcgccga

SEQ ID NO: 1070907 - RNA, 21 nt, Mycobacterium bovis subsp bovis AF2122/97
cagaccuagcaccgcgccgaa

SEQ ID NO: 1070908 - RNA, 17 nt, Mycobacterium bovis subsp bovis AF2122/97
cagaccgcggcggccga

SEQ ID NO: 1070909 - RNA, 21 nt, Mycobacterium bovis subsp bovis AF2122/97
cagaccggaaacagcauggcg

SEQ ID NO: 1070910 - RNA, 12 nt, Mycobacterium bovis subsp bovis AF2122/97
cagaccggcauc

SEQ ID NO: 1070911 - RNA, 14 nt, Mycobacterium bovis subsp bovis AF2122/97
cagaccggccgacg

SEQ ID NO: 1070912 - RNA, 15 nt, Mycobacterium bovis subsp bovis AF2122/97
cagaccggccgacgu

SEQ ID NO: 1070913 - RNA, 21 nt, Mycobacterium bovis subsp bovis AF2122/97
cagacccguugcccaacccgg

SEQ ID NO: 1070914 - RNA, 12 nt, Mycobacterium bovis subsp bovis AF2122/97
cagaccgccgac

SEQ ID NO: 1070915 - RNA, 14 nt, Mycobacterium bovis subsp bovis AF2122/97
cagaccgccgacgc

SEQ ID NO: 1070916 - RNA, 17 nt, Mycobacterium bovis subsp bovis AF2122/97
cagaccgccgacgccgu

SEQ ID NO: 1070917 - RNA, 23 nt, Mycobacterium bovis subsp bovis AF2122/97
cagaccgccacacggggccgcca

SEQ ID NO: 1070918 - RNA, 18 nt, Mycobacterium bovis subsp bovis AF2122/97
cagaccgaucggcaggcc

SEQ ID NO: 1070919 - RNA, 14 nt, Mycobacterium bovis subsp bovis AF2122/97
cagaccgcaccauu

SEQ ID NO: 1070920 - RNA, 24 nt, Mycobacterium bovis subsp bovis AF2122/97
cagacgcugcccaaaagcgcggca

SEQ ID NO: 1070921 - RNA, 16 nt, Mycobacterium bovis subsp bovis AF2122/97
cagacggggucgcccg

SEQ ID NO: 1070922 - RNA, 18 nt, Mycobacterium bovis subsp bovis AF2122/97
cagacggggucgcccggg

SEQ ID NO: 1070923 - RNA, 23 nt, Mycobacterium bovis subsp bovis AF2122/97
cagacggggucgcccggggcgca

SEQ ID NO: 1070924 - RNA, 16 nt, Mycobacterium bovis subsp bovis AF2122/97
cagacgguccgcuacg

SEQ ID NO: 1070925 - RNA, 23 nt, Mycobacterium bovis subsp bovis AF2122/97
cagacggugaagccgagcgcccg

SEQ ID NO: 1070926 - RNA, 16 nt, Mycobacterium bovis subsp bovis AF2122/97
cagagacaugccggcg

SEQ ID NO: 1070927 - RNA, 13 nt, Mycobacterium bovis subsp bovis AF2122/97
cagagccgccguu

SEQ ID NO: 1070928 - RNA, 19 nt, Mycobacterium bovis subsp bovis AF2122/97
cagagccgccguugccgcc

SEQ ID NO: 1070929 - RNA, 15 nt, Mycobacterium bovis subsp bovis AF2122/97
cagagccgcgcgccg

SEQ ID NO: 1070930 - RNA, 17 nt, Mycobacterium bovis subsp bovis AF2122/97
cagagccgcgcgccggu

SEQ ID NO: 1070931 - RNA, 18 nt, Mycobacterium bovis subsp bovis AF2122/97
cagagccgcgcgccgguu

SEQ ID NO: 1070932 - RNA, 13 nt, Mycobacterium bovis subsp bovis AF2122/97
cagagccgcugcg

SEQ ID NO: 1070933 - RNA, 18 nt, Mycobacterium bovis subsp bovis AF2122/97
cagagccgcugcggcacc

SEQ ID NO: 1070934 - RNA, 20 nt, Mycobacterium bovis subsp bovis AF2122/97
cagagccgcugcggcaccga

SEQ ID NO: 1070935 - RNA, 14 nt, Mycobacterium bovis subsp bovis AF2122/97
cagagccccggcaa

SEQ ID NO: 1070936 - RNA, 12 nt, Mycobacterium bovis subsp bovis AF2122/97
cagagcaccgcg

SEQ ID NO: 1070937 - RNA, 17 nt, Mycobacterium bovis subsp bovis AF2122/97
cagagcaccgcgaacag

SEQ ID NO: 1070938 - RNA, 16 nt, Mycobacterium bovis subsp bovis AF2122/97
cagagcacgcgcggcg

SEQ ID NO: 1070939 - RNA, 19 nt, Mycobacterium bovis subsp bovis AF2122/97
cagacccagcucgucgacg

SEQ ID NO: 1070940 - RNA, 17 nt, Mycobacterium bovis subsp bovis AF2122/97
cagacccgagcgcucga

SEQ ID NO: 1070941 - RNA, 22 nt, Mycobacterium bovis subsp bovis AF2122/97
cagacccgugccgucaacgaug

SEQ ID NO: 1070942 - RNA, 12 nt, Mycobacterium bovis subsp bovis AF2122/97
cagaccgacccg

SEQ ID NO: 1070943 - RNA, 14 nt, Mycobacterium bovis subsp bovis AF2122/97
cagaccgaccucgg

SEQ ID NO: 1070944 - RNA, 13 nt, Mycobacterium bovis subsp bovis AF2122/97
cagaccgaucggc

SEQ ID NO: 1070945 - RNA, 15 nt, Mycobacterium bovis subsp bovis AF2122/97
cagaccgaucggcag

SEQ ID NO: 1070946 - RNA, 14 nt, Mycobacterium bovis subsp bovis AF2122/97
cagacccagcucgu

SEQ ID NO: 1070947 - RNA, 19 nt, Mycobacterium bovis subsp bovis AF2122/97
cagaccagggcagcggcca

SEQ ID NO: 1070948 - RNA, 22 nt, Mycobacterium bovis subsp bovis AF2122/97
cagaccaagcccgucgucgugc

SEQ ID NO: 1070949 - RNA, 18 nt, Mycobacterium bovis subsp bovis AF2122/97
cagaaucaggcucgccga

SEQ ID NO: 1070950 - RNA, 14 nt, Mycobacterium bovis subsp bovis AF2122/97
cagaaggccagcga

SEQ ID NO: 1070951 - RNA, 15 nt, Mycobacterium bovis subsp bovis AF2122/97
cagaaggaucagcgc

SEQ ID NO: 1070952 - RNA, 20 nt, Mycobacterium bovis subsp bovis AF2122/97
cagaaggaucagcgcacugg

SEQ ID NO: 1070953 - RNA, 16 nt, Mycobacterium bovis subsp bovis AF2122/97
cagaaguaggcgaccg

SEQ ID NO: 1070954 - RNA, 15 nt, Mycobacterium bovis subsp bovis AF2122/97
cagaaggccgcggug

SEQ ID NO: 1070955 - RNA, 20 nt, Mycobacterium bovis subsp bovis AF2122/97
cagaaguugauggucaaugc

SEQ ID NO: 1070956 - RNA, 18 nt, Mycobacterium bovis subsp bovis AF2122/97
cacuggugcagcgccgac

SEQ ID NO: 1070957 - RNA, 19 nt, Mycobacterium bovis subsp bovis AF2122/97
cacuggugcagcgccgaca

SEQ ID NO: 1070958 - RNA, 20 nt, Mycobacterium bovis subsp bovis AF2122/97
cacuggugcagcgccgacag

SEQ ID NO: 1070959 - RNA, 18 nt, Mycobacterium bovis subsp bovis AF2122/97
cacugggugcgucgaccc

SEQ ID NO: 1070960 - RNA, 16 nt, Mycobacterium bovis subsp bovis AF2122/97
cacuggucgcggcgcu

SEQ ID NO: 1070961 - RNA, 19 nt, Mycobacterium bovis subsp bovis AF2122/97
cacuggucgcggcgcuggc

SEQ ID NO: 1070962 - RNA, 17 nt, Mycobacterium bovis subsp bovis AF2122/97
cacugguggcgauccgu

SEQ ID NO: 1070963 - RNA, 16 nt, Mycobacterium bovis subsp bovis AF2122/97
cacuguuggugccgcc

SEQ ID NO: 1070964 - RNA, 16 nt, Mycobacterium bovis subsp bovis AF2122/97
cacuguuacggccaca

SEQ ID NO: 1070965 - RNA, 18 nt, Mycobacterium bovis subsp bovis AF2122/97
cacuguugcccaauucga

SEQ ID NO: 1070966 - RNA, 19 nt, Mycobacterium bovis subsp bovis AF2122/97
cacugucgauuugaucgac

SEQ ID NO: 1070967 - RNA, 13 nt, Mycobacterium bovis subsp bovis AF2122/97
cacugugcucgcc

SEQ ID NO: 1070968 - RNA, 19 nt, Mycobacterium bovis subsp bovis AF2122/97
cacuuagcccgauggugcc

SEQ ID NO: 1070969 - RNA, 18 nt, Mycobacterium bovis subsp bovis AF2122/97
cacuuuucgguggcggca

SEQ ID NO: 1070970 - RNA, 21 nt, Mycobacterium bovis subsp bovis AF2122/97
cagaaacgcgaugguggccgc

SEQ ID NO: 1070971 - RNA, 19 nt, Mycobacterium bovis subsp bovis AF2122/97
cagaaacaccgacgacggc

SEQ ID NO: 1070972 - RNA, 14 nt, Mycobacterium bovis subsp bovis AF2122/97
cagaaaccggguag

SEQ ID NO: 1070973 - RNA, 15 nt, Mycobacterium bovis subsp bovis AF2122/97
cacgcugcaggcggc

SEQ ID NO: 1070974 - RNA, 17 nt, Mycobacterium bovis subsp bovis AF2122/97
cacgcugcaggcggccg

SEQ ID NO: 1070975 - RNA, 22 nt, Mycobacterium bovis subsp bovis AF2122/97
cacgcugcccaaaaggaagacc

SEQ ID NO: 1070976 - RNA, 20 nt, Mycobacterium bovis subsp bovis AF2122/97
cacgcugaguccccaggugg

SEQ ID NO: 1070977 - RNA, 15 nt, Mycobacterium bovis subsp bovis AF2122/97
cacgcugccccgccg

SEQ ID NO: 1070978 - RNA, 21 nt, Mycobacterium bovis subsp bovis AF2122/97
cacgcugcccacgggccggcc

SEQ ID NO: 1070979 - RNA, 13 nt, Mycobacterium bovis subsp bovis AF2122/97
cacgcuggcguug

SEQ ID NO: 1070980 - RNA, 21 nt, Mycobacterium bovis subsp bovis AF2122/97
cacgcuggaacuuggcgucga

SEQ ID NO: 1070981 - RNA, 13 nt, Mycobacterium bovis subsp bovis AF2122/97
cacgcuggccucg

SEQ ID NO: 1070982 - RNA, 14 nt, Mycobacterium bovis subsp bovis AF2122/97
cacgcuggccucgu

SEQ ID NO: 1070983 - RNA, 14 nt, Mycobacterium bovis subsp bovis AF2122/97
cacgcugcucgacg

SEQ ID NO: 1070984 - RNA, 13 nt, Mycobacterium bovis subsp bovis AF2122/97
cacgcugcugcgg

SEQ ID NO: 1070985 - RNA, 18 nt, Mycobacterium bovis subsp bovis AF2122/97
cacgcugcugcgggugau

SEQ ID NO: 1070986 - RNA, 18 nt, Mycobacterium bovis subsp bovis AF2122/97
cacgcuggaacuuggcgu

SEQ ID NO: 1070987 - RNA, 19 nt, Mycobacterium bovis subsp bovis AF2122/97
cacgcuggaacuuggcguc

SEQ ID NO: 1070988 - RNA, 23 nt, Mycobacterium bovis subsp bovis AF2122/97
cacgcugugcgguaucggucagc

SEQ ID NO: 1070989 - RNA, 16 nt, Mycobacterium bovis subsp bovis AF2122/97
cacgcugugcucgacg

SEQ ID NO: 1070990 - RNA, 15 nt, Mycobacterium bovis subsp bovis AF2122/97
cacgcuuaacagcgg

SEQ ID NO: 1070991 - RNA, 22 nt, Mycobacterium bovis subsp bovis AF2122/97
cacgcugucccgcgggccagca

SEQ ID NO: 1070992 - RNA, 16 nt, Mycobacterium bovis subsp bovis AF2122/97
cacgcuguccgcguga

SEQ ID NO: 1070993 - RNA, 15 nt, Mycobacterium bovis subsp bovis AF2122/97
cacggaaggcccggc

SEQ ID NO: 1070994 - RNA, 17 nt, Mycobacterium bovis subsp bovis AF2122/97
cacggaaggcccggcgc

SEQ ID NO: 1070995 - RNA, 16 nt, Mycobacterium bovis subsp bovis AF2122/97
cacggaaguaucgccg

SEQ ID NO: 1070996 - RNA, 18 nt, Mycobacterium bovis subsp bovis AF2122/97
cacggaccagcgccggac

SEQ ID NO: 1070997 - RNA, 12 nt, Mycobacterium bovis subsp bovis AF2122/97
cacggaccgcca

SEQ ID NO: 1070998 - RNA, 15 nt, Mycobacterium bovis subsp bovis AF2122/97
cacggaccgccaccu

SEQ ID NO: 1070999 - RNA, 15 nt, Mycobacterium bovis subsp bovis AF2122/97
cacggaccgcgucgc

SEQ ID NO: 1071000 - RNA, 17 nt, Mycobacterium bovis subsp bovis AF2122/97
cacggaccgcgucgcgg

SEQ ID NO: 1071001 - RNA, 15 nt, Mycobacterium bovis subsp bovis AF2122/97
cacggagaccggccg

SEQ ID NO: 1071002 - RNA, 18 nt, Mycobacterium bovis subsp bovis AF2122/97
cacggaggguugccgccg

SEQ ID NO: 1071003 - RNA, 20 nt, Mycobacterium bovis subsp bovis AF2122/97
cacggagguccgguggacga

SEQ ID NO: 1071004 - RNA, 16 nt, Mycobacterium bovis subsp bovis AF2122/97
cacggaucgcggcggc

SEQ ID NO: 1071005 - RNA, 19 nt, Mycobacterium bovis subsp bovis AF2122/97
cacggcaaaggcgcucugc

SEQ ID NO: 1071006 - RNA, 18 nt, Mycobacterium bovis subsp bovis AF2122/97
cacggcaaccagcgagcc

SEQ ID NO: 1071007 - RNA, 23 nt, Mycobacterium bovis subsp bovis AF2122/97
cacggcaagccaaccagcccggc

SEQ ID NO: 1071008 - RNA, 15 nt, Mycobacterium bovis subsp bovis AF2122/97
cacggaugcgauggc

SEQ ID NO: 1071009 - RNA, 19 nt, Mycobacterium bovis subsp bovis AF2122/97
cacggaugcgauggccgac

SEQ ID NO: 1071010 - RNA, 20 nt, Mycobacterium bovis subsp bovis AF2122/97
cacggaugcgauggccgacg

SEQ ID NO: 1071011 - RNA, 21 nt, Mycobacterium bovis subsp bovis AF2122/97
cacggaugcgauggccgacgc

SEQ ID NO: 1071012 - RNA, 24 nt, Mycobacterium bovis subsp bovis AF2122/97
cacggaugucgcccaaccgaaccg

SEQ ID NO: 1071013 - RNA, 13 nt, Mycobacterium bovis subsp bovis AF2122/97
cacggauucgggc

SEQ ID NO: 1071014 - RNA, 15 nt, Mycobacterium bovis subsp bovis AF2122/97
cacggcacccaaucc

SEQ ID NO: 1071015 - RNA, 17 nt, Mycobacterium bovis subsp bovis AF2122/97
cacggcaagcgugaccc

SEQ ID NO: 1071016 - RNA, 15 nt, Mycobacterium bovis subsp bovis AF2122/97
cacggcacaaucggc

SEQ ID NO: 1071017 - RNA, 13 nt, Mycobacterium bovis subsp bovis AF2122/97
cacggcaccacca

SEQ ID NO: 1071018 - RNA, 13 nt, Mycobacterium bovis subsp bovis AF2122/97
cacggcagcgccc

SEQ ID NO: 1071019 - RNA, 20 nt, Mycobacterium bovis subsp bovis AF2122/97
cacggcagcgcccagaucgc

SEQ ID NO: 1071020 - RNA, 18 nt, Mycobacterium bovis subsp bovis AF2122/97
cacggcagcgccggucgg

SEQ ID NO: 1071021 - RNA, 22 nt, Mycobacterium bovis subsp bovis AF2122/97
cacggcagcgccggucggaucg

SEQ ID NO: 1071022 - RNA, 17 nt, Mycobacterium bovis subsp bovis AF2122/97
cacggcaggcagggcag

SEQ ID NO: 1071023 - RNA, 23 nt, Mycobacterium bovis subsp bovis AF2122/97
cacggcaggcagggcagcccggc

SEQ ID NO: 1071024 - RNA, 19 nt, Mycobacterium bovis subsp bovis AF2122/97
cacggccagaaacccggcg

SEQ ID NO: 1071025 - RNA, 16 nt, Mycobacterium bovis subsp bovis AF2122/97
cacggccccugccacg

SEQ ID NO: 1071026 - RNA, 20 nt, Mycobacterium bovis subsp bovis AF2122/97
cacggccccugccacgacga

SEQ ID NO: 1071027 - RNA, 23 nt, Mycobacterium bovis subsp bovis AF2122/97
cacggccccugccacgacgaaca

SEQ ID NO: 1071028 - RNA, 12 nt, Mycobacterium bovis subsp bovis AF2122/97
cacggccagcgg

SEQ ID NO: 1071029 - RNA, 15 nt, Mycobacterium bovis subsp bovis AF2122/97
cacggccaggucgac

SEQ ID NO: 1071030 - RNA, 15 nt, Mycobacterium bovis subsp bovis AF2122/97
cacggccaugaucac

SEQ ID NO: 1071031 - RNA, 23 nt, Mycobacterium bovis subsp bovis AF2122/97
cacggccauauugggaguccggc

SEQ ID NO: 1071032 - RNA, 17 nt, Mycobacterium bovis subsp bovis AF2122/97
cacggccaggucgacgg

SEQ ID NO: 1071033 - RNA, 23 nt, Mycobacterium bovis subsp bovis AF2122/97
cacgcuagccgacagcucaucga

SEQ ID NO: 1071034 - RNA, 14 nt, Mycobacterium bovis subsp bovis AF2122/97
cacgcucacgggcu

SEQ ID NO: 1071035 - RNA, 14 nt, Mycobacterium bovis subsp bovis AF2122/97
cacgcucacccggc

SEQ ID NO: 1071036 - RNA, 15 nt, Mycobacterium bovis subsp bovis AF2122/97
cacgcucacccggcg

SEQ ID NO: 1071037 - RNA, 18 nt, Mycobacterium bovis subsp bovis AF2122/97
cacgcucaugaccgcucg

SEQ ID NO: 1071038 - RNA, 21 nt, Mycobacterium bovis subsp bovis AF2122/97
cacgcucggcguccgcccagc

SEQ ID NO: 1071039 - RNA, 15 nt, Mycobacterium bovis subsp bovis AF2122/97
cacgcucggcgccgu

SEQ ID NO: 1071040 - RNA, 13 nt, Mycobacterium bovis subsp bovis AF2122/97
cacgcucggcgcc

SEQ ID NO: 1071041 - RNA, 15 nt, Mycobacterium bovis subsp bovis AF2122/97
cacgcuccagcucgg

SEQ ID NO: 1071042 - RNA, 23 nt, Mycobacterium bovis subsp bovis AF2122/97
cacgcuccgccggguuggcgccg

SEQ ID NO: 1071043 - RNA, 13 nt, Mycobacterium bovis subsp bovis AF2122/97
cacgcggcggucg

SEQ ID NO: 1071044 - RNA, 16 nt, Mycobacterium bovis subsp bovis AF2122/97
cacgcggcggucguug

SEQ ID NO: 1071045 - RNA, 20 nt, Mycobacterium bovis subsp bovis AF2122/97
cacgcgggcacugguggcga

SEQ ID NO: 1071046 - RNA, 17 nt, Mycobacterium bovis subsp bovis AF2122/97
cacgcggguugcgcggc

SEQ ID NO: 1071047 - RNA, 17 nt, Mycobacterium bovis subsp bovis AF2122/97
cacgcguugacgaucuc

SEQ ID NO: 1071048 - RNA, 23 nt, Mycobacterium bovis subsp bovis AF2122/97
cacgcgucuucggucgcggccuc

SEQ ID NO: 1071049 - RNA, 23 nt, Mycobacterium bovis subsp bovis AF2122/97
cacgcgugcaccauacucaccga

SEQ ID NO: 1071050 - RNA, 20 nt, Mycobacterium bovis subsp bovis AF2122/97
cacgcgugccgcaaccggcg

SEQ ID NO: 1071051 - RNA, 18 nt, Mycobacterium bovis subsp bovis AF2122/97
cacgcgugcuuagcgcga

SEQ ID NO: 1071052 - RNA, 17 nt, Mycobacterium bovis subsp bovis AF2122/97
cacgcgucgugccacuu

SEQ ID NO: 1071053 - RNA, 23 nt, Mycobacterium bovis subsp bovis AF2122/97
cacgcgucuggaacgugaugcgg

SEQ ID NO: 1071054 - RNA, 19 nt, Mycobacterium bovis subsp bovis AF2122/97
cacgcgucuucggucgcgg

SEQ ID NO: 1071055 - RNA, 14 nt, Mycobacterium bovis subsp bovis AF2122/97
cacgcguacgucgg

SEQ ID NO: 1071056 - RNA, 15 nt, Mycobacterium bovis subsp bovis AF2122/97
cacgcgcgcaggccg

SEQ ID NO: 1071057 - RNA, 16 nt, Mycobacterium bovis subsp bovis AF2122/97
cacgcgcgcaggccgc

SEQ ID NO: 1071058 - RNA, 17 nt, Mycobacterium bovis subsp bovis AF2122/97
cacgcgcgcaggccgcc

SEQ ID NO: 1071059 - RNA, 19 nt, Mycobacterium bovis subsp bovis AF2122/97
cacgcgcgcaggccgccgc

SEQ ID NO: 1071060 - RNA, 13 nt, Mycobacterium bovis subsp bovis AF2122/97
cacgcgcggaucg

SEQ ID NO: 1071061 - RNA, 14 nt, Mycobacterium bovis subsp bovis AF2122/97
cacgcgcgcgaccu

SEQ ID NO: 1071062 - RNA, 14 nt, Mycobacterium bovis subsp bovis AF2122/97
caccucaccgcgga

SEQ ID NO: 1071063 - RNA, 17 nt, Mycobacterium bovis subsp bovis AF2122/97
caccuccagcaccaccg

SEQ ID NO: 1071064 - RNA, 16 nt, Mycobacterium bovis subsp bovis AF2122/97
caccucccacgccgcc

SEQ ID NO: 1071065 - RNA, 17 nt, Mycobacterium bovis subsp bovis AF2122/97
caccucccacgccgccg

SEQ ID NO: 1071066 - RNA, 20 nt, Mycobacterium bovis subsp bovis AF2122/97
caccucccagggcucggcgg

SEQ ID NO: 1071067 - RNA, 17 nt, Mycobacterium bovis subsp bovis AF2122/97
cacgcgcccgcaccacc

SEQ ID NO: 1071068 - RNA, 18 nt, Mycobacterium bovis subsp bovis AF2122/97
cacgcgcccgcaccaccg

SEQ ID NO: 1071069 - RNA, 12 nt, Mycobacterium bovis subsp bovis AF2122/97
cacgcgcgucgg

SEQ ID NO: 1071070 - RNA, 13 nt, Mycobacterium bovis subsp bovis AF2122/97
cacgcgcgucggu

SEQ ID NO: 1071071 - RNA, 17 nt, Mycobacterium bovis subsp bovis AF2122/97
cacgcgcucaccgacgc

SEQ ID NO: 1071072 - RNA, 15 nt, Mycobacterium bovis subsp bovis AF2122/97
cacgcgcggaucggc

SEQ ID NO: 1071073 - RNA, 19 nt, Mycobacterium bovis subsp bovis AF2122/97
cacgcgcucaccgacgcug

SEQ ID NO: 1071074 - RNA, 22 nt, Mycobacterium bovis subsp bovis AF2122/97
cacgcggaaaccaucgccagcc

SEQ ID NO: 1071075 - RNA, 17 nt, Mycobacterium bovis subsp bovis AF2122/97
cacgcgcucgcgcaagc

SEQ ID NO: 1071076 - RNA, 18 nt, Mycobacterium bovis subsp bovis AF2122/97
cacgcggaccucgaagcc

SEQ ID NO: 1071077 - RNA, 21 nt, Mycobacterium bovis subsp bovis AF2122/97
caccguuguaugcugcgcgcc

SEQ ID NO: 1071078 - RNA, 22 nt, Mycobacterium bovis subsp bovis AF2122/97
caccguuguaugcugcgcgccg

SEQ ID NO: 1071079 - RNA, 15 nt, Mycobacterium bovis subsp bovis AF2122/97
caccguugcguuggc

SEQ ID NO: 1071080 - RNA, 21 nt, Mycobacterium bovis subsp bovis AF2122/97
caccguugcguuggcgccacc

SEQ ID NO: 1071081 - RNA, 16 nt, Mycobacterium bovis subsp bovis AF2122/97
caccguuggccgcgcu

SEQ ID NO: 1071082 - RNA, 15 nt, Mycobacterium bovis subsp bovis AF2122/97
caccguugccgaacc

SEQ ID NO: 1071083 - RNA, 19 nt, Mycobacterium bovis subsp bovis AF2122/97
caccgugccgggcgacggu

SEQ ID NO: 1071084 - RNA, 18 nt, Mycobacterium bovis subsp bovis AF2122/97
caccguuaccgccgucgc

SEQ ID NO: 1071085 - RNA, 15 nt, Mycobacterium bovis subsp bovis AF2122/97
caccuccagcaccac

SEQ ID NO: 1071086 - RNA, 19 nt, Mycobacterium bovis subsp bovis AF2122/97
caccuaugggaccggcaau

SEQ ID NO: 1071087 - RNA, 20 nt, Mycobacterium bovis subsp bovis AF2122/97
caccuacgaagcguugaccg

SEQ ID NO: 1071088 - RNA, 16 nt, Mycobacterium bovis subsp bovis AF2122/97
caccguuugcgcaccg

SEQ ID NO: 1071089 - RNA, 19 nt, Mycobacterium bovis subsp bovis AF2122/97
caccguuugggcgccggug

SEQ ID NO: 1071090 - RNA, 11 nt, Mycobacterium bovis subsp bovis AF2122/97
cacggcgaaug

SEQ ID NO: 1071091 - RNA, 22 nt, Mycobacterium bovis subsp bovis AF2122/97
cacggcgaaugcauuggcggug

SEQ ID NO: 1071092 - RNA, 14 nt, Mycobacterium bovis subsp bovis AF2122/97
cacggccgucgacg

SEQ ID NO: 1071093 - RNA, 15 nt, Mycobacterium bovis subsp bovis AF2122/97
cacggccgucgacga

SEQ ID NO: 1071094 - RNA, 12 nt, Mycobacterium bovis subsp bovis AF2122/97
cacggccgucga

SEQ ID NO: 1071095 - RNA, 12 nt, Mycobacterium bovis subsp bovis AF2122/97
cacggccgccga

SEQ ID NO: 1071096 - RNA, 12 nt, Mycobacterium bovis subsp bovis AF2122/97
cacggccggguc

SEQ ID NO: 1071097 - RNA, 12 nt, Mycobacterium bovis subsp bovis AF2122/97
cacggccggccg

SEQ ID NO: 1071098 - RNA, 18 nt, Mycobacterium bovis subsp bovis AF2122/97
cacggccggccgcugcca

SEQ ID NO: 1071099 - RNA, 22 nt, Mycobacterium bovis subsp bovis AF2122/97
cacggccggauacggcgacacc

SEQ ID NO: 1071100 - RNA, 18 nt, Mycobacterium bovis subsp bovis AF2122/97
cacggccaugaucacacc

SEQ ID NO: 1071101 - RNA, 14 nt, Mycobacterium bovis subsp bovis AF2122/97
cacggcccgagccg

SEQ ID NO: 1071102 - RNA, 18 nt, Mycobacterium bovis subsp bovis AF2122/97
cacggcgacgaucucggc

SEQ ID NO: 1071103 - RNA, 22 nt, Mycobacterium bovis subsp bovis AF2122/97
cacggcgacgaucucggcggcc

SEQ ID NO: 1071104 - RNA, 18 nt, Mycobacterium bovis subsp bovis AF2122/97
cacggcgaccacgccgcc

SEQ ID NO: 1071105 - RNA, 23 nt, Mycobacterium bovis subsp bovis AF2122/97
cacggcgaaccggcccaccgacg

SEQ ID NO: 1071106 - RNA, 20 nt, Mycobacterium bovis subsp bovis AF2122/97
cacggcgacauacccgauca

SEQ ID NO: 1071107 - RNA, 15 nt, Mycobacterium bovis subsp bovis AF2122/97
cacggccuugccgau

SEQ ID NO: 1071108 - RNA, 13 nt, Mycobacterium bovis subsp bovis AF2122/97
cacggcgccgacc

SEQ ID NO: 1071109 - RNA, 15 nt, Mycobacterium bovis subsp bovis AF2122/97
cacggcgccgacccg

SEQ ID NO: 1071110 - RNA, 19 nt, Mycobacterium bovis subsp bovis AF2122/97
cacggcgaccacgccgccg

SEQ ID NO: 1071111 - RNA, 13 nt, Mycobacterium bovis subsp bovis AF2122/97
cacggcgauccgg

SEQ ID NO: 1071112 - RNA, 19 nt, Mycobacterium bovis subsp bovis AF2122/97
cacggcgauccggucggcc

SEQ ID NO: 1071113 - RNA, 18 nt, Mycobacterium bovis subsp bovis AF2122/97
cacggcgccuacaccggc

SEQ ID NO: 1071114 - RNA, 15 nt, Mycobacterium bovis subsp bovis AF2122/97
cacggcgccgccacg

SEQ ID NO: 1071115 - RNA, 22 nt, Mycobacterium bovis subsp bovis AF2122/97
cacggcgguugccccgaccgcc

SEQ ID NO: 1071116 - RNA, 23 nt, Mycobacterium bovis subsp bovis AF2122/97
cacggcgguugccccgaccgccg

SEQ ID NO: 1071117 - RNA, 14 nt, Mycobacterium bovis subsp bovis AF2122/97
cacggcgucggcca

SEQ ID NO: 1071118 - RNA, 17 nt, Mycobacterium bovis subsp bovis AF2122/97
cacggcgucggccaccc

SEQ ID NO: 1071119 - RNA, 22 nt, Mycobacterium bovis subsp bovis AF2122/97
cacggcgucggccacccggucc

SEQ ID NO: 1071120 - RNA, 23 nt, Mycobacterium bovis subsp bovis AF2122/97
cacggcgucggccacccggucca

SEQ ID NO: 1071121 - RNA, 20 nt, Mycobacterium bovis subsp bovis AF2122/97
cacggcgucggccaccgccu

SEQ ID NO: 1071122 - RNA, 17 nt, Mycobacterium bovis subsp bovis AF2122/97
cacggcgucuuccucgg

SEQ ID NO: 1071123 - RNA, 14 nt, Mycobacterium bovis subsp bovis AF2122/97
cacggcgucgaugu

SEQ ID NO: 1071124 - RNA, 22 nt, Mycobacterium bovis subsp bovis AF2122/97
cacggcgucuuccucggccacc

SEQ ID NO: 1071125 - RNA, 19 nt, Mycobacterium bovis subsp bovis AF2122/97
cacggcuucgaccaucacc

SEQ ID NO: 1071126 - RNA, 18 nt, Mycobacterium bovis subsp bovis AF2122/97
cacggcuucgcgguuggc

SEQ ID NO: 1071127 - RNA, 14 nt, Mycobacterium bovis subsp bovis AF2122/97
cacggcuucggcga

SEQ ID NO: 1071128 - RNA, 20 nt, Mycobacterium bovis subsp bovis AF2122/97
cacggcuuugcggcgcgacc

SEQ ID NO: 1071129 - RNA, 21 nt, Mycobacterium bovis subsp bovis AF2122/97
cacggcuuugcggcgcgacca

SEQ ID NO: 1071130 - RNA, 13 nt, Mycobacterium bovis subsp bovis AF2122/97
cacgggaagccgc

SEQ ID NO: 1071131 - RNA, 15 nt, Mycobacterium bovis subsp bovis AF2122/97
cacgggaagccgcgc

SEQ ID NO: 1071132 - RNA, 16 nt, Mycobacterium bovis subsp bovis AF2122/97
cacgggaaucgcucgc

SEQ ID NO: 1071133 - RNA, 15 nt, Mycobacterium bovis subsp bovis AF2122/97
cacggcguggucggc

SEQ ID NO: 1071134 - RNA, 21 nt, Mycobacterium bovis subsp bovis AF2122/97
cacggcugcccaugguggcga

SEQ ID NO: 1071135 - RNA, 13 nt, Mycobacterium bovis subsp bovis AF2122/97
cacggcgucgaug

SEQ ID NO: 1071136 - RNA, 14 nt, Mycobacterium bovis subsp bovis AF2122/97
cacggcgugucggg

SEQ ID NO: 1071137 - RNA, 17 nt, Mycobacterium bovis subsp bovis AF2122/97
cacggcucgccggcucg

SEQ ID NO: 1071138 - RNA, 22 nt, Mycobacterium bovis subsp bovis AF2122/97
cacggcgcguugggaccagugc

SEQ ID NO: 1071139 - RNA, 19 nt, Mycobacterium bovis subsp bovis AF2122/97
cacggcgcugcccacgccg

SEQ ID NO: 1071140 - RNA, 12 nt, Mycobacterium bovis subsp bovis AF2122/97
cacggcgcgcca

SEQ ID NO: 1071141 - RNA, 13 nt, Mycobacterium bovis subsp bovis AF2122/97
cacggcgcgagcc

SEQ ID NO: 1071142 - RNA, 14 nt, Mycobacterium bovis subsp bovis AF2122/97
cacggcgcggcgga

SEQ ID NO: 1071143 - RNA, 22 nt, Mycobacterium bovis subsp bovis AF2122/97
cacggcggccaccugcuggccg

SEQ ID NO: 1071144 - RNA, 13 nt, Mycobacterium bovis subsp bovis AF2122/97
cacggcggccagg

SEQ ID NO: 1071145 - RNA, 15 nt, Mycobacterium bovis subsp bovis AF2122/97
cacggcggccccggc

SEQ ID NO: 1071146 - RNA, 14 nt, Mycobacterium bovis subsp bovis AF2122/97
cacggcggcccgcu

SEQ ID NO: 1071147 - RNA, 15 nt, Mycobacterium bovis subsp bovis AF2122/97
cacggcggcccgcuc

SEQ ID NO: 1071148 - RNA, 12 nt, Mycobacterium bovis subsp bovis AF2122/97
cacggcggccac

SEQ ID NO: 1071149 - RNA, 16 nt, Mycobacterium bovis subsp bovis AF2122/97
cacggcgcgcgcgccg

SEQ ID NO: 1071150 - RNA, 22 nt, Mycobacterium bovis subsp bovis AF2122/97
cacggcgcgcgcgccggcugcc

SEQ ID NO: 1071151 - RNA, 14 nt, Mycobacterium bovis subsp bovis AF2122/97
cacggucagcucgc

SEQ ID NO: 1071152 - RNA, 13 nt, Mycobacterium bovis subsp bovis AF2122/97
cacggucaagccg

SEQ ID NO: 1071153 - RNA, 17 nt, Mycobacterium bovis subsp bovis AF2122/97
cacggucagccaggugu

SEQ ID NO: 1071154 - RNA, 13 nt, Mycobacterium bovis subsp bovis AF2122/97
cacggucaccggc

SEQ ID NO: 1071155 - RNA, 15 nt, Mycobacterium bovis subsp bovis AF2122/97
cacggucaccggcac

SEQ ID NO: 1071156 - RNA, 16 nt, Mycobacterium bovis subsp bovis AF2122/97
cacggucaccggcacg

SEQ ID NO: 1071157 - RNA, 14 nt, Mycobacterium bovis subsp bovis AF2122/97
cacggucagcacgc

SEQ ID NO: 1071158 - RNA, 16 nt, Mycobacterium bovis subsp bovis AF2122/97
cacggucaagccggcg

SEQ ID NO: 1071159 - RNA, 21 nt, Mycobacterium bovis subsp bovis AF2122/97
cacggucaauugugcggcccc

SEQ ID NO: 1071160 - RNA, 22 nt, Mycobacterium bovis subsp bovis AF2122/97
cacggucaauugugcggccccg

SEQ ID NO: 1071161 - RNA, 19 nt, Mycobacterium bovis subsp bovis AF2122/97
cacggucacacgccagccg

SEQ ID NO: 1071162 - RNA, 20 nt, Mycobacterium bovis subsp bovis AF2122/97
cacggggcgugacagggcgg

SEQ ID NO: 1071163 - RNA, 22 nt, Mycobacterium bovis subsp bovis AF2122/97
cacgguagacaagucggcgcug

SEQ ID NO: 1071164 - RNA, 14 nt, Mycobacterium bovis subsp bovis AF2122/97
cacgguccgccacg

SEQ ID NO: 1071165 - RNA, 16 nt, Mycobacterium bovis subsp bovis AF2122/97
cacgguccggcccacc

SEQ ID NO: 1071166 - RNA, 21 nt, Mycobacterium bovis subsp bovis AF2122/97
cacgguccggcccaccagcgc

SEQ ID NO: 1071167 - RNA, 16 nt, Mycobacterium bovis subsp bovis AF2122/97
cacgguccacgguggc

SEQ ID NO: 1071168 - RNA, 19 nt, Mycobacterium bovis subsp bovis AF2122/97
cacggucgaccaggacggu

SEQ ID NO: 1071169 - RNA, 12 nt, Mycobacterium bovis subsp bovis AF2122/97
cacggucgacga

SEQ ID NO: 1071170 - RNA, 14 nt, Mycobacterium bovis subsp bovis AF2122/97
cacggucgacgaug

SEQ ID NO: 1071171 - RNA, 19 nt, Mycobacterium bovis subsp bovis AF2122/97
cacggucgcccgaucggcg

SEQ ID NO: 1071172 - RNA, 20 nt, Mycobacterium bovis subsp bovis AF2122/97
cacggucgcccgaucggcgg

SEQ ID NO: 1071173 - RNA, 15 nt, Mycobacterium bovis subsp bovis AF2122/97
cacggucgccgacca

SEQ ID NO: 1071174 - RNA, 18 nt, Mycobacterium bovis subsp bovis AF2122/97
cacggucaugccgccgcc

SEQ ID NO: 1071175 - RNA, 22 nt, Mycobacterium bovis subsp bovis AF2122/97
cacggucauugggugucaaugu

SEQ ID NO: 1071176 - RNA, 19 nt, Mycobacterium bovis subsp bovis AF2122/97
cacggucagcucgcugacg

SEQ ID NO: 1071177 - RNA, 16 nt, Mycobacterium bovis subsp bovis AF2122/97
cacggucaucucggug

SEQ ID NO: 1071178 - RNA, 13 nt, Mycobacterium bovis subsp bovis AF2122/97
cacggucaugccg

SEQ ID NO: 1071179 - RNA, 18 nt, Mycobacterium bovis subsp bovis AF2122/97
cacgggcggccaccgcac

SEQ ID NO: 1071180 - RNA, 13 nt, Mycobacterium bovis subsp bovis AF2122/97
cacgggcggccau

SEQ ID NO: 1071181 - RNA, 23 nt, Mycobacterium bovis subsp bovis AF2122/97
cacgggcggccauggcacugccg

SEQ ID NO: 1071182 - RNA, 23 nt, Mycobacterium bovis subsp bovis AF2122/97
cacgggcgucgucgguaaugccg

SEQ ID NO: 1071183 - RNA, 21 nt, Mycobacterium bovis subsp bovis AF2122/97
cacggguacggucucacggcg

SEQ ID NO: 1071184 - RNA, 17 nt, Mycobacterium bovis subsp bovis AF2122/97
cacggguagcugccgcg

SEQ ID NO: 1071185 - RNA, 19 nt, Mycobacterium bovis subsp bovis AF2122/97
cacggguagcugccgcggc

SEQ ID NO: 1071186 - RNA, 20 nt, Mycobacterium bovis subsp bovis AF2122/97
cacggguagcugccgcggcc

SEQ ID NO: 1071187 - RNA, 14 nt, Mycobacterium bovis subsp bovis AF2122/97
cacggggaccgggc

SEQ ID NO: 1071188 - RNA, 23 nt, Mycobacterium bovis subsp bovis AF2122/97
cacgggaguacgggagccggcug

SEQ ID NO: 1071189 - RNA, 17 nt, Mycobacterium bovis subsp bovis AF2122/97
cacggcuuuucgacgcu

SEQ ID NO: 1071190 - RNA, 22 nt, Mycobacterium bovis subsp bovis AF2122/97
cacgggcacgaucgucgcggcc

SEQ ID NO: 1071191 - RNA, 20 nt, Mycobacterium bovis subsp bovis AF2122/97
cacgggcagcuucaaugucg

SEQ ID NO: 1071192 - RNA, 19 nt, Mycobacterium bovis subsp bovis AF2122/97
cacgggccaccagcgucgc

SEQ ID NO: 1071193 - RNA, 14 nt, Mycobacterium bovis subsp bovis AF2122/97
cacgggcggccacc

SEQ ID NO: 1071194 - RNA, 15 nt, Mycobacterium bovis subsp bovis AF2122/97
cacgggcggccaccg

SEQ ID NO: 1071195 - RNA, 21 nt, Mycobacterium bovis subsp bovis AF2122/97
cacgggcccaggacagcagcc

SEQ ID NO: 1071196 - RNA, 17 nt, Mycobacterium bovis subsp bovis AF2122/97
cacguacgccgccgauc

SEQ ID NO: 1071197 - RNA, 15 nt, Mycobacterium bovis subsp bovis AF2122/97
cacguaagcgguugu

SEQ ID NO: 1071198 - RNA, 22 nt, Mycobacterium bovis subsp bovis AF2122/97
cacgguuggcgcucaacucagu

SEQ ID NO: 1071199 - RNA, 19 nt, Mycobacterium bovis subsp bovis AF2122/97
cacgguuuucgagggaugg

SEQ ID NO: 1071200 - RNA, 21 nt, Mycobacterium bovis subsp bovis AF2122/97
cacgguugccggcggcgacgu

SEQ ID NO: 1071201 - RNA, 14 nt, Mycobacterium bovis subsp bovis AF2122/97
cacgguuggccacc

SEQ ID NO: 1071202 - RNA, 15 nt, Mycobacterium bovis subsp bovis AF2122/97
cacgguuggccacca

SEQ ID NO: 1071203 - RNA, 18 nt, Mycobacterium bovis subsp bovis AF2122/97
cacgguuggccaccagcu

SEQ ID NO: 1071204 - RNA, 19 nt, Mycobacterium bovis subsp bovis AF2122/97
cacgguuggccaccagcug

SEQ ID NO: 1071205 - RNA, 21 nt, Mycobacterium bovis subsp bovis AF2122/97
cacgguuggccaccagcuggc

SEQ ID NO: 1071206 - RNA, 15 nt, Mycobacterium bovis subsp bovis AF2122/97
cacggugugcacggc

SEQ ID NO: 1071207 - RNA, 16 nt, Mycobacterium bovis subsp bovis AF2122/97
cacggugugcacggcg

SEQ ID NO: 1071208 - RNA, 16 nt, Mycobacterium bovis subsp bovis AF2122/97
cacggugugcuaccaa

SEQ ID NO: 1071209 - RNA, 20 nt, Mycobacterium bovis subsp bovis AF2122/97
cacggugugcuaccaauucg

SEQ ID NO: 1071210 - RNA, 19 nt, Mycobacterium bovis subsp bovis AF2122/97
cacgguugccgcgaucggg

SEQ ID NO: 1071211 - RNA, 20 nt, Mycobacterium bovis subsp bovis AF2122/97
cacggugccgccgucgauga

SEQ ID NO: 1071212 - RNA, 22 nt, Mycobacterium bovis subsp bovis AF2122/97
cacggugggcgccgacaccggc

SEQ ID NO: 1071213 - RNA, 20 nt, Mycobacterium bovis subsp bovis AF2122/97
cacgguggugucagccaccg

SEQ ID NO: 1071214 - RNA, 17 nt, Mycobacterium bovis subsp bovis AF2122/97
cacggugggcgccgaca

SEQ ID NO: 1071215 - RNA, 18 nt, Mycobacterium bovis subsp bovis AF2122/97
cacggugggcgccgacac

SEQ ID NO: 1071216 - RNA, 22 nt, Mycobacterium bovis subsp bovis AF2122/97
cacgguggcucuguagcgucgc

SEQ ID NO: 1071217 - RNA, 23 nt, Mycobacterium bovis subsp bovis AF2122/97
cacgguggcucuguagcgucgca

SEQ ID NO: 1071218 - RNA, 13 nt, Mycobacterium bovis subsp bovis AF2122/97
cacgguggcuucg

SEQ ID NO: 1071219 - RNA, 16 nt, Mycobacterium bovis subsp bovis AF2122/97
cacggugaacaauccg

SEQ ID NO: 1071220 - RNA, 21 nt, Mycobacterium bovis subsp bovis AF2122/97
cacggucugccacgaggcauc

SEQ ID NO: 1071221 - RNA, 15 nt, Mycobacterium bovis subsp bovis AF2122/97
cacggugaucuucuu

SEQ ID NO: 1071222 - RNA, 21 nt, Mycobacterium bovis subsp bovis AF2122/97
cacggugagccgguggcccgc

SEQ ID NO: 1071223 - RNA, 14 nt, Mycobacterium bovis subsp bovis AF2122/97
cacggucgcggauc

SEQ ID NO: 1071224 - RNA, 16 nt, Mycobacterium bovis subsp bovis AF2122/97
cacggugaccacgccg

SEQ ID NO: 1071225 - RNA, 20 nt, Mycobacterium bovis subsp bovis AF2122/97
cacggugcguucgugcugcc

SEQ ID NO: 1071226 - RNA, 22 nt, Mycobacterium bovis subsp bovis AF2122/97
cacgguggacgauacgcgcacc

SEQ ID NO: 1071227 - RNA, 16 nt, Mycobacterium bovis subsp bovis AF2122/97
cacgguggagcgcgcc

SEQ ID NO: 1071228 - RNA, 17 nt, Mycobacterium bovis subsp bovis AF2122/97
cacgguggccgcugcca

SEQ ID NO: 1071229 - RNA, 20 nt, Mycobacterium bovis subsp bovis AF2122/97
cacgguggccgcugccagcc

SEQ ID NO: 1071230 - RNA, 15 nt, Mycobacterium bovis subsp bovis AF2122/97
cacgguggcgccgaa

SEQ ID NO: 1071231 - RNA, 16 nt, Mycobacterium bovis subsp bovis AF2122/97
cacgguggcgccgaac

SEQ ID NO: 1071232 - RNA, 16 nt, Mycobacterium bovis subsp bovis AF2122/97
cacgguggccgagccg

SEQ ID NO: 1071233 - RNA, 13 nt, Mycobacterium bovis subsp bovis AF2122/97
cacggugccgccg

SEQ ID NO: 1071234 - RNA, 14 nt, Mycobacterium bovis subsp bovis AF2122/97
cacggugccggcac

SEQ ID NO: 1071235 - RNA, 15 nt, Mycobacterium bovis subsp bovis AF2122/97
cacggugcccagggc

SEQ ID NO: 1071236 - RNA, 19 nt, Mycobacterium bovis subsp bovis AF2122/97
cacggugaugaggaucgcg

SEQ ID NO: 1071237 - RNA, 19 nt, Mycobacterium bovis subsp bovis AF2122/97
cacggugccgacgaugacg

SEQ ID NO: 1071238 - RNA, 17 nt, Mycobacterium bovis subsp bovis AF2122/97
cagcgaaagcgucgagc

SEQ ID NO: 1071239 - RNA, 17 nt, Mycobacterium bovis subsp bovis AF2122/97
cagcgaaacaccggcca

SEQ ID NO: 1071240 - RNA, 20 nt, Mycobacterium bovis subsp bovis AF2122/97
cagcgaaacaccggccagcg

SEQ ID NO: 1071241 - RNA, 15 nt, Mycobacterium bovis subsp bovis AF2122/97
cagcgaaaacccggu

SEQ ID NO: 1071242 - RNA, 15 nt, Mycobacterium bovis subsp bovis AF2122/97
cagcgaaaaccgucg

SEQ ID NO: 1071243 - RNA, 21 nt, Mycobacterium bovis subsp bovis AF2122/97
cagcgaaaugcccaucaccag

SEQ ID NO: 1071244 - RNA, 22 nt, Mycobacterium bovis subsp bovis AF2122/97
cagcgaaaugcccaucaccaga

SEQ ID NO: 1071245 - RNA, 18 nt, Mycobacterium bovis subsp bovis AF2122/97
cagccuuguugccgccgg

SEQ ID NO: 1071246 - RNA, 17 nt, Mycobacterium bovis subsp bovis AF2122/97
cagcgaaccaccggcgc

SEQ ID NO: 1071247 - RNA, 23 nt, Mycobacterium bovis subsp bovis AF2122/97
cagcgaaccaccggcgccgccgg

SEQ ID NO: 1071248 - RNA, 14 nt, Mycobacterium bovis subsp bovis AF2122/97
cagcgaaccgaccc

SEQ ID NO: 1071249 - RNA, 19 nt, Mycobacterium bovis subsp bovis AF2122/97
cagcgaaccgacccggccg

SEQ ID NO: 1071250 - RNA, 13 nt, Mycobacterium bovis subsp bovis AF2122/97
cagcgaaccgccg

SEQ ID NO: 1071251 - RNA, 22 nt, Mycobacterium bovis subsp bovis AF2122/97
cagcgaacagacaugcgcacca

SEQ ID NO: 1071252 - RNA, 15 nt, Mycobacterium bovis subsp bovis AF2122/97
cagcgaaccaccggc

SEQ ID NO: 1071253 - RNA, 16 nt, Mycobacterium bovis subsp bovis AF2122/97
cagcgaaccaccggcg

SEQ ID NO: 1071254 - RNA, 14 nt, Mycobacterium bovis subsp bovis AF2122/97
cagcgaaccgccgg

SEQ ID NO: 1071255 - RNA, 23 nt, Mycobacterium bovis subsp bovis AF2122/97
cagcgacccggccagcggcagga

SEQ ID NO: 1071256 - RNA, 20 nt, Mycobacterium bovis subsp bovis AF2122/97
cagcgaccaaugcagugcga

SEQ ID NO: 1071257 - RNA, 17 nt, Mycobacterium bovis subsp bovis AF2122/97
cagcgagcauaccgccg

SEQ ID NO: 1071258 - RNA, 15 nt, Mycobacterium bovis subsp bovis AF2122/97
cagcgacgccggccc

SEQ ID NO: 1071259 - RNA, 18 nt, Mycobacterium bovis subsp bovis AF2122/97
cagcgacuugcggugcuc

SEQ ID NO: 1071260 - RNA, 13 nt, Mycobacterium bovis subsp bovis AF2122/97
cagcgacgccggc

SEQ ID NO: 1071261 - RNA, 17 nt, Mycobacterium bovis subsp bovis AF2122/97
cagcgacgccaugucga

SEQ ID NO: 1071262 - RNA, 15 nt, Mycobacterium bovis subsp bovis AF2122/97
cagcgacgaccacac

SEQ ID NO: 1071263 - RNA, 16 nt, Mycobacterium bovis subsp bovis AF2122/97
cagcgacgaccacacc

SEQ ID NO: 1071264 - RNA, 19 nt, Mycobacterium bovis subsp bovis AF2122/97
cagcgacgaccacaccacg

SEQ ID NO: 1071265 - RNA, 14 nt, Mycobacterium bovis subsp bovis AF2122/97
cagcgaccgguaau

SEQ ID NO: 1071266 - RNA, 21 nt, Mycobacterium bovis subsp bovis AF2122/97
cagcgaccgguaauccguugc

SEQ ID NO: 1071267 - RNA, 20 nt, Mycobacterium bovis subsp bovis AF2122/97
cagcgaccucacgaaucgcu

SEQ ID NO: 1071268 - RNA, 13 nt, Mycobacterium bovis subsp bovis AF2122/97
cagcgacgcauaa

SEQ ID NO: 1071269 - RNA, 11 nt, Mycobacterium bovis subsp bovis AF2122/97
cagcgacgcca

SEQ ID NO: 1071270 - RNA, 18 nt, Mycobacterium bovis subsp bovis AF2122/97
cagccugauauccgcgga

SEQ ID NO: 1071271 - RNA, 15 nt, Mycobacterium bovis subsp bovis AF2122/97
cagccugcgccgcgc

SEQ ID NO: 1071272 - RNA, 17 nt, Mycobacterium bovis subsp bovis AF2122/97
cagccugccgaugacga

SEQ ID NO: 1071273 - RNA, 20 nt, Mycobacterium bovis subsp bovis AF2122/97
cagccugccgaugacgaugg

SEQ ID NO: 1071274 - RNA, 14 nt, Mycobacterium bovis subsp bovis AF2122/97
cagccucgcgggca

SEQ ID NO: 1071275 - RNA, 15 nt, Mycobacterium bovis subsp bovis AF2122/97
cagccugcuggccgc

SEQ ID NO: 1071276 - RNA, 17 nt, Mycobacterium bovis subsp bovis AF2122/97
cagccugcuggccgcgg

SEQ ID NO: 1071277 - RNA, 22 nt, Mycobacterium bovis subsp bovis AF2122/97
cagccugcuggccgcggccucg

SEQ ID NO: 1071278 - RNA, 20 nt, Mycobacterium bovis subsp bovis AF2122/97
cagccugcagcgaaacaccg

SEQ ID NO: 1071279 - RNA, 22 nt, Mycobacterium bovis subsp bovis AF2122/97
cagccugcagcgaaacaccggc

SEQ ID NO: 1071280 - RNA, 15 nt, Mycobacterium bovis subsp bovis AF2122/97
cagccuggucgcgca

SEQ ID NO: 1071281 - RNA, 20 nt, Mycobacterium bovis subsp bovis AF2122/97
cagccuggcaaccacguccg

SEQ ID NO: 1071282 - RNA, 21 nt, Mycobacterium bovis subsp bovis AF2122/97
cagccggccauacgcgcgcgg

SEQ ID NO: 1071283 - RNA, 13 nt, Mycobacterium bovis subsp bovis AF2122/97
cagccggcccguc

SEQ ID NO: 1071284 - RNA, 18 nt, Mycobacterium bovis subsp bovis AF2122/97
cagccggcccugcggcca

SEQ ID NO: 1071285 - RNA, 20 nt, Mycobacterium bovis subsp bovis AF2122/97
cagccggcccugcggccaau

SEQ ID NO: 1071286 - RNA, 12 nt, Mycobacterium bovis subsp bovis AF2122/97
cagccggccgcg

SEQ ID NO: 1071287 - RNA, 14 nt, Mycobacterium bovis subsp bovis AF2122/97
cagccggccgcgac

SEQ ID NO: 1071288 - RNA, 19 nt, Mycobacterium bovis subsp bovis AF2122/97
cagccguucucgcccaccc

SEQ ID NO: 1071289 - RNA, 20 nt, Mycobacterium bovis subsp bovis AF2122/97
cagccguuuuccugaucgcg

SEQ ID NO: 1071290 - RNA, 20 nt, Mycobacterium bovis subsp bovis AF2122/97
cagccuaccggcuacggcga

SEQ ID NO: 1071291 - RNA, 16 nt, Mycobacterium bovis subsp bovis AF2122/97
cagccggccgcgaccg

SEQ ID NO: 1071292 - RNA, 23 nt, Mycobacterium bovis subsp bovis AF2122/97
cagcgcaaacaucuugucgaucu

SEQ ID NO: 1071293 - RNA, 14 nt, Mycobacterium bovis subsp bovis AF2122/97
cagcgcaacaucga

SEQ ID NO: 1071294 - RNA, 18 nt, Mycobacterium bovis subsp bovis AF2122/97
cagcgcaacaucgaaaac

SEQ ID NO: 1071295 - RNA, 15 nt, Mycobacterium bovis subsp bovis AF2122/97
cagcgaugcgguguc

SEQ ID NO: 1071296 - RNA, 22 nt, Mycobacterium bovis subsp bovis AF2122/97
cagcgaugcggugucgggcugg

SEQ ID NO: 1071297 - RNA, 18 nt, Mycobacterium bovis subsp bovis AF2122/97
cagcgaugugaaccgggc

SEQ ID NO: 1071298 - RNA, 15 nt, Mycobacterium bovis subsp bovis AF2122/97
cagcgagcccagcug

SEQ ID NO: 1071299 - RNA, 14 nt, Mycobacterium bovis subsp bovis AF2122/97
cagcgaugcggcgu

SEQ ID NO: 1071300 - RNA, 15 nt, Mycobacterium bovis subsp bovis AF2122/97
cagcgaugcggcguu

SEQ ID NO: 1071301 - RNA, 17 nt, Mycobacterium bovis subsp bovis AF2122/97
cagcgaugcggcguugg

SEQ ID NO: 1071302 - RNA, 17 nt, Mycobacterium bovis subsp bovis AF2122/97
cagcgccaagacgucgg

SEQ ID NO: 1071303 - RNA, 20 nt, Mycobacterium bovis subsp bovis AF2122/97
cagcgccaagacgucggcgu

SEQ ID NO: 1071304 - RNA, 20 nt, Mycobacterium bovis subsp bovis AF2122/97
cagcgcauuucggaucucga

SEQ ID NO: 1071305 - RNA, 15 nt, Mycobacterium bovis subsp bovis AF2122/97
cagcgcaucggccag

SEQ ID NO: 1071306 - RNA, 17 nt, Mycobacterium bovis subsp bovis AF2122/97
cagcgcaucgccgcugg

SEQ ID NO: 1071307 - RNA, 13 nt, Mycobacterium bovis subsp bovis AF2122/97
cagcgcaucgccg

SEQ ID NO: 1071308 - RNA, 16 nt, Mycobacterium bovis subsp bovis AF2122/97
cagcgcaucgccgcug

SEQ ID NO: 1071309 - RNA, 18 nt, Mycobacterium bovis subsp bovis AF2122/97
cagcgcauccacaaucac

SEQ ID NO: 1071310 - RNA, 14 nt, Mycobacterium bovis subsp bovis AF2122/97
cagcgccgcauucg

SEQ ID NO: 1071311 - RNA, 19 nt, Mycobacterium bovis subsp bovis AF2122/97
cagcgccgcauucgcgaca

SEQ ID NO: 1071312 - RNA, 23 nt, Mycobacterium bovis subsp bovis AF2122/97
cagcgccgccaccgaagccgccg

SEQ ID NO: 1071313 - RNA, 17 nt, Mycobacterium bovis subsp bovis AF2122/97
cagcgcccagaucgccg

SEQ ID NO: 1071314 - RNA, 11 nt, Mycobacterium bovis subsp bovis AF2122/97
cagcgccgccg

SEQ ID NO: 1071315 - RNA, 17 nt, Mycobacterium bovis subsp bovis AF2122/97
cagcgccaaugucagcu

SEQ ID NO: 1071316 - RNA, 17 nt, Mycobacterium bovis subsp bovis AF2122/97
cagcgccgcgcgcgccg

SEQ ID NO: 1071317 - RNA, 19 nt, Mycobacterium bovis subsp bovis AF2122/97
cagcgccgcgcgcgccgca

SEQ ID NO: 1071318 - RNA, 13 nt, Mycobacterium bovis subsp bovis AF2122/97
cagcgccgcggcc

SEQ ID NO: 1071319 - RNA, 15 nt, Mycobacterium bovis subsp bovis AF2122/97
cagcgccgcggcccg

SEQ ID NO: 1071320 - RNA, 19 nt, Mycobacterium bovis subsp bovis AF2122/97
cagcgccgcggcccgcucg

SEQ ID NO: 1071321 - RNA, 22 nt, Mycobacterium bovis subsp bovis AF2122/97
cagcgccgcgccccagacgcgc

SEQ ID NO: 1071322 - RNA, 15 nt, Mycobacterium bovis subsp bovis AF2122/97
cagcgccgccggcgc

SEQ ID NO: 1071323 - RNA, 16 nt, Mycobacterium bovis subsp bovis AF2122/97
cagcgccgccggcgcc

SEQ ID NO: 1071324 - RNA, 15 nt, Mycobacterium bovis subsp bovis AF2122/97
cagcgccgccgaggu

SEQ ID NO: 1071325 - RNA, 12 nt, Mycobacterium bovis subsp bovis AF2122/97
cagcgccgccgc

SEQ ID NO: 1071326 - RNA, 15 nt, Mycobacterium bovis subsp bovis AF2122/97
cagcgccgccgccga

SEQ ID NO: 1071327 - RNA, 17 nt, Mycobacterium bovis subsp bovis AF2122/97
cagcgccgccgccgacg

SEQ ID NO: 1071328 - RNA, 18 nt, Mycobacterium bovis subsp bovis AF2122/97
cagcgccgccgccgacga

SEQ ID NO: 1071329 - RNA, 12 nt, Mycobacterium bovis subsp bovis AF2122/97
cagcgccaccgu

SEQ ID NO: 1071330 - RNA, 20 nt, Mycobacterium bovis subsp bovis AF2122/97
cagcgccaccguuaccgccg

SEQ ID NO: 1071331 - RNA, 13 nt, Mycobacterium bovis subsp bovis AF2122/97
cagcgccacccga

SEQ ID NO: 1071332 - RNA, 18 nt, Mycobacterium bovis subsp bovis AF2122/97
cagcgccacccgaucggg

SEQ ID NO: 1071333 - RNA, 20 nt, Mycobacterium bovis subsp bovis AF2122/97
cagcgccacccgaucgggcg

SEQ ID NO: 1071334 - RNA, 16 nt, Mycobacterium bovis subsp bovis AF2122/97
cagcgccacccggucc

SEQ ID NO: 1071335 - RNA, 22 nt, Mycobacterium bovis subsp bovis AF2122/97
cagcgccacccgguccggcccg

SEQ ID NO: 1071336 - RNA, 15 nt, Mycobacterium bovis subsp bovis AF2122/97
cagcgccaugcuguc

SEQ ID NO: 1071337 - RNA, 18 nt, Mycobacterium bovis subsp bovis AF2122/97
cagcgccaucgaugcggu

SEQ ID NO: 1071338 - RNA, 12 nt, Mycobacterium bovis subsp bovis AF2122/97
cagcgccagggg

SEQ ID NO: 1071339 - RNA, 20 nt, Mycobacterium bovis subsp bovis AF2122/97
cagcgccaggggugugccgu

SEQ ID NO: 1071340 - RNA, 19 nt, Mycobacterium bovis subsp bovis AF2122/97
cagcgccagugccucgcgg

SEQ ID NO: 1071341 - RNA, 14 nt, Mycobacterium bovis subsp bovis AF2122/97
cagcccgcgcagca

SEQ ID NO: 1071342 - RNA, 17 nt, Mycobacterium bovis subsp bovis AF2122/97
cagcccgcgcagcgguc

SEQ ID NO: 1071343 - RNA, 14 nt, Mycobacterium bovis subsp bovis AF2122/97
cagcccgcuggccg

SEQ ID NO: 1071344 - RNA, 14 nt, Mycobacterium bovis subsp bovis AF2122/97
cagcccggacgcgc

SEQ ID NO: 1071345 - RNA, 22 nt, Mycobacterium bovis subsp bovis AF2122/97
cagcccggcacugaccgcgaug

SEQ ID NO: 1071346 - RNA, 17 nt, Mycobacterium bovis subsp bovis AF2122/97
cagcccggcacugaccg

SEQ ID NO: 1071347 - RNA, 13 nt, Mycobacterium bovis subsp bovis AF2122/97
cagcccggccgcc

SEQ ID NO: 1071348 - RNA, 15 nt, Mycobacterium bovis subsp bovis AF2122/97
cagcccggccgccga

SEQ ID NO: 1071349 - RNA, 16 nt, Mycobacterium bovis subsp bovis AF2122/97
cagcccggccggucga

SEQ ID NO: 1071350 - RNA, 20 nt, Mycobacterium bovis subsp bovis AF2122/97
cagcccggccggucgagacg

SEQ ID NO: 1071351 - RNA, 20 nt, Mycobacterium bovis subsp bovis AF2122/97
cagccgaccgaccuggucgg

SEQ ID NO: 1071352 - RNA, 14 nt, Mycobacterium bovis subsp bovis AF2122/97
cagccgaccgaugg

SEQ ID NO: 1071353 - RNA, 21 nt, Mycobacterium bovis subsp bovis AF2122/97
cagccgcccugaauccucucg

SEQ ID NO: 1071354 - RNA, 18 nt, Mycobacterium bovis subsp bovis AF2122/97
cagccgaucaucaccggc

SEQ ID NO: 1071355 - RNA, 12 nt, Mycobacterium bovis subsp bovis AF2122/97
cagccgccgacu

SEQ ID NO: 1071356 - RNA, 21 nt, Mycobacterium bovis subsp bovis AF2122/97
cagccgccgacuuccgcgucg

SEQ ID NO: 1071357 - RNA, 15 nt, Mycobacterium bovis subsp bovis AF2122/97
cagccgccgccggca

SEQ ID NO: 1071358 - RNA, 22 nt, Mycobacterium bovis subsp bovis AF2122/97
cagccgccgccugugcgcggug

SEQ ID NO: 1071359 - RNA, 14 nt, Mycobacterium bovis subsp bovis AF2122/97
cagccgacgcggcg

SEQ ID NO: 1071360 - RNA, 15 nt, Mycobacterium bovis subsp bovis AF2122/97
cagccgacgcggcgg

SEQ ID NO: 1071361 - RNA, 22 nt, Mycobacterium bovis subsp bovis AF2122/97
cagccgagcgagaaucacgguc

SEQ ID NO: 1071362 - RNA, 20 nt, Mycobacterium bovis subsp bovis AF2122/97
cagccgauacaggccacgca

SEQ ID NO: 1071363 - RNA, 21 nt, Mycobacterium bovis subsp bovis AF2122/97
cagccgauacaggccacgcac

SEQ ID NO: 1071364 - RNA, 13 nt, Mycobacterium bovis subsp bovis AF2122/97
cagccgagcucac

SEQ ID NO: 1071365 - RNA, 23 nt, Mycobacterium bovis subsp bovis AF2122/97
cagccgagcucacuucacgccgc

SEQ ID NO: 1071366 - RNA, 19 nt, Mycobacterium bovis subsp bovis AF2122/97
cagccgcgggccgcgucca

SEQ ID NO: 1071367 - RNA, 13 nt, Mycobacterium bovis subsp bovis AF2122/97
cagccgcggcgcc

SEQ ID NO: 1071368 - RNA, 13 nt, Mycobacterium bovis subsp bovis AF2122/97
cagccgcggcccu

SEQ ID NO: 1071369 - RNA, 21 nt, Mycobacterium bovis subsp bovis AF2122/97
cagccgcgcgggucacgaccu

SEQ ID NO: 1071370 - RNA, 22 nt, Mycobacterium bovis subsp bovis AF2122/97
cagccgcgcgguacugcgcagc

SEQ ID NO: 1071371 - RNA, 14 nt, Mycobacterium bovis subsp bovis AF2122/97
cagccgcgcgguga

SEQ ID NO: 1071372 - RNA, 14 nt, Mycobacterium bovis subsp bovis AF2122/97
cagccgcgcguccg

SEQ ID NO: 1071373 - RNA, 14 nt, Mycobacterium bovis subsp bovis AF2122/97
cagccgcucgacgg

SEQ ID NO: 1071374 - RNA, 15 nt, Mycobacterium bovis subsp bovis AF2122/97
cagccgcucgacggc

SEQ ID NO: 1071375 - RNA, 13 nt, Mycobacterium bovis subsp bovis AF2122/97
cagccgcgcugcg

SEQ ID NO: 1071376 - RNA, 19 nt, Mycobacterium bovis subsp bovis AF2122/97
cagccggccaauggccugc

SEQ ID NO: 1071377 - RNA, 23 nt, Mycobacterium bovis subsp bovis AF2122/97
cagccggccaauggccugcagcg

SEQ ID NO: 1071378 - RNA, 18 nt, Mycobacterium bovis subsp bovis AF2122/97
cagccggcauagcggccc

SEQ ID NO: 1071379 - RNA, 19 nt, Mycobacterium bovis subsp bovis AF2122/97
cagccggcauagcggccca

SEQ ID NO: 1071380 - RNA, 15 nt, Mycobacterium bovis subsp bovis AF2122/97
cagccggcagcgaga

SEQ ID NO: 1071381 - RNA, 14 nt, Mycobacterium bovis subsp bovis AF2122/97
cagccgcggggcga

SEQ ID NO: 1071382 - RNA, 12 nt, Mycobacterium bovis subsp bovis AF2122/97
cagccgcgccgc

SEQ ID NO: 1071383 - RNA, 12 nt, Mycobacterium bovis subsp bovis AF2122/97
cagccgcgccga

SEQ ID NO: 1071384 - RNA, 16 nt, Mycobacterium bovis subsp bovis AF2122/97
cagccgcgcgccaucg

SEQ ID NO: 1071385 - RNA, 22 nt, Mycobacterium bovis subsp bovis AF2122/97
cagccgcgcgccaucgccucca

SEQ ID NO: 1071386 - RNA, 13 nt, Mycobacterium bovis subsp bovis AF2122/97
cagccgcgcgccg

SEQ ID NO: 1071387 - RNA, 18 nt, Mycobacterium bovis subsp bovis AF2122/97
cagccgcgccgcggcccg

SEQ ID NO: 1071388 - RNA, 15 nt, Mycobacterium bovis subsp bovis AF2122/97
cagccgcgacgcggc

SEQ ID NO: 1071389 - RNA, 19 nt, Mycobacterium bovis subsp bovis AF2122/97
cagccgcgagccggugauc

SEQ ID NO: 1071390 - RNA, 15 nt, Mycobacterium bovis subsp bovis AF2122/97
cagccgccggccggc

SEQ ID NO: 1071391 - RNA, 14 nt, Mycobacterium bovis subsp bovis AF2122/97
cagccgccugucgg

SEQ ID NO: 1071392 - RNA, 16 nt, Mycobacterium bovis subsp bovis AF2122/97
cagcccgccgaucggg

SEQ ID NO: 1071393 - RNA, 22 nt, Mycobacterium bovis subsp bovis AF2122/97
cagcccgccggacccgcccuug

SEQ ID NO: 1071394 - RNA, 13 nt, Mycobacterium bovis subsp bovis AF2122/97
cagcccgcgcagc

SEQ ID NO: 1071395 - RNA, 16 nt, Mycobacterium bovis subsp bovis AF2122/97
cagcccccgcugaccg

SEQ ID NO: 1071396 - RNA, 17 nt, Mycobacterium bovis subsp bovis AF2122/97
cagccccgcgcccaccc

SEQ ID NO: 1071397 - RNA, 15 nt, Mycobacterium bovis subsp bovis AF2122/97
cagccccgcggccag

SEQ ID NO: 1071398 - RNA, 21 nt, Mycobacterium bovis subsp bovis AF2122/97
cagccccgcuggucgaccggc

SEQ ID NO: 1071399 - RNA, 14 nt, Mycobacterium bovis subsp bovis AF2122/97
cagccccgacugcg

SEQ ID NO: 1071400 - RNA, 19 nt, Mycobacterium bovis subsp bovis AF2122/97
cagccccgacugcgcccau

SEQ ID NO: 1071401 - RNA, 17 nt, Mycobacterium bovis subsp bovis AF2122/97
cagccccuccgcgccga

SEQ ID NO: 1071402 - RNA, 20 nt, Mycobacterium bovis subsp bovis AF2122/97
cagcccaucccgauccugcc

SEQ ID NO: 1071403 - RNA, 16 nt, Mycobacterium bovis subsp bovis AF2122/97
cagcccaugcgccacg

SEQ ID NO: 1071404 - RNA, 13 nt, Mycobacterium bovis subsp bovis AF2122/97
cagcccaugggcg

SEQ ID NO: 1071405 - RNA, 19 nt, Mycobacterium bovis subsp bovis AF2122/97
cagcccaugucgagcacgc

SEQ ID NO: 1071406 - RNA, 13 nt, Mycobacterium bovis subsp bovis AF2122/97
cagccccaacccu

SEQ ID NO: 1071407 - RNA, 18 nt, Mycobacterium bovis subsp bovis AF2122/97
cagccccacccgccgccg

SEQ ID NO: 1071408 - RNA, 19 nt, Mycobacterium bovis subsp bovis AF2122/97
cagccccacccgccgccgc

SEQ ID NO: 1071409 - RNA, 13 nt, Mycobacterium bovis subsp bovis AF2122/97
cagccccagcuug

SEQ ID NO: 1071410 - RNA, 20 nt, Mycobacterium bovis subsp bovis AF2122/97
cagccccagcuugcggugau

SEQ ID NO: 1071411 - RNA, 15 nt, Mycobacterium bovis subsp bovis AF2122/97
cagccccccggcgac

SEQ ID NO: 1071412 - RNA, 16 nt, Mycobacterium bovis subsp bovis AF2122/97
cagccccccggcgacg

SEQ ID NO: 1071413 - RNA, 18 nt, Mycobacterium bovis subsp bovis AF2122/97
cagccccccggcgacggc

SEQ ID NO: 1071414 - RNA, 17 nt, Mycobacterium bovis subsp bovis AF2122/97
cagccccaugaucuggu

SEQ ID NO: 1071415 - RNA, 18 nt, Mycobacterium bovis subsp bovis AF2122/97
cagccccauugccgucgc

SEQ ID NO: 1071416 - RNA, 19 nt, Mycobacterium bovis subsp bovis AF2122/97
cagccccauugccgucgcg

SEQ ID NO: 1071417 - RNA, 20 nt, Mycobacterium bovis subsp bovis AF2122/97
cagccccauugccgucgcgg

SEQ ID NO: 1071418 - RNA, 16 nt, Mycobacterium bovis subsp bovis AF2122/97
cagcccaggguguccg

SEQ ID NO: 1071419 - RNA, 16 nt, Mycobacterium bovis subsp bovis AF2122/97
cagcccagcacgcugg

SEQ ID NO: 1071420 - RNA, 22 nt, Mycobacterium bovis subsp bovis AF2122/97
cagcccagccaacucaggccgg

SEQ ID NO: 1071421 - RNA, 14 nt, Mycobacterium bovis subsp bovis AF2122/97
cagcccaccggugc

SEQ ID NO: 1071422 - RNA, 22 nt, Mycobacterium bovis subsp bovis AF2122/97
cagcccaccggugccgcccgcg

SEQ ID NO: 1071423 - RNA, 15 nt, Mycobacterium bovis subsp bovis AF2122/97
cagcccaccggcgcc

SEQ ID NO: 1071424 - RNA, 19 nt, Mycobacterium bovis subsp bovis AF2122/97
cagcccaccggcgccgccg

SEQ ID NO: 1071425 - RNA, 20 nt, Mycobacterium bovis subsp bovis AF2122/97
cagcccaccggcgccgccgg

SEQ ID NO: 1071426 - RNA, 13 nt, Mycobacterium bovis subsp bovis AF2122/97
cagcccaccggug

SEQ ID NO: 1071427 - RNA, 18 nt, Mycobacterium bovis subsp bovis AF2122/97
cagccaugcucgucuugg

SEQ ID NO: 1071428 - RNA, 15 nt, Mycobacterium bovis subsp bovis AF2122/97
cagccaugcugcucg

SEQ ID NO: 1071429 - RNA, 15 nt, Mycobacterium bovis subsp bovis AF2122/97
cagccauggcagcgc

SEQ ID NO: 1071430 - RNA, 14 nt, Mycobacterium bovis subsp bovis AF2122/97
cagccauggccgcc

SEQ ID NO: 1071431 - RNA, 21 nt, Mycobacterium bovis subsp bovis AF2122/97
cagccauucuucgaucagcgg

SEQ ID NO: 1071432 - RNA, 22 nt, Mycobacterium bovis subsp bovis AF2122/97
cagccauucuucgaucagcggc

SEQ ID NO: 1071433 - RNA, 23 nt, Mycobacterium bovis subsp bovis AF2122/97
cagcccacaggcggcgcugcagc

SEQ ID NO: 1071434 - RNA, 17 nt, Mycobacterium bovis subsp bovis AF2122/97
cagcccaacucggccag

SEQ ID NO: 1071435 - RNA, 16 nt, Mycobacterium bovis subsp bovis AF2122/97
cagccagggcgccgaa

SEQ ID NO: 1071436 - RNA, 16 nt, Mycobacterium bovis subsp bovis AF2122/97
cagccaggcgaaguac

SEQ ID NO: 1071437 - RNA, 19 nt, Mycobacterium bovis subsp bovis AF2122/97
cagccaggugucgucgauc

SEQ ID NO: 1071438 - RNA, 19 nt, Mycobacterium bovis subsp bovis AF2122/97
cagccaguugaucaggccg

SEQ ID NO: 1071439 - RNA, 19 nt, Mycobacterium bovis subsp bovis AF2122/97
cagccagggucccgccgcc

SEQ ID NO: 1071440 - RNA, 23 nt, Mycobacterium bovis subsp bovis AF2122/97
cagccaguguugcaguggcgacg

SEQ ID NO: 1071441 - RNA, 12 nt, Mycobacterium bovis subsp bovis AF2122/97
cagccagccgga

SEQ ID NO: 1071442 - RNA, 17 nt, Mycobacterium bovis subsp bovis AF2122/97
cagccagccugcuggcc

SEQ ID NO: 1071443 - RNA, 18 nt, Mycobacterium bovis subsp bovis AF2122/97
cagccagccugcuggccg

SEQ ID NO: 1071444 - RNA, 16 nt, Mycobacterium bovis subsp bovis AF2122/97
cagccagcgauccagc

SEQ ID NO: 1071445 - RNA, 20 nt, Mycobacterium bovis subsp bovis AF2122/97
cagccagcgccaugcugucg

SEQ ID NO: 1071446 - RNA, 14 nt, Mycobacterium bovis subsp bovis AF2122/97
cagccagcgggcga

SEQ ID NO: 1071447 - RNA, 14 nt, Mycobacterium bovis subsp bovis AF2122/97
cagccagccggagu

SEQ ID NO: 1071448 - RNA, 15 nt, Mycobacterium bovis subsp bovis AF2122/97
cagccagcgggcgau

SEQ ID NO: 1071449 - RNA, 17 nt, Mycobacterium bovis subsp bovis AF2122/97
cagccagcgguagcugc

SEQ ID NO: 1071450 - RNA, 16 nt, Mycobacterium bovis subsp bovis AF2122/97
cagccagcguccaugg

SEQ ID NO: 1071451 - RNA, 19 nt, Mycobacterium bovis subsp bovis AF2122/97
cagccagcguccauggucg

SEQ ID NO: 1071452 - RNA, 12 nt, Mycobacterium bovis subsp bovis AF2122/97
cagccaggccgc

SEQ ID NO: 1071453 - RNA, 16 nt, Mycobacterium bovis subsp bovis AF2122/97
cagccaggcgauugcc

SEQ ID NO: 1071454 - RNA, 21 nt, Mycobacterium bovis subsp bovis AF2122/97
cagccaggccuuggugcggcc

SEQ ID NO: 1071455 - RNA, 13 nt, Mycobacterium bovis subsp bovis AF2122/97
cagccagccgccc

SEQ ID NO: 1071456 - RNA, 17 nt, Mycobacterium bovis subsp bovis AF2122/97
cagccagaucuccccga

SEQ ID NO: 1071457 - RNA, 18 nt, Mycobacterium bovis subsp bovis AF2122/97
cagccagauuugacgaca

SEQ ID NO: 1071458 - RNA, 15 nt, Mycobacterium bovis subsp bovis AF2122/97
cagccagcaacacca

SEQ ID NO: 1071459 - RNA, 13 nt, Mycobacterium bovis subsp bovis AF2122/97
cagccagccaccg

SEQ ID NO: 1071460 - RNA, 18 nt, Mycobacterium bovis subsp bovis AF2122/97
cagccaccaccaggucgg

SEQ ID NO: 1071461 - RNA, 21 nt, Mycobacterium bovis subsp bovis AF2122/97
cagccacauacaggcccgcca

SEQ ID NO: 1071462 - RNA, 22 nt, Mycobacterium bovis subsp bovis AF2122/97
cagccacauacaggcccgccag

SEQ ID NO: 1071463 - RNA, 23 nt, Mycobacterium bovis subsp bovis AF2122/97
cagccacauacaggcccgccagc

SEQ ID NO: 1071464 - RNA, 15 nt, Mycobacterium bovis subsp bovis AF2122/97
cagccacagccgacc

SEQ ID NO: 1071465 - RNA, 22 nt, Mycobacterium bovis subsp bovis AF2122/97
cagccacuccucggugugcucg

SEQ ID NO: 1071466 - RNA, 20 nt, Mycobacterium bovis subsp bovis AF2122/97
cagccacucgccacucagcc

SEQ ID NO: 1071467 - RNA, 14 nt, Mycobacterium bovis subsp bovis AF2122/97
cagccacagccgac

SEQ ID NO: 1071468 - RNA, 15 nt, Mycobacterium bovis subsp bovis AF2122/97
cagccacagcccggc

SEQ ID NO: 1071469 - RNA, 17 nt, Mycobacterium bovis subsp bovis AF2122/97
cagccacagcccggcgg

SEQ ID NO: 1071470 - RNA, 18 nt, Mycobacterium bovis subsp bovis AF2122/97
cagccacagcccggcggc

SEQ ID NO: 1071471 - RNA, 19 nt, Mycobacterium bovis subsp bovis AF2122/97
cagccaaugccggaucggg

SEQ ID NO: 1071472 - RNA, 16 nt, Mycobacterium bovis subsp bovis AF2122/97
cagcaucuuuggcggc

SEQ ID NO: 1071473 - RNA, 20 nt, Mycobacterium bovis subsp bovis AF2122/97
cagcaucucgucgaucucgc

SEQ ID NO: 1071474 - RNA, 15 nt, Mycobacterium bovis subsp bovis AF2122/97
cagcaugaagucccg

SEQ ID NO: 1071475 - RNA, 19 nt, Mycobacterium bovis subsp bovis AF2122/97
cagcaucuuuggcggccgc

SEQ ID NO: 1071476 - RNA, 20 nt, Mycobacterium bovis subsp bovis AF2122/97
cagcaucuuuggcggccgca

SEQ ID NO: 1071477 - RNA, 17 nt, Mycobacterium bovis subsp bovis AF2122/97
cagcaucagcucgaugc

SEQ ID NO: 1071478 - RNA, 18 nt, Mycobacterium bovis subsp bovis AF2122/97
cagcaucagcucgaugcc

SEQ ID NO: 1071479 - RNA, 16 nt, Mycobacterium bovis subsp bovis AF2122/97
cagcaucuccgucggc

SEQ ID NO: 1071480 - RNA, 19 nt, Mycobacterium bovis subsp bovis AF2122/97
cagcaucuccgucggccag

SEQ ID NO: 1071481 - RNA, 14 nt, Mycobacterium bovis subsp bovis AF2122/97
cagcaucucggcgg

SEQ ID NO: 1071482 - RNA, 19 nt, Mycobacterium bovis subsp bovis AF2122/97
cagcaucgucgccacgaug

SEQ ID NO: 1071483 - RNA, 16 nt, Mycobacterium bovis subsp bovis AF2122/97
cagcaucggguggcga

SEQ ID NO: 1071484 - RNA, 13 nt, Mycobacterium bovis subsp bovis AF2122/97
cagcagcgccgcg

SEQ ID NO: 1071485 - RNA, 21 nt, Mycobacterium bovis subsp bovis AF2122/97
cagcagcgccgcguggcuggc

SEQ ID NO: 1071486 - RNA, 11 nt, Mycobacterium bovis subsp bovis AF2122/97
cagcaggccgg

SEQ ID NO: 1071487 - RNA, 15 nt, Mycobacterium bovis subsp bovis AF2122/97
cagcaggccgggcgc

SEQ ID NO: 1071488 - RNA, 15 nt, Mycobacterium bovis subsp bovis AF2122/97
cagcagcgccgcgcg

SEQ ID NO: 1071489 - RNA, 16 nt, Mycobacterium bovis subsp bovis AF2122/97
cagcagcgccgcgcgg

SEQ ID NO: 1071490 - RNA, 13 nt, Mycobacterium bovis subsp bovis AF2122/97
cagcaggcgaugc

SEQ ID NO: 1071491 - RNA, 13 nt, Mycobacterium bovis subsp bovis AF2122/97
cagcagcgacggu

SEQ ID NO: 1071492 - RNA, 18 nt, Mycobacterium bovis subsp bovis AF2122/97
cagcagcgacggucaggu

SEQ ID NO: 1071493 - RNA, 14 nt, Mycobacterium bovis subsp bovis AF2122/97
cagcagcgcaacca

SEQ ID NO: 1071494 - RNA, 22 nt, Mycobacterium bovis subsp bovis AF2122/97
cagcagcgcaacggccagcgcu

SEQ ID NO: 1071495 - RNA, 22 nt, Mycobacterium bovis subsp bovis AF2122/97
cagcagcgacuccagcgcccgg

SEQ ID NO: 1071496 - RNA, 17 nt, Mycobacterium bovis subsp bovis AF2122/97
cagcagcgacgcugccg

SEQ ID NO: 1071497 - RNA, 20 nt, Mycobacterium bovis subsp bovis AF2122/97
cagcagcgacgcugccgcca

SEQ ID NO: 1071498 - RNA, 16 nt, Mycobacterium bovis subsp bovis AF2122/97
cagcagcgccacccgg

SEQ ID NO: 1071499 - RNA, 22 nt, Mycobacterium bovis subsp bovis AF2122/97
cagcagcgccacccgguccggc

SEQ ID NO: 1071500 - RNA, 23 nt, Mycobacterium bovis subsp bovis AF2122/97
cagcagcgccacccgguccggcc

SEQ ID NO: 1071501 - RNA, 22 nt, Mycobacterium bovis subsp bovis AF2122/97
cagcagcgaaaaccgucgcaga

SEQ ID NO: 1071502 - RNA, 13 nt, Mycobacterium bovis subsp bovis AF2122/97
cagcagccagccc

SEQ ID NO: 1071503 - RNA, 20 nt, Mycobacterium bovis subsp bovis AF2122/97
cagcagccgcgacgcggcgu

SEQ ID NO: 1071504 - RNA, 13 nt, Mycobacterium bovis subsp bovis AF2122/97
cagcagccgccgg

SEQ ID NO: 1071505 - RNA, 17 nt, Mycobacterium bovis subsp bovis AF2122/97
cagcagccgccggccgg

SEQ ID NO: 1071506 - RNA, 20 nt, Mycobacterium bovis subsp bovis AF2122/97
cagcagccgccggccggcau

SEQ ID NO: 1071507 - RNA, 17 nt, Mycobacterium bovis subsp bovis AF2122/97
cagcagccgcgacgcgg

SEQ ID NO: 1071508 - RNA, 13 nt, Mycobacterium bovis subsp bovis AF2122/97
cagcagccgccga

SEQ ID NO: 1071509 - RNA, 17 nt, Mycobacterium bovis subsp bovis AF2122/97
cagcagguccgcggccg

SEQ ID NO: 1071510 - RNA, 19 nt, Mycobacterium bovis subsp bovis AF2122/97
cagcagguccgcggccgcg

SEQ ID NO: 1071511 - RNA, 18 nt, Mycobacterium bovis subsp bovis AF2122/97
cagcaggugcaucgccac

SEQ ID NO: 1071512 - RNA, 14 nt, Mycobacterium bovis subsp bovis AF2122/97
cagcaggucgucgg

SEQ ID NO: 1071513 - RNA, 21 nt, Mycobacterium bovis subsp bovis AF2122/97
cagcaggucgccugcccccgc

SEQ ID NO: 1071514 - RNA, 16 nt, Mycobacterium bovis subsp bovis AF2122/97
cagcagguugccgaag

SEQ ID NO: 1071515 - RNA, 21 nt, Mycobacterium bovis subsp bovis AF2122/97
cagcaggugccaaccgcggcg

SEQ ID NO: 1071516 - RNA, 23 nt, Mycobacterium bovis subsp bovis AF2122/97
cagcaggugccaaccgcggcgau

SEQ ID NO: 1071517 - RNA, 21 nt, Mycobacterium bovis subsp bovis AF2122/97
cagcaggucgucggcgucgcg

SEQ ID NO: 1071518 - RNA, 21 nt, Mycobacterium bovis subsp bovis AF2122/97
cagcagguuguaguccgcgcc

SEQ ID NO: 1071519 - RNA, 22 nt, Mycobacterium bovis subsp bovis AF2122/97
cagcagguuguaguccgcgccg

SEQ ID NO: 1071520 - RNA, 12 nt, Mycobacterium bovis subsp bovis AF2122/97
cagcaguacuaa

SEQ ID NO: 1071521 - RNA, 20 nt, Mycobacterium bovis subsp bovis AF2122/97
cagcaguacuaacaacacca

SEQ ID NO: 1071522 - RNA, 22 nt, Mycobacterium bovis subsp bovis AF2122/97
cagcaguagaucggaucgaagu

SEQ ID NO: 1071523 - RNA, 19 nt, Mycobacterium bovis subsp bovis AF2122/97
cagcagguuuucgaucugg

SEQ ID NO: 1071524 - RNA, 14 nt, Mycobacterium bovis subsp bovis AF2122/97
cagcaguacaccgc

SEQ ID NO: 1071525 - RNA, 16 nt, Mycobacterium bovis subsp bovis AF2122/97
cagcaguacaccgccc

SEQ ID NO: 1071526 - RNA, 18 nt, Mycobacterium bovis subsp bovis AF2122/97
cagcauauccgccggcga

SEQ ID NO: 1071527 - RNA, 18 nt, Mycobacterium bovis subsp bovis AF2122/97
cagcaucaacaccggcug

SEQ ID NO: 1071528 - RNA, 12 nt, Mycobacterium bovis subsp bovis AF2122/97
cagcacgucgcg

SEQ ID NO: 1071529 - RNA, 13 nt, Mycobacterium bovis subsp bovis AF2122/97
cagcacgucgcgg

SEQ ID NO: 1071530 - RNA, 19 nt, Mycobacterium bovis subsp bovis AF2122/97
cagcacguggaccggcacg

SEQ ID NO: 1071531 - RNA, 15 nt, Mycobacterium bovis subsp bovis AF2122/97
cagcacgugugcggg

SEQ ID NO: 1071532 - RNA, 21 nt, Mycobacterium bovis subsp bovis AF2122/97
cagcacucggugucggccgcg

SEQ ID NO: 1071533 - RNA, 22 nt, Mycobacterium bovis subsp bovis AF2122/97
cagcacucuucgaugaagcugg

SEQ ID NO: 1071534 - RNA, 17 nt, Mycobacterium bovis subsp bovis AF2122/97
cagcagauccaggcguc

SEQ ID NO: 1071535 - RNA, 22 nt, Mycobacterium bovis subsp bovis AF2122/97
cagcagauccaggcgucgguga

SEQ ID NO: 1071536 - RNA, 21 nt, Mycobacterium bovis subsp bovis AF2122/97
cagcacuccaccgcuggcccg

SEQ ID NO: 1071537 - RNA, 16 nt, Mycobacterium bovis subsp bovis AF2122/97
cagcacuccggcgacg

SEQ ID NO: 1071538 - RNA, 14 nt, Mycobacterium bovis subsp bovis AF2122/97
cagcacucgguguc

SEQ ID NO: 1071539 - RNA, 23 nt, Mycobacterium bovis subsp bovis AF2122/97
cagcagauugucgacggucaccg

SEQ ID NO: 1071540 - RNA, 22 nt, Mycobacterium bovis subsp bovis AF2122/97
cagcagauugucgacggucacc

SEQ ID NO: 1071541 - RNA, 23 nt, Mycobacterium bovis subsp bovis AF2122/97
cagcagcaaacaucgcaggcacc

SEQ ID NO: 1071542 - RNA, 16 nt, Mycobacterium bovis subsp bovis AF2122/97
cagcagcaaccgccau

SEQ ID NO: 1071543 - RNA, 12 nt, Mycobacterium bovis subsp bovis AF2122/97
cagcagcagugc

SEQ ID NO: 1071544 - RNA, 16 nt, Mycobacterium bovis subsp bovis AF2122/97
cagcagcauccggccg

SEQ ID NO: 1071545 - RNA, 15 nt, Mycobacterium bovis subsp bovis AF2122/97
cagcagcccgguggu

SEQ ID NO: 1071546 - RNA, 20 nt, Mycobacterium bovis subsp bovis AF2122/97
cagcagcccccgcugaccgu

SEQ ID NO: 1071547 - RNA, 14 nt, Mycobacterium bovis subsp bovis AF2122/97
cagcagccacccga

SEQ ID NO: 1071548 - RNA, 13 nt, Mycobacterium bovis subsp bovis AF2122/97
cagcacggcgacg

SEQ ID NO: 1071549 - RNA, 17 nt, Mycobacterium bovis subsp bovis AF2122/97
cagcacggcgaucggug

SEQ ID NO: 1071550 - RNA, 13 nt, Mycobacterium bovis subsp bovis AF2122/97
cagcacggcgccg

SEQ ID NO: 1071551 - RNA, 14 nt, Mycobacterium bovis subsp bovis AF2122/97
cagcacggcgccgc

SEQ ID NO: 1071552 - RNA, 18 nt, Mycobacterium bovis subsp bovis AF2122/97
cagcacggcgccgccacg

SEQ ID NO: 1071553 - RNA, 20 nt, Mycobacterium bovis subsp bovis AF2122/97
cagcacgggugagcaccacg

SEQ ID NO: 1071554 - RNA, 19 nt, Mycobacterium bovis subsp bovis AF2122/97
cagcacggcuucgcgguug

SEQ ID NO: 1071555 - RNA, 23 nt, Mycobacterium bovis subsp bovis AF2122/97
cagcacggcuucgcgguuggcgg

SEQ ID NO: 1071556 - RNA, 13 nt, Mycobacterium bovis subsp bovis AF2122/97
cagcacggcgauc

SEQ ID NO: 1071557 - RNA, 16 nt, Mycobacterium bovis subsp bovis AF2122/97
cagcacggcggccacg

SEQ ID NO: 1071558 - RNA, 13 nt, Mycobacterium bovis subsp bovis AF2122/97
cagcacgucguug

SEQ ID NO: 1071559 - RNA, 20 nt, Mycobacterium bovis subsp bovis AF2122/97
cagcacgucguugugcagau

SEQ ID NO: 1071560 - RNA, 22 nt, Mycobacterium bovis subsp bovis AF2122/97
cagcacgguguacgcccgcucg

SEQ ID NO: 1071561 - RNA, 18 nt, Mycobacterium bovis subsp bovis AF2122/97
cagcacguacugcuccuc

SEQ ID NO: 1071562 - RNA, 23 nt, Mycobacterium bovis subsp bovis AF2122/97
cagcacgguguacgcccgcucgg

SEQ ID NO: 1071563 - RNA, 16 nt, Mycobacterium bovis subsp bovis AF2122/97
cagcacgguuguugua

SEQ ID NO: 1071564 - RNA, 16 nt, Mycobacterium bovis subsp bovis AF2122/97
cagcaccucgaccgcc

SEQ ID NO: 1071565 - RNA, 18 nt, Mycobacterium bovis subsp bovis AF2122/97
cagcaccucgaccgccaa

SEQ ID NO: 1071566 - RNA, 21 nt, Mycobacterium bovis subsp bovis AF2122/97
cagcaccucgaccgccaaccu

SEQ ID NO: 1071567 - RNA, 16 nt, Mycobacterium bovis subsp bovis AF2122/97
cagcacgauccagcug

SEQ ID NO: 1071568 - RNA, 18 nt, Mycobacterium bovis subsp bovis AF2122/97
cagcacgauccagcugua

SEQ ID NO: 1071569 - RNA, 14 nt, Mycobacterium bovis subsp bovis AF2122/97
cagcacgccgccgg

SEQ ID NO: 1071570 - RNA, 18 nt, Mycobacterium bovis subsp bovis AF2122/97
cagcacgccgccggccgc

SEQ ID NO: 1071571 - RNA, 21 nt, Mycobacterium bovis subsp bovis AF2122/97
cagcacgccgccggccgccag

SEQ ID NO: 1071572 - RNA, 13 nt, Mycobacterium bovis subsp bovis AF2122/97
cagcacgcccgaa

SEQ ID NO: 1071573 - RNA, 13 nt, Mycobacterium bovis subsp bovis AF2122/97
cagcacgcccgcg

SEQ ID NO: 1071574 - RNA, 16 nt, Mycobacterium bovis subsp bovis AF2122/97
cagcacgcccucgacg

SEQ ID NO: 1071575 - RNA, 22 nt, Mycobacterium bovis subsp bovis AF2122/97
cagcacgcccucgacgcgcucg

SEQ ID NO: 1071576 - RNA, 18 nt, Mycobacterium bovis subsp bovis AF2122/97
cagcaccggcucgacugc

SEQ ID NO: 1071577 - RNA, 20 nt, Mycobacterium bovis subsp bovis AF2122/97
cagcaccggggacagcccgg

SEQ ID NO: 1071578 - RNA, 22 nt, Mycobacterium bovis subsp bovis AF2122/97
cagcaccgugacagcggcauug

SEQ ID NO: 1071579 - RNA, 16 nt, Mycobacterium bovis subsp bovis AF2122/97
cagcaccgucgggccc

SEQ ID NO: 1071580 - RNA, 19 nt, Mycobacterium bovis subsp bovis AF2122/97
cagcaccgucggcaccagc

SEQ ID NO: 1071581 - RNA, 14 nt, Mycobacterium bovis subsp bovis AF2122/97
cagcaccguacggc

SEQ ID NO: 1071582 - RNA, 17 nt, Mycobacterium bovis subsp bovis AF2122/97
cagcaccguucgcagca

SEQ ID NO: 1071583 - RNA, 19 nt, Mycobacterium bovis subsp bovis AF2122/97
cagcaccuccaccgcgccg

SEQ ID NO: 1071584 - RNA, 23 nt, Mycobacterium bovis subsp bovis AF2122/97
cagcaccuccaccgcgccggcgg

SEQ ID NO: 1071585 - RNA, 16 nt, Mycobacterium bovis subsp bovis AF2122/97
cagcaccagcgccuug

SEQ ID NO: 1071586 - RNA, 23 nt, Mycobacterium bovis subsp bovis AF2122/97
cagcaccacggcgcgcgcgccgg

SEQ ID NO: 1071587 - RNA, 19 nt, Mycobacterium bovis subsp bovis AF2122/97
cagcaccaggguggcccgg

SEQ ID NO: 1071588 - RNA, 22 nt, Mycobacterium bovis subsp bovis AF2122/97
cagcaccaggguggcccgggga

SEQ ID NO: 1071589 - RNA, 19 nt, Mycobacterium bovis subsp bovis AF2122/97
cagcacauccugcagcucg

SEQ ID NO: 1071590 - RNA, 22 nt, Mycobacterium bovis subsp bovis AF2122/97
cagcacauccugcagcucgggc

SEQ ID NO: 1071591 - RNA, 16 nt, Mycobacterium bovis subsp bovis AF2122/97
cagcacaggcuggcga

SEQ ID NO: 1071592 - RNA, 20 nt, Mycobacterium bovis subsp bovis AF2122/97
cagcacauucugcagcgucu

SEQ ID NO: 1071593 - RNA, 17 nt, Mycobacterium bovis subsp bovis AF2122/97
cagcacauucugcagcg

SEQ ID NO: 1071594 - RNA, 15 nt, Mycobacterium bovis subsp bovis AF2122/97
cagcaccaccagcag

SEQ ID NO: 1071595 - RNA, 17 nt, Mycobacterium bovis subsp bovis AF2122/97
cagcaccacgucgacga

SEQ ID NO: 1071596 - RNA, 19 nt, Mycobacterium bovis subsp bovis AF2122/97
cagcaccacgucgacgaug

SEQ ID NO: 1071597 - RNA, 23 nt, Mycobacterium bovis subsp bovis AF2122/97
cagcaccaaggucuucaggccgc

SEQ ID NO: 1071598 - RNA, 18 nt, Mycobacterium bovis subsp bovis AF2122/97
cagcaccacaacgucggc

SEQ ID NO: 1071599 - RNA, 15 nt, Mycobacterium bovis subsp bovis AF2122/97
cagcaaccgcucggc

SEQ ID NO: 1071600 - RNA, 15 nt, Mycobacterium bovis subsp bovis AF2122/97
cagcaacccgccguu

SEQ ID NO: 1071601 - RNA, 22 nt, Mycobacterium bovis subsp bovis AF2122/97
cagcaacccgccguugccaccg

SEQ ID NO: 1071602 - RNA, 18 nt, Mycobacterium bovis subsp bovis AF2122/97
cagauacuccgcgguugu

SEQ ID NO: 1071603 - RNA, 16 nt, Mycobacterium bovis subsp bovis AF2122/97
cagauacaucgggauc

SEQ ID NO: 1071604 - RNA, 21 nt, Mycobacterium bovis subsp bovis AF2122/97
cagcaacgacaaaccgggcgu

SEQ ID NO: 1071605 - RNA, 21 nt, Mycobacterium bovis subsp bovis AF2122/97
cagcaacgacccgaagccgac

SEQ ID NO: 1071606 - RNA, 14 nt, Mycobacterium bovis subsp bovis AF2122/97
cagcaacggcagcg

SEQ ID NO: 1071607 - RNA, 15 nt, Mycobacterium bovis subsp bovis AF2122/97
cagcaacggcggcgu

SEQ ID NO: 1071608 - RNA, 16 nt, Mycobacterium bovis subsp bovis AF2122/97
cagcaacggcggcguc

SEQ ID NO: 1071609 - RNA, 14 nt, Mycobacterium bovis subsp bovis AF2122/97
cagcaacggcaucc

SEQ ID NO: 1071610 - RNA, 20 nt, Mycobacterium bovis subsp bovis AF2122/97
cagcacagcauuguccggcg

SEQ ID NO: 1071611 - RNA, 13 nt, Mycobacterium bovis subsp bovis AF2122/97
cagcacaccgccc

SEQ ID NO: 1071612 - RNA, 14 nt, Mycobacterium bovis subsp bovis AF2122/97
cagcacaccgcccg

SEQ ID NO: 1071613 - RNA, 15 nt, Mycobacterium bovis subsp bovis AF2122/97
cagcacaccgguuga

SEQ ID NO: 1071614 - RNA, 13 nt, Mycobacterium bovis subsp bovis AF2122/97
cagcacaccgucg

SEQ ID NO: 1071615 - RNA, 16 nt, Mycobacterium bovis subsp bovis AF2122/97
cagcacaccgucgacg

SEQ ID NO: 1071616 - RNA, 23 nt, Mycobacterium bovis subsp bovis AF2122/97
cagcgucacccugucgcgcaccg

SEQ ID NO: 1071617 - RNA, 18 nt, Mycobacterium bovis subsp bovis AF2122/97
cagcgucauccucgucgu

SEQ ID NO: 1071618 - RNA, 21 nt, Mycobacterium bovis subsp bovis AF2122/97
cagcgucgacugaacgguuuc

SEQ ID NO: 1071619 - RNA, 12 nt, Mycobacterium bovis subsp bovis AF2122/97
cagcgucgacac

SEQ ID NO: 1071620 - RNA, 14 nt, Mycobacterium bovis subsp bovis AF2122/97
cagcgucaacagcg

SEQ ID NO: 1071621 - RNA, 14 nt, Mycobacterium bovis subsp bovis AF2122/97
cagcguccaaccca

SEQ ID NO: 1071622 - RNA, 20 nt, Mycobacterium bovis subsp bovis AF2122/97
cagcggcucuauccggcgca

SEQ ID NO: 1071623 - RNA, 13 nt, Mycobacterium bovis subsp bovis AF2122/97
cagcgggcugcgc

SEQ ID NO: 1071624 - RNA, 21 nt, Mycobacterium bovis subsp bovis AF2122/97
cagcgggggcagcgcgaacac

SEQ ID NO: 1071625 - RNA, 14 nt, Mycobacterium bovis subsp bovis AF2122/97
cagcggguccccgg

SEQ ID NO: 1071626 - RNA, 24 nt, Mycobacterium bovis subsp bovis AF2122/97
cagcggguccccggucaggacggc

SEQ ID NO: 1071627 - RNA, 23 nt, Mycobacterium bovis subsp bovis AF2122/97
cagcgggucgaccccggccagga

SEQ ID NO: 1071628 - RNA, 18 nt, Mycobacterium bovis subsp bovis AF2122/97
cagcggggucuugacggc

SEQ ID NO: 1071629 - RNA, 17 nt, Mycobacterium bovis subsp bovis AF2122/97
cagcggggugcugcgca

SEQ ID NO: 1071630 - RNA, 21 nt, Mycobacterium bovis subsp bovis AF2122/97
cagcguauuggacgcugccgc

SEQ ID NO: 1071631 - RNA, 22 nt, Mycobacterium bovis subsp bovis AF2122/97
cagcguauuggacgcugccgca

SEQ ID NO: 1071632 - RNA, 16 nt, Mycobacterium bovis subsp bovis AF2122/97
cagcguaucggccggc

SEQ ID NO: 1071633 - RNA, 17 nt, Mycobacterium bovis subsp bovis AF2122/97
cagcguaucggccggca

SEQ ID NO: 1071634 - RNA, 20 nt, Mycobacterium bovis subsp bovis AF2122/97
cagcgggugaaucgacaccg

SEQ ID NO: 1071635 - RNA, 14 nt, Mycobacterium bovis subsp bovis AF2122/97
cagcgggucgccgg

SEQ ID NO: 1071636 - RNA, 20 nt, Mycobacterium bovis subsp bovis AF2122/97
cagcgggucgcgggugccga

SEQ ID NO: 1071637 - RNA, 21 nt, Mycobacterium bovis subsp bovis AF2122/97
cagcgccuccagcaccacggc

SEQ ID NO: 1071638 - RNA, 18 nt, Mycobacterium bovis subsp bovis AF2122/97
cagcggcgucgucgucga

SEQ ID NO: 1071639 - RNA, 13 nt, Mycobacterium bovis subsp bovis AF2122/97
cagcggcucggcg

SEQ ID NO: 1071640 - RNA, 14 nt, Mycobacterium bovis subsp bovis AF2122/97
cagcggcucggcgg

SEQ ID NO: 1071641 - RNA, 22 nt, Mycobacterium bovis subsp bovis AF2122/97
cagcggcgggggcgucgccgcc

SEQ ID NO: 1071642 - RNA, 23 nt, Mycobacterium bovis subsp bovis AF2122/97
cagcggcgggggcgucgccgccg

SEQ ID NO: 1071643 - RNA, 20 nt, Mycobacterium bovis subsp bovis AF2122/97
cagcggcggucucggcgucg

SEQ ID NO: 1071644 - RNA, 14 nt, Mycobacterium bovis subsp bovis AF2122/97
cagcggcggcgucg

SEQ ID NO: 1071645 - RNA, 17 nt, Mycobacterium bovis subsp bovis AF2122/97
cagcggcggcgucgacg

SEQ ID NO: 1071646 - RNA, 18 nt, Mycobacterium bovis subsp bovis AF2122/97
cagcggcggcgucgacgg

SEQ ID NO: 1071647 - RNA, 19 nt, Mycobacterium bovis subsp bovis AF2122/97
cagcgccuccacucuucgg

SEQ ID NO: 1071648 - RNA, 21 nt, Mycobacterium bovis subsp bovis AF2122/97
cagcgccucauccuccaguuc

SEQ ID NO: 1071649 - RNA, 20 nt, Mycobacterium bovis subsp bovis AF2122/97
cagcgccguggcgcggucgg

SEQ ID NO: 1071650 - RNA, 23 nt, Mycobacterium bovis subsp bovis AF2122/97
cagcgccggauggguggccagca

SEQ ID NO: 1071651 - RNA, 12 nt, Mycobacterium bovis subsp bovis AF2122/97
cagcgccggcca

SEQ ID NO: 1071652 - RNA, 21 nt, Mycobacterium bovis subsp bovis AF2122/97
cagcgccgcggcuacaucggc

SEQ ID NO: 1071653 - RNA, 22 nt, Mycobacterium bovis subsp bovis AF2122/97
cagcgccgcggcuacaucggcg

SEQ ID NO: 1071654 - RNA, 13 nt, Mycobacterium bovis subsp bovis AF2122/97
cagcgccgcgcgg

SEQ ID NO: 1071655 - RNA, 21 nt, Mycobacterium bovis subsp bovis AF2122/97
cagcgccgcguggcuggcggc

SEQ ID NO: 1071656 - RNA, 16 nt, Mycobacterium bovis subsp bovis AF2122/97
cagcgucgaucgugcg

SEQ ID NO: 1071657 - RNA, 19 nt, Mycobacterium bovis subsp bovis AF2122/97
cagcgucccggucgccaaa

SEQ ID NO: 1071658 - RNA, 12 nt, Mycobacterium bovis subsp bovis AF2122/97
cagcgucgcacg

SEQ ID NO: 1071659 - RNA, 23 nt, Mycobacterium bovis subsp bovis AF2122/97
cagcgucgcacgcgcgcaggccg

SEQ ID NO: 1071660 - RNA, 17 nt, Mycobacterium bovis subsp bovis AF2122/97
cagcgucuggccgucgc

SEQ ID NO: 1071661 - RNA, 16 nt, Mycobacterium bovis subsp bovis AF2122/97
cagcgucucucgcagc

SEQ ID NO: 1071662 - RNA, 17 nt, Mycobacterium bovis subsp bovis AF2122/97
cagcgucucucgcagcu

SEQ ID NO: 1071663 - RNA, 21 nt, Mycobacterium bovis subsp bovis AF2122/97
cagcgucucucgcagcuccuc

SEQ ID NO: 1071664 - RNA, 20 nt, Mycobacterium bovis subsp bovis AF2122/97
cagcgucugagcgccggcau

SEQ ID NO: 1071665 - RNA, 14 nt, Mycobacterium bovis subsp bovis AF2122/97
cagcgugaccaccg

SEQ ID NO: 1071666 - RNA, 20 nt, Mycobacterium bovis subsp bovis AF2122/97
cagcgugaccaccgccgaca

SEQ ID NO: 1071667 - RNA, 20 nt, Mycobacterium bovis subsp bovis AF2122/97
cagcgucucggaggcgacca

SEQ ID NO: 1071668 - RNA, 17 nt, Mycobacterium bovis subsp bovis AF2122/97
cagcuaguggccgagua

SEQ ID NO: 1071669 - RNA, 22 nt, Mycobacterium bovis subsp bovis AF2122/97
cagcuaucccaggggcaccgag

SEQ ID NO: 1071670 - RNA, 19 nt, Mycobacterium bovis subsp bovis AF2122/97
cagcuagcccggcagcacg

SEQ ID NO: 1071671 - RNA, 14 nt, Mycobacterium bovis subsp bovis AF2122/97
cagcuaccuccgcc

SEQ ID NO: 1071672 - RNA, 20 nt, Mycobacterium bovis subsp bovis AF2122/97
cagcucacccggagcacccg

SEQ ID NO: 1071673 - RNA, 15 nt, Mycobacterium bovis subsp bovis AF2122/97
cagcguuggcggcga

SEQ ID NO: 1071674 - RNA, 21 nt, Mycobacterium bovis subsp bovis AF2122/97
cagcguugucggguggcugcu

SEQ ID NO: 1071675 - RNA, 14 nt, Mycobacterium bovis subsp bovis AF2122/97
cagcguucccgccg

SEQ ID NO: 1071676 - RNA, 21 nt, Mycobacterium bovis subsp bovis AF2122/97
cagcguucgguugaacgaccu

SEQ ID NO: 1071677 - RNA, 17 nt, Mycobacterium bovis subsp bovis AF2122/97
cagcguuugcuggcgga

SEQ ID NO: 1071678 - RNA, 19 nt, Mycobacterium bovis subsp bovis AF2122/97
cagcucgaacagcucgauc

SEQ ID NO: 1071679 - RNA, 19 nt, Mycobacterium bovis subsp bovis AF2122/97
cagcuccgggucgacgacg

SEQ ID NO: 1071680 - RNA, 18 nt, Mycobacterium bovis subsp bovis AF2122/97
cagcuccucgcgcucgcc

SEQ ID NO: 1071681 - RNA, 19 nt, Mycobacterium bovis subsp bovis AF2122/97
cagcuccucgcgcucgccg

SEQ ID NO: 1071682 - RNA, 20 nt, Mycobacterium bovis subsp bovis AF2122/97
cagcuccucgcgcucgccgg

SEQ ID NO: 1071683 - RNA, 22 nt, Mycobacterium bovis subsp bovis AF2122/97
cagcuccucgcgcucgccggug

SEQ ID NO: 1071684 - RNA, 23 nt, Mycobacterium bovis subsp bovis AF2122/97
cagcuccucgcgcucgccggugu

SEQ ID NO: 1071685 - RNA, 17 nt, Mycobacterium bovis subsp bovis AF2122/97
cagcucgaacagguugg

SEQ ID NO: 1071686 - RNA, 18 nt, Mycobacterium bovis subsp bovis AF2122/97
cagcucgaacagguuggc

SEQ ID NO: 1071687 - RNA, 15 nt, Mycobacterium bovis subsp bovis AF2122/97
cagcucgaccaggaa

SEQ ID NO: 1071688 - RNA, 15 nt, Mycobacterium bovis subsp bovis AF2122/97
cagcuccgccgccga

SEQ ID NO: 1071689 - RNA, 21 nt, Mycobacterium bovis subsp bovis AF2122/97
cagcucccgccacgucgccgg

SEQ ID NO: 1071690 - RNA, 20 nt, Mycobacterium bovis subsp bovis AF2122/97
cagcuccgugacaccgggga

SEQ ID NO: 1071691 - RNA, 13 nt, Mycobacterium bovis subsp bovis AF2122/97
cagcuccggcgac

SEQ ID NO: 1071692 - RNA, 15 nt, Mycobacterium bovis subsp bovis AF2122/97
cagcuccccgccgga

SEQ ID NO: 1071693 - RNA, 17 nt, Mycobacterium bovis subsp bovis AF2122/97
cagcuccacuggcgucu

SEQ ID NO: 1071694 - RNA, 16 nt, Mycobacterium bovis subsp bovis AF2122/97
cagcucacgcugaagc

SEQ ID NO: 1071695 - RNA, 17 nt, Mycobacterium bovis subsp bovis AF2122/97
cagcucacccugcucga

SEQ ID NO: 1071696 - RNA, 14 nt, Mycobacterium bovis subsp bovis AF2122/97
cagcucaccgacgg

SEQ ID NO: 1071697 - RNA, 19 nt, Mycobacterium bovis subsp bovis AF2122/97
cagcucaucgcgcacgccc

SEQ ID NO: 1071698 - RNA, 18 nt, Mycobacterium bovis subsp bovis AF2122/97
cagcucaucgauccucgc

SEQ ID NO: 1071699 - RNA, 13 nt, Mycobacterium bovis subsp bovis AF2122/97
cagcucaucgcgc

SEQ ID NO: 1071700 - RNA, 21 nt, Mycobacterium bovis subsp bovis AF2122/97
cagcucacggacgcugggcgg

SEQ ID NO: 1071701 - RNA, 20 nt, Mycobacterium bovis subsp bovis AF2122/97
cagcucagugaugcgccccg

SEQ ID NO: 1071702 - RNA, 19 nt, Mycobacterium bovis subsp bovis AF2122/97
cagcucgcgggccgcgucg

SEQ ID NO: 1071703 - RNA, 14 nt, Mycobacterium bovis subsp bovis AF2122/97
cagcucggcaacgu

SEQ ID NO: 1071704 - RNA, 18 nt, Mycobacterium bovis subsp bovis AF2122/97
cagcucggcacccgccgg

SEQ ID NO: 1071705 - RNA, 16 nt, Mycobacterium bovis subsp bovis AF2122/97
cagcucggcggcagcg

SEQ ID NO: 1071706 - RNA, 20 nt, Mycobacterium bovis subsp bovis AF2122/97
cagcucggcggcagcggcgg

SEQ ID NO: 1071707 - RNA, 20 nt, Mycobacterium bovis subsp bovis AF2122/97
cagcucggguugcgcgaugg

SEQ ID NO: 1071708 - RNA, 16 nt, Mycobacterium bovis subsp bovis AF2122/97
cagcucgggggcgccg

SEQ ID NO: 1071709 - RNA, 17 nt, Mycobacterium bovis subsp bovis AF2122/97
cagcucgggggcgccgg

SEQ ID NO: 1071710 - RNA, 22 nt, Mycobacterium bovis subsp bovis AF2122/97
cagcucgggggcgccggcgccc

SEQ ID NO: 1071711 - RNA, 16 nt, Mycobacterium bovis subsp bovis AF2122/97
cagcucggggcgauga

SEQ ID NO: 1071712 - RNA, 14 nt, Mycobacterium bovis subsp bovis AF2122/97
cagcucggugaugu

SEQ ID NO: 1071713 - RNA, 19 nt, Mycobacterium bovis subsp bovis AF2122/97
cagcucggugacaagcggc

SEQ ID NO: 1071714 - RNA, 23 nt, Mycobacterium bovis subsp bovis AF2122/97
cagcucggugcacggcgcuacca

SEQ ID NO: 1071715 - RNA, 17 nt, Mycobacterium bovis subsp bovis AF2122/97
cagcucgagcgccucgg

SEQ ID NO: 1071716 - RNA, 16 nt, Mycobacterium bovis subsp bovis AF2122/97
cagcucgaucacgccg

SEQ ID NO: 1071717 - RNA, 18 nt, Mycobacterium bovis subsp bovis AF2122/97
cagcucgaucacgccggc

SEQ ID NO: 1071718 - RNA, 20 nt, Mycobacterium bovis subsp bovis AF2122/97
cagcucgaucacgccggccu

SEQ ID NO: 1071719 - RNA, 14 nt, Mycobacterium bovis subsp bovis AF2122/97
cagcucgcgguggg

SEQ ID NO: 1071720 - RNA, 13 nt, Mycobacterium bovis subsp bovis AF2122/97
cagcucggccagg

SEQ ID NO: 1071721 - RNA, 19 nt, Mycobacterium bovis subsp bovis AF2122/97
cagcucggccaggcuggcc

SEQ ID NO: 1071722 - RNA, 21 nt, Mycobacterium bovis subsp bovis AF2122/97
cagcucggccagugccgguuc

SEQ ID NO: 1071723 - RNA, 14 nt, Mycobacterium bovis subsp bovis AF2122/97
cagcucgcgcacgu

SEQ ID NO: 1071724 - RNA, 22 nt, Mycobacterium bovis subsp bovis AF2122/97
cagcucgcgcucgcucacgccg

SEQ ID NO: 1071725 - RNA, 17 nt, Mycobacterium bovis subsp bovis AF2122/97
cagcugcaaugacugga

SEQ ID NO: 1071726 - RNA, 23 nt, Mycobacterium bovis subsp bovis AF2122/97
cagcugcaaugacuggaccgcgg

SEQ ID NO: 1071727 - RNA, 19 nt, Mycobacterium bovis subsp bovis AF2122/97
cagcugagcggccggcaug

SEQ ID NO: 1071728 - RNA, 15 nt, Mycobacterium bovis subsp bovis AF2122/97
cagcugacgggccgc

SEQ ID NO: 1071729 - RNA, 14 nt, Mycobacterium bovis subsp bovis AF2122/97
cagcugacggcgca

SEQ ID NO: 1071730 - RNA, 17 nt, Mycobacterium bovis subsp bovis AF2122/97
cagcugacgucaccacg

SEQ ID NO: 1071731 - RNA, 15 nt, Mycobacterium bovis subsp bovis AF2122/97
cagcugagccgucgg

SEQ ID NO: 1071732 - RNA, 17 nt, Mycobacterium bovis subsp bovis AF2122/97
cagcucgucgucggcgu

SEQ ID NO: 1071733 - RNA, 15 nt, Mycobacterium bovis subsp bovis AF2122/97
cagcucgucgacguc

SEQ ID NO: 1071734 - RNA, 12 nt, Mycobacterium bovis subsp bovis AF2122/97
cagcucgucggc

SEQ ID NO: 1071735 - RNA, 15 nt, Mycobacterium bovis subsp bovis AF2122/97
cagcugaaucgggau

SEQ ID NO: 1071736 - RNA, 23 nt, Mycobacterium bovis subsp bovis AF2122/97
cagcugaaaauaggccgggcagu

SEQ ID NO: 1071737 - RNA, 18 nt, Mycobacterium bovis subsp bovis AF2122/97
cagcugggcaucaccgcc

SEQ ID NO: 1071738 - RNA, 19 nt, Mycobacterium bovis subsp bovis AF2122/97
cagcugggcaucaccgccg

SEQ ID NO: 1071739 - RNA, 20 nt, Mycobacterium bovis subsp bovis AF2122/97
cagcugggcaucaccgccgc

SEQ ID NO: 1071740 - RNA, 21 nt, Mycobacterium bovis subsp bovis AF2122/97
cagcugggcaucaucagcggc

SEQ ID NO: 1071741 - RNA, 19 nt, Mycobacterium bovis subsp bovis AF2122/97
cagcuggcggcagcgguuu

SEQ ID NO: 1071742 - RNA, 20 nt, Mycobacterium bovis subsp bovis AF2122/97
cagcuggcgcagccugccga

SEQ ID NO: 1071743 - RNA, 14 nt, Mycobacterium bovis subsp bovis AF2122/97
cagcugggcgacca

SEQ ID NO: 1071744 - RNA, 20 nt, Mycobacterium bovis subsp bovis AF2122/97
cagcugggucccgcuggcau

SEQ ID NO: 1071745 - RNA, 17 nt, Mycobacterium bovis subsp bovis AF2122/97
cagcugguugugcuggg

SEQ ID NO: 1071746 - RNA, 13 nt, Mycobacterium bovis subsp bovis AF2122/97
cagcuggucgugg

SEQ ID NO: 1071747 - RNA, 13 nt, Mycobacterium bovis subsp bovis AF2122/97
cagcuggcgacgg

SEQ ID NO: 1071748 - RNA, 15 nt, Mycobacterium bovis subsp bovis AF2122/97
cagcuggcggcagcg

SEQ ID NO: 1071749 - RNA, 11 nt, Mycobacterium bovis subsp bovis AF2122/97
cagcuggccgc

SEQ ID NO: 1071750 - RNA, 17 nt, Mycobacterium bovis subsp bovis AF2122/97
cagcuggacggccucca

SEQ ID NO: 1071751 - RNA, 13 nt, Mycobacterium bovis subsp bovis AF2122/97
cagcuggacuccg

SEQ ID NO: 1071752 - RNA, 24 nt, Mycobacterium bovis subsp bovis AF2122/97
cagcuggacuccggucagcgcggc

SEQ ID NO: 1071753 - RNA, 18 nt, Mycobacterium bovis subsp bovis AF2122/97
cagcugcgcaucgccacc

SEQ ID NO: 1071754 - RNA, 13 nt, Mycobacterium bovis subsp bovis AF2122/97
cagcugcgccagg

SEQ ID NO: 1071755 - RNA, 22 nt, Mycobacterium bovis subsp bovis AF2122/97
cagcugcccgccagcgccgccg

SEQ ID NO: 1071756 - RNA, 21 nt, Mycobacterium bovis subsp bovis AF2122/97
cagcugcgcacgucgggcccg

SEQ ID NO: 1071757 - RNA, 16 nt, Mycobacterium bovis subsp bovis AF2122/97
cagcugcgcgggcgag

SEQ ID NO: 1071758 - RNA, 17 nt, Mycobacterium bovis subsp bovis AF2122/97
cagcugcgcgggcgagu

SEQ ID NO: 1071759 - RNA, 16 nt, Mycobacterium bovis subsp bovis AF2122/97
cagcugcggacuggca

SEQ ID NO: 1071760 - RNA, 19 nt, Mycobacterium bovis subsp bovis AF2122/97
cagcugcggauccaccacg

SEQ ID NO: 1071761 - RNA, 16 nt, Mycobacterium bovis subsp bovis AF2122/97
cagcugcggcuccggc

SEQ ID NO: 1071762 - RNA, 22 nt, Mycobacterium bovis subsp bovis AF2122/97
cagcugcuggaugucgucgacg

SEQ ID NO: 1071763 - RNA, 15 nt, Mycobacterium bovis subsp bovis AF2122/97
cagcugcggucgcgg

SEQ ID NO: 1071764 - RNA, 23 nt, Mycobacterium bovis subsp bovis AF2122/97
cagcugcggguucacuuccgggc

SEQ ID NO: 1071765 - RNA, 22 nt, Mycobacterium bovis subsp bovis AF2122/97
cagcugcggacuggcauccgcc

SEQ ID NO: 1071766 - RNA, 21 nt, Mycobacterium bovis subsp bovis AF2122/97
cagcugcggauacagccgccg

SEQ ID NO: 1071767 - RNA, 23 nt, Mycobacterium bovis subsp bovis AF2122/97
cagcugcggauacagccgccgcc

SEQ ID NO: 1071768 - RNA, 16 nt, Mycobacterium bovis subsp bovis AF2122/97
cagcuguucgagccgc

SEQ ID NO: 1071769 - RNA, 15 nt, Mycobacterium bovis subsp bovis AF2122/97
cagcuguucggccaa

SEQ ID NO: 1071770 - RNA, 18 nt, Mycobacterium bovis subsp bovis AF2122/97
cagcuguucggccaaccc

SEQ ID NO: 1071771 - RNA, 22 nt, Mycobacterium bovis subsp bovis AF2122/97
cagcugugaacaggccgaggcg

SEQ ID NO: 1071772 - RNA, 15 nt, Mycobacterium bovis subsp bovis AF2122/97
cagcugugcgacccg

SEQ ID NO: 1071773 - RNA, 22 nt, Mycobacterium bovis subsp bovis AF2122/97
cagcugucauccccggccagcc

SEQ ID NO: 1071774 - RNA, 17 nt, Mycobacterium bovis subsp bovis AF2122/97
cagcuguccucgcgggc

SEQ ID NO: 1071775 - RNA, 17 nt, Mycobacterium bovis subsp bovis AF2122/97
cagcugugaacaggccg

SEQ ID NO: 1071776 - RNA, 18 nt, Mycobacterium bovis subsp bovis AF2122/97
cagcugugaacaggccga

SEQ ID NO: 1071777 - RNA, 15 nt, Mycobacterium bovis subsp bovis AF2122/97
cagcuuccgcugaac

SEQ ID NO: 1071778 - RNA, 21 nt, Mycobacterium bovis subsp bovis AF2122/97
cagcuucucagcaccaugcuc

SEQ ID NO: 1071779 - RNA, 15 nt, Mycobacterium bovis subsp bovis AF2122/97
cagcuucaacaccgg

SEQ ID NO: 1071780 - RNA, 22 nt, Mycobacterium bovis subsp bovis AF2122/97
cagcuugcccgagcccagccgg

SEQ ID NO: 1071781 - RNA, 16 nt, Mycobacterium bovis subsp bovis AF2122/97
cagcuugcccgacggc

SEQ ID NO: 1071782 - RNA, 16 nt, Mycobacterium bovis subsp bovis AF2122/97
cagcuugccgaccugc

SEQ ID NO: 1071783 - RNA, 18 nt, Mycobacterium bovis subsp bovis AF2122/97
cagcuugcggagccgccg

SEQ ID NO: 1071784 - RNA, 16 nt, Mycobacterium bovis subsp bovis AF2122/97
cagcuugcugcgcacc

SEQ ID NO: 1071785 - RNA, 17 nt, Mycobacterium bovis subsp bovis AF2122/97
cagcuuggagaucgccg

SEQ ID NO: 1071786 - RNA, 14 nt, Mycobacterium bovis subsp bovis AF2122/97
cagcuuggccagcc

SEQ ID NO: 1071787 - RNA, 13 nt, Mycobacterium bovis subsp bovis AF2122/97
cagcuuggccggu

SEQ ID NO: 1071788 - RNA, 20 nt, Mycobacterium bovis subsp bovis AF2122/97
cagcuugaccgaccacgcga

SEQ ID NO: 1071789 - RNA, 15 nt, Mycobacterium bovis subsp bovis AF2122/97
caggccggcggcggu

SEQ ID NO: 1071790 - RNA, 14 nt, Mycobacterium bovis subsp bovis AF2122/97
caggccggcggcgg

SEQ ID NO: 1071791 - RNA, 20 nt, Mycobacterium bovis subsp bovis AF2122/97
caggccggcucgccgacccg

SEQ ID NO: 1071792 - RNA, 18 nt, Mycobacterium bovis subsp bovis AF2122/97
caggccggcgucgaucaa

SEQ ID NO: 1071793 - RNA, 12 nt, Mycobacterium bovis subsp bovis AF2122/97
caggccggugac

SEQ ID NO: 1071794 - RNA, 19 nt, Mycobacterium bovis subsp bovis AF2122/97
caggccgggacagcgccgg

SEQ ID NO: 1071795 - RNA, 18 nt, Mycobacterium bovis subsp bovis AF2122/97
caggccguaguggccggc

SEQ ID NO: 1071796 - RNA, 16 nt, Mycobacterium bovis subsp bovis AF2122/97
caggccgucaccgacg

SEQ ID NO: 1071797 - RNA, 21 nt, Mycobacterium bovis subsp bovis AF2122/97
caggccgguuugcacgcacca

SEQ ID NO: 1071798 - RNA, 17 nt, Mycobacterium bovis subsp bovis AF2122/97
caggccguacgacggca

SEQ ID NO: 1071799 - RNA, 15 nt, Mycobacterium bovis subsp bovis AF2122/97
caggccgcaaugcgu

SEQ ID NO: 1071800 - RNA, 13 nt, Mycobacterium bovis subsp bovis AF2122/97
caggccgcacagc

SEQ ID NO: 1071801 - RNA, 17 nt, Mycobacterium bovis subsp bovis AF2122/97
caggccgccaccgucac

SEQ ID NO: 1071802 - RNA, 18 nt, Mycobacterium bovis subsp bovis AF2122/97
caggccgaucagcgcggc

SEQ ID NO: 1071803 - RNA, 19 nt, Mycobacterium bovis subsp bovis AF2122/97
caggcccuggccagcccga

SEQ ID NO: 1071804 - RNA, 17 nt, Mycobacterium bovis subsp bovis AF2122/97
caggcgaucgcccggcc

SEQ ID NO: 1071805 - RNA, 22 nt, Mycobacterium bovis subsp bovis AF2122/97
caggcgaucgcccggccccgca

SEQ ID NO: 1071806 - RNA, 15 nt, Mycobacterium bovis subsp bovis AF2122/97
caggcgaucuggccg

SEQ ID NO: 1071807 - RNA, 15 nt, Mycobacterium bovis subsp bovis AF2122/97
caggcgcgccgcacc

SEQ ID NO: 1071808 - RNA, 18 nt, Mycobacterium bovis subsp bovis AF2122/97
caggcgcgccgcacccgg

SEQ ID NO: 1071809 - RNA, 21 nt, Mycobacterium bovis subsp bovis AF2122/97
caggcgcgccgcacccgggac

SEQ ID NO: 1071810 - RNA, 17 nt, Mycobacterium bovis subsp bovis AF2122/97
caggcgaaguacccggc

SEQ ID NO: 1071811 - RNA, 14 nt, Mycobacterium bovis subsp bovis AF2122/97
caggcgaccgggga

SEQ ID NO: 1071812 - RNA, 19 nt, Mycobacterium bovis subsp bovis AF2122/97
caggcgaccggggaucggg

SEQ ID NO: 1071813 - RNA, 20 nt, Mycobacterium bovis subsp bovis AF2122/97
caggcgaccggggaucgggg

SEQ ID NO: 1071814 - RNA, 23 nt, Mycobacterium bovis subsp bovis AF2122/97
caggcgacgagcacacaacaccc

SEQ ID NO: 1071815 - RNA, 18 nt, Mycobacterium bovis subsp bovis AF2122/97
caggcgauaaagccgcug

SEQ ID NO: 1071816 - RNA, 16 nt, Mycobacterium bovis subsp bovis AF2122/97
caggcgagccgccacc

SEQ ID NO: 1071817 - RNA, 19 nt, Mycobacterium bovis subsp bovis AF2122/97
caggcgaaggcggcuucgc

SEQ ID NO: 1071818 - RNA, 19 nt, Mycobacterium bovis subsp bovis AF2122/97
caggcgaguuaggccgcca

SEQ ID NO: 1071819 - RNA, 20 nt, Mycobacterium bovis subsp bovis AF2122/97
caggcgaguuaggccgccag

SEQ ID NO: 1071820 - RNA, 12 nt, Mycobacterium bovis subsp bovis AF2122/97
caggccgucgcg

SEQ ID NO: 1071821 - RNA, 22 nt, Mycobacterium bovis subsp bovis AF2122/97
caggccgucgcgccucaucggc

SEQ ID NO: 1071822 - RNA, 13 nt, Mycobacterium bovis subsp bovis AF2122/97
caggccgucggcg

SEQ ID NO: 1071823 - RNA, 20 nt, Mycobacterium bovis subsp bovis AF2122/97
caggccgucgaguuccggcc

SEQ ID NO: 1071824 - RNA, 23 nt, Mycobacterium bovis subsp bovis AF2122/97
caggccgucgaguuccggccggu

SEQ ID NO: 1071825 - RNA, 13 nt, Mycobacterium bovis subsp bovis AF2122/97
caggccgucgaug

SEQ ID NO: 1071826 - RNA, 14 nt, Mycobacterium bovis subsp bovis AF2122/97
caggccgucgauga

SEQ ID NO: 1071827 - RNA, 19 nt, Mycobacterium bovis subsp bovis AF2122/97
caggccgucgaugaucugc

SEQ ID NO: 1071828 - RNA, 17 nt, Mycobacterium bovis subsp bovis AF2122/97
caggccgucggcgucga

SEQ ID NO: 1071829 - RNA, 14 nt, Mycobacterium bovis subsp bovis AF2122/97
caggccuggcgagc

SEQ ID NO: 1071830 - RNA, 16 nt, Mycobacterium bovis subsp bovis AF2122/97
caggccuuggugcggc

SEQ ID NO: 1071831 - RNA, 18 nt, Mycobacterium bovis subsp bovis AF2122/97
caggcgaacaccagaugg

SEQ ID NO: 1071832 - RNA, 15 nt, Mycobacterium bovis subsp bovis AF2122/97
caggcuugccgaugg

SEQ ID NO: 1071833 - RNA, 15 nt, Mycobacterium bovis subsp bovis AF2122/97
caggcuugcggcacc

SEQ ID NO: 1071834 - RNA, 20 nt, Mycobacterium bovis subsp bovis AF2122/97
caggcugggcagaccgaucg

SEQ ID NO: 1071835 - RNA, 20 nt, Mycobacterium bovis subsp bovis AF2122/97
cagggaaccauugcccgacg

SEQ ID NO: 1071836 - RNA, 23 nt, Mycobacterium bovis subsp bovis AF2122/97
cagggaaccauugcccgacgaug

SEQ ID NO: 1071837 - RNA, 20 nt, Mycobacterium bovis subsp bovis AF2122/97
cagggaagcaagggcgaugg

SEQ ID NO: 1071838 - RNA, 17 nt, Mycobacterium bovis subsp bovis AF2122/97
caggcuggcgauggccg

SEQ ID NO: 1071839 - RNA, 21 nt, Mycobacterium bovis subsp bovis AF2122/97
caggcucgggcaaggccaccg

SEQ ID NO: 1071840 - RNA, 13 nt, Mycobacterium bovis subsp bovis AF2122/97
caggcuccggccg

SEQ ID NO: 1071841 - RNA, 14 nt, Mycobacterium bovis subsp bovis AF2122/97
caggcuccggccgg

SEQ ID NO: 1071842 - RNA, 24 nt, Mycobacterium bovis subsp bovis AF2122/97
caggcucgagguguagcccuccga

SEQ ID NO: 1071843 - RNA, 14 nt, Mycobacterium bovis subsp bovis AF2122/97
caggcucgccgaug

SEQ ID NO: 1071844 - RNA, 18 nt, Mycobacterium bovis subsp bovis AF2122/97
caggcucacacucggccg

SEQ ID NO: 1071845 - RNA, 20 nt, Mycobacterium bovis subsp bovis AF2122/97
caggcucacacucggccggg

SEQ ID NO: 1071846 - RNA, 18 nt, Mycobacterium bovis subsp bovis AF2122/97
caggcucgaaccgacgcg

SEQ ID NO: 1071847 - RNA, 13 nt, Mycobacterium bovis subsp bovis AF2122/97
caggcucagcugg

SEQ ID NO: 1071848 - RNA, 20 nt, Mycobacterium bovis subsp bovis AF2122/97
caggcucagcugguggcggc

SEQ ID NO: 1071849 - RNA, 14 nt, Mycobacterium bovis subsp bovis AF2122/97
caggcucauccgcc

SEQ ID NO: 1071850 - RNA, 15 nt, Mycobacterium bovis subsp bovis AF2122/97
caggcgcgcaccacc

SEQ ID NO: 1071851 - RNA, 16 nt, Mycobacterium bovis subsp bovis AF2122/97
caggcgcgcaccaccg

SEQ ID NO: 1071852 - RNA, 15 nt, Mycobacterium bovis subsp bovis AF2122/97
caggcgcggcccagg

SEQ ID NO: 1071853 - RNA, 23 nt, Mycobacterium bovis subsp bovis AF2122/97
caggcgcggcgacaagccgagcc

SEQ ID NO: 1071854 - RNA, 15 nt, Mycobacterium bovis subsp bovis AF2122/97
caggcgcgucggugg

SEQ ID NO: 1071855 - RNA, 21 nt, Mycobacterium bovis subsp bovis AF2122/97
caggcgcucagcgcggccacg

SEQ ID NO: 1071856 - RNA, 24 nt, Mycobacterium bovis subsp bovis AF2122/97
caggcgcucagcgcggccacgccg

SEQ ID NO: 1071857 - RNA, 19 nt, Mycobacterium bovis subsp bovis AF2122/97
caggcgcucgaaggccgca

SEQ ID NO: 1071858 - RNA, 23 nt, Mycobacterium bovis subsp bovis AF2122/97
caggcgcugcagcauggcuccga

SEQ ID NO: 1071859 - RNA, 20 nt, Mycobacterium bovis subsp bovis AF2122/97
caggcgugucgucgcggccg

SEQ ID NO: 1071860 - RNA, 22 nt, Mycobacterium bovis subsp bovis AF2122/97
caggcgugucgucgcggccggu

SEQ ID NO: 1071861 - RNA, 15 nt, Mycobacterium bovis subsp bovis AF2122/97
caggcguucgacguc

SEQ ID NO: 1071862 - RNA, 19 nt, Mycobacterium bovis subsp bovis AF2122/97
caggcuaauagcucgccgg

SEQ ID NO: 1071863 - RNA, 21 nt, Mycobacterium bovis subsp bovis AF2122/97
caggcuaauagcucgccggcg

SEQ ID NO: 1071864 - RNA, 21 nt, Mycobacterium bovis subsp bovis AF2122/97
caggcuaccguuacccgggau

SEQ ID NO: 1071865 - RNA, 19 nt, Mycobacterium bovis subsp bovis AF2122/97
cagcuuggcgucgaugcgg

SEQ ID NO: 1071866 - RNA, 22 nt, Mycobacterium bovis subsp bovis AF2122/97
cagcuugggcagcagcgcgcgg

SEQ ID NO: 1071867 - RNA, 14 nt, Mycobacterium bovis subsp bovis AF2122/97
cagcuugucgggca

SEQ ID NO: 1071868 - RNA, 18 nt, Mycobacterium bovis subsp bovis AF2122/97
cagcuugugggcgacggc

SEQ ID NO: 1071869 - RNA, 20 nt, Mycobacterium bovis subsp bovis AF2122/97
cagcuuguuuuccaccagcg

SEQ ID NO: 1071870 - RNA, 20 nt, Mycobacterium bovis subsp bovis AF2122/97
caggaacaaguagccgucgu

SEQ ID NO: 1071871 - RNA, 18 nt, Mycobacterium bovis subsp bovis AF2122/97
cagcuuucuuggcgggcg

SEQ ID NO: 1071872 - RNA, 21 nt, Mycobacterium bovis subsp bovis AF2122/97
cagcuuugacgcccucggcga

SEQ ID NO: 1071873 - RNA, 20 nt, Mycobacterium bovis subsp bovis AF2122/97
caggaaaaccccggccacca

SEQ ID NO: 1071874 - RNA, 16 nt, Mycobacterium bovis subsp bovis AF2122/97
caggaacgccgugccg

SEQ ID NO: 1071875 - RNA, 21 nt, Mycobacterium bovis subsp bovis AF2122/97
caggaacgccgugccguacgc

SEQ ID NO: 1071876 - RNA, 16 nt, Mycobacterium bovis subsp bovis AF2122/97
caggaacggcucggcc

SEQ ID NO: 1071877 - RNA, 17 nt, Mycobacterium bovis subsp bovis AF2122/97
caggaacggcccgggau

SEQ ID NO: 1071878 - RNA, 15 nt, Mycobacterium bovis subsp bovis AF2122/97
caggaacucggccca

SEQ ID NO: 1071879 - RNA, 13 nt, Mycobacterium bovis subsp bovis AF2122/97
caggaaggcgacg

SEQ ID NO: 1071880 - RNA, 19 nt, Mycobacterium bovis subsp bovis AF2122/97
caggaaggcgacgccgaaa

SEQ ID NO: 1071881 - RNA, 15 nt, Mycobacterium bovis subsp bovis AF2122/97
caggaagcgguggcc

SEQ ID NO: 1071882 - RNA, 13 nt, Mycobacterium bovis subsp bovis AF2122/97
caggaagccgaga

SEQ ID NO: 1071883 - RNA, 14 nt, Mycobacterium bovis subsp bovis AF2122/97
caggaagcccacga

SEQ ID NO: 1071884 - RNA, 21 nt, Mycobacterium bovis subsp bovis AF2122/97
caggaagauuucugggccgcu

SEQ ID NO: 1071885 - RNA, 16 nt, Mycobacterium bovis subsp bovis AF2122/97
caggacuggcaccgcc

SEQ ID NO: 1071886 - RNA, 18 nt, Mycobacterium bovis subsp bovis AF2122/97
caggacgguugguccgcc

SEQ ID NO: 1071887 - RNA, 22 nt, Mycobacterium bovis subsp bovis AF2122/97
caggacgguugguccgccgucg

SEQ ID NO: 1071888 - RNA, 13 nt, Mycobacterium bovis subsp bovis AF2122/97
caggacuuggugg

SEQ ID NO: 1071889 - RNA, 23 nt, Mycobacterium bovis subsp bovis AF2122/97
caggagcaccucgaagugcaggu

SEQ ID NO: 1071890 - RNA, 16 nt, Mycobacterium bovis subsp bovis AF2122/97
caggagccgaucacgc

SEQ ID NO: 1071891 - RNA, 16 nt, Mycobacterium bovis subsp bovis AF2122/97
caggaucgccugagcg

SEQ ID NO: 1071892 - RNA, 16 nt, Mycobacterium bovis subsp bovis AF2122/97
caggaugaagacgcgg

SEQ ID NO: 1071893 - RNA, 16 nt, Mycobacterium bovis subsp bovis AF2122/97
caggaucgcggcgccg

SEQ ID NO: 1071894 - RNA, 17 nt, Mycobacterium bovis subsp bovis AF2122/97
caggaucgcggcgccgu

SEQ ID NO: 1071895 - RNA, 14 nt, Mycobacterium bovis subsp bovis AF2122/97
caggacgucggcga

SEQ ID NO: 1071896 - RNA, 20 nt, Mycobacterium bovis subsp bovis AF2122/97
caggacguuugagaccccaa

SEQ ID NO: 1071897 - RNA, 15 nt, Mycobacterium bovis subsp bovis AF2122/97
caggacuccggccgc

SEQ ID NO: 1071898 - RNA, 16 nt, Mycobacterium bovis subsp bovis AF2122/97
caggacuccggccgca

SEQ ID NO: 1071899 - RNA, 23 nt, Mycobacterium bovis subsp bovis AF2122/97
caggaccgcgccgaucaccaccg

SEQ ID NO: 1071900 - RNA, 12 nt, Mycobacterium bovis subsp bovis AF2122/97
caggaccgcgcc

SEQ ID NO: 1071901 - RNA, 17 nt, Mycobacterium bovis subsp bovis AF2122/97
caggaccagcaccgccg

SEQ ID NO: 1071902 - RNA, 18 nt, Mycobacterium bovis subsp bovis AF2122/97
caggaccagcaccgccgc

SEQ ID NO: 1071903 - RNA, 19 nt, Mycobacterium bovis subsp bovis AF2122/97
caggaccagcaccgccgcg

SEQ ID NO: 1071904 - RNA, 16 nt, Mycobacterium bovis subsp bovis AF2122/97
caggacagcagccgcc

SEQ ID NO: 1071905 - RNA, 16 nt, Mycobacterium bovis subsp bovis AF2122/97
caggaccaacgccaac

SEQ ID NO: 1071906 - RNA, 16 nt, Mycobacterium bovis subsp bovis AF2122/97
caggaaguacgcgacg

SEQ ID NO: 1071907 - RNA, 16 nt, Mycobacterium bovis subsp bovis AF2122/97
caggccacugccgacc

SEQ ID NO: 1071908 - RNA, 13 nt, Mycobacterium bovis subsp bovis AF2122/97
caggccacgggcg

SEQ ID NO: 1071909 - RNA, 17 nt, Mycobacterium bovis subsp bovis AF2122/97
caggccagagucgcccg

SEQ ID NO: 1071910 - RNA, 20 nt, Mycobacterium bovis subsp bovis AF2122/97
caggccagagucgcccgcac

SEQ ID NO: 1071911 - RNA, 12 nt, Mycobacterium bovis subsp bovis AF2122/97
caggccaccccg

SEQ ID NO: 1071912 - RNA, 20 nt, Mycobacterium bovis subsp bovis AF2122/97
caggccaccgcagacgccgu

SEQ ID NO: 1071913 - RNA, 23 nt, Mycobacterium bovis subsp bovis AF2122/97
caggccaacuuggcggccagccg

SEQ ID NO: 1071914 - RNA, 19 nt, Mycobacterium bovis subsp bovis AF2122/97
caggccaagguggccacca

SEQ ID NO: 1071915 - RNA, 19 nt, Mycobacterium bovis subsp bovis AF2122/97
caggcauggcgccguugcc

SEQ ID NO: 1071916 - RNA, 14 nt, Mycobacterium bovis subsp bovis AF2122/97
caggcauggcgccg

SEQ ID NO: 1071917 - RNA, 17 nt, Mycobacterium bovis subsp bovis AF2122/97
caggcauggcgccguug

SEQ ID NO: 1071918 - RNA, 22 nt, Mycobacterium bovis subsp bovis AF2122/97
caggcauuuucacugugccgcu

SEQ ID NO: 1071919 - RNA, 20 nt, Mycobacterium bovis subsp bovis AF2122/97
caggcauucccgcggcaacg

SEQ ID NO: 1071920 - RNA, 14 nt, Mycobacterium bovis subsp bovis AF2122/97
caggcacaacaucg

SEQ ID NO: 1071921 - RNA, 17 nt, Mycobacterium bovis subsp bovis AF2122/97
caggcacaacaucgccg

SEQ ID NO: 1071922 - RNA, 15 nt, Mycobacterium bovis subsp bovis AF2122/97
caggcaagccagcac

SEQ ID NO: 1071923 - RNA, 16 nt, Mycobacterium bovis subsp bovis AF2122/97
caggcaagccagcacu

SEQ ID NO: 1071924 - RNA, 18 nt, Mycobacterium bovis subsp bovis AF2122/97
caggcaaucgcgggcgau

SEQ ID NO: 1071925 - RNA, 18 nt, Mycobacterium bovis subsp bovis AF2122/97
caggcaaugcccgaccgg

SEQ ID NO: 1071926 - RNA, 13 nt, Mycobacterium bovis subsp bovis AF2122/97
caggaugaugacc

SEQ ID NO: 1071927 - RNA, 19 nt, Mycobacterium bovis subsp bovis AF2122/97
caggcccucgggugucaca

SEQ ID NO: 1071928 - RNA, 19 nt, Mycobacterium bovis subsp bovis AF2122/97
caggcccucgggacugcgc

SEQ ID NO: 1071929 - RNA, 20 nt, Mycobacterium bovis subsp bovis AF2122/97
caggcccucgacggcgucga

SEQ ID NO: 1071930 - RNA, 13 nt, Mycobacterium bovis subsp bovis AF2122/97
caggcccggcggu

SEQ ID NO: 1071931 - RNA, 20 nt, Mycobacterium bovis subsp bovis AF2122/97
caggcccggcggugugcgca

SEQ ID NO: 1071932 - RNA, 23 nt, Mycobacterium bovis subsp bovis AF2122/97
caggcccugccgacgcuccaggg

SEQ ID NO: 1071933 - RNA, 21 nt, Mycobacterium bovis subsp bovis AF2122/97
caggcccagccgagcggcggc

SEQ ID NO: 1071934 - RNA, 13 nt, Mycobacterium bovis subsp bovis AF2122/97
caggccagcgcuc

SEQ ID NO: 1071935 - RNA, 23 nt, Mycobacterium bovis subsp bovis AF2122/97
caggccagggucagcucggugau

SEQ ID NO: 1071936 - RNA, 19 nt, Mycobacterium bovis subsp bovis AF2122/97
caggccagcgcucaccggc

SEQ ID NO: 1071937 - RNA, 18 nt, Mycobacterium bovis subsp bovis AF2122/97
caggccagcggauuugcc

SEQ ID NO: 1071938 - RNA, 21 nt, Mycobacterium bovis subsp bovis AF2122/97
caggccacguagcagcgccgg

SEQ ID NO: 1071939 - RNA, 13 nt, Mycobacterium bovis subsp bovis AF2122/97
cauccgccgggcc

SEQ ID NO: 1071940 - RNA, 17 nt, Mycobacterium bovis subsp bovis AF2122/97
cauccgccgggccaggc

SEQ ID NO: 1071941 - RNA, 12 nt, Mycobacterium bovis subsp bovis AF2122/97
cauccgccgccc

SEQ ID NO: 1071942 - RNA, 19 nt, Mycobacterium bovis subsp bovis AF2122/97
cauccgccgcccccgcccg

SEQ ID NO: 1071943 - RNA, 23 nt, Mycobacterium bovis subsp bovis AF2122/97
cauccgccccgcccgcacccaug

SEQ ID NO: 1071944 - RNA, 19 nt, Mycobacterium bovis subsp bovis AF2122/97
caucccgaauggccgaucc

SEQ ID NO: 1071945 - RNA, 22 nt, Mycobacterium bovis subsp bovis AF2122/97
caucccgauguaccccagcgcc

SEQ ID NO: 1071946 - RNA, 20 nt, Mycobacterium bovis subsp bovis AF2122/97
cauccccuugguggccagcc

SEQ ID NO: 1071947 - RNA, 17 nt, Mycobacterium bovis subsp bovis AF2122/97
caucccggaccgauggu

SEQ ID NO: 1071948 - RNA, 14 nt, Mycobacterium bovis subsp bovis AF2122/97
caucccgccgcccg

SEQ ID NO: 1071949 - RNA, 18 nt, Mycobacterium bovis subsp bovis AF2122/97
cauccccggagcgauccg

SEQ ID NO: 1071950 - RNA, 19 nt, Mycobacterium bovis subsp bovis AF2122/97
cauccccuggccagcagag

SEQ ID NO: 1071951 - RNA, 17 nt, Mycobacterium bovis subsp bovis AF2122/97
cauccagaugcccagca

SEQ ID NO: 1071952 - RNA, 18 nt, Mycobacterium bovis subsp bovis AF2122/97
cauccccgagcugucggc

SEQ ID NO: 1071953 - RNA, 12 nt, Mycobacterium bovis subsp bovis AF2122/97
cauccccgccgg

SEQ ID NO: 1071954 - RNA, 14 nt, Mycobacterium bovis subsp bovis AF2122/97
cauccccgccggcg

SEQ ID NO: 1071955 - RNA, 15 nt, Mycobacterium bovis subsp bovis AF2122/97
cauccccgccggcgc

SEQ ID NO: 1071956 - RNA, 16 nt, Mycobacterium bovis subsp bovis AF2122/97
cauccccgccggcgcc

SEQ ID NO: 1071957 - RNA, 18 nt, Mycobacterium bovis subsp bovis AF2122/97
cauccagagcuggcuacg

SEQ ID NO: 1071958 - RNA, 22 nt, Mycobacterium bovis subsp bovis AF2122/97
cauccagagcuggcuacgggcc

SEQ ID NO: 1071959 - RNA, 14 nt, Mycobacterium bovis subsp bovis AF2122/97
cauccagccgugcg

SEQ ID NO: 1071960 - RNA, 20 nt, Mycobacterium bovis subsp bovis AF2122/97
cauccacugcgagggcacgc

SEQ ID NO: 1071961 - RNA, 19 nt, Mycobacterium bovis subsp bovis AF2122/97
cauccagaagccggccacu

SEQ ID NO: 1071962 - RNA, 21 nt, Mycobacterium bovis subsp bovis AF2122/97
cauccagaaguaggcgaccgc

SEQ ID NO: 1071963 - RNA, 22 nt, Mycobacterium bovis subsp bovis AF2122/97
cauccagaaguaggcgaccgcc

SEQ ID NO: 1071964 - RNA, 14 nt, Mycobacterium bovis subsp bovis AF2122/97
cauccacugcggcg

SEQ ID NO: 1071965 - RNA, 23 nt, Mycobacterium bovis subsp bovis AF2122/97
cauccagaaguaggcgaccgcca

SEQ ID NO: 1071966 - RNA, 22 nt, Mycobacterium bovis subsp bovis AF2122/97
caucauguggucaacggccgac

SEQ ID NO: 1071967 - RNA, 15 nt, Mycobacterium bovis subsp bovis AF2122/97
cauccaccgauggcg

SEQ ID NO: 1071968 - RNA, 12 nt, Mycobacterium bovis subsp bovis AF2122/97
caucaccggcau

SEQ ID NO: 1071969 - RNA, 22 nt, Mycobacterium bovis subsp bovis AF2122/97
caucaccggagcuuguugcagc

SEQ ID NO: 1071970 - RNA, 15 nt, Mycobacterium bovis subsp bovis AF2122/97
caucaccgccgcggc

SEQ ID NO: 1071971 - RNA, 17 nt, Mycobacterium bovis subsp bovis AF2122/97
caucaccgccgcggccg

SEQ ID NO: 1071972 - RNA, 21 nt, Mycobacterium bovis subsp bovis AF2122/97
caucaccgccgcggccgccgu

SEQ ID NO: 1071973 - RNA, 12 nt, Mycobacterium bovis subsp bovis AF2122/97
caucaccgcgcc

SEQ ID NO: 1071974 - RNA, 14 nt, Mycobacterium bovis subsp bovis AF2122/97
caucaccgcgccag

SEQ ID NO: 1071975 - RNA, 14 nt, Mycobacterium bovis subsp bovis AF2122/97
caucagugcgccgg

SEQ ID NO: 1071976 - RNA, 17 nt, Mycobacterium bovis subsp bovis AF2122/97
caucaguuugacgccga

SEQ ID NO: 1071977 - RNA, 18 nt, Mycobacterium bovis subsp bovis AF2122/97
caucacccagcgccgacc

SEQ ID NO: 1071978 - RNA, 13 nt, Mycobacterium bovis subsp bovis AF2122/97
caucaccccggcc

SEQ ID NO: 1071979 - RNA, 16 nt, Mycobacterium bovis subsp bovis AF2122/97
caucaccgaacggcga

SEQ ID NO: 1071980 - RNA, 15 nt, Mycobacterium bovis subsp bovis AF2122/97
caucaccgccagccc

SEQ ID NO: 1071981 - RNA, 18 nt, Mycobacterium bovis subsp bovis AF2122/97
caucaccgccagccccgc

SEQ ID NO: 1071982 - RNA, 16 nt, Mycobacterium bovis subsp bovis AF2122/97
caucaucgccaccacc

SEQ ID NO: 1071983 - RNA, 20 nt, Mycobacterium bovis subsp bovis AF2122/97
caucaucgcccaccgcaacg

SEQ ID NO: 1071984 - RNA, 20 nt, Mycobacterium bovis subsp bovis AF2122/97
caucaucgcccugggcgccg

SEQ ID NO: 1071985 - RNA, 15 nt, Mycobacterium bovis subsp bovis AF2122/97
caucaucgacgcgcg

SEQ ID NO: 1071986 - RNA, 21 nt, Mycobacterium bovis subsp bovis AF2122/97
caucaucgacggugaucaggu

SEQ ID NO: 1071987 - RNA, 15 nt, Mycobacterium bovis subsp bovis AF2122/97
caucauggccgugua

SEQ ID NO: 1071988 - RNA, 14 nt, Mycobacterium bovis subsp bovis AF2122/97
caucauggcggccc

SEQ ID NO: 1071989 - RNA, 17 nt, Mycobacterium bovis subsp bovis AF2122/97
caucauguggucaacgg

SEQ ID NO: 1071990 - RNA, 14 nt, Mycobacterium bovis subsp bovis AF2122/97
caucaugucggcgc

SEQ ID NO: 1071991 - RNA, 15 nt, Mycobacterium bovis subsp bovis AF2122/97
caucaugucggcgca

SEQ ID NO: 1071992 - RNA, 22 nt, Mycobacterium bovis subsp bovis AF2122/97
caucgacagcaucacgcccacg

SEQ ID NO: 1071993 - RNA, 14 nt, Mycobacterium bovis subsp bovis AF2122/97
caucgagcgggauc

SEQ ID NO: 1071994 - RNA, 14 nt, Mycobacterium bovis subsp bovis AF2122/97
caucgaccgcccgc

SEQ ID NO: 1071995 - RNA, 19 nt, Mycobacterium bovis subsp bovis AF2122/97
caucgaccgcccgccagcg

SEQ ID NO: 1071996 - RNA, 17 nt, Mycobacterium bovis subsp bovis AF2122/97
caucgagcgggaucggg

SEQ ID NO: 1071997 - RNA, 18 nt, Mycobacterium bovis subsp bovis AF2122/97
caucgagcgggaucgggc

SEQ ID NO: 1071998 - RNA, 15 nt, Mycobacterium bovis subsp bovis AF2122/97
caucgaggccacgcc

SEQ ID NO: 1071999 - RNA, 14 nt, Mycobacterium bovis subsp bovis AF2122/97
caucgaguccacca

SEQ ID NO: 1072000 - RNA, 15 nt, Mycobacterium bovis subsp bovis AF2122/97
caucgaugcggugaa

SEQ ID NO: 1072001 - RNA, 20 nt, Mycobacterium bovis subsp bovis AF2122/97
caucgaucccguucggggcc

SEQ ID NO: 1072002 - RNA, 19 nt, Mycobacterium bovis subsp bovis AF2122/97
caucgaucgagcaggccgc

SEQ ID NO: 1072003 - RNA, 20 nt, Mycobacterium bovis subsp bovis AF2122/97
caucgaucgagcaggccgcc

SEQ ID NO: 1072004 - RNA, 21 nt, Mycobacterium bovis subsp bovis AF2122/97
caucgaucgagcaggccgccc

SEQ ID NO: 1072005 - RNA, 21 nt, Mycobacterium bovis subsp bovis AF2122/97
caucgaugucggcucggcccc

SEQ ID NO: 1072006 - RNA, 15 nt, Mycobacterium bovis subsp bovis AF2122/97
caucgauuggcucga

SEQ ID NO: 1072007 - RNA, 19 nt, Mycobacterium bovis subsp bovis AF2122/97
caucgcacgggccaccagc

SEQ ID NO: 1072008 - RNA, 17 nt, Mycobacterium bovis subsp bovis AF2122/97
caucgcaggcaccccga

SEQ ID NO: 1072009 - RNA, 19 nt, Mycobacterium bovis subsp bovis AF2122/97
caucgcaggcaccccgauc

SEQ ID NO: 1072010 - RNA, 13 nt, Mycobacterium bovis subsp bovis AF2122/97
caucgcagacggc

SEQ ID NO: 1072011 - RNA, 19 nt, Mycobacterium bovis subsp bovis AF2122/97
caucgccaacaccaaccag

SEQ ID NO: 1072012 - RNA, 21 nt, Mycobacterium bovis subsp bovis AF2122/97
caucgccacacccaaaccggc

SEQ ID NO: 1072013 - RNA, 21 nt, Mycobacterium bovis subsp bovis AF2122/97
caucgccaccaccccgucgag

SEQ ID NO: 1072014 - RNA, 13 nt, Mycobacterium bovis subsp bovis AF2122/97
caucgcccggugc

SEQ ID NO: 1072015 - RNA, 20 nt, Mycobacterium bovis subsp bovis AF2122/97
caucgcccggugcgucgugg

SEQ ID NO: 1072016 - RNA, 15 nt, Mycobacterium bovis subsp bovis AF2122/97
caucgccaccaucac

SEQ ID NO: 1072017 - RNA, 16 nt, Mycobacterium bovis subsp bovis AF2122/97
cauccgcgacggcgcc

SEQ ID NO: 1072018 - RNA, 22 nt, Mycobacterium bovis subsp bovis AF2122/97
caucgaauuccagccagccgcc

SEQ ID NO: 1072019 - RNA, 17 nt, Mycobacterium bovis subsp bovis AF2122/97
caucgaaggugcuggug

SEQ ID NO: 1072020 - RNA, 17 nt, Mycobacterium bovis subsp bovis AF2122/97
caucgaagugcggcccg

SEQ ID NO: 1072021 - RNA, 15 nt, Mycobacterium bovis subsp bovis AF2122/97
cauccuuaugcgcgg

SEQ ID NO: 1072022 - RNA, 16 nt, Mycobacterium bovis subsp bovis AF2122/97
cauccuuaugcgcggu

SEQ ID NO: 1072023 - RNA, 19 nt, Mycobacterium bovis subsp bovis AF2122/97
cauccuuaugcgcggugac

SEQ ID NO: 1072024 - RNA, 19 nt, Mycobacterium bovis subsp bovis AF2122/97
cauccuguggcggggcaac

SEQ ID NO: 1072025 - RNA, 12 nt, Mycobacterium bovis subsp bovis AF2122/97
caucgaacgacg

SEQ ID NO: 1072026 - RNA, 19 nt, Mycobacterium bovis subsp bovis AF2122/97
caucgaaaaaccucgacgc

SEQ ID NO: 1072027 - RNA, 16 nt, Mycobacterium bovis subsp bovis AF2122/97
caucgaaaaccgaggc

SEQ ID NO: 1072028 - RNA, 15 nt, Mycobacterium bovis subsp bovis AF2122/97
cauccuucgccggcg

SEQ ID NO: 1072029 - RNA, 19 nt, Mycobacterium bovis subsp bovis AF2122/97
cauccuugacgcggccaca

SEQ ID NO: 1072030 - RNA, 21 nt, Mycobacterium bovis subsp bovis AF2122/97
caguugucuggucauggccga

SEQ ID NO: 1072031 - RNA, 18 nt, Mycobacterium bovis subsp bovis AF2122/97
caguuguggcgcugcguc

SEQ ID NO: 1072032 - RNA, 15 nt, Mycobacterium bovis subsp bovis AF2122/97
caguugggccucagc

SEQ ID NO: 1072033 - RNA, 21 nt, Mycobacterium bovis subsp bovis AF2122/97
caguuucggcgucgucgacgg

SEQ ID NO: 1072034 - RNA, 13 nt, Mycobacterium bovis subsp bovis AF2122/97
caguuuucaccgc

SEQ ID NO: 1072035 - RNA, 14 nt, Mycobacterium bovis subsp bovis AF2122/97
caguuugugccgcc

SEQ ID NO: 1072036 - RNA, 20 nt, Mycobacterium bovis subsp bovis AF2122/97
caguuugggauccuggccga

SEQ ID NO: 1072037 - RNA, 13 nt, Mycobacterium bovis subsp bovis AF2122/97
caguugcccgacg

SEQ ID NO: 1072038 - RNA, 17 nt, Mycobacterium bovis subsp bovis AF2122/97
caguugcccgacgccgg

SEQ ID NO: 1072039 - RNA, 19 nt, Mycobacterium bovis subsp bovis AF2122/97
caguugcccgacgccgguc

SEQ ID NO: 1072040 - RNA, 17 nt, Mycobacterium bovis subsp bovis AF2122/97
caguuggcaccagccgg

SEQ ID NO: 1072041 - RNA, 20 nt, Mycobacterium bovis subsp bovis AF2122/97
caguuggccaugcaccgaug

SEQ ID NO: 1072042 - RNA, 16 nt, Mycobacterium bovis subsp bovis AF2122/97
caguuggcaccagccg

SEQ ID NO: 1072043 - RNA, 22 nt, Mycobacterium bovis subsp bovis AF2122/97
caguuguauuccgggguaucga

SEQ ID NO: 1072044 - RNA, 21 nt, Mycobacterium bovis subsp bovis AF2122/97
caguuggaacugaugaaccac

SEQ ID NO: 1072045 - RNA, 13 nt, Mycobacterium bovis subsp bovis AF2122/97
caguuggcaccag

SEQ ID NO: 1072046 - RNA, 19 nt, Mycobacterium bovis subsp bovis AF2122/97
cauaagcccccgacacgcc

SEQ ID NO: 1072047 - RNA, 19 nt, Mycobacterium bovis subsp bovis AF2122/97
cauaagcgaggaucucggc

SEQ ID NO: 1072048 - RNA, 20 nt, Mycobacterium bovis subsp bovis AF2122/97
cauaaaacucgggggcugca

SEQ ID NO: 1072049 - RNA, 13 nt, Mycobacterium bovis subsp bovis AF2122/97
cauaaaccgcguc

SEQ ID NO: 1072050 - RNA, 17 nt, Mycobacterium bovis subsp bovis AF2122/97
cauaauauugccgccuc

SEQ ID NO: 1072051 - RNA, 13 nt, Mycobacterium bovis subsp bovis AF2122/97
cauacagccgccg

SEQ ID NO: 1072052 - RNA, 14 nt, Mycobacterium bovis subsp bovis AF2122/97
cauacagccgccga

SEQ ID NO: 1072053 - RNA, 15 nt, Mycobacterium bovis subsp bovis AF2122/97
cauacccagcucguc

SEQ ID NO: 1072054 - RNA, 14 nt, Mycobacterium bovis subsp bovis AF2122/97
cauacagcgcccgg

SEQ ID NO: 1072055 - RNA, 19 nt, Mycobacterium bovis subsp bovis AF2122/97
cauaggcaaggucaacccg

SEQ ID NO: 1072056 - RNA, 16 nt, Mycobacterium bovis subsp bovis AF2122/97
cauaggccgcgucgau

SEQ ID NO: 1072057 - RNA, 13 nt, Mycobacterium bovis subsp bovis AF2122/97
cauaggccgacgg

SEQ ID NO: 1072058 - RNA, 16 nt, Mycobacterium bovis subsp bovis AF2122/97
cauaggcccacggcag

SEQ ID NO: 1072059 - RNA, 20 nt, Mycobacterium bovis subsp bovis AF2122/97
cauaggcccacggcagcgcc

SEQ ID NO: 1072060 - RNA, 19 nt, Mycobacterium bovis subsp bovis AF2122/97
cauaggccccgccagcgcc

SEQ ID NO: 1072061 - RNA, 20 nt, Mycobacterium bovis subsp bovis AF2122/97
cauagcucaacggaaccgau

SEQ ID NO: 1072062 - RNA, 15 nt, Mycobacterium bovis subsp bovis AF2122/97
cauagcugccggccc

SEQ ID NO: 1072063 - RNA, 19 nt, Mycobacterium bovis subsp bovis AF2122/97
cauagcugccggcccacca

SEQ ID NO: 1072064 - RNA, 21 nt, Mycobacterium bovis subsp bovis AF2122/97
cauagcgacggcgcucggcga

SEQ ID NO: 1072065 - RNA, 15 nt, Mycobacterium bovis subsp bovis AF2122/97
cauagcgcaccaccg

SEQ ID NO: 1072066 - RNA, 16 nt, Mycobacterium bovis subsp bovis AF2122/97
cauagcgccgcgccca

SEQ ID NO: 1072067 - RNA, 23 nt, Mycobacterium bovis subsp bovis AF2122/97
cauacccaucaacaucggcccgc

SEQ ID NO: 1072068 - RNA, 13 nt, Mycobacterium bovis subsp bovis AF2122/97
cauagccugcgcc

SEQ ID NO: 1072069 - RNA, 16 nt, Mycobacterium bovis subsp bovis AF2122/97
cauagccugcgccgac

SEQ ID NO: 1072070 - RNA, 19 nt, Mycobacterium bovis subsp bovis AF2122/97
cauagccugcgccgacccg

SEQ ID NO: 1072071 - RNA, 15 nt, Mycobacterium bovis subsp bovis AF2122/97
cauacccgcgcgcac

SEQ ID NO: 1072072 - RNA, 19 nt, Mycobacterium bovis subsp bovis AF2122/97
cauagguaguugcucggcu

SEQ ID NO: 1072073 - RNA, 15 nt, Mycobacterium bovis subsp bovis AF2122/97
cauagguaugcccgg

SEQ ID NO: 1072074 - RNA, 21 nt, Mycobacterium bovis subsp bovis AF2122/97
cauaggucacaaacggcaagc

SEQ ID NO: 1072075 - RNA, 16 nt, Mycobacterium bovis subsp bovis AF2122/97
cauaggcggccaucga

SEQ ID NO: 1072076 - RNA, 16 nt, Mycobacterium bovis subsp bovis AF2122/97
cauaggcuuccggcgc

SEQ ID NO: 1072077 - RNA, 14 nt, Mycobacterium bovis subsp bovis AF2122/97
cauaggcgcgguca

SEQ ID NO: 1072078 - RNA, 17 nt, Mycobacterium bovis subsp bovis AF2122/97
cauaggcgcugaacgcg

SEQ ID NO: 1072079 - RNA, 14 nt, Mycobacterium bovis subsp bovis AF2122/97
cauaguuggcgccc

SEQ ID NO: 1072080 - RNA, 23 nt, Mycobacterium bovis subsp bovis AF2122/97
cauaguuggcgcccgaagccggg

SEQ ID NO: 1072081 - RNA, 18 nt, Mycobacterium bovis subsp bovis AF2122/97
cauaguuguuccuggucg

SEQ ID NO: 1072082 - RNA, 20 nt, Mycobacterium bovis subsp bovis AF2122/97
cauaggcguaaugcgcggcg

SEQ ID NO: 1072083 - RNA, 20 nt, Mycobacterium bovis subsp bovis AF2122/97
caucaaccguccccggcguc

SEQ ID NO: 1072084 - RNA, 14 nt, Mycobacterium bovis subsp bovis AF2122/97
caucaacgacacca

SEQ ID NO: 1072085 - RNA, 14 nt, Mycobacterium bovis subsp bovis AF2122/97
caucaacgccacga

SEQ ID NO: 1072086 - RNA, 16 nt, Mycobacterium bovis subsp bovis AF2122/97
caucaacgcgggcgcu

SEQ ID NO: 1072087 - RNA, 13 nt, Mycobacterium bovis subsp bovis AF2122/97
caucaccagcggc

SEQ ID NO: 1072088 - RNA, 20 nt, Mycobacterium bovis subsp bovis AF2122/97
caucaagaaacguggugacg

SEQ ID NO: 1072089 - RNA, 14 nt, Mycobacterium bovis subsp bovis AF2122/97
caucaaggccaccu

SEQ ID NO: 1072090 - RNA, 23 nt, Mycobacterium bovis subsp bovis AF2122/97
cauaucgugaugugcccauucau

SEQ ID NO: 1072091 - RNA, 15 nt, Mycobacterium bovis subsp bovis AF2122/97
cauauagcggaccga

SEQ ID NO: 1072092 - RNA, 14 nt, Mycobacterium bovis subsp bovis AF2122/97
cagggccagcggca

SEQ ID NO: 1072093 - RNA, 15 nt, Mycobacterium bovis subsp bovis AF2122/97
cagggccagcggcag

SEQ ID NO: 1072094 - RNA, 17 nt, Mycobacterium bovis subsp bovis AF2122/97
cagggccagcggcagcc

SEQ ID NO: 1072095 - RNA, 16 nt, Mycobacterium bovis subsp bovis AF2122/97
cagggccagaucgccg

SEQ ID NO: 1072096 - RNA, 19 nt, Mycobacterium bovis subsp bovis AF2122/97
cagggccagaucgccgggc

SEQ ID NO: 1072097 - RNA, 15 nt, Mycobacterium bovis subsp bovis AF2122/97
cagggccaccaccac

SEQ ID NO: 1072098 - RNA, 20 nt, Mycobacterium bovis subsp bovis AF2122/97
cagggccaccaccacggcca

SEQ ID NO: 1072099 - RNA, 18 nt, Mycobacterium bovis subsp bovis AF2122/97
cagggacccgagaucacc

SEQ ID NO: 1072100 - RNA, 14 nt, Mycobacterium bovis subsp bovis AF2122/97
cagggacccggcgc

SEQ ID NO: 1072101 - RNA, 22 nt, Mycobacterium bovis subsp bovis AF2122/97
caggcuggcgauggccguccga

SEQ ID NO: 1072102 - RNA, 13 nt, Mycobacterium bovis subsp bovis AF2122/97
cagggacgaugcc

SEQ ID NO: 1072103 - RNA, 13 nt, Mycobacterium bovis subsp bovis AF2122/97
cagggagcggcug

SEQ ID NO: 1072104 - RNA, 20 nt, Mycobacterium bovis subsp bovis AF2122/97
cagggcauugcggcccgcga

SEQ ID NO: 1072105 - RNA, 17 nt, Mycobacterium bovis subsp bovis AF2122/97
cagggccacuggccggu

SEQ ID NO: 1072106 - RNA, 18 nt, Mycobacterium bovis subsp bovis AF2122/97
cagggccacuggccgguu

SEQ ID NO: 1072107 - RNA, 20 nt, Mycobacterium bovis subsp bovis AF2122/97
cagggugacuucgcugcggu

SEQ ID NO: 1072108 - RNA, 23 nt, Mycobacterium bovis subsp bovis AF2122/97
cagggugacuucgcugcgguggg

SEQ ID NO: 1072109 - RNA, 18 nt, Mycobacterium bovis subsp bovis AF2122/97
cagggugccggcgccgcc

SEQ ID NO: 1072110 - RNA, 19 nt, Mycobacterium bovis subsp bovis AF2122/97
cagggugccggcgccgccc

SEQ ID NO: 1072111 - RNA, 15 nt, Mycobacterium bovis subsp bovis AF2122/97
cagggugccggcggu

SEQ ID NO: 1072112 - RNA, 20 nt, Mycobacterium bovis subsp bovis AF2122/97
cagggugccggcggugacgg

SEQ ID NO: 1072113 - RNA, 23 nt, Mycobacterium bovis subsp bovis AF2122/97
cagggugccggcggugacggcgg

SEQ ID NO: 1072114 - RNA, 15 nt, Mycobacterium bovis subsp bovis AF2122/97
cagggugccggucac

SEQ ID NO: 1072115 - RNA, 14 nt, Mycobacterium bovis subsp bovis AF2122/97
cagggugccgucgg

SEQ ID NO: 1072116 - RNA, 13 nt, Mycobacterium bovis subsp bovis AF2122/97
cagggugcgccgg

SEQ ID NO: 1072117 - RNA, 13 nt, Mycobacterium bovis subsp bovis AF2122/97
cagggugccggcg

SEQ ID NO: 1072118 - RNA, 15 nt, Mycobacterium bovis subsp bovis AF2122/97
cagggugcccucggc

SEQ ID NO: 1072119 - RNA, 14 nt, Mycobacterium bovis subsp bovis AF2122/97
cagggugcgccggu

SEQ ID NO: 1072120 - RNA, 20 nt, Mycobacterium bovis subsp bovis AF2122/97
cagggugcgcuugcggccgc

SEQ ID NO: 1072121 - RNA, 17 nt, Mycobacterium bovis subsp bovis AF2122/97
caggguuggcaccguca

SEQ ID NO: 1072122 - RNA, 18 nt, Mycobacterium bovis subsp bovis AF2122/97
caggucauauugugggug

SEQ ID NO: 1072123 - RNA, 15 nt, Mycobacterium bovis subsp bovis AF2122/97
caggucaucggcggc

SEQ ID NO: 1072124 - RNA, 23 nt, Mycobacterium bovis subsp bovis AF2122/97
cagguauuugccgugcucaccgg

SEQ ID NO: 1072125 - RNA, 22 nt, Mycobacterium bovis subsp bovis AF2122/97
caggucaauggucuuuguccac

SEQ ID NO: 1072126 - RNA, 13 nt, Mycobacterium bovis subsp bovis AF2122/97
caggucaucggug

SEQ ID NO: 1072127 - RNA, 16 nt, Mycobacterium bovis subsp bovis AF2122/97
cagguccaaguccucc

SEQ ID NO: 1072128 - RNA, 21 nt, Mycobacterium bovis subsp bovis AF2122/97
cagguccaaguccuccacggc

SEQ ID NO: 1072129 - RNA, 13 nt, Mycobacterium bovis subsp bovis AF2122/97
caggucaccggcc

SEQ ID NO: 1072130 - RNA, 15 nt, Mycobacterium bovis subsp bovis AF2122/97
caggucaccggccgc

SEQ ID NO: 1072131 - RNA, 18 nt, Mycobacterium bovis subsp bovis AF2122/97
caggucaccggccgccga

SEQ ID NO: 1072132 - RNA, 21 nt, Mycobacterium bovis subsp bovis AF2122/97
cagguagcggguugggaccga

SEQ ID NO: 1072133 - RNA, 23 nt, Mycobacterium bovis subsp bovis AF2122/97
cagguacaucccggugucgaugc

SEQ ID NO: 1072134 - RNA, 13 nt, Mycobacterium bovis subsp bovis AF2122/97
cagguaggcgcga

SEQ ID NO: 1072135 - RNA, 17 nt, Mycobacterium bovis subsp bovis AF2122/97
cagguaaacggauucga

SEQ ID NO: 1072136 - RNA, 14 nt, Mycobacterium bovis subsp bovis AF2122/97
cagguaaccccgca

SEQ ID NO: 1072137 - RNA, 14 nt, Mycobacterium bovis subsp bovis AF2122/97
caggguuggcagcc

SEQ ID NO: 1072138 - RNA, 18 nt, Mycobacterium bovis subsp bovis AF2122/97
caggucggugcggucauc

SEQ ID NO: 1072139 - RNA, 18 nt, Mycobacterium bovis subsp bovis AF2122/97
caggucggugggcggcga

SEQ ID NO: 1072140 - RNA, 21 nt, Mycobacterium bovis subsp bovis AF2122/97
caggucggugugcaucgccgg

SEQ ID NO: 1072141 - RNA, 15 nt, Mycobacterium bovis subsp bovis AF2122/97
caggucgucggcguc

SEQ ID NO: 1072142 - RNA, 15 nt, Mycobacterium bovis subsp bovis AF2122/97
caggucgugcccggg

SEQ ID NO: 1072143 - RNA, 16 nt, Mycobacterium bovis subsp bovis AF2122/97
caggucgugcccggga

SEQ ID NO: 1072144 - RNA, 17 nt, Mycobacterium bovis subsp bovis AF2122/97
caggucuucgcugucga

SEQ ID NO: 1072145 - RNA, 22 nt, Mycobacterium bovis subsp bovis AF2122/97
caggucuccaucaaccgcgcug

SEQ ID NO: 1072146 - RNA, 16 nt, Mycobacterium bovis subsp bovis AF2122/97
caggucuccuugggcg

SEQ ID NO: 1072147 - RNA, 20 nt, Mycobacterium bovis subsp bovis AF2122/97
caggucuacccggucgccgg

SEQ ID NO: 1072148 - RNA, 18 nt, Mycobacterium bovis subsp bovis AF2122/97
caggugacauguugccgc

SEQ ID NO: 1072149 - RNA, 20 nt, Mycobacterium bovis subsp bovis AF2122/97
caggugaccgagaucgucgc

SEQ ID NO: 1072150 - RNA, 15 nt, Mycobacterium bovis subsp bovis AF2122/97
caggucggugcgguc

SEQ ID NO: 1072151 - RNA, 20 nt, Mycobacterium bovis subsp bovis AF2122/97
caggucggugacgaagagca

SEQ ID NO: 1072152 - RNA, 19 nt, Mycobacterium bovis subsp bovis AF2122/97
caggucggucaggucgagg

SEQ ID NO: 1072153 - RNA, 21 nt, Mycobacterium bovis subsp bovis AF2122/97
caggucgcgauagccgccgcg

SEQ ID NO: 1072154 - RNA, 21 nt, Mycobacterium bovis subsp bovis AF2122/97
caggucggggucagauccagg

SEQ ID NO: 1072155 - RNA, 20 nt, Mycobacterium bovis subsp bovis AF2122/97
caggucggaacuagccaguu

SEQ ID NO: 1072156 - RNA, 15 nt, Mycobacterium bovis subsp bovis AF2122/97
caggucgccgagacc

SEQ ID NO: 1072157 - RNA, 18 nt, Mycobacterium bovis subsp bovis AF2122/97
caggucgccgagaccggc

SEQ ID NO: 1072158 - RNA, 13 nt, Mycobacterium bovis subsp bovis AF2122/97
caggucgcaccac

SEQ ID NO: 1072159 - RNA, 18 nt, Mycobacterium bovis subsp bovis AF2122/97
caggucgccagcucggca

SEQ ID NO: 1072160 - RNA, 19 nt, Mycobacterium bovis subsp bovis AF2122/97
caggucgcccaacaccgcg

SEQ ID NO: 1072161 - RNA, 20 nt, Mycobacterium bovis subsp bovis AF2122/97
caggucgcccaacaccgcgc

SEQ ID NO: 1072162 - RNA, 23 nt, Mycobacterium bovis subsp bovis AF2122/97
caggucgcccaacaccgcgccga

SEQ ID NO: 1072163 - RNA, 20 nt, Mycobacterium bovis subsp bovis AF2122/97
caggugcgccguggcaucgc

SEQ ID NO: 1072164 - RNA, 13 nt, Mycobacterium bovis subsp bovis AF2122/97
caggugcgcgacc

SEQ ID NO: 1072165 - RNA, 19 nt, Mycobacterium bovis subsp bovis AF2122/97
caggugcccaucggguggu

SEQ ID NO: 1072166 - RNA, 19 nt, Mycobacterium bovis subsp bovis AF2122/97
caggugcggcggcaucggu

SEQ ID NO: 1072167 - RNA, 14 nt, Mycobacterium bovis subsp bovis AF2122/97
caggugcgggccgg

SEQ ID NO: 1072168 - RNA, 19 nt, Mycobacterium bovis subsp bovis AF2122/97
caggugccguggcuaccgc

SEQ ID NO: 1072169 - RNA, 13 nt, Mycobacterium bovis subsp bovis AF2122/97
caggugcccggcc

SEQ ID NO: 1072170 - RNA, 15 nt, Mycobacterium bovis subsp bovis AF2122/97
caggugccaggaugu

SEQ ID NO: 1072171 - RNA, 17 nt, Mycobacterium bovis subsp bovis AF2122/97
caggugccaaacgccgc

SEQ ID NO: 1072172 - RNA, 18 nt, Mycobacterium bovis subsp bovis AF2122/97
caggugccaaacgccgcc

SEQ ID NO: 1072173 - RNA, 19 nt, Mycobacterium bovis subsp bovis AF2122/97
caggugccagaccagggca

SEQ ID NO: 1072174 - RNA, 16 nt, Mycobacterium bovis subsp bovis AF2122/97
caggugacgaucaggu

SEQ ID NO: 1072175 - RNA, 17 nt, Mycobacterium bovis subsp bovis AF2122/97
caggugacgaucagguc

SEQ ID NO: 1072176 - RNA, 16 nt, Mycobacterium bovis subsp bovis AF2122/97
caggugcaagcgguuu

SEQ ID NO: 1072177 - RNA, 19 nt, Mycobacterium bovis subsp bovis AF2122/97
cagguguaggugccccacu

SEQ ID NO: 1072178 - RNA, 14 nt, Mycobacterium bovis subsp bovis AF2122/97
caggugggugaacg

SEQ ID NO: 1072179 - RNA, 17 nt, Mycobacterium bovis subsp bovis AF2122/97
cagguggucaucgccac

SEQ ID NO: 1072180 - RNA, 16 nt, Mycobacterium bovis subsp bovis AF2122/97
caggugucgucgaucg

SEQ ID NO: 1072181 - RNA, 18 nt, Mycobacterium bovis subsp bovis AF2122/97
cagguguugacgccaacg

SEQ ID NO: 1072182 - RNA, 15 nt, Mycobacterium bovis subsp bovis AF2122/97
cagguguuggugcgg

SEQ ID NO: 1072183 - RNA, 12 nt, Mycobacterium bovis subsp bovis AF2122/97
caggugugcccc

SEQ ID NO: 1072184 - RNA, 18 nt, Mycobacterium bovis subsp bovis AF2122/97
caggugugugacgaucgu

SEQ ID NO: 1072185 - RNA, 16 nt, Mycobacterium bovis subsp bovis AF2122/97
cagguuaggguccagg

SEQ ID NO: 1072186 - RNA, 21 nt, Mycobacterium bovis subsp bovis AF2122/97
cagguuugcgccgcgcagcga

SEQ ID NO: 1072187 - RNA, 17 nt, Mycobacterium bovis subsp bovis AF2122/97
cagguuuccggccugca

SEQ ID NO: 1072188 - RNA, 15 nt, Mycobacterium bovis subsp bovis AF2122/97
cagucggcgccgccg

SEQ ID NO: 1072189 - RNA, 19 nt, Mycobacterium bovis subsp bovis AF2122/97
cagugaagacaccaggccc

SEQ ID NO: 1072190 - RNA, 19 nt, Mycobacterium bovis subsp bovis AF2122/97
cagugaaucggaccgaccg

SEQ ID NO: 1072191 - RNA, 16 nt, Mycobacterium bovis subsp bovis AF2122/97
cagugaaauugccgcc

SEQ ID NO: 1072192 - RNA, 17 nt, Mycobacterium bovis subsp bovis AF2122/97
cagugaaauugccgccg

SEQ ID NO: 1072193 - RNA, 22 nt, Mycobacterium bovis subsp bovis AF2122/97
cagucgcgguaccaucaccgcg

SEQ ID NO: 1072194 - RNA, 21 nt, Mycobacterium bovis subsp bovis AF2122/97
caguccucgggcaggcggcca

SEQ ID NO: 1072195 - RNA, 23 nt, Mycobacterium bovis subsp bovis AF2122/97
caguccucgggcaggcggccagc

SEQ ID NO: 1072196 - RNA, 15 nt, Mycobacterium bovis subsp bovis AF2122/97
cagucgcgcgcucgc

SEQ ID NO: 1072197 - RNA, 16 nt, Mycobacterium bovis subsp bovis AF2122/97
cagucgcgcgcucgcg

SEQ ID NO: 1072198 - RNA, 13 nt, Mycobacterium bovis subsp bovis AF2122/97
cagucggccaccu

SEQ ID NO: 1072199 - RNA, 20 nt, Mycobacterium bovis subsp bovis AF2122/97
cagucggccaccuggucggc

SEQ ID NO: 1072200 - RNA, 13 nt, Mycobacterium bovis subsp bovis AF2122/97
cagucgcucgcug

SEQ ID NO: 1072201 - RNA, 22 nt, Mycobacterium bovis subsp bovis AF2122/97
cagucgcuggguggcgggccgg

SEQ ID NO: 1072202 - RNA, 20 nt, Mycobacterium bovis subsp bovis AF2122/97
cagugagggucccacggcgg

SEQ ID NO: 1072203 - RNA, 19 nt, Mycobacterium bovis subsp bovis AF2122/97
cagugagcagccggaccgu

SEQ ID NO: 1072204 - RNA, 19 nt, Mycobacterium bovis subsp bovis AF2122/97
cagugaccucgucggcgac

SEQ ID NO: 1072205 - RNA, 16 nt, Mycobacterium bovis subsp bovis AF2122/97
cagugaucaccaaccc

SEQ ID NO: 1072206 - RNA, 22 nt, Mycobacterium bovis subsp bovis AF2122/97
cagugacgccucgacacccagc

SEQ ID NO: 1072207 - RNA, 16 nt, Mycobacterium bovis subsp bovis AF2122/97
cagugacucgaucacc

SEQ ID NO: 1072208 - RNA, 14 nt, Mycobacterium bovis subsp bovis AF2122/97
cagugaccucgucg

SEQ ID NO: 1072209 - RNA, 15 nt, Mycobacterium bovis subsp bovis AF2122/97
cagugaccucgucgg

SEQ ID NO: 1072210 - RNA, 17 nt, Mycobacterium bovis subsp bovis AF2122/97
cagugacagugcgucga

SEQ ID NO: 1072211 - RNA, 15 nt, Mycobacterium bovis subsp bovis AF2122/97
cagugcccgaucgcu

SEQ ID NO: 1072212 - RNA, 17 nt, Mycobacterium bovis subsp bovis AF2122/97
cagugcccgcacugccg

SEQ ID NO: 1072213 - RNA, 18 nt, Mycobacterium bovis subsp bovis AF2122/97
cagugcccgcacugccgc

SEQ ID NO: 1072214 - RNA, 19 nt, Mycobacterium bovis subsp bovis AF2122/97
cagugcccgcacugccgcc

SEQ ID NO: 1072215 - RNA, 15 nt, Mycobacterium bovis subsp bovis AF2122/97
cagugccccgcccgg

SEQ ID NO: 1072216 - RNA, 14 nt, Mycobacterium bovis subsp bovis AF2122/97
cagugccccgccga

SEQ ID NO: 1072217 - RNA, 17 nt, Mycobacterium bovis subsp bovis AF2122/97
cagugccccgccgagcg

SEQ ID NO: 1072218 - RNA, 23 nt, Mycobacterium bovis subsp bovis AF2122/97
cagugccgcacccagaccgccga

SEQ ID NO: 1072219 - RNA, 19 nt, Mycobacterium bovis subsp bovis AF2122/97
cagugccccgccgagcggu

SEQ ID NO: 1072220 - RNA, 21 nt, Mycobacterium bovis subsp bovis AF2122/97
cagugcccgcacugccgccgg

SEQ ID NO: 1072221 - RNA, 18 nt, Mycobacterium bovis subsp bovis AF2122/97
cagugccgcccaccacac

SEQ ID NO: 1072222 - RNA, 16 nt, Mycobacterium bovis subsp bovis AF2122/97
cagugccgugcugaac

SEQ ID NO: 1072223 - RNA, 20 nt, Mycobacterium bovis subsp bovis AF2122/97
caguccggcggacgugacca

SEQ ID NO: 1072224 - RNA, 16 nt, Mycobacterium bovis subsp bovis AF2122/97
caguccgacaccggcg

SEQ ID NO: 1072225 - RNA, 18 nt, Mycobacterium bovis subsp bovis AF2122/97
caguccgacaccggcggc

SEQ ID NO: 1072226 - RNA, 23 nt, Mycobacterium bovis subsp bovis AF2122/97
caguccgacaccggcggcaucga

SEQ ID NO: 1072227 - RNA, 13 nt, Mycobacterium bovis subsp bovis AF2122/97
caguccgcgccgg

SEQ ID NO: 1072228 - RNA, 15 nt, Mycobacterium bovis subsp bovis AF2122/97
caguccgcgccggcg

SEQ ID NO: 1072229 - RNA, 18 nt, Mycobacterium bovis subsp bovis AF2122/97
caguccggcguucccgcc

SEQ ID NO: 1072230 - RNA, 12 nt, Mycobacterium bovis subsp bovis AF2122/97
caguccgauggu

SEQ ID NO: 1072231 - RNA, 18 nt, Mycobacterium bovis subsp bovis AF2122/97
caguccucaucgagcgcg

SEQ ID NO: 1072232 - RNA, 21 nt, Mycobacterium bovis subsp bovis AF2122/97
caguccucaucgagcgcgcga

SEQ ID NO: 1072233 - RNA, 23 nt, Mycobacterium bovis subsp bovis AF2122/97
caguccucaucgagcgcgcgacg

SEQ ID NO: 1072234 - RNA, 24 nt, Mycobacterium bovis subsp bovis AF2122/97
caguaccaccggcaccggccgugc

SEQ ID NO: 1072235 - RNA, 20 nt, Mycobacterium bovis subsp bovis AF2122/97
caguaccaccggcaccggcc

SEQ ID NO: 1072236 - RNA, 13 nt, Mycobacterium bovis subsp bovis AF2122/97
cagucccgugacg

SEQ ID NO: 1072237 - RNA, 15 nt, Mycobacterium bovis subsp bovis AF2122/97
cagucccucgccaac

SEQ ID NO: 1072238 - RNA, 17 nt, Mycobacterium bovis subsp bovis AF2122/97
caguccgaaagccgccg

SEQ ID NO: 1072239 - RNA, 18 nt, Mycobacterium bovis subsp bovis AF2122/97
caguccgaaagccgccga

SEQ ID NO: 1072240 - RNA, 13 nt, Mycobacterium bovis subsp bovis AF2122/97
cagucccggcgca

SEQ ID NO: 1072241 - RNA, 19 nt, Mycobacterium bovis subsp bovis AF2122/97
cagguuuugccgcguacga

SEQ ID NO: 1072242 - RNA, 16 nt, Mycobacterium bovis subsp bovis AF2122/97
caguaaccguccgcgg

SEQ ID NO: 1072243 - RNA, 13 nt, Mycobacterium bovis subsp bovis AF2122/97
caguacaccggcg

SEQ ID NO: 1072244 - RNA, 20 nt, Mycobacterium bovis subsp bovis AF2122/97
caguaauacugccguucggg

SEQ ID NO: 1072245 - RNA, 17 nt, Mycobacterium bovis subsp bovis AF2122/97
caguucgacggcgucaa

SEQ ID NO: 1072246 - RNA, 13 nt, Mycobacterium bovis subsp bovis AF2122/97
caguucggcgucg

SEQ ID NO: 1072247 - RNA, 21 nt, Mycobacterium bovis subsp bovis AF2122/97
caguucggugagccgggcggc

SEQ ID NO: 1072248 - RNA, 15 nt, Mycobacterium bovis subsp bovis AF2122/97
caguucgcggccauc

SEQ ID NO: 1072249 - RNA, 13 nt, Mycobacterium bovis subsp bovis AF2122/97
caguucgcgccgu

SEQ ID NO: 1072250 - RNA, 19 nt, Mycobacterium bovis subsp bovis AF2122/97
caguucgcgccguggcguc

SEQ ID NO: 1072251 - RNA, 12 nt, Mycobacterium bovis subsp bovis AF2122/97
caguucgccgcg

SEQ ID NO: 1072252 - RNA, 13 nt, Mycobacterium bovis subsp bovis AF2122/97
caguucgccgcgc

SEQ ID NO: 1072253 - RNA, 17 nt, Mycobacterium bovis subsp bovis AF2122/97
caguucgguguuggaca

SEQ ID NO: 1072254 - RNA, 21 nt, Mycobacterium bovis subsp bovis AF2122/97
caguucggcgucguccgcgcc

SEQ ID NO: 1072255 - RNA, 20 nt, Mycobacterium bovis subsp bovis AF2122/97
caguucuaccaccuugccga

SEQ ID NO: 1072256 - RNA, 14 nt, Mycobacterium bovis subsp bovis AF2122/97
caguucguggcugg

SEQ ID NO: 1072257 - RNA, 23 nt, Mycobacterium bovis subsp bovis AF2122/97
caguucguggcuggcaugccggc

SEQ ID NO: 1072258 - RNA, 22 nt, Mycobacterium bovis subsp bovis AF2122/97
caguucgugggucaacgucagg

SEQ ID NO: 1072259 - RNA, 15 nt, Mycobacterium bovis subsp bovis AF2122/97
caguucgugacgugc

SEQ ID NO: 1072260 - RNA, 17 nt, Mycobacterium bovis subsp bovis AF2122/97
caguucucgcgcuugcg

SEQ ID NO: 1072261 - RNA, 22 nt, Mycobacterium bovis subsp bovis AF2122/97
caguucucgcgcuugcgccgcc

SEQ ID NO: 1072262 - RNA, 17 nt, Mycobacterium bovis subsp bovis AF2122/97
caguucucggucccgcc

SEQ ID NO: 1072263 - RNA, 22 nt, Mycobacterium bovis subsp bovis AF2122/97
caguugaacucgaccaccgccg

SEQ ID NO: 1072264 - RNA, 16 nt, Mycobacterium bovis subsp bovis AF2122/97
caguugaucaggccga

SEQ ID NO: 1072265 - RNA, 22 nt, Mycobacterium bovis subsp bovis AF2122/97
caguugauccugcaguacggcc

SEQ ID NO: 1072266 - RNA, 17 nt, Mycobacterium bovis subsp bovis AF2122/97
cagugcgcagaacacca

SEQ ID NO: 1072267 - RNA, 16 nt, Mycobacterium bovis subsp bovis AF2122/97
cagugcgcagaacacc

SEQ ID NO: 1072268 - RNA, 17 nt, Mycobacterium bovis subsp bovis AF2122/97
cagugccucggcgaugg

SEQ ID NO: 1072269 - RNA, 18 nt, Mycobacterium bovis subsp bovis AF2122/97
cagugccucggcggcguu

SEQ ID NO: 1072270 - RNA, 14 nt, Mycobacterium bovis subsp bovis AF2122/97
cagugcgacccggg

SEQ ID NO: 1072271 - RNA, 17 nt, Mycobacterium bovis subsp bovis AF2122/97
cagugcgacccgggcgu

SEQ ID NO: 1072272 - RNA, 20 nt, Mycobacterium bovis subsp bovis AF2122/97
cagugcgacguaaagggcgu

SEQ ID NO: 1072273 - RNA, 20 nt, Mycobacterium bovis subsp bovis AF2122/97
caguggauccggcagcagcc

SEQ ID NO: 1072274 - RNA, 18 nt, Mycobacterium bovis subsp bovis AF2122/97
caguggcagccagcggcg

SEQ ID NO: 1072275 - RNA, 22 nt, Mycobacterium bovis subsp bovis AF2122/97
caguggccaccaucaccucgca

SEQ ID NO: 1072276 - RNA, 11 nt, Mycobacterium bovis subsp bovis AF2122/97
caguggcgcgg

SEQ ID NO: 1072277 - RNA, 20 nt, Mycobacterium bovis subsp bovis AF2122/97
caguggcgcguaggcccaac

SEQ ID NO: 1072278 - RNA, 17 nt, Mycobacterium bovis subsp bovis AF2122/97
caguggcgcgugcagcg

SEQ ID NO: 1072279 - RNA, 23 nt, Mycobacterium bovis subsp bovis AF2122/97
cagugggacaaagacgccgucgg

SEQ ID NO: 1072280 - RNA, 14 nt, Mycobacterium bovis subsp bovis AF2122/97
cagugggccgacgu

SEQ ID NO: 1072281 - RNA, 16 nt, Mycobacterium bovis subsp bovis AF2122/97
caguggggguccggcg

SEQ ID NO: 1072282 - RNA, 19 nt, Mycobacterium bovis subsp bovis AF2122/97
caguggggguccggcggcc

SEQ ID NO: 1072283 - RNA, 21 nt, Mycobacterium bovis subsp bovis AF2122/97
caguggcguuacgcucggcga

SEQ ID NO: 1072284 - RNA, 22 nt, Mycobacterium bovis subsp bovis AF2122/97
caguggcucgcggaugcucguu

SEQ ID NO: 1072285 - RNA, 20 nt, Mycobacterium bovis subsp bovis AF2122/97
caguggucgauuucggcgcg

SEQ ID NO: 1072286 - RNA, 18 nt, Mycobacterium bovis subsp bovis AF2122/97
caguuccgcugcggugcc

SEQ ID NO: 1072287 - RNA, 20 nt, Mycobacterium bovis subsp bovis AF2122/97
caguuccacccggugccgca

SEQ ID NO: 1072288 - RNA, 22 nt, Mycobacterium bovis subsp bovis AF2122/97
caguucccgaaccccgaccgcu

SEQ ID NO: 1072289 - RNA, 14 nt, Mycobacterium bovis subsp bovis AF2122/97
caguuccagcucgc

SEQ ID NO: 1072290 - RNA, 18 nt, Mycobacterium bovis subsp bovis AF2122/97
caguucacgcucgacgac

SEQ ID NO: 1072291 - RNA, 15 nt, Mycobacterium bovis subsp bovis AF2122/97
caguucacguucggc

SEQ ID NO: 1072292 - RNA, 20 nt, Mycobacterium bovis subsp bovis AF2122/97
caguucaucgggcaccaacc

SEQ ID NO: 1072293 - RNA, 16 nt, Mycobacterium bovis subsp bovis AF2122/97
cauggcccgaucgacc

SEQ ID NO: 1072294 - RNA, 17 nt, Mycobacterium bovis subsp bovis AF2122/97
cauggcgaaccgucagc

SEQ ID NO: 1072295 - RNA, 21 nt, Mycobacterium bovis subsp bovis AF2122/97
cauggcgaaccgucagcgcgc

SEQ ID NO: 1072296 - RNA, 23 nt, Mycobacterium bovis subsp bovis AF2122/97
cauggcgacggucgugaucggcg

SEQ ID NO: 1072297 - RNA, 23 nt, Mycobacterium bovis subsp bovis AF2122/97
cauggcgagcguuuggacgggcg

SEQ ID NO: 1072298 - RNA, 21 nt, Mycobacterium bovis subsp bovis AF2122/97
cauggcgaacacgucggccag

SEQ ID NO: 1072299 - RNA, 18 nt, Mycobacterium bovis subsp bovis AF2122/97
cauggcagcgcgcugagg

SEQ ID NO: 1072300 - RNA, 18 nt, Mycobacterium bovis subsp bovis AF2122/97
cauggcacugccggcacg

SEQ ID NO: 1072301 - RNA, 22 nt, Mycobacterium bovis subsp bovis AF2122/97
cauggcacugccggcacgccga

SEQ ID NO: 1072302 - RNA, 20 nt, Mycobacterium bovis subsp bovis AF2122/97
cauggcaagucaacaccgcg

SEQ ID NO: 1072303 - RNA, 15 nt, Mycobacterium bovis subsp bovis AF2122/97
cauggccagcgcuuc

SEQ ID NO: 1072304 - RNA, 12 nt, Mycobacterium bovis subsp bovis AF2122/97
cauggcgccgcg

SEQ ID NO: 1072305 - RNA, 18 nt, Mycobacterium bovis subsp bovis AF2122/97
cauggcgccguugccggc

SEQ ID NO: 1072306 - RNA, 19 nt, Mycobacterium bovis subsp bovis AF2122/97
cauggcgccguugccggcg

SEQ ID NO: 1072307 - RNA, 14 nt, Mycobacterium bovis subsp bovis AF2122/97
cauggcgcgcaacc

SEQ ID NO: 1072308 - RNA, 16 nt, Mycobacterium bovis subsp bovis AF2122/97
cauggcgcgcaaccgc

SEQ ID NO: 1072309 - RNA, 18 nt, Mycobacterium bovis subsp bovis AF2122/97
cauggcgcgcaaccgcug

SEQ ID NO: 1072310 - RNA, 15 nt, Mycobacterium bovis subsp bovis AF2122/97
cauggcgccgcgccg

SEQ ID NO: 1072311 - RNA, 20 nt, Mycobacterium bovis subsp bovis AF2122/97
cauggcggcuccgcccggcg

SEQ ID NO: 1072312 - RNA, 22 nt, Mycobacterium bovis subsp bovis AF2122/97
cauggcggcuccgcccggcgug

SEQ ID NO: 1072313 - RNA, 16 nt, Mycobacterium bovis subsp bovis AF2122/97
cauggcgggucggucg

SEQ ID NO: 1072314 - RNA, 22 nt, Mycobacterium bovis subsp bovis AF2122/97
caugggugaugcaacgcggcga

SEQ ID NO: 1072315 - RNA, 14 nt, Mycobacterium bovis subsp bovis AF2122/97
cauggguagccgcc

SEQ ID NO: 1072316 - RNA, 21 nt, Mycobacterium bovis subsp bovis AF2122/97
caugggucuggcaggccagca

SEQ ID NO: 1072317 - RNA, 12 nt, Mycobacterium bovis subsp bovis AF2122/97
caugggccggcg

SEQ ID NO: 1072318 - RNA, 13 nt, Mycobacterium bovis subsp bovis AF2122/97
caugggccggcgc

SEQ ID NO: 1072319 - RNA, 21 nt, Mycobacterium bovis subsp bovis AF2122/97
caugggggaacccccucgcga

SEQ ID NO: 1072320 - RNA, 13 nt, Mycobacterium bovis subsp bovis AF2122/97
cauggugagcugu

SEQ ID NO: 1072321 - RNA, 14 nt, Mycobacterium bovis subsp bovis AF2122/97
cauggucuucgcgg

SEQ ID NO: 1072322 - RNA, 15 nt, Mycobacterium bovis subsp bovis AF2122/97
cauggucgcgccacc

SEQ ID NO: 1072323 - RNA, 16 nt, Mycobacterium bovis subsp bovis AF2122/97
cauggucgcgccaccc

SEQ ID NO: 1072324 - RNA, 18 nt, Mycobacterium bovis subsp bovis AF2122/97
caugguccgaccagcggc

SEQ ID NO: 1072325 - RNA, 19 nt, Mycobacterium bovis subsp bovis AF2122/97
caugggcgccaucccgccg

SEQ ID NO: 1072326 - RNA, 17 nt, Mycobacterium bovis subsp bovis AF2122/97
cauggucgacgaacacc

SEQ ID NO: 1072327 - RNA, 19 nt, Mycobacterium bovis subsp bovis AF2122/97
caugguccaaccagcacca

SEQ ID NO: 1072328 - RNA, 17 nt, Mycobacterium bovis subsp bovis AF2122/97
caugguccacagccggc

SEQ ID NO: 1072329 - RNA, 20 nt, Mycobacterium bovis subsp bovis AF2122/97
caugguccacagccggcggc

SEQ ID NO: 1072330 - RNA, 20 nt, Mycobacterium bovis subsp bovis AF2122/97
caugguccagcacaucggcg

SEQ ID NO: 1072331 - RNA, 20 nt, Mycobacterium bovis subsp bovis AF2122/97
caugguugaugacggcgucg

SEQ ID NO: 1072332 - RNA, 15 nt, Mycobacterium bovis subsp bovis AF2122/97
caugguuggugucgu

SEQ ID NO: 1072333 - RNA, 16 nt, Mycobacterium bovis subsp bovis AF2122/97
cauggugguggccggg

SEQ ID NO: 1072334 - RNA, 15 nt, Mycobacterium bovis subsp bovis AF2122/97
caugguggcgccgac

SEQ ID NO: 1072335 - RNA, 17 nt, Mycobacterium bovis subsp bovis AF2122/97
caugguggcgccgaccu

SEQ ID NO: 1072336 - RNA, 19 nt, Mycobacterium bovis subsp bovis AF2122/97
caugcggguaaaccaggug

SEQ ID NO: 1072337 - RNA, 19 nt, Mycobacterium bovis subsp bovis AF2122/97
caugcggcggcgcucgucg

SEQ ID NO: 1072338 - RNA, 13 nt, Mycobacterium bovis subsp bovis AF2122/97
caugcgugccggc

SEQ ID NO: 1072339 - RNA, 20 nt, Mycobacterium bovis subsp bovis AF2122/97
caugcgguuugccggugcgg

SEQ ID NO: 1072340 - RNA, 21 nt, Mycobacterium bovis subsp bovis AF2122/97
caugcgguuugccggugcggu

SEQ ID NO: 1072341 - RNA, 18 nt, Mycobacterium bovis subsp bovis AF2122/97
caugcgguuuggaucacc

SEQ ID NO: 1072342 - RNA, 20 nt, Mycobacterium bovis subsp bovis AF2122/97
caugcggauucgcgcugucc

SEQ ID NO: 1072343 - RNA, 20 nt, Mycobacterium bovis subsp bovis AF2122/97
caugcggaauuugcuugggc

SEQ ID NO: 1072344 - RNA, 21 nt, Mycobacterium bovis subsp bovis AF2122/97
caugcggaauuugcuugggcc

SEQ ID NO: 1072345 - RNA, 14 nt, Mycobacterium bovis subsp bovis AF2122/97
caugcggaucggcg

SEQ ID NO: 1072346 - RNA, 17 nt, Mycobacterium bovis subsp bovis AF2122/97
caugcuccuaucacugg

SEQ ID NO: 1072347 - RNA, 14 nt, Mycobacterium bovis subsp bovis AF2122/97
caugcucgacgccc

SEQ ID NO: 1072348 - RNA, 17 nt, Mycobacterium bovis subsp bovis AF2122/97
caugcucgacgcccgcc

SEQ ID NO: 1072349 - RNA, 22 nt, Mycobacterium bovis subsp bovis AF2122/97
caugcguuggggcacgacgccg

SEQ ID NO: 1072350 - RNA, 15 nt, Mycobacterium bovis subsp bovis AF2122/97
caugcugcucgagga

SEQ ID NO: 1072351 - RNA, 21 nt, Mycobacterium bovis subsp bovis AF2122/97
caugcugucggugccgucgag

SEQ ID NO: 1072352 - RNA, 19 nt, Mycobacterium bovis subsp bovis AF2122/97
caugcugucguagcgcgag

SEQ ID NO: 1072353 - RNA, 20 nt, Mycobacterium bovis subsp bovis AF2122/97
cauggacggauaguucacca

SEQ ID NO: 1072354 - RNA, 19 nt, Mycobacterium bovis subsp bovis AF2122/97
caugcuggucagcggcgcg

SEQ ID NO: 1072355 - RNA, 15 nt, Mycobacterium bovis subsp bovis AF2122/97
caugcgcguccagcu

SEQ ID NO: 1072356 - RNA, 16 nt, Mycobacterium bovis subsp bovis AF2122/97
caugcgcguccagcug

SEQ ID NO: 1072357 - RNA, 20 nt, Mycobacterium bovis subsp bovis AF2122/97
caugcgcuccggcgcgacgc

SEQ ID NO: 1072358 - RNA, 12 nt, Mycobacterium bovis subsp bovis AF2122/97
caugcgcucgcg

SEQ ID NO: 1072359 - RNA, 21 nt, Mycobacterium bovis subsp bovis AF2122/97
caugcggaucacaucggccau

SEQ ID NO: 1072360 - RNA, 19 nt, Mycobacterium bovis subsp bovis AF2122/97
caugcgcuggaaugcgguc

SEQ ID NO: 1072361 - RNA, 19 nt, Mycobacterium bovis subsp bovis AF2122/97
caugcgcagaaacgccgag

SEQ ID NO: 1072362 - RNA, 23 nt, Mycobacterium bovis subsp bovis AF2122/97
caugcgcagaaacgccgagcgcc

SEQ ID NO: 1072363 - RNA, 13 nt, Mycobacterium bovis subsp bovis AF2122/97
caugcgcaccagu

SEQ ID NO: 1072364 - RNA, 18 nt, Mycobacterium bovis subsp bovis AF2122/97
caugcgauucugcguccu

SEQ ID NO: 1072365 - RNA, 20 nt, Mycobacterium bovis subsp bovis AF2122/97
caugcgcaccaguccagcgg

SEQ ID NO: 1072366 - RNA, 15 nt, Mycobacterium bovis subsp bovis AF2122/97
caugcgccaacccgg

SEQ ID NO: 1072367 - RNA, 15 nt, Mycobacterium bovis subsp bovis AF2122/97
caucgccgcggccag

SEQ ID NO: 1072368 - RNA, 16 nt, Mycobacterium bovis subsp bovis AF2122/97
caucgccgccgcgcgu

SEQ ID NO: 1072369 - RNA, 15 nt, Mycobacterium bovis subsp bovis AF2122/97
caucgccgccggugc

SEQ ID NO: 1072370 - RNA, 21 nt, Mycobacterium bovis subsp bovis AF2122/97
caucgccgccggugccgcccg

SEQ ID NO: 1072371 - RNA, 22 nt, Mycobacterium bovis subsp bovis AF2122/97
caucgccgccguugccgccguc

SEQ ID NO: 1072372 - RNA, 16 nt, Mycobacterium bovis subsp bovis AF2122/97
caucgccgacacccuc

SEQ ID NO: 1072373 - RNA, 17 nt, Mycobacterium bovis subsp bovis AF2122/97
caucgccgacacccucg

SEQ ID NO: 1072374 - RNA, 22 nt, Mycobacterium bovis subsp bovis AF2122/97
caucgcccugggcgccggcguc

SEQ ID NO: 1072375 - RNA, 19 nt, Mycobacterium bovis subsp bovis AF2122/97
caugccguugcgaucgcgu

SEQ ID NO: 1072376 - RNA, 19 nt, Mycobacterium bovis subsp bovis AF2122/97
caugccugcgaaacgcugg

SEQ ID NO: 1072377 - RNA, 19 nt, Mycobacterium bovis subsp bovis AF2122/97
caugcgacuucaucuucga

SEQ ID NO: 1072378 - RNA, 13 nt, Mycobacterium bovis subsp bovis AF2122/97
caucgccgacgcc

SEQ ID NO: 1072379 - RNA, 20 nt, Mycobacterium bovis subsp bovis AF2122/97
caugcgaggggcggcaaucg

SEQ ID NO: 1072380 - RNA, 16 nt, Mycobacterium bovis subsp bovis AF2122/97
cauguucucgaccgcg

SEQ ID NO: 1072381 - RNA, 17 nt, Mycobacterium bovis subsp bovis AF2122/97
cauguucucgaccgcgu

SEQ ID NO: 1072382 - RNA, 14 nt, Mycobacterium bovis subsp bovis AF2122/97
cauguucggccacc

SEQ ID NO: 1072383 - RNA, 15 nt, Mycobacterium bovis subsp bovis AF2122/97
cauguucggccacca

SEQ ID NO: 1072384 - RNA, 13 nt, Mycobacterium bovis subsp bovis AF2122/97
cauguucggccac

SEQ ID NO: 1072385 - RNA, 18 nt, Mycobacterium bovis subsp bovis AF2122/97
caugugguggcgccggcc

SEQ ID NO: 1072386 - RNA, 16 nt, Mycobacterium bovis subsp bovis AF2122/97
cauguguggcagcccc

SEQ ID NO: 1072387 - RNA, 17 nt, Mycobacterium bovis subsp bovis AF2122/97
cauguuccuugcggccg

SEQ ID NO: 1072388 - RNA, 19 nt, Mycobacterium bovis subsp bovis AF2122/97
cauguuccuugcggccgcu

SEQ ID NO: 1072389 - RNA, 14 nt, Mycobacterium bovis subsp bovis AF2122/97
cauguugcggacca

SEQ ID NO: 1072390 - RNA, 12 nt, Mycobacterium bovis subsp bovis AF2122/97
cauuagccggac

SEQ ID NO: 1072391 - RNA, 12 nt, Mycobacterium bovis subsp bovis AF2122/97
cauuaggccggg

SEQ ID NO: 1072392 - RNA, 13 nt, Mycobacterium bovis subsp bovis AF2122/97
cauuaggccgggg

SEQ ID NO: 1072393 - RNA, 19 nt, Mycobacterium bovis subsp bovis AF2122/97
cauguccgcagcggugcgc

SEQ ID NO: 1072394 - RNA, 19 nt, Mycobacterium bovis subsp bovis AF2122/97
caugucgagcacgccaacg

SEQ ID NO: 1072395 - RNA, 11 nt, Mycobacterium bovis subsp bovis AF2122/97
caugucgagga

SEQ ID NO: 1072396 - RNA, 23 nt, Mycobacterium bovis subsp bovis AF2122/97
caugucgaagaaccggccgacga

SEQ ID NO: 1072397 - RNA, 19 nt, Mycobacterium bovis subsp bovis AF2122/97
caugucgaucagcgcgacg

SEQ ID NO: 1072398 - RNA, 16 nt, Mycobacterium bovis subsp bovis AF2122/97
caugucgauccggcgc

SEQ ID NO: 1072399 - RNA, 19 nt, Mycobacterium bovis subsp bovis AF2122/97
caugucgaagaaccggccg

SEQ ID NO: 1072400 - RNA, 20 nt, Mycobacterium bovis subsp bovis AF2122/97
caugucgaagaaccggccga

SEQ ID NO: 1072401 - RNA, 21 nt, Mycobacterium bovis subsp bovis AF2122/97
caugucaagcgaugucccauc

SEQ ID NO: 1072402 - RNA, 14 nt, Mycobacterium bovis subsp bovis AF2122/97
cauguccaccagcg

SEQ ID NO: 1072403 - RNA, 16 nt, Mycobacterium bovis subsp bovis AF2122/97
cauguaccgaccgcgu

SEQ ID NO: 1072404 - RNA, 16 nt, Mycobacterium bovis subsp bovis AF2122/97
caugugggugaacacc

SEQ ID NO: 1072405 - RNA, 22 nt, Mycobacterium bovis subsp bovis AF2122/97
caugugacaucgggccgccgag

SEQ ID NO: 1072406 - RNA, 14 nt, Mycobacterium bovis subsp bovis AF2122/97
caugugaccggcga

SEQ ID NO: 1072407 - RNA, 21 nt, Mycobacterium bovis subsp bovis AF2122/97
caugugcgcgaccacccgccg

SEQ ID NO: 1072408 - RNA, 16 nt, Mycobacterium bovis subsp bovis AF2122/97
caugucgcggacccgc

SEQ ID NO: 1072409 - RNA, 14 nt, Mycobacterium bovis subsp bovis AF2122/97
caugucgcugccgc

SEQ ID NO: 1072410 - RNA, 14 nt, Mycobacterium bovis subsp bovis AF2122/97
caugucggccaccc

SEQ ID NO: 1072411 - RNA, 15 nt, Mycobacterium bovis subsp bovis AF2122/97
caugucggccaccgg

SEQ ID NO: 1072412 - RNA, 16 nt, Mycobacterium bovis subsp bovis AF2122/97
caugucggccggggcc

SEQ ID NO: 1072413 - RNA, 20 nt, Mycobacterium bovis subsp bovis AF2122/97
caugucggccggggccaccc

SEQ ID NO: 1072414 - RNA, 14 nt, Mycobacterium bovis subsp bovis AF2122/97
caugucuuguggug

SEQ ID NO: 1072415 - RNA, 15 nt, Mycobacterium bovis subsp bovis AF2122/97
caugucggcgcgccg

SEQ ID NO: 1072416 - RNA, 12 nt, Mycobacterium bovis subsp bovis AF2122/97
cauucaccgcgg

SEQ ID NO: 1072417 - RNA, 15 nt, Mycobacterium bovis subsp bovis AF2122/97
cauucauaggcccgc

SEQ ID NO: 1072418 - RNA, 13 nt, Mycobacterium bovis subsp bovis AF2122/97
cauucgguguggc

SEQ ID NO: 1072419 - RNA, 15 nt, Mycobacterium bovis subsp bovis AF2122/97
cauucgguguggccg

SEQ ID NO: 1072420 - RNA, 19 nt, Mycobacterium bovis subsp bovis AF2122/97
cauucgguguggccguggg

SEQ ID NO: 1072421 - RNA, 14 nt, Mycobacterium bovis subsp bovis AF2122/97
cauucccaacacag

SEQ ID NO: 1072422 - RNA, 20 nt, Mycobacterium bovis subsp bovis AF2122/97
cauucccgcucgcaggccgg

SEQ ID NO: 1072423 - RNA, 21 nt, Mycobacterium bovis subsp bovis AF2122/97
cauucccgcucgcaggccggc

SEQ ID NO: 1072424 - RNA, 17 nt, Mycobacterium bovis subsp bovis AF2122/97
cauucccgcucgcaggc

SEQ ID NO: 1072425 - RNA, 18 nt, Mycobacterium bovis subsp bovis AF2122/97
cauucccauaucgaucgg

SEQ ID NO: 1072426 - RNA, 17 nt, Mycobacterium bovis subsp bovis AF2122/97
cauugaucgacggccag

SEQ ID NO: 1072427 - RNA, 19 nt, Mycobacterium bovis subsp bovis AF2122/97
cauugaucgacggccagcc

SEQ ID NO: 1072428 - RNA, 17 nt, Mycobacterium bovis subsp bovis AF2122/97
cauugaguucggccacc

SEQ ID NO: 1072429 - RNA, 18 nt, Mycobacterium bovis subsp bovis AF2122/97
cauugaguucggccacca

SEQ ID NO: 1072430 - RNA, 21 nt, Mycobacterium bovis subsp bovis AF2122/97
cauugaguucggccaccaacc

SEQ ID NO: 1072431 - RNA, 22 nt, Mycobacterium bovis subsp bovis AF2122/97
cauugccgacgcgcggccagcc

SEQ ID NO: 1072432 - RNA, 15 nt, Mycobacterium bovis subsp bovis AF2122/97
cauugccauacagca

SEQ ID NO: 1072433 - RNA, 16 nt, Mycobacterium bovis subsp bovis AF2122/97
cauugcccgacgaugc

SEQ ID NO: 1072434 - RNA, 13 nt, Mycobacterium bovis subsp bovis AF2122/97
cauugccggcgac

SEQ ID NO: 1072435 - RNA, 14 nt, Mycobacterium bovis subsp bovis AF2122/97
cauugccgaugguc

SEQ ID NO: 1072436 - RNA, 16 nt, Mycobacterium bovis subsp bovis AF2122/97
cauugccgccggcgcc

SEQ ID NO: 1072437 - RNA, 14 nt, Mycobacterium bovis subsp bovis AF2122/97
cauugccgccggug

SEQ ID NO: 1072438 - RNA, 12 nt, Mycobacterium bovis subsp bovis AF2122/97
cauugccgccgu

SEQ ID NO: 1072439 - RNA, 13 nt, Mycobacterium bovis subsp bovis AF2122/97
cauugccgccguc

SEQ ID NO: 1072440 - RNA, 20 nt, Mycobacterium bovis subsp bovis AF2122/97
cauugccgccgucgccgccg

SEQ ID NO: 1072441 - RNA, 20 nt, Mycobacterium bovis subsp bovis AF2122/97
cauugccgccguugccgccg

SEQ ID NO: 1072442 - RNA, 17 nt, Mycobacterium bovis subsp bovis AF2122/97
cauugagcuggcgcccg

SEQ ID NO: 1072443 - RNA, 23 nt, Mycobacterium bovis subsp bovis AF2122/97
cauugaggaagccguuggcgacg

SEQ ID NO: 1072444 - RNA, 16 nt, Mycobacterium bovis subsp bovis AF2122/97
cauugacccgacgaug

SEQ ID NO: 1072445 - RNA, 16 nt, Mycobacterium bovis subsp bovis AF2122/97
cauucguggagccggc

SEQ ID NO: 1072446 - RNA, 17 nt, Mycobacterium bovis subsp bovis AF2122/97
cauucgugggaaccacc

SEQ ID NO: 1072447 - RNA, 14 nt, Mycobacterium bovis subsp bovis AF2122/97
cauucggcgagccg

SEQ ID NO: 1072448 - RNA, 19 nt, Mycobacterium bovis subsp bovis AF2122/97
cauucucggccggcggcgc

SEQ ID NO: 1072449 - RNA, 14 nt, Mycobacterium bovis subsp bovis AF2122/97
cauucucgccgacg

SEQ ID NO: 1072450 - RNA, 16 nt, Mycobacterium bovis subsp bovis AF2122/97
cauucucgccgacggc

SEQ ID NO: 1072451 - RNA, 18 nt, Mycobacterium bovis subsp bovis AF2122/97
cauugcgaacucgcugcc

SEQ ID NO: 1072452 - RNA, 20 nt, Mycobacterium bovis subsp bovis AF2122/97
cauugccguucucgucgagg

SEQ ID NO: 1072453 - RNA, 13 nt, Mycobacterium bovis subsp bovis AF2122/97
cauugcugcucgu

SEQ ID NO: 1072454 - RNA, 22 nt, Mycobacterium bovis subsp bovis AF2122/97
cauuggcgaucagcagccgccg

SEQ ID NO: 1072455 - RNA, 15 nt, Mycobacterium bovis subsp bovis AF2122/97
cauuggcgccgccga

SEQ ID NO: 1072456 - RNA, 22 nt, Mycobacterium bovis subsp bovis AF2122/97
cauuggcgccgccgaucccguc

SEQ ID NO: 1072457 - RNA, 14 nt, Mycobacterium bovis subsp bovis AF2122/97
cauuggcggugcgc

SEQ ID NO: 1072458 - RNA, 22 nt, Mycobacterium bovis subsp bovis AF2122/97
cauuggcgucgacaacacgccg

SEQ ID NO: 1072459 - RNA, 13 nt, Mycobacterium bovis subsp bovis AF2122/97
cauugggcgggcu

SEQ ID NO: 1072460 - RNA, 17 nt, Mycobacterium bovis subsp bovis AF2122/97
cauugggguggcaucga

SEQ ID NO: 1072461 - RNA, 22 nt, Mycobacterium bovis subsp bovis AF2122/97
cauugggguggcaucgaacgcc

SEQ ID NO: 1072462 - RNA, 19 nt, Mycobacterium bovis subsp bovis AF2122/97
cauuggccaggucggccac

SEQ ID NO: 1072463 - RNA, 18 nt, Mycobacterium bovis subsp bovis AF2122/97
cauuggccuaggacaccg

SEQ ID NO: 1072464 - RNA, 20 nt, Mycobacterium bovis subsp bovis AF2122/97
cauuggccuguucaacuccg

SEQ ID NO: 1072465 - RNA, 15 nt, Mycobacterium bovis subsp bovis AF2122/97
cauugguguccacca

SEQ ID NO: 1072466 - RNA, 23 nt, Mycobacterium bovis subsp bovis AF2122/97
cauuggcuccgaacauggccagc

SEQ ID NO: 1072467 - RNA, 21 nt, Mycobacterium bovis subsp bovis AF2122/97
cauuguccugaaaacaccgca

SEQ ID NO: 1072468 - RNA, 15 nt, Mycobacterium bovis subsp bovis AF2122/97
cauugucgccggaug

SEQ ID NO: 1072469 - RNA, 17 nt, Mycobacterium bovis subsp bovis AF2122/97
cauugguaccggcuucg

SEQ ID NO: 1072470 - RNA, 16 nt, Mycobacterium bovis subsp bovis AF2122/97
cauuucguggcgcgcc

SEQ ID NO: 1072471 - RNA, 14 nt, Mycobacterium bovis subsp bovis AF2122/97
ccaacccgggccgc

SEQ ID NO: 1072472 - RNA, 18 nt, Mycobacterium bovis subsp bovis AF2122/97
ccaacccgggccgccagg

SEQ ID NO: 1072473 - RNA, 13 nt, Mycobacterium bovis subsp bovis AF2122/97
ccaaccgggccgg

SEQ ID NO: 1072474 - RNA, 18 nt, Mycobacterium bovis subsp bovis AF2122/97
ccaaccgguagccaggcg

SEQ ID NO: 1072475 - RNA, 20 nt, Mycobacterium bovis subsp bovis AF2122/97
ccaaccggucaaacgcgcgc

SEQ ID NO: 1072476 - RNA, 12 nt, Mycobacterium bovis subsp bovis AF2122/97
ccaaccggucgu

SEQ ID NO: 1072477 - RNA, 13 nt, Mycobacterium bovis subsp bovis AF2122/97
ccaaccggucguc

SEQ ID NO: 1072478 - RNA, 16 nt, Mycobacterium bovis subsp bovis AF2122/97
ccaaccgguggccggu

SEQ ID NO: 1072479 - RNA, 19 nt, Mycobacterium bovis subsp bovis AF2122/97
ccaaccgguggccggucgu

SEQ ID NO: 1072480 - RNA, 17 nt, Mycobacterium bovis subsp bovis AF2122/97
ccaacuccaucagcgcg

SEQ ID NO: 1072481 - RNA, 14 nt, Mycobacterium bovis subsp bovis AF2122/97
ccaacuccucagcc

SEQ ID NO: 1072482 - RNA, 18 nt, Mycobacterium bovis subsp bovis AF2122/97
ccaacuccugcagcccgg

SEQ ID NO: 1072483 - RNA, 13 nt, Mycobacterium bovis subsp bovis AF2122/97
ccaacucgaccga

SEQ ID NO: 1072484 - RNA, 17 nt, Mycobacterium bovis subsp bovis AF2122/97
ccaaccgccggccagca

SEQ ID NO: 1072485 - RNA, 21 nt, Mycobacterium bovis subsp bovis AF2122/97
ccaacccgucuuaucggcguc

SEQ ID NO: 1072486 - RNA, 19 nt, Mycobacterium bovis subsp bovis AF2122/97
ccaacccuaaaccagccac

SEQ ID NO: 1072487 - RNA, 22 nt, Mycobacterium bovis subsp bovis AF2122/97
ccaacccuaaaccagccaccac

SEQ ID NO: 1072488 - RNA, 22 nt, Mycobacterium bovis subsp bovis AF2122/97
ccaacccauuucgucagcgacc

SEQ ID NO: 1072489 - RNA, 16 nt, Mycobacterium bovis subsp bovis AF2122/97
ccaaccccauggccag

SEQ ID NO: 1072490 - RNA, 14 nt, Mycobacterium bovis subsp bovis AF2122/97
ccaaccccgccggc

SEQ ID NO: 1072491 - RNA, 20 nt, Mycobacterium bovis subsp bovis AF2122/97
ccaaccccgccggccggaac

SEQ ID NO: 1072492 - RNA, 17 nt, Mycobacterium bovis subsp bovis AF2122/97
ccaacuggucgccaacg

SEQ ID NO: 1072493 - RNA, 22 nt, Mycobacterium bovis subsp bovis AF2122/97
ccaacuggucgccaacgccagc

SEQ ID NO: 1072494 - RNA, 22 nt, Mycobacterium bovis subsp bovis AF2122/97
ccaacugaauggcaccgaggcc

SEQ ID NO: 1072495 - RNA, 18 nt, Mycobacterium bovis subsp bovis AF2122/97
ccaacugaauggcaccga

SEQ ID NO: 1072496 - RNA, 14 nt, Mycobacterium bovis subsp bovis AF2122/97
ccaacugaaccgag

SEQ ID NO: 1072497 - RNA, 20 nt, Mycobacterium bovis subsp bovis AF2122/97
ccaacucggccaacgacggc

SEQ ID NO: 1072498 - RNA, 13 nt, Mycobacterium bovis subsp bovis AF2122/97
ccaacucggccaa

SEQ ID NO: 1072499 - RNA, 21 nt, Mycobacterium bovis subsp bovis AF2122/97
ccaacucggcccgggugacgg

SEQ ID NO: 1072500 - RNA, 15 nt, Mycobacterium bovis subsp bovis AF2122/97
ccaacucggcggcca

SEQ ID NO: 1072501 - RNA, 17 nt, Mycobacterium bovis subsp bovis AF2122/97
ccaacucggcggccagc

SEQ ID NO: 1072502 - RNA, 22 nt, Mycobacterium bovis subsp bovis AF2122/97
ccaacucguggaacuccguccg

SEQ ID NO: 1072503 - RNA, 13 nt, Mycobacterium bovis subsp bovis AF2122/97
ccaagcccgccgg

SEQ ID NO: 1072504 - RNA, 13 nt, Mycobacterium bovis subsp bovis AF2122/97
ccaagccgccggc

SEQ ID NO: 1072505 - RNA, 21 nt, Mycobacterium bovis subsp bovis AF2122/97
ccaagccgcggcuaggccagc

SEQ ID NO: 1072506 - RNA, 21 nt, Mycobacterium bovis subsp bovis AF2122/97
ccaagccgggugggagcagcc

SEQ ID NO: 1072507 - RNA, 22 nt, Mycobacterium bovis subsp bovis AF2122/97
ccaagccgggugggagcagccg

SEQ ID NO: 1072508 - RNA, 17 nt, Mycobacterium bovis subsp bovis AF2122/97
ccaagcgacucgccggc

SEQ ID NO: 1072509 - RNA, 13 nt, Mycobacterium bovis subsp bovis AF2122/97
ccaagcguccgcu

SEQ ID NO: 1072510 - RNA, 16 nt, Mycobacterium bovis subsp bovis AF2122/97
ccaagcgugcugccgc

SEQ ID NO: 1072511 - RNA, 12 nt, Mycobacterium bovis subsp bovis AF2122/97
ccaacacgucga

SEQ ID NO: 1072512 - RNA, 22 nt, Mycobacterium bovis subsp bovis AF2122/97
ccaacacuggggccccgggaag

SEQ ID NO: 1072513 - RNA, 13 nt, Mycobacterium bovis subsp bovis AF2122/97
ccaacaccgcggc

SEQ ID NO: 1072514 - RNA, 15 nt, Mycobacterium bovis subsp bovis AF2122/97
ccaacaccgcggcgc

SEQ ID NO: 1072515 - RNA, 17 nt, Mycobacterium bovis subsp bovis AF2122/97
ccaacaccgcggcgcug

SEQ ID NO: 1072516 - RNA, 15 nt, Mycobacterium bovis subsp bovis AF2122/97
ccaacacccgccggu

SEQ ID NO: 1072517 - RNA, 18 nt, Mycobacterium bovis subsp bovis AF2122/97
ccaacaaaggccgggugg

SEQ ID NO: 1072518 - RNA, 12 nt, Mycobacterium bovis subsp bovis AF2122/97
ccaacaccgcgc

SEQ ID NO: 1072519 - RNA, 16 nt, Mycobacterium bovis subsp bovis AF2122/97
ccaacaccgcgccgac

SEQ ID NO: 1072520 - RNA, 20 nt, Mycobacterium bovis subsp bovis AF2122/97
ccaacaccgcgccgacgaaa

SEQ ID NO: 1072521 - RNA, 12 nt, Mycobacterium bovis subsp bovis AF2122/97
ccaacaccagca

SEQ ID NO: 1072522 - RNA, 14 nt, Mycobacterium bovis subsp bovis AF2122/97
ccaacaccagcagc

SEQ ID NO: 1072523 - RNA, 15 nt, Mycobacterium bovis subsp bovis AF2122/97
ccaacaccagcagca

SEQ ID NO: 1072524 - RNA, 12 nt, Mycobacterium bovis subsp bovis AF2122/97
ccaacaccaacc

SEQ ID NO: 1072525 - RNA, 15 nt, Mycobacterium bovis subsp bovis AF2122/97
ccaacaccagcgcgu

SEQ ID NO: 1072526 - RNA, 14 nt, Mycobacterium bovis subsp bovis AF2122/97
ccaacaccagguca

SEQ ID NO: 1072527 - RNA, 20 nt, Mycobacterium bovis subsp bovis AF2122/97
ccaaaugccccgaaccgcgc

SEQ ID NO: 1072528 - RNA, 13 nt, Mycobacterium bovis subsp bovis AF2122/97
ccaaacgccauca

SEQ ID NO: 1072529 - RNA, 15 nt, Mycobacterium bovis subsp bovis AF2122/97
ccaaacuacccgccc

SEQ ID NO: 1072530 - RNA, 23 nt, Mycobacterium bovis subsp bovis AF2122/97
ccaaacccaugucggcgcgccgc

SEQ ID NO: 1072531 - RNA, 13 nt, Mycobacterium bovis subsp bovis AF2122/97
ccaaacccggcgg

SEQ ID NO: 1072532 - RNA, 23 nt, Mycobacterium bovis subsp bovis AF2122/97
ccaaaacggucgaccgugcgucg

SEQ ID NO: 1072533 - RNA, 20 nt, Mycobacterium bovis subsp bovis AF2122/97
ccaaaagggcggcagcgagg

SEQ ID NO: 1072534 - RNA, 14 nt, Mycobacterium bovis subsp bovis AF2122/97
ccaaacaccccggc

SEQ ID NO: 1072535 - RNA, 21 nt, Mycobacterium bovis subsp bovis AF2122/97
ccaaacacccuugcccacggc

SEQ ID NO: 1072536 - RNA, 16 nt, Mycobacterium bovis subsp bovis AF2122/97
ccaaaaagaccgccgc

SEQ ID NO: 1072537 - RNA, 13 nt, Mycobacterium bovis subsp bovis AF2122/97
ccacccagggccu

SEQ ID NO: 1072538 - RNA, 23 nt, Mycobacterium bovis subsp bovis AF2122/97
ccacccagugccacgccugagcc

SEQ ID NO: 1072539 - RNA, 18 nt, Mycobacterium bovis subsp bovis AF2122/97
ccacccauagacccggcu

SEQ ID NO: 1072540 - RNA, 16 nt, Mycobacterium bovis subsp bovis AF2122/97
ccaccccgaggccgac

SEQ ID NO: 1072541 - RNA, 16 nt, Mycobacterium bovis subsp bovis AF2122/97
ccaccagguccacccc

SEQ ID NO: 1072542 - RNA, 22 nt, Mycobacterium bovis subsp bovis AF2122/97
ccaccaucgccucggcgcugcg

SEQ ID NO: 1072543 - RNA, 15 nt, Mycobacterium bovis subsp bovis AF2122/97
ccacccacgccgacu

SEQ ID NO: 1072544 - RNA, 20 nt, Mycobacterium bovis subsp bovis AF2122/97
ccacccacauggcggcccgg

SEQ ID NO: 1072545 - RNA, 18 nt, Mycobacterium bovis subsp bovis AF2122/97
ccaccauucgcgggccga

SEQ ID NO: 1072546 - RNA, 23 nt, Mycobacterium bovis subsp bovis AF2122/97
ccaccauucgcgggccgaggccg

SEQ ID NO: 1072547 - RNA, 17 nt, Mycobacterium bovis subsp bovis AF2122/97
ccacccaagcucgguca

SEQ ID NO: 1072548 - RNA, 15 nt, Mycobacterium bovis subsp bovis AF2122/97
ccaccaggcccaucu

SEQ ID NO: 1072549 - RNA, 12 nt, Mycobacterium bovis subsp bovis AF2122/97
ccaccagcacgc

SEQ ID NO: 1072550 - RNA, 18 nt, Mycobacterium bovis subsp bovis AF2122/97
ccaccaccgcugccggcg

SEQ ID NO: 1072551 - RNA, 12 nt, Mycobacterium bovis subsp bovis AF2122/97
ccaccaccggca

SEQ ID NO: 1072552 - RNA, 13 nt, Mycobacterium bovis subsp bovis AF2122/97
ccaccaccggcac

SEQ ID NO: 1072553 - RNA, 15 nt, Mycobacterium bovis subsp bovis AF2122/97
ccaccaccgagccgu

SEQ ID NO: 1072554 - RNA, 13 nt, Mycobacterium bovis subsp bovis AF2122/97
ccaccaccgccgg

SEQ ID NO: 1072555 - RNA, 19 nt, Mycobacterium bovis subsp bovis AF2122/97
ccaccaccgccggugccgc

SEQ ID NO: 1072556 - RNA, 19 nt, Mycobacterium bovis subsp bovis AF2122/97
ccaccaccggugaacacca

SEQ ID NO: 1072557 - RNA, 17 nt, Mycobacterium bovis subsp bovis AF2122/97
ccaccaccuccgcgucg

SEQ ID NO: 1072558 - RNA, 22 nt, Mycobacterium bovis subsp bovis AF2122/97
ccaccagaaacaccgacgacgg

SEQ ID NO: 1072559 - RNA, 23 nt, Mycobacterium bovis subsp bovis AF2122/97
ccaccagaaacaccgacgacggc

SEQ ID NO: 1072560 - RNA, 14 nt, Mycobacterium bovis subsp bovis AF2122/97
ccaccagaaccacu

SEQ ID NO: 1072561 - RNA, 17 nt, Mycobacterium bovis subsp bovis AF2122/97
ccaccagaaccagcgac

SEQ ID NO: 1072562 - RNA, 16 nt, Mycobacterium bovis subsp bovis AF2122/97
ccaccagacaacgccg

SEQ ID NO: 1072563 - RNA, 14 nt, Mycobacterium bovis subsp bovis AF2122/97
ccacaucaggucgg

SEQ ID NO: 1072564 - RNA, 17 nt, Mycobacterium bovis subsp bovis AF2122/97
ccacauccuggcggcug

SEQ ID NO: 1072565 - RNA, 17 nt, Mycobacterium bovis subsp bovis AF2122/97
ccacaucaacuugccgc

SEQ ID NO: 1072566 - RNA, 19 nt, Mycobacterium bovis subsp bovis AF2122/97
ccacaucagccgcaccagu

SEQ ID NO: 1072567 - RNA, 20 nt, Mycobacterium bovis subsp bovis AF2122/97
ccacaucgucggcgggcggc

SEQ ID NO: 1072568 - RNA, 16 nt, Mycobacterium bovis subsp bovis AF2122/97
ccacaucgaugucggc

SEQ ID NO: 1072569 - RNA, 17 nt, Mycobacterium bovis subsp bovis AF2122/97
ccacaucgaugucggcu

SEQ ID NO: 1072570 - RNA, 14 nt, Mycobacterium bovis subsp bovis AF2122/97
ccacaucgccagca

SEQ ID NO: 1072571 - RNA, 23 nt, Mycobacterium bovis subsp bovis AF2122/97
ccacaucgaacgacgcauccgga

SEQ ID NO: 1072572 - RNA, 13 nt, Mycobacterium bovis subsp bovis AF2122/97
ccaccaccacggc

SEQ ID NO: 1072573 - RNA, 15 nt, Mycobacterium bovis subsp bovis AF2122/97
ccaccaccacggcca

SEQ ID NO: 1072574 - RNA, 12 nt, Mycobacterium bovis subsp bovis AF2122/97
ccaccaccaacg

SEQ ID NO: 1072575 - RNA, 21 nt, Mycobacterium bovis subsp bovis AF2122/97
ccacauuccguagccggcggu

SEQ ID NO: 1072576 - RNA, 18 nt, Mycobacterium bovis subsp bovis AF2122/97
ccacauggcggcccggug

SEQ ID NO: 1072577 - RNA, 21 nt, Mycobacterium bovis subsp bovis AF2122/97
ccacauguugucgacggucgg

SEQ ID NO: 1072578 - RNA, 22 nt, Mycobacterium bovis subsp bovis AF2122/97
ccacaugacgaucgcggcgggc

SEQ ID NO: 1072579 - RNA, 14 nt, Mycobacterium bovis subsp bovis AF2122/97
ccacauggcccgga

SEQ ID NO: 1072580 - RNA, 21 nt, Mycobacterium bovis subsp bovis AF2122/97
ccacacccgcgaacgcgacag

SEQ ID NO: 1072581 - RNA, 17 nt, Mycobacterium bovis subsp bovis AF2122/97
ccacacccaaaccggcc

SEQ ID NO: 1072582 - RNA, 20 nt, Mycobacterium bovis subsp bovis AF2122/97
ccacacccagcgugcccgcc

SEQ ID NO: 1072583 - RNA, 22 nt, Mycobacterium bovis subsp bovis AF2122/97
ccacacccagcgugcccgccac

SEQ ID NO: 1072584 - RNA, 14 nt, Mycobacterium bovis subsp bovis AF2122/97
ccacacccaguuga

SEQ ID NO: 1072585 - RNA, 15 nt, Mycobacterium bovis subsp bovis AF2122/97
ccacaccacgauggc

SEQ ID NO: 1072586 - RNA, 16 nt, Mycobacterium bovis subsp bovis AF2122/97
ccacaccacgauggcg

SEQ ID NO: 1072587 - RNA, 22 nt, Mycobacterium bovis subsp bovis AF2122/97
ccacaccacgguggccgcugcc

SEQ ID NO: 1072588 - RNA, 22 nt, Mycobacterium bovis subsp bovis AF2122/97
ccacaccagcuuguagcgcucg

SEQ ID NO: 1072589 - RNA, 17 nt, Mycobacterium bovis subsp bovis AF2122/97
ccacaccaggccgagcc

SEQ ID NO: 1072590 - RNA, 23 nt, Mycobacterium bovis subsp bovis AF2122/97
ccacacagaucuugugccaggcg

SEQ ID NO: 1072591 - RNA, 16 nt, Mycobacterium bovis subsp bovis AF2122/97
ccacacagccgcgcug

SEQ ID NO: 1072592 - RNA, 17 nt, Mycobacterium bovis subsp bovis AF2122/97
ccacacagccgcgcugc

SEQ ID NO: 1072593 - RNA, 13 nt, Mycobacterium bovis subsp bovis AF2122/97
ccacagcgugcgg

SEQ ID NO: 1072594 - RNA, 14 nt, Mycobacterium bovis subsp bovis AF2122/97
ccacagccggcggc

SEQ ID NO: 1072595 - RNA, 19 nt, Mycobacterium bovis subsp bovis AF2122/97
ccacagcgacagcgugccg

SEQ ID NO: 1072596 - RNA, 14 nt, Mycobacterium bovis subsp bovis AF2122/97
ccacagcccggcga

SEQ ID NO: 1072597 - RNA, 14 nt, Mycobacterium bovis subsp bovis AF2122/97
ccacagcccggcgg

SEQ ID NO: 1072598 - RNA, 16 nt, Mycobacterium bovis subsp bovis AF2122/97
ccacagcccggcggcg

SEQ ID NO: 1072599 - RNA, 14 nt, Mycobacterium bovis subsp bovis AF2122/97
ccacagccgcgccg

SEQ ID NO: 1072600 - RNA, 15 nt, Mycobacterium bovis subsp bovis AF2122/97
ccacaccgcggcggc

SEQ ID NO: 1072601 - RNA, 16 nt, Mycobacterium bovis subsp bovis AF2122/97
ccacaccgcggcggcg

SEQ ID NO: 1072602 - RNA, 18 nt, Mycobacterium bovis subsp bovis AF2122/97
ccacaccgcggcggcgcg

SEQ ID NO: 1072603 - RNA, 11 nt, Mycobacterium bovis subsp bovis AF2122/97
ccacagcuugc

SEQ ID NO: 1072604 - RNA, 14 nt, Mycobacterium bovis subsp bovis AF2122/97
ccacaggcggcgcu

SEQ ID NO: 1072605 - RNA, 12 nt, Mycobacterium bovis subsp bovis AF2122/97
ccacaggugacc

SEQ ID NO: 1072606 - RNA, 17 nt, Mycobacterium bovis subsp bovis AF2122/97
ccacauacaggcccgcc

SEQ ID NO: 1072607 - RNA, 21 nt, Mycobacterium bovis subsp bovis AF2122/97
ccacagucgccggccggcccg

SEQ ID NO: 1072608 - RNA, 16 nt, Mycobacterium bovis subsp bovis AF2122/97
ccacagucgugagcca

SEQ ID NO: 1072609 - RNA, 14 nt, Mycobacterium bovis subsp bovis AF2122/97
ccacaaucgcagau

SEQ ID NO: 1072610 - RNA, 19 nt, Mycobacterium bovis subsp bovis AF2122/97
ccacaaugacucggccgca

SEQ ID NO: 1072611 - RNA, 14 nt, Mycobacterium bovis subsp bovis AF2122/97
ccaauugucaagcc

SEQ ID NO: 1072612 - RNA, 15 nt, Mycobacterium bovis subsp bovis AF2122/97
ccaauuggcgucguc

SEQ ID NO: 1072613 - RNA, 14 nt, Mycobacterium bovis subsp bovis AF2122/97
ccaauugcgccgag

SEQ ID NO: 1072614 - RNA, 18 nt, Mycobacterium bovis subsp bovis AF2122/97
ccaauugcggccgcgcgc

SEQ ID NO: 1072615 - RNA, 17 nt, Mycobacterium bovis subsp bovis AF2122/97
ccaauggagccgcgacc

SEQ ID NO: 1072616 - RNA, 15 nt, Mycobacterium bovis subsp bovis AF2122/97
ccaauucccgcgcgg

SEQ ID NO: 1072617 - RNA, 15 nt, Mycobacterium bovis subsp bovis AF2122/97
ccaaguugcagcggg

SEQ ID NO: 1072618 - RNA, 19 nt, Mycobacterium bovis subsp bovis AF2122/97
ccaaggacgaacgcgccgg

SEQ ID NO: 1072619 - RNA, 23 nt, Mycobacterium bovis subsp bovis AF2122/97
ccaagcugucaagcgggcuggcg

SEQ ID NO: 1072620 - RNA, 14 nt, Mycobacterium bovis subsp bovis AF2122/97
ccaagcucugcguc

SEQ ID NO: 1072621 - RNA, 21 nt, Mycobacterium bovis subsp bovis AF2122/97
ccaagcucggccaccagcgcc

SEQ ID NO: 1072622 - RNA, 15 nt, Mycobacterium bovis subsp bovis AF2122/97
ccaagcucggccagc

SEQ ID NO: 1072623 - RNA, 19 nt, Mycobacterium bovis subsp bovis AF2122/97
ccaagcucggccagcacgc

SEQ ID NO: 1072624 - RNA, 21 nt, Mycobacterium bovis subsp bovis AF2122/97
ccaagcucggccagcacgccg

SEQ ID NO: 1072625 - RNA, 13 nt, Mycobacterium bovis subsp bovis AF2122/97
ccaagcucggccc

SEQ ID NO: 1072626 - RNA, 19 nt, Mycobacterium bovis subsp bovis AF2122/97
ccaauacucgccaucgcgg

SEQ ID NO: 1072627 - RNA, 14 nt, Mycobacterium bovis subsp bovis AF2122/97
ccacgccgccggug

SEQ ID NO: 1072628 - RNA, 16 nt, Mycobacterium bovis subsp bovis AF2122/97
ccacgccggcaucguc

SEQ ID NO: 1072629 - RNA, 16 nt, Mycobacterium bovis subsp bovis AF2122/97
ccacgccguagcgcag

SEQ ID NO: 1072630 - RNA, 20 nt, Mycobacterium bovis subsp bovis AF2122/97
ccacgccguagcgcagcgcc

SEQ ID NO: 1072631 - RNA, 22 nt, Mycobacterium bovis subsp bovis AF2122/97
ccacgccguagcgcagcgccuc

SEQ ID NO: 1072632 - RNA, 12 nt, Mycobacterium bovis subsp bovis AF2122/97
ccacgccgguga

SEQ ID NO: 1072633 - RNA, 21 nt, Mycobacterium bovis subsp bovis AF2122/97
ccacgccgguggcacggcccc

SEQ ID NO: 1072634 - RNA, 14 nt, Mycobacterium bovis subsp bovis AF2122/97
ccacgccgucgaca

SEQ ID NO: 1072635 - RNA, 16 nt, Mycobacterium bovis subsp bovis AF2122/97
ccacgccguggcccgc

SEQ ID NO: 1072636 - RNA, 13 nt, Mycobacterium bovis subsp bovis AF2122/97
ccacgccugccga

SEQ ID NO: 1072637 - RNA, 14 nt, Mycobacterium bovis subsp bovis AF2122/97
ccacgccgacggca

SEQ ID NO: 1072638 - RNA, 18 nt, Mycobacterium bovis subsp bovis AF2122/97
ccacgccgacggcaccga

SEQ ID NO: 1072639 - RNA, 15 nt, Mycobacterium bovis subsp bovis AF2122/97
ccacgccgaugcggu

SEQ ID NO: 1072640 - RNA, 15 nt, Mycobacterium bovis subsp bovis AF2122/97
ccacgccgcaucggc

SEQ ID NO: 1072641 - RNA, 14 nt, Mycobacterium bovis subsp bovis AF2122/97
ccacgauccgcggu

SEQ ID NO: 1072642 - RNA, 16 nt, Mycobacterium bovis subsp bovis AF2122/97
ccacgauccgcgguag

SEQ ID NO: 1072643 - RNA, 19 nt, Mycobacterium bovis subsp bovis AF2122/97
ccacgaucagcagcgucgg

SEQ ID NO: 1072644 - RNA, 16 nt, Mycobacterium bovis subsp bovis AF2122/97
ccacgaguuggccaag

SEQ ID NO: 1072645 - RNA, 20 nt, Mycobacterium bovis subsp bovis AF2122/97
ccacgauaucgaugcggcga

SEQ ID NO: 1072646 - RNA, 18 nt, Mycobacterium bovis subsp bovis AF2122/97
ccacgagcguagcgaccu

SEQ ID NO: 1072647 - RNA, 17 nt, Mycobacterium bovis subsp bovis AF2122/97
ccacgagcaacgggcga

SEQ ID NO: 1072648 - RNA, 14 nt, Mycobacterium bovis subsp bovis AF2122/97
ccacgagcagccga

SEQ ID NO: 1072649 - RNA, 16 nt, Mycobacterium bovis subsp bovis AF2122/97
ccacgcguagcggucc

SEQ ID NO: 1072650 - RNA, 14 nt, Mycobacterium bovis subsp bovis AF2122/97
ccacgcguugacga

SEQ ID NO: 1072651 - RNA, 20 nt, Mycobacterium bovis subsp bovis AF2122/97
ccacgcgucgcuguuggcga

SEQ ID NO: 1072652 - RNA, 16 nt, Mycobacterium bovis subsp bovis AF2122/97
ccacgcucaacccgug

SEQ ID NO: 1072653 - RNA, 19 nt, Mycobacterium bovis subsp bovis AF2122/97
ccacggcgggaacggugcc

SEQ ID NO: 1072654 - RNA, 14 nt, Mycobacterium bovis subsp bovis AF2122/97
ccacggccagcggg

SEQ ID NO: 1072655 - RNA, 24 nt, Mycobacterium bovis subsp bovis AF2122/97
ccacggcgguugccccgaccgccg

SEQ ID NO: 1072656 - RNA, 19 nt, Mycobacterium bovis subsp bovis AF2122/97
ccacggcugaccggggucg

SEQ ID NO: 1072657 - RNA, 21 nt, Mycobacterium bovis subsp bovis AF2122/97
ccacggcugcccaugguggcg

SEQ ID NO: 1072658 - RNA, 16 nt, Mycobacterium bovis subsp bovis AF2122/97
ccacggcuguggccgc

SEQ ID NO: 1072659 - RNA, 16 nt, Mycobacterium bovis subsp bovis AF2122/97
ccacggcgucggccac

SEQ ID NO: 1072660 - RNA, 13 nt, Mycobacterium bovis subsp bovis AF2122/97
ccacggcgugguc

SEQ ID NO: 1072661 - RNA, 14 nt, Mycobacterium bovis subsp bovis AF2122/97
ccacggcguggucg

SEQ ID NO: 1072662 - RNA, 18 nt, Mycobacterium bovis subsp bovis AF2122/97
ccacggcguuacguggug

SEQ ID NO: 1072663 - RNA, 15 nt, Mycobacterium bovis subsp bovis AF2122/97
ccacggcguugccgc

SEQ ID NO: 1072664 - RNA, 17 nt, Mycobacterium bovis subsp bovis AF2122/97
ccacggcguugccgccg

SEQ ID NO: 1072665 - RNA, 23 nt, Mycobacterium bovis subsp bovis AF2122/97
ccacggcguugccgccggcucca

SEQ ID NO: 1072666 - RNA, 15 nt, Mycobacterium bovis subsp bovis AF2122/97
ccacggccagaaacc

SEQ ID NO: 1072667 - RNA, 19 nt, Mycobacterium bovis subsp bovis AF2122/97
ccacggccagaaacccggc

SEQ ID NO: 1072668 - RNA, 16 nt, Mycobacterium bovis subsp bovis AF2122/97
ccaccggcgucgacgu

SEQ ID NO: 1072669 - RNA, 22 nt, Mycobacterium bovis subsp bovis AF2122/97
ccaccggcgucugcccgcccag

SEQ ID NO: 1072670 - RNA, 14 nt, Mycobacterium bovis subsp bovis AF2122/97
ccaccgaccucgac

SEQ ID NO: 1072671 - RNA, 23 nt, Mycobacterium bovis subsp bovis AF2122/97
ccaccggggaagaucucggccag

SEQ ID NO: 1072672 - RNA, 15 nt, Mycobacterium bovis subsp bovis AF2122/97
ccaccgggcccgccg

SEQ ID NO: 1072673 - RNA, 22 nt, Mycobacterium bovis subsp bovis AF2122/97
ccaccgugguggacgaccgcgc

SEQ ID NO: 1072674 - RNA, 22 nt, Mycobacterium bovis subsp bovis AF2122/97
ccaccguacgacagucgcaguc

SEQ ID NO: 1072675 - RNA, 17 nt, Mycobacterium bovis subsp bovis AF2122/97
ccaccggugccgcccgc

SEQ ID NO: 1072676 - RNA, 21 nt, Mycobacterium bovis subsp bovis AF2122/97
ccaccggugccgcccgcgccg

SEQ ID NO: 1072677 - RNA, 15 nt, Mycobacterium bovis subsp bovis AF2122/97
ccaccggugccgccg

SEQ ID NO: 1072678 - RNA, 20 nt, Mycobacterium bovis subsp bovis AF2122/97
ccaccggugccgccguugcc

SEQ ID NO: 1072679 - RNA, 16 nt, Mycobacterium bovis subsp bovis AF2122/97
ccaccggugccggcga

SEQ ID NO: 1072680 - RNA, 15 nt, Mycobacterium bovis subsp bovis AF2122/97
ccaccgguaccgccg

SEQ ID NO: 1072681 - RNA, 16 nt, Mycobacterium bovis subsp bovis AF2122/97
ccaccgguaccgccgg

SEQ ID NO: 1072682 - RNA, 16 nt, Mycobacterium bovis subsp bovis AF2122/97
ccaccgguaccggcga

SEQ ID NO: 1072683 - RNA, 18 nt, Mycobacterium bovis subsp bovis AF2122/97
ccaccgguaccggcgacg

SEQ ID NO: 1072684 - RNA, 18 nt, Mycobacterium bovis subsp bovis AF2122/97
ccaccggugccggcgacg

SEQ ID NO: 1072685 - RNA, 17 nt, Mycobacterium bovis subsp bovis AF2122/97
ccaccguagccgagggu

SEQ ID NO: 1072686 - RNA, 21 nt, Mycobacterium bovis subsp bovis AF2122/97
ccaccccgcgcgccagcucgg

SEQ ID NO: 1072687 - RNA, 22 nt, Mycobacterium bovis subsp bovis AF2122/97
ccacccgcaccaccggccccac

SEQ ID NO: 1072688 - RNA, 22 nt, Mycobacterium bovis subsp bovis AF2122/97
ccaccccugcgguccgcugcca

SEQ ID NO: 1072689 - RNA, 14 nt, Mycobacterium bovis subsp bovis AF2122/97
ccaccccggccaac

SEQ ID NO: 1072690 - RNA, 13 nt, Mycobacterium bovis subsp bovis AF2122/97
ccaccccggccgc

SEQ ID NO: 1072691 - RNA, 15 nt, Mycobacterium bovis subsp bovis AF2122/97
ccaccccggccgcau

SEQ ID NO: 1072692 - RNA, 15 nt, Mycobacterium bovis subsp bovis AF2122/97
ccacccgcaccgccg

SEQ ID NO: 1072693 - RNA, 16 nt, Mycobacterium bovis subsp bovis AF2122/97
ccacccgcaccgccgg

SEQ ID NO: 1072694 - RNA, 14 nt, Mycobacterium bovis subsp bovis AF2122/97
ccacccgcaccgcg

SEQ ID NO: 1072695 - RNA, 15 nt, Mycobacterium bovis subsp bovis AF2122/97
ccacccgcagaccgg

SEQ ID NO: 1072696 - RNA, 24 nt, Mycobacterium bovis subsp bovis AF2122/97
ccacccugcacugcgcgugcucga

SEQ ID NO: 1072697 - RNA, 13 nt, Mycobacterium bovis subsp bovis AF2122/97
ccacccuugccgc

SEQ ID NO: 1072698 - RNA, 17 nt, Mycobacterium bovis subsp bovis AF2122/97
ccacccuugccgccggu

SEQ ID NO: 1072699 - RNA, 16 nt, Mycobacterium bovis subsp bovis AF2122/97
ccacccuugccgcugg

SEQ ID NO: 1072700 - RNA, 16 nt, Mycobacterium bovis subsp bovis AF2122/97
ccaccgaagccgccgg

SEQ ID NO: 1072701 - RNA, 16 nt, Mycobacterium bovis subsp bovis AF2122/97
ccaccgaacgcggcca

SEQ ID NO: 1072702 - RNA, 17 nt, Mycobacterium bovis subsp bovis AF2122/97
ccaccgaacgcggccac

SEQ ID NO: 1072703 - RNA, 18 nt, Mycobacterium bovis subsp bovis AF2122/97
ccaccgaacgcggccacc

SEQ ID NO: 1072704 - RNA, 20 nt, Mycobacterium bovis subsp bovis AF2122/97
ccaccgaacgugugggccau

SEQ ID NO: 1072705 - RNA, 23 nt, Mycobacterium bovis subsp bovis AF2122/97
ccaccccggucggagcggugccg

SEQ ID NO: 1072706 - RNA, 17 nt, Mycobacterium bovis subsp bovis AF2122/97
ccacccuuggcccggug

SEQ ID NO: 1072707 - RNA, 19 nt, Mycobacterium bovis subsp bovis AF2122/97
ccaccgaaaccggucagca

SEQ ID NO: 1072708 - RNA, 21 nt, Mycobacterium bovis subsp bovis AF2122/97
ccaccgaaauacccagcgcag

SEQ ID NO: 1072709 - RNA, 23 nt, Mycobacterium bovis subsp bovis AF2122/97
ccaccgaaauugcccuagcagca

SEQ ID NO: 1072710 - RNA, 15 nt, Mycobacterium bovis subsp bovis AF2122/97
ccaccgacagcaccc

SEQ ID NO: 1072711 - RNA, 17 nt, Mycobacterium bovis subsp bovis AF2122/97
ccaccgacagcacccgg

SEQ ID NO: 1072712 - RNA, 14 nt, Mycobacterium bovis subsp bovis AF2122/97
ccaccgacagcacc

SEQ ID NO: 1072713 - RNA, 15 nt, Mycobacterium bovis subsp bovis AF2122/97
ccaccgaccgcguaa

SEQ ID NO: 1072714 - RNA, 15 nt, Mycobacterium bovis subsp bovis AF2122/97
ccaccuggggccgca

SEQ ID NO: 1072715 - RNA, 20 nt, Mycobacterium bovis subsp bovis AF2122/97
ccaccucgacgcaccuaugg

SEQ ID NO: 1072716 - RNA, 18 nt, Mycobacterium bovis subsp bovis AF2122/97
ccaccuucaucaacgaca

SEQ ID NO: 1072717 - RNA, 20 nt, Mycobacterium bovis subsp bovis AF2122/97
ccaccuucugacgcggccgg

SEQ ID NO: 1072718 - RNA, 22 nt, Mycobacterium bovis subsp bovis AF2122/97
ccaccuucugacgcggccgggc

SEQ ID NO: 1072719 - RNA, 19 nt, Mycobacterium bovis subsp bovis AF2122/97
ccaccuguuggcaugccgc

SEQ ID NO: 1072720 - RNA, 16 nt, Mycobacterium bovis subsp bovis AF2122/97
ccaccguugggccgac

SEQ ID NO: 1072721 - RNA, 21 nt, Mycobacterium bovis subsp bovis AF2122/97
ccaccucaccgaucucgacca

SEQ ID NO: 1072722 - RNA, 22 nt, Mycobacterium bovis subsp bovis AF2122/97
ccaccuccugguugaccucggu

SEQ ID NO: 1072723 - RNA, 18 nt, Mycobacterium bovis subsp bovis AF2122/97
ccaccucgaucgcgccgu

SEQ ID NO: 1072724 - RNA, 22 nt, Mycobacterium bovis subsp bovis AF2122/97
ccaccguuugagcggccaccgu

SEQ ID NO: 1072725 - RNA, 23 nt, Mycobacterium bovis subsp bovis AF2122/97
ccaccguuugagcggccaccgua

SEQ ID NO: 1072726 - RNA, 20 nt, Mycobacterium bovis subsp bovis AF2122/97
ccaccguugccgaaccacgc

SEQ ID NO: 1072727 - RNA, 15 nt, Mycobacterium bovis subsp bovis AF2122/97
ccaccguugccgccg

SEQ ID NO: 1072728 - RNA, 17 nt, Mycobacterium bovis subsp bovis AF2122/97
ccaccucccgcagccgg

SEQ ID NO: 1072729 - RNA, 17 nt, Mycobacterium bovis subsp bovis AF2122/97
ccaccuccgaggccgcc

SEQ ID NO: 1072730 - RNA, 15 nt, Mycobacterium bovis subsp bovis AF2122/97
ccaccuccugguuga

SEQ ID NO: 1072731 - RNA, 14 nt, Mycobacterium bovis subsp bovis AF2122/97
ccaccuuggccaga

SEQ ID NO: 1072732 - RNA, 16 nt, Mycobacterium bovis subsp bovis AF2122/97
ccacgaccgccgauac

SEQ ID NO: 1072733 - RNA, 18 nt, Mycobacterium bovis subsp bovis AF2122/97
ccacgacgaacaccagcg

SEQ ID NO: 1072734 - RNA, 21 nt, Mycobacterium bovis subsp bovis AF2122/97
ccacgacgaacaccagcgcgc

SEQ ID NO: 1072735 - RNA, 14 nt, Mycobacterium bovis subsp bovis AF2122/97
ccaccuugccgaac

SEQ ID NO: 1072736 - RNA, 18 nt, Mycobacterium bovis subsp bovis AF2122/97
ccacgaccccggcgguac

SEQ ID NO: 1072737 - RNA, 20 nt, Mycobacterium bovis subsp bovis AF2122/97
ccacgaccgucucgguggug

SEQ ID NO: 1072738 - RNA, 21 nt, Mycobacterium bovis subsp bovis AF2122/97
ccacgaccgucucggugguga

SEQ ID NO: 1072739 - RNA, 13 nt, Mycobacterium bovis subsp bovis AF2122/97
ccacgacgucguc

SEQ ID NO: 1072740 - RNA, 12 nt, Mycobacterium bovis subsp bovis AF2122/97
ccagaccggcgg

SEQ ID NO: 1072741 - RNA, 20 nt, Mycobacterium bovis subsp bovis AF2122/97
ccagaccggcucgucgggca

SEQ ID NO: 1072742 - RNA, 19 nt, Mycobacterium bovis subsp bovis AF2122/97
ccagaccgccgacgccguu

SEQ ID NO: 1072743 - RNA, 22 nt, Mycobacterium bovis subsp bovis AF2122/97
ccagacccagcucgucgacguc

SEQ ID NO: 1072744 - RNA, 11 nt, Mycobacterium bovis subsp bovis AF2122/97
ccagagaucga

SEQ ID NO: 1072745 - RNA, 15 nt, Mycobacterium bovis subsp bovis AF2122/97
ccagagccgcgagca

SEQ ID NO: 1072746 - RNA, 15 nt, Mycobacterium bovis subsp bovis AF2122/97
ccagagcuucgccgc

SEQ ID NO: 1072747 - RNA, 17 nt, Mycobacterium bovis subsp bovis AF2122/97
ccagagcuucgccgcgc

SEQ ID NO: 1072748 - RNA, 12 nt, Mycobacterium bovis subsp bovis AF2122/97
ccagaggcccga

SEQ ID NO: 1072749 - RNA, 13 nt, Mycobacterium bovis subsp bovis AF2122/97
ccagagccgcgcg

SEQ ID NO: 1072750 - RNA, 23 nt, Mycobacterium bovis subsp bovis AF2122/97
ccagagccgcgcgccgguuggcc

SEQ ID NO: 1072751 - RNA, 12 nt, Mycobacterium bovis subsp bovis AF2122/97
ccagacauccag

SEQ ID NO: 1072752 - RNA, 15 nt, Mycobacterium bovis subsp bovis AF2122/97
ccagacccacgaugg

SEQ ID NO: 1072753 - RNA, 22 nt, Mycobacterium bovis subsp bovis AF2122/97
ccagacacuggccgucggcgug

SEQ ID NO: 1072754 - RNA, 16 nt, Mycobacterium bovis subsp bovis AF2122/97
ccagacaauccgccgc

SEQ ID NO: 1072755 - RNA, 19 nt, Mycobacterium bovis subsp bovis AF2122/97
ccagacaauccgccgccgg

SEQ ID NO: 1072756 - RNA, 21 nt, Mycobacterium bovis subsp bovis AF2122/97
ccagacaauccgccgccgggu

SEQ ID NO: 1072757 - RNA, 16 nt, Mycobacterium bovis subsp bovis AF2122/97
ccagaauuccggcgga

SEQ ID NO: 1072758 - RNA, 18 nt, Mycobacterium bovis subsp bovis AF2122/97
ccagaauuccggcggagc

SEQ ID NO: 1072759 - RNA, 13 nt, Mycobacterium bovis subsp bovis AF2122/97
ccagaaucgggcc

SEQ ID NO: 1072760 - RNA, 15 nt, Mycobacterium bovis subsp bovis AF2122/97
ccagcacaccgucga

SEQ ID NO: 1072761 - RNA, 14 nt, Mycobacterium bovis subsp bovis AF2122/97
ccagcacaccgccc

SEQ ID NO: 1072762 - RNA, 16 nt, Mycobacterium bovis subsp bovis AF2122/97
ccagcacaccgcccgc

SEQ ID NO: 1072763 - RNA, 19 nt, Mycobacterium bovis subsp bovis AF2122/97
ccagcacaccgucgacgac

SEQ ID NO: 1072764 - RNA, 14 nt, Mycobacterium bovis subsp bovis AF2122/97
ccagcacacccaga

SEQ ID NO: 1072765 - RNA, 18 nt, Mycobacterium bovis subsp bovis AF2122/97
ccagcacacgccuaccgc

SEQ ID NO: 1072766 - RNA, 15 nt, Mycobacterium bovis subsp bovis AF2122/97
ccagcaaugcccgca

SEQ ID NO: 1072767 - RNA, 15 nt, Mycobacterium bovis subsp bovis AF2122/97
ccagcacaucggcga

SEQ ID NO: 1072768 - RNA, 17 nt, Mycobacterium bovis subsp bovis AF2122/97
ccagcacaucggcgagc

SEQ ID NO: 1072769 - RNA, 14 nt, Mycobacterium bovis subsp bovis AF2122/97
ccagcaaggccagc

SEQ ID NO: 1072770 - RNA, 18 nt, Mycobacterium bovis subsp bovis AF2122/97
ccagcaacuuugagcaga

SEQ ID NO: 1072771 - RNA, 15 nt, Mycobacterium bovis subsp bovis AF2122/97
ccagaucaccgucga

SEQ ID NO: 1072772 - RNA, 18 nt, Mycobacterium bovis subsp bovis AF2122/97
ccagcaagugugagcaga

SEQ ID NO: 1072773 - RNA, 14 nt, Mycobacterium bovis subsp bovis AF2122/97
ccagauacgucguc

SEQ ID NO: 1072774 - RNA, 16 nt, Mycobacterium bovis subsp bovis AF2122/97
ccagauaggcaccaag

SEQ ID NO: 1072775 - RNA, 23 nt, Mycobacterium bovis subsp bovis AF2122/97
ccagauagguuccaccgggcguc

SEQ ID NO: 1072776 - RNA, 14 nt, Mycobacterium bovis subsp bovis AF2122/97
ccagauaucgaagc

SEQ ID NO: 1072777 - RNA, 18 nt, Mycobacterium bovis subsp bovis AF2122/97
ccagcaacgcgguggacc

SEQ ID NO: 1072778 - RNA, 16 nt, Mycobacterium bovis subsp bovis AF2122/97
ccagaucagccgccgc

SEQ ID NO: 1072779 - RNA, 18 nt, Mycobacterium bovis subsp bovis AF2122/97
ccagaucagccgccgccu

SEQ ID NO: 1072780 - RNA, 15 nt, Mycobacterium bovis subsp bovis AF2122/97
ccagagucgcccgca

SEQ ID NO: 1072781 - RNA, 16 nt, Mycobacterium bovis subsp bovis AF2122/97
ccagaguucccgaaac

SEQ ID NO: 1072782 - RNA, 14 nt, Mycobacterium bovis subsp bovis AF2122/97
ccagauaccaccgc

SEQ ID NO: 1072783 - RNA, 17 nt, Mycobacterium bovis subsp bovis AF2122/97
ccagauaccaccgccgc

SEQ ID NO: 1072784 - RNA, 23 nt, Mycobacterium bovis subsp bovis AF2122/97
ccagauaccaccgccgcugccgg

SEQ ID NO: 1072785 - RNA, 14 nt, Mycobacterium bovis subsp bovis AF2122/97
ccagauacccgcgu

SEQ ID NO: 1072786 - RNA, 22 nt, Mycobacterium bovis subsp bovis AF2122/97
ccagauacccgcguaccacggu

SEQ ID NO: 1072787 - RNA, 16 nt, Mycobacterium bovis subsp bovis AF2122/97
ccacguagcagcgccg

SEQ ID NO: 1072788 - RNA, 19 nt, Mycobacterium bovis subsp bovis AF2122/97
ccacguagcagcgccggca

SEQ ID NO: 1072789 - RNA, 19 nt, Mycobacterium bovis subsp bovis AF2122/97
ccacguacuccaccgcgcc

SEQ ID NO: 1072790 - RNA, 20 nt, Mycobacterium bovis subsp bovis AF2122/97
ccacguacuccaccgcgccg

SEQ ID NO: 1072791 - RNA, 18 nt, Mycobacterium bovis subsp bovis AF2122/97
ccacguaagcgguugucc

SEQ ID NO: 1072792 - RNA, 20 nt, Mycobacterium bovis subsp bovis AF2122/97
ccacguaagcgguuguccgg

SEQ ID NO: 1072793 - RNA, 16 nt, Mycobacterium bovis subsp bovis AF2122/97
ccacgguugccggcgg

SEQ ID NO: 1072794 - RNA, 17 nt, Mycobacterium bovis subsp bovis AF2122/97
ccacgguugccggcggc

SEQ ID NO: 1072795 - RNA, 21 nt, Mycobacterium bovis subsp bovis AF2122/97
ccacgguugccggcggcgacg

SEQ ID NO: 1072796 - RNA, 21 nt, Mycobacterium bovis subsp bovis AF2122/97
ccacggugucccgcgaggcaa

SEQ ID NO: 1072797 - RNA, 18 nt, Mycobacterium bovis subsp bovis AF2122/97
ccacggcuuugcggcgcg

SEQ ID NO: 1072798 - RNA, 14 nt, Mycobacterium bovis subsp bovis AF2122/97
ccacgguugccggc

SEQ ID NO: 1072799 - RNA, 15 nt, Mycobacterium bovis subsp bovis AF2122/97
ccacgguugccggcg

SEQ ID NO: 1072800 - RNA, 22 nt, Mycobacterium bovis subsp bovis AF2122/97
ccacgguggucccccgcagcca

SEQ ID NO: 1072801 - RNA, 13 nt, Mycobacterium bovis subsp bovis AF2122/97
ccacgguggccgc

SEQ ID NO: 1072802 - RNA, 22 nt, Mycobacterium bovis subsp bovis AF2122/97
ccacgguggccgcugccagccg

SEQ ID NO: 1072803 - RNA, 16 nt, Mycobacterium bovis subsp bovis AF2122/97
ccacgguggugggcua

SEQ ID NO: 1072804 - RNA, 24 nt, Mycobacterium bovis subsp bovis AF2122/97
ccacgguguaccagguggaccggc

SEQ ID NO: 1072805 - RNA, 18 nt, Mycobacterium bovis subsp bovis AF2122/97
ccacgguggagcgcgccu

SEQ ID NO: 1072806 - RNA, 17 nt, Mycobacterium bovis subsp bovis AF2122/97
ccacggcuuugcggcgc

SEQ ID NO: 1072807 - RNA, 20 nt, Mycobacterium bovis subsp bovis AF2122/97
ccacguccaacucggcccgg

SEQ ID NO: 1072808 - RNA, 22 nt, Mycobacterium bovis subsp bovis AF2122/97
ccacguccaacucggcccgggu

SEQ ID NO: 1072809 - RNA, 23 nt, Mycobacterium bovis subsp bovis AF2122/97
ccacguccgcaaccucgccgucg

SEQ ID NO: 1072810 - RNA, 18 nt, Mycobacterium bovis subsp bovis AF2122/97
ccacgucgaugugcgccc

SEQ ID NO: 1072811 - RNA, 21 nt, Mycobacterium bovis subsp bovis AF2122/97
ccacguccgcaaccucgccgu

SEQ ID NO: 1072812 - RNA, 14 nt, Mycobacterium bovis subsp bovis AF2122/97
ccacguagcagcag

SEQ ID NO: 1072813 - RNA, 16 nt, Mycobacterium bovis subsp bovis AF2122/97
ccacguccaacucggc

SEQ ID NO: 1072814 - RNA, 16 nt, Mycobacterium bovis subsp bovis AF2122/97
ccacgucgacggucug

SEQ ID NO: 1072815 - RNA, 22 nt, Mycobacterium bovis subsp bovis AF2122/97
ccacguucgcgggcgucccgca

SEQ ID NO: 1072816 - RNA, 15 nt, Mycobacterium bovis subsp bovis AF2122/97
ccacguuggccccgc

SEQ ID NO: 1072817 - RNA, 17 nt, Mycobacterium bovis subsp bovis AF2122/97
ccacguuguccgcgacg

SEQ ID NO: 1072818 - RNA, 18 nt, Mycobacterium bovis subsp bovis AF2122/97
ccacguugugcagcgcgu

SEQ ID NO: 1072819 - RNA, 20 nt, Mycobacterium bovis subsp bovis AF2122/97
ccacguugaugaugccggcg

SEQ ID NO: 1072820 - RNA, 15 nt, Mycobacterium bovis subsp bovis AF2122/97
ccacuacaucgauca

SEQ ID NO: 1072821 - RNA, 13 nt, Mycobacterium bovis subsp bovis AF2122/97
ccacugccaccgc

SEQ ID NO: 1072822 - RNA, 14 nt, Mycobacterium bovis subsp bovis AF2122/97
ccacugccaccgcg

SEQ ID NO: 1072823 - RNA, 15 nt, Mycobacterium bovis subsp bovis AF2122/97
ccacugccaccgcga

SEQ ID NO: 1072824 - RNA, 16 nt, Mycobacterium bovis subsp bovis AF2122/97
ccacugcccgccgacg

SEQ ID NO: 1072825 - RNA, 19 nt, Mycobacterium bovis subsp bovis AF2122/97
ccacugcccgccgacgcca

SEQ ID NO: 1072826 - RNA, 15 nt, Mycobacterium bovis subsp bovis AF2122/97
ccacugccagccgug

SEQ ID NO: 1072827 - RNA, 14 nt, Mycobacterium bovis subsp bovis AF2122/97
ccacugaccgcgau

SEQ ID NO: 1072828 - RNA, 19 nt, Mycobacterium bovis subsp bovis AF2122/97
ccacugaccgcgaucgccg

SEQ ID NO: 1072829 - RNA, 20 nt, Mycobacterium bovis subsp bovis AF2122/97
ccacucggucguugccgcgg

SEQ ID NO: 1072830 - RNA, 19 nt, Mycobacterium bovis subsp bovis AF2122/97
ccacucucgccacgccgug

SEQ ID NO: 1072831 - RNA, 17 nt, Mycobacterium bovis subsp bovis AF2122/97
ccacucuucgggcggcg

SEQ ID NO: 1072832 - RNA, 19 nt, Mycobacterium bovis subsp bovis AF2122/97
ccacucuucgggcggcguc

SEQ ID NO: 1072833 - RNA, 21 nt, Mycobacterium bovis subsp bovis AF2122/97
ccacguugaugaugccggcgu

SEQ ID NO: 1072834 - RNA, 22 nt, Mycobacterium bovis subsp bovis AF2122/97
ccacucaagauaacggcgaccg

SEQ ID NO: 1072835 - RNA, 21 nt, Mycobacterium bovis subsp bovis AF2122/97
ccacucacacaaccgacgggu

SEQ ID NO: 1072836 - RNA, 20 nt, Mycobacterium bovis subsp bovis AF2122/97
ccacucacauuggccagguc

SEQ ID NO: 1072837 - RNA, 21 nt, Mycobacterium bovis subsp bovis AF2122/97
ccacuaggaagguggcccgcg

SEQ ID NO: 1072838 - RNA, 12 nt, Mycobacterium bovis subsp bovis AF2122/97
ccacuacggccu

SEQ ID NO: 1072839 - RNA, 17 nt, Mycobacterium bovis subsp bovis AF2122/97
ccacuagcauugucgcc

SEQ ID NO: 1072840 - RNA, 14 nt, Mycobacterium bovis subsp bovis AF2122/97
ccacuugaugcucg

SEQ ID NO: 1072841 - RNA, 12 nt, Mycobacterium bovis subsp bovis AF2122/97
ccacuucggcgc

SEQ ID NO: 1072842 - RNA, 17 nt, Mycobacterium bovis subsp bovis AF2122/97
ccacuucggcgccgcgc

SEQ ID NO: 1072843 - RNA, 13 nt, Mycobacterium bovis subsp bovis AF2122/97
ccacugccgcgcg

SEQ ID NO: 1072844 - RNA, 16 nt, Mycobacterium bovis subsp bovis AF2122/97
ccacuuccacggcgug

SEQ ID NO: 1072845 - RNA, 20 nt, Mycobacterium bovis subsp bovis AF2122/97
ccagaaacgcgaugguggcc

SEQ ID NO: 1072846 - RNA, 18 nt, Mycobacterium bovis subsp bovis AF2122/97
ccacuuccgggcgaccaa

SEQ ID NO: 1072847 - RNA, 22 nt, Mycobacterium bovis subsp bovis AF2122/97
ccacuuggggcgccagggucgg

SEQ ID NO: 1072848 - RNA, 15 nt, Mycobacterium bovis subsp bovis AF2122/97
ccacuuggguggcgc

SEQ ID NO: 1072849 - RNA, 20 nt, Mycobacterium bovis subsp bovis AF2122/97
ccagcgagccguaucggacg

SEQ ID NO: 1072850 - RNA, 16 nt, Mycobacterium bovis subsp bovis AF2122/97
ccagcgagcgccaggu

SEQ ID NO: 1072851 - RNA, 15 nt, Mycobacterium bovis subsp bovis AF2122/97
ccagcgagcccagcu

SEQ ID NO: 1072852 - RNA, 19 nt, Mycobacterium bovis subsp bovis AF2122/97
ccagcgaaaauucggucuc

SEQ ID NO: 1072853 - RNA, 19 nt, Mycobacterium bovis subsp bovis AF2122/97
ccagcgagcauaccgccgc

SEQ ID NO: 1072854 - RNA, 17 nt, Mycobacterium bovis subsp bovis AF2122/97
ccagccuuuccggccgc

SEQ ID NO: 1072855 - RNA, 17 nt, Mycobacterium bovis subsp bovis AF2122/97
ccagccuuuuucggcga

SEQ ID NO: 1072856 - RNA, 21 nt, Mycobacterium bovis subsp bovis AF2122/97
ccagccuuuuucggcgagucg

SEQ ID NO: 1072857 - RNA, 22 nt, Mycobacterium bovis subsp bovis AF2122/97
ccagcgaggugggcgucaucga

SEQ ID NO: 1072858 - RNA, 14 nt, Mycobacterium bovis subsp bovis AF2122/97
ccagcgaggccagc

SEQ ID NO: 1072859 - RNA, 15 nt, Mycobacterium bovis subsp bovis AF2122/97
ccagcgaggccagcg

SEQ ID NO: 1072860 - RNA, 16 nt, Mycobacterium bovis subsp bovis AF2122/97
ccagcgauccaccaag

SEQ ID NO: 1072861 - RNA, 21 nt, Mycobacterium bovis subsp bovis AF2122/97
ccagccgguuggcugccggca

SEQ ID NO: 1072862 - RNA, 13 nt, Mycobacterium bovis subsp bovis AF2122/97
ccagccgugccgg

SEQ ID NO: 1072863 - RNA, 22 nt, Mycobacterium bovis subsp bovis AF2122/97
ccagccgugcuuguugcgcgac

SEQ ID NO: 1072864 - RNA, 19 nt, Mycobacterium bovis subsp bovis AF2122/97
ccagccguuuuccugaucg

SEQ ID NO: 1072865 - RNA, 13 nt, Mycobacterium bovis subsp bovis AF2122/97
ccagccugcuggc

SEQ ID NO: 1072866 - RNA, 22 nt, Mycobacterium bovis subsp bovis AF2122/97
ccagccguucucgcccacccgc

SEQ ID NO: 1072867 - RNA, 21 nt, Mycobacterium bovis subsp bovis AF2122/97
ccagccguggcggcgggccuc

SEQ ID NO: 1072868 - RNA, 22 nt, Mycobacterium bovis subsp bovis AF2122/97
ccagccuaccggcuacggcgac

SEQ ID NO: 1072869 - RNA, 21 nt, Mycobacterium bovis subsp bovis AF2122/97
ccagccgcggcccucgaugcc

SEQ ID NO: 1072870 - RNA, 23 nt, Mycobacterium bovis subsp bovis AF2122/97
ccagccgcggcgccuccgcucgg

SEQ ID NO: 1072871 - RNA, 16 nt, Mycobacterium bovis subsp bovis AF2122/97
ccagccgcgcguccgg

SEQ ID NO: 1072872 - RNA, 16 nt, Mycobacterium bovis subsp bovis AF2122/97
ccagccgaagaaccgg

SEQ ID NO: 1072873 - RNA, 20 nt, Mycobacterium bovis subsp bovis AF2122/97
ccagccgaagaaccggucgc

SEQ ID NO: 1072874 - RNA, 13 nt, Mycobacterium bovis subsp bovis AF2122/97
ccagccgacgccu

SEQ ID NO: 1072875 - RNA, 13 nt, Mycobacterium bovis subsp bovis AF2122/97
ccagccggugccg

SEQ ID NO: 1072876 - RNA, 14 nt, Mycobacterium bovis subsp bovis AF2122/97
ccagccggugccgc

SEQ ID NO: 1072877 - RNA, 15 nt, Mycobacterium bovis subsp bovis AF2122/97
ccagccggcagcagc

SEQ ID NO: 1072878 - RNA, 13 nt, Mycobacterium bovis subsp bovis AF2122/97
ccagccggugagc

SEQ ID NO: 1072879 - RNA, 20 nt, Mycobacterium bovis subsp bovis AF2122/97
ccagccggcagcagcgggcg

SEQ ID NO: 1072880 - RNA, 16 nt, Mycobacterium bovis subsp bovis AF2122/97
ccagccggaccgcgac

SEQ ID NO: 1072881 - RNA, 18 nt, Mycobacterium bovis subsp bovis AF2122/97
ccagccggaccgcgacgg

SEQ ID NO: 1072882 - RNA, 16 nt, Mycobacterium bovis subsp bovis AF2122/97
ccagccgcucacccgg

SEQ ID NO: 1072883 - RNA, 23 nt, Mycobacterium bovis subsp bovis AF2122/97
ccagccagcuggacuccggucag

SEQ ID NO: 1072884 - RNA, 18 nt, Mycobacterium bovis subsp bovis AF2122/97
ccagccagccugcuggcc

SEQ ID NO: 1072885 - RNA, 16 nt, Mycobacterium bovis subsp bovis AF2122/97
ccagccaggcgaagua

SEQ ID NO: 1072886 - RNA, 18 nt, Mycobacterium bovis subsp bovis AF2122/97
ccagcccgucaucgcgua

SEQ ID NO: 1072887 - RNA, 14 nt, Mycobacterium bovis subsp bovis AF2122/97
ccagcccuucagcg

SEQ ID NO: 1072888 - RNA, 20 nt, Mycobacterium bovis subsp bovis AF2122/97
ccagccgacaacuguccugc

SEQ ID NO: 1072889 - RNA, 15 nt, Mycobacterium bovis subsp bovis AF2122/97
ccagcccuuggcgcg

SEQ ID NO: 1072890 - RNA, 21 nt, Mycobacterium bovis subsp bovis AF2122/97
ccagcgccgccgccgacgaag

SEQ ID NO: 1072891 - RNA, 13 nt, Mycobacterium bovis subsp bovis AF2122/97
ccagcgccgccgg

SEQ ID NO: 1072892 - RNA, 14 nt, Mycobacterium bovis subsp bovis AF2122/97
ccagcgccgccggc

SEQ ID NO: 1072893 - RNA, 16 nt, Mycobacterium bovis subsp bovis AF2122/97
ccagcgccgccggcgc

SEQ ID NO: 1072894 - RNA, 13 nt, Mycobacterium bovis subsp bovis AF2122/97
ccagcgccaccgu

SEQ ID NO: 1072895 - RNA, 21 nt, Mycobacterium bovis subsp bovis AF2122/97
ccagcgccaccguuaccgccg

SEQ ID NO: 1072896 - RNA, 17 nt, Mycobacterium bovis subsp bovis AF2122/97
ccagcgccgcggcccgc

SEQ ID NO: 1072897 - RNA, 13 nt, Mycobacterium bovis subsp bovis AF2122/97
ccagcgccgcggc

SEQ ID NO: 1072898 - RNA, 15 nt, Mycobacterium bovis subsp bovis AF2122/97
ccagcgccggccagg

SEQ ID NO: 1072899 - RNA, 12 nt, Mycobacterium bovis subsp bovis AF2122/97
ccagcgcggcgc

SEQ ID NO: 1072900 - RNA, 12 nt, Mycobacterium bovis subsp bovis AF2122/97
ccagcgcggcga

SEQ ID NO: 1072901 - RNA, 13 nt, Mycobacterium bovis subsp bovis AF2122/97
ccagcgcguggaa

SEQ ID NO: 1072902 - RNA, 14 nt, Mycobacterium bovis subsp bovis AF2122/97
ccagcgcgcgccgc

SEQ ID NO: 1072903 - RNA, 18 nt, Mycobacterium bovis subsp bovis AF2122/97
ccagcgccuugaccagca

SEQ ID NO: 1072904 - RNA, 22 nt, Mycobacterium bovis subsp bovis AF2122/97
ccagcgccuugacgccaguugc

SEQ ID NO: 1072905 - RNA, 13 nt, Mycobacterium bovis subsp bovis AF2122/97
ccagcgcgagccc

SEQ ID NO: 1072906 - RNA, 13 nt, Mycobacterium bovis subsp bovis AF2122/97
ccagcgcgcgcgg

SEQ ID NO: 1072907 - RNA, 17 nt, Mycobacterium bovis subsp bovis AF2122/97
ccagcgcgcgcgggugc

SEQ ID NO: 1072908 - RNA, 17 nt, Mycobacterium bovis subsp bovis AF2122/97
ccagcgccuccagcacc

SEQ ID NO: 1072909 - RNA, 15 nt, Mycobacterium bovis subsp bovis AF2122/97
aaaucaagcacagcc

SEQ ID NO: 1072910 - RNA, 13 nt, Mycobacterium bovis subsp bovis AF2122/97
ccagcaggcggcu

SEQ ID NO: 1072911 - RNA, 14 nt, Mycobacterium bovis subsp bovis AF2122/97
ccagcaggcggcuc

SEQ ID NO: 1072912 - RNA, 12 nt, Mycobacterium bovis subsp bovis AF2122/97
ccagcaggccgg

SEQ ID NO: 1072913 - RNA, 17 nt, Mycobacterium bovis subsp bovis AF2122/97
ccagcagggccaccacc

SEQ ID NO: 1072914 - RNA, 20 nt, Mycobacterium bovis subsp bovis AF2122/97
ccagcagggccaccaccacg

SEQ ID NO: 1072915 - RNA, 16 nt, Mycobacterium bovis subsp bovis AF2122/97
ccagcaucucggcggc

SEQ ID NO: 1072916 - RNA, 15 nt, Mycobacterium bovis subsp bovis AF2122/97
ccagcaucggcagca

SEQ ID NO: 1072917 - RNA, 22 nt, Mycobacterium bovis subsp bovis AF2122/97
ccagcaucggcagcagcgcaac

SEQ ID NO: 1072918 - RNA, 12 nt, Mycobacterium bovis subsp bovis AF2122/97
ccagcagggugu

SEQ ID NO: 1072919 - RNA, 14 nt, Mycobacterium bovis subsp bovis AF2122/97
ccagcaucucggcc

SEQ ID NO: 1072920 - RNA, 19 nt, Mycobacterium bovis subsp bovis AF2122/97
ccagcaugacaccggccac

SEQ ID NO: 1072921 - RNA, 20 nt, Mycobacterium bovis subsp bovis AF2122/97
ccagcaugacaccggccacc

SEQ ID NO: 1072922 - RNA, 23 nt, Mycobacterium bovis subsp bovis AF2122/97
ccagcauggcuuuugcgccgaau

SEQ ID NO: 1072923 - RNA, 14 nt, Mycobacterium bovis subsp bovis AF2122/97
ccagccagccgccc

SEQ ID NO: 1072924 - RNA, 17 nt, Mycobacterium bovis subsp bovis AF2122/97
ccagcaugucgggccgc

SEQ ID NO: 1072925 - RNA, 16 nt, Mycobacterium bovis subsp bovis AF2122/97
ccagcagcucggccga

SEQ ID NO: 1072926 - RNA, 12 nt, Mycobacterium bovis subsp bovis AF2122/97
ccagcaggccga

SEQ ID NO: 1072927 - RNA, 21 nt, Mycobacterium bovis subsp bovis AF2122/97
ccagcaggaacgccgugccgu

SEQ ID NO: 1072928 - RNA, 13 nt, Mycobacterium bovis subsp bovis AF2122/97
ccagcaggaagua

SEQ ID NO: 1072929 - RNA, 12 nt, Mycobacterium bovis subsp bovis AF2122/97
ccagcagcgacg

SEQ ID NO: 1072930 - RNA, 14 nt, Mycobacterium bovis subsp bovis AF2122/97
ccagcagcggcgag

SEQ ID NO: 1072931 - RNA, 13 nt, Mycobacterium bovis subsp bovis AF2122/97
ccagcagcugcga

SEQ ID NO: 1072932 - RNA, 23 nt, Mycobacterium bovis subsp bovis AF2122/97
ccagcagcucggggcgaugagcc

SEQ ID NO: 1072933 - RNA, 12 nt, Mycobacterium bovis subsp bovis AF2122/97
ccagcagcugaa

SEQ ID NO: 1072934 - RNA, 15 nt, Mycobacterium bovis subsp bovis AF2122/97
ccagcagcgaaaacc

SEQ ID NO: 1072935 - RNA, 13 nt, Mycobacterium bovis subsp bovis AF2122/97
ccagcagcgcaac

SEQ ID NO: 1072936 - RNA, 22 nt, Mycobacterium bovis subsp bovis AF2122/97
ccagcagcgacuccagcgcccg

SEQ ID NO: 1072937 - RNA, 16 nt, Mycobacterium bovis subsp bovis AF2122/97
ccagcagcgcaaccag

SEQ ID NO: 1072938 - RNA, 15 nt, Mycobacterium bovis subsp bovis AF2122/97
ccagcagccgcgacg

SEQ ID NO: 1072939 - RNA, 16 nt, Mycobacterium bovis subsp bovis AF2122/97
ccagcaccgccgcgcc

SEQ ID NO: 1072940 - RNA, 17 nt, Mycobacterium bovis subsp bovis AF2122/97
ccagcaccgccgcgccg

SEQ ID NO: 1072941 - RNA, 18 nt, Mycobacterium bovis subsp bovis AF2122/97
ccagcaccgccgcgccgg

SEQ ID NO: 1072942 - RNA, 22 nt, Mycobacterium bovis subsp bovis AF2122/97
ccagcaccgccgcgccggcggc

SEQ ID NO: 1072943 - RNA, 16 nt, Mycobacterium bovis subsp bovis AF2122/97
ccagcaccgccgcugc

SEQ ID NO: 1072944 - RNA, 12 nt, Mycobacterium bovis subsp bovis AF2122/97
ccagcaccgccg

SEQ ID NO: 1072945 - RNA, 13 nt, Mycobacterium bovis subsp bovis AF2122/97
ccagcaccgccgc

SEQ ID NO: 1072946 - RNA, 15 nt, Mycobacterium bovis subsp bovis AF2122/97
ccagcaccacgucga

SEQ ID NO: 1072947 - RNA, 22 nt, Mycobacterium bovis subsp bovis AF2122/97
ccagcaccaccgcggugugcgu

SEQ ID NO: 1072948 - RNA, 15 nt, Mycobacterium bovis subsp bovis AF2122/97
ccagcaccacggcgc

SEQ ID NO: 1072949 - RNA, 18 nt, Mycobacterium bovis subsp bovis AF2122/97
ccagcacgguggcuucga

SEQ ID NO: 1072950 - RNA, 20 nt, Mycobacterium bovis subsp bovis AF2122/97
ccagcacuccaccgcuggcc

SEQ ID NO: 1072951 - RNA, 13 nt, Mycobacterium bovis subsp bovis AF2122/97
ccagcacgcccgc

SEQ ID NO: 1072952 - RNA, 17 nt, Mycobacterium bovis subsp bovis AF2122/97
ccagcacgcgcgcgacc

SEQ ID NO: 1072953 - RNA, 21 nt, Mycobacterium bovis subsp bovis AF2122/97
ccagcacgccgccggccgcca

SEQ ID NO: 1072954 - RNA, 16 nt, Mycobacterium bovis subsp bovis AF2122/97
ccagcacggcaaccag

SEQ ID NO: 1072955 - RNA, 14 nt, Mycobacterium bovis subsp bovis AF2122/97
ccagcacgcuggcg

SEQ ID NO: 1072956 - RNA, 15 nt, Mycobacterium bovis subsp bovis AF2122/97
ccagcacgcuggcgu

SEQ ID NO: 1072957 - RNA, 13 nt, Mycobacterium bovis subsp bovis AF2122/97
ccagcacgcucgu

SEQ ID NO: 1072958 - RNA, 15 nt, Mycobacterium bovis subsp bovis AF2122/97
ccagcagcagcgccg

SEQ ID NO: 1072959 - RNA, 16 nt, Mycobacterium bovis subsp bovis AF2122/97
ccagcagcagcgccgc

SEQ ID NO: 1072960 - RNA, 20 nt, Mycobacterium bovis subsp bovis AF2122/97
ccagcagcagcgccgcgugg

SEQ ID NO: 1072961 - RNA, 21 nt, Mycobacterium bovis subsp bovis AF2122/97
ccagcagcagcgccgcguggc

SEQ ID NO: 1072962 - RNA, 18 nt, Mycobacterium bovis subsp bovis AF2122/97
ccagcagccaggagccga

SEQ ID NO: 1072963 - RNA, 14 nt, Mycobacterium bovis subsp bovis AF2122/97
ccagcagcaccgac

SEQ ID NO: 1072964 - RNA, 17 nt, Mycobacterium bovis subsp bovis AF2122/97
ccagcagcaaucagccg

SEQ ID NO: 1072965 - RNA, 15 nt, Mycobacterium bovis subsp bovis AF2122/97
ccagcagcaccaacu

SEQ ID NO: 1072966 - RNA, 12 nt, Mycobacterium bovis subsp bovis AF2122/97
ccagcagcaacc

SEQ ID NO: 1072967 - RNA, 17 nt, Mycobacterium bovis subsp bovis AF2122/97
ccagcagcaacgacccg

SEQ ID NO: 1072968 - RNA, 23 nt, Mycobacterium bovis subsp bovis AF2122/97
ccagcagaucagguccuaggugu

SEQ ID NO: 1072969 - RNA, 16 nt, Mycobacterium bovis subsp bovis AF2122/97
ccagcacuccgcgggg

SEQ ID NO: 1072970 - RNA, 13 nt, Mycobacterium bovis subsp bovis AF2122/97
aaauagcgagcgu

SEQ ID NO: 1072971 - RNA, 15 nt, Mycobacterium bovis subsp bovis AF2122/97
cccggcccagcgccc

SEQ ID NO: 1072972 - RNA, 12 nt, Mycobacterium bovis subsp bovis AF2122/97
cccggcccgcca

SEQ ID NO: 1072973 - RNA, 14 nt, Mycobacterium bovis subsp bovis AF2122/97
cccggcccgccacc

SEQ ID NO: 1072974 - RNA, 16 nt, Mycobacterium bovis subsp bovis AF2122/97
cccggccccgcggcca

SEQ ID NO: 1072975 - RNA, 17 nt, Mycobacterium bovis subsp bovis AF2122/97
cccggcccgccaccccg

SEQ ID NO: 1072976 - RNA, 19 nt, Mycobacterium bovis subsp bovis AF2122/97
cccggcccaaggaacggcg

SEQ ID NO: 1072977 - RNA, 21 nt, Mycobacterium bovis subsp bovis AF2122/97
cccggcccuccgggcccaucg

SEQ ID NO: 1072978 - RNA, 23 nt, Mycobacterium bovis subsp bovis AF2122/97
cccggcccugaacgguucggccg

SEQ ID NO: 1072979 - RNA, 13 nt, Mycobacterium bovis subsp bovis AF2122/97
cccggccgaguac

SEQ ID NO: 1072980 - RNA, 14 nt, Mycobacterium bovis subsp bovis AF2122/97
cccggccgaguacc

SEQ ID NO: 1072981 - RNA, 15 nt, Mycobacterium bovis subsp bovis AF2122/97
cccggccgccagcgc

SEQ ID NO: 1072982 - RNA, 17 nt, Mycobacterium bovis subsp bovis AF2122/97
cccggccgccagcgcgc

SEQ ID NO: 1072983 - RNA, 18 nt, Mycobacterium bovis subsp bovis AF2122/97
cccggccgaacgccucgc

SEQ ID NO: 1072984 - RNA, 18 nt, Mycobacterium bovis subsp bovis AF2122/97
cccggccgccagcgcgcc

SEQ ID NO: 1072985 - RNA, 13 nt, Mycobacterium bovis subsp bovis AF2122/97
cccggccgcgcac

SEQ ID NO: 1072986 - RNA, 15 nt, Mycobacterium bovis subsp bovis AF2122/97
cccggccgcgcccca

SEQ ID NO: 1072987 - RNA, 17 nt, Mycobacterium bovis subsp bovis AF2122/97
cccggccgcgcggggug

SEQ ID NO: 1072988 - RNA, 12 nt, Mycobacterium bovis subsp bovis AF2122/97
cccggccgccga

SEQ ID NO: 1072989 - RNA, 23 nt, Mycobacterium bovis subsp bovis AF2122/97
cccggccguugggccaccggcgc

SEQ ID NO: 1072990 - RNA, 12 nt, Mycobacterium bovis subsp bovis AF2122/97
cccggccgcgcc

SEQ ID NO: 1072991 - RNA, 18 nt, Mycobacterium bovis subsp bovis AF2122/97
cccggccgcaucggucaa

SEQ ID NO: 1072992 - RNA, 23 nt, Mycobacterium bovis subsp bovis AF2122/97
cccggccggacgggugcgggccg

SEQ ID NO: 1072993 - RNA, 14 nt, Mycobacterium bovis subsp bovis AF2122/97
cccggccggcuagc

SEQ ID NO: 1072994 - RNA, 15 nt, Mycobacterium bovis subsp bovis AF2122/97
cccggccggucgaga

SEQ ID NO: 1072995 - RNA, 21 nt, Mycobacterium bovis subsp bovis AF2122/97
cccggccucaacacccggccg

SEQ ID NO: 1072996 - RNA, 17 nt, Mycobacterium bovis subsp bovis AF2122/97
cccggccuucuccaucg

SEQ ID NO: 1072997 - RNA, 16 nt, Mycobacterium bovis subsp bovis AF2122/97
cccggccuugccgccg

SEQ ID NO: 1072998 - RNA, 15 nt, Mycobacterium bovis subsp bovis AF2122/97
cccggccuuggcggc

SEQ ID NO: 1072999 - RNA, 13 nt, Mycobacterium bovis subsp bovis AF2122/97
cccggcgacgacc

SEQ ID NO: 1073000 - RNA, 15 nt, Mycobacterium bovis subsp bovis AF2122/97
cccggcgacgacccg

SEQ ID NO: 1073001 - RNA, 16 nt, Mycobacterium bovis subsp bovis AF2122/97
cccggcgacccgguca

SEQ ID NO: 1073002 - RNA, 21 nt, Mycobacterium bovis subsp bovis AF2122/97
cccggcgaauacgaccgucgc

SEQ ID NO: 1073003 - RNA, 15 nt, Mycobacterium bovis subsp bovis AF2122/97
cccggcgacccgguc

SEQ ID NO: 1073004 - RNA, 21 nt, Mycobacterium bovis subsp bovis AF2122/97
cccggcgaugagcaugcccag

SEQ ID NO: 1073005 - RNA, 16 nt, Mycobacterium bovis subsp bovis AF2122/97
cccggccaagccggcg

SEQ ID NO: 1073006 - RNA, 15 nt, Mycobacterium bovis subsp bovis AF2122/97
cccggccaaccacca

SEQ ID NO: 1073007 - RNA, 13 nt, Mycobacterium bovis subsp bovis AF2122/97
cccggccaacccg

SEQ ID NO: 1073008 - RNA, 13 nt, Mycobacterium bovis subsp bovis AF2122/97
cccggccaagccg

SEQ ID NO: 1073009 - RNA, 14 nt, Mycobacterium bovis subsp bovis AF2122/97
cccggccaccagca

SEQ ID NO: 1073010 - RNA, 16 nt, Mycobacterium bovis subsp bovis AF2122/97
cccggccaccagcaug

SEQ ID NO: 1073011 - RNA, 21 nt, Mycobacterium bovis subsp bovis AF2122/97
cccggccagcugcguggcgaa

SEQ ID NO: 1073012 - RNA, 22 nt, Mycobacterium bovis subsp bovis AF2122/97
cccggccagcugcguggcgaac

SEQ ID NO: 1073013 - RNA, 13 nt, Mycobacterium bovis subsp bovis AF2122/97
cccggccaggccg

SEQ ID NO: 1073014 - RNA, 14 nt, Mycobacterium bovis subsp bovis AF2122/97
cccggccaggccga

SEQ ID NO: 1073015 - RNA, 12 nt, Mycobacterium bovis subsp bovis AF2122/97
cccggccagccg

SEQ ID NO: 1073016 - RNA, 13 nt, Mycobacterium bovis subsp bovis AF2122/97
cccggccagccgc

SEQ ID NO: 1073017 - RNA, 21 nt, Mycobacterium bovis subsp bovis AF2122/97
cccggccauagcccgagcgcu

SEQ ID NO: 1073018 - RNA, 13 nt, Mycobacterium bovis subsp bovis AF2122/97
cccggccaggucg

SEQ ID NO: 1073019 - RNA, 19 nt, Mycobacterium bovis subsp bovis AF2122/97
cccggcaccccuuugacgc

SEQ ID NO: 1073020 - RNA, 17 nt, Mycobacterium bovis subsp bovis AF2122/97
cccggcacugaccgcga

SEQ ID NO: 1073021 - RNA, 20 nt, Mycobacterium bovis subsp bovis AF2122/97
cccggaggguucggacggcu

SEQ ID NO: 1073022 - RNA, 17 nt, Mycobacterium bovis subsp bovis AF2122/97
cccggcacacggccuug

SEQ ID NO: 1073023 - RNA, 16 nt, Mycobacterium bovis subsp bovis AF2122/97
cccggauaucgaccac

SEQ ID NO: 1073024 - RNA, 20 nt, Mycobacterium bovis subsp bovis AF2122/97
cccggauaucgaccaccggg

SEQ ID NO: 1073025 - RNA, 23 nt, Mycobacterium bovis subsp bovis AF2122/97
cccggcacugaccgcgaugaucg

SEQ ID NO: 1073026 - RNA, 17 nt, Mycobacterium bovis subsp bovis AF2122/97
cccggcagagcacgcgc

SEQ ID NO: 1073027 - RNA, 15 nt, Mycobacterium bovis subsp bovis AF2122/97
cccggcagcccggcg

SEQ ID NO: 1073028 - RNA, 17 nt, Mycobacterium bovis subsp bovis AF2122/97
cccggcagcccggcggc

SEQ ID NO: 1073029 - RNA, 19 nt, Mycobacterium bovis subsp bovis AF2122/97
cccggcagcccggcggccg

SEQ ID NO: 1073030 - RNA, 20 nt, Mycobacterium bovis subsp bovis AF2122/97
cccggcagcccggcggccgc

SEQ ID NO: 1073031 - RNA, 12 nt, Mycobacterium bovis subsp bovis AF2122/97
cccgggccgccg

SEQ ID NO: 1073032 - RNA, 13 nt, Mycobacterium bovis subsp bovis AF2122/97
cccgggcccgccg

SEQ ID NO: 1073033 - RNA, 12 nt, Mycobacterium bovis subsp bovis AF2122/97
cccgggcccgcu

SEQ ID NO: 1073034 - RNA, 14 nt, Mycobacterium bovis subsp bovis AF2122/97
cccgggccaggcug

SEQ ID NO: 1073035 - RNA, 23 nt, Mycobacterium bovis subsp bovis AF2122/97
cccgggcauccuucaccagcugc

SEQ ID NO: 1073036 - RNA, 22 nt, Mycobacterium bovis subsp bovis AF2122/97
cccggguuggccgaacagcugc

SEQ ID NO: 1073037 - RNA, 13 nt, Mycobacterium bovis subsp bovis AF2122/97
cccgggcccgucg

SEQ ID NO: 1073038 - RNA, 23 nt, Mycobacterium bovis subsp bovis AF2122/97
cccgggacguuguccaccgccac

SEQ ID NO: 1073039 - RNA, 22 nt, Mycobacterium bovis subsp bovis AF2122/97
cccggcucggccagccagcggg

SEQ ID NO: 1073040 - RNA, 23 nt, Mycobacterium bovis subsp bovis AF2122/97
cccgggauaguuuucggccgcca

SEQ ID NO: 1073041 - RNA, 20 nt, Mycobacterium bovis subsp bovis AF2122/97
cccgggaccauagccugcgc

SEQ ID NO: 1073042 - RNA, 14 nt, Mycobacterium bovis subsp bovis AF2122/97
cccggcucggugcg

SEQ ID NO: 1073043 - RNA, 19 nt, Mycobacterium bovis subsp bovis AF2122/97
cccggcucucuucgcgcgc

SEQ ID NO: 1073044 - RNA, 17 nt, Mycobacterium bovis subsp bovis AF2122/97
cccgggaaggaaccggg

SEQ ID NO: 1073045 - RNA, 18 nt, Mycobacterium bovis subsp bovis AF2122/97
cccgggaaggaaccgggc

SEQ ID NO: 1073046 - RNA, 22 nt, Mycobacterium bovis subsp bovis AF2122/97
cccgggaucuagaugcggaacg

SEQ ID NO: 1073047 - RNA, 14 nt, Mycobacterium bovis subsp bovis AF2122/97
cccgggcagcacca

SEQ ID NO: 1073048 - RNA, 22 nt, Mycobacterium bovis subsp bovis AF2122/97
cccgggcagccccuccgcgccg

SEQ ID NO: 1073049 - RNA, 14 nt, Mycobacterium bovis subsp bovis AF2122/97
cccgggcagccugc

SEQ ID NO: 1073050 - RNA, 16 nt, Mycobacterium bovis subsp bovis AF2122/97
cccgguagcguucggc

SEQ ID NO: 1073051 - RNA, 17 nt, Mycobacterium bovis subsp bovis AF2122/97
cccgguagcguucggcg

SEQ ID NO: 1073052 - RNA, 23 nt, Mycobacterium bovis subsp bovis AF2122/97
cccgguagcguucggcgagcauc

SEQ ID NO: 1073053 - RNA, 18 nt, Mycobacterium bovis subsp bovis AF2122/97
cccgguagcggcggcaug

SEQ ID NO: 1073054 - RNA, 15 nt, Mycobacterium bovis subsp bovis AF2122/97
cccgguagccccguc

SEQ ID NO: 1073055 - RNA, 16 nt, Mycobacterium bovis subsp bovis AF2122/97
cccgguagccccgucg

SEQ ID NO: 1073056 - RNA, 24 nt, Mycobacterium bovis subsp bovis AF2122/97
cccgguaauccacuccagcgaacc

SEQ ID NO: 1073057 - RNA, 23 nt, Mycobacterium bovis subsp bovis AF2122/97
cccggucgauucggcucaucccg

SEQ ID NO: 1073058 - RNA, 17 nt, Mycobacterium bovis subsp bovis AF2122/97
cccggucgaggucggcg

SEQ ID NO: 1073059 - RNA, 18 nt, Mycobacterium bovis subsp bovis AF2122/97
cccggucgagccagcgga

SEQ ID NO: 1073060 - RNA, 18 nt, Mycobacterium bovis subsp bovis AF2122/97
cccggucgagcguuuugg

SEQ ID NO: 1073061 - RNA, 14 nt, Mycobacterium bovis subsp bovis AF2122/97
cccggucgagcucg

SEQ ID NO: 1073062 - RNA, 15 nt, Mycobacterium bovis subsp bovis AF2122/97
cccggucggcccgcg

SEQ ID NO: 1073063 - RNA, 21 nt, Mycobacterium bovis subsp bovis AF2122/97
cccggucuacgccaccgagau

SEQ ID NO: 1073064 - RNA, 23 nt, Mycobacterium bovis subsp bovis AF2122/97
cccggucuacgccaccgagaucg

SEQ ID NO: 1073065 - RNA, 20 nt, Mycobacterium bovis subsp bovis AF2122/97
cccggucuauuugccugccg

SEQ ID NO: 1073066 - RNA, 19 nt, Mycobacterium bovis subsp bovis AF2122/97
cccggucucgacggcggcc

SEQ ID NO: 1073067 - RNA, 18 nt, Mycobacterium bovis subsp bovis AF2122/97
cccggucgcugauccggg

SEQ ID NO: 1073068 - RNA, 20 nt, Mycobacterium bovis subsp bovis AF2122/97
cccggucggagcggugccga

SEQ ID NO: 1073069 - RNA, 17 nt, Mycobacterium bovis subsp bovis AF2122/97
cccggucuacgacgucg

SEQ ID NO: 1073070 - RNA, 22 nt, Mycobacterium bovis subsp bovis AF2122/97
cccggucuacgacgucgcugua

SEQ ID NO: 1073071 - RNA, 18 nt, Mycobacterium bovis subsp bovis AF2122/97
cccggcgauuggaccgcc

SEQ ID NO: 1073072 - RNA, 16 nt, Mycobacterium bovis subsp bovis AF2122/97
cccggcgcaagcgccg

SEQ ID NO: 1073073 - RNA, 16 nt, Mycobacterium bovis subsp bovis AF2122/97
cccggcgaugcagccg

SEQ ID NO: 1073074 - RNA, 17 nt, Mycobacterium bovis subsp bovis AF2122/97
cccggcgccgucgauga

SEQ ID NO: 1073075 - RNA, 22 nt, Mycobacterium bovis subsp bovis AF2122/97
cccggcgccgucgaugaccagc

SEQ ID NO: 1073076 - RNA, 16 nt, Mycobacterium bovis subsp bovis AF2122/97
cccggcgcgauccccg

SEQ ID NO: 1073077 - RNA, 16 nt, Mycobacterium bovis subsp bovis AF2122/97
cccggcgccgcgggug

SEQ ID NO: 1073078 - RNA, 13 nt, Mycobacterium bovis subsp bovis AF2122/97
cccggcgcggcca

SEQ ID NO: 1073079 - RNA, 14 nt, Mycobacterium bovis subsp bovis AF2122/97
cccggcgcggccgc

SEQ ID NO: 1073080 - RNA, 15 nt, Mycobacterium bovis subsp bovis AF2122/97
cccggcgcggccgca

SEQ ID NO: 1073081 - RNA, 14 nt, Mycobacterium bovis subsp bovis AF2122/97
cccggcgcggcgga

SEQ ID NO: 1073082 - RNA, 15 nt, Mycobacterium bovis subsp bovis AF2122/97
cccggcgcggcggac

SEQ ID NO: 1073083 - RNA, 13 nt, Mycobacterium bovis subsp bovis AF2122/97
cccggcgcgguca

SEQ ID NO: 1073084 - RNA, 13 nt, Mycobacterium bovis subsp bovis AF2122/97
cccggcgcggccg

SEQ ID NO: 1073085 - RNA, 15 nt, Mycobacterium bovis subsp bovis AF2122/97
cccggcuccagcacc

SEQ ID NO: 1073086 - RNA, 23 nt, Mycobacterium bovis subsp bovis AF2122/97
cccggcucacagcacagcgcagc

SEQ ID NO: 1073087 - RNA, 12 nt, Mycobacterium bovis subsp bovis AF2122/97
cccggcucggcc

SEQ ID NO: 1073088 - RNA, 16 nt, Mycobacterium bovis subsp bovis AF2122/97
cccggcucggccaccg

SEQ ID NO: 1073089 - RNA, 21 nt, Mycobacterium bovis subsp bovis AF2122/97
cccggcucggccagccagcgg

SEQ ID NO: 1073090 - RNA, 13 nt, Mycobacterium bovis subsp bovis AF2122/97
cccggcucgaugg

SEQ ID NO: 1073091 - RNA, 18 nt, Mycobacterium bovis subsp bovis AF2122/97
cccggcuaggagaucagc

SEQ ID NO: 1073092 - RNA, 21 nt, Mycobacterium bovis subsp bovis AF2122/97
cccggcuaggagaucagcacc

SEQ ID NO: 1073093 - RNA, 22 nt, Mycobacterium bovis subsp bovis AF2122/97
cccggcuaggagaucagcaccg

SEQ ID NO: 1073094 - RNA, 17 nt, Mycobacterium bovis subsp bovis AF2122/97
cccggcggacgacgucg

SEQ ID NO: 1073095 - RNA, 11 nt, Mycobacterium bovis subsp bovis AF2122/97
cccggcggcca

SEQ ID NO: 1073096 - RNA, 21 nt, Mycobacterium bovis subsp bovis AF2122/97
cccggcgugucgccgccacca

SEQ ID NO: 1073097 - RNA, 15 nt, Mycobacterium bovis subsp bovis AF2122/97
cccgugcggcucgcc

SEQ ID NO: 1073098 - RNA, 21 nt, Mycobacterium bovis subsp bovis AF2122/97
cccgugcuuuccuugcgcgcc

SEQ ID NO: 1073099 - RNA, 23 nt, Mycobacterium bovis subsp bovis AF2122/97
cccuaucguuaucgacaccacca

SEQ ID NO: 1073100 - RNA, 19 nt, Mycobacterium bovis subsp bovis AF2122/97
cccuagggcggugccgccg

SEQ ID NO: 1073101 - RNA, 22 nt, Mycobacterium bovis subsp bovis AF2122/97
cccguggugauggucgugaucu

SEQ ID NO: 1073102 - RNA, 15 nt, Mycobacterium bovis subsp bovis AF2122/97
cccgugguggcgcca

SEQ ID NO: 1073103 - RNA, 24 nt, Mycobacterium bovis subsp bovis AF2122/97
cccgugguggcgccaugaagccgg

SEQ ID NO: 1073104 - RNA, 20 nt, Mycobacterium bovis subsp bovis AF2122/97
cccucaguguacaccgcgcc

SEQ ID NO: 1073105 - RNA, 14 nt, Mycobacterium bovis subsp bovis AF2122/97
cccucaguucacgu

SEQ ID NO: 1073106 - RNA, 18 nt, Mycobacterium bovis subsp bovis AF2122/97
cccucaguucacguucgg

SEQ ID NO: 1073107 - RNA, 14 nt, Mycobacterium bovis subsp bovis AF2122/97
cccucagcaccgcu

SEQ ID NO: 1073108 - RNA, 20 nt, Mycobacterium bovis subsp bovis AF2122/97
cccucaguucacguucggcg

SEQ ID NO: 1073109 - RNA, 17 nt, Mycobacterium bovis subsp bovis AF2122/97
cccucaugucgggcaac

SEQ ID NO: 1073110 - RNA, 18 nt, Mycobacterium bovis subsp bovis AF2122/97
cccucagccgcggccaca

SEQ ID NO: 1073111 - RNA, 19 nt, Mycobacterium bovis subsp bovis AF2122/97
cccucaacgaucgcgccgu

SEQ ID NO: 1073112 - RNA, 12 nt, Mycobacterium bovis subsp bovis AF2122/97
cccucggcgccg

SEQ ID NO: 1073113 - RNA, 12 nt, Mycobacterium bovis subsp bovis AF2122/97
cccucggccgca

SEQ ID NO: 1073114 - RNA, 13 nt, Mycobacterium bovis subsp bovis AF2122/97
cccucggccgcag

SEQ ID NO: 1073115 - RNA, 15 nt, Mycobacterium bovis subsp bovis AF2122/97
cccucggccgcccgu

SEQ ID NO: 1073116 - RNA, 16 nt, Mycobacterium bovis subsp bovis AF2122/97
cccucggcacggucgc

SEQ ID NO: 1073117 - RNA, 15 nt, Mycobacterium bovis subsp bovis AF2122/97
cccuccacagcggcc

SEQ ID NO: 1073118 - RNA, 18 nt, Mycobacterium bovis subsp bovis AF2122/97
cccucggcgugaucaccg

SEQ ID NO: 1073119 - RNA, 13 nt, Mycobacterium bovis subsp bovis AF2122/97
cccucggugccac

SEQ ID NO: 1073120 - RNA, 15 nt, Mycobacterium bovis subsp bovis AF2122/97
cccucgggaucaccg

SEQ ID NO: 1073121 - RNA, 19 nt, Mycobacterium bovis subsp bovis AF2122/97
cccucguaauccacgccga

SEQ ID NO: 1073122 - RNA, 15 nt, Mycobacterium bovis subsp bovis AF2122/97
cccugaacgguucgg

SEQ ID NO: 1073123 - RNA, 17 nt, Mycobacterium bovis subsp bovis AF2122/97
cccugaagccagcgcaa

SEQ ID NO: 1073124 - RNA, 16 nt, Mycobacterium bovis subsp bovis AF2122/97
cccgucuccagcacca

SEQ ID NO: 1073125 - RNA, 12 nt, Mycobacterium bovis subsp bovis AF2122/97
cccgucgucguc

SEQ ID NO: 1073126 - RNA, 14 nt, Mycobacterium bovis subsp bovis AF2122/97
cccgucggcggcgu

SEQ ID NO: 1073127 - RNA, 13 nt, Mycobacterium bovis subsp bovis AF2122/97
cccgucggcgccg

SEQ ID NO: 1073128 - RNA, 13 nt, Mycobacterium bovis subsp bovis AF2122/97
cccgucgguggug

SEQ ID NO: 1073129 - RNA, 13 nt, Mycobacterium bovis subsp bovis AF2122/97
cccgucgcggccg

SEQ ID NO: 1073130 - RNA, 13 nt, Mycobacterium bovis subsp bovis AF2122/97
cccgugcgcgcgc

SEQ ID NO: 1073131 - RNA, 15 nt, Mycobacterium bovis subsp bovis AF2122/97
cccgugcuggcgccg

SEQ ID NO: 1073132 - RNA, 18 nt, Mycobacterium bovis subsp bovis AF2122/97
cccgugcacgaucgcggu

SEQ ID NO: 1073133 - RNA, 17 nt, Mycobacterium bovis subsp bovis AF2122/97
cccgugauccgccgaca

SEQ ID NO: 1073134 - RNA, 23 nt, Mycobacterium bovis subsp bovis AF2122/97
cccgucuggcaugaccgcugccg

SEQ ID NO: 1073135 - RNA, 18 nt, Mycobacterium bovis subsp bovis AF2122/97
cccgucuuccagccaggc

SEQ ID NO: 1073136 - RNA, 18 nt, Mycobacterium bovis subsp bovis AF2122/97
cccguacccacgacgggc

SEQ ID NO: 1073137 - RNA, 19 nt, Mycobacterium bovis subsp bovis AF2122/97
cccgucgccgcccgugccg

SEQ ID NO: 1073138 - RNA, 20 nt, Mycobacterium bovis subsp bovis AF2122/97
cccgucgccgcccgugccgc

SEQ ID NO: 1073139 - RNA, 16 nt, Mycobacterium bovis subsp bovis AF2122/97
cccguaaaccgauauc

SEQ ID NO: 1073140 - RNA, 19 nt, Mycobacterium bovis subsp bovis AF2122/97
cccgguugggguggcggug

SEQ ID NO: 1073141 - RNA, 13 nt, Mycobacterium bovis subsp bovis AF2122/97
cccgguuucgauc

SEQ ID NO: 1073142 - RNA, 16 nt, Mycobacterium bovis subsp bovis AF2122/97
cccgguacgccgcgcc

SEQ ID NO: 1073143 - RNA, 17 nt, Mycobacterium bovis subsp bovis AF2122/97
cccgguuggaccacgug

SEQ ID NO: 1073144 - RNA, 18 nt, Mycobacterium bovis subsp bovis AF2122/97
cccgguugugcgcgcgcc

SEQ ID NO: 1073145 - RNA, 19 nt, Mycobacterium bovis subsp bovis AF2122/97
cccgguuguggaaccacgg

SEQ ID NO: 1073146 - RNA, 22 nt, Mycobacterium bovis subsp bovis AF2122/97
cccgguuguggaaccacggcgc

SEQ ID NO: 1073147 - RNA, 23 nt, Mycobacterium bovis subsp bovis AF2122/97
cccgguuccggcgaucaacgcgc

SEQ ID NO: 1073148 - RNA, 16 nt, Mycobacterium bovis subsp bovis AF2122/97
cccggucuuacggucg

SEQ ID NO: 1073149 - RNA, 13 nt, Mycobacterium bovis subsp bovis AF2122/97
cccggugacgccg

SEQ ID NO: 1073150 - RNA, 21 nt, Mycobacterium bovis subsp bovis AF2122/97
cccgguucagcgcuggcaggc

SEQ ID NO: 1073151 - RNA, 12 nt, Mycobacterium bovis subsp bovis AF2122/97
cccgguugacgc

SEQ ID NO: 1073152 - RNA, 12 nt, Mycobacterium bovis subsp bovis AF2122/97
cccgguugacuc

SEQ ID NO: 1073153 - RNA, 20 nt, Mycobacterium bovis subsp bovis AF2122/97
cccggugacccgcugggccg

SEQ ID NO: 1073154 - RNA, 14 nt, Mycobacterium bovis subsp bovis AF2122/97
cccgguucugcgcc

SEQ ID NO: 1073155 - RNA, 20 nt, Mycobacterium bovis subsp bovis AF2122/97
cccgguucugcgcccacccg

SEQ ID NO: 1073156 - RNA, 12 nt, Mycobacterium bovis subsp bovis AF2122/97
cccugcacagca

SEQ ID NO: 1073157 - RNA, 20 nt, Mycobacterium bovis subsp bovis AF2122/97
cccugagaacacguucggcg

SEQ ID NO: 1073158 - RNA, 17 nt, Mycobacterium bovis subsp bovis AF2122/97
cccugcacggugcccag

SEQ ID NO: 1073159 - RNA, 22 nt, Mycobacterium bovis subsp bovis AF2122/97
cccugcacggugcccagggcga

SEQ ID NO: 1073160 - RNA, 23 nt, Mycobacterium bovis subsp bovis AF2122/97
cccugcacugcgcgugcucgacg

SEQ ID NO: 1073161 - RNA, 15 nt, Mycobacterium bovis subsp bovis AF2122/97
cccugaugaucgucc

SEQ ID NO: 1073162 - RNA, 21 nt, Mycobacterium bovis subsp bovis AF2122/97
cccugaucgugaacacgucgc

SEQ ID NO: 1073163 - RNA, 23 nt, Mycobacterium bovis subsp bovis AF2122/97
cccugaucgugaacacgucgcgg

SEQ ID NO: 1073164 - RNA, 20 nt, Mycobacterium bovis subsp bovis AF2122/97
cccugaugugaguccagccg

SEQ ID NO: 1073165 - RNA, 22 nt, Mycobacterium bovis subsp bovis AF2122/97
cccugaucaaggaccgcucugc

SEQ ID NO: 1073166 - RNA, 23 nt, Mycobacterium bovis subsp bovis AF2122/97
cccugaucaaggaccgcucugcg

SEQ ID NO: 1073167 - RNA, 20 nt, Mycobacterium bovis subsp bovis AF2122/97
cccugcuggcccaacaucaa

SEQ ID NO: 1073168 - RNA, 12 nt, Mycobacterium bovis subsp bovis AF2122/97
cccugcucggcc

SEQ ID NO: 1073169 - RNA, 15 nt, Mycobacterium bovis subsp bovis AF2122/97
cccugcucggccaac

SEQ ID NO: 1073170 - RNA, 13 nt, Mycobacterium bovis subsp bovis AF2122/97
cccugcgugcggc

SEQ ID NO: 1073171 - RNA, 13 nt, Mycobacterium bovis subsp bovis AF2122/97
cccugcggccacg

SEQ ID NO: 1073172 - RNA, 23 nt, Mycobacterium bovis subsp bovis AF2122/97
cccugccacgacgaacaccagcg

SEQ ID NO: 1073173 - RNA, 13 nt, Mycobacterium bovis subsp bovis AF2122/97
cccugguccaccc

SEQ ID NO: 1073174 - RNA, 14 nt, Mycobacterium bovis subsp bovis AF2122/97
cccugguccacccg

SEQ ID NO: 1073175 - RNA, 17 nt, Mycobacterium bovis subsp bovis AF2122/97
cccuguccggcgccgag

SEQ ID NO: 1073176 - RNA, 20 nt, Mycobacterium bovis subsp bovis AF2122/97
cccugucgcgcaccggaucg

SEQ ID NO: 1073177 - RNA, 15 nt, Mycobacterium bovis subsp bovis AF2122/97
cccugucaacgccgc

SEQ ID NO: 1073178 - RNA, 22 nt, Mycobacterium bovis subsp bovis AF2122/97
cccugucauguccugggccgcc

SEQ ID NO: 1073179 - RNA, 12 nt, Mycobacterium bovis subsp bovis AF2122/97
cccuggcggccc

SEQ ID NO: 1073180 - RNA, 13 nt, Mycobacterium bovis subsp bovis AF2122/97
ccgaaacgauggc

SEQ ID NO: 1073181 - RNA, 15 nt, Mycobacterium bovis subsp bovis AF2122/97
ccgaaacgauggccg

SEQ ID NO: 1073182 - RNA, 12 nt, Mycobacterium bovis subsp bovis AF2122/97
ccgaaacgccgg

SEQ ID NO: 1073183 - RNA, 15 nt, Mycobacterium bovis subsp bovis AF2122/97
ccgaaaccggucagc

SEQ ID NO: 1073184 - RNA, 23 nt, Mycobacterium bovis subsp bovis AF2122/97
ccgaaaacgacaucaccaccgca

SEQ ID NO: 1073185 - RNA, 11 nt, Mycobacterium bovis subsp bovis AF2122/97
ccgaaacccga

SEQ ID NO: 1073186 - RNA, 14 nt, Mycobacterium bovis subsp bovis AF2122/97
ccgaaacccgaugu

SEQ ID NO: 1073187 - RNA, 15 nt, Mycobacterium bovis subsp bovis AF2122/97
ccgaaaaacgacccc

SEQ ID NO: 1073188 - RNA, 20 nt, Mycobacterium bovis subsp bovis AF2122/97
ccgaaacaccgucuggccgu

SEQ ID NO: 1073189 - RNA, 22 nt, Mycobacterium bovis subsp bovis AF2122/97
cccugugccagcagcagcgccg

SEQ ID NO: 1073190 - RNA, 21 nt, Mycobacterium bovis subsp bovis AF2122/97
cccugugucgccgucgcggca

SEQ ID NO: 1073191 - RNA, 21 nt, Mycobacterium bovis subsp bovis AF2122/97
cccuguucuccgugaucgagg

SEQ ID NO: 1073192 - RNA, 17 nt, Mycobacterium bovis subsp bovis AF2122/97
cccuguuguugucggug

SEQ ID NO: 1073193 - RNA, 22 nt, Mycobacterium bovis subsp bovis AF2122/97
cccuguuguugucggugucggu

SEQ ID NO: 1073194 - RNA, 23 nt, Mycobacterium bovis subsp bovis AF2122/97
cccuucaaagcggccucgaccuc

SEQ ID NO: 1073195 - RNA, 17 nt, Mycobacterium bovis subsp bovis AF2122/97
cccgcaggacgcugccg

SEQ ID NO: 1073196 - RNA, 14 nt, Mycobacterium bovis subsp bovis AF2122/97
cccgcagcugcgga

SEQ ID NO: 1073197 - RNA, 17 nt, Mycobacterium bovis subsp bovis AF2122/97
cccgcaauucgcggucc

SEQ ID NO: 1073198 - RNA, 20 nt, Mycobacterium bovis subsp bovis AF2122/97
cccgcagccgggcaccaccc

SEQ ID NO: 1073199 - RNA, 20 nt, Mycobacterium bovis subsp bovis AF2122/97
cccgcaauuguucgcggccg

SEQ ID NO: 1073200 - RNA, 20 nt, Mycobacterium bovis subsp bovis AF2122/97
cccgcacacagaccgugacg

SEQ ID NO: 1073201 - RNA, 15 nt, Mycobacterium bovis subsp bovis AF2122/97
cccgcagccgcgagu

SEQ ID NO: 1073202 - RNA, 22 nt, Mycobacterium bovis subsp bovis AF2122/97
cccgcaccacaccgugggcgac

SEQ ID NO: 1073203 - RNA, 22 nt, Mycobacterium bovis subsp bovis AF2122/97
cccgccacguacuccaccgcgc

SEQ ID NO: 1073204 - RNA, 14 nt, Mycobacterium bovis subsp bovis AF2122/97
cccgcauccgcacc

SEQ ID NO: 1073205 - RNA, 21 nt, Mycobacterium bovis subsp bovis AF2122/97
cccgcaguggucggcuccgcg

SEQ ID NO: 1073206 - RNA, 18 nt, Mycobacterium bovis subsp bovis AF2122/97
cccgauugaguucggcgg

SEQ ID NO: 1073207 - RNA, 21 nt, Mycobacterium bovis subsp bovis AF2122/97
cccgauuuauccggaucggcc

SEQ ID NO: 1073208 - RNA, 13 nt, Mycobacterium bovis subsp bovis AF2122/97
cccgcaacacuga

SEQ ID NO: 1073209 - RNA, 14 nt, Mycobacterium bovis subsp bovis AF2122/97
cccgcaacgacuga

SEQ ID NO: 1073210 - RNA, 16 nt, Mycobacterium bovis subsp bovis AF2122/97
cccgcaacgccaacac

SEQ ID NO: 1073211 - RNA, 14 nt, Mycobacterium bovis subsp bovis AF2122/97
cccgcaacuacggc

SEQ ID NO: 1073212 - RNA, 15 nt, Mycobacterium bovis subsp bovis AF2122/97
cccgaucccggccag

SEQ ID NO: 1073213 - RNA, 23 nt, Mycobacterium bovis subsp bovis AF2122/97
cccgauccugcccaccaucccgc

SEQ ID NO: 1073214 - RNA, 21 nt, Mycobacterium bovis subsp bovis AF2122/97
cccgaugguggccgcgcgguc

SEQ ID NO: 1073215 - RNA, 18 nt, Mycobacterium bovis subsp bovis AF2122/97
cccgauguaccccagcgc

SEQ ID NO: 1073216 - RNA, 17 nt, Mycobacterium bovis subsp bovis AF2122/97
cccgaugucgucgacga

SEQ ID NO: 1073217 - RNA, 17 nt, Mycobacterium bovis subsp bovis AF2122/97
cccgauauucggccaug

SEQ ID NO: 1073218 - RNA, 14 nt, Mycobacterium bovis subsp bovis AF2122/97
cccgauccgccacg

SEQ ID NO: 1073219 - RNA, 17 nt, Mycobacterium bovis subsp bovis AF2122/97
cccgauucagcgcccca

SEQ ID NO: 1073220 - RNA, 20 nt, Mycobacterium bovis subsp bovis AF2122/97
cccgccgccaccagcugcgc

SEQ ID NO: 1073221 - RNA, 13 nt, Mycobacterium bovis subsp bovis AF2122/97
cccgccgaccgac

SEQ ID NO: 1073222 - RNA, 12 nt, Mycobacterium bovis subsp bovis AF2122/97
cccgccgcgacc

SEQ ID NO: 1073223 - RNA, 15 nt, Mycobacterium bovis subsp bovis AF2122/97
cccgccgcgaccacg

SEQ ID NO: 1073224 - RNA, 16 nt, Mycobacterium bovis subsp bovis AF2122/97
cccgccggugaucggc

SEQ ID NO: 1073225 - RNA, 22 nt, Mycobacterium bovis subsp bovis AF2122/97
cccgccggugaucggcggcaac

SEQ ID NO: 1073226 - RNA, 19 nt, Mycobacterium bovis subsp bovis AF2122/97
cccgccggguccgccgggc

SEQ ID NO: 1073227 - RNA, 20 nt, Mycobacterium bovis subsp bovis AF2122/97
cccgccgugccgcggcgacg

SEQ ID NO: 1073228 - RNA, 15 nt, Mycobacterium bovis subsp bovis AF2122/97
cccgccguuuccgcc

SEQ ID NO: 1073229 - RNA, 19 nt, Mycobacterium bovis subsp bovis AF2122/97
cccgccguuuccgccgccg

SEQ ID NO: 1073230 - RNA, 20 nt, Mycobacterium bovis subsp bovis AF2122/97
cccgccguugccaccggugc

SEQ ID NO: 1073231 - RNA, 19 nt, Mycobacterium bovis subsp bovis AF2122/97
cccgccguugccgccgacg

SEQ ID NO: 1073232 - RNA, 12 nt, Mycobacterium bovis subsp bovis AF2122/97
cccgccgucgcc

SEQ ID NO: 1073233 - RNA, 14 nt, Mycobacterium bovis subsp bovis AF2122/97
cccgccguagacca

SEQ ID NO: 1073234 - RNA, 15 nt, Mycobacterium bovis subsp bovis AF2122/97
cccgccgguggccgc

SEQ ID NO: 1073235 - RNA, 13 nt, Mycobacterium bovis subsp bovis AF2122/97
cccgccgucaccc

SEQ ID NO: 1073236 - RNA, 16 nt, Mycobacterium bovis subsp bovis AF2122/97
cccgccgucgccacca

SEQ ID NO: 1073237 - RNA, 13 nt, Mycobacterium bovis subsp bovis AF2122/97
cccgccgucgccg

SEQ ID NO: 1073238 - RNA, 22 nt, Mycobacterium bovis subsp bovis AF2122/97
cccgccgucuuggcccgguccg

SEQ ID NO: 1073239 - RNA, 13 nt, Mycobacterium bovis subsp bovis AF2122/97
cccgcccacggca

SEQ ID NO: 1073240 - RNA, 19 nt, Mycobacterium bovis subsp bovis AF2122/97
cccgccauugccgccggcg

SEQ ID NO: 1073241 - RNA, 21 nt, Mycobacterium bovis subsp bovis AF2122/97
cccgccauugccgccggcgcc

SEQ ID NO: 1073242 - RNA, 20 nt, Mycobacterium bovis subsp bovis AF2122/97
cccgccaucugccugccugc

SEQ ID NO: 1073243 - RNA, 13 nt, Mycobacterium bovis subsp bovis AF2122/97
cccgccgacgcca

SEQ ID NO: 1073244 - RNA, 18 nt, Mycobacterium bovis subsp bovis AF2122/97
cccgccgacgccagaucc

SEQ ID NO: 1073245 - RNA, 13 nt, Mycobacterium bovis subsp bovis AF2122/97
cccgccgaugccg

SEQ ID NO: 1073246 - RNA, 17 nt, Mycobacterium bovis subsp bovis AF2122/97
cccgccgaugcugccgc

SEQ ID NO: 1073247 - RNA, 18 nt, Mycobacterium bovis subsp bovis AF2122/97
cccgccgaugcugccgcc

SEQ ID NO: 1073248 - RNA, 22 nt, Mycobacterium bovis subsp bovis AF2122/97
cccgccgaugcugccgccgccg

SEQ ID NO: 1073249 - RNA, 11 nt, Mycobacterium bovis subsp bovis AF2122/97
cccgccagggc

SEQ ID NO: 1073250 - RNA, 23 nt, Mycobacterium bovis subsp bovis AF2122/97
cccgccagggcacguggcgguac

SEQ ID NO: 1073251 - RNA, 17 nt, Mycobacterium bovis subsp bovis AF2122/97
cccgccagggcggcauc

SEQ ID NO: 1073252 - RNA, 19 nt, Mycobacterium bovis subsp bovis AF2122/97
cccgccaucagcccggcgc

SEQ ID NO: 1073253 - RNA, 21 nt, Mycobacterium bovis subsp bovis AF2122/97
cccgccaucagcccggcgcgc

SEQ ID NO: 1073254 - RNA, 20 nt, Mycobacterium bovis subsp bovis AF2122/97
cccgccaucauggcggcccg

SEQ ID NO: 1073255 - RNA, 18 nt, Mycobacterium bovis subsp bovis AF2122/97
cccgccagcgauccacca

SEQ ID NO: 1073256 - RNA, 15 nt, Mycobacterium bovis subsp bovis AF2122/97
cccgccagcgccgcc

SEQ ID NO: 1073257 - RNA, 16 nt, Mycobacterium bovis subsp bovis AF2122/97
cccgccagcgccgccg

SEQ ID NO: 1073258 - RNA, 12 nt, Mycobacterium bovis subsp bovis AF2122/97
cccgccagcggc

SEQ ID NO: 1073259 - RNA, 19 nt, Mycobacterium bovis subsp bovis AF2122/97
cccgcgaacgcgacagcca

SEQ ID NO: 1073260 - RNA, 22 nt, Mycobacterium bovis subsp bovis AF2122/97
cccgcgaacgcgacagccaccu

SEQ ID NO: 1073261 - RNA, 18 nt, Mycobacterium bovis subsp bovis AF2122/97
cccgcgaaccgcggaucg

SEQ ID NO: 1073262 - RNA, 22 nt, Mycobacterium bovis subsp bovis AF2122/97
cccgcgaaauauuggcccguca

SEQ ID NO: 1073263 - RNA, 14 nt, Mycobacterium bovis subsp bovis AF2122/97
cccgcgcccggccg

SEQ ID NO: 1073264 - RNA, 18 nt, Mycobacterium bovis subsp bovis AF2122/97
cccgcgcccccggugccg

SEQ ID NO: 1073265 - RNA, 17 nt, Mycobacterium bovis subsp bovis AF2122/97
cccgccucggcggcggc

SEQ ID NO: 1073266 - RNA, 17 nt, Mycobacterium bovis subsp bovis AF2122/97
cccgccucgggccggcg

SEQ ID NO: 1073267 - RNA, 15 nt, Mycobacterium bovis subsp bovis AF2122/97
cccgccucgaccgcc

SEQ ID NO: 1073268 - RNA, 16 nt, Mycobacterium bovis subsp bovis AF2122/97
cccgccucgaccgcca

SEQ ID NO: 1073269 - RNA, 23 nt, Mycobacterium bovis subsp bovis AF2122/97
cccgccguugccgccgucaccgc

SEQ ID NO: 1073270 - RNA, 15 nt, Mycobacterium bovis subsp bovis AF2122/97
cccgccugaccgcca

SEQ ID NO: 1073271 - RNA, 17 nt, Mycobacterium bovis subsp bovis AF2122/97
cccgccuguaccggcgu

SEQ ID NO: 1073272 - RNA, 20 nt, Mycobacterium bovis subsp bovis AF2122/97
cccgcgucuacgucguccag

SEQ ID NO: 1073273 - RNA, 16 nt, Mycobacterium bovis subsp bovis AF2122/97
cccgcguggccgguca

SEQ ID NO: 1073274 - RNA, 18 nt, Mycobacterium bovis subsp bovis AF2122/97
cccgcguggccggucacg

SEQ ID NO: 1073275 - RNA, 23 nt, Mycobacterium bovis subsp bovis AF2122/97
cccgcguguccuuugccaccucg

SEQ ID NO: 1073276 - RNA, 22 nt, Mycobacterium bovis subsp bovis AF2122/97
cccgcguuugcgaagcccacgu

SEQ ID NO: 1073277 - RNA, 16 nt, Mycobacterium bovis subsp bovis AF2122/97
cccgcucaacgggccg

SEQ ID NO: 1073278 - RNA, 21 nt, Mycobacterium bovis subsp bovis AF2122/97
cccgcguugaaggcgccggug

SEQ ID NO: 1073279 - RNA, 14 nt, Mycobacterium bovis subsp bovis AF2122/97
cccgcuagcccacc

SEQ ID NO: 1073280 - RNA, 15 nt, Mycobacterium bovis subsp bovis AF2122/97
cccgcuagcccacca

SEQ ID NO: 1073281 - RNA, 16 nt, Mycobacterium bovis subsp bovis AF2122/97
cccgcuagcccaccac

SEQ ID NO: 1073282 - RNA, 15 nt, Mycobacterium bovis subsp bovis AF2122/97
cccgcgccgccgcca

SEQ ID NO: 1073283 - RNA, 17 nt, Mycobacterium bovis subsp bovis AF2122/97
cccgcgguuucgggccg

SEQ ID NO: 1073284 - RNA, 24 nt, Mycobacterium bovis subsp bovis AF2122/97
cccgcgguuugcacgucacgcgga

SEQ ID NO: 1073285 - RNA, 12 nt, Mycobacterium bovis subsp bovis AF2122/97
cccgcgccgaca

SEQ ID NO: 1073286 - RNA, 14 nt, Mycobacterium bovis subsp bovis AF2122/97
cccgcgcgacgccg

SEQ ID NO: 1073287 - RNA, 15 nt, Mycobacterium bovis subsp bovis AF2122/97
cccgcuugcgcggcu

SEQ ID NO: 1073288 - RNA, 19 nt, Mycobacterium bovis subsp bovis AF2122/97
cccgcuuggaccguugccg

SEQ ID NO: 1073289 - RNA, 20 nt, Mycobacterium bovis subsp bovis AF2122/97
cccgcuuggcgagccacggc

SEQ ID NO: 1073290 - RNA, 13 nt, Mycobacterium bovis subsp bovis AF2122/97
cccgcugguggug

SEQ ID NO: 1073291 - RNA, 18 nt, Mycobacterium bovis subsp bovis AF2122/97
cccgcuggugguucccga

SEQ ID NO: 1073292 - RNA, 17 nt, Mycobacterium bovis subsp bovis AF2122/97
cccgcuggucgaccggc

SEQ ID NO: 1073293 - RNA, 16 nt, Mycobacterium bovis subsp bovis AF2122/97
cccggacgcaacaccc

SEQ ID NO: 1073294 - RNA, 18 nt, Mycobacterium bovis subsp bovis AF2122/97
cccggacgucggcggccg

SEQ ID NO: 1073295 - RNA, 16 nt, Mycobacterium bovis subsp bovis AF2122/97
cccggacgauggcguc

SEQ ID NO: 1073296 - RNA, 22 nt, Mycobacterium bovis subsp bovis AF2122/97
cccggacgauggcgucggccag

SEQ ID NO: 1073297 - RNA, 18 nt, Mycobacterium bovis subsp bovis AF2122/97
cccgcucagcauucacca

SEQ ID NO: 1073298 - RNA, 16 nt, Mycobacterium bovis subsp bovis AF2122/97
cccgcucagccguccg

SEQ ID NO: 1073299 - RNA, 15 nt, Mycobacterium bovis subsp bovis AF2122/97
cccgcuccacgguca

SEQ ID NO: 1073300 - RNA, 15 nt, Mycobacterium bovis subsp bovis AF2122/97
cccgcuccgccgucg

SEQ ID NO: 1073301 - RNA, 20 nt, Mycobacterium bovis subsp bovis AF2122/97
cccgcuccgccgucgccgcc

SEQ ID NO: 1073302 - RNA, 14 nt, Mycobacterium bovis subsp bovis AF2122/97
cccgcuccgcgccg

SEQ ID NO: 1073303 - RNA, 13 nt, Mycobacterium bovis subsp bovis AF2122/97
cccgcuccgcggc

SEQ ID NO: 1073304 - RNA, 16 nt, Mycobacterium bovis subsp bovis AF2122/97
cccgcuccuccggcac

SEQ ID NO: 1073305 - RNA, 16 nt, Mycobacterium bovis subsp bovis AF2122/97
cccgcuggcucaucga

SEQ ID NO: 1073306 - RNA, 14 nt, Mycobacterium bovis subsp bovis AF2122/97
cccgcuggcccgcc

SEQ ID NO: 1073307 - RNA, 15 nt, Mycobacterium bovis subsp bovis AF2122/97
cccgcucccccgcca

SEQ ID NO: 1073308 - RNA, 15 nt, Mycobacterium bovis subsp bovis AF2122/97
cccgcuccgcggcuc

SEQ ID NO: 1073309 - RNA, 21 nt, Mycobacterium bovis subsp bovis AF2122/97
ccccgccguugccgccgacgc

SEQ ID NO: 1073310 - RNA, 23 nt, Mycobacterium bovis subsp bovis AF2122/97
ccccgagauccguccgcuggugg

SEQ ID NO: 1073311 - RNA, 13 nt, Mycobacterium bovis subsp bovis AF2122/97
ccccgccgcgacg

SEQ ID NO: 1073312 - RNA, 14 nt, Mycobacterium bovis subsp bovis AF2122/97
ccccgccguuaccg

SEQ ID NO: 1073313 - RNA, 15 nt, Mycobacterium bovis subsp bovis AF2122/97
ccccgccguugccgc

SEQ ID NO: 1073314 - RNA, 15 nt, Mycobacterium bovis subsp bovis AF2122/97
ccccgccgucgccac

SEQ ID NO: 1073315 - RNA, 13 nt, Mycobacterium bovis subsp bovis AF2122/97
ccccgcggccagc

SEQ ID NO: 1073316 - RNA, 14 nt, Mycobacterium bovis subsp bovis AF2122/97
ccccgcgcggugcc

SEQ ID NO: 1073317 - RNA, 12 nt, Mycobacterium bovis subsp bovis AF2122/97
ccccgcgcugag

SEQ ID NO: 1073318 - RNA, 18 nt, Mycobacterium bovis subsp bovis AF2122/97
ccccgcgccugccucacc

SEQ ID NO: 1073319 - RNA, 15 nt, Mycobacterium bovis subsp bovis AF2122/97
ccccgaggaugccga

SEQ ID NO: 1073320 - RNA, 20 nt, Mycobacterium bovis subsp bovis AF2122/97
ccccgagcugccgucgcugc

SEQ ID NO: 1073321 - RNA, 13 nt, Mycobacterium bovis subsp bovis AF2122/97
ccccgacugccgc

SEQ ID NO: 1073322 - RNA, 16 nt, Mycobacterium bovis subsp bovis AF2122/97
ccccgagccgugcacc

SEQ ID NO: 1073323 - RNA, 19 nt, Mycobacterium bovis subsp bovis AF2122/97
cccccgaaccugcggcagc

SEQ ID NO: 1073324 - RNA, 21 nt, Mycobacterium bovis subsp bovis AF2122/97
cccccgaucaggccgacgucg

SEQ ID NO: 1073325 - RNA, 20 nt, Mycobacterium bovis subsp bovis AF2122/97
cccccauugccgccgucgcc

SEQ ID NO: 1073326 - RNA, 16 nt, Mycobacterium bovis subsp bovis AF2122/97
cccccgccggccgcgc

SEQ ID NO: 1073327 - RNA, 16 nt, Mycobacterium bovis subsp bovis AF2122/97
cccccggcaccgccgg

SEQ ID NO: 1073328 - RNA, 20 nt, Mycobacterium bovis subsp bovis AF2122/97
cccccggggcgcucgcgcgc

SEQ ID NO: 1073329 - RNA, 21 nt, Mycobacterium bovis subsp bovis AF2122/97
cccccggguccgccguugccg

SEQ ID NO: 1073330 - RNA, 14 nt, Mycobacterium bovis subsp bovis AF2122/97
cccccggcgacggc

SEQ ID NO: 1073331 - RNA, 18 nt, Mycobacterium bovis subsp bovis AF2122/97
ccccgaacauccgccgcc

SEQ ID NO: 1073332 - RNA, 24 nt, Mycobacterium bovis subsp bovis AF2122/97
cccccggugccguuggagccgcca

SEQ ID NO: 1073333 - RNA, 14 nt, Mycobacterium bovis subsp bovis AF2122/97
cccccgucggccuu

SEQ ID NO: 1073334 - RNA, 15 nt, Mycobacterium bovis subsp bovis AF2122/97
ccccgaccgccgugg

SEQ ID NO: 1073335 - RNA, 16 nt, Mycobacterium bovis subsp bovis AF2122/97
ccccgaccugcaagac

SEQ ID NO: 1073336 - RNA, 23 nt, Mycobacterium bovis subsp bovis AF2122/97
ccccgacacucaaccugaaccgg

SEQ ID NO: 1073337 - RNA, 13 nt, Mycobacterium bovis subsp bovis AF2122/97
ccccgaccagcag

SEQ ID NO: 1073338 - RNA, 17 nt, Mycobacterium bovis subsp bovis AF2122/97
ccccagcaccacgguga

SEQ ID NO: 1073339 - RNA, 15 nt, Mycobacterium bovis subsp bovis AF2122/97
ccccagaccggcggc

SEQ ID NO: 1073340 - RNA, 19 nt, Mycobacterium bovis subsp bovis AF2122/97
ccccagaccggcggcuacg

SEQ ID NO: 1073341 - RNA, 18 nt, Mycobacterium bovis subsp bovis AF2122/97
ccccagacaauccgccgc

SEQ ID NO: 1073342 - RNA, 12 nt, Mycobacterium bovis subsp bovis AF2122/97
ccccagaccgcc

SEQ ID NO: 1073343 - RNA, 20 nt, Mycobacterium bovis subsp bovis AF2122/97
ccccaggccgcuugccccgc

SEQ ID NO: 1073344 - RNA, 23 nt, Mycobacterium bovis subsp bovis AF2122/97
ccccacuugccgggcaaucgcuc

SEQ ID NO: 1073345 - RNA, 16 nt, Mycobacterium bovis subsp bovis AF2122/97
ccccaggcgcucagcg

SEQ ID NO: 1073346 - RNA, 22 nt, Mycobacterium bovis subsp bovis AF2122/97
ccccaggcgcucaucacccagc

SEQ ID NO: 1073347 - RNA, 18 nt, Mycobacterium bovis subsp bovis AF2122/97
ccccaguugugcggccag

SEQ ID NO: 1073348 - RNA, 19 nt, Mycobacterium bovis subsp bovis AF2122/97
ccccaguugugcggccagg

SEQ ID NO: 1073349 - RNA, 14 nt, Mycobacterium bovis subsp bovis AF2122/97
ccccauacucggcg

SEQ ID NO: 1073350 - RNA, 23 nt, Mycobacterium bovis subsp bovis AF2122/97
ccccauaguuguuccuggucgag

SEQ ID NO: 1073351 - RNA, 20 nt, Mycobacterium bovis subsp bovis AF2122/97
cccccaggcgcucagcgcgg

SEQ ID NO: 1073352 - RNA, 23 nt, Mycobacterium bovis subsp bovis AF2122/97
ccccauaaacucuguggugucga

SEQ ID NO: 1073353 - RNA, 18 nt, Mycobacterium bovis subsp bovis AF2122/97
ccccaguucgacggcguc

SEQ ID NO: 1073354 - RNA, 13 nt, Mycobacterium bovis subsp bovis AF2122/97
ccccaguucggcg

SEQ ID NO: 1073355 - RNA, 15 nt, Mycobacterium bovis subsp bovis AF2122/97
ccccaguucggcguc

SEQ ID NO: 1073356 - RNA, 15 nt, Mycobacterium bovis subsp bovis AF2122/97
ccccaggggaggcga

SEQ ID NO: 1073357 - RNA, 12 nt, Mycobacterium bovis subsp bovis AF2122/97
cccaggcgaaca

SEQ ID NO: 1073358 - RNA, 17 nt, Mycobacterium bovis subsp bovis AF2122/97
cccaggcgccgaugucg

SEQ ID NO: 1073359 - RNA, 14 nt, Mycobacterium bovis subsp bovis AF2122/97
cccaggcgcugccg

SEQ ID NO: 1073360 - RNA, 22 nt, Mycobacterium bovis subsp bovis AF2122/97
cccaggcgcucagcgcggccac

SEQ ID NO: 1073361 - RNA, 20 nt, Mycobacterium bovis subsp bovis AF2122/97
cccaggcgcucaucacccag

SEQ ID NO: 1073362 - RNA, 15 nt, Mycobacterium bovis subsp bovis AF2122/97
ccccaccggaaucga

SEQ ID NO: 1073363 - RNA, 17 nt, Mycobacterium bovis subsp bovis AF2122/97
ccccaccggccgaaggc

SEQ ID NO: 1073364 - RNA, 16 nt, Mycobacterium bovis subsp bovis AF2122/97
ccccacgccugccgaa

SEQ ID NO: 1073365 - RNA, 12 nt, Mycobacterium bovis subsp bovis AF2122/97
ccccacggcccg

SEQ ID NO: 1073366 - RNA, 14 nt, Mycobacterium bovis subsp bovis AF2122/97
ccccacggugcggu

SEQ ID NO: 1073367 - RNA, 14 nt, Mycobacterium bovis subsp bovis AF2122/97
ccccggccgcaucg

SEQ ID NO: 1073368 - RNA, 13 nt, Mycobacterium bovis subsp bovis AF2122/97
ccccggcagcgcc

SEQ ID NO: 1073369 - RNA, 14 nt, Mycobacterium bovis subsp bovis AF2122/97
ccccggccccgacg

SEQ ID NO: 1073370 - RNA, 23 nt, Mycobacterium bovis subsp bovis AF2122/97
ccccggccacuugguaguccugc

SEQ ID NO: 1073371 - RNA, 13 nt, Mycobacterium bovis subsp bovis AF2122/97
ccccggcggcagc

SEQ ID NO: 1073372 - RNA, 20 nt, Mycobacterium bovis subsp bovis AF2122/97
ccccggcgcuggugcgccac

SEQ ID NO: 1073373 - RNA, 14 nt, Mycobacterium bovis subsp bovis AF2122/97
ccccggcgcggcgg

SEQ ID NO: 1073374 - RNA, 17 nt, Mycobacterium bovis subsp bovis AF2122/97
ccccguuucggucgaca

SEQ ID NO: 1073375 - RNA, 15 nt, Mycobacterium bovis subsp bovis AF2122/97
ccccguuggcggugg

SEQ ID NO: 1073376 - RNA, 18 nt, Mycobacterium bovis subsp bovis AF2122/97
ccccguugugucaccggc

SEQ ID NO: 1073377 - RNA, 18 nt, Mycobacterium bovis subsp bovis AF2122/97
ccccguuuacggcccggc

SEQ ID NO: 1073378 - RNA, 15 nt, Mycobacterium bovis subsp bovis AF2122/97
cccgaaccaccgcgu

SEQ ID NO: 1073379 - RNA, 15 nt, Mycobacterium bovis subsp bovis AF2122/97
cccgaaccccgaccg

SEQ ID NO: 1073380 - RNA, 17 nt, Mycobacterium bovis subsp bovis AF2122/97
cccgaaccugcggcagc

SEQ ID NO: 1073381 - RNA, 23 nt, Mycobacterium bovis subsp bovis AF2122/97
cccgaacuucugguaggcggcca

SEQ ID NO: 1073382 - RNA, 23 nt, Mycobacterium bovis subsp bovis AF2122/97
cccgaagaccuggccugcggcag

SEQ ID NO: 1073383 - RNA, 18 nt, Mycobacterium bovis subsp bovis AF2122/97
cccgaagaugaccucggc

SEQ ID NO: 1073384 - RNA, 23 nt, Mycobacterium bovis subsp bovis AF2122/97
cccgaagaugaccucggcgacga

SEQ ID NO: 1073385 - RNA, 19 nt, Mycobacterium bovis subsp bovis AF2122/97
cccgaacaauucacgcacc

SEQ ID NO: 1073386 - RNA, 12 nt, Mycobacterium bovis subsp bovis AF2122/97
ccccuccgcgcc

SEQ ID NO: 1073387 - RNA, 13 nt, Mycobacterium bovis subsp bovis AF2122/97
ccccucggccgcc

SEQ ID NO: 1073388 - RNA, 16 nt, Mycobacterium bovis subsp bovis AF2122/97
ccccucggcuucggag

SEQ ID NO: 1073389 - RNA, 13 nt, Mycobacterium bovis subsp bovis AF2122/97
cccgacucgucgg

SEQ ID NO: 1073390 - RNA, 22 nt, Mycobacterium bovis subsp bovis AF2122/97
cccgacuccggcaggcccgacg

SEQ ID NO: 1073391 - RNA, 17 nt, Mycobacterium bovis subsp bovis AF2122/97
cccgacgucgcggagua

SEQ ID NO: 1073392 - RNA, 23 nt, Mycobacterium bovis subsp bovis AF2122/97
cccgacgucgcggaguagccgca

SEQ ID NO: 1073393 - RNA, 22 nt, Mycobacterium bovis subsp bovis AF2122/97
cccgacguagccguacgguccg

SEQ ID NO: 1073394 - RNA, 20 nt, Mycobacterium bovis subsp bovis AF2122/97
cccgacggacuccggccggc

SEQ ID NO: 1073395 - RNA, 18 nt, Mycobacterium bovis subsp bovis AF2122/97
cccgauagcgaccgcggc

SEQ ID NO: 1073396 - RNA, 19 nt, Mycobacterium bovis subsp bovis AF2122/97
cccgacuucaagacagccg

SEQ ID NO: 1073397 - RNA, 17 nt, Mycobacterium bovis subsp bovis AF2122/97
cccgauacggccggccg

SEQ ID NO: 1073398 - RNA, 16 nt, Mycobacterium bovis subsp bovis AF2122/97
cccgacugcgcccaua

SEQ ID NO: 1073399 - RNA, 23 nt, Mycobacterium bovis subsp bovis AF2122/97
cccgauccagugguaggccgccg

SEQ ID NO: 1073400 - RNA, 16 nt, Mycobacterium bovis subsp bovis AF2122/97
cccgaucaggccgacg

SEQ ID NO: 1073401 - RNA, 14 nt, Mycobacterium bovis subsp bovis AF2122/97
cccgaucaccccgg

SEQ ID NO: 1073402 - RNA, 20 nt, Mycobacterium bovis subsp bovis AF2122/97
cccgaucaccccggucggcc

SEQ ID NO: 1073403 - RNA, 14 nt, Mycobacterium bovis subsp bovis AF2122/97
cccgaucaccagcc

SEQ ID NO: 1073404 - RNA, 13 nt, Mycobacterium bovis subsp bovis AF2122/97
cccgacgccgguc

SEQ ID NO: 1073405 - RNA, 23 nt, Mycobacterium bovis subsp bovis AF2122/97
cccgacgcagcuugcccgacggc

SEQ ID NO: 1073406 - RNA, 21 nt, Mycobacterium bovis subsp bovis AF2122/97
cccgacgccagcugcccgacg

SEQ ID NO: 1073407 - RNA, 22 nt, Mycobacterium bovis subsp bovis AF2122/97
cccgacgacguauucguugggg

SEQ ID NO: 1073408 - RNA, 20 nt, Mycobacterium bovis subsp bovis AF2122/97
cccgacgagauacggccacc

SEQ ID NO: 1073409 - RNA, 21 nt, Mycobacterium bovis subsp bovis AF2122/97
cccgacgagauugccgggccg

SEQ ID NO: 1073410 - RNA, 23 nt, Mycobacterium bovis subsp bovis AF2122/97
cccgacgagauugccgggccgcc

SEQ ID NO: 1073411 - RNA, 16 nt, Mycobacterium bovis subsp bovis AF2122/97
cccgaccgccguggcc

SEQ ID NO: 1073412 - RNA, 13 nt, Mycobacterium bovis subsp bovis AF2122/97
cccgacgagucgc

SEQ ID NO: 1073413 - RNA, 15 nt, Mycobacterium bovis subsp bovis AF2122/97
cccgacgagucgccg

SEQ ID NO: 1073414 - RNA, 21 nt, Mycobacterium bovis subsp bovis AF2122/97
cccgaauagucggcaucgcga

SEQ ID NO: 1073415 - RNA, 19 nt, Mycobacterium bovis subsp bovis AF2122/97
cccgaaugccuucgaugaa

SEQ ID NO: 1073416 - RNA, 12 nt, Mycobacterium bovis subsp bovis AF2122/97
cccgaccgcugg

SEQ ID NO: 1073417 - RNA, 20 nt, Mycobacterium bovis subsp bovis AF2122/97
cccgaccgguccagccaacg

SEQ ID NO: 1073418 - RNA, 15 nt, Mycobacterium bovis subsp bovis AF2122/97
cccgaaguggugacc

SEQ ID NO: 1073419 - RNA, 19 nt, Mycobacterium bovis subsp bovis AF2122/97
cccgaaguggugaccgacg

SEQ ID NO: 1073420 - RNA, 20 nt, Mycobacterium bovis subsp bovis AF2122/97
cccgaagauuuugggcgccg

SEQ ID NO: 1073421 - RNA, 17 nt, Mycobacterium bovis subsp bovis AF2122/97
cccgaagccgaccgggu

SEQ ID NO: 1073422 - RNA, 19 nt, Mycobacterium bovis subsp bovis AF2122/97
cccgaagccggugccggcg

SEQ ID NO: 1073423 - RNA, 19 nt, Mycobacterium bovis subsp bovis AF2122/97
ccaguuccgcugcggugcc

SEQ ID NO: 1073424 - RNA, 12 nt, Mycobacterium bovis subsp bovis AF2122/97
ccaguucggcgg

SEQ ID NO: 1073425 - RNA, 21 nt, Mycobacterium bovis subsp bovis AF2122/97
ccaguucuaccaccuugccga

SEQ ID NO: 1073426 - RNA, 21 nt, Mycobacterium bovis subsp bovis AF2122/97
ccagugggaugaccuuggccg

SEQ ID NO: 1073427 - RNA, 14 nt, Mycobacterium bovis subsp bovis AF2122/97
ccagugggccgacg

SEQ ID NO: 1073428 - RNA, 15 nt, Mycobacterium bovis subsp bovis AF2122/97
ccagugucagcacga

SEQ ID NO: 1073429 - RNA, 11 nt, Mycobacterium bovis subsp bovis AF2122/97
ccagugcugga

SEQ ID NO: 1073430 - RNA, 18 nt, Mycobacterium bovis subsp bovis AF2122/97
ccaguggccaccaucacc

SEQ ID NO: 1073431 - RNA, 17 nt, Mycobacterium bovis subsp bovis AF2122/97
ccaguuccacccggugc

SEQ ID NO: 1073432 - RNA, 21 nt, Mycobacterium bovis subsp bovis AF2122/97
ccaguuccacccggugccgca

SEQ ID NO: 1073433 - RNA, 22 nt, Mycobacterium bovis subsp bovis AF2122/97
ccagugugcgguuggaucggcg

SEQ ID NO: 1073434 - RNA, 12 nt, Mycobacterium bovis subsp bovis AF2122/97
ccaguuacguug

SEQ ID NO: 1073435 - RNA, 22 nt, Mycobacterium bovis subsp bovis AF2122/97
ccaguguguccugucgcaccag

SEQ ID NO: 1073436 - RNA, 22 nt, Mycobacterium bovis subsp bovis AF2122/97
ccaguguugcgcugcggccagc

SEQ ID NO: 1073437 - RNA, 18 nt, Mycobacterium bovis subsp bovis AF2122/97
ccagugcgguggcaggug

SEQ ID NO: 1073438 - RNA, 21 nt, Mycobacterium bovis subsp bovis AF2122/97
ccagugcgcaacccagccgcg

SEQ ID NO: 1073439 - RNA, 23 nt, Mycobacterium bovis subsp bovis AF2122/97
ccagugcgcaacccagccgcgcc

SEQ ID NO: 1073440 - RNA, 21 nt, Mycobacterium bovis subsp bovis AF2122/97
ccagugcgcagaacaccaccg

SEQ ID NO: 1073441 - RNA, 17 nt, Mycobacterium bovis subsp bovis AF2122/97
ccagugcgcagcccgca

SEQ ID NO: 1073442 - RNA, 22 nt, Mycobacterium bovis subsp bovis AF2122/97
ccagugcaucggucagcgccga

SEQ ID NO: 1073443 - RNA, 13 nt, Mycobacterium bovis subsp bovis AF2122/97
ccagugcccgcac

SEQ ID NO: 1073444 - RNA, 15 nt, Mycobacterium bovis subsp bovis AF2122/97
ccagugacucaccgu

SEQ ID NO: 1073445 - RNA, 16 nt, Mycobacterium bovis subsp bovis AF2122/97
ccagugacucaccgug

SEQ ID NO: 1073446 - RNA, 20 nt, Mycobacterium bovis subsp bovis AF2122/97
ccagugagcaugcgacguca

SEQ ID NO: 1073447 - RNA, 15 nt, Mycobacterium bovis subsp bovis AF2122/97
ccagugccccgccga

SEQ ID NO: 1073448 - RNA, 16 nt, Mycobacterium bovis subsp bovis AF2122/97
ccagugccccgccgag

SEQ ID NO: 1073449 - RNA, 18 nt, Mycobacterium bovis subsp bovis AF2122/97
ccagugccccgccgagcg

SEQ ID NO: 1073450 - RNA, 16 nt, Mycobacterium bovis subsp bovis AF2122/97
ccagucggcgccgccg

SEQ ID NO: 1073451 - RNA, 12 nt, Mycobacterium bovis subsp bovis AF2122/97
ccagucggcgcc

SEQ ID NO: 1073452 - RNA, 12 nt, Mycobacterium bovis subsp bovis AF2122/97
ccagucggccac

SEQ ID NO: 1073453 - RNA, 21 nt, Mycobacterium bovis subsp bovis AF2122/97
ccagucggccaccuggucggc

SEQ ID NO: 1073454 - RNA, 13 nt, Mycobacterium bovis subsp bovis AF2122/97
ccagucgcggcgc

SEQ ID NO: 1073455 - RNA, 14 nt, Mycobacterium bovis subsp bovis AF2122/97
ccagucgcggcgcg

SEQ ID NO: 1073456 - RNA, 18 nt, Mycobacterium bovis subsp bovis AF2122/97
ccagucgcggcgcgagga

SEQ ID NO: 1073457 - RNA, 14 nt, Mycobacterium bovis subsp bovis AF2122/97
ccagucgcggcguu

SEQ ID NO: 1073458 - RNA, 16 nt, Mycobacterium bovis subsp bovis AF2122/97
ccagucgcgcagcguc

SEQ ID NO: 1073459 - RNA, 14 nt, Mycobacterium bovis subsp bovis AF2122/97
ccagucccggcgca

SEQ ID NO: 1073460 - RNA, 14 nt, Mycobacterium bovis subsp bovis AF2122/97
ccaguccagcgcgc

SEQ ID NO: 1073461 - RNA, 22 nt, Mycobacterium bovis subsp bovis AF2122/97
ccaguccaaucuucucgagccg

SEQ ID NO: 1073462 - RNA, 13 nt, Mycobacterium bovis subsp bovis AF2122/97
ccaucagcgcgac

SEQ ID NO: 1073463 - RNA, 16 nt, Mycobacterium bovis subsp bovis AF2122/97
ccaucaccggcggccc

SEQ ID NO: 1073464 - RNA, 16 nt, Mycobacterium bovis subsp bovis AF2122/97
ccaucacgguggccgc

SEQ ID NO: 1073465 - RNA, 14 nt, Mycobacterium bovis subsp bovis AF2122/97
ccaucacggucagc

SEQ ID NO: 1073466 - RNA, 12 nt, Mycobacterium bovis subsp bovis AF2122/97
ccaucaccgcca

SEQ ID NO: 1073467 - RNA, 21 nt, Mycobacterium bovis subsp bovis AF2122/97
ccaucacccuguuugcccaac

SEQ ID NO: 1073468 - RNA, 14 nt, Mycobacterium bovis subsp bovis AF2122/97
ccaucaccagcggc

SEQ ID NO: 1073469 - RNA, 23 nt, Mycobacterium bovis subsp bovis AF2122/97
ccaucaccgccuuugccgccggc

SEQ ID NO: 1073470 - RNA, 16 nt, Mycobacterium bovis subsp bovis AF2122/97
ccaucaccgcgccagc

SEQ ID NO: 1073471 - RNA, 13 nt, Mycobacterium bovis subsp bovis AF2122/97
ccaucaccgccag

SEQ ID NO: 1073472 - RNA, 12 nt, Mycobacterium bovis subsp bovis AF2122/97
ccaucaaccgcg

SEQ ID NO: 1073473 - RNA, 21 nt, Mycobacterium bovis subsp bovis AF2122/97
ccaucaacgccggcgacggcg

SEQ ID NO: 1073474 - RNA, 23 nt, Mycobacterium bovis subsp bovis AF2122/97
ccaucaacaggccucgaccgcgg

SEQ ID NO: 1073475 - RNA, 19 nt, Mycobacterium bovis subsp bovis AF2122/97
ccaucaacaucggcccgcu

SEQ ID NO: 1073476 - RNA, 22 nt, Mycobacterium bovis subsp bovis AF2122/97
ccaucaacauugugcucgccga

SEQ ID NO: 1073477 - RNA, 20 nt, Mycobacterium bovis subsp bovis AF2122/97
ccaucaccacaccggcagcu

SEQ ID NO: 1073478 - RNA, 12 nt, Mycobacterium bovis subsp bovis AF2122/97
ccaucaccaccg

SEQ ID NO: 1073479 - RNA, 15 nt, Mycobacterium bovis subsp bovis AF2122/97
ccaucaccaccggca

SEQ ID NO: 1073480 - RNA, 14 nt, Mycobacterium bovis subsp bovis AF2122/97
ccaucaagagcgcg

SEQ ID NO: 1073481 - RNA, 16 nt, Mycobacterium bovis subsp bovis AF2122/97
ccaucaacugcaucac

SEQ ID NO: 1073482 - RNA, 13 nt, Mycobacterium bovis subsp bovis AF2122/97
ccaucaaggucau

SEQ ID NO: 1073483 - RNA, 20 nt, Mycobacterium bovis subsp bovis AF2122/97
ccauagugcggcagcggugg

SEQ ID NO: 1073484 - RNA, 20 nt, Mycobacterium bovis subsp bovis AF2122/97
ccauagacaucccugacgaa

SEQ ID NO: 1073485 - RNA, 19 nt, Mycobacterium bovis subsp bovis AF2122/97
ccaguugugcggccaggcg

SEQ ID NO: 1073486 - RNA, 19 nt, Mycobacterium bovis subsp bovis AF2122/97
ccauacagcaccccgccgg

SEQ ID NO: 1073487 - RNA, 21 nt, Mycobacterium bovis subsp bovis AF2122/97
ccauacagcaccccgccgggg

SEQ ID NO: 1073488 - RNA, 15 nt, Mycobacterium bovis subsp bovis AF2122/97
ccauaaucacaucgc

SEQ ID NO: 1073489 - RNA, 16 nt, Mycobacterium bovis subsp bovis AF2122/97
ccauaccuucggcgau

SEQ ID NO: 1073490 - RNA, 19 nt, Mycobacterium bovis subsp bovis AF2122/97
ccauacggaagggcccggu

SEQ ID NO: 1073491 - RNA, 18 nt, Mycobacterium bovis subsp bovis AF2122/97
ccauacggcaauacccgc

SEQ ID NO: 1073492 - RNA, 23 nt, Mycobacterium bovis subsp bovis AF2122/97
ccauacggcaauacccgccgcga

SEQ ID NO: 1073493 - RNA, 13 nt, Mycobacterium bovis subsp bovis AF2122/97
ccauaccggccgc

SEQ ID NO: 1073494 - RNA, 17 nt, Mycobacterium bovis subsp bovis AF2122/97
ccauaccuucggcgauc

SEQ ID NO: 1073495 - RNA, 13 nt, Mycobacterium bovis subsp bovis AF2122/97
ccauacgcaccgg

SEQ ID NO: 1073496 - RNA, 14 nt, Mycobacterium bovis subsp bovis AF2122/97
ccauacgcgcgcgg

SEQ ID NO: 1073497 - RNA, 20 nt, Mycobacterium bovis subsp bovis AF2122/97
ccauagccgcgacccgcgca

SEQ ID NO: 1073498 - RNA, 21 nt, Mycobacterium bovis subsp bovis AF2122/97
ccauagccgguggucgcgccc

SEQ ID NO: 1073499 - RNA, 20 nt, Mycobacterium bovis subsp bovis AF2122/97
ccauagccugcgccgacccg

SEQ ID NO: 1073500 - RNA, 23 nt, Mycobacterium bovis subsp bovis AF2122/97
ccauagccugcgccgacccgcgc

SEQ ID NO: 1073501 - RNA, 16 nt, Mycobacterium bovis subsp bovis AF2122/97
ccauacgugccgccga

SEQ ID NO: 1073502 - RNA, 21 nt, Mycobacterium bovis subsp bovis AF2122/97
ccauacuaauggcgccaccgg

SEQ ID NO: 1073503 - RNA, 18 nt, Mycobacterium bovis subsp bovis AF2122/97
ccauaggcccacggcagc

SEQ ID NO: 1073504 - RNA, 20 nt, Mycobacterium bovis subsp bovis AF2122/97
ccauaggcccacggcagcgc

SEQ ID NO: 1073505 - RNA, 14 nt, Mycobacterium bovis subsp bovis AF2122/97
ccauagcugccggc

SEQ ID NO: 1073506 - RNA, 16 nt, Mycobacterium bovis subsp bovis AF2122/97
ccauagcgccgcgccc

SEQ ID NO: 1073507 - RNA, 24 nt, Mycobacterium bovis subsp bovis AF2122/97
ccaggccgcaaugcguugaccgau

SEQ ID NO: 1073508 - RNA, 16 nt, Mycobacterium bovis subsp bovis AF2122/97
ccaggcgagccggcgc

SEQ ID NO: 1073509 - RNA, 19 nt, Mycobacterium bovis subsp bovis AF2122/97
ccaggcgagccggcgcgca

SEQ ID NO: 1073510 - RNA, 22 nt, Mycobacterium bovis subsp bovis AF2122/97
ccaggccgaugugucgaugagg

SEQ ID NO: 1073511 - RNA, 22 nt, Mycobacterium bovis subsp bovis AF2122/97
ccaggcgauugcccgcgcucgc

SEQ ID NO: 1073512 - RNA, 14 nt, Mycobacterium bovis subsp bovis AF2122/97
ccaggcggacgccg

SEQ ID NO: 1073513 - RNA, 15 nt, Mycobacterium bovis subsp bovis AF2122/97
ccaggcggacgccgc

SEQ ID NO: 1073514 - RNA, 22 nt, Mycobacterium bovis subsp bovis AF2122/97
ccaggcggcgcgggucggcgac

SEQ ID NO: 1073515 - RNA, 16 nt, Mycobacterium bovis subsp bovis AF2122/97
ccaggcgggcggcacc

SEQ ID NO: 1073516 - RNA, 22 nt, Mycobacterium bovis subsp bovis AF2122/97
ccaggcgugucgucgcggccgg

SEQ ID NO: 1073517 - RNA, 22 nt, Mycobacterium bovis subsp bovis AF2122/97
ccaggcgugcacaggucagcgc

SEQ ID NO: 1073518 - RNA, 21 nt, Mycobacterium bovis subsp bovis AF2122/97
ccaggcugucgcgggccacca

SEQ ID NO: 1073519 - RNA, 14 nt, Mycobacterium bovis subsp bovis AF2122/97
ccaggcugucgcgg

SEQ ID NO: 1073520 - RNA, 18 nt, Mycobacterium bovis subsp bovis AF2122/97
ccaggcuggcgucaccgc

SEQ ID NO: 1073521 - RNA, 16 nt, Mycobacterium bovis subsp bovis AF2122/97
ccaggcccgacacggc

SEQ ID NO: 1073522 - RNA, 15 nt, Mycobacterium bovis subsp bovis AF2122/97
ccaggcccuggccag

SEQ ID NO: 1073523 - RNA, 15 nt, Mycobacterium bovis subsp bovis AF2122/97
ccaggccgaccgcgc

SEQ ID NO: 1073524 - RNA, 14 nt, Mycobacterium bovis subsp bovis AF2122/97
ccaggccgagcucg

SEQ ID NO: 1073525 - RNA, 21 nt, Mycobacterium bovis subsp bovis AF2122/97
ccaggcgagugaacucguccu

SEQ ID NO: 1073526 - RNA, 17 nt, Mycobacterium bovis subsp bovis AF2122/97
ccaggccgaugccgacc

SEQ ID NO: 1073527 - RNA, 14 nt, Mycobacterium bovis subsp bovis AF2122/97
ccaggccgaugccg

SEQ ID NO: 1073528 - RNA, 18 nt, Mycobacterium bovis subsp bovis AF2122/97
ccaggccgaucagcgcgg

SEQ ID NO: 1073529 - RNA, 20 nt, Mycobacterium bovis subsp bovis AF2122/97
ccaggcccauacgugccgcc

SEQ ID NO: 1073530 - RNA, 13 nt, Mycobacterium bovis subsp bovis AF2122/97
ccaggccaccccg

SEQ ID NO: 1073531 - RNA, 14 nt, Mycobacterium bovis subsp bovis AF2122/97
ccaggccagggcgg

SEQ ID NO: 1073532 - RNA, 21 nt, Mycobacterium bovis subsp bovis AF2122/97
ccagcgcuucgucggccggca

SEQ ID NO: 1073533 - RNA, 19 nt, Mycobacterium bovis subsp bovis AF2122/97
ccagcggaagcgguugacc

SEQ ID NO: 1073534 - RNA, 23 nt, Mycobacterium bovis subsp bovis AF2122/97
ccagcgcuagccgggcgcgccgg

SEQ ID NO: 1073535 - RNA, 15 nt, Mycobacterium bovis subsp bovis AF2122/97
ccagcgcucaccggc

SEQ ID NO: 1073536 - RNA, 16 nt, Mycobacterium bovis subsp bovis AF2122/97
ccagcgcucaccggcg

SEQ ID NO: 1073537 - RNA, 16 nt, Mycobacterium bovis subsp bovis AF2122/97
ccagcgcugcugccga

SEQ ID NO: 1073538 - RNA, 16 nt, Mycobacterium bovis subsp bovis AF2122/97
ccagggagcggcugca

SEQ ID NO: 1073539 - RNA, 19 nt, Mycobacterium bovis subsp bovis AF2122/97
ccagggagcggcugcacgc

SEQ ID NO: 1073540 - RNA, 18 nt, Mycobacterium bovis subsp bovis AF2122/97
ccagggagugccgcacga

SEQ ID NO: 1073541 - RNA, 13 nt, Mycobacterium bovis subsp bovis AF2122/97
ccaggggcgcaac

SEQ ID NO: 1073542 - RNA, 18 nt, Mycobacterium bovis subsp bovis AF2122/97
ccaggggaccgcggcgcg

SEQ ID NO: 1073543 - RNA, 16 nt, Mycobacterium bovis subsp bovis AF2122/97
ccagggggcgugccgc

SEQ ID NO: 1073544 - RNA, 21 nt, Mycobacterium bovis subsp bovis AF2122/97
ccaggggugugccguggucga

SEQ ID NO: 1073545 - RNA, 21 nt, Mycobacterium bovis subsp bovis AF2122/97
ccaggggucgcugugcagcgg

SEQ ID NO: 1073546 - RNA, 14 nt, Mycobacterium bovis subsp bovis AF2122/97
ccagggucccgccg

SEQ ID NO: 1073547 - RNA, 15 nt, Mycobacterium bovis subsp bovis AF2122/97
ccagggucccgccgc

SEQ ID NO: 1073548 - RNA, 22 nt, Mycobacterium bovis subsp bovis AF2122/97
ccagggucaccucgucgccuag

SEQ ID NO: 1073549 - RNA, 15 nt, Mycobacterium bovis subsp bovis AF2122/97
ccagggucgaugucg

SEQ ID NO: 1073550 - RNA, 21 nt, Mycobacterium bovis subsp bovis AF2122/97
ccagggugccggucacgucga

SEQ ID NO: 1073551 - RNA, 17 nt, Mycobacterium bovis subsp bovis AF2122/97
ccagggugaccaggccg

SEQ ID NO: 1073552 - RNA, 19 nt, Mycobacterium bovis subsp bovis AF2122/97
ccagggugcccucggccgc

SEQ ID NO: 1073553 - RNA, 23 nt, Mycobacterium bovis subsp bovis AF2122/97
ccagggugcccucggccgccuga

SEQ ID NO: 1073554 - RNA, 13 nt, Mycobacterium bovis subsp bovis AF2122/97
ccaggguggucgu

SEQ ID NO: 1073555 - RNA, 16 nt, Mycobacterium bovis subsp bovis AF2122/97
ccaggguguccgucga

SEQ ID NO: 1073556 - RNA, 22 nt, Mycobacterium bovis subsp bovis AF2122/97
ccaggguguccgucgaaccuac

SEQ ID NO: 1073557 - RNA, 21 nt, Mycobacterium bovis subsp bovis AF2122/97
ccaggguguauggccaccacg

SEQ ID NO: 1073558 - RNA, 23 nt, Mycobacterium bovis subsp bovis AF2122/97
ccaggguguauggccaccacgca

SEQ ID NO: 1073559 - RNA, 23 nt, Mycobacterium bovis subsp bovis AF2122/97
ccaggucauugccggcgacgaua

SEQ ID NO: 1073560 - RNA, 14 nt, Mycobacterium bovis subsp bovis AF2122/97
ccagguccaccccg

SEQ ID NO: 1073561 - RNA, 15 nt, Mycobacterium bovis subsp bovis AF2122/97
ccagguccaccccgc

SEQ ID NO: 1073562 - RNA, 18 nt, Mycobacterium bovis subsp bovis AF2122/97
ccagguaaacggauucga

SEQ ID NO: 1073563 - RNA, 19 nt, Mycobacterium bovis subsp bovis AF2122/97
ccagguccgccggugccgc

SEQ ID NO: 1073564 - RNA, 14 nt, Mycobacterium bovis subsp bovis AF2122/97
ccaggucgacaccg

SEQ ID NO: 1073565 - RNA, 22 nt, Mycobacterium bovis subsp bovis AF2122/97
ccaggugcagcaccagccacgc

SEQ ID NO: 1073566 - RNA, 14 nt, Mycobacterium bovis subsp bovis AF2122/97
ccaggugcgccgug

SEQ ID NO: 1073567 - RNA, 16 nt, Mycobacterium bovis subsp bovis AF2122/97
ccaggucuccuugggc

SEQ ID NO: 1073568 - RNA, 17 nt, Mycobacterium bovis subsp bovis AF2122/97
ccaggucgaugcgggcg

SEQ ID NO: 1073569 - RNA, 21 nt, Mycobacterium bovis subsp bovis AF2122/97
ccaggucgaugcgggcgacga

SEQ ID NO: 1073570 - RNA, 17 nt, Mycobacterium bovis subsp bovis AF2122/97
ccaggugaucgcgaggc

SEQ ID NO: 1073571 - RNA, 15 nt, Mycobacterium bovis subsp bovis AF2122/97
ccaggugacgcccgc

SEQ ID NO: 1073572 - RNA, 16 nt, Mycobacterium bovis subsp bovis AF2122/97
ccaggucgacaccgcg

SEQ ID NO: 1073573 - RNA, 17 nt, Mycobacterium bovis subsp bovis AF2122/97
ccaggucgacaccgcgg

SEQ ID NO: 1073574 - RNA, 17 nt, Mycobacterium bovis subsp bovis AF2122/97
ccaggucgagcaccggc

SEQ ID NO: 1073575 - RNA, 18 nt, Mycobacterium bovis subsp bovis AF2122/97
ccaggucgagcaccggcu

SEQ ID NO: 1073576 - RNA, 19 nt, Mycobacterium bovis subsp bovis AF2122/97
ccaggucgaggcaggccuc

SEQ ID NO: 1073577 - RNA, 22 nt, Mycobacterium bovis subsp bovis AF2122/97
ccaggucgaggcaggccucggc

SEQ ID NO: 1073578 - RNA, 20 nt, Mycobacterium bovis subsp bovis AF2122/97
ccaggucuccaucaaccgcg

SEQ ID NO: 1073579 - RNA, 21 nt, Mycobacterium bovis subsp bovis AF2122/97
ccaggucuccaucaaccgcgc

SEQ ID NO: 1073580 - RNA, 22 nt, Mycobacterium bovis subsp bovis AF2122/97
ccaggucuccaucaaccgcgcu

SEQ ID NO: 1073581 - RNA, 23 nt, Mycobacterium bovis subsp bovis AF2122/97
ccagguugcaaccuugggcgccg

SEQ ID NO: 1073582 - RNA, 17 nt, Mycobacterium bovis subsp bovis AF2122/97
ccagguugccgucggcc

SEQ ID NO: 1073583 - RNA, 22 nt, Mycobacterium bovis subsp bovis AF2122/97
ccagguugccgucggccucggc

SEQ ID NO: 1073584 - RNA, 18 nt, Mycobacterium bovis subsp bovis AF2122/97
ccagguugccuuggcggc

SEQ ID NO: 1073585 - RNA, 20 nt, Mycobacterium bovis subsp bovis AF2122/97
ccagguugccuuggcggcca

SEQ ID NO: 1073586 - RNA, 22 nt, Mycobacterium bovis subsp bovis AF2122/97
ccaggugcguccaggccagggc

SEQ ID NO: 1073587 - RNA, 21 nt, Mycobacterium bovis subsp bovis AF2122/97
ccaggugcugguauagccggc

SEQ ID NO: 1073588 - RNA, 14 nt, Mycobacterium bovis subsp bovis AF2122/97
ccagguggaccggc

SEQ ID NO: 1073589 - RNA, 15 nt, Mycobacterium bovis subsp bovis AF2122/97
ccagguggaccggcc

SEQ ID NO: 1073590 - RNA, 23 nt, Mycobacterium bovis subsp bovis AF2122/97
ccagguuguagacggcacccccg

SEQ ID NO: 1073591 - RNA, 18 nt, Mycobacterium bovis subsp bovis AF2122/97
ccaguaggcuucgaccgu

SEQ ID NO: 1073592 - RNA, 16 nt, Mycobacterium bovis subsp bovis AF2122/97
ccaguaugcggugccc

SEQ ID NO: 1073593 - RNA, 21 nt, Mycobacterium bovis subsp bovis AF2122/97
ccaguauggccgccaccgcga

SEQ ID NO: 1073594 - RNA, 15 nt, Mycobacterium bovis subsp bovis AF2122/97
cccaggccgaucagc

SEQ ID NO: 1073595 - RNA, 15 nt, Mycobacterium bovis subsp bovis AF2122/97
cccaggccgucgcgc

SEQ ID NO: 1073596 - RNA, 19 nt, Mycobacterium bovis subsp bovis AF2122/97
cccaggaucagcccggacg

SEQ ID NO: 1073597 - RNA, 23 nt, Mycobacterium bovis subsp bovis AF2122/97
cccaggacuccggccgcacgccg

SEQ ID NO: 1073598 - RNA, 15 nt, Mycobacterium bovis subsp bovis AF2122/97
cccaggacagcagcc

SEQ ID NO: 1073599 - RNA, 17 nt, Mycobacterium bovis subsp bovis AF2122/97
cccaggaagccgagacc

SEQ ID NO: 1073600 - RNA, 14 nt, Mycobacterium bovis subsp bovis AF2122/97
cccagcgcccgccg

SEQ ID NO: 1073601 - RNA, 15 nt, Mycobacterium bovis subsp bovis AF2122/97
cccagcgcccgccgg

SEQ ID NO: 1073602 - RNA, 17 nt, Mycobacterium bovis subsp bovis AF2122/97
cccagcgcccgccggca

SEQ ID NO: 1073603 - RNA, 12 nt, Mycobacterium bovis subsp bovis AF2122/97
cccagcgcccgg

SEQ ID NO: 1073604 - RNA, 16 nt, Mycobacterium bovis subsp bovis AF2122/97
cccagcgcccggccac

SEQ ID NO: 1073605 - RNA, 21 nt, Mycobacterium bovis subsp bovis AF2122/97
cccagcgcacggaccaucgcc

SEQ ID NO: 1073606 - RNA, 23 nt, Mycobacterium bovis subsp bovis AF2122/97
cccagcgagcgccaggucagcuc

SEQ ID NO: 1073607 - RNA, 17 nt, Mycobacterium bovis subsp bovis AF2122/97
cccagcgacucggccag

SEQ ID NO: 1073608 - RNA, 18 nt, Mycobacterium bovis subsp bovis AF2122/97
cccagcgaaucacccgcg

SEQ ID NO: 1073609 - RNA, 24 nt, Mycobacterium bovis subsp bovis AF2122/97
cccagcgaauccaggccguacucg

SEQ ID NO: 1073610 - RNA, 13 nt, Mycobacterium bovis subsp bovis AF2122/97
cccagcgaaugcu

SEQ ID NO: 1073611 - RNA, 16 nt, Mycobacterium bovis subsp bovis AF2122/97
cccagcgacaacacca

SEQ ID NO: 1073612 - RNA, 18 nt, Mycobacterium bovis subsp bovis AF2122/97
cccagcgacccggccagc

SEQ ID NO: 1073613 - RNA, 15 nt, Mycobacterium bovis subsp bovis AF2122/97
cccagccgcgccagc

SEQ ID NO: 1073614 - RNA, 16 nt, Mycobacterium bovis subsp bovis AF2122/97
cccagccgcgccagcu

SEQ ID NO: 1073615 - RNA, 13 nt, Mycobacterium bovis subsp bovis AF2122/97
cccagccgcggcg

SEQ ID NO: 1073616 - RNA, 14 nt, Mycobacterium bovis subsp bovis AF2122/97
cccagccgcggcgc

SEQ ID NO: 1073617 - RNA, 20 nt, Mycobacterium bovis subsp bovis AF2122/97
cccagccccacccgccgccg

SEQ ID NO: 1073618 - RNA, 15 nt, Mycobacterium bovis subsp bovis AF2122/97
cccagccgccagccc

SEQ ID NO: 1073619 - RNA, 16 nt, Mycobacterium bovis subsp bovis AF2122/97
cccagccgcaucgggc

SEQ ID NO: 1073620 - RNA, 17 nt, Mycobacterium bovis subsp bovis AF2122/97
cccagccgagcguggcg

SEQ ID NO: 1073621 - RNA, 23 nt, Mycobacterium bovis subsp bovis AF2122/97
cccagaaaaccgccgcaaccgcg

SEQ ID NO: 1073622 - RNA, 20 nt, Mycobacterium bovis subsp bovis AF2122/97
cccagcaaccgcucggcgau

SEQ ID NO: 1073623 - RNA, 20 nt, Mycobacterium bovis subsp bovis AF2122/97
cccagccagcagcggcgagc

SEQ ID NO: 1073624 - RNA, 13 nt, Mycobacterium bovis subsp bovis AF2122/97
cccagccaacccg

SEQ ID NO: 1073625 - RNA, 16 nt, Mycobacterium bovis subsp bovis AF2122/97
cccagccaugcugcuc

SEQ ID NO: 1073626 - RNA, 16 nt, Mycobacterium bovis subsp bovis AF2122/97
cccagcccagccguuc

SEQ ID NO: 1073627 - RNA, 15 nt, Mycobacterium bovis subsp bovis AF2122/97
cccagcacaaccagc

SEQ ID NO: 1073628 - RNA, 13 nt, Mycobacterium bovis subsp bovis AF2122/97
cccagaucggcga

SEQ ID NO: 1073629 - RNA, 15 nt, Mycobacterium bovis subsp bovis AF2122/97
cccagaucggcgacg

SEQ ID NO: 1073630 - RNA, 19 nt, Mycobacterium bovis subsp bovis AF2122/97
cccagaucgguugaucggc

SEQ ID NO: 1073631 - RNA, 22 nt, Mycobacterium bovis subsp bovis AF2122/97
cccaccgucgucguuucgccag

SEQ ID NO: 1073632 - RNA, 18 nt, Mycobacterium bovis subsp bovis AF2122/97
cccacaguuaucagccgc

SEQ ID NO: 1073633 - RNA, 14 nt, Mycobacterium bovis subsp bovis AF2122/97
cccaccggucgccg

SEQ ID NO: 1073634 - RNA, 17 nt, Mycobacterium bovis subsp bovis AF2122/97
cccacagucgugagcca

SEQ ID NO: 1073635 - RNA, 13 nt, Mycobacterium bovis subsp bovis AF2122/97
cccaccgggcggc

SEQ ID NO: 1073636 - RNA, 13 nt, Mycobacterium bovis subsp bovis AF2122/97
cccaccgguaccg

SEQ ID NO: 1073637 - RNA, 16 nt, Mycobacterium bovis subsp bovis AF2122/97
cccaccgguaccgcca

SEQ ID NO: 1073638 - RNA, 14 nt, Mycobacterium bovis subsp bovis AF2122/97
cccaccgugccggg

SEQ ID NO: 1073639 - RNA, 16 nt, Mycobacterium bovis subsp bovis AF2122/97
cccaccucccgcagcc

SEQ ID NO: 1073640 - RNA, 17 nt, Mycobacterium bovis subsp bovis AF2122/97
cccaccucccgcagccg

SEQ ID NO: 1073641 - RNA, 14 nt, Mycobacterium bovis subsp bovis AF2122/97
cccaccuggggccg

SEQ ID NO: 1073642 - RNA, 18 nt, Mycobacterium bovis subsp bovis AF2122/97
cccaccuggggccgcacg

SEQ ID NO: 1073643 - RNA, 13 nt, Mycobacterium bovis subsp bovis AF2122/97
cccaccgucaccc

SEQ ID NO: 1073644 - RNA, 13 nt, Mycobacterium bovis subsp bovis AF2122/97
cccaccggugccg

SEQ ID NO: 1073645 - RNA, 19 nt, Mycobacterium bovis subsp bovis AF2122/97
cccacaggcuuuuccggcg

SEQ ID NO: 1073646 - RNA, 19 nt, Mycobacterium bovis subsp bovis AF2122/97
cccacagguuugcgccgcg

SEQ ID NO: 1073647 - RNA, 19 nt, Mycobacterium bovis subsp bovis AF2122/97
cccacagucgccggccggc

SEQ ID NO: 1073648 - RNA, 23 nt, Mycobacterium bovis subsp bovis AF2122/97
cccacaggggcagcgcggccacc

SEQ ID NO: 1073649 - RNA, 14 nt, Mycobacterium bovis subsp bovis AF2122/97
cccacaccuuggcg

SEQ ID NO: 1073650 - RNA, 15 nt, Mycobacterium bovis subsp bovis AF2122/97
cccacacgccgaacg

SEQ ID NO: 1073651 - RNA, 13 nt, Mycobacterium bovis subsp bovis AF2122/97
cccacacggugcg

SEQ ID NO: 1073652 - RNA, 19 nt, Mycobacterium bovis subsp bovis AF2122/97
cccacaaugacucggccgc

SEQ ID NO: 1073653 - RNA, 13 nt, Mycobacterium bovis subsp bovis AF2122/97
cccacacagucgg

SEQ ID NO: 1073654 - RNA, 16 nt, Mycobacterium bovis subsp bovis AF2122/97
cccacacagucggugc

SEQ ID NO: 1073655 - RNA, 12 nt, Mycobacterium bovis subsp bovis AF2122/97
cccacagcgugc

SEQ ID NO: 1073656 - RNA, 20 nt, Mycobacterium bovis subsp bovis AF2122/97
cccacacccgggacgaaccg

SEQ ID NO: 1073657 - RNA, 12 nt, Mycobacterium bovis subsp bovis AF2122/97
cccacgagagcg

SEQ ID NO: 1073658 - RNA, 19 nt, Mycobacterium bovis subsp bovis AF2122/97
cccacgacgaagucguugg

SEQ ID NO: 1073659 - RNA, 12 nt, Mycobacterium bovis subsp bovis AF2122/97
cccacgaucagc

SEQ ID NO: 1073660 - RNA, 20 nt, Mycobacterium bovis subsp bovis AF2122/97
cccacgaucagcagcgucgg

SEQ ID NO: 1073661 - RNA, 13 nt, Mycobacterium bovis subsp bovis AF2122/97
cccacgcccggcc

SEQ ID NO: 1073662 - RNA, 15 nt, Mycobacterium bovis subsp bovis AF2122/97
cccacugccgugccg

SEQ ID NO: 1073663 - RNA, 13 nt, Mycobacterium bovis subsp bovis AF2122/97
cccacugcccgcc

SEQ ID NO: 1073664 - RNA, 17 nt, Mycobacterium bovis subsp bovis AF2122/97
cccacuggugcagcgcc

SEQ ID NO: 1073665 - RNA, 21 nt, Mycobacterium bovis subsp bovis AF2122/97
cccacuuuucgguggcggcag

SEQ ID NO: 1073666 - RNA, 18 nt, Mycobacterium bovis subsp bovis AF2122/97
cccaagguggcggccagu

SEQ ID NO: 1073667 - RNA, 20 nt, Mycobacterium bovis subsp bovis AF2122/97
cccaagcuaccccgacggcg

SEQ ID NO: 1073668 - RNA, 15 nt, Mycobacterium bovis subsp bovis AF2122/97
cccaaguccagcagc

SEQ ID NO: 1073669 - RNA, 18 nt, Mycobacterium bovis subsp bovis AF2122/97
cccaaguccagcagcgac

SEQ ID NO: 1073670 - RNA, 21 nt, Mycobacterium bovis subsp bovis AF2122/97
cccaagucgacgguggcgccg

SEQ ID NO: 1073671 - RNA, 14 nt, Mycobacterium bovis subsp bovis AF2122/97
cccaagucgccgag

SEQ ID NO: 1073672 - RNA, 15 nt, Mycobacterium bovis subsp bovis AF2122/97
ccauguucggagcca

SEQ ID NO: 1073673 - RNA, 15 nt, Mycobacterium bovis subsp bovis AF2122/97
cccaagcccucgacg

SEQ ID NO: 1073674 - RNA, 15 nt, Mycobacterium bovis subsp bovis AF2122/97
cccaagccgccggcg

SEQ ID NO: 1073675 - RNA, 23 nt, Mycobacterium bovis subsp bovis AF2122/97
cccaagccgccggcgccagcgcc

SEQ ID NO: 1073676 - RNA, 17 nt, Mycobacterium bovis subsp bovis AF2122/97
cccaagcguccgcugca

SEQ ID NO: 1073677 - RNA, 15 nt, Mycobacterium bovis subsp bovis AF2122/97
cccaaugccaccgcg

SEQ ID NO: 1073678 - RNA, 19 nt, Mycobacterium bovis subsp bovis AF2122/97
cccaaugccaccgcggccg

SEQ ID NO: 1073679 - RNA, 17 nt, Mycobacterium bovis subsp bovis AF2122/97
cccaauggagccgcgac

SEQ ID NO: 1073680 - RNA, 21 nt, Mycobacterium bovis subsp bovis AF2122/97
cccacaaucagcccgacaccg

SEQ ID NO: 1073681 - RNA, 22 nt, Mycobacterium bovis subsp bovis AF2122/97
cccaaucgggaucgcugccagc

SEQ ID NO: 1073682 - RNA, 19 nt, Mycobacterium bovis subsp bovis AF2122/97
cccaaucagugcagcgugg

SEQ ID NO: 1073683 - RNA, 21 nt, Mycobacterium bovis subsp bovis AF2122/97
cccaauaguccuugcgccagc

SEQ ID NO: 1073684 - RNA, 12 nt, Mycobacterium bovis subsp bovis AF2122/97
ccaugucgcgcc

SEQ ID NO: 1073685 - RNA, 14 nt, Mycobacterium bovis subsp bovis AF2122/97
ccaugucggcgcgc

SEQ ID NO: 1073686 - RNA, 21 nt, Mycobacterium bovis subsp bovis AF2122/97
ccaugucggcgcgccgcacac

SEQ ID NO: 1073687 - RNA, 15 nt, Mycobacterium bovis subsp bovis AF2122/97
ccaugucgagcacgc

SEQ ID NO: 1073688 - RNA, 22 nt, Mycobacterium bovis subsp bovis AF2122/97
ccaugucuccgacauuggccgu

SEQ ID NO: 1073689 - RNA, 19 nt, Mycobacterium bovis subsp bovis AF2122/97
aaaucgucagcgccgccgg

SEQ ID NO: 1073690 - RNA, 22 nt, Mycobacterium bovis subsp bovis AF2122/97
ccauguccgcaguucggucguc

SEQ ID NO: 1073691 - RNA, 20 nt, Mycobacterium bovis subsp bovis AF2122/97
ccaugguugaugacggcguc

SEQ ID NO: 1073692 - RNA, 14 nt, Mycobacterium bovis subsp bovis AF2122/97
ccauggucggucaa

SEQ ID NO: 1073693 - RNA, 13 nt, Mycobacterium bovis subsp bovis AF2122/97
ccauggucgcgcc

SEQ ID NO: 1073694 - RNA, 19 nt, Mycobacterium bovis subsp bovis AF2122/97
ccauggucgcgccacccgc

SEQ ID NO: 1073695 - RNA, 17 nt, Mycobacterium bovis subsp bovis AF2122/97
ccaugggucuggcaggc

SEQ ID NO: 1073696 - RNA, 20 nt, Mycobacterium bovis subsp bovis AF2122/97
ccaugggucuggcaggccag

SEQ ID NO: 1073697 - RNA, 22 nt, Mycobacterium bovis subsp bovis AF2122/97
ccauggucauguucggggcgca

SEQ ID NO: 1073698 - RNA, 18 nt, Mycobacterium bovis subsp bovis AF2122/97
ccaugcaacacaccgcgg

SEQ ID NO: 1073699 - RNA, 22 nt, Mycobacterium bovis subsp bovis AF2122/97
ccaugaugugcagcgagucggg

SEQ ID NO: 1073700 - RNA, 20 nt, Mycobacterium bovis subsp bovis AF2122/97
ccaugauugccaggaccgcg

SEQ ID NO: 1073701 - RNA, 12 nt, Mycobacterium bovis subsp bovis AF2122/97
ccaugauggccg

SEQ ID NO: 1073702 - RNA, 15 nt, Mycobacterium bovis subsp bovis AF2122/97
ccaugaucucggcga

SEQ ID NO: 1073703 - RNA, 18 nt, Mycobacterium bovis subsp bovis AF2122/97
ccaugaucacaccgcugc

SEQ ID NO: 1073704 - RNA, 13 nt, Mycobacterium bovis subsp bovis AF2122/97
ccaugaaggagau

SEQ ID NO: 1073705 - RNA, 12 nt, Mycobacterium bovis subsp bovis AF2122/97
ccaugaccggcc

SEQ ID NO: 1073706 - RNA, 14 nt, Mycobacterium bovis subsp bovis AF2122/97
ccaugaccggccgc

SEQ ID NO: 1073707 - RNA, 20 nt, Mycobacterium bovis subsp bovis AF2122/97
ccaugaccgggcuggccagc

SEQ ID NO: 1073708 - RNA, 14 nt, Mycobacterium bovis subsp bovis AF2122/97
ccaucucggaccac

SEQ ID NO: 1073709 - RNA, 12 nt, Mycobacterium bovis subsp bovis AF2122/97
ccaucggggccg

SEQ ID NO: 1073710 - RNA, 15 nt, Mycobacterium bovis subsp bovis AF2122/97
ccaucucggaccaca

SEQ ID NO: 1073711 - RNA, 21 nt, Mycobacterium bovis subsp bovis AF2122/97
ccaucugauccggugccgcga

SEQ ID NO: 1073712 - RNA, 15 nt, Mycobacterium bovis subsp bovis AF2122/97
ccaucgucugguggc

SEQ ID NO: 1073713 - RNA, 17 nt, Mycobacterium bovis subsp bovis AF2122/97
ccaucgucugguggcag

SEQ ID NO: 1073714 - RNA, 16 nt, Mycobacterium bovis subsp bovis AF2122/97
ccaucguuucacccgg

SEQ ID NO: 1073715 - RNA, 14 nt, Mycobacterium bovis subsp bovis AF2122/97
ccaucuucggacgc

SEQ ID NO: 1073716 - RNA, 16 nt, Mycobacterium bovis subsp bovis AF2122/97
ccaucuggccgcgggc

SEQ ID NO: 1073717 - RNA, 16 nt, Mycobacterium bovis subsp bovis AF2122/97
ccaucuuaacgucggc

SEQ ID NO: 1073718 - RNA, 21 nt, Mycobacterium bovis subsp bovis AF2122/97
ccaucuucaucgccucgagga

SEQ ID NO: 1073719 - RNA, 13 nt, Mycobacterium bovis subsp bovis AF2122/97
ccauggccaccga

SEQ ID NO: 1073720 - RNA, 13 nt, Mycobacterium bovis subsp bovis AF2122/97
ccauggcggcgcc

SEQ ID NO: 1073721 - RNA, 17 nt, Mycobacterium bovis subsp bovis AF2122/97
ccauggguagccgccca

SEQ ID NO: 1073722 - RNA, 16 nt, Mycobacterium bovis subsp bovis AF2122/97
ccaugggcaauggugg

SEQ ID NO: 1073723 - RNA, 17 nt, Mycobacterium bovis subsp bovis AF2122/97
ccauggcgccgcgccga

SEQ ID NO: 1073724 - RNA, 19 nt, Mycobacterium bovis subsp bovis AF2122/97
ccauggcgccgcgccgauu

SEQ ID NO: 1073725 - RNA, 12 nt, Mycobacterium bovis subsp bovis AF2122/97
ccauggccacca

SEQ ID NO: 1073726 - RNA, 16 nt, Mycobacterium bovis subsp bovis AF2122/97
ccauggccaccgaacg

SEQ ID NO: 1073727 - RNA, 23 nt, Mycobacterium bovis subsp bovis AF2122/97
ccauggccaccgaacgcggccac

SEQ ID NO: 1073728 - RNA, 14 nt, Mycobacterium bovis subsp bovis AF2122/97
ccauggcacugccg

SEQ ID NO: 1073729 - RNA, 20 nt, Mycobacterium bovis subsp bovis AF2122/97
ccauggcacugccggcacgc

SEQ ID NO: 1073730 - RNA, 20 nt, Mycobacterium bovis subsp bovis AF2122/97
ccaugcuggucagcggcgcg

SEQ ID NO: 1073731 - RNA, 15 nt, Mycobacterium bovis subsp bovis AF2122/97
ccaugcccgcacgcu

SEQ ID NO: 1073732 - RNA, 19 nt, Mycobacterium bovis subsp bovis AF2122/97
ccaugcccgcacgcucggc

SEQ ID NO: 1073733 - RNA, 19 nt, Mycobacterium bovis subsp bovis AF2122/97
ccaugccgaauaccggugg

SEQ ID NO: 1073734 - RNA, 14 nt, Mycobacterium bovis subsp bovis AF2122/97
ccaugccgaucggc

SEQ ID NO: 1073735 - RNA, 16 nt, Mycobacterium bovis subsp bovis AF2122/97
ccaugccgaccggcac

SEQ ID NO: 1073736 - RNA, 19 nt, Mycobacterium bovis subsp bovis AF2122/97
ccaugccgaccggcacccg

SEQ ID NO: 1073737 - RNA, 15 nt, Mycobacterium bovis subsp bovis AF2122/97
ccaugccgcucggca

SEQ ID NO: 1073738 - RNA, 18 nt, Mycobacterium bovis subsp bovis AF2122/97
ccaugccgaucggccugc

SEQ ID NO: 1073739 - RNA, 19 nt, Mycobacterium bovis subsp bovis AF2122/97
ccaugccgccgaagccgcg

SEQ ID NO: 1073740 - RNA, 16 nt, Mycobacterium bovis subsp bovis AF2122/97
ccaucgcccggugcgu

SEQ ID NO: 1073741 - RNA, 16 nt, Mycobacterium bovis subsp bovis AF2122/97
ccaucgccaugaugga

SEQ ID NO: 1073742 - RNA, 15 nt, Mycobacterium bovis subsp bovis AF2122/97
ccaucgccgacgccc

SEQ ID NO: 1073743 - RNA, 15 nt, Mycobacterium bovis subsp bovis AF2122/97
ccaucgccaccgcgu

SEQ ID NO: 1073744 - RNA, 21 nt, Mycobacterium bovis subsp bovis AF2122/97
ccaucgccaacaccaaccagu

SEQ ID NO: 1073745 - RNA, 12 nt, Mycobacterium bovis subsp bovis AF2122/97
ccaucgcaucuc

SEQ ID NO: 1073746 - RNA, 15 nt, Mycobacterium bovis subsp bovis AF2122/97
ccaucgcggaaccgu

SEQ ID NO: 1073747 - RNA, 22 nt, Mycobacterium bovis subsp bovis AF2122/97
ccaucgcgacaucgguggcggc

SEQ ID NO: 1073748 - RNA, 13 nt, Mycobacterium bovis subsp bovis AF2122/97
ccaucgcgacggc

SEQ ID NO: 1073749 - RNA, 17 nt, Mycobacterium bovis subsp bovis AF2122/97
ccaucgcgacggcaagc

SEQ ID NO: 1073750 - RNA, 19 nt, Mycobacterium bovis subsp bovis AF2122/97
ccaucgcgacuagacgccg

SEQ ID NO: 1073751 - RNA, 22 nt, Mycobacterium bovis subsp bovis AF2122/97
ccaucgcgacuagacgccgccg

SEQ ID NO: 1073752 - RNA, 20 nt, Mycobacterium bovis subsp bovis AF2122/97
ccaucgccuccagccggcga

SEQ ID NO: 1073753 - RNA, 20 nt, Mycobacterium bovis subsp bovis AF2122/97
ccaucgccucggcgcugcgc

SEQ ID NO: 1073754 - RNA, 18 nt, Mycobacterium bovis subsp bovis AF2122/97
ccaucgccuggaugccga

SEQ ID NO: 1073755 - RNA, 18 nt, Mycobacterium bovis subsp bovis AF2122/97
ccaucgcgacaucggugg

SEQ ID NO: 1073756 - RNA, 21 nt, Mycobacterium bovis subsp bovis AF2122/97
ccaucgccagcaucagcccgg

SEQ ID NO: 1073757 - RNA, 19 nt, Mycobacterium bovis subsp bovis AF2122/97
ccaucgcggaaccguacgc

SEQ ID NO: 1073758 - RNA, 15 nt, Mycobacterium bovis subsp bovis AF2122/97
ccaucgcgucggcga

SEQ ID NO: 1073759 - RNA, 20 nt, Mycobacterium bovis subsp bovis AF2122/97
ccaucggccuggugcucaac

SEQ ID NO: 1073760 - RNA, 21 nt, Mycobacterium bovis subsp bovis AF2122/97
ccaucggcuaggccggccgga

SEQ ID NO: 1073761 - RNA, 13 nt, Mycobacterium bovis subsp bovis AF2122/97
ccaucgggcgcgg

SEQ ID NO: 1073762 - RNA, 17 nt, Mycobacterium bovis subsp bovis AF2122/97
ccaucgggucacccccg

SEQ ID NO: 1073763 - RNA, 19 nt, Mycobacterium bovis subsp bovis AF2122/97
ccaucgguuugcacucguc

SEQ ID NO: 1073764 - RNA, 16 nt, Mycobacterium bovis subsp bovis AF2122/97
ccaucggugcgcacgg

SEQ ID NO: 1073765 - RNA, 17 nt, Mycobacterium bovis subsp bovis AF2122/97
ccaucggugcgcacggc

SEQ ID NO: 1073766 - RNA, 20 nt, Mycobacterium bovis subsp bovis AF2122/97
ccaucgaggcgaucaccgcg

SEQ ID NO: 1073767 - RNA, 23 nt, Mycobacterium bovis subsp bovis AF2122/97
ccaucgaccuugagcacuccguc

SEQ ID NO: 1073768 - RNA, 14 nt, Mycobacterium bovis subsp bovis AF2122/97
ccaucgaccgcccg

SEQ ID NO: 1073769 - RNA, 16 nt, Mycobacterium bovis subsp bovis AF2122/97
ccaucgaccgcccgcc

SEQ ID NO: 1073770 - RNA, 22 nt, Mycobacterium bovis subsp bovis AF2122/97
ccaucgaaaaaccucgacgccc

SEQ ID NO: 1073771 - RNA, 19 nt, Mycobacterium bovis subsp bovis AF2122/97
ccaucgacccgaucacgcu

SEQ ID NO: 1073772 - RNA, 17 nt, Mycobacterium bovis subsp bovis AF2122/97
ccauccucgcggugcgc

SEQ ID NO: 1073773 - RNA, 16 nt, Mycobacterium bovis subsp bovis AF2122/97
ccauccuuaugcgcgg

SEQ ID NO: 1073774 - RNA, 16 nt, Mycobacterium bovis subsp bovis AF2122/97
ccauccucgagcugcu

SEQ ID NO: 1073775 - RNA, 23 nt, Mycobacterium bovis subsp bovis AF2122/97
ccauccgugaaucgagcaccgca

SEQ ID NO: 1073776 - RNA, 22 nt, Mycobacterium bovis subsp bovis AF2122/97
ccauccggucccgccgugccgc

SEQ ID NO: 1073777 - RNA, 12 nt, Mycobacterium bovis subsp bovis AF2122/97
ccauccggucga

SEQ ID NO: 1073778 - RNA, 16 nt, Mycobacterium bovis subsp bovis AF2122/97
ccauccggucggucuc

SEQ ID NO: 1073779 - RNA, 20 nt, Mycobacterium bovis subsp bovis AF2122/97
ccauccggucggucucggcg

SEQ ID NO: 1073780 - RNA, 16 nt, Mycobacterium bovis subsp bovis AF2122/97
ccauccgggccgcggc

SEQ ID NO: 1073781 - RNA, 17 nt, Mycobacterium bovis subsp bovis AF2122/97
ccauccgggccgcggcc

SEQ ID NO: 1073782 - RNA, 19 nt, Mycobacterium bovis subsp bovis AF2122/97
ccauccggcggcggccagg

SEQ ID NO: 1073783 - RNA, 22 nt, Mycobacterium bovis subsp bovis AF2122/97
ccauccggcggcggccaggaug

SEQ ID NO: 1073784 - RNA, 22 nt, Mycobacterium bovis subsp bovis AF2122/97
ccauccgauggcccggcucaca

SEQ ID NO: 1073785 - RNA, 13 nt, Mycobacterium bovis subsp bovis AF2122/97
ccaucccggccga

SEQ ID NO: 1073786 - RNA, 14 nt, Mycobacterium bovis subsp bovis AF2122/97
ccaucccgagcucc

SEQ ID NO: 1073787 - RNA, 15 nt, Mycobacterium bovis subsp bovis AF2122/97
ccaucccggcgccgc

SEQ ID NO: 1073788 - RNA, 17 nt, Mycobacterium bovis subsp bovis AF2122/97
ccaucccgguuccggcg

SEQ ID NO: 1073789 - RNA, 16 nt, Mycobacterium bovis subsp bovis AF2122/97
ccgaguucgucagcgg

SEQ ID NO: 1073790 - RNA, 22 nt, Mycobacterium bovis subsp bovis AF2122/97
ccgaguugaagaagccgguguu

SEQ ID NO: 1073791 - RNA, 19 nt, Mycobacterium bovis subsp bovis AF2122/97
ccgaguugaaggugccggc

SEQ ID NO: 1073792 - RNA, 20 nt, Mycobacterium bovis subsp bovis AF2122/97
ccgaguugaaggugccggcg

SEQ ID NO: 1073793 - RNA, 18 nt, Mycobacterium bovis subsp bovis AF2122/97
ccgaguuguucagcccgu

SEQ ID NO: 1073794 - RNA, 21 nt, Mycobacterium bovis subsp bovis AF2122/97
ccgaguugaaggugccggcgu

SEQ ID NO: 1073795 - RNA, 15 nt, Mycobacterium bovis subsp bovis AF2122/97
ccgaguugaccgccg

SEQ ID NO: 1073796 - RNA, 14 nt, Mycobacterium bovis subsp bovis AF2122/97
ccgaguugcccggg

SEQ ID NO: 1073797 - RNA, 15 nt, Mycobacterium bovis subsp bovis AF2122/97
ccgaguugcccgggu

SEQ ID NO: 1073798 - RNA, 15 nt, Mycobacterium bovis subsp bovis AF2122/97
ccgaguuaccgguga

SEQ ID NO: 1073799 - RNA, 17 nt, Mycobacterium bovis subsp bovis AF2122/97
ccgauaaaaaccacccc

SEQ ID NO: 1073800 - RNA, 18 nt, Mycobacterium bovis subsp bovis AF2122/97
ccgaguuucugaagcccg

SEQ ID NO: 1073801 - RNA, 19 nt, Mycobacterium bovis subsp bovis AF2122/97
ccgagucgauugccaccga

SEQ ID NO: 1073802 - RNA, 21 nt, Mycobacterium bovis subsp bovis AF2122/97
ccgaguuucugaagcccgaca

SEQ ID NO: 1073803 - RNA, 15 nt, Mycobacterium bovis subsp bovis AF2122/97
ccgauaaauggccga

SEQ ID NO: 1073804 - RNA, 17 nt, Mycobacterium bovis subsp bovis AF2122/97
ccgauaaauggccgaug

SEQ ID NO: 1073805 - RNA, 22 nt, Mycobacterium bovis subsp bovis AF2122/97
ccgauaacaaggccgccgccgu

SEQ ID NO: 1073806 - RNA, 23 nt, Mycobacterium bovis subsp bovis AF2122/97
ccgauacagcacauccagcccug

SEQ ID NO: 1073807 - RNA, 23 nt, Mycobacterium bovis subsp bovis AF2122/97
ccgauaacaaggccgccgccguc

SEQ ID NO: 1073808 - RNA, 18 nt, Mycobacterium bovis subsp bovis AF2122/97
ccgauaagguucgugcgu

SEQ ID NO: 1073809 - RNA, 22 nt, Mycobacterium bovis subsp bovis AF2122/97
ccgagucgaucacguggugcgg

SEQ ID NO: 1073810 - RNA, 17 nt, Mycobacterium bovis subsp bovis AF2122/97
ccgagucgaaaccgccc

SEQ ID NO: 1073811 - RNA, 17 nt, Mycobacterium bovis subsp bovis AF2122/97
ccgagucgacggccagu

SEQ ID NO: 1073812 - RNA, 14 nt, Mycobacterium bovis subsp bovis AF2122/97
ccgagugcggugug

SEQ ID NO: 1073813 - RNA, 15 nt, Mycobacterium bovis subsp bovis AF2122/97
ccgagugcggugugu

SEQ ID NO: 1073814 - RNA, 14 nt, Mycobacterium bovis subsp bovis AF2122/97
ccgagugaccaggg

SEQ ID NO: 1073815 - RNA, 23 nt, Mycobacterium bovis subsp bovis AF2122/97
ccgaggucuccggugcgcagcca

SEQ ID NO: 1073816 - RNA, 14 nt, Mycobacterium bovis subsp bovis AF2122/97
ccgaggugccgcgc

SEQ ID NO: 1073817 - RNA, 20 nt, Mycobacterium bovis subsp bovis AF2122/97
ccgaguaccagcccaccggc

SEQ ID NO: 1073818 - RNA, 22 nt, Mycobacterium bovis subsp bovis AF2122/97
ccgaguaccagcccaccggcgc

SEQ ID NO: 1073819 - RNA, 16 nt, Mycobacterium bovis subsp bovis AF2122/97
ccgaguaccggccagc

SEQ ID NO: 1073820 - RNA, 17 nt, Mycobacterium bovis subsp bovis AF2122/97
ccgaguaccggccagcc

SEQ ID NO: 1073821 - RNA, 20 nt, Mycobacterium bovis subsp bovis AF2122/97
ccgaguauuggucggugggg

SEQ ID NO: 1073822 - RNA, 17 nt, Mycobacterium bovis subsp bovis AF2122/97
ccgagggcugcguggcg

SEQ ID NO: 1073823 - RNA, 20 nt, Mycobacterium bovis subsp bovis AF2122/97
ccgagggcugcguggcgggc

SEQ ID NO: 1073824 - RNA, 18 nt, Mycobacterium bovis subsp bovis AF2122/97
ccgaggcucgggccgcac

SEQ ID NO: 1073825 - RNA, 15 nt, Mycobacterium bovis subsp bovis AF2122/97
ccgaggcuggcaucc

SEQ ID NO: 1073826 - RNA, 18 nt, Mycobacterium bovis subsp bovis AF2122/97
ccgaggcuggcaucccgg

SEQ ID NO: 1073827 - RNA, 15 nt, Mycobacterium bovis subsp bovis AF2122/97
ccgagggccgucaca

SEQ ID NO: 1073828 - RNA, 22 nt, Mycobacterium bovis subsp bovis AF2122/97
ccgagggccugacgcgucagcg

SEQ ID NO: 1073829 - RNA, 17 nt, Mycobacterium bovis subsp bovis AF2122/97
ccgaggcgaguucgcgc

SEQ ID NO: 1073830 - RNA, 14 nt, Mycobacterium bovis subsp bovis AF2122/97
ccgaggcgaccgga

SEQ ID NO: 1073831 - RNA, 18 nt, Mycobacterium bovis subsp bovis AF2122/97
ccgaggccucggccagcg

SEQ ID NO: 1073832 - RNA, 13 nt, Mycobacterium bovis subsp bovis AF2122/97
ccgaggccgccga

SEQ ID NO: 1073833 - RNA, 14 nt, Mycobacterium bovis subsp bovis AF2122/97
ccgaggacgccggc

SEQ ID NO: 1073834 - RNA, 15 nt, Mycobacterium bovis subsp bovis AF2122/97
ccgaggacgccggcg

SEQ ID NO: 1073835 - RNA, 16 nt, Mycobacterium bovis subsp bovis AF2122/97
ccgaggacgccggcgc

SEQ ID NO: 1073836 - RNA, 17 nt, Mycobacterium bovis subsp bovis AF2122/97
ccgagcuuggccgccgc

SEQ ID NO: 1073837 - RNA, 23 nt, Mycobacterium bovis subsp bovis AF2122/97
ccgaggaaguccagcuggccggg

SEQ ID NO: 1073838 - RNA, 19 nt, Mycobacterium bovis subsp bovis AF2122/97
ccgaggagggccgcgaucg

SEQ ID NO: 1073839 - RNA, 17 nt, Mycobacterium bovis subsp bovis AF2122/97
ccgagccgguaaccgcg

SEQ ID NO: 1073840 - RNA, 14 nt, Mycobacterium bovis subsp bovis AF2122/97
ccgagccuggauca

SEQ ID NO: 1073841 - RNA, 22 nt, Mycobacterium bovis subsp bovis AF2122/97
ccgagccuggaucacacccacg

SEQ ID NO: 1073842 - RNA, 16 nt, Mycobacterium bovis subsp bovis AF2122/97
ccgagccggugccacu

SEQ ID NO: 1073843 - RNA, 23 nt, Mycobacterium bovis subsp bovis AF2122/97
ccgagcgaccgucccagcgccgc

SEQ ID NO: 1073844 - RNA, 18 nt, Mycobacterium bovis subsp bovis AF2122/97
ccgagcgaugcgaccgac

SEQ ID NO: 1073845 - RNA, 22 nt, Mycobacterium bovis subsp bovis AF2122/97
ccgagcgcaaucgaccacgacg

SEQ ID NO: 1073846 - RNA, 21 nt, Mycobacterium bovis subsp bovis AF2122/97
ccgagcgcgccgaaggccgcc

SEQ ID NO: 1073847 - RNA, 18 nt, Mycobacterium bovis subsp bovis AF2122/97
ccgagcgccaguucgcgg

SEQ ID NO: 1073848 - RNA, 13 nt, Mycobacterium bovis subsp bovis AF2122/97
ccgagcgcccgca

SEQ ID NO: 1073849 - RNA, 16 nt, Mycobacterium bovis subsp bovis AF2122/97
ccgagcgcgcgcuguu

SEQ ID NO: 1073850 - RNA, 18 nt, Mycobacterium bovis subsp bovis AF2122/97
ccgagcgcgccguugccg

SEQ ID NO: 1073851 - RNA, 18 nt, Mycobacterium bovis subsp bovis AF2122/97
ccgagcgcucgaucacgg

SEQ ID NO: 1073852 - RNA, 19 nt, Mycobacterium bovis subsp bovis AF2122/97
ccgagcgcucgaucacggc

SEQ ID NO: 1073853 - RNA, 20 nt, Mycobacterium bovis subsp bovis AF2122/97
ccgagcgcuugaccccgccg

SEQ ID NO: 1073854 - RNA, 18 nt, Mycobacterium bovis subsp bovis AF2122/97
ccgagcggaccaccgcuc

SEQ ID NO: 1073855 - RNA, 21 nt, Mycobacterium bovis subsp bovis AF2122/97
ccgagcggaccaccgcucgcc

SEQ ID NO: 1073856 - RNA, 23 nt, Mycobacterium bovis subsp bovis AF2122/97
ccgagcggagccgccgacucggc

SEQ ID NO: 1073857 - RNA, 13 nt, Mycobacterium bovis subsp bovis AF2122/97
ccgagcggcaucg

SEQ ID NO: 1073858 - RNA, 21 nt, Mycobacterium bovis subsp bovis AF2122/97
ccgagcggcaucggucaccgc

SEQ ID NO: 1073859 - RNA, 22 nt, Mycobacterium bovis subsp bovis AF2122/97
ccgagcggcaucggucaccgcg

SEQ ID NO: 1073860 - RNA, 15 nt, Mycobacterium bovis subsp bovis AF2122/97
ccgagcggucgaucu

SEQ ID NO: 1073861 - RNA, 20 nt, Mycobacterium bovis subsp bovis AF2122/97
ccgagcggugaauucggcga

SEQ ID NO: 1073862 - RNA, 14 nt, Mycobacterium bovis subsp bovis AF2122/97
ccgagcggugccgg

SEQ ID NO: 1073863 - RNA, 16 nt, Mycobacterium bovis subsp bovis AF2122/97
ccgagcggugccggcg

SEQ ID NO: 1073864 - RNA, 15 nt, Mycobacterium bovis subsp bovis AF2122/97
ccgagcucgggugcg

SEQ ID NO: 1073865 - RNA, 18 nt, Mycobacterium bovis subsp bovis AF2122/97
ccgagcucguugcuggcg

SEQ ID NO: 1073866 - RNA, 21 nt, Mycobacterium bovis subsp bovis AF2122/97
ccgagcucguugcuggcggcc

SEQ ID NO: 1073867 - RNA, 22 nt, Mycobacterium bovis subsp bovis AF2122/97
ccgagcucguugcuggcggcca

SEQ ID NO: 1073868 - RNA, 14 nt, Mycobacterium bovis subsp bovis AF2122/97
ccgagcugauccgg

SEQ ID NO: 1073869 - RNA, 15 nt, Mycobacterium bovis subsp bovis AF2122/97
ccgagcuacgaccgu

SEQ ID NO: 1073870 - RNA, 20 nt, Mycobacterium bovis subsp bovis AF2122/97
ccgagcucacuucacgccgc

SEQ ID NO: 1073871 - RNA, 22 nt, Mycobacterium bovis subsp bovis AF2122/97
ccgagcucacuucacgccgccc

SEQ ID NO: 1073872 - RNA, 15 nt, Mycobacterium bovis subsp bovis AF2122/97
ccgagcuccgcggcg

SEQ ID NO: 1073873 - RNA, 19 nt, Mycobacterium bovis subsp bovis AF2122/97
ccgagcuccgcggcgagcu

SEQ ID NO: 1073874 - RNA, 19 nt, Mycobacterium bovis subsp bovis AF2122/97
ccgagcuugggccggugca

SEQ ID NO: 1073875 - RNA, 16 nt, Mycobacterium bovis subsp bovis AF2122/97
ccgagcuggcgcgcgg

SEQ ID NO: 1073876 - RNA, 23 nt, Mycobacterium bovis subsp bovis AF2122/97
ccgagcuugagcgugagcgccgc

SEQ ID NO: 1073877 - RNA, 15 nt, Mycobacterium bovis subsp bovis AF2122/97
ccgagcugugcgcag

SEQ ID NO: 1073878 - RNA, 15 nt, Mycobacterium bovis subsp bovis AF2122/97
ccgagcuucagcgcg

SEQ ID NO: 1073879 - RNA, 16 nt, Mycobacterium bovis subsp bovis AF2122/97
ccgagcuucagcgcgc

SEQ ID NO: 1073880 - RNA, 20 nt, Mycobacterium bovis subsp bovis AF2122/97
ccgagcuuccaaacccggug

SEQ ID NO: 1073881 - RNA, 19 nt, Mycobacterium bovis subsp bovis AF2122/97
ccgagcuccuccaccaacu

SEQ ID NO: 1073882 - RNA, 17 nt, Mycobacterium bovis subsp bovis AF2122/97
ccgagcugauccgggug

SEQ ID NO: 1073883 - RNA, 14 nt, Mycobacterium bovis subsp bovis AF2122/97
ccgagcuggccguc

SEQ ID NO: 1073884 - RNA, 20 nt, Mycobacterium bovis subsp bovis AF2122/97
ccgagcuggcaacgccgcgc

SEQ ID NO: 1073885 - RNA, 21 nt, Mycobacterium bovis subsp bovis AF2122/97
ccgagcuggcaacgccgcgcc

SEQ ID NO: 1073886 - RNA, 23 nt, Mycobacterium bovis subsp bovis AF2122/97
ccgagcuggcaacgccgcgccgu

SEQ ID NO: 1073887 - RNA, 16 nt, Mycobacterium bovis subsp bovis AF2122/97
ccgagccaucaccgca

SEQ ID NO: 1073888 - RNA, 14 nt, Mycobacterium bovis subsp bovis AF2122/97
ccgagcccagcgcc

SEQ ID NO: 1073889 - RNA, 19 nt, Mycobacterium bovis subsp bovis AF2122/97
ccgagccacaaaggcgccg

SEQ ID NO: 1073890 - RNA, 14 nt, Mycobacterium bovis subsp bovis AF2122/97
ccgagccacgaccc

SEQ ID NO: 1073891 - RNA, 16 nt, Mycobacterium bovis subsp bovis AF2122/97
ccgagccagcacccgc

SEQ ID NO: 1073892 - RNA, 16 nt, Mycobacterium bovis subsp bovis AF2122/97
ccgagccagcuccggc

SEQ ID NO: 1073893 - RNA, 17 nt, Mycobacterium bovis subsp bovis AF2122/97
ccgagccagcuccggcg

SEQ ID NO: 1073894 - RNA, 15 nt, Mycobacterium bovis subsp bovis AF2122/97
ccgagcccgaucgcg

SEQ ID NO: 1073895 - RNA, 21 nt, Mycobacterium bovis subsp bovis AF2122/97
ccgagcccgaucgcggcccgg

SEQ ID NO: 1073896 - RNA, 18 nt, Mycobacterium bovis subsp bovis AF2122/97
ccgagcccgaugguggug

SEQ ID NO: 1073897 - RNA, 19 nt, Mycobacterium bovis subsp bovis AF2122/97
ccgagcccggugcuaccgg

SEQ ID NO: 1073898 - RNA, 15 nt, Mycobacterium bovis subsp bovis AF2122/97
ccgagcccagccggg

SEQ ID NO: 1073899 - RNA, 15 nt, Mycobacterium bovis subsp bovis AF2122/97
ccgagcccgggccgu

SEQ ID NO: 1073900 - RNA, 12 nt, Mycobacterium bovis subsp bovis AF2122/97
ccgagccgcggu

SEQ ID NO: 1073901 - RNA, 14 nt, Mycobacterium bovis subsp bovis AF2122/97
ccgagccgcguggg

SEQ ID NO: 1073902 - RNA, 17 nt, Mycobacterium bovis subsp bovis AF2122/97
ccgagccgcccgcccgg

SEQ ID NO: 1073903 - RNA, 19 nt, Mycobacterium bovis subsp bovis AF2122/97
ccgagccgcccgcccggac

SEQ ID NO: 1073904 - RNA, 13 nt, Mycobacterium bovis subsp bovis AF2122/97
ccgagccgcgaug

SEQ ID NO: 1073905 - RNA, 20 nt, Mycobacterium bovis subsp bovis AF2122/97
ccgagccgaaguugaugucg

SEQ ID NO: 1073906 - RNA, 16 nt, Mycobacterium bovis subsp bovis AF2122/97
ccgagccgacaucgau

SEQ ID NO: 1073907 - RNA, 21 nt, Mycobacterium bovis subsp bovis AF2122/97
ccgagccgauauaccagggca

SEQ ID NO: 1073908 - RNA, 13 nt, Mycobacterium bovis subsp bovis AF2122/97
ccgagccgcacag

SEQ ID NO: 1073909 - RNA, 18 nt, Mycobacterium bovis subsp bovis AF2122/97
ccgaaauacccagcgcag

SEQ ID NO: 1073910 - RNA, 15 nt, Mycobacterium bovis subsp bovis AF2122/97
ccgaacaacaucacu

SEQ ID NO: 1073911 - RNA, 18 nt, Mycobacterium bovis subsp bovis AF2122/97
ccgaacaacaucacugcc

SEQ ID NO: 1073912 - RNA, 14 nt, Mycobacterium bovis subsp bovis AF2122/97
ccgaaaucggccag

SEQ ID NO: 1073913 - RNA, 17 nt, Mycobacterium bovis subsp bovis AF2122/97
ccgaaacggggcgacgu

SEQ ID NO: 1073914 - RNA, 15 nt, Mycobacterium bovis subsp bovis AF2122/97
ccgaaacucgacgug

SEQ ID NO: 1073915 - RNA, 16 nt, Mycobacterium bovis subsp bovis AF2122/97
ccgaaacucgacguga

SEQ ID NO: 1073916 - RNA, 20 nt, Mycobacterium bovis subsp bovis AF2122/97
ccgaaaucaguugcgcucca

SEQ ID NO: 1073917 - RNA, 17 nt, Mycobacterium bovis subsp bovis AF2122/97
ccgaacagcaggccucc

SEQ ID NO: 1073918 - RNA, 13 nt, Mycobacterium bovis subsp bovis AF2122/97
ccgaacagcaggc

SEQ ID NO: 1073919 - RNA, 19 nt, Mycobacterium bovis subsp bovis AF2122/97
ccgaacagcgaaccgccgg

SEQ ID NO: 1073920 - RNA, 12 nt, Mycobacterium bovis subsp bovis AF2122/97
ccgaacagcugc

SEQ ID NO: 1073921 - RNA, 15 nt, Mycobacterium bovis subsp bovis AF2122/97
ccgaacagcugcccg

SEQ ID NO: 1073922 - RNA, 18 nt, Mycobacterium bovis subsp bovis AF2122/97
ccgaacacuuugcgcacu

SEQ ID NO: 1073923 - RNA, 15 nt, Mycobacterium bovis subsp bovis AF2122/97
ccgaacaccgucagc

SEQ ID NO: 1073924 - RNA, 18 nt, Mycobacterium bovis subsp bovis AF2122/97
ccgaacaccucggcacgg

SEQ ID NO: 1073925 - RNA, 13 nt, Mycobacterium bovis subsp bovis AF2122/97
ccgaacaccgccg

SEQ ID NO: 1073926 - RNA, 20 nt, Mycobacterium bovis subsp bovis AF2122/97
ccgaacaauuucugcagccc

SEQ ID NO: 1073927 - RNA, 17 nt, Mycobacterium bovis subsp bovis AF2122/97
ccgaacacaccgggcgg

SEQ ID NO: 1073928 - RNA, 17 nt, Mycobacterium bovis subsp bovis AF2122/97
ccgaucgucucggccac

SEQ ID NO: 1073929 - RNA, 15 nt, Mycobacterium bovis subsp bovis AF2122/97
ccgaucgucucggcc

SEQ ID NO: 1073930 - RNA, 20 nt, Mycobacterium bovis subsp bovis AF2122/97
ccgaucgggcuucggccaga

SEQ ID NO: 1073931 - RNA, 14 nt, Mycobacterium bovis subsp bovis AF2122/97
ccgaucucgaccag

SEQ ID NO: 1073932 - RNA, 16 nt, Mycobacterium bovis subsp bovis AF2122/97
ccgaucucaagggcau

SEQ ID NO: 1073933 - RNA, 18 nt, Mycobacterium bovis subsp bovis AF2122/97
ccgaucucuccggcggcg

SEQ ID NO: 1073934 - RNA, 20 nt, Mycobacterium bovis subsp bovis AF2122/97
ccgaucucugcggcggucuc

SEQ ID NO: 1073935 - RNA, 15 nt, Mycobacterium bovis subsp bovis AF2122/97
ccgaucucugguguc

SEQ ID NO: 1073936 - RNA, 17 nt, Mycobacterium bovis subsp bovis AF2122/97
ccgaucugcuccucggu

SEQ ID NO: 1073937 - RNA, 23 nt, Mycobacterium bovis subsp bovis AF2122/97
ccgaucugguaagucagcucgau

SEQ ID NO: 1073938 - RNA, 16 nt, Mycobacterium bovis subsp bovis AF2122/97
ccgaucugcucgccga

SEQ ID NO: 1073939 - RNA, 14 nt, Mycobacterium bovis subsp bovis AF2122/97
ccgaucucgcccag

SEQ ID NO: 1073940 - RNA, 21 nt, Mycobacterium bovis subsp bovis AF2122/97
ccgaucugcuccucggucagc

SEQ ID NO: 1073941 - RNA, 22 nt, Mycobacterium bovis subsp bovis AF2122/97
ccgaucugcucgccgagcucgg

SEQ ID NO: 1073942 - RNA, 15 nt, Mycobacterium bovis subsp bovis AF2122/97
ccgaucuuggccacc

SEQ ID NO: 1073943 - RNA, 17 nt, Mycobacterium bovis subsp bovis AF2122/97
ccgaucuuggccaccgc

SEQ ID NO: 1073944 - RNA, 19 nt, Mycobacterium bovis subsp bovis AF2122/97
ccgaucuuggccaccgccg

SEQ ID NO: 1073945 - RNA, 19 nt, Mycobacterium bovis subsp bovis AF2122/97
ccgaugaaccaggcggccg

SEQ ID NO: 1073946 - RNA, 17 nt, Mycobacterium bovis subsp bovis AF2122/97
ccgaugacccacugcag

SEQ ID NO: 1073947 - RNA, 18 nt, Mycobacterium bovis subsp bovis AF2122/97
ccgaugacgaucggcggc

SEQ ID NO: 1073948 - RNA, 15 nt, Mycobacterium bovis subsp bovis AF2122/97
ccgaugacgaucggc

SEQ ID NO: 1073949 - RNA, 16 nt, Mycobacterium bovis subsp bovis AF2122/97
ccgaugacgaucggcg

SEQ ID NO: 1073950 - RNA, 13 nt, Mycobacterium bovis subsp bovis AF2122/97
ccgaugaccgaag

SEQ ID NO: 1073951 - RNA, 22 nt, Mycobacterium bovis subsp bovis AF2122/97
ccgaugaccuguagaucagcag

SEQ ID NO: 1073952 - RNA, 17 nt, Mycobacterium bovis subsp bovis AF2122/97
ccgaugacgaagugcag

SEQ ID NO: 1073953 - RNA, 21 nt, Mycobacterium bovis subsp bovis AF2122/97
ccgaugacgaugccgccgaag

SEQ ID NO: 1073954 - RNA, 17 nt, Mycobacterium bovis subsp bovis AF2122/97
ccgaugacgauggccgc

SEQ ID NO: 1073955 - RNA, 21 nt, Mycobacterium bovis subsp bovis AF2122/97
ccgaugacgauggccgccgcg

SEQ ID NO: 1073956 - RNA, 22 nt, Mycobacterium bovis subsp bovis AF2122/97
ccgaugacgauggccgccgcga

SEQ ID NO: 1073957 - RNA, 14 nt, Mycobacterium bovis subsp bovis AF2122/97
ccgaugacgcguuc

SEQ ID NO: 1073958 - RNA, 12 nt, Mycobacterium bovis subsp bovis AF2122/97
ccgaugagccca

SEQ ID NO: 1073959 - RNA, 20 nt, Mycobacterium bovis subsp bovis AF2122/97
ccgaugaucgguaccgacgg

SEQ ID NO: 1073960 - RNA, 17 nt, Mycobacterium bovis subsp bovis AF2122/97
ccgaugauggacaccag

SEQ ID NO: 1073961 - RNA, 21 nt, Mycobacterium bovis subsp bovis AF2122/97
ccgaugcaucggugcagcccg

SEQ ID NO: 1073962 - RNA, 22 nt, Mycobacterium bovis subsp bovis AF2122/97
ccgaugcaucggugcagcccgc

SEQ ID NO: 1073963 - RNA, 17 nt, Mycobacterium bovis subsp bovis AF2122/97
ccgaugccgccggcccc

SEQ ID NO: 1073964 - RNA, 21 nt, Mycobacterium bovis subsp bovis AF2122/97
ccgaugccggcgagggccacg

SEQ ID NO: 1073965 - RNA, 16 nt, Mycobacterium bovis subsp bovis AF2122/97
ccgaugccgaagcccc

SEQ ID NO: 1073966 - RNA, 20 nt, Mycobacterium bovis subsp bovis AF2122/97
ccgaugccgaagcccccgac

SEQ ID NO: 1073967 - RNA, 17 nt, Mycobacterium bovis subsp bovis AF2122/97
ccgaugccgacggcgcc

SEQ ID NO: 1073968 - RNA, 20 nt, Mycobacterium bovis subsp bovis AF2122/97
ccgaugcccucgauggccag

SEQ ID NO: 1073969 - RNA, 22 nt, Mycobacterium bovis subsp bovis AF2122/97
ccgaugcccucgauggccaggc

SEQ ID NO: 1073970 - RNA, 14 nt, Mycobacterium bovis subsp bovis AF2122/97
ccgaugcgccaccg

SEQ ID NO: 1073971 - RNA, 20 nt, Mycobacterium bovis subsp bovis AF2122/97
ccgaugcgccaccggcgccg

SEQ ID NO: 1073972 - RNA, 19 nt, Mycobacterium bovis subsp bovis AF2122/97
ccgaugccgugcccggugc

SEQ ID NO: 1073973 - RNA, 16 nt, Mycobacterium bovis subsp bovis AF2122/97
ccgaugccuugaccgc

SEQ ID NO: 1073974 - RNA, 19 nt, Mycobacterium bovis subsp bovis AF2122/97
ccgaugccuugaccgcggu

SEQ ID NO: 1073975 - RNA, 22 nt, Mycobacterium bovis subsp bovis AF2122/97
ccgaugcgaaacaucucggcgc

SEQ ID NO: 1073976 - RNA, 14 nt, Mycobacterium bovis subsp bovis AF2122/97
ccgaugcgacgcag

SEQ ID NO: 1073977 - RNA, 14 nt, Mycobacterium bovis subsp bovis AF2122/97
ccgaugcggugcgg

SEQ ID NO: 1073978 - RNA, 16 nt, Mycobacterium bovis subsp bovis AF2122/97
ccgaugcgggucucga

SEQ ID NO: 1073979 - RNA, 14 nt, Mycobacterium bovis subsp bovis AF2122/97
ccgaugcugccgcc

SEQ ID NO: 1073980 - RNA, 12 nt, Mycobacterium bovis subsp bovis AF2122/97
ccgaugcucguc

SEQ ID NO: 1073981 - RNA, 16 nt, Mycobacterium bovis subsp bovis AF2122/97
ccgaugcugacgaugc

SEQ ID NO: 1073982 - RNA, 21 nt, Mycobacterium bovis subsp bovis AF2122/97
ccgauggaugggcugcgcguc

SEQ ID NO: 1073983 - RNA, 14 nt, Mycobacterium bovis subsp bovis AF2122/97
ccgauggcgguggc

SEQ ID NO: 1073984 - RNA, 20 nt, Mycobacterium bovis subsp bovis AF2122/97
ccgauggcgucgccggcccc

SEQ ID NO: 1073985 - RNA, 13 nt, Mycobacterium bovis subsp bovis AF2122/97
ccgauggcgcacc

SEQ ID NO: 1073986 - RNA, 15 nt, Mycobacterium bovis subsp bovis AF2122/97
ccgauggcgaugcgc

SEQ ID NO: 1073987 - RNA, 21 nt, Mycobacterium bovis subsp bovis AF2122/97
ccgaugggaaucagugaagac

SEQ ID NO: 1073988 - RNA, 16 nt, Mycobacterium bovis subsp bovis AF2122/97
ccgauggugccgaccc

SEQ ID NO: 1073989 - RNA, 23 nt, Mycobacterium bovis subsp bovis AF2122/97
ccgauggugccgacccgccgcgc

SEQ ID NO: 1073990 - RNA, 14 nt, Mycobacterium bovis subsp bovis AF2122/97
ccgaugguacccgc

SEQ ID NO: 1073991 - RNA, 16 nt, Mycobacterium bovis subsp bovis AF2122/97
ccgaugguacccgcgc

SEQ ID NO: 1073992 - RNA, 19 nt, Mycobacterium bovis subsp bovis AF2122/97
ccgaugguacccgcgccgc

SEQ ID NO: 1073993 - RNA, 17 nt, Mycobacterium bovis subsp bovis AF2122/97
ccgaugguggccgcgcg

SEQ ID NO: 1073994 - RNA, 13 nt, Mycobacterium bovis subsp bovis AF2122/97
ccgaugucgaugc

SEQ ID NO: 1073995 - RNA, 15 nt, Mycobacterium bovis subsp bovis AF2122/97
ccgaugugggcgccg

SEQ ID NO: 1073996 - RNA, 20 nt, Mycobacterium bovis subsp bovis AF2122/97
ccgaugugggcgccgucgcc

SEQ ID NO: 1073997 - RNA, 14 nt, Mycobacterium bovis subsp bovis AF2122/97
ccgaugugcucggu

SEQ ID NO: 1073998 - RNA, 14 nt, Mycobacterium bovis subsp bovis AF2122/97
ccgaugucgucgac

SEQ ID NO: 1073999 - RNA, 22 nt, Mycobacterium bovis subsp bovis AF2122/97
ccgaugucgucuuuggucagcc

SEQ ID NO: 1074000 - RNA, 16 nt, Mycobacterium bovis subsp bovis AF2122/97
ccgauguggccggcga

SEQ ID NO: 1074001 - RNA, 14 nt, Mycobacterium bovis subsp bovis AF2122/97
ccgauguggucggc

SEQ ID NO: 1074002 - RNA, 12 nt, Mycobacterium bovis subsp bovis AF2122/97
ccgaucggcagg

SEQ ID NO: 1074003 - RNA, 12 nt, Mycobacterium bovis subsp bovis AF2122/97
ccgaucggccaa

SEQ ID NO: 1074004 - RNA, 16 nt, Mycobacterium bovis subsp bovis AF2122/97
ccgaucggccaacagg

SEQ ID NO: 1074005 - RNA, 14 nt, Mycobacterium bovis subsp bovis AF2122/97
ccgaucggccacca

SEQ ID NO: 1074006 - RNA, 17 nt, Mycobacterium bovis subsp bovis AF2122/97
ccgaucggccaccaucg

SEQ ID NO: 1074007 - RNA, 15 nt, Mycobacterium bovis subsp bovis AF2122/97
ccgaucggcgcgccg

SEQ ID NO: 1074008 - RNA, 15 nt, Mycobacterium bovis subsp bovis AF2122/97
ccgaucggcggaucg

SEQ ID NO: 1074009 - RNA, 17 nt, Mycobacterium bovis subsp bovis AF2122/97
ccgaucggcaaucgacu

SEQ ID NO: 1074010 - RNA, 14 nt, Mycobacterium bovis subsp bovis AF2122/97
ccgaucggccugca

SEQ ID NO: 1074011 - RNA, 22 nt, Mycobacterium bovis subsp bovis AF2122/97
ccgaucgggguggucgcaccgc

SEQ ID NO: 1074012 - RNA, 15 nt, Mycobacterium bovis subsp bovis AF2122/97
ccgaucggucgaucg

SEQ ID NO: 1074013 - RNA, 16 nt, Mycobacterium bovis subsp bovis AF2122/97
ccgaucggucguccgg

SEQ ID NO: 1074014 - RNA, 14 nt, Mycobacterium bovis subsp bovis AF2122/97
ccgaucggugccgg

SEQ ID NO: 1074015 - RNA, 24 nt, Mycobacterium bovis subsp bovis AF2122/97
ccgaucggugucgggcugaguggc

SEQ ID NO: 1074016 - RNA, 21 nt, Mycobacterium bovis subsp bovis AF2122/97
ccgaucgggcucacucgccga

SEQ ID NO: 1074017 - RNA, 23 nt, Mycobacterium bovis subsp bovis AF2122/97
ccgaucgggcucacucgccgaau

SEQ ID NO: 1074018 - RNA, 15 nt, Mycobacterium bovis subsp bovis AF2122/97
ccgaucggcaccgug

SEQ ID NO: 1074019 - RNA, 16 nt, Mycobacterium bovis subsp bovis AF2122/97
ccgaucgcggcggccu

SEQ ID NO: 1074020 - RNA, 15 nt, Mycobacterium bovis subsp bovis AF2122/97
ccgaucgaugccacg

SEQ ID NO: 1074021 - RNA, 14 nt, Mycobacterium bovis subsp bovis AF2122/97
ccgaucaugucggc

SEQ ID NO: 1074022 - RNA, 22 nt, Mycobacterium bovis subsp bovis AF2122/97
ccgauccacuguagggccggug

SEQ ID NO: 1074023 - RNA, 18 nt, Mycobacterium bovis subsp bovis AF2122/97
ccgauccagcaggccguc

SEQ ID NO: 1074024 - RNA, 22 nt, Mycobacterium bovis subsp bovis AF2122/97
ccgauccagcaggccgucgauc

SEQ ID NO: 1074025 - RNA, 15 nt, Mycobacterium bovis subsp bovis AF2122/97
ccgaucccggccagc

SEQ ID NO: 1074026 - RNA, 20 nt, Mycobacterium bovis subsp bovis AF2122/97
ccgaucccggccagcuccuc

SEQ ID NO: 1074027 - RNA, 17 nt, Mycobacterium bovis subsp bovis AF2122/97
ccgaucccgugguggcg

SEQ ID NO: 1074028 - RNA, 15 nt, Mycobacterium bovis subsp bovis AF2122/97
ccgauccgcacagca

SEQ ID NO: 1074029 - RNA, 15 nt, Mycobacterium bovis subsp bovis AF2122/97
ccgauccgaucgcag

SEQ ID NO: 1074030 - RNA, 14 nt, Mycobacterium bovis subsp bovis AF2122/97
ccgaucgauaucgg

SEQ ID NO: 1074031 - RNA, 15 nt, Mycobacterium bovis subsp bovis AF2122/97
ccgaucgacacccgc

SEQ ID NO: 1074032 - RNA, 17 nt, Mycobacterium bovis subsp bovis AF2122/97
ccgaucgacacccgcuc

SEQ ID NO: 1074033 - RNA, 13 nt, Mycobacterium bovis subsp bovis AF2122/97
ccgauccugccca

SEQ ID NO: 1074034 - RNA, 22 nt, Mycobacterium bovis subsp bovis AF2122/97
ccgauccugcccaccaucccgc

SEQ ID NO: 1074035 - RNA, 18 nt, Mycobacterium bovis subsp bovis AF2122/97
ccgaucgaaccgcugcuc

SEQ ID NO: 1074036 - RNA, 15 nt, Mycobacterium bovis subsp bovis AF2122/97
ccgauccuggccacu

SEQ ID NO: 1074037 - RNA, 15 nt, Mycobacterium bovis subsp bovis AF2122/97
ccgauccgguggcug

SEQ ID NO: 1074038 - RNA, 23 nt, Mycobacterium bovis subsp bovis AF2122/97
ccgauccgguggcuggccgccac

SEQ ID NO: 1074039 - RNA, 16 nt, Mycobacterium bovis subsp bovis AF2122/97
ccgauccggccgccga

SEQ ID NO: 1074040 - RNA, 13 nt, Mycobacterium bovis subsp bovis AF2122/97
ccgaucagcaccg

SEQ ID NO: 1074041 - RNA, 22 nt, Mycobacterium bovis subsp bovis AF2122/97
ccgaucagcaccgacggcgcau

SEQ ID NO: 1074042 - RNA, 15 nt, Mycobacterium bovis subsp bovis AF2122/97
ccgaucacggugggc

SEQ ID NO: 1074043 - RNA, 19 nt, Mycobacterium bovis subsp bovis AF2122/97
ccgaucacggugggcgccg

SEQ ID NO: 1074044 - RNA, 21 nt, Mycobacterium bovis subsp bovis AF2122/97
ccgaucacggugggcgccgac

SEQ ID NO: 1074045 - RNA, 23 nt, Mycobacterium bovis subsp bovis AF2122/97
ccgaucaccgguucggugagcgg

SEQ ID NO: 1074046 - RNA, 16 nt, Mycobacterium bovis subsp bovis AF2122/97
ccgaucaccuucggcc

SEQ ID NO: 1074047 - RNA, 17 nt, Mycobacterium bovis subsp bovis AF2122/97
ccgaucaccuucggccg

SEQ ID NO: 1074048 - RNA, 15 nt, Mycobacterium bovis subsp bovis AF2122/97
ccgaucacgcuguuc

SEQ ID NO: 1074049 - RNA, 17 nt, Mycobacterium bovis subsp bovis AF2122/97
ccgaucaccucggcgac

SEQ ID NO: 1074050 - RNA, 19 nt, Mycobacterium bovis subsp bovis AF2122/97
ccgaucaccucggcgacgu

SEQ ID NO: 1074051 - RNA, 13 nt, Mycobacterium bovis subsp bovis AF2122/97
ccgaucaccccgg

SEQ ID NO: 1074052 - RNA, 18 nt, Mycobacterium bovis subsp bovis AF2122/97
ccgaucaccccggucggc

SEQ ID NO: 1074053 - RNA, 21 nt, Mycobacterium bovis subsp bovis AF2122/97
ccgaucaccccggucggcccg

SEQ ID NO: 1074054 - RNA, 12 nt, Mycobacterium bovis subsp bovis AF2122/97
ccgaucacccgc

SEQ ID NO: 1074055 - RNA, 14 nt, Mycobacterium bovis subsp bovis AF2122/97
ccgaucacccgcac

SEQ ID NO: 1074056 - RNA, 16 nt, Mycobacterium bovis subsp bovis AF2122/97
ccgaucacccgcaggu

SEQ ID NO: 1074057 - RNA, 13 nt, Mycobacterium bovis subsp bovis AF2122/97
ccgaucagcaggg

SEQ ID NO: 1074058 - RNA, 13 nt, Mycobacterium bovis subsp bovis AF2122/97
ccgaucagcccgg

SEQ ID NO: 1074059 - RNA, 23 nt, Mycobacterium bovis subsp bovis AF2122/97
ccgaucagcccggccuugccgcc

SEQ ID NO: 1074060 - RNA, 16 nt, Mycobacterium bovis subsp bovis AF2122/97
ccgaucagccguggca

SEQ ID NO: 1074061 - RNA, 20 nt, Mycobacterium bovis subsp bovis AF2122/97
ccgaucagcagggcggcguu

SEQ ID NO: 1074062 - RNA, 13 nt, Mycobacterium bovis subsp bovis AF2122/97
ccgaucaguccgg

SEQ ID NO: 1074063 - RNA, 15 nt, Mycobacterium bovis subsp bovis AF2122/97
ccgaucaucaccggc

SEQ ID NO: 1074064 - RNA, 19 nt, Mycobacterium bovis subsp bovis AF2122/97
ccgaucaucauauccgccc

SEQ ID NO: 1074065 - RNA, 23 nt, Mycobacterium bovis subsp bovis AF2122/97
ccgaucaucauauccgccccagc

SEQ ID NO: 1074066 - RNA, 20 nt, Mycobacterium bovis subsp bovis AF2122/97
ccgaucagcguggcgcccgu

SEQ ID NO: 1074067 - RNA, 13 nt, Mycobacterium bovis subsp bovis AF2122/97
ccgauaucgcaga

SEQ ID NO: 1074068 - RNA, 17 nt, Mycobacterium bovis subsp bovis AF2122/97
ccgauaucgcugcggaa

SEQ ID NO: 1074069 - RNA, 15 nt, Mycobacterium bovis subsp bovis AF2122/97
ccgaucaacggaaug

SEQ ID NO: 1074070 - RNA, 15 nt, Mycobacterium bovis subsp bovis AF2122/97
ccgauauucggccau

SEQ ID NO: 1074071 - RNA, 23 nt, Mycobacterium bovis subsp bovis AF2122/97
ccgaucaacggaaugaaggcacc

SEQ ID NO: 1074072 - RNA, 13 nt, Mycobacterium bovis subsp bovis AF2122/97
ccgaucaccaccg

SEQ ID NO: 1074073 - RNA, 13 nt, Mycobacterium bovis subsp bovis AF2122/97
ccgauagaucgcg

SEQ ID NO: 1074074 - RNA, 20 nt, Mycobacterium bovis subsp bovis AF2122/97
ccgauacuaaacaggccgcc

SEQ ID NO: 1074075 - RNA, 18 nt, Mycobacterium bovis subsp bovis AF2122/97
ccgauacuucaucggcac

SEQ ID NO: 1074076 - RNA, 21 nt, Mycobacterium bovis subsp bovis AF2122/97
ccgauagaacuagaucgucgu

SEQ ID NO: 1074077 - RNA, 15 nt, Mycobacterium bovis subsp bovis AF2122/97
ccgauacggccggcc

SEQ ID NO: 1074078 - RNA, 17 nt, Mycobacterium bovis subsp bovis AF2122/97
ccgauacggccggccgu

SEQ ID NO: 1074079 - RNA, 16 nt, Mycobacterium bovis subsp bovis AF2122/97
ccgauacccagcgggu

SEQ ID NO: 1074080 - RNA, 15 nt, Mycobacterium bovis subsp bovis AF2122/97
ccgauaccggcggcg

SEQ ID NO: 1074081 - RNA, 19 nt, Mycobacterium bovis subsp bovis AF2122/97
ccgauaccggcggcgagcg

SEQ ID NO: 1074082 - RNA, 18 nt, Mycobacterium bovis subsp bovis AF2122/97
ccgauaccgucagcgccg

SEQ ID NO: 1074083 - RNA, 18 nt, Mycobacterium bovis subsp bovis AF2122/97
ccgcauucguggagccgg

SEQ ID NO: 1074084 - RNA, 13 nt, Mycobacterium bovis subsp bovis AF2122/97
ccgcauucggacg

SEQ ID NO: 1074085 - RNA, 19 nt, Mycobacterium bovis subsp bovis AF2122/97
ccgcauucguggagccggc

SEQ ID NO: 1074086 - RNA, 20 nt, Mycobacterium bovis subsp bovis AF2122/97
ccgcauucguggagccggcc

SEQ ID NO: 1074087 - RNA, 21 nt, Mycobacterium bovis subsp bovis AF2122/97
ccgcauucguggagccggccg

SEQ ID NO: 1074088 - RNA, 22 nt, Mycobacterium bovis subsp bovis AF2122/97
ccgcauucguggagccggccgu

SEQ ID NO: 1074089 - RNA, 23 nt, Mycobacterium bovis subsp bovis AF2122/97
ccgccaaccccaacaucccggac

SEQ ID NO: 1074090 - RNA, 19 nt, Mycobacterium bovis subsp bovis AF2122/97
ccgccaacaucuccgcguc

SEQ ID NO: 1074091 - RNA, 20 nt, Mycobacterium bovis subsp bovis AF2122/97
ccgcauugaucucgaccggc

SEQ ID NO: 1074092 - RNA, 21 nt, Mycobacterium bovis subsp bovis AF2122/97
ccgcauugaucucgaccggcu

SEQ ID NO: 1074093 - RNA, 19 nt, Mycobacterium bovis subsp bovis AF2122/97
ccgcauggugggugccggc

SEQ ID NO: 1074094 - RNA, 21 nt, Mycobacterium bovis subsp bovis AF2122/97
ccgcaugcgcuccggcgcgac

SEQ ID NO: 1074095 - RNA, 14 nt, Mycobacterium bovis subsp bovis AF2122/97
ccgcauggcgcggg

SEQ ID NO: 1074096 - RNA, 18 nt, Mycobacterium bovis subsp bovis AF2122/97
ccgcauggcagcggcggu

SEQ ID NO: 1074097 - RNA, 22 nt, Mycobacterium bovis subsp bovis AF2122/97
ccgcaugcccuggaccagcggg

SEQ ID NO: 1074098 - RNA, 12 nt, Mycobacterium bovis subsp bovis AF2122/97
ccgcagcgccua

SEQ ID NO: 1074099 - RNA, 18 nt, Mycobacterium bovis subsp bovis AF2122/97
ccgcagcggaacugggcc

SEQ ID NO: 1074100 - RNA, 22 nt, Mycobacterium bovis subsp bovis AF2122/97
ccgcaucgucgccgcgcagaaa

SEQ ID NO: 1074101 - RNA, 14 nt, Mycobacterium bovis subsp bovis AF2122/97
ccgcaugccacggc

SEQ ID NO: 1074102 - RNA, 15 nt, Mycobacterium bovis subsp bovis AF2122/97
ccgcaucuggccggc

SEQ ID NO: 1074103 - RNA, 17 nt, Mycobacterium bovis subsp bovis AF2122/97
ccgcaucuggccggcgg

SEQ ID NO: 1074104 - RNA, 22 nt, Mycobacterium bovis subsp bovis AF2122/97
ccgcaucgguggggcgccgggg

SEQ ID NO: 1074105 - RNA, 16 nt, Mycobacterium bovis subsp bovis AF2122/97
ccgcaucgucgagcca

SEQ ID NO: 1074106 - RNA, 21 nt, Mycobacterium bovis subsp bovis AF2122/97
ccgcagcguguaguggcccgc

SEQ ID NO: 1074107 - RNA, 17 nt, Mycobacterium bovis subsp bovis AF2122/97
ccgcagcuauuucgcga

SEQ ID NO: 1074108 - RNA, 14 nt, Mycobacterium bovis subsp bovis AF2122/97
ccgcagcgugaucu

SEQ ID NO: 1074109 - RNA, 21 nt, Mycobacterium bovis subsp bovis AF2122/97
ccgcagcgugaucuggccacg

SEQ ID NO: 1074110 - RNA, 21 nt, Mycobacterium bovis subsp bovis AF2122/97
ccgccaagcucggccaccagc

SEQ ID NO: 1074111 - RNA, 16 nt, Mycobacterium bovis subsp bovis AF2122/97
ccgccaccaccagggc

SEQ ID NO: 1074112 - RNA, 17 nt, Mycobacterium bovis subsp bovis AF2122/97
ccgccaccuuggcuggg

SEQ ID NO: 1074113 - RNA, 16 nt, Mycobacterium bovis subsp bovis AF2122/97
ccgccaccgucaccgc

SEQ ID NO: 1074114 - RNA, 23 nt, Mycobacterium bovis subsp bovis AF2122/97
ccgccaccgucaccgccgucacc

SEQ ID NO: 1074115 - RNA, 19 nt, Mycobacterium bovis subsp bovis AF2122/97
ccgccaccgucauggcggg

SEQ ID NO: 1074116 - RNA, 18 nt, Mycobacterium bovis subsp bovis AF2122/97
ccgccaccucccagggcu

SEQ ID NO: 1074117 - RNA, 16 nt, Mycobacterium bovis subsp bovis AF2122/97
ccgccaccggcgccgc

SEQ ID NO: 1074118 - RNA, 14 nt, Mycobacterium bovis subsp bovis AF2122/97
ccgccacaccaacg

SEQ ID NO: 1074119 - RNA, 13 nt, Mycobacterium bovis subsp bovis AF2122/97
ccgccaccaaauc

SEQ ID NO: 1074120 - RNA, 12 nt, Mycobacterium bovis subsp bovis AF2122/97
ccgccacagcac

SEQ ID NO: 1074121 - RNA, 16 nt, Mycobacterium bovis subsp bovis AF2122/97
ccgccacagcacccac

SEQ ID NO: 1074122 - RNA, 23 nt, Mycobacterium bovis subsp bovis AF2122/97
ccgccagcaugacaccggccacc

SEQ ID NO: 1074123 - RNA, 15 nt, Mycobacterium bovis subsp bovis AF2122/97
ccgccagcagggcca

SEQ ID NO: 1074124 - RNA, 16 nt, Mycobacterium bovis subsp bovis AF2122/97
ccgccacgggcggcca

SEQ ID NO: 1074125 - RNA, 17 nt, Mycobacterium bovis subsp bovis AF2122/97
ccgccacguacuccacc

SEQ ID NO: 1074126 - RNA, 19 nt, Mycobacterium bovis subsp bovis AF2122/97
ccgccacguacuccaccgc

SEQ ID NO: 1074127 - RNA, 17 nt, Mycobacterium bovis subsp bovis AF2122/97
ccgccacuggcgccggu

SEQ ID NO: 1074128 - RNA, 22 nt, Mycobacterium bovis subsp bovis AF2122/97
ccgccacuggcgccggugccgc

SEQ ID NO: 1074129 - RNA, 16 nt, Mycobacterium bovis subsp bovis AF2122/97
ccgccacuucccccgg

SEQ ID NO: 1074130 - RNA, 23 nt, Mycobacterium bovis subsp bovis AF2122/97
ccgccacuucccccggguccgcc

SEQ ID NO: 1074131 - RNA, 20 nt, Mycobacterium bovis subsp bovis AF2122/97
ccgccaggccgcgcgacaac

SEQ ID NO: 1074132 - RNA, 19 nt, Mycobacterium bovis subsp bovis AF2122/97
ccgccaucgccgccggugc

SEQ ID NO: 1074133 - RNA, 16 nt, Mycobacterium bovis subsp bovis AF2122/97
ccgccaugcggcgcgu

SEQ ID NO: 1074134 - RNA, 15 nt, Mycobacterium bovis subsp bovis AF2122/97
ccgccauugacgccg

SEQ ID NO: 1074135 - RNA, 21 nt, Mycobacterium bovis subsp bovis AF2122/97
ccgccauugacgccguugccg

SEQ ID NO: 1074136 - RNA, 17 nt, Mycobacterium bovis subsp bovis AF2122/97
ccgccaugaaaucaccc

SEQ ID NO: 1074137 - RNA, 20 nt, Mycobacterium bovis subsp bovis AF2122/97
ccgccagcauugaagaagcc

SEQ ID NO: 1074138 - RNA, 14 nt, Mycobacterium bovis subsp bovis AF2122/97
ccgccagcccggug

SEQ ID NO: 1074139 - RNA, 22 nt, Mycobacterium bovis subsp bovis AF2122/97
ccgccagcccggugauggugcc

SEQ ID NO: 1074140 - RNA, 12 nt, Mycobacterium bovis subsp bovis AF2122/97
ccgccagccccg

SEQ ID NO: 1074141 - RNA, 17 nt, Mycobacterium bovis subsp bovis AF2122/97
ccgccagccccgcgccc

SEQ ID NO: 1074142 - RNA, 14 nt, Mycobacterium bovis subsp bovis AF2122/97
ccgccagccgcgag

SEQ ID NO: 1074143 - RNA, 13 nt, Mycobacterium bovis subsp bovis AF2122/97
ccgccagcggccg

SEQ ID NO: 1074144 - RNA, 19 nt, Mycobacterium bovis subsp bovis AF2122/97
ccgccaggaacucggccca

SEQ ID NO: 1074145 - RNA, 13 nt, Mycobacterium bovis subsp bovis AF2122/97
ccgccagcucacg

SEQ ID NO: 1074146 - RNA, 24 nt, Mycobacterium bovis subsp bovis AF2122/97
ccgccaggaaucccucggccgcag

SEQ ID NO: 1074147 - RNA, 12 nt, Mycobacterium bovis subsp bovis AF2122/97
ccgccaggccga

SEQ ID NO: 1074148 - RNA, 22 nt, Mycobacterium bovis subsp bovis AF2122/97
ccgccauugccgccggcgccgc

SEQ ID NO: 1074149 - RNA, 17 nt, Mycobacterium bovis subsp bovis AF2122/97
ccgccauugccgccggu

SEQ ID NO: 1074150 - RNA, 19 nt, Mycobacterium bovis subsp bovis AF2122/97
ccgccauugccgccggugc

SEQ ID NO: 1074151 - RNA, 19 nt, Mycobacterium bovis subsp bovis AF2122/97
ccgccauugccgccgucgc

SEQ ID NO: 1074152 - RNA, 17 nt, Mycobacterium bovis subsp bovis AF2122/97
ccgccauugccguccgg

SEQ ID NO: 1074153 - RNA, 21 nt, Mycobacterium bovis subsp bovis AF2122/97
ccgccauugccguccggugga

SEQ ID NO: 1074154 - RNA, 16 nt, Mycobacterium bovis subsp bovis AF2122/97
ccgccauuucgcccga

SEQ ID NO: 1074155 - RNA, 15 nt, Mycobacterium bovis subsp bovis AF2122/97
ccgcccacgcugccc

SEQ ID NO: 1074156 - RNA, 18 nt, Mycobacterium bovis subsp bovis AF2122/97
ccgcccagaccgccgacg

SEQ ID NO: 1074157 - RNA, 13 nt, Mycobacterium bovis subsp bovis AF2122/97
ccgcccagcccgg

SEQ ID NO: 1074158 - RNA, 15 nt, Mycobacterium bovis subsp bovis AF2122/97
ccgcccagcccggcg

SEQ ID NO: 1074159 - RNA, 16 nt, Mycobacterium bovis subsp bovis AF2122/97
ccgcccagcguugucg

SEQ ID NO: 1074160 - RNA, 20 nt, Mycobacterium bovis subsp bovis AF2122/97
ccgcccagcgaccgcugcag

SEQ ID NO: 1074161 - RNA, 22 nt, Mycobacterium bovis subsp bovis AF2122/97
ccgccccagcugcggucgcggc

SEQ ID NO: 1074162 - RNA, 15 nt, Mycobacterium bovis subsp bovis AF2122/97
ccgcccaugccucca

SEQ ID NO: 1074163 - RNA, 22 nt, Mycobacterium bovis subsp bovis AF2122/97
ccgcccaugccuccagaaccga

SEQ ID NO: 1074164 - RNA, 13 nt, Mycobacterium bovis subsp bovis AF2122/97
ccgcccccgccgg

SEQ ID NO: 1074165 - RNA, 16 nt, Mycobacterium bovis subsp bovis AF2122/97
ccgcccccgccggccg

SEQ ID NO: 1074166 - RNA, 17 nt, Mycobacterium bovis subsp bovis AF2122/97
ccgcccccgccggccgc

SEQ ID NO: 1074167 - RNA, 13 nt, Mycobacterium bovis subsp bovis AF2122/97
ccgcccccgcccg

SEQ ID NO: 1074168 - RNA, 12 nt, Mycobacterium bovis subsp bovis AF2122/97
ccgcccaucacc

SEQ ID NO: 1074169 - RNA, 13 nt, Mycobacterium bovis subsp bovis AF2122/97
ccgccccgcgccu

SEQ ID NO: 1074170 - RNA, 16 nt, Mycobacterium bovis subsp bovis AF2122/97
ccgccccggccaggac

SEQ ID NO: 1074171 - RNA, 12 nt, Mycobacterium bovis subsp bovis AF2122/97
ccgccccggcgg

SEQ ID NO: 1074172 - RNA, 13 nt, Mycobacterium bovis subsp bovis AF2122/97
ccgccccggcggc

SEQ ID NO: 1074173 - RNA, 14 nt, Mycobacterium bovis subsp bovis AF2122/97
ccgccccggcggcg

SEQ ID NO: 1074174 - RNA, 21 nt, Mycobacterium bovis subsp bovis AF2122/97
ccgccccugcgcggccaccuc

SEQ ID NO: 1074175 - RNA, 12 nt, Mycobacterium bovis subsp bovis AF2122/97
ccgccccguggg

SEQ ID NO: 1074176 - RNA, 12 nt, Mycobacterium bovis subsp bovis AF2122/97
ccgcaccgucgc

SEQ ID NO: 1074177 - RNA, 22 nt, Mycobacterium bovis subsp bovis AF2122/97
ccgcaccugggcggcgcgaagu

SEQ ID NO: 1074178 - RNA, 17 nt, Mycobacterium bovis subsp bovis AF2122/97
ccgcacgaaccggucga

SEQ ID NO: 1074179 - RNA, 15 nt, Mycobacterium bovis subsp bovis AF2122/97
ccgcacgaugccggg

SEQ ID NO: 1074180 - RNA, 12 nt, Mycobacterium bovis subsp bovis AF2122/97
ccgcacgauggc

SEQ ID NO: 1074181 - RNA, 13 nt, Mycobacterium bovis subsp bovis AF2122/97
ccgcacgaugccg

SEQ ID NO: 1074182 - RNA, 12 nt, Mycobacterium bovis subsp bovis AF2122/97
ccgcacgccggc

SEQ ID NO: 1074183 - RNA, 16 nt, Mycobacterium bovis subsp bovis AF2122/97
ccgcacgccgaccggc

SEQ ID NO: 1074184 - RNA, 13 nt, Mycobacterium bovis subsp bovis AF2122/97
ccgcacggcgacg

SEQ ID NO: 1074185 - RNA, 16 nt, Mycobacterium bovis subsp bovis AF2122/97
ccgcacggaaggucga

SEQ ID NO: 1074186 - RNA, 17 nt, Mycobacterium bovis subsp bovis AF2122/97
ccgcacggaaggucgac

SEQ ID NO: 1074187 - RNA, 18 nt, Mycobacterium bovis subsp bovis AF2122/97
ccgcacgcacgccacugg

SEQ ID NO: 1074188 - RNA, 18 nt, Mycobacterium bovis subsp bovis AF2122/97
ccgcacgccggccagcga

SEQ ID NO: 1074189 - RNA, 16 nt, Mycobacterium bovis subsp bovis AF2122/97
ccgcacgcucgcccua

SEQ ID NO: 1074190 - RNA, 15 nt, Mycobacterium bovis subsp bovis AF2122/97
ccgcacgcucggcgu

SEQ ID NO: 1074191 - RNA, 13 nt, Mycobacterium bovis subsp bovis AF2122/97
ccgcaccggccgc

SEQ ID NO: 1074192 - RNA, 14 nt, Mycobacterium bovis subsp bovis AF2122/97
ccgcaccggccgcu

SEQ ID NO: 1074193 - RNA, 22 nt, Mycobacterium bovis subsp bovis AF2122/97
ccgcaccggccgcuauggcccg

SEQ ID NO: 1074194 - RNA, 17 nt, Mycobacterium bovis subsp bovis AF2122/97
ccgcaccggugcucguc

SEQ ID NO: 1074195 - RNA, 23 nt, Mycobacterium bovis subsp bovis AF2122/97
ccgcaccggggugugcgggcggu

SEQ ID NO: 1074196 - RNA, 20 nt, Mycobacterium bovis subsp bovis AF2122/97
ccgcaccggaucaccgcgcc

SEQ ID NO: 1074197 - RNA, 23 nt, Mycobacterium bovis subsp bovis AF2122/97
ccgcaccgcgguacgccggucgg

SEQ ID NO: 1074198 - RNA, 14 nt, Mycobacterium bovis subsp bovis AF2122/97
ccgcaccgccugcu

SEQ ID NO: 1074199 - RNA, 23 nt, Mycobacterium bovis subsp bovis AF2122/97
ccgcaccgccugcucggcgaccg

SEQ ID NO: 1074200 - RNA, 12 nt, Mycobacterium bovis subsp bovis AF2122/97
ccgcaccgccgg

SEQ ID NO: 1074201 - RNA, 18 nt, Mycobacterium bovis subsp bovis AF2122/97
ccgcacccccgucgauca

SEQ ID NO: 1074202 - RNA, 20 nt, Mycobacterium bovis subsp bovis AF2122/97
ccgcaccgaaaccaugccgc

SEQ ID NO: 1074203 - RNA, 19 nt, Mycobacterium bovis subsp bovis AF2122/97
ccgcacccccuccgcgaug

SEQ ID NO: 1074204 - RNA, 22 nt, Mycobacterium bovis subsp bovis AF2122/97
ccgcacccccuccgcgaugccg

SEQ ID NO: 1074205 - RNA, 15 nt, Mycobacterium bovis subsp bovis AF2122/97
ccgcaccccggccgc

SEQ ID NO: 1074206 - RNA, 15 nt, Mycobacterium bovis subsp bovis AF2122/97
ccgcacccgcucccg

SEQ ID NO: 1074207 - RNA, 15 nt, Mycobacterium bovis subsp bovis AF2122/97
ccgcacccggccgcg

SEQ ID NO: 1074208 - RNA, 14 nt, Mycobacterium bovis subsp bovis AF2122/97
ccgcacccgggacg

SEQ ID NO: 1074209 - RNA, 16 nt, Mycobacterium bovis subsp bovis AF2122/97
ccgcacccguccggcc

SEQ ID NO: 1074210 - RNA, 21 nt, Mycobacterium bovis subsp bovis AF2122/97
ccgcagcaggugcaucgccac

SEQ ID NO: 1074211 - RNA, 20 nt, Mycobacterium bovis subsp bovis AF2122/97
ccgcagcaggggacgaccau

SEQ ID NO: 1074212 - RNA, 13 nt, Mycobacterium bovis subsp bovis AF2122/97
ccgcagcccgccg

SEQ ID NO: 1074213 - RNA, 16 nt, Mycobacterium bovis subsp bovis AF2122/97
ccgcagaucaccgcca

SEQ ID NO: 1074214 - RNA, 14 nt, Mycobacterium bovis subsp bovis AF2122/97
ccgcagccaggucu

SEQ ID NO: 1074215 - RNA, 12 nt, Mycobacterium bovis subsp bovis AF2122/97
ccgcagccagca

SEQ ID NO: 1074216 - RNA, 19 nt, Mycobacterium bovis subsp bovis AF2122/97
ccgcagcaccucgucgauc

SEQ ID NO: 1074217 - RNA, 15 nt, Mycobacterium bovis subsp bovis AF2122/97
ccgcagcaccgucgg

SEQ ID NO: 1074218 - RNA, 15 nt, Mycobacterium bovis subsp bovis AF2122/97
ccgcagagcaccgcg

SEQ ID NO: 1074219 - RNA, 17 nt, Mycobacterium bovis subsp bovis AF2122/97
ccgcagacgcggcaggu

SEQ ID NO: 1074220 - RNA, 19 nt, Mycobacterium bovis subsp bovis AF2122/97
ccgcagacgugguagccgg

SEQ ID NO: 1074221 - RNA, 13 nt, Mycobacterium bovis subsp bovis AF2122/97
ccgcacgcuggcg

SEQ ID NO: 1074222 - RNA, 21 nt, Mycobacterium bovis subsp bovis AF2122/97
ccgcacggugaccacgccgug

SEQ ID NO: 1074223 - RNA, 13 nt, Mycobacterium bovis subsp bovis AF2122/97
ccgcacgggaucg

SEQ ID NO: 1074224 - RNA, 12 nt, Mycobacterium bovis subsp bovis AF2122/97
ccgcacgggccc

SEQ ID NO: 1074225 - RNA, 13 nt, Mycobacterium bovis subsp bovis AF2122/97
ccgcacgggccca

SEQ ID NO: 1074226 - RNA, 14 nt, Mycobacterium bovis subsp bovis AF2122/97
ccgcacggugacca

SEQ ID NO: 1074227 - RNA, 18 nt, Mycobacterium bovis subsp bovis AF2122/97
ccgcacgguguauccgac

SEQ ID NO: 1074228 - RNA, 18 nt, Mycobacterium bovis subsp bovis AF2122/97
ccgcacguucacgcgcgg

SEQ ID NO: 1074229 - RNA, 12 nt, Mycobacterium bovis subsp bovis AF2122/97
ccgcacguuggc

SEQ ID NO: 1074230 - RNA, 19 nt, Mycobacterium bovis subsp bovis AF2122/97
ccgcagaaugucguaggcg

SEQ ID NO: 1074231 - RNA, 15 nt, Mycobacterium bovis subsp bovis AF2122/97
ccgcagaccgccacc

SEQ ID NO: 1074232 - RNA, 23 nt, Mycobacterium bovis subsp bovis AF2122/97
ccgcagaccgguuucuucggcca

SEQ ID NO: 1074233 - RNA, 16 nt, Mycobacterium bovis subsp bovis AF2122/97
ccgcacugccgccggu

SEQ ID NO: 1074234 - RNA, 16 nt, Mycobacterium bovis subsp bovis AF2122/97
ccgcacgguucgggug

SEQ ID NO: 1074235 - RNA, 15 nt, Mycobacterium bovis subsp bovis AF2122/97
ccgcacguuggcggc

SEQ ID NO: 1074236 - RNA, 17 nt, Mycobacterium bovis subsp bovis AF2122/97
ccgcaaacccgccgaca

SEQ ID NO: 1074237 - RNA, 16 nt, Mycobacterium bovis subsp bovis AF2122/97
ccgauuuugugagcca

SEQ ID NO: 1074238 - RNA, 20 nt, Mycobacterium bovis subsp bovis AF2122/97
ccgcaaaaucgucagcgccg

SEQ ID NO: 1074239 - RNA, 13 nt, Mycobacterium bovis subsp bovis AF2122/97
ccgauuccgcgcg

SEQ ID NO: 1074240 - RNA, 14 nt, Mycobacterium bovis subsp bovis AF2122/97
ccgauuccgcgcgu

SEQ ID NO: 1074241 - RNA, 22 nt, Mycobacterium bovis subsp bovis AF2122/97
ccgauuacggugaucgccggcu

SEQ ID NO: 1074242 - RNA, 20 nt, Mycobacterium bovis subsp bovis AF2122/97
ccgauucugauaucgucggu

SEQ ID NO: 1074243 - RNA, 18 nt, Mycobacterium bovis subsp bovis AF2122/97
ccgauugaguucggcggc

SEQ ID NO: 1074244 - RNA, 22 nt, Mycobacterium bovis subsp bovis AF2122/97
ccgauuuugggaucgugccggc

SEQ ID NO: 1074245 - RNA, 16 nt, Mycobacterium bovis subsp bovis AF2122/97
ccgcaaacgcggcguc

SEQ ID NO: 1074246 - RNA, 13 nt, Mycobacterium bovis subsp bovis AF2122/97
ccgcaacagcucg

SEQ ID NO: 1074247 - RNA, 18 nt, Mycobacterium bovis subsp bovis AF2122/97
ccgcaacagcucggccag

SEQ ID NO: 1074248 - RNA, 22 nt, Mycobacterium bovis subsp bovis AF2122/97
ccgcaacagcucggccaggcug

SEQ ID NO: 1074249 - RNA, 17 nt, Mycobacterium bovis subsp bovis AF2122/97
ccgcaacaucgggucgc

SEQ ID NO: 1074250 - RNA, 12 nt, Mycobacterium bovis subsp bovis AF2122/97
ccgcaaccgcga

SEQ ID NO: 1074251 - RNA, 17 nt, Mycobacterium bovis subsp bovis AF2122/97
ccgcaacccguauggcg

SEQ ID NO: 1074252 - RNA, 20 nt, Mycobacterium bovis subsp bovis AF2122/97
ccgcaacaacgccgcgacgu

SEQ ID NO: 1074253 - RNA, 23 nt, Mycobacterium bovis subsp bovis AF2122/97
ccgcaaccgguaucgccgcuacg

SEQ ID NO: 1074254 - RNA, 16 nt, Mycobacterium bovis subsp bovis AF2122/97
ccgcaacgacggccgu

SEQ ID NO: 1074255 - RNA, 20 nt, Mycobacterium bovis subsp bovis AF2122/97
ccgcaacgacggccgucgcc

SEQ ID NO: 1074256 - RNA, 14 nt, Mycobacterium bovis subsp bovis AF2122/97
ccgcaacgacugau

SEQ ID NO: 1074257 - RNA, 20 nt, Mycobacterium bovis subsp bovis AF2122/97
ccgcaacgccaacacgcguu

SEQ ID NO: 1074258 - RNA, 15 nt, Mycobacterium bovis subsp bovis AF2122/97
ccgcaacgcuucggc

SEQ ID NO: 1074259 - RNA, 22 nt, Mycobacterium bovis subsp bovis AF2122/97
ccgcaacggauaacccguggcg

SEQ ID NO: 1074260 - RNA, 12 nt, Mycobacterium bovis subsp bovis AF2122/97
ccgcaacggaug

SEQ ID NO: 1074261 - RNA, 21 nt, Mycobacterium bovis subsp bovis AF2122/97
ccgcaacggauguggugucga

SEQ ID NO: 1074262 - RNA, 23 nt, Mycobacterium bovis subsp bovis AF2122/97
ccgcaaggcgccgauaccggcgg

SEQ ID NO: 1074263 - RNA, 23 nt, Mycobacterium bovis subsp bovis AF2122/97
ccgcaaggcguguagccugcggc

SEQ ID NO: 1074264 - RNA, 23 nt, Mycobacterium bovis subsp bovis AF2122/97
ccgcaaggaccugugcggccgac

SEQ ID NO: 1074265 - RNA, 24 nt, Mycobacterium bovis subsp bovis AF2122/97
ccgcaagugucuccggcaacagca

SEQ ID NO: 1074266 - RNA, 17 nt, Mycobacterium bovis subsp bovis AF2122/97
ccgcaauggggcgcaau

SEQ ID NO: 1074267 - RNA, 16 nt, Mycobacterium bovis subsp bovis AF2122/97
ccgcaaugcgagcgcg

SEQ ID NO: 1074268 - RNA, 16 nt, Mycobacterium bovis subsp bovis AF2122/97
ccgcaaugcguugacc

SEQ ID NO: 1074269 - RNA, 14 nt, Mycobacterium bovis subsp bovis AF2122/97
ccgcaauucgcggu

SEQ ID NO: 1074270 - RNA, 12 nt, Mycobacterium bovis subsp bovis AF2122/97
ccgcaaucgcga

SEQ ID NO: 1074271 - RNA, 15 nt, Mycobacterium bovis subsp bovis AF2122/97
ccgcaaugaccgcgg

SEQ ID NO: 1074272 - RNA, 18 nt, Mycobacterium bovis subsp bovis AF2122/97
ccgcaaugaccuggccgc

SEQ ID NO: 1074273 - RNA, 17 nt, Mycobacterium bovis subsp bovis AF2122/97
ccgcaauggaccgaacg

SEQ ID NO: 1074274 - RNA, 13 nt, Mycobacterium bovis subsp bovis AF2122/97
ccgcacagcgacg

SEQ ID NO: 1074275 - RNA, 19 nt, Mycobacterium bovis subsp bovis AF2122/97
ccgcacacagaccgugacg

SEQ ID NO: 1074276 - RNA, 14 nt, Mycobacterium bovis subsp bovis AF2122/97
ccgcacaaacgggc

SEQ ID NO: 1074277 - RNA, 23 nt, Mycobacterium bovis subsp bovis AF2122/97
ccgcacaaacgggcgugggccgc

SEQ ID NO: 1074278 - RNA, 19 nt, Mycobacterium bovis subsp bovis AF2122/97
ccgcaauuguucgcggccg

SEQ ID NO: 1074279 - RNA, 13 nt, Mycobacterium bovis subsp bovis AF2122/97
ccgcacaacgaua

SEQ ID NO: 1074280 - RNA, 15 nt, Mycobacterium bovis subsp bovis AF2122/97
ccgcacccccgucga

SEQ ID NO: 1074281 - RNA, 22 nt, Mycobacterium bovis subsp bovis AF2122/97
ccgcaccccauacucggcggcu

SEQ ID NO: 1074282 - RNA, 15 nt, Mycobacterium bovis subsp bovis AF2122/97
ccgcacccagaccgc

SEQ ID NO: 1074283 - RNA, 12 nt, Mycobacterium bovis subsp bovis AF2122/97
ccgcaccagugg

SEQ ID NO: 1074284 - RNA, 16 nt, Mycobacterium bovis subsp bovis AF2122/97
ccgcaccaggguugcc

SEQ ID NO: 1074285 - RNA, 13 nt, Mycobacterium bovis subsp bovis AF2122/97
ccgcaccaccggc

SEQ ID NO: 1074286 - RNA, 16 nt, Mycobacterium bovis subsp bovis AF2122/97
ccgcaccaccggcccc

SEQ ID NO: 1074287 - RNA, 17 nt, Mycobacterium bovis subsp bovis AF2122/97
ccgcaccaccggcccca

SEQ ID NO: 1074288 - RNA, 23 nt, Mycobacterium bovis subsp bovis AF2122/97
ccgcaccaccggccccaccgaca

SEQ ID NO: 1074289 - RNA, 17 nt, Mycobacterium bovis subsp bovis AF2122/97
ccgcaccacaccguggg

SEQ ID NO: 1074290 - RNA, 19 nt, Mycobacterium bovis subsp bovis AF2122/97
ccgcaccacaccgugggcg

SEQ ID NO: 1074291 - RNA, 15 nt, Mycobacterium bovis subsp bovis AF2122/97
ccgcguugccggggu

SEQ ID NO: 1074292 - RNA, 23 nt, Mycobacterium bovis subsp bovis AF2122/97
ccgcuaggaucggauggcggcca

SEQ ID NO: 1074293 - RNA, 19 nt, Mycobacterium bovis subsp bovis AF2122/97
ccgcucacaagccgugcag

SEQ ID NO: 1074294 - RNA, 16 nt, Mycobacterium bovis subsp bovis AF2122/97
ccgcuauucggcggca

SEQ ID NO: 1074295 - RNA, 16 nt, Mycobacterium bovis subsp bovis AF2122/97
ccgcuaugaugccgcc

SEQ ID NO: 1074296 - RNA, 18 nt, Mycobacterium bovis subsp bovis AF2122/97
ccgcguugaugaccaggu

SEQ ID NO: 1074297 - RNA, 15 nt, Mycobacterium bovis subsp bovis AF2122/97
ccgcguucucggcac

SEQ ID NO: 1074298 - RNA, 17 nt, Mycobacterium bovis subsp bovis AF2122/97
ccgcguugaaggcgccg

SEQ ID NO: 1074299 - RNA, 19 nt, Mycobacterium bovis subsp bovis AF2122/97
ccgcguugaugaccgccgc

SEQ ID NO: 1074300 - RNA, 20 nt, Mycobacterium bovis subsp bovis AF2122/97
ccgcguuuauaccucgccgc

SEQ ID NO: 1074301 - RNA, 21 nt, Mycobacterium bovis subsp bovis AF2122/97
ccgcguuuauaccucgccgcc

SEQ ID NO: 1074302 - RNA, 13 nt, Mycobacterium bovis subsp bovis AF2122/97
ccgcguuguccgc

SEQ ID NO: 1074303 - RNA, 22 nt, Mycobacterium bovis subsp bovis AF2122/97
ccgcguuucgcgacgucugcca

SEQ ID NO: 1074304 - RNA, 15 nt, Mycobacterium bovis subsp bovis AF2122/97
ccgcucggcggucgg

SEQ ID NO: 1074305 - RNA, 14 nt, Mycobacterium bovis subsp bovis AF2122/97
ccgcuccagcucgg

SEQ ID NO: 1074306 - RNA, 22 nt, Mycobacterium bovis subsp bovis AF2122/97
ccgcuccaaaagccucagccgc

SEQ ID NO: 1074307 - RNA, 13 nt, Mycobacterium bovis subsp bovis AF2122/97
ccgcuccaagcgc

SEQ ID NO: 1074308 - RNA, 16 nt, Mycobacterium bovis subsp bovis AF2122/97
ccgcucacccggucgc

SEQ ID NO: 1074309 - RNA, 16 nt, Mycobacterium bovis subsp bovis AF2122/97
ccgcucauccagcgcg

SEQ ID NO: 1074310 - RNA, 20 nt, Mycobacterium bovis subsp bovis AF2122/97
ccgcucaucgaucacacguc

SEQ ID NO: 1074311 - RNA, 21 nt, Mycobacterium bovis subsp bovis AF2122/97
ccgcucaucgaucccguucgg

SEQ ID NO: 1074312 - RNA, 17 nt, Mycobacterium bovis subsp bovis AF2122/97
ccgcucacgaagaccgc

SEQ ID NO: 1074313 - RNA, 19 nt, Mycobacterium bovis subsp bovis AF2122/97
ccgcucagccguccgggcg

SEQ ID NO: 1074314 - RNA, 23 nt, Mycobacterium bovis subsp bovis AF2122/97
ccgcucagccguccgggcggccu

SEQ ID NO: 1074315 - RNA, 20 nt, Mycobacterium bovis subsp bovis AF2122/97
ccgcguggugcugaccgcgc

SEQ ID NO: 1074316 - RNA, 16 nt, Mycobacterium bovis subsp bovis AF2122/97
ccgcguguaccgcgac

SEQ ID NO: 1074317 - RNA, 17 nt, Mycobacterium bovis subsp bovis AF2122/97
ccgcguguccuuugcca

SEQ ID NO: 1074318 - RNA, 13 nt, Mycobacterium bovis subsp bovis AF2122/97
ccgcguggcuggc

SEQ ID NO: 1074319 - RNA, 17 nt, Mycobacterium bovis subsp bovis AF2122/97
ccgcguggcuggcggcg

SEQ ID NO: 1074320 - RNA, 17 nt, Mycobacterium bovis subsp bovis AF2122/97
ccgcguuaugccaggcg

SEQ ID NO: 1074321 - RNA, 14 nt, Mycobacterium bovis subsp bovis AF2122/97
ccgcggucagaucc

SEQ ID NO: 1074322 - RNA, 18 nt, Mycobacterium bovis subsp bovis AF2122/97
ccgcgugcgcaucccgaa

SEQ ID NO: 1074323 - RNA, 15 nt, Mycobacterium bovis subsp bovis AF2122/97
ccgcgugccacucga

SEQ ID NO: 1074324 - RNA, 11 nt, Mycobacterium bovis subsp bovis AF2122/97
ccgcgugcguc

SEQ ID NO: 1074325 - RNA, 17 nt, Mycobacterium bovis subsp bovis AF2122/97
ccgcgugcucgagcacc

SEQ ID NO: 1074326 - RNA, 13 nt, Mycobacterium bovis subsp bovis AF2122/97
ccgcguggccggu

SEQ ID NO: 1074327 - RNA, 15 nt, Mycobacterium bovis subsp bovis AF2122/97
ccgcguggccgguca

SEQ ID NO: 1074328 - RNA, 15 nt, Mycobacterium bovis subsp bovis AF2122/97
ccgcgugccgcccgc

SEQ ID NO: 1074329 - RNA, 16 nt, Mycobacterium bovis subsp bovis AF2122/97
ccgcgugcucgccgua

SEQ ID NO: 1074330 - RNA, 17 nt, Mycobacterium bovis subsp bovis AF2122/97
ccgcgguagacgccgcc

SEQ ID NO: 1074331 - RNA, 18 nt, Mycobacterium bovis subsp bovis AF2122/97
ccgcgguagacgccgccg

SEQ ID NO: 1074332 - RNA, 22 nt, Mycobacterium bovis subsp bovis AF2122/97
ccgcgguagacggcacugugcg

SEQ ID NO: 1074333 - RNA, 17 nt, Mycobacterium bovis subsp bovis AF2122/97
ccgcgguagccgaccga

SEQ ID NO: 1074334 - RNA, 18 nt, Mycobacterium bovis subsp bovis AF2122/97
ccgcgguagccgaccgac

SEQ ID NO: 1074335 - RNA, 18 nt, Mycobacterium bovis subsp bovis AF2122/97
ccgcgguacgccggucgg

SEQ ID NO: 1074336 - RNA, 22 nt, Mycobacterium bovis subsp bovis AF2122/97
ccgcgguagcggaccugcgaga

SEQ ID NO: 1074337 - RNA, 14 nt, Mycobacterium bovis subsp bovis AF2122/97
ccgcggucaccccg

SEQ ID NO: 1074338 - RNA, 23 nt, Mycobacterium bovis subsp bovis AF2122/97
ccgcggucaccccggcucggcca

SEQ ID NO: 1074339 - RNA, 21 nt, Mycobacterium bovis subsp bovis AF2122/97
ccgcgucgagugccgccaccg

SEQ ID NO: 1074340 - RNA, 20 nt, Mycobacterium bovis subsp bovis AF2122/97
ccgcgucggacuccgagaga

SEQ ID NO: 1074341 - RNA, 13 nt, Mycobacterium bovis subsp bovis AF2122/97
ccgcgucggcggc

SEQ ID NO: 1074342 - RNA, 15 nt, Mycobacterium bovis subsp bovis AF2122/97
ccgcgucggcggcca

SEQ ID NO: 1074343 - RNA, 19 nt, Mycobacterium bovis subsp bovis AF2122/97
ccgcgucggcggcgaccgc

SEQ ID NO: 1074344 - RNA, 20 nt, Mycobacterium bovis subsp bovis AF2122/97
ccgcgucggcggcgaccgcc

SEQ ID NO: 1074345 - RNA, 13 nt, Mycobacterium bovis subsp bovis AF2122/97
ccgcgucgccggc

SEQ ID NO: 1074346 - RNA, 21 nt, Mycobacterium bovis subsp bovis AF2122/97
ccgcuguggucuucaucgccg

SEQ ID NO: 1074347 - RNA, 16 nt, Mycobacterium bovis subsp bovis AF2122/97
ccgcugugggucgauc

SEQ ID NO: 1074348 - RNA, 17 nt, Mycobacterium bovis subsp bovis AF2122/97
ccgcuguguucagcgca

SEQ ID NO: 1074349 - RNA, 20 nt, Mycobacterium bovis subsp bovis AF2122/97
ccgcuuagcaaucggcagga

SEQ ID NO: 1074350 - RNA, 13 nt, Mycobacterium bovis subsp bovis AF2122/97
ccgcuucagcacg

SEQ ID NO: 1074351 - RNA, 15 nt, Mycobacterium bovis subsp bovis AF2122/97
ccgcuggggcgcccg

SEQ ID NO: 1074352 - RNA, 11 nt, Mycobacterium bovis subsp bovis AF2122/97
ccgcuggggcu

SEQ ID NO: 1074353 - RNA, 15 nt, Mycobacterium bovis subsp bovis AF2122/97
ccgcugggcucgcug

SEQ ID NO: 1074354 - RNA, 18 nt, Mycobacterium bovis subsp bovis AF2122/97
ccgcugggcuuggggccg

SEQ ID NO: 1074355 - RNA, 18 nt, Mycobacterium bovis subsp bovis AF2122/97
ccgcugggggcggucgcc

SEQ ID NO: 1074356 - RNA, 14 nt, Mycobacterium bovis subsp bovis AF2122/97
ccgcugucgagccg

SEQ ID NO: 1074357 - RNA, 24 nt, Mycobacterium bovis subsp bovis AF2122/97
ccgcugucguaccgcucggcggca

SEQ ID NO: 1074358 - RNA, 19 nt, Mycobacterium bovis subsp bovis AF2122/97
ccgcugucgagccggugcc

SEQ ID NO: 1074359 - RNA, 20 nt, Mycobacterium bovis subsp bovis AF2122/97
ccgcuggcccgccagaacgg

SEQ ID NO: 1074360 - RNA, 20 nt, Mycobacterium bovis subsp bovis AF2122/97
ccgcuggcucaucgaagcuu

SEQ ID NO: 1074361 - RNA, 19 nt, Mycobacterium bovis subsp bovis AF2122/97
ccgcuggcgguaagcgaaa

SEQ ID NO: 1074362 - RNA, 19 nt, Mycobacterium bovis subsp bovis AF2122/97
ccgcugcggcaccacccgg

SEQ ID NO: 1074363 - RNA, 20 nt, Mycobacterium bovis subsp bovis AF2122/97
ccgcugcggcaccacccggc

SEQ ID NO: 1074364 - RNA, 14 nt, Mycobacterium bovis subsp bovis AF2122/97
ccgcugccgccggu

SEQ ID NO: 1074365 - RNA, 14 nt, Mycobacterium bovis subsp bovis AF2122/97
ccgcugccggcacg

SEQ ID NO: 1074366 - RNA, 11 nt, Mycobacterium bovis subsp bovis AF2122/97
ccgcugccggu

SEQ ID NO: 1074367 - RNA, 18 nt, Mycobacterium bovis subsp bovis AF2122/97
ccgcugccgguggcggcg

SEQ ID NO: 1074368 - RNA, 15 nt, Mycobacterium bovis subsp bovis AF2122/97
ccgcugccggcgccg

SEQ ID NO: 1074369 - RNA, 16 nt, Mycobacterium bovis subsp bovis AF2122/97
ccgcugccggcgccgc

SEQ ID NO: 1074370 - RNA, 18 nt, Mycobacterium bovis subsp bovis AF2122/97
ccgcucucggcgauuuug

SEQ ID NO: 1074371 - RNA, 17 nt, Mycobacterium bovis subsp bovis AF2122/97
ccgcugccgcgcggcga

SEQ ID NO: 1074372 - RNA, 18 nt, Mycobacterium bovis subsp bovis AF2122/97
ccgcucgguaccggucga

SEQ ID NO: 1074373 - RNA, 16 nt, Mycobacterium bovis subsp bovis AF2122/97
ccgcucgguccagccg

SEQ ID NO: 1074374 - RNA, 17 nt, Mycobacterium bovis subsp bovis AF2122/97
ccgcucgguccagccgg

SEQ ID NO: 1074375 - RNA, 13 nt, Mycobacterium bovis subsp bovis AF2122/97
ccgcucggucgcc

SEQ ID NO: 1074376 - RNA, 17 nt, Mycobacterium bovis subsp bovis AF2122/97
ccgcucgggguggucgg

SEQ ID NO: 1074377 - RNA, 23 nt, Mycobacterium bovis subsp bovis AF2122/97
ccgcucgggcaacgccucgagca

SEQ ID NO: 1074378 - RNA, 13 nt, Mycobacterium bovis subsp bovis AF2122/97
ccgcucgggcgcg

SEQ ID NO: 1074379 - RNA, 18 nt, Mycobacterium bovis subsp bovis AF2122/97
ccgcucguucgugcagcc

SEQ ID NO: 1074380 - RNA, 15 nt, Mycobacterium bovis subsp bovis AF2122/97
ccgcucagggugcgc

SEQ ID NO: 1074381 - RNA, 19 nt, Mycobacterium bovis subsp bovis AF2122/97
ccgcggcccggacgucggc

SEQ ID NO: 1074382 - RNA, 15 nt, Mycobacterium bovis subsp bovis AF2122/97
ccgcggcccgcgugc

SEQ ID NO: 1074383 - RNA, 14 nt, Mycobacterium bovis subsp bovis AF2122/97
ccgcggccgccguc

SEQ ID NO: 1074384 - RNA, 18 nt, Mycobacterium bovis subsp bovis AF2122/97
ccgcggccgaaacgccau

SEQ ID NO: 1074385 - RNA, 23 nt, Mycobacterium bovis subsp bovis AF2122/97
ccgcggccuuggcggccgcgacc

SEQ ID NO: 1074386 - RNA, 18 nt, Mycobacterium bovis subsp bovis AF2122/97
ccgcggcgaaccagcgcg

SEQ ID NO: 1074387 - RNA, 18 nt, Mycobacterium bovis subsp bovis AF2122/97
ccgcggcccgcgugcgca

SEQ ID NO: 1074388 - RNA, 20 nt, Mycobacterium bovis subsp bovis AF2122/97
ccgcggccggguggcccggc

SEQ ID NO: 1074389 - RNA, 13 nt, Mycobacterium bovis subsp bovis AF2122/97
ccgcggccggcgc

SEQ ID NO: 1074390 - RNA, 14 nt, Mycobacterium bovis subsp bovis AF2122/97
ccgcggccucccgc

SEQ ID NO: 1074391 - RNA, 13 nt, Mycobacterium bovis subsp bovis AF2122/97
ccgcggcgcagca

SEQ ID NO: 1074392 - RNA, 16 nt, Mycobacterium bovis subsp bovis AF2122/97
ccgcggccuuggcggc

SEQ ID NO: 1074393 - RNA, 14 nt, Mycobacterium bovis subsp bovis AF2122/97
ccgcggcgauuacg

SEQ ID NO: 1074394 - RNA, 14 nt, Mycobacterium bovis subsp bovis AF2122/97
ccgcggcgcccggc

SEQ ID NO: 1074395 - RNA, 21 nt, Mycobacterium bovis subsp bovis AF2122/97
ccgcggcgccauagccgcgac

SEQ ID NO: 1074396 - RNA, 15 nt, Mycobacterium bovis subsp bovis AF2122/97
ccgcggcgcagcacg

SEQ ID NO: 1074397 - RNA, 17 nt, Mycobacterium bovis subsp bovis AF2122/97
ccgcggcgcagcacggc

SEQ ID NO: 1074398 - RNA, 19 nt, Mycobacterium bovis subsp bovis AF2122/97
ccgcggcgcagcacggcgg

SEQ ID NO: 1074399 - RNA, 20 nt, Mycobacterium bovis subsp bovis AF2122/97
ccgcggcgccguugccaccg

SEQ ID NO: 1074400 - RNA, 15 nt, Mycobacterium bovis subsp bovis AF2122/97
ccgcggcgccuccgc

SEQ ID NO: 1074401 - RNA, 15 nt, Mycobacterium bovis subsp bovis AF2122/97
ccgcggcgcgacggc

SEQ ID NO: 1074402 - RNA, 14 nt, Mycobacterium bovis subsp bovis AF2122/97
ccgcggcgcgcaac

SEQ ID NO: 1074403 - RNA, 18 nt, Mycobacterium bovis subsp bovis AF2122/97
ccgcggcggcagcggcga

SEQ ID NO: 1074404 - RNA, 15 nt, Mycobacterium bovis subsp bovis AF2122/97
ccgcggcggcgcgug

SEQ ID NO: 1074405 - RNA, 16 nt, Mycobacterium bovis subsp bovis AF2122/97
ccgcggcggcagcacc

SEQ ID NO: 1074406 - RNA, 14 nt, Mycobacterium bovis subsp bovis AF2122/97
ccgcggcggcagca

SEQ ID NO: 1074407 - RNA, 14 nt, Mycobacterium bovis subsp bovis AF2122/97
ccgcggcggaaggc

SEQ ID NO: 1074408 - RNA, 19 nt, Mycobacterium bovis subsp bovis AF2122/97
ccgcggcuacaucggcggc

SEQ ID NO: 1074409 - RNA, 19 nt, Mycobacterium bovis subsp bovis AF2122/97
ccgcggcgcugaugccguc

SEQ ID NO: 1074410 - RNA, 23 nt, Mycobacterium bovis subsp bovis AF2122/97
ccgcggcggucagucccgugacg

SEQ ID NO: 1074411 - RNA, 12 nt, Mycobacterium bovis subsp bovis AF2122/97
ccgcgggugcgg

SEQ ID NO: 1074412 - RNA, 18 nt, Mycobacterium bovis subsp bovis AF2122/97
ccgcgggugcggcauggc

SEQ ID NO: 1074413 - RNA, 14 nt, Mycobacterium bovis subsp bovis AF2122/97
ccgcgggugauguu

SEQ ID NO: 1074414 - RNA, 14 nt, Mycobacterium bovis subsp bovis AF2122/97
ccgcgggucgugcc

SEQ ID NO: 1074415 - RNA, 13 nt, Mycobacterium bovis subsp bovis AF2122/97
ccgcgggccagca

SEQ ID NO: 1074416 - RNA, 17 nt, Mycobacterium bovis subsp bovis AF2122/97
ccgcgggccagcaccuc

SEQ ID NO: 1074417 - RNA, 20 nt, Mycobacterium bovis subsp bovis AF2122/97
ccgcgggucgcugcgacugg

SEQ ID NO: 1074418 - RNA, 17 nt, Mycobacterium bovis subsp bovis AF2122/97
ccgcgggucguccggcg

SEQ ID NO: 1074419 - RNA, 20 nt, Mycobacterium bovis subsp bovis AF2122/97
ccgcgggucguccggcggca

SEQ ID NO: 1074420 - RNA, 12 nt, Mycobacterium bovis subsp bovis AF2122/97
ccgcgggccgcc

SEQ ID NO: 1074421 - RNA, 14 nt, Mycobacterium bovis subsp bovis AF2122/97
ccgcgggccgcgcg

SEQ ID NO: 1074422 - RNA, 16 nt, Mycobacterium bovis subsp bovis AF2122/97
ccgcgggccgcgucca

SEQ ID NO: 1074423 - RNA, 20 nt, Mycobacterium bovis subsp bovis AF2122/97
ccgcgggccgcguccagacc

SEQ ID NO: 1074424 - RNA, 20 nt, Mycobacterium bovis subsp bovis AF2122/97
ccgcgggaccuucgagccgc

SEQ ID NO: 1074425 - RNA, 22 nt, Mycobacterium bovis subsp bovis AF2122/97
ccgcggcugucacgccugccac

SEQ ID NO: 1074426 - RNA, 17 nt, Mycobacterium bovis subsp bovis AF2122/97
ccgcggcuuccccggua

SEQ ID NO: 1074427 - RNA, 16 nt, Mycobacterium bovis subsp bovis AF2122/97
ccgcgggacaccaccg

SEQ ID NO: 1074428 - RNA, 18 nt, Mycobacterium bovis subsp bovis AF2122/97
ccgcgggacaccaccgcc

SEQ ID NO: 1074429 - RNA, 12 nt, Mycobacterium bovis subsp bovis AF2122/97
ccgcgcggcgca

SEQ ID NO: 1074430 - RNA, 17 nt, Mycobacterium bovis subsp bovis AF2122/97
ccgcgcggcgcagcacc

SEQ ID NO: 1074431 - RNA, 14 nt, Mycobacterium bovis subsp bovis AF2122/97
ccgcgcgccggcga

SEQ ID NO: 1074432 - RNA, 12 nt, Mycobacterium bovis subsp bovis AF2122/97
ccgcgcggcgag

SEQ ID NO: 1074433 - RNA, 21 nt, Mycobacterium bovis subsp bovis AF2122/97
ccgcgcggcgagagccucggc

SEQ ID NO: 1074434 - RNA, 19 nt, Mycobacterium bovis subsp bovis AF2122/97
ccgcgcggcgacagcuugg

SEQ ID NO: 1074435 - RNA, 20 nt, Mycobacterium bovis subsp bovis AF2122/97
ccgcgcuugcgaucgccgcu

SEQ ID NO: 1074436 - RNA, 17 nt, Mycobacterium bovis subsp bovis AF2122/97
ccgcgcuugcgaucggc

SEQ ID NO: 1074437 - RNA, 20 nt, Mycobacterium bovis subsp bovis AF2122/97
ccgcgcuugcgaucggcacu

SEQ ID NO: 1074438 - RNA, 15 nt, Mycobacterium bovis subsp bovis AF2122/97
ccgcgcgggcggauc

SEQ ID NO: 1074439 - RNA, 22 nt, Mycobacterium bovis subsp bovis AF2122/97
ccgcgcggcgcauuccggcgcc

SEQ ID NO: 1074440 - RNA, 18 nt, Mycobacterium bovis subsp bovis AF2122/97
ccgcgcuugcgaucgccg

SEQ ID NO: 1074441 - RNA, 18 nt, Mycobacterium bovis subsp bovis AF2122/97
ccgcgcuuucgagugcag

SEQ ID NO: 1074442 - RNA, 22 nt, Mycobacterium bovis subsp bovis AF2122/97
ccgcgcuuucgagugcagcggc

SEQ ID NO: 1074443 - RNA, 21 nt, Mycobacterium bovis subsp bovis AF2122/97
ccgcggccaccaccgccgccg

SEQ ID NO: 1074444 - RNA, 23 nt, Mycobacterium bovis subsp bovis AF2122/97
ccgcggccaccaccgccgccggc

SEQ ID NO: 1074445 - RNA, 14 nt, Mycobacterium bovis subsp bovis AF2122/97
ccgcggccacaacc

SEQ ID NO: 1074446 - RNA, 21 nt, Mycobacterium bovis subsp bovis AF2122/97
ccgcggccacaucgccagcag

SEQ ID NO: 1074447 - RNA, 12 nt, Mycobacterium bovis subsp bovis AF2122/97
ccgcggccaccg

SEQ ID NO: 1074448 - RNA, 13 nt, Mycobacterium bovis subsp bovis AF2122/97
ccgcggccaccgc

SEQ ID NO: 1074449 - RNA, 15 nt, Mycobacterium bovis subsp bovis AF2122/97
ccgcggccaccgccg

SEQ ID NO: 1074450 - RNA, 16 nt, Mycobacterium bovis subsp bovis AF2122/97
ccgcggccaccgccgc

SEQ ID NO: 1074451 - RNA, 18 nt, Mycobacterium bovis subsp bovis AF2122/97
ccgcggccaccgccgccg

SEQ ID NO: 1074452 - RNA, 18 nt, Mycobacterium bovis subsp bovis AF2122/97
ccgcggauuccagcgcgu

SEQ ID NO: 1074453 - RNA, 22 nt, Mycobacterium bovis subsp bovis AF2122/97
ccgcggcaacaccaccucgacg

SEQ ID NO: 1074454 - RNA, 12 nt, Mycobacterium bovis subsp bovis AF2122/97
ccgcggcaacgc

SEQ ID NO: 1074455 - RNA, 17 nt, Mycobacterium bovis subsp bovis AF2122/97
ccgcggcaacgcggucu

SEQ ID NO: 1074456 - RNA, 21 nt, Mycobacterium bovis subsp bovis AF2122/97
ccgcggaugcucaggucaccg

SEQ ID NO: 1074457 - RNA, 14 nt, Mycobacterium bovis subsp bovis AF2122/97
ccgcggcaccgccg

SEQ ID NO: 1074458 - RNA, 22 nt, Mycobacterium bovis subsp bovis AF2122/97
ccgcggcaccuuguagcgggca

SEQ ID NO: 1074459 - RNA, 10 nt, Mycobacterium bovis subsp bovis AF2122/97
ccgcggcacg

SEQ ID NO: 1074460 - RNA, 22 nt, Mycobacterium bovis subsp bovis AF2122/97
ccgcggcaugcaaugcuggcgg

SEQ ID NO: 1074461 - RNA, 15 nt, Mycobacterium bovis subsp bovis AF2122/97
ccgcggaucgaccgc

SEQ ID NO: 1074462 - RNA, 21 nt, Mycobacterium bovis subsp bovis AF2122/97
ccgcggaucgacuucgacgac

SEQ ID NO: 1074463 - RNA, 13 nt, Mycobacterium bovis subsp bovis AF2122/97
ccgcggaucgacc

SEQ ID NO: 1074464 - RNA, 19 nt, Mycobacterium bovis subsp bovis AF2122/97
ccgcggaucaccaucgccg

SEQ ID NO: 1074465 - RNA, 20 nt, Mycobacterium bovis subsp bovis AF2122/97
ccgcggaucaccaucgccgc

SEQ ID NO: 1074466 - RNA, 18 nt, Mycobacterium bovis subsp bovis AF2122/97
ccgcggacuuggcggucg

SEQ ID NO: 1074467 - RNA, 21 nt, Mycobacterium bovis subsp bovis AF2122/97
ccgcggagaaggcgcgggcga

SEQ ID NO: 1074468 - RNA, 13 nt, Mycobacterium bovis subsp bovis AF2122/97
ccgcggagcgcau

SEQ ID NO: 1074469 - RNA, 15 nt, Mycobacterium bovis subsp bovis AF2122/97
ccgcggaggcggcca

SEQ ID NO: 1074470 - RNA, 18 nt, Mycobacterium bovis subsp bovis AF2122/97
ccgcggauaggccgcgcg

SEQ ID NO: 1074471 - RNA, 20 nt, Mycobacterium bovis subsp bovis AF2122/97
ccgcggauaggccgcgcggc

SEQ ID NO: 1074472 - RNA, 16 nt, Mycobacterium bovis subsp bovis AF2122/97
ccgcggacugguauuc

SEQ ID NO: 1074473 - RNA, 15 nt, Mycobacterium bovis subsp bovis AF2122/97
ccgcggacguggucg

SEQ ID NO: 1074474 - RNA, 15 nt, Mycobacterium bovis subsp bovis AF2122/97
ccgcggaccgcaacg

SEQ ID NO: 1074475 - RNA, 15 nt, Mycobacterium bovis subsp bovis AF2122/97
ccgccucgaccgcca

SEQ ID NO: 1074476 - RNA, 16 nt, Mycobacterium bovis subsp bovis AF2122/97
ccgccucgaccgccag

SEQ ID NO: 1074477 - RNA, 21 nt, Mycobacterium bovis subsp bovis AF2122/97
ccgccucgcggaugagcucgg

SEQ ID NO: 1074478 - RNA, 12 nt, Mycobacterium bovis subsp bovis AF2122/97
ccgccucgggug

SEQ ID NO: 1074479 - RNA, 18 nt, Mycobacterium bovis subsp bovis AF2122/97
ccgccucguacggaccgu

SEQ ID NO: 1074480 - RNA, 22 nt, Mycobacterium bovis subsp bovis AF2122/97
ccgccucguacggaccgucgcc

SEQ ID NO: 1074481 - RNA, 13 nt, Mycobacterium bovis subsp bovis AF2122/97
ccgccugcaccgc

SEQ ID NO: 1074482 - RNA, 16 nt, Mycobacterium bovis subsp bovis AF2122/97
ccgccugcaccgccgc

SEQ ID NO: 1074483 - RNA, 14 nt, Mycobacterium bovis subsp bovis AF2122/97
ccgccugcgccgcc

SEQ ID NO: 1074484 - RNA, 19 nt, Mycobacterium bovis subsp bovis AF2122/97
ccgccugcgccgccagcgc

SEQ ID NO: 1074485 - RNA, 20 nt, Mycobacterium bovis subsp bovis AF2122/97
ccgccugcgccgccagcgcc

SEQ ID NO: 1074486 - RNA, 21 nt, Mycobacterium bovis subsp bovis AF2122/97
ccgccugcgccgccagcgccg

SEQ ID NO: 1074487 - RNA, 22 nt, Mycobacterium bovis subsp bovis AF2122/97
ccgccugcgccgccagcgccgc

SEQ ID NO: 1074488 - RNA, 15 nt, Mycobacterium bovis subsp bovis AF2122/97
ccgccugcgccgccc

SEQ ID NO: 1074489 - RNA, 17 nt, Mycobacterium bovis subsp bovis AF2122/97
ccgccugcgccgcccgc

SEQ ID NO: 1074490 - RNA, 17 nt, Mycobacterium bovis subsp bovis AF2122/97
ccgccugccccacccgc

SEQ ID NO: 1074491 - RNA, 23 nt, Mycobacterium bovis subsp bovis AF2122/97
ccgccugacgguaaaugucgaac

SEQ ID NO: 1074492 - RNA, 22 nt, Mycobacterium bovis subsp bovis AF2122/97
ccgccugccccacccgcggcgc

SEQ ID NO: 1074493 - RNA, 20 nt, Mycobacterium bovis subsp bovis AF2122/97
ccgcgaauacgaggacgacg

SEQ ID NO: 1074494 - RNA, 21 nt, Mycobacterium bovis subsp bovis AF2122/97
ccgcgaaugaagcccucgucg

SEQ ID NO: 1074495 - RNA, 23 nt, Mycobacterium bovis subsp bovis AF2122/97
ccgcgaaucaacaggaccgggau

SEQ ID NO: 1074496 - RNA, 20 nt, Mycobacterium bovis subsp bovis AF2122/97
ccgcgaaugucgccgccugg

SEQ ID NO: 1074497 - RNA, 18 nt, Mycobacterium bovis subsp bovis AF2122/97
ccgcgaaugugaucaccc

SEQ ID NO: 1074498 - RNA, 19 nt, Mycobacterium bovis subsp bovis AF2122/97
ccgcgaaugugaucacccg

SEQ ID NO: 1074499 - RNA, 17 nt, Mycobacterium bovis subsp bovis AF2122/97
ccgcgaccacgcaccgc

SEQ ID NO: 1074500 - RNA, 19 nt, Mycobacterium bovis subsp bovis AF2122/97
ccgcgaccacgcaccgccc

SEQ ID NO: 1074501 - RNA, 21 nt, Mycobacterium bovis subsp bovis AF2122/97
ccgcgaccacgcaccgccccg

SEQ ID NO: 1074502 - RNA, 18 nt, Mycobacterium bovis subsp bovis AF2122/97
ccgcgacauccgcggcau

SEQ ID NO: 1074503 - RNA, 13 nt, Mycobacterium bovis subsp bovis AF2122/97
ccgcgaccaucgc

SEQ ID NO: 1074504 - RNA, 18 nt, Mycobacterium bovis subsp bovis AF2122/97
ccgcgaccaaaccgcugu

SEQ ID NO: 1074505 - RNA, 13 nt, Mycobacterium bovis subsp bovis AF2122/97
ccgcgaccagcgc

SEQ ID NO: 1074506 - RNA, 14 nt, Mycobacterium bovis subsp bovis AF2122/97
ccgcgaccagcgcc

SEQ ID NO: 1074507 - RNA, 16 nt, Mycobacterium bovis subsp bovis AF2122/97
ccgcgaccccugguag

SEQ ID NO: 1074508 - RNA, 14 nt, Mycobacterium bovis subsp bovis AF2122/97
ccgcgaccucgcgg

SEQ ID NO: 1074509 - RNA, 16 nt, Mycobacterium bovis subsp bovis AF2122/97
ccgcgaccucgcggcg

SEQ ID NO: 1074510 - RNA, 16 nt, Mycobacterium bovis subsp bovis AF2122/97
ccgcgaccggcguaac

SEQ ID NO: 1074511 - RNA, 23 nt, Mycobacterium bovis subsp bovis AF2122/97
ccgcgacgaugccucggcggccu

SEQ ID NO: 1074512 - RNA, 14 nt, Mycobacterium bovis subsp bovis AF2122/97
ccgcgacggcaggc

SEQ ID NO: 1074513 - RNA, 18 nt, Mycobacterium bovis subsp bovis AF2122/97
ccgcgacggcaggcucgg

SEQ ID NO: 1074514 - RNA, 15 nt, Mycobacterium bovis subsp bovis AF2122/97
ccgcgacggcgcccu

SEQ ID NO: 1074515 - RNA, 14 nt, Mycobacterium bovis subsp bovis AF2122/97
ccgcgacggcgccg

SEQ ID NO: 1074516 - RNA, 13 nt, Mycobacterium bovis subsp bovis AF2122/97
ccgcgacggcggc

SEQ ID NO: 1074517 - RNA, 21 nt, Mycobacterium bovis subsp bovis AF2122/97
ccgcgacguugaacucgaguu

SEQ ID NO: 1074518 - RNA, 21 nt, Mycobacterium bovis subsp bovis AF2122/97
ccgcgacggccuuggcgacgu

SEQ ID NO: 1074519 - RNA, 22 nt, Mycobacterium bovis subsp bovis AF2122/97
ccgcgaccgcauugagcuggcg

SEQ ID NO: 1074520 - RNA, 15 nt, Mycobacterium bovis subsp bovis AF2122/97
ccgcgacgcggcguc

SEQ ID NO: 1074521 - RNA, 13 nt, Mycobacterium bovis subsp bovis AF2122/97
ccgcgacgcucgc

SEQ ID NO: 1074522 - RNA, 18 nt, Mycobacterium bovis subsp bovis AF2122/97
ccgcgacgcucgcugcag

SEQ ID NO: 1074523 - RNA, 20 nt, Mycobacterium bovis subsp bovis AF2122/97
ccgcgaucgugcagguugcc

SEQ ID NO: 1074524 - RNA, 20 nt, Mycobacterium bovis subsp bovis AF2122/97
ccgcgaucggugcgggcgcc

SEQ ID NO: 1074525 - RNA, 22 nt, Mycobacterium bovis subsp bovis AF2122/97
ccgcgaucggugcgggcgccgc

SEQ ID NO: 1074526 - RNA, 21 nt, Mycobacterium bovis subsp bovis AF2122/97
ccgcgacgggcacccgagccg

SEQ ID NO: 1074527 - RNA, 19 nt, Mycobacterium bovis subsp bovis AF2122/97
ccgcgagcccggccucggc

SEQ ID NO: 1074528 - RNA, 16 nt, Mycobacterium bovis subsp bovis AF2122/97
ccgcgagauagcacca

SEQ ID NO: 1074529 - RNA, 15 nt, Mycobacterium bovis subsp bovis AF2122/97
ccgcgagaucgggcc

SEQ ID NO: 1074530 - RNA, 22 nt, Mycobacterium bovis subsp bovis AF2122/97
ccgcgacuuccuguacaaccug

SEQ ID NO: 1074531 - RNA, 13 nt, Mycobacterium bovis subsp bovis AF2122/97
ccgcgccgcccgc

SEQ ID NO: 1074532 - RNA, 14 nt, Mycobacterium bovis subsp bovis AF2122/97
ccgcgccgccccgc

SEQ ID NO: 1074533 - RNA, 15 nt, Mycobacterium bovis subsp bovis AF2122/97
ccgcgccgcgccgcc

SEQ ID NO: 1074534 - RNA, 20 nt, Mycobacterium bovis subsp bovis AF2122/97
ccgcgccgccgccaccaccc

SEQ ID NO: 1074535 - RNA, 17 nt, Mycobacterium bovis subsp bovis AF2122/97
ccgcgccgccucgggca

SEQ ID NO: 1074536 - RNA, 14 nt, Mycobacterium bovis subsp bovis AF2122/97
ccgcgccggcacgg

SEQ ID NO: 1074537 - RNA, 17 nt, Mycobacterium bovis subsp bovis AF2122/97
ccgcgccggcacgggcg

SEQ ID NO: 1074538 - RNA, 18 nt, Mycobacterium bovis subsp bovis AF2122/97
ccgcgccgcgccgcgccg

SEQ ID NO: 1074539 - RNA, 17 nt, Mycobacterium bovis subsp bovis AF2122/97
ccgcgccgcggcccgcu

SEQ ID NO: 1074540 - RNA, 18 nt, Mycobacterium bovis subsp bovis AF2122/97
ccgcgccgcggcccgcuc

SEQ ID NO: 1074541 - RNA, 23 nt, Mycobacterium bovis subsp bovis AF2122/97
ccgcgccggcggaagcggcggcc

SEQ ID NO: 1074542 - RNA, 14 nt, Mycobacterium bovis subsp bovis AF2122/97
ccgcgccggcggca

SEQ ID NO: 1074543 - RNA, 12 nt, Mycobacterium bovis subsp bovis AF2122/97
ccgcgccggccg

SEQ ID NO: 1074544 - RNA, 13 nt, Mycobacterium bovis subsp bovis AF2122/97
ccgcgccggccgc

SEQ ID NO: 1074545 - RNA, 14 nt, Mycobacterium bovis subsp bovis AF2122/97
ccgcgccggccgca

SEQ ID NO: 1074546 - RNA, 16 nt, Mycobacterium bovis subsp bovis AF2122/97
ccgcgccggccgcugc

SEQ ID NO: 1074547 - RNA, 14 nt, Mycobacterium bovis subsp bovis AF2122/97
ccgcgccggcgggc

SEQ ID NO: 1074548 - RNA, 15 nt, Mycobacterium bovis subsp bovis AF2122/97
ccgcgccggcggcca

SEQ ID NO: 1074549 - RNA, 11 nt, Mycobacterium bovis subsp bovis AF2122/97
ccgcgccgggu

SEQ ID NO: 1074550 - RNA, 15 nt, Mycobacterium bovis subsp bovis AF2122/97
ccgcgccggguccgc

SEQ ID NO: 1074551 - RNA, 17 nt, Mycobacterium bovis subsp bovis AF2122/97
ccgcgccggcguugccg

SEQ ID NO: 1074552 - RNA, 12 nt, Mycobacterium bovis subsp bovis AF2122/97
ccgcgccguucc

SEQ ID NO: 1074553 - RNA, 19 nt, Mycobacterium bovis subsp bovis AF2122/97
ccgcgccgucgucgcgcag

SEQ ID NO: 1074554 - RNA, 12 nt, Mycobacterium bovis subsp bovis AF2122/97
ccgcgccgucgu

SEQ ID NO: 1074555 - RNA, 14 nt, Mycobacterium bovis subsp bovis AF2122/97
ccgcgcgcaagcca

SEQ ID NO: 1074556 - RNA, 19 nt, Mycobacterium bovis subsp bovis AF2122/97
ccgcgcgaugcuggcgaac

SEQ ID NO: 1074557 - RNA, 23 nt, Mycobacterium bovis subsp bovis AF2122/97
ccgcgcgcauauccgcaggcccg

SEQ ID NO: 1074558 - RNA, 16 nt, Mycobacterium bovis subsp bovis AF2122/97
ccgcgcgccagcucgg

SEQ ID NO: 1074559 - RNA, 14 nt, Mycobacterium bovis subsp bovis AF2122/97
ccgcgccggacagc

SEQ ID NO: 1074560 - RNA, 20 nt, Mycobacterium bovis subsp bovis AF2122/97
ccgcgcgcacuugcguggcg

SEQ ID NO: 1074561 - RNA, 15 nt, Mycobacterium bovis subsp bovis AF2122/97
ccgcgcgccggccau

SEQ ID NO: 1074562 - RNA, 18 nt, Mycobacterium bovis subsp bovis AF2122/97
ccgcgcagcugccgcacc

SEQ ID NO: 1074563 - RNA, 18 nt, Mycobacterium bovis subsp bovis AF2122/97
ccgcgcaggggcggcgug

SEQ ID NO: 1074564 - RNA, 18 nt, Mycobacterium bovis subsp bovis AF2122/97
ccgcgauggugcgccggg

SEQ ID NO: 1074565 - RNA, 19 nt, Mycobacterium bovis subsp bovis AF2122/97
ccgcgauggugcgccgggc

SEQ ID NO: 1074566 - RNA, 18 nt, Mycobacterium bovis subsp bovis AF2122/97
ccgcgcaucaucgcccac

SEQ ID NO: 1074567 - RNA, 19 nt, Mycobacterium bovis subsp bovis AF2122/97
ccgcgaugcgcaccagcgg

SEQ ID NO: 1074568 - RNA, 17 nt, Mycobacterium bovis subsp bovis AF2122/97
ccgcgauggccgcgugc

SEQ ID NO: 1074569 - RNA, 22 nt, Mycobacterium bovis subsp bovis AF2122/97
ccgcgaugacggugccgaccgc

SEQ ID NO: 1074570 - RNA, 18 nt, Mycobacterium bovis subsp bovis AF2122/97
ccgcgaugauggcgguac

SEQ ID NO: 1074571 - RNA, 23 nt, Mycobacterium bovis subsp bovis AF2122/97
ccgcgauggcguagcccaugccg

SEQ ID NO: 1074572 - RNA, 23 nt, Mycobacterium bovis subsp bovis AF2122/97
ccgcgaugaucgcaucgacgugc

SEQ ID NO: 1074573 - RNA, 21 nt, Mycobacterium bovis subsp bovis AF2122/97
ccgcgaugauaccugcccacg

SEQ ID NO: 1074574 - RNA, 18 nt, Mycobacterium bovis subsp bovis AF2122/97
ccgcgaucugcagcgcgg

SEQ ID NO: 1074575 - RNA, 21 nt, Mycobacterium bovis subsp bovis AF2122/97
ccgcgaugacggugccgaccg

SEQ ID NO: 1074576 - RNA, 14 nt, Mycobacterium bovis subsp bovis AF2122/97
ccgcgaugacgacc

SEQ ID NO: 1074577 - RNA, 23 nt, Mycobacterium bovis subsp bovis AF2122/97
ccgcgccaacagaugccacccag

SEQ ID NO: 1074578 - RNA, 14 nt, Mycobacterium bovis subsp bovis AF2122/97
ccgcgcccaccccg

SEQ ID NO: 1074579 - RNA, 19 nt, Mycobacterium bovis subsp bovis AF2122/97
ccgcgcccaccccggccgc

SEQ ID NO: 1074580 - RNA, 18 nt, Mycobacterium bovis subsp bovis AF2122/97
ccgcgcccaccagcggcg

SEQ ID NO: 1074581 - RNA, 20 nt, Mycobacterium bovis subsp bovis AF2122/97
ccgcgcccaccagcggcggc

SEQ ID NO: 1074582 - RNA, 21 nt, Mycobacterium bovis subsp bovis AF2122/97
ccgcgcccaccagcggcggca

SEQ ID NO: 1074583 - RNA, 14 nt, Mycobacterium bovis subsp bovis AF2122/97
ccgcgcccgagccg

SEQ ID NO: 1074584 - RNA, 12 nt, Mycobacterium bovis subsp bovis AF2122/97
ccgcgcccgacg

SEQ ID NO: 1074585 - RNA, 19 nt, Mycobacterium bovis subsp bovis AF2122/97
ccgcgcccgccucgaccgc

SEQ ID NO: 1074586 - RNA, 12 nt, Mycobacterium bovis subsp bovis AF2122/97
ccgcgcccgccg

SEQ ID NO: 1074587 - RNA, 16 nt, Mycobacterium bovis subsp bovis AF2122/97
ccgcgcccgccgaucc

SEQ ID NO: 1074588 - RNA, 20 nt, Mycobacterium bovis subsp bovis AF2122/97
ccgcgccccaugggggaacc

SEQ ID NO: 1074589 - RNA, 14 nt, Mycobacterium bovis subsp bovis AF2122/97
ccgcgcccggccgg

SEQ ID NO: 1074590 - RNA, 14 nt, Mycobacterium bovis subsp bovis AF2122/97
ccgccgcggccgcc

SEQ ID NO: 1074591 - RNA, 19 nt, Mycobacterium bovis subsp bovis AF2122/97
ccgccgcggccgccguccc

SEQ ID NO: 1074592 - RNA, 12 nt, Mycobacterium bovis subsp bovis AF2122/97
ccgccgcggccg

SEQ ID NO: 1074593 - RNA, 16 nt, Mycobacterium bovis subsp bovis AF2122/97
ccgccgcggccggcgc

SEQ ID NO: 1074594 - RNA, 19 nt, Mycobacterium bovis subsp bovis AF2122/97
ccgccgcggccacaaccuc

SEQ ID NO: 1074595 - RNA, 15 nt, Mycobacterium bovis subsp bovis AF2122/97
ccgccgcgggcgccg

SEQ ID NO: 1074596 - RNA, 24 nt, Mycobacterium bovis subsp bovis AF2122/97
ccgccgcgucauucaccgcguuga

SEQ ID NO: 1074597 - RNA, 13 nt, Mycobacterium bovis subsp bovis AF2122/97
ccgccgcggucgg

SEQ ID NO: 1074598 - RNA, 13 nt, Mycobacterium bovis subsp bovis AF2122/97
ccgccgcguuucg

SEQ ID NO: 1074599 - RNA, 14 nt, Mycobacterium bovis subsp bovis AF2122/97
ccgccgcuacccca

SEQ ID NO: 1074600 - RNA, 17 nt, Mycobacterium bovis subsp bovis AF2122/97
ccgccgcuaccgcccgc

SEQ ID NO: 1074601 - RNA, 22 nt, Mycobacterium bovis subsp bovis AF2122/97
ccgcccggcuaggagaucagca

SEQ ID NO: 1074602 - RNA, 14 nt, Mycobacterium bovis subsp bovis AF2122/97
ccgcccggcgagca

SEQ ID NO: 1074603 - RNA, 14 nt, Mycobacterium bovis subsp bovis AF2122/97
ccgccgcggcaggg

SEQ ID NO: 1074604 - RNA, 16 nt, Mycobacterium bovis subsp bovis AF2122/97
ccgccgcggcagggcg

SEQ ID NO: 1074605 - RNA, 14 nt, Mycobacterium bovis subsp bovis AF2122/97
ccgccgcggccaca

SEQ ID NO: 1074606 - RNA, 12 nt, Mycobacterium bovis subsp bovis AF2122/97
ccgcccggcccg

SEQ ID NO: 1074607 - RNA, 15 nt, Mycobacterium bovis subsp bovis AF2122/97
ccgcccggcccggcu

SEQ ID NO: 1074608 - RNA, 12 nt, Mycobacterium bovis subsp bovis AF2122/97
ccgcccgagccg

SEQ ID NO: 1074609 - RNA, 12 nt, Mycobacterium bovis subsp bovis AF2122/97
ccgccgcugccg

SEQ ID NO: 1074610 - RNA, 14 nt, Mycobacterium bovis subsp bovis AF2122/97
ccgccgcugccgau

SEQ ID NO: 1074611 - RNA, 15 nt, Mycobacterium bovis subsp bovis AF2122/97
ccgccgcugccgccc

SEQ ID NO: 1074612 - RNA, 21 nt, Mycobacterium bovis subsp bovis AF2122/97
ccgccgcugccgccgagcugg

SEQ ID NO: 1074613 - RNA, 15 nt, Mycobacterium bovis subsp bovis AF2122/97
ccgccgcugccgcgc

SEQ ID NO: 1074614 - RNA, 16 nt, Mycobacterium bovis subsp bovis AF2122/97
ccgccgcugccgcgcg

SEQ ID NO: 1074615 - RNA, 13 nt, Mycobacterium bovis subsp bovis AF2122/97
ccgccgcugccgg

SEQ ID NO: 1074616 - RNA, 16 nt, Mycobacterium bovis subsp bovis AF2122/97
ccgccgcugccggugg

SEQ ID NO: 1074617 - RNA, 18 nt, Mycobacterium bovis subsp bovis AF2122/97
ccgccgcugccgguggcg

SEQ ID NO: 1074618 - RNA, 12 nt, Mycobacterium bovis subsp bovis AF2122/97
ccgccgcugcca

SEQ ID NO: 1074619 - RNA, 21 nt, Mycobacterium bovis subsp bovis AF2122/97
ccgccgcuggucuuucacgua

SEQ ID NO: 1074620 - RNA, 20 nt, Mycobacterium bovis subsp bovis AF2122/97
ccgccggacccgcccuugcc

SEQ ID NO: 1074621 - RNA, 15 nt, Mycobacterium bovis subsp bovis AF2122/97
ccgccggacccgccg

SEQ ID NO: 1074622 - RNA, 16 nt, Mycobacterium bovis subsp bovis AF2122/97
ccgccggacccgccgg

SEQ ID NO: 1074623 - RNA, 18 nt, Mycobacterium bovis subsp bovis AF2122/97
ccgccggacccgccgggu

SEQ ID NO: 1074624 - RNA, 22 nt, Mycobacterium bovis subsp bovis AF2122/97
ccgccggacccgucgagcagca

SEQ ID NO: 1074625 - RNA, 19 nt, Mycobacterium bovis subsp bovis AF2122/97
ccgccggaagcgccggccg

SEQ ID NO: 1074626 - RNA, 16 nt, Mycobacterium bovis subsp bovis AF2122/97
ccgccggauagcaccg

SEQ ID NO: 1074627 - RNA, 20 nt, Mycobacterium bovis subsp bovis AF2122/97
ccgccggauagcaccggcac

SEQ ID NO: 1074628 - RNA, 20 nt, Mycobacterium bovis subsp bovis AF2122/97
ccgccggaucaggaucgaca

SEQ ID NO: 1074629 - RNA, 16 nt, Mycobacterium bovis subsp bovis AF2122/97
ccgccggaucgccacg

SEQ ID NO: 1074630 - RNA, 15 nt, Mycobacterium bovis subsp bovis AF2122/97
ccgccggaccgccgc

SEQ ID NO: 1074631 - RNA, 16 nt, Mycobacterium bovis subsp bovis AF2122/97
ccgccggccgccagcg

SEQ ID NO: 1074632 - RNA, 12 nt, Mycobacterium bovis subsp bovis AF2122/97
ccgccggccgcg

SEQ ID NO: 1074633 - RNA, 15 nt, Mycobacterium bovis subsp bovis AF2122/97
ccgccggccgcgcag

SEQ ID NO: 1074634 - RNA, 14 nt, Mycobacterium bovis subsp bovis AF2122/97
ccgccggccgcgcc

SEQ ID NO: 1074635 - RNA, 15 nt, Mycobacterium bovis subsp bovis AF2122/97
ccgccggccgcgccg

SEQ ID NO: 1074636 - RNA, 19 nt, Mycobacterium bovis subsp bovis AF2122/97
ccgccggccccaccgguac

SEQ ID NO: 1074637 - RNA, 13 nt, Mycobacterium bovis subsp bovis AF2122/97
ccgccggccccgc

SEQ ID NO: 1074638 - RNA, 19 nt, Mycobacterium bovis subsp bovis AF2122/97
ccgccggccccgccgcuac

SEQ ID NO: 1074639 - RNA, 12 nt, Mycobacterium bovis subsp bovis AF2122/97
ccgccggccagu

SEQ ID NO: 1074640 - RNA, 20 nt, Mycobacterium bovis subsp bovis AF2122/97
ccgccggccccgccgucacc

SEQ ID NO: 1074641 - RNA, 22 nt, Mycobacterium bovis subsp bovis AF2122/97
ccgccggccggaacgcccggcu

SEQ ID NO: 1074642 - RNA, 13 nt, Mycobacterium bovis subsp bovis AF2122/97
ccgccggccggca

SEQ ID NO: 1074643 - RNA, 14 nt, Mycobacterium bovis subsp bovis AF2122/97
ccgccggccgucgg

SEQ ID NO: 1074644 - RNA, 12 nt, Mycobacterium bovis subsp bovis AF2122/97
ccgccggccagg

SEQ ID NO: 1074645 - RNA, 15 nt, Mycobacterium bovis subsp bovis AF2122/97
ccgccggccagguga

SEQ ID NO: 1074646 - RNA, 17 nt, Mycobacterium bovis subsp bovis AF2122/97
ccgccggauucgcccgg

SEQ ID NO: 1074647 - RNA, 21 nt, Mycobacterium bovis subsp bovis AF2122/97
ccgccggauucgcccgggcgu

SEQ ID NO: 1074648 - RNA, 12 nt, Mycobacterium bovis subsp bovis AF2122/97
ccgccggcaacc

SEQ ID NO: 1074649 - RNA, 16 nt, Mycobacterium bovis subsp bovis AF2122/97
ccgccggcacccgccg

SEQ ID NO: 1074650 - RNA, 13 nt, Mycobacterium bovis subsp bovis AF2122/97
ccgccggcaccgc

SEQ ID NO: 1074651 - RNA, 23 nt, Mycobacterium bovis subsp bovis AF2122/97
ccgccggcaccgccagugcccgc

SEQ ID NO: 1074652 - RNA, 16 nt, Mycobacterium bovis subsp bovis AF2122/97
ccgccggcaccgccgg

SEQ ID NO: 1074653 - RNA, 19 nt, Mycobacterium bovis subsp bovis AF2122/97
ccgccggcaccgccggugg

SEQ ID NO: 1074654 - RNA, 21 nt, Mycobacterium bovis subsp bovis AF2122/97
ccgccggcaccgccgguggcg

SEQ ID NO: 1074655 - RNA, 22 nt, Mycobacterium bovis subsp bovis AF2122/97
ccgccgucuuggcccgguccgc

SEQ ID NO: 1074656 - RNA, 17 nt, Mycobacterium bovis subsp bovis AF2122/97
ccgccgucguacaccuc

SEQ ID NO: 1074657 - RNA, 22 nt, Mycobacterium bovis subsp bovis AF2122/97
ccgccgucggguugcgacgaac

SEQ ID NO: 1074658 - RNA, 16 nt, Mycobacterium bovis subsp bovis AF2122/97
ccgccgucggcgagca

SEQ ID NO: 1074659 - RNA, 17 nt, Mycobacterium bovis subsp bovis AF2122/97
ccgccgucgccggugcc

SEQ ID NO: 1074660 - RNA, 13 nt, Mycobacterium bovis subsp bovis AF2122/97
ccgccgugccccc

SEQ ID NO: 1074661 - RNA, 15 nt, Mycobacterium bovis subsp bovis AF2122/97
ccgccgugccgcggc

SEQ ID NO: 1074662 - RNA, 16 nt, Mycobacterium bovis subsp bovis AF2122/97
ccgccgugccgcggcg

SEQ ID NO: 1074663 - RNA, 19 nt, Mycobacterium bovis subsp bovis AF2122/97
ccgccguggcgucggcguc

SEQ ID NO: 1074664 - RNA, 19 nt, Mycobacterium bovis subsp bovis AF2122/97
ccgccguggaacacgaagu

SEQ ID NO: 1074665 - RNA, 22 nt, Mycobacterium bovis subsp bovis AF2122/97
ccgccguuaccgccgcugccga

SEQ ID NO: 1074666 - RNA, 20 nt, Mycobacterium bovis subsp bovis AF2122/97
ccgccguuaccgccguugcc

SEQ ID NO: 1074667 - RNA, 21 nt, Mycobacterium bovis subsp bovis AF2122/97
ccgccguuaccgccguugccg

SEQ ID NO: 1074668 - RNA, 22 nt, Mycobacterium bovis subsp bovis AF2122/97
ccgccguuaccgccguugccga

SEQ ID NO: 1074669 - RNA, 18 nt, Mycobacterium bovis subsp bovis AF2122/97
ccgccguuacggagggca

SEQ ID NO: 1074670 - RNA, 19 nt, Mycobacterium bovis subsp bovis AF2122/97
ccgccguucccaccaccac

SEQ ID NO: 1074671 - RNA, 21 nt, Mycobacterium bovis subsp bovis AF2122/97
ccgccguucccaccaccaccg

SEQ ID NO: 1074672 - RNA, 24 nt, Mycobacterium bovis subsp bovis AF2122/97
ccgccguucccaccaccaccgccg

SEQ ID NO: 1074673 - RNA, 15 nt, Mycobacterium bovis subsp bovis AF2122/97
ccgccguucccgccg

SEQ ID NO: 1074674 - RNA, 16 nt, Mycobacterium bovis subsp bovis AF2122/97
ccgccguucccgccgg

SEQ ID NO: 1074675 - RNA, 18 nt, Mycobacterium bovis subsp bovis AF2122/97
ccgccuccgccgaggccg

SEQ ID NO: 1074676 - RNA, 20 nt, Mycobacterium bovis subsp bovis AF2122/97
ccgccuccgccgaggccgcc

SEQ ID NO: 1074677 - RNA, 21 nt, Mycobacterium bovis subsp bovis AF2122/97
ccgccuccgccgaggccgccg

SEQ ID NO: 1074678 - RNA, 12 nt, Mycobacterium bovis subsp bovis AF2122/97
ccgccuccgcgg

SEQ ID NO: 1074679 - RNA, 19 nt, Mycobacterium bovis subsp bovis AF2122/97
ccgccguugggccgcgccc

SEQ ID NO: 1074680 - RNA, 15 nt, Mycobacterium bovis subsp bovis AF2122/97
ccgccguugucgacc

SEQ ID NO: 1074681 - RNA, 19 nt, Mycobacterium bovis subsp bovis AF2122/97
ccgccgguggccgcgcugg

SEQ ID NO: 1074682 - RNA, 22 nt, Mycobacterium bovis subsp bovis AF2122/97
ccgccgguggccgcgcugguca

SEQ ID NO: 1074683 - RNA, 15 nt, Mycobacterium bovis subsp bovis AF2122/97
ccgccgguggcgccg

SEQ ID NO: 1074684 - RNA, 23 nt, Mycobacterium bovis subsp bovis AF2122/97
ccgccgguggcgccggggccgcc

SEQ ID NO: 1074685 - RNA, 20 nt, Mycobacterium bovis subsp bovis AF2122/97
ccgccggugccgaucagcag

SEQ ID NO: 1074686 - RNA, 17 nt, Mycobacterium bovis subsp bovis AF2122/97
ccgccggugccgaugac

SEQ ID NO: 1074687 - RNA, 13 nt, Mycobacterium bovis subsp bovis AF2122/97
ccgccggugccgc

SEQ ID NO: 1074688 - RNA, 17 nt, Mycobacterium bovis subsp bovis AF2122/97
ccgccggucccgcgugc

SEQ ID NO: 1074689 - RNA, 16 nt, Mycobacterium bovis subsp bovis AF2122/97
ccgccggugaucggcg

SEQ ID NO: 1074690 - RNA, 18 nt, Mycobacterium bovis subsp bovis AF2122/97
ccgccggugaucggcggc

SEQ ID NO: 1074691 - RNA, 12 nt, Mycobacterium bovis subsp bovis AF2122/97
ccgccggugccg

SEQ ID NO: 1074692 - RNA, 21 nt, Mycobacterium bovis subsp bovis AF2122/97
ccgccggugccacccuugccg

SEQ ID NO: 1074693 - RNA, 16 nt, Mycobacterium bovis subsp bovis AF2122/97
ccgccggugccaccga

SEQ ID NO: 1074694 - RNA, 17 nt, Mycobacterium bovis subsp bovis AF2122/97
ccgccggugccaccgac

SEQ ID NO: 1074695 - RNA, 18 nt, Mycobacterium bovis subsp bovis AF2122/97
ccgccggugccaccgacg

SEQ ID NO: 1074696 - RNA, 22 nt, Mycobacterium bovis subsp bovis AF2122/97
ccgccgucgccgccggcgccgc

SEQ ID NO: 1074697 - RNA, 13 nt, Mycobacterium bovis subsp bovis AF2122/97
ccgccgucgccgg

SEQ ID NO: 1074698 - RNA, 17 nt, Mycobacterium bovis subsp bovis AF2122/97
ccgccggugccgccgcc

SEQ ID NO: 1074699 - RNA, 21 nt, Mycobacterium bovis subsp bovis AF2122/97
ccgccggugccgccggugccg

SEQ ID NO: 1074700 - RNA, 21 nt, Mycobacterium bovis subsp bovis AF2122/97
ccgccggugccgccgucgccg

SEQ ID NO: 1074701 - RNA, 17 nt, Mycobacterium bovis subsp bovis AF2122/97
ccgccgucgccacgccc

SEQ ID NO: 1074702 - RNA, 14 nt, Mycobacterium bovis subsp bovis AF2122/97
ccgccgucgccgcc

SEQ ID NO: 1074703 - RNA, 18 nt, Mycobacterium bovis subsp bovis AF2122/97
ccgccgucgccgccaaag

SEQ ID NO: 1074704 - RNA, 16 nt, Mycobacterium bovis subsp bovis AF2122/97
ccgccgucgccgccgc

SEQ ID NO: 1074705 - RNA, 22 nt, Mycobacterium bovis subsp bovis AF2122/97
ccgccggugccgccauugacgc

SEQ ID NO: 1074706 - RNA, 15 nt, Mycobacterium bovis subsp bovis AF2122/97
ccgccggugccgccg

SEQ ID NO: 1074707 - RNA, 23 nt, Mycobacterium bovis subsp bovis AF2122/97
ccgccgucgccaccaucguugcc

SEQ ID NO: 1074708 - RNA, 19 nt, Mycobacterium bovis subsp bovis AF2122/97
ccgccgucgccaccgguac

SEQ ID NO: 1074709 - RNA, 15 nt, Mycobacterium bovis subsp bovis AF2122/97
ccgccgucgccacca

SEQ ID NO: 1074710 - RNA, 13 nt, Mycobacterium bovis subsp bovis AF2122/97
ccgccggcgccac

SEQ ID NO: 1074711 - RNA, 15 nt, Mycobacterium bovis subsp bovis AF2122/97
ccgccggcgccaccc

SEQ ID NO: 1074712 - RNA, 16 nt, Mycobacterium bovis subsp bovis AF2122/97
ccgccggcgccaccgu

SEQ ID NO: 1074713 - RNA, 15 nt, Mycobacterium bovis subsp bovis AF2122/97
ccgccggcgccagcg

SEQ ID NO: 1074714 - RNA, 16 nt, Mycobacterium bovis subsp bovis AF2122/97
ccgccggcgccagcgc

SEQ ID NO: 1074715 - RNA, 14 nt, Mycobacterium bovis subsp bovis AF2122/97
ccgccggcgacugc

SEQ ID NO: 1074716 - RNA, 16 nt, Mycobacterium bovis subsp bovis AF2122/97
ccgccggcgacugcag

SEQ ID NO: 1074717 - RNA, 12 nt, Mycobacterium bovis subsp bovis AF2122/97
ccgccggcgccg

SEQ ID NO: 1074718 - RNA, 13 nt, Mycobacterium bovis subsp bovis AF2122/97
ccgccggcgccgc

SEQ ID NO: 1074719 - RNA, 15 nt, Mycobacterium bovis subsp bovis AF2122/97
ccgccggcgccgccg

SEQ ID NO: 1074720 - RNA, 20 nt, Mycobacterium bovis subsp bovis AF2122/97
ccgccgggggcaccguuacc

SEQ ID NO: 1074721 - RNA, 15 nt, Mycobacterium bovis subsp bovis AF2122/97
aaaugauagcggcgc

SEQ ID NO: 1074722 - RNA, 15 nt, Mycobacterium bovis subsp bovis AF2122/97
ccgguuuccgucuga

SEQ ID NO: 1074723 - RNA, 19 nt, Mycobacterium bovis subsp bovis AF2122/97
ccgguuucuucggccagcu

SEQ ID NO: 1074724 - RNA, 20 nt, Mycobacterium bovis subsp bovis AF2122/97
ccguaacagccggccggauc

SEQ ID NO: 1074725 - RNA, 20 nt, Mycobacterium bovis subsp bovis AF2122/97
ccguaaacagcgcgccggcg

SEQ ID NO: 1074726 - RNA, 21 nt, Mycobacterium bovis subsp bovis AF2122/97
ccguaaaccgauaucgcugcg

SEQ ID NO: 1074727 - RNA, 20 nt, Mycobacterium bovis subsp bovis AF2122/97
ccguaaagccaacuggucgc

SEQ ID NO: 1074728 - RNA, 19 nt, Mycobacterium bovis subsp bovis AF2122/97
ccguaacgccaagcucggc

SEQ ID NO: 1074729 - RNA, 20 nt, Mycobacterium bovis subsp bovis AF2122/97
ccguaacgcggaucgggcac

SEQ ID NO: 1074730 - RNA, 16 nt, Mycobacterium bovis subsp bovis AF2122/97
ccguaagcaccagcca

SEQ ID NO: 1074731 - RNA, 22 nt, Mycobacterium bovis subsp bovis AF2122/97
ccguaagcggauguccccgacg

SEQ ID NO: 1074732 - RNA, 18 nt, Mycobacterium bovis subsp bovis AF2122/97
ccgguucccgggcagccg

SEQ ID NO: 1074733 - RNA, 22 nt, Mycobacterium bovis subsp bovis AF2122/97
ccgguucccuuguucccgaaac

SEQ ID NO: 1074734 - RNA, 14 nt, Mycobacterium bovis subsp bovis AF2122/97
ccgguuccgccggc

SEQ ID NO: 1074735 - RNA, 21 nt, Mycobacterium bovis subsp bovis AF2122/97
ccgguuccggcgaucaacgcg

SEQ ID NO: 1074736 - RNA, 20 nt, Mycobacterium bovis subsp bovis AF2122/97
ccgguugucgcagcgcacac

SEQ ID NO: 1074737 - RNA, 14 nt, Mycobacterium bovis subsp bovis AF2122/97
ccgguugggguggc

SEQ ID NO: 1074738 - RNA, 16 nt, Mycobacterium bovis subsp bovis AF2122/97
ccgguugggguggcgg

SEQ ID NO: 1074739 - RNA, 22 nt, Mycobacterium bovis subsp bovis AF2122/97
ccgguucgauggcaucggccau

SEQ ID NO: 1074740 - RNA, 23 nt, Mycobacterium bovis subsp bovis AF2122/97
ccgguucgauggcaucggccauc

SEQ ID NO: 1074741 - RNA, 21 nt, Mycobacterium bovis subsp bovis AF2122/97
ccggugguuucacuacggguc

SEQ ID NO: 1074742 - RNA, 14 nt, Mycobacterium bovis subsp bovis AF2122/97
ccgguggugcugcc

SEQ ID NO: 1074743 - RNA, 20 nt, Mycobacterium bovis subsp bovis AF2122/97
ccgguguagcagcgccagca

SEQ ID NO: 1074744 - RNA, 19 nt, Mycobacterium bovis subsp bovis AF2122/97
ccgguguugccgccggugc

SEQ ID NO: 1074745 - RNA, 24 nt, Mycobacterium bovis subsp bovis AF2122/97
ccgguuaauggaaugaucggcguc

SEQ ID NO: 1074746 - RNA, 13 nt, Mycobacterium bovis subsp bovis AF2122/97
ccgguucaccaug

SEQ ID NO: 1074747 - RNA, 23 nt, Mycobacterium bovis subsp bovis AF2122/97
ccgguuauggcauucgauaccgc

SEQ ID NO: 1074748 - RNA, 18 nt, Mycobacterium bovis subsp bovis AF2122/97
ccgguucagggguggcgc

SEQ ID NO: 1074749 - RNA, 22 nt, Mycobacterium bovis subsp bovis AF2122/97
ccgguguugccguuaccgccaa

SEQ ID NO: 1074750 - RNA, 23 nt, Mycobacterium bovis subsp bovis AF2122/97
ccgguggcggcggcggcaacggc

SEQ ID NO: 1074751 - RNA, 22 nt, Mycobacterium bovis subsp bovis AF2122/97
ccgguggcggcucacgaccggc

SEQ ID NO: 1074752 - RNA, 16 nt, Mycobacterium bovis subsp bovis AF2122/97
ccgguggccaucgcgc

SEQ ID NO: 1074753 - RNA, 20 nt, Mycobacterium bovis subsp bovis AF2122/97
ccgguggcccgccggcagug

SEQ ID NO: 1074754 - RNA, 20 nt, Mycobacterium bovis subsp bovis AF2122/97
ccgguggcgccggggccgcc

SEQ ID NO: 1074755 - RNA, 22 nt, Mycobacterium bovis subsp bovis AF2122/97
ccgguggcagggaaccauugcc

SEQ ID NO: 1074756 - RNA, 18 nt, Mycobacterium bovis subsp bovis AF2122/97
ccgguggccaacaccgcc

SEQ ID NO: 1074757 - RNA, 19 nt, Mycobacterium bovis subsp bovis AF2122/97
ccgguggccaacaccgcca

SEQ ID NO: 1074758 - RNA, 16 nt, Mycobacterium bovis subsp bovis AF2122/97
ccgguggccagcacgu

SEQ ID NO: 1074759 - RNA, 19 nt, Mycobacterium bovis subsp bovis AF2122/97
ccggugggcggcucgucga

SEQ ID NO: 1074760 - RNA, 16 nt, Mycobacterium bovis subsp bovis AF2122/97
ccgguggcuggccgcc

SEQ ID NO: 1074761 - RNA, 17 nt, Mycobacterium bovis subsp bovis AF2122/97
ccgguggcuggccgcca

SEQ ID NO: 1074762 - RNA, 22 nt, Mycobacterium bovis subsp bovis AF2122/97
ccgguggcguggucucggucag

SEQ ID NO: 1074763 - RNA, 13 nt, Mycobacterium bovis subsp bovis AF2122/97
ccgguggcguuug

SEQ ID NO: 1074764 - RNA, 21 nt, Mycobacterium bovis subsp bovis AF2122/97
ccgguggcugaucaccguugc

SEQ ID NO: 1074765 - RNA, 21 nt, Mycobacterium bovis subsp bovis AF2122/97
ccggugggguugcgcgguagc

SEQ ID NO: 1074766 - RNA, 22 nt, Mycobacterium bovis subsp bovis AF2122/97
ccggugggucugcucagcgcgg

SEQ ID NO: 1074767 - RNA, 19 nt, Mycobacterium bovis subsp bovis AF2122/97
ccggugguaacggcggcca

SEQ ID NO: 1074768 - RNA, 23 nt, Mycobacterium bovis subsp bovis AF2122/97
ccggugguaacggcggccauggc

SEQ ID NO: 1074769 - RNA, 17 nt, Mycobacterium bovis subsp bovis AF2122/97
ccggugguagcggcggu

SEQ ID NO: 1074770 - RNA, 21 nt, Mycobacterium bovis subsp bovis AF2122/97
ccggugguagcggcgguuucg

SEQ ID NO: 1074771 - RNA, 17 nt, Mycobacterium bovis subsp bovis AF2122/97
ccgguggucaggaacac

SEQ ID NO: 1074772 - RNA, 20 nt, Mycobacterium bovis subsp bovis AF2122/97
ccgguggugacggcgguacc

SEQ ID NO: 1074773 - RNA, 23 nt, Mycobacterium bovis subsp bovis AF2122/97
ccgguggugacggcgguaccgcc

SEQ ID NO: 1074774 - RNA, 13 nt, Mycobacterium bovis subsp bovis AF2122/97
ccggugccacugc

SEQ ID NO: 1074775 - RNA, 20 nt, Mycobacterium bovis subsp bovis AF2122/97
ccggugccacugccguugcc

SEQ ID NO: 1074776 - RNA, 16 nt, Mycobacterium bovis subsp bovis AF2122/97
ccggugccaccgacgc

SEQ ID NO: 1074777 - RNA, 14 nt, Mycobacterium bovis subsp bovis AF2122/97
ccggugccaccggc

SEQ ID NO: 1074778 - RNA, 19 nt, Mycobacterium bovis subsp bovis AF2122/97
ccggugccaccggcuggug

SEQ ID NO: 1074779 - RNA, 20 nt, Mycobacterium bovis subsp bovis AF2122/97
ccggugcccgcaccacaccg

SEQ ID NO: 1074780 - RNA, 14 nt, Mycobacterium bovis subsp bovis AF2122/97
ccggugcccgcggu

SEQ ID NO: 1074781 - RNA, 18 nt, Mycobacterium bovis subsp bovis AF2122/97
ccggugacaaguggugcc

SEQ ID NO: 1074782 - RNA, 18 nt, Mycobacterium bovis subsp bovis AF2122/97
ccgguggacagaugcauc

SEQ ID NO: 1074783 - RNA, 19 nt, Mycobacterium bovis subsp bovis AF2122/97
ccgguggaaaagccacggc

SEQ ID NO: 1074784 - RNA, 12 nt, Mycobacterium bovis subsp bovis AF2122/97
ccggugccgacg

SEQ ID NO: 1074785 - RNA, 19 nt, Mycobacterium bovis subsp bovis AF2122/97
ccggugccgccauugacgc

SEQ ID NO: 1074786 - RNA, 23 nt, Mycobacterium bovis subsp bovis AF2122/97
ccgguggacgaucuggcagccga

SEQ ID NO: 1074787 - RNA, 16 nt, Mycobacterium bovis subsp bovis AF2122/97
ccgguggaauccacca

SEQ ID NO: 1074788 - RNA, 20 nt, Mycobacterium bovis subsp bovis AF2122/97
ccgguggaauccaccagccg

SEQ ID NO: 1074789 - RNA, 23 nt, Mycobacterium bovis subsp bovis AF2122/97
ccggugccgccauugacgccguu

SEQ ID NO: 1074790 - RNA, 14 nt, Mycobacterium bovis subsp bovis AF2122/97
ccgguggcacccgc

SEQ ID NO: 1074791 - RNA, 19 nt, Mycobacterium bovis subsp bovis AF2122/97
ccgguggcaccggcggcga

SEQ ID NO: 1074792 - RNA, 20 nt, Mycobacterium bovis subsp bovis AF2122/97
ccgguggcaccggcggcgac

SEQ ID NO: 1074793 - RNA, 18 nt, Mycobacterium bovis subsp bovis AF2122/97
ccgguggcacggccccug

SEQ ID NO: 1074794 - RNA, 15 nt, Mycobacterium bovis subsp bovis AF2122/97
ccgguggcagagccg

SEQ ID NO: 1074795 - RNA, 19 nt, Mycobacterium bovis subsp bovis AF2122/97
ccgguccgucaccaccgcc

SEQ ID NO: 1074796 - RNA, 21 nt, Mycobacterium bovis subsp bovis AF2122/97
ccgguccgucaccaccgccgc

SEQ ID NO: 1074797 - RNA, 23 nt, Mycobacterium bovis subsp bovis AF2122/97
ccgguccgucaccaccgccgcca

SEQ ID NO: 1074798 - RNA, 11 nt, Mycobacterium bovis subsp bovis AF2122/97
ccgguccggcg

SEQ ID NO: 1074799 - RNA, 16 nt, Mycobacterium bovis subsp bovis AF2122/97
ccgggucaccagcgca

SEQ ID NO: 1074800 - RNA, 22 nt, Mycobacterium bovis subsp bovis AF2122/97
ccggucgacagcgaaggcgccg

SEQ ID NO: 1074801 - RNA, 14 nt, Mycobacterium bovis subsp bovis AF2122/97
ccgguccggcgucg

SEQ ID NO: 1074802 - RNA, 19 nt, Mycobacterium bovis subsp bovis AF2122/97
ccggguagcucccugggcg

SEQ ID NO: 1074803 - RNA, 20 nt, Mycobacterium bovis subsp bovis AF2122/97
ccgguccugggauccggcgg

SEQ ID NO: 1074804 - RNA, 22 nt, Mycobacterium bovis subsp bovis AF2122/97
ccggucgacuccagcaccagca

SEQ ID NO: 1074805 - RNA, 19 nt, Mycobacterium bovis subsp bovis AF2122/97
ccggucgaggucggcgauc

SEQ ID NO: 1074806 - RNA, 17 nt, Mycobacterium bovis subsp bovis AF2122/97
ccggucgaugccgaugc

SEQ ID NO: 1074807 - RNA, 11 nt, Mycobacterium bovis subsp bovis AF2122/97
ccggucgaugu

SEQ ID NO: 1074808 - RNA, 14 nt, Mycobacterium bovis subsp bovis AF2122/97
ccggucgccgacgg

SEQ ID NO: 1074809 - RNA, 15 nt, Mycobacterium bovis subsp bovis AF2122/97
ccggucgccgacggc

SEQ ID NO: 1074810 - RNA, 16 nt, Mycobacterium bovis subsp bovis AF2122/97
ccggucgcagugcacc

SEQ ID NO: 1074811 - RNA, 23 nt, Mycobacterium bovis subsp bovis AF2122/97
ccggucgcagugcacccgggccg

SEQ ID NO: 1074812 - RNA, 19 nt, Mycobacterium bovis subsp bovis AF2122/97
ccggucgcauggucgacga

SEQ ID NO: 1074813 - RNA, 14 nt, Mycobacterium bovis subsp bovis AF2122/97
ccggucgccgguca

SEQ ID NO: 1074814 - RNA, 15 nt, Mycobacterium bovis subsp bovis AF2122/97
ccggucgaugucggc

SEQ ID NO: 1074815 - RNA, 18 nt, Mycobacterium bovis subsp bovis AF2122/97
ccggucgccucaccggcg

SEQ ID NO: 1074816 - RNA, 16 nt, Mycobacterium bovis subsp bovis AF2122/97
ccggucgccgcgucua

SEQ ID NO: 1074817 - RNA, 23 nt, Mycobacterium bovis subsp bovis AF2122/97
ccggguaaagcgaugggaacggg

SEQ ID NO: 1074818 - RNA, 15 nt, Mycobacterium bovis subsp bovis AF2122/97
ccggguacgccgggc

SEQ ID NO: 1074819 - RNA, 17 nt, Mycobacterium bovis subsp bovis AF2122/97
ccggguagcggcgccgc

SEQ ID NO: 1074820 - RNA, 16 nt, Mycobacterium bovis subsp bovis AF2122/97
ccggguagacaccgcg

SEQ ID NO: 1074821 - RNA, 17 nt, Mycobacterium bovis subsp bovis AF2122/97
ccggguagacaccgcga

SEQ ID NO: 1074822 - RNA, 21 nt, Mycobacterium bovis subsp bovis AF2122/97
ccggguagacaugggugaauc

SEQ ID NO: 1074823 - RNA, 16 nt, Mycobacterium bovis subsp bovis AF2122/97
ccggguauggcggcga

SEQ ID NO: 1074824 - RNA, 20 nt, Mycobacterium bovis subsp bovis AF2122/97
ccggguauggcggcgacggc

SEQ ID NO: 1074825 - RNA, 18 nt, Mycobacterium bovis subsp bovis AF2122/97
ccggggcgcccggccagg

SEQ ID NO: 1074826 - RNA, 12 nt, Mycobacterium bovis subsp bovis AF2122/97
ccggggcggccg

SEQ ID NO: 1074827 - RNA, 15 nt, Mycobacterium bovis subsp bovis AF2122/97
ccggggcugccgccg

SEQ ID NO: 1074828 - RNA, 20 nt, Mycobacterium bovis subsp bovis AF2122/97
ccggggcugccgccguugcc

SEQ ID NO: 1074829 - RNA, 15 nt, Mycobacterium bovis subsp bovis AF2122/97
ccggggcucucggau

SEQ ID NO: 1074830 - RNA, 21 nt, Mycobacterium bovis subsp bovis AF2122/97
ccggggcugcccgcggacgug

SEQ ID NO: 1074831 - RNA, 15 nt, Mycobacterium bovis subsp bovis AF2122/97
ccggggcugccgaac

SEQ ID NO: 1074832 - RNA, 21 nt, Mycobacterium bovis subsp bovis AF2122/97
ccggggugugcgggcggugca

SEQ ID NO: 1074833 - RNA, 13 nt, Mycobacterium bovis subsp bovis AF2122/97
ccgggguucaccg

SEQ ID NO: 1074834 - RNA, 17 nt, Mycobacterium bovis subsp bovis AF2122/97
ccgggggcaccguuacc

SEQ ID NO: 1074835 - RNA, 16 nt, Mycobacterium bovis subsp bovis AF2122/97
ccgggguucaccgucg

SEQ ID NO: 1074836 - RNA, 17 nt, Mycobacterium bovis subsp bovis AF2122/97
ccggugaccacuugcag

SEQ ID NO: 1074837 - RNA, 19 nt, Mycobacterium bovis subsp bovis AF2122/97
ccggugacaaauucggcgu

SEQ ID NO: 1074838 - RNA, 15 nt, Mycobacterium bovis subsp bovis AF2122/97
ccggugacaaggaug

SEQ ID NO: 1074839 - RNA, 13 nt, Mycobacterium bovis subsp bovis AF2122/97
ccggugaccagca

SEQ ID NO: 1074840 - RNA, 17 nt, Mycobacterium bovis subsp bovis AF2122/97
ccggugaacccgauugg

SEQ ID NO: 1074841 - RNA, 22 nt, Mycobacterium bovis subsp bovis AF2122/97
ccggugaacgguagcacugucg

SEQ ID NO: 1074842 - RNA, 19 nt, Mycobacterium bovis subsp bovis AF2122/97
ccggugacgacgucgccgc

SEQ ID NO: 1074843 - RNA, 20 nt, Mycobacterium bovis subsp bovis AF2122/97
ccggugacgacgucgccgcc

SEQ ID NO: 1074844 - RNA, 19 nt, Mycobacterium bovis subsp bovis AF2122/97
ccggugacgaugaccgcgc

SEQ ID NO: 1074845 - RNA, 21 nt, Mycobacterium bovis subsp bovis AF2122/97
ccggugauggugaccagcagg

SEQ ID NO: 1074846 - RNA, 18 nt, Mycobacterium bovis subsp bovis AF2122/97
ccggugauggugccaucc

SEQ ID NO: 1074847 - RNA, 22 nt, Mycobacterium bovis subsp bovis AF2122/97
ccggucuugcaucgccaaugcg

SEQ ID NO: 1074848 - RNA, 15 nt, Mycobacterium bovis subsp bovis AF2122/97
ccggucuuacggucg

SEQ ID NO: 1074849 - RNA, 19 nt, Mycobacterium bovis subsp bovis AF2122/97
ccggucuugggcgcgggug

SEQ ID NO: 1074850 - RNA, 22 nt, Mycobacterium bovis subsp bovis AF2122/97
ccggucuugggcgcgggugcgc

SEQ ID NO: 1074851 - RNA, 21 nt, Mycobacterium bovis subsp bovis AF2122/97
ccggugaacaccagcaggaag

SEQ ID NO: 1074852 - RNA, 21 nt, Mycobacterium bovis subsp bovis AF2122/97
ccggucgcuguccacugccac

SEQ ID NO: 1074853 - RNA, 20 nt, Mycobacterium bovis subsp bovis AF2122/97
ccggucgcuguccacugcca

SEQ ID NO: 1074854 - RNA, 14 nt, Mycobacterium bovis subsp bovis AF2122/97
ccggucggagcggu

SEQ ID NO: 1074855 - RNA, 19 nt, Mycobacterium bovis subsp bovis AF2122/97
ccggucggagcggugccga

SEQ ID NO: 1074856 - RNA, 20 nt, Mycobacterium bovis subsp bovis AF2122/97
ccggucggagcggugccgac

SEQ ID NO: 1074857 - RNA, 17 nt, Mycobacterium bovis subsp bovis AF2122/97
ccggucggcaccaccac

SEQ ID NO: 1074858 - RNA, 21 nt, Mycobacterium bovis subsp bovis AF2122/97
ccggucggcaccaccacgccg

SEQ ID NO: 1074859 - RNA, 13 nt, Mycobacterium bovis subsp bovis AF2122/97
ccggucgccgcga

SEQ ID NO: 1074860 - RNA, 14 nt, Mycobacterium bovis subsp bovis AF2122/97
ccggucggcccaca

SEQ ID NO: 1074861 - RNA, 19 nt, Mycobacterium bovis subsp bovis AF2122/97
ccggucggcgaaaggccag

SEQ ID NO: 1074862 - RNA, 13 nt, Mycobacterium bovis subsp bovis AF2122/97
ccggucggcccgc

SEQ ID NO: 1074863 - RNA, 15 nt, Mycobacterium bovis subsp bovis AF2122/97
ccggucggcccgcgc

SEQ ID NO: 1074864 - RNA, 12 nt, Mycobacterium bovis subsp bovis AF2122/97
ccggucggccag

SEQ ID NO: 1074865 - RNA, 12 nt, Mycobacterium bovis subsp bovis AF2122/97
ccggucggccau

SEQ ID NO: 1074866 - RNA, 22 nt, Mycobacterium bovis subsp bovis AF2122/97
ccggucgggcgcggggcggccu

SEQ ID NO: 1074867 - RNA, 15 nt, Mycobacterium bovis subsp bovis AF2122/97
ccggucggcgguagc

SEQ ID NO: 1074868 - RNA, 22 nt, Mycobacterium bovis subsp bovis AF2122/97
ccggucggcgguagccgaccag

SEQ ID NO: 1074869 - RNA, 12 nt, Mycobacterium bovis subsp bovis AF2122/97
ccggucggcgac

SEQ ID NO: 1074870 - RNA, 19 nt, Mycobacterium bovis subsp bovis AF2122/97
ccggucucgacggcggccg

SEQ ID NO: 1074871 - RNA, 22 nt, Mycobacterium bovis subsp bovis AF2122/97
ccggucuauuugccugccgcgc

SEQ ID NO: 1074872 - RNA, 17 nt, Mycobacterium bovis subsp bovis AF2122/97
ccggucuacgacgucgc

SEQ ID NO: 1074873 - RNA, 22 nt, Mycobacterium bovis subsp bovis AF2122/97
ccguagacccacagucgccggc

SEQ ID NO: 1074874 - RNA, 12 nt, Mycobacterium bovis subsp bovis AF2122/97
ccguaccgguga

SEQ ID NO: 1074875 - RNA, 15 nt, Mycobacterium bovis subsp bovis AF2122/97
ccguacagcccggcc

SEQ ID NO: 1074876 - RNA, 18 nt, Mycobacterium bovis subsp bovis AF2122/97
ccguacaguccacgcgua

SEQ ID NO: 1074877 - RNA, 15 nt, Mycobacterium bovis subsp bovis AF2122/97
ccguacaucagcgcg

SEQ ID NO: 1074878 - RNA, 21 nt, Mycobacterium bovis subsp bovis AF2122/97
ccgucauacucgacaccgacu

SEQ ID NO: 1074879 - RNA, 23 nt, Mycobacterium bovis subsp bovis AF2122/97
ccgucauacucgacaccgacucg

SEQ ID NO: 1074880 - RNA, 13 nt, Mycobacterium bovis subsp bovis AF2122/97
ccguccagcgccg

SEQ ID NO: 1074881 - RNA, 16 nt, Mycobacterium bovis subsp bovis AF2122/97
ccguccagcgccgcgg

SEQ ID NO: 1074882 - RNA, 21 nt, Mycobacterium bovis subsp bovis AF2122/97
ccgucagguucuaccaaaucg

SEQ ID NO: 1074883 - RNA, 23 nt, Mycobacterium bovis subsp bovis AF2122/97
ccgucagguacgucuuggaucac

SEQ ID NO: 1074884 - RNA, 17 nt, Mycobacterium bovis subsp bovis AF2122/97
ccgucaguucggugugc

SEQ ID NO: 1074885 - RNA, 15 nt, Mycobacterium bovis subsp bovis AF2122/97
ccgucauacucgaca

SEQ ID NO: 1074886 - RNA, 17 nt, Mycobacterium bovis subsp bovis AF2122/97
ccgucagcgucggcgca

SEQ ID NO: 1074887 - RNA, 13 nt, Mycobacterium bovis subsp bovis AF2122/97
ccgucagcggcca

SEQ ID NO: 1074888 - RNA, 12 nt, Mycobacterium bovis subsp bovis AF2122/97
ccgucagcggcg

SEQ ID NO: 1074889 - RNA, 16 nt, Mycobacterium bovis subsp bovis AF2122/97
ccgucagcggcggcca

SEQ ID NO: 1074890 - RNA, 14 nt, Mycobacterium bovis subsp bovis AF2122/97
ccgucagcgggcag

SEQ ID NO: 1074891 - RNA, 16 nt, Mycobacterium bovis subsp bovis AF2122/97
ccgucagcgggcagca

SEQ ID NO: 1074892 - RNA, 14 nt, Mycobacterium bovis subsp bovis AF2122/97
ccgucagcgccgcu

SEQ ID NO: 1074893 - RNA, 18 nt, Mycobacterium bovis subsp bovis AF2122/97
ccgucagcgccgcugacu

SEQ ID NO: 1074894 - RNA, 14 nt, Mycobacterium bovis subsp bovis AF2122/97
ccguagacgccgag

SEQ ID NO: 1074895 - RNA, 18 nt, Mycobacterium bovis subsp bovis AF2122/97
ccguagagcaugccgccc

SEQ ID NO: 1074896 - RNA, 20 nt, Mycobacterium bovis subsp bovis AF2122/97
ccguagagcaugccgcccgc

SEQ ID NO: 1074897 - RNA, 22 nt, Mycobacterium bovis subsp bovis AF2122/97
ccguagagcaugccgcccgcgc

SEQ ID NO: 1074898 - RNA, 18 nt, Mycobacterium bovis subsp bovis AF2122/97
ccgucagggucaccugcg

SEQ ID NO: 1074899 - RNA, 19 nt, Mycobacterium bovis subsp bovis AF2122/97
ccgucagggucaccugcgg

SEQ ID NO: 1074900 - RNA, 22 nt, Mycobacterium bovis subsp bovis AF2122/97
ccgucagggucaccugcgggcc

SEQ ID NO: 1074901 - RNA, 14 nt, Mycobacterium bovis subsp bovis AF2122/97
ccguacccacgacg

SEQ ID NO: 1074902 - RNA, 20 nt, Mycobacterium bovis subsp bovis AF2122/97
ccguccaggcgcugcagcau

SEQ ID NO: 1074903 - RNA, 16 nt, Mycobacterium bovis subsp bovis AF2122/97
ccgucccccgcacgcg

SEQ ID NO: 1074904 - RNA, 23 nt, Mycobacterium bovis subsp bovis AF2122/97
ccgucaguucggugugcggcgca

SEQ ID NO: 1074905 - RNA, 13 nt, Mycobacterium bovis subsp bovis AF2122/97
ccguccggggccg

SEQ ID NO: 1074906 - RNA, 14 nt, Mycobacterium bovis subsp bovis AF2122/97
ccguccgggucacc

SEQ ID NO: 1074907 - RNA, 17 nt, Mycobacterium bovis subsp bovis AF2122/97
ccguccggcuuggcggc

SEQ ID NO: 1074908 - RNA, 21 nt, Mycobacterium bovis subsp bovis AF2122/97
ccguccccggcguccgaccgg

SEQ ID NO: 1074909 - RNA, 19 nt, Mycobacterium bovis subsp bovis AF2122/97
ccgucccgaaacgccgggu

SEQ ID NO: 1074910 - RNA, 13 nt, Mycobacterium bovis subsp bovis AF2122/97
ccguccucgguca

SEQ ID NO: 1074911 - RNA, 14 nt, Mycobacterium bovis subsp bovis AF2122/97
ccguccucgucggu

SEQ ID NO: 1074912 - RNA, 23 nt, Mycobacterium bovis subsp bovis AF2122/97
ccguccugacuuuugucacugcg

SEQ ID NO: 1074913 - RNA, 12 nt, Mycobacterium bovis subsp bovis AF2122/97
ccguccgucggc

SEQ ID NO: 1074914 - RNA, 14 nt, Mycobacterium bovis subsp bovis AF2122/97
ccguccgucggcgc

SEQ ID NO: 1074915 - RNA, 22 nt, Mycobacterium bovis subsp bovis AF2122/97
ccgucgacagucaacagggcca

SEQ ID NO: 1074916 - RNA, 12 nt, Mycobacterium bovis subsp bovis AF2122/97
ccgucgaccggc

SEQ ID NO: 1074917 - RNA, 17 nt, Mycobacterium bovis subsp bovis AF2122/97
ccgucgacgagcgccuc

SEQ ID NO: 1074918 - RNA, 16 nt, Mycobacterium bovis subsp bovis AF2122/97
ccgucgacgaucagcg

SEQ ID NO: 1074919 - RNA, 17 nt, Mycobacterium bovis subsp bovis AF2122/97
ccgucgaaauacccggu

SEQ ID NO: 1074920 - RNA, 18 nt, Mycobacterium bovis subsp bovis AF2122/97
ccgucgaacgcgcgcgug

SEQ ID NO: 1074921 - RNA, 20 nt, Mycobacterium bovis subsp bovis AF2122/97
ccgucgaacgguagcacggu

SEQ ID NO: 1074922 - RNA, 14 nt, Mycobacterium bovis subsp bovis AF2122/97
ccgucgcggucaac

SEQ ID NO: 1074923 - RNA, 16 nt, Mycobacterium bovis subsp bovis AF2122/97
ccgucgagucgccgag

SEQ ID NO: 1074924 - RNA, 23 nt, Mycobacterium bovis subsp bovis AF2122/97
ccgucgaucaagugcgguccggc

SEQ ID NO: 1074925 - RNA, 17 nt, Mycobacterium bovis subsp bovis AF2122/97
ccgucgauccgucggcg

SEQ ID NO: 1074926 - RNA, 19 nt, Mycobacterium bovis subsp bovis AF2122/97
ccgucgauccgucggcgga

SEQ ID NO: 1074927 - RNA, 18 nt, Mycobacterium bovis subsp bovis AF2122/97
ccgucgcuacccgccacg

SEQ ID NO: 1074928 - RNA, 18 nt, Mycobacterium bovis subsp bovis AF2122/97
ccgucgcuagggugagcc

SEQ ID NO: 1074929 - RNA, 22 nt, Mycobacterium bovis subsp bovis AF2122/97
ccgucgcuagggugagcccggg

SEQ ID NO: 1074930 - RNA, 17 nt, Mycobacterium bovis subsp bovis AF2122/97
ccgucgcuaugcgccgc

SEQ ID NO: 1074931 - RNA, 18 nt, Mycobacterium bovis subsp bovis AF2122/97
ccgucgcuaugcgccgca

SEQ ID NO: 1074932 - RNA, 17 nt, Mycobacterium bovis subsp bovis AF2122/97
ccgucgcgucgaccgga

SEQ ID NO: 1074933 - RNA, 20 nt, Mycobacterium bovis subsp bovis AF2122/97
ccgucgcgucgaccggacaa

SEQ ID NO: 1074934 - RNA, 18 nt, Mycobacterium bovis subsp bovis AF2122/97
ccgucgcugcccgcgcgg

SEQ ID NO: 1074935 - RNA, 16 nt, Mycobacterium bovis subsp bovis AF2122/97
ccgucgcuggccggca

SEQ ID NO: 1074936 - RNA, 21 nt, Mycobacterium bovis subsp bovis AF2122/97
ccgucggaacugaccacgucg

SEQ ID NO: 1074937 - RNA, 17 nt, Mycobacterium bovis subsp bovis AF2122/97
ccgucggacauaccgcg

SEQ ID NO: 1074938 - RNA, 18 nt, Mycobacterium bovis subsp bovis AF2122/97
ccgucggagccggccacc

SEQ ID NO: 1074939 - RNA, 22 nt, Mycobacterium bovis subsp bovis AF2122/97
ccgucggagccggccaccucgg

SEQ ID NO: 1074940 - RNA, 22 nt, Mycobacterium bovis subsp bovis AF2122/97
ccgucggaggugaaccccgccg

SEQ ID NO: 1074941 - RNA, 20 nt, Mycobacterium bovis subsp bovis AF2122/97
ccgucggagucgacggucac

SEQ ID NO: 1074942 - RNA, 22 nt, Mycobacterium bovis subsp bovis AF2122/97
ccgucggauggaaggcggccag

SEQ ID NO: 1074943 - RNA, 17 nt, Mycobacterium bovis subsp bovis AF2122/97
ccgucgaguuccggccg

SEQ ID NO: 1074944 - RNA, 18 nt, Mycobacterium bovis subsp bovis AF2122/97
ccgucgagccggacaggc

SEQ ID NO: 1074945 - RNA, 14 nt, Mycobacterium bovis subsp bovis AF2122/97
ccgucgagcacggu

SEQ ID NO: 1074946 - RNA, 21 nt, Mycobacterium bovis subsp bovis AF2122/97
ccgucgagcacggugagccgg

SEQ ID NO: 1074947 - RNA, 23 nt, Mycobacterium bovis subsp bovis AF2122/97
ccgucgagcaacgugacccggau

SEQ ID NO: 1074948 - RNA, 15 nt, Mycobacterium bovis subsp bovis AF2122/97
ccgucgacgcggccg

SEQ ID NO: 1074949 - RNA, 14 nt, Mycobacterium bovis subsp bovis AF2122/97
ccgucgacgcgguc

SEQ ID NO: 1074950 - RNA, 15 nt, Mycobacterium bovis subsp bovis AF2122/97
ccgucggccaggcca

SEQ ID NO: 1074951 - RNA, 23 nt, Mycobacterium bovis subsp bovis AF2122/97
ccgucggcaauacuccgcugacg

SEQ ID NO: 1074952 - RNA, 15 nt, Mycobacterium bovis subsp bovis AF2122/97
ccgucggcaccagca

SEQ ID NO: 1074953 - RNA, 12 nt, Mycobacterium bovis subsp bovis AF2122/97
ccgucggcagca

SEQ ID NO: 1074954 - RNA, 15 nt, Mycobacterium bovis subsp bovis AF2122/97
ccgucggcagcagcg

SEQ ID NO: 1074955 - RNA, 23 nt, Mycobacterium bovis subsp bovis AF2122/97
ccgucggauggaaggcggccagg

SEQ ID NO: 1074956 - RNA, 14 nt, Mycobacterium bovis subsp bovis AF2122/97
ccgucggcccgcuc

SEQ ID NO: 1074957 - RNA, 13 nt, Mycobacterium bovis subsp bovis AF2122/97
ccgucggcgaagg

SEQ ID NO: 1074958 - RNA, 13 nt, Mycobacterium bovis subsp bovis AF2122/97
ccgucggcgcccg

SEQ ID NO: 1074959 - RNA, 12 nt, Mycobacterium bovis subsp bovis AF2122/97
ccgucggcgugg

SEQ ID NO: 1074960 - RNA, 13 nt, Mycobacterium bovis subsp bovis AF2122/97
ccgucggcgagca

SEQ ID NO: 1074961 - RNA, 11 nt, Mycobacterium bovis subsp bovis AF2122/97
ccgucggcgcu

SEQ ID NO: 1074962 - RNA, 21 nt, Mycobacterium bovis subsp bovis AF2122/97
ccgucgggacggccaacaggg

SEQ ID NO: 1074963 - RNA, 22 nt, Mycobacterium bovis subsp bovis AF2122/97
ccgugacccucagcaccgcugg

SEQ ID NO: 1074964 - RNA, 20 nt, Mycobacterium bovis subsp bovis AF2122/97
ccgugacccauucucggccg

SEQ ID NO: 1074965 - RNA, 22 nt, Mycobacterium bovis subsp bovis AF2122/97
ccgugacccauucucggccggc

SEQ ID NO: 1074966 - RNA, 16 nt, Mycobacterium bovis subsp bovis AF2122/97
ccgugaaucgagcacc

SEQ ID NO: 1074967 - RNA, 18 nt, Mycobacterium bovis subsp bovis AF2122/97
ccgugaauucgccgaacg

SEQ ID NO: 1074968 - RNA, 21 nt, Mycobacterium bovis subsp bovis AF2122/97
ccgugacagcggcauugccag

SEQ ID NO: 1074969 - RNA, 15 nt, Mycobacterium bovis subsp bovis AF2122/97
ccgugaccgagccgc

SEQ ID NO: 1074970 - RNA, 14 nt, Mycobacterium bovis subsp bovis AF2122/97
ccgugaccgccgcg

SEQ ID NO: 1074971 - RNA, 18 nt, Mycobacterium bovis subsp bovis AF2122/97
ccgugaccgccgcgccgg

SEQ ID NO: 1074972 - RNA, 19 nt, Mycobacterium bovis subsp bovis AF2122/97
ccgugaccgccgcgccggc

SEQ ID NO: 1074973 - RNA, 20 nt, Mycobacterium bovis subsp bovis AF2122/97
ccgugaccgccgcgccggca

SEQ ID NO: 1074974 - RNA, 18 nt, Mycobacterium bovis subsp bovis AF2122/97
ccgugacguaucgccgcg

SEQ ID NO: 1074975 - RNA, 19 nt, Mycobacterium bovis subsp bovis AF2122/97
ccgugacguaucgccgcgg

SEQ ID NO: 1074976 - RNA, 22 nt, Mycobacterium bovis subsp bovis AF2122/97
ccgugacguaucgccgcgggcg

SEQ ID NO: 1074977 - RNA, 11 nt, Mycobacterium bovis subsp bovis AF2122/97
ccgugccagcu

SEQ ID NO: 1074978 - RNA, 16 nt, Mycobacterium bovis subsp bovis AF2122/97
ccgugcagcucgguca

SEQ ID NO: 1074979 - RNA, 14 nt, Mycobacterium bovis subsp bovis AF2122/97
ccgugagcaccagc

SEQ ID NO: 1074980 - RNA, 20 nt, Mycobacterium bovis subsp bovis AF2122/97
ccgugcagggcauugcggcc

SEQ ID NO: 1074981 - RNA, 17 nt, Mycobacterium bovis subsp bovis AF2122/97
ccgugcagcucggucag

SEQ ID NO: 1074982 - RNA, 20 nt, Mycobacterium bovis subsp bovis AF2122/97
ccgugcagcucggucagcgu

SEQ ID NO: 1074983 - RNA, 22 nt, Mycobacterium bovis subsp bovis AF2122/97
ccgucguacucgaccgcgagca

SEQ ID NO: 1074984 - RNA, 19 nt, Mycobacterium bovis subsp bovis AF2122/97
ccgucguacucggcggcca

SEQ ID NO: 1074985 - RNA, 19 nt, Mycobacterium bovis subsp bovis AF2122/97
ccgucgggcacaccgacgc

SEQ ID NO: 1074986 - RNA, 22 nt, Mycobacterium bovis subsp bovis AF2122/97
ccgucgggcacaccgacgccgc

SEQ ID NO: 1074987 - RNA, 13 nt, Mycobacterium bovis subsp bovis AF2122/97
ccgucgggcagca

SEQ ID NO: 1074988 - RNA, 14 nt, Mycobacterium bovis subsp bovis AF2122/97
ccgucgggcccagc

SEQ ID NO: 1074989 - RNA, 14 nt, Mycobacterium bovis subsp bovis AF2122/97
ccgucgucaccgcg

SEQ ID NO: 1074990 - RNA, 15 nt, Mycobacterium bovis subsp bovis AF2122/97
ccgucgucaccgcga

SEQ ID NO: 1074991 - RNA, 15 nt, Mycobacterium bovis subsp bovis AF2122/97
ccgucgucagcgggu

SEQ ID NO: 1074992 - RNA, 23 nt, Mycobacterium bovis subsp bovis AF2122/97
ccgucgucgucgacacggugauc

SEQ ID NO: 1074993 - RNA, 21 nt, Mycobacterium bovis subsp bovis AF2122/97
ccgucuuugucacgcaccgcg

SEQ ID NO: 1074994 - RNA, 15 nt, Mycobacterium bovis subsp bovis AF2122/97
ccgugaaccgcccgc

SEQ ID NO: 1074995 - RNA, 17 nt, Mycobacterium bovis subsp bovis AF2122/97
ccgugaacggauguggu

SEQ ID NO: 1074996 - RNA, 15 nt, Mycobacterium bovis subsp bovis AF2122/97
ccgucgucguacggc

SEQ ID NO: 1074997 - RNA, 16 nt, Mycobacterium bovis subsp bovis AF2122/97
ccgucgucgucgacac

SEQ ID NO: 1074998 - RNA, 20 nt, Mycobacterium bovis subsp bovis AF2122/97
ccgucgucgccgucggugcc

SEQ ID NO: 1074999 - RNA, 21 nt, Mycobacterium bovis subsp bovis AF2122/97
ccgucgucgccgucggugccg

SEQ ID NO: 1075000 - RNA, 14 nt, Mycobacterium bovis subsp bovis AF2122/97
ccgucgucggucac

SEQ ID NO: 1075001 - RNA, 18 nt, Mycobacterium bovis subsp bovis AF2122/97
ccgucgucgaccacgacg

SEQ ID NO: 1075002 - RNA, 20 nt, Mycobacterium bovis subsp bovis AF2122/97
ccgucguaugcggugacgac

SEQ ID NO: 1075003 - RNA, 17 nt, Mycobacterium bovis subsp bovis AF2122/97
ccguucgacccagcggu

SEQ ID NO: 1075004 - RNA, 15 nt, Mycobacterium bovis subsp bovis AF2122/97
ccguucgcagcacca

SEQ ID NO: 1075005 - RNA, 13 nt, Mycobacterium bovis subsp bovis AF2122/97
ccguucgcgucgc

SEQ ID NO: 1075006 - RNA, 21 nt, Mycobacterium bovis subsp bovis AF2122/97
ccguucggggccccgcggcgc

SEQ ID NO: 1075007 - RNA, 14 nt, Mycobacterium bovis subsp bovis AF2122/97
ccguucggggcgcg

SEQ ID NO: 1075008 - RNA, 20 nt, Mycobacterium bovis subsp bovis AF2122/97
ccguucgcucccccgcuacg

SEQ ID NO: 1075009 - RNA, 17 nt, Mycobacterium bovis subsp bovis AF2122/97
ccguucgggccguccuc

SEQ ID NO: 1075010 - RNA, 19 nt, Mycobacterium bovis subsp bovis AF2122/97
ccguugaccucuucgggca

SEQ ID NO: 1075011 - RNA, 19 nt, Mycobacterium bovis subsp bovis AF2122/97
ccguugaacggcaccagcg

SEQ ID NO: 1075012 - RNA, 21 nt, Mycobacterium bovis subsp bovis AF2122/97
ccguugaagacggccaccggg

SEQ ID NO: 1075013 - RNA, 13 nt, Mycobacterium bovis subsp bovis AF2122/97
ccguugaagccca

SEQ ID NO: 1075014 - RNA, 18 nt, Mycobacterium bovis subsp bovis AF2122/97
ccguugaagcccaacagc

SEQ ID NO: 1075015 - RNA, 14 nt, Mycobacterium bovis subsp bovis AF2122/97
ccguugacgccguu

SEQ ID NO: 1075016 - RNA, 18 nt, Mycobacterium bovis subsp bovis AF2122/97
ccguucucgcccacccgc

SEQ ID NO: 1075017 - RNA, 14 nt, Mycobacterium bovis subsp bovis AF2122/97
ccguugccgccggc

SEQ ID NO: 1075018 - RNA, 20 nt, Mycobacterium bovis subsp bovis AF2122/97
ccguugccgccgucaccgcc

SEQ ID NO: 1075019 - RNA, 15 nt, Mycobacterium bovis subsp bovis AF2122/97
ccguugccgccgucg

SEQ ID NO: 1075020 - RNA, 17 nt, Mycobacterium bovis subsp bovis AF2122/97
ccguugccgccgucgcc

SEQ ID NO: 1075021 - RNA, 21 nt, Mycobacterium bovis subsp bovis AF2122/97
ccguugccgccguugccgccg

SEQ ID NO: 1075022 - RNA, 13 nt, Mycobacterium bovis subsp bovis AF2122/97
ccguugccggcgu

SEQ ID NO: 1075023 - RNA, 12 nt, Mycobacterium bovis subsp bovis AF2122/97
ccguugccgccu

SEQ ID NO: 1075024 - RNA, 23 nt, Mycobacterium bovis subsp bovis AF2122/97
ccguugccgccuuugcccccggu

SEQ ID NO: 1075025 - RNA, 20 nt, Mycobacterium bovis subsp bovis AF2122/97
ccguugccgucgucgccguc

SEQ ID NO: 1075026 - RNA, 21 nt, Mycobacterium bovis subsp bovis AF2122/97
ccguugccgucgucgccgucg

SEQ ID NO: 1075027 - RNA, 14 nt, Mycobacterium bovis subsp bovis AF2122/97
ccguugccgaucaa

SEQ ID NO: 1075028 - RNA, 17 nt, Mycobacterium bovis subsp bovis AF2122/97
ccguugccgaucagccc

SEQ ID NO: 1075029 - RNA, 21 nt, Mycobacterium bovis subsp bovis AF2122/97
ccguugcccccauugccgccg

SEQ ID NO: 1075030 - RNA, 20 nt, Mycobacterium bovis subsp bovis AF2122/97
ccguugccgauggugauggg

SEQ ID NO: 1075031 - RNA, 21 nt, Mycobacterium bovis subsp bovis AF2122/97
ccguugccgccauuggcaggc

SEQ ID NO: 1075032 - RNA, 15 nt, Mycobacterium bovis subsp bovis AF2122/97
ccguugccgccgaag

SEQ ID NO: 1075033 - RNA, 15 nt, Mycobacterium bovis subsp bovis AF2122/97
ccguugccgccgacg

SEQ ID NO: 1075034 - RNA, 19 nt, Mycobacterium bovis subsp bovis AF2122/97
ccguugccgccgacgccgc

SEQ ID NO: 1075035 - RNA, 16 nt, Mycobacterium bovis subsp bovis AF2122/97
ccguugcccaacccgg

SEQ ID NO: 1075036 - RNA, 19 nt, Mycobacterium bovis subsp bovis AF2122/97
ccguugccgaaccacgcgc

SEQ ID NO: 1075037 - RNA, 21 nt, Mycobacterium bovis subsp bovis AF2122/97
ccguugccaccggugccggcg

SEQ ID NO: 1075038 - RNA, 13 nt, Mycobacterium bovis subsp bovis AF2122/97
ccguugccaacaa

SEQ ID NO: 1075039 - RNA, 17 nt, Mycobacterium bovis subsp bovis AF2122/97
ccguugccaagcagcug

SEQ ID NO: 1075040 - RNA, 18 nt, Mycobacterium bovis subsp bovis AF2122/97
ccguugaugucggcaggu

SEQ ID NO: 1075041 - RNA, 21 nt, Mycobacterium bovis subsp bovis AF2122/97
ccguugauucggccgccgacg

SEQ ID NO: 1075042 - RNA, 20 nt, Mycobacterium bovis subsp bovis AF2122/97
ccguugaucaagaaggccag

SEQ ID NO: 1075043 - RNA, 20 nt, Mycobacterium bovis subsp bovis AF2122/97
ccgugugcaucggcgaccgc

SEQ ID NO: 1075044 - RNA, 22 nt, Mycobacterium bovis subsp bovis AF2122/97
ccgugugcucuugcgccacggc

SEQ ID NO: 1075045 - RNA, 16 nt, Mycobacterium bovis subsp bovis AF2122/97
ccguguggccguuggc

SEQ ID NO: 1075046 - RNA, 20 nt, Mycobacterium bovis subsp bovis AF2122/97
ccguguggccguuggccgga

SEQ ID NO: 1075047 - RNA, 18 nt, Mycobacterium bovis subsp bovis AF2122/97
ccgugugggccccgccga

SEQ ID NO: 1075048 - RNA, 19 nt, Mycobacterium bovis subsp bovis AF2122/97
ccguguggucccggcacga

SEQ ID NO: 1075049 - RNA, 20 nt, Mycobacterium bovis subsp bovis AF2122/97
ccgugucgagaucucacgug

SEQ ID NO: 1075050 - RNA, 17 nt, Mycobacterium bovis subsp bovis AF2122/97
ccguguaugcauccacu

SEQ ID NO: 1075051 - RNA, 24 nt, Mycobacterium bovis subsp bovis AF2122/97
ccgugucaccgccgggaagccgca

SEQ ID NO: 1075052 - RNA, 16 nt, Mycobacterium bovis subsp bovis AF2122/97
ccgugucacgcgacca

SEQ ID NO: 1075053 - RNA, 21 nt, Mycobacterium bovis subsp bovis AF2122/97
ccgugucacgcgaccaccgcc

SEQ ID NO: 1075054 - RNA, 22 nt, Mycobacterium bovis subsp bovis AF2122/97
ccgugucacgcgaccaccgccg

SEQ ID NO: 1075055 - RNA, 13 nt, Mycobacterium bovis subsp bovis AF2122/97
ccguguagauggg

SEQ ID NO: 1075056 - RNA, 15 nt, Mycobacterium bovis subsp bovis AF2122/97
ccguguaaccaucgu

SEQ ID NO: 1075057 - RNA, 18 nt, Mycobacterium bovis subsp bovis AF2122/97
ccgugccgcaucacccgg

SEQ ID NO: 1075058 - RNA, 12 nt, Mycobacterium bovis subsp bovis AF2122/97
ccgugccgcccg

SEQ ID NO: 1075059 - RNA, 18 nt, Mycobacterium bovis subsp bovis AF2122/97
ccgugccgcccgcgccgc

SEQ ID NO: 1075060 - RNA, 18 nt, Mycobacterium bovis subsp bovis AF2122/97
ccgugccgaugccggcga

SEQ ID NO: 1075061 - RNA, 15 nt, Mycobacterium bovis subsp bovis AF2122/97
ccgugcccggugcgg

SEQ ID NO: 1075062 - RNA, 22 nt, Mycobacterium bovis subsp bovis AF2122/97
ccguggugguugaucagccaga

SEQ ID NO: 1075063 - RNA, 20 nt, Mycobacterium bovis subsp bovis AF2122/97
ccguggugguugaucagcca

SEQ ID NO: 1075064 - RNA, 18 nt, Mycobacterium bovis subsp bovis AF2122/97
ccgugguggucgggcgca

SEQ ID NO: 1075065 - RNA, 20 nt, Mycobacterium bovis subsp bovis AF2122/97
ccgugguggucgggcgcaac

SEQ ID NO: 1075066 - RNA, 20 nt, Mycobacterium bovis subsp bovis AF2122/97
ccgugccgccgacaccaccg

SEQ ID NO: 1075067 - RNA, 15 nt, Mycobacterium bovis subsp bovis AF2122/97
ccgugccgagcgugc

SEQ ID NO: 1075068 - RNA, 22 nt, Mycobacterium bovis subsp bovis AF2122/97
ccgugccgagcuucagcgcgcu

SEQ ID NO: 1075069 - RNA, 16 nt, Mycobacterium bovis subsp bovis AF2122/97
ccguucccaccaccac

SEQ ID NO: 1075070 - RNA, 14 nt, Mycobacterium bovis subsp bovis AF2122/97
ccguucagcgacca

SEQ ID NO: 1075071 - RNA, 17 nt, Mycobacterium bovis subsp bovis AF2122/97
ccguguugcacgcgggu

SEQ ID NO: 1075072 - RNA, 13 nt, Mycobacterium bovis subsp bovis AF2122/97
ccguguuucgaac

SEQ ID NO: 1075073 - RNA, 20 nt, Mycobacterium bovis subsp bovis AF2122/97
ccguuaauucgaaacccggc

SEQ ID NO: 1075074 - RNA, 21 nt, Mycobacterium bovis subsp bovis AF2122/97
ccguuagcuuagcugccgucg

SEQ ID NO: 1075075 - RNA, 13 nt, Mycobacterium bovis subsp bovis AF2122/97
ccguuaccgccgc

SEQ ID NO: 1075076 - RNA, 18 nt, Mycobacterium bovis subsp bovis AF2122/97
ccguuaccgccgcugccg

SEQ ID NO: 1075077 - RNA, 13 nt, Mycobacterium bovis subsp bovis AF2122/97
ccguuaccgccgu

SEQ ID NO: 1075078 - RNA, 15 nt, Mycobacterium bovis subsp bovis AF2122/97
ccguuaccgccgucg

SEQ ID NO: 1075079 - RNA, 12 nt, Mycobacterium bovis subsp bovis AF2122/97
ccguugucggcg

SEQ ID NO: 1075080 - RNA, 16 nt, Mycobacterium bovis subsp bovis AF2122/97
ccguuguccagaacgg

SEQ ID NO: 1075081 - RNA, 19 nt, Mycobacterium bovis subsp bovis AF2122/97
ccguuguccagcgcgacgu

SEQ ID NO: 1075082 - RNA, 14 nt, Mycobacterium bovis subsp bovis AF2122/97
ccguuggugccgcc

SEQ ID NO: 1075083 - RNA, 22 nt, Mycobacterium bovis subsp bovis AF2122/97
ccguuggugccgccugugccac

SEQ ID NO: 1075084 - RNA, 15 nt, Mycobacterium bovis subsp bovis AF2122/97
ccguuggcaaugacc

SEQ ID NO: 1075085 - RNA, 20 nt, Mycobacterium bovis subsp bovis AF2122/97
ccguuggcggcgguggccag

SEQ ID NO: 1075086 - RNA, 16 nt, Mycobacterium bovis subsp bovis AF2122/97
ccguugggccgcgccc

SEQ ID NO: 1075087 - RNA, 21 nt, Mycobacterium bovis subsp bovis AF2122/97
ccguugcugagcguaggccag

SEQ ID NO: 1075088 - RNA, 19 nt, Mycobacterium bovis subsp bovis AF2122/97
ccguugcgucugcucggcg

SEQ ID NO: 1075089 - RNA, 17 nt, Mycobacterium bovis subsp bovis AF2122/97
ccguugcuauucgccag

SEQ ID NO: 1075090 - RNA, 22 nt, Mycobacterium bovis subsp bovis AF2122/97
ccguugcgacaccuccgucagc

SEQ ID NO: 1075091 - RNA, 16 nt, Mycobacterium bovis subsp bovis AF2122/97
ccguugugucaccggc

SEQ ID NO: 1075092 - RNA, 14 nt, Mycobacterium bovis subsp bovis AF2122/97
ccguuucggcgccg

SEQ ID NO: 1075093 - RNA, 15 nt, Mycobacterium bovis subsp bovis AF2122/97
ccguuuccgccgccg

SEQ ID NO: 1075094 - RNA, 21 nt, Mycobacterium bovis subsp bovis AF2122/97
ccguuuccggcgcuccgccag

SEQ ID NO: 1075095 - RNA, 18 nt, Mycobacterium bovis subsp bovis AF2122/97
ccguuuccucagcugcuc

SEQ ID NO: 1075096 - RNA, 14 nt, Mycobacterium bovis subsp bovis AF2122/97
ccguuuccugcguc

SEQ ID NO: 1075097 - RNA, 22 nt, Mycobacterium bovis subsp bovis AF2122/97
ccguuuacggcccggcacccgg

SEQ ID NO: 1075098 - RNA, 23 nt, Mycobacterium bovis subsp bovis AF2122/97
ccguuguucccauagccagccga

SEQ ID NO: 1075099 - RNA, 14 nt, Mycobacterium bovis subsp bovis AF2122/97
ccguuugacgcgcu

SEQ ID NO: 1075100 - RNA, 15 nt, Mycobacterium bovis subsp bovis AF2122/97
ccguuuuaccucggc

SEQ ID NO: 1075101 - RNA, 15 nt, Mycobacterium bovis subsp bovis AF2122/97
ccguuugcgcaccgg

SEQ ID NO: 1075102 - RNA, 19 nt, Mycobacterium bovis subsp bovis AF2122/97
ccguuuugggugaucgcac

SEQ ID NO: 1075103 - RNA, 15 nt, Mycobacterium bovis subsp bovis AF2122/97
ccuagaccgggcggu

SEQ ID NO: 1075104 - RNA, 18 nt, Mycobacterium bovis subsp bovis AF2122/97
ccuacggugcagucgauu

SEQ ID NO: 1075105 - RNA, 13 nt, Mycobacterium bovis subsp bovis AF2122/97
ccuagcaccgcgc

SEQ ID NO: 1075106 - RNA, 15 nt, Mycobacterium bovis subsp bovis AF2122/97
ccuagcaccgcgccg

SEQ ID NO: 1075107 - RNA, 18 nt, Mycobacterium bovis subsp bovis AF2122/97
ccuagcagggugccggcg

SEQ ID NO: 1075108 - RNA, 22 nt, Mycobacterium bovis subsp bovis AF2122/97
ccuagcagggugccggcgccgc

SEQ ID NO: 1075109 - RNA, 18 nt, Mycobacterium bovis subsp bovis AF2122/97
ccuagccaacgagcgcgc

SEQ ID NO: 1075110 - RNA, 20 nt, Mycobacterium bovis subsp bovis AF2122/97
ccuagccgcagccccgacag

SEQ ID NO: 1075111 - RNA, 14 nt, Mycobacterium bovis subsp bovis AF2122/97
ccuagccgcggcac

SEQ ID NO: 1075112 - RNA, 20 nt, Mycobacterium bovis subsp bovis AF2122/97
ccuagccccugaaggccagc

SEQ ID NO: 1075113 - RNA, 12 nt, Mycobacterium bovis subsp bovis AF2122/97
ccuagccggcgc

SEQ ID NO: 1075114 - RNA, 16 nt, Mycobacterium bovis subsp bovis AF2122/97
ccuagccggcgcgccc

SEQ ID NO: 1075115 - RNA, 15 nt, Mycobacterium bovis subsp bovis AF2122/97
ccuaccgucgaccac

SEQ ID NO: 1075116 - RNA, 12 nt, Mycobacterium bovis subsp bovis AF2122/97
ccuaccgagcua

SEQ ID NO: 1075117 - RNA, 20 nt, Mycobacterium bovis subsp bovis AF2122/97
ccuaccgaugaaccaggcgg

SEQ ID NO: 1075118 - RNA, 14 nt, Mycobacterium bovis subsp bovis AF2122/97
ccuacgcagcgcgg

SEQ ID NO: 1075119 - RNA, 20 nt, Mycobacterium bovis subsp bovis AF2122/97
ccuaccuccucggcguggca

SEQ ID NO: 1075120 - RNA, 21 nt, Mycobacterium bovis subsp bovis AF2122/97
ccuacccgagaacgcccgagu

SEQ ID NO: 1075121 - RNA, 15 nt, Mycobacterium bovis subsp bovis AF2122/97
ccuaccgugcuggca

SEQ ID NO: 1075122 - RNA, 21 nt, Mycobacterium bovis subsp bovis AF2122/97
ccuacaccggcaagccacgcc

SEQ ID NO: 1075123 - RNA, 13 nt, Mycobacterium bovis subsp bovis AF2122/97
ccuacaccggcgc

SEQ ID NO: 1075124 - RNA, 14 nt, Mycobacterium bovis subsp bovis AF2122/97
ccuaaacaccgcga

SEQ ID NO: 1075125 - RNA, 18 nt, Mycobacterium bovis subsp bovis AF2122/97
ccuaaguucgccacgccc

SEQ ID NO: 1075126 - RNA, 17 nt, Mycobacterium bovis subsp bovis AF2122/97
ccuaaaaccccgagccg

SEQ ID NO: 1075127 - RNA, 13 nt, Mycobacterium bovis subsp bovis AF2122/97
ccucgccggccac

SEQ ID NO: 1075128 - RNA, 14 nt, Mycobacterium bovis subsp bovis AF2122/97
ccucgccggccacc

SEQ ID NO: 1075129 - RNA, 20 nt, Mycobacterium bovis subsp bovis AF2122/97
ccucgccggccacccgcgcg

SEQ ID NO: 1075130 - RNA, 12 nt, Mycobacterium bovis subsp bovis AF2122/97
ccucgccggccg

SEQ ID NO: 1075131 - RNA, 12 nt, Mycobacterium bovis subsp bovis AF2122/97
ccucgccgcgcg

SEQ ID NO: 1075132 - RNA, 22 nt, Mycobacterium bovis subsp bovis AF2122/97
ccucgcgggcuuaugcacgacg

SEQ ID NO: 1075133 - RNA, 18 nt, Mycobacterium bovis subsp bovis AF2122/97
ccucgccccaccggccga

SEQ ID NO: 1075134 - RNA, 23 nt, Mycobacterium bovis subsp bovis AF2122/97
ccucgcggaugagcucggccauc

SEQ ID NO: 1075135 - RNA, 20 nt, Mycobacterium bovis subsp bovis AF2122/97
ccucgcggaugagcucggcc

SEQ ID NO: 1075136 - RNA, 22 nt, Mycobacterium bovis subsp bovis AF2122/97
ccucgcggaugagcucggccau

SEQ ID NO: 1075137 - RNA, 15 nt, Mycobacterium bovis subsp bovis AF2122/97
ccucgcccuggccgc

SEQ ID NO: 1075138 - RNA, 14 nt, Mycobacterium bovis subsp bovis AF2122/97
ccucgagcgcggcg

SEQ ID NO: 1075139 - RNA, 18 nt, Mycobacterium bovis subsp bovis AF2122/97
ccucgagcgcggcgaucg

SEQ ID NO: 1075140 - RNA, 16 nt, Mycobacterium bovis subsp bovis AF2122/97
ccucgaccgccagccc

SEQ ID NO: 1075141 - RNA, 16 nt, Mycobacterium bovis subsp bovis AF2122/97
ccucgauagcggcgcc

SEQ ID NO: 1075142 - RNA, 13 nt, Mycobacterium bovis subsp bovis AF2122/97
ccucgaucgacuc

SEQ ID NO: 1075143 - RNA, 14 nt, Mycobacterium bovis subsp bovis AF2122/97
ccucgaucgcgcag

SEQ ID NO: 1075144 - RNA, 14 nt, Mycobacterium bovis subsp bovis AF2122/97
ccucgaucgcgccg

SEQ ID NO: 1075145 - RNA, 15 nt, Mycobacterium bovis subsp bovis AF2122/97
ccucgaucgcgccgu

SEQ ID NO: 1075146 - RNA, 15 nt, Mycobacterium bovis subsp bovis AF2122/97
ccucgaucagcgccg

SEQ ID NO: 1075147 - RNA, 21 nt, Mycobacterium bovis subsp bovis AF2122/97
ccucgaccggucggugauggu

SEQ ID NO: 1075148 - RNA, 18 nt, Mycobacterium bovis subsp bovis AF2122/97
ccucgaguacccaaccgg

SEQ ID NO: 1075149 - RNA, 12 nt, Mycobacterium bovis subsp bovis AF2122/97
ccucggcgaugu

SEQ ID NO: 1075150 - RNA, 23 nt, Mycobacterium bovis subsp bovis AF2122/97
ccucggcgccgucggagccggcc

SEQ ID NO: 1075151 - RNA, 17 nt, Mycobacterium bovis subsp bovis AF2122/97
ccucgggaggcagcgcg

SEQ ID NO: 1075152 - RNA, 13 nt, Mycobacterium bovis subsp bovis AF2122/97
ccucgggccggcg

SEQ ID NO: 1075153 - RNA, 14 nt, Mycobacterium bovis subsp bovis AF2122/97
ccucgggaucggcg

SEQ ID NO: 1075154 - RNA, 15 nt, Mycobacterium bovis subsp bovis AF2122/97
ccucgggcaacucgg

SEQ ID NO: 1075155 - RNA, 15 nt, Mycobacterium bovis subsp bovis AF2122/97
ccucgucgacgucgg

SEQ ID NO: 1075156 - RNA, 15 nt, Mycobacterium bovis subsp bovis AF2122/97
ccucggugagcagcu

SEQ ID NO: 1075157 - RNA, 21 nt, Mycobacterium bovis subsp bovis AF2122/97
ccucggugagaaucgacuccg

SEQ ID NO: 1075158 - RNA, 19 nt, Mycobacterium bovis subsp bovis AF2122/97
ccucggugaccaggccggc

SEQ ID NO: 1075159 - RNA, 20 nt, Mycobacterium bovis subsp bovis AF2122/97
ccucggugaccaggccggcc

SEQ ID NO: 1075160 - RNA, 22 nt, Mycobacterium bovis subsp bovis AF2122/97
ccucgggugucacagugguggg

SEQ ID NO: 1075161 - RNA, 20 nt, Mycobacterium bovis subsp bovis AF2122/97
ccucggucccguugccgccc

SEQ ID NO: 1075162 - RNA, 17 nt, Mycobacterium bovis subsp bovis AF2122/97
ccucggucagcggggug

SEQ ID NO: 1075163 - RNA, 17 nt, Mycobacterium bovis subsp bovis AF2122/97
ccucgggcaggcggcca

SEQ ID NO: 1075164 - RNA, 23 nt, Mycobacterium bovis subsp bovis AF2122/97
ccucggcgacgaugucgagcgcg

SEQ ID NO: 1075165 - RNA, 19 nt, Mycobacterium bovis subsp bovis AF2122/97
ccucggcgaccgcgucguc

SEQ ID NO: 1075166 - RNA, 22 nt, Mycobacterium bovis subsp bovis AF2122/97
ccucggcgaccaucugaucggg

SEQ ID NO: 1075167 - RNA, 22 nt, Mycobacterium bovis subsp bovis AF2122/97
ccucggagaucgagaucaccuu

SEQ ID NO: 1075168 - RNA, 21 nt, Mycobacterium bovis subsp bovis AF2122/97
ccucgcugucgaucagcgacc

SEQ ID NO: 1075169 - RNA, 18 nt, Mycobacterium bovis subsp bovis AF2122/97
ccucggacugcagcgcgg

SEQ ID NO: 1075170 - RNA, 20 nt, Mycobacterium bovis subsp bovis AF2122/97
ccucgcguagggccagcgcc

SEQ ID NO: 1075171 - RNA, 17 nt, Mycobacterium bovis subsp bovis AF2122/97
ccucgcuaauugcggcc

SEQ ID NO: 1075172 - RNA, 19 nt, Mycobacterium bovis subsp bovis AF2122/97
ccucgcucuccauggccga

SEQ ID NO: 1075173 - RNA, 20 nt, Mycobacterium bovis subsp bovis AF2122/97
ccucgaaggcacugcgaucg

SEQ ID NO: 1075174 - RNA, 20 nt, Mycobacterium bovis subsp bovis AF2122/97
ccucgaaggcuucgcuggcu

SEQ ID NO: 1075175 - RNA, 13 nt, Mycobacterium bovis subsp bovis AF2122/97
ccucgacagcggc

SEQ ID NO: 1075176 - RNA, 17 nt, Mycobacterium bovis subsp bovis AF2122/97
ccucgaauucggccggc

SEQ ID NO: 1075177 - RNA, 19 nt, Mycobacterium bovis subsp bovis AF2122/97
ccuccgucagcgccgcgcg

SEQ ID NO: 1075178 - RNA, 23 nt, Mycobacterium bovis subsp bovis AF2122/97
ccuccggugcauauuggaucguc

SEQ ID NO: 1075179 - RNA, 21 nt, Mycobacterium bovis subsp bovis AF2122/97
ccuccggguauggcggcgacg

SEQ ID NO: 1075180 - RNA, 15 nt, Mycobacterium bovis subsp bovis AF2122/97
ccuccggguuggcga

SEQ ID NO: 1075181 - RNA, 20 nt, Mycobacterium bovis subsp bovis AF2122/97
ccuccggguuggcgacgauc

SEQ ID NO: 1075182 - RNA, 20 nt, Mycobacterium bovis subsp bovis AF2122/97
ccuccuccguuuggcugccg

SEQ ID NO: 1075183 - RNA, 13 nt, Mycobacterium bovis subsp bovis AF2122/97
ccuccucgacguc

SEQ ID NO: 1075184 - RNA, 17 nt, Mycobacterium bovis subsp bovis AF2122/97
ccuccucgagcaggaug

SEQ ID NO: 1075185 - RNA, 12 nt, Mycobacterium bovis subsp bovis AF2122/97
ccuccucgauag

SEQ ID NO: 1075186 - RNA, 19 nt, Mycobacterium bovis subsp bovis AF2122/97
ccuccucgauagcggcgcc

SEQ ID NO: 1075187 - RNA, 15 nt, Mycobacterium bovis subsp bovis AF2122/97
ccuccggcagcagca

SEQ ID NO: 1075188 - RNA, 17 nt, Mycobacterium bovis subsp bovis AF2122/97
ccuccggcaccaacgcc

SEQ ID NO: 1075189 - RNA, 20 nt, Mycobacterium bovis subsp bovis AF2122/97
ccuccggcaccuccagcacc

SEQ ID NO: 1075190 - RNA, 17 nt, Mycobacterium bovis subsp bovis AF2122/97
ccuccggcgcagcgacc

SEQ ID NO: 1075191 - RNA, 20 nt, Mycobacterium bovis subsp bovis AF2122/97
ccuccggcgcagcgaccggu

SEQ ID NO: 1075192 - RNA, 17 nt, Mycobacterium bovis subsp bovis AF2122/97
ccuccgcgccgaucagc

SEQ ID NO: 1075193 - RNA, 23 nt, Mycobacterium bovis subsp bovis AF2122/97
ccuccgcucacggauucgggcga

SEQ ID NO: 1075194 - RNA, 17 nt, Mycobacterium bovis subsp bovis AF2122/97
ccuccggaaucgcccgg

SEQ ID NO: 1075195 - RNA, 16 nt, Mycobacterium bovis subsp bovis AF2122/97
ccuccggacccacccg

SEQ ID NO: 1075196 - RNA, 17 nt, Mycobacterium bovis subsp bovis AF2122/97
ccuccgccgaggccgcc

SEQ ID NO: 1075197 - RNA, 14 nt, Mycobacterium bovis subsp bovis AF2122/97
ccuccgcaaucgcg

SEQ ID NO: 1075198 - RNA, 21 nt, Mycobacterium bovis subsp bovis AF2122/97
ccucaucguuccacgagucgu

SEQ ID NO: 1075199 - RNA, 16 nt, Mycobacterium bovis subsp bovis AF2122/97
ccucaucgcggucgcc

SEQ ID NO: 1075200 - RNA, 21 nt, Mycobacterium bovis subsp bovis AF2122/97
ccucaucgcggucgccaccgu

SEQ ID NO: 1075201 - RNA, 15 nt, Mycobacterium bovis subsp bovis AF2122/97
ccucaucggcaccgu

SEQ ID NO: 1075202 - RNA, 15 nt, Mycobacterium bovis subsp bovis AF2122/97
ccucaucgagcgcgc

SEQ ID NO: 1075203 - RNA, 19 nt, Mycobacterium bovis subsp bovis AF2122/97
ccucaucgagcgcgcgacg

SEQ ID NO: 1075204 - RNA, 17 nt, Mycobacterium bovis subsp bovis AF2122/97
ccucauagagcggcacc

SEQ ID NO: 1075205 - RNA, 22 nt, Mycobacterium bovis subsp bovis AF2122/97
ccucaguacagcgcguuggcga

SEQ ID NO: 1075206 - RNA, 23 nt, Mycobacterium bovis subsp bovis AF2122/97
ccucaguguacaccgcgcccgcc

SEQ ID NO: 1075207 - RNA, 20 nt, Mycobacterium bovis subsp bovis AF2122/97
ccucaguucacguucggcga

SEQ ID NO: 1075208 - RNA, 22 nt, Mycobacterium bovis subsp bovis AF2122/97
ccucaguucacguucggcgacg

SEQ ID NO: 1075209 - RNA, 17 nt, Mycobacterium bovis subsp bovis AF2122/97
ccucaacgaucgcgccg

SEQ ID NO: 1075210 - RNA, 13 nt, Mycobacterium bovis subsp bovis AF2122/97
ccucaacggcggc

SEQ ID NO: 1075211 - RNA, 16 nt, Mycobacterium bovis subsp bovis AF2122/97
ccucaacggcggcaac

SEQ ID NO: 1075212 - RNA, 17 nt, Mycobacterium bovis subsp bovis AF2122/97
ccucaauuggcucggcg

SEQ ID NO: 1075213 - RNA, 17 nt, Mycobacterium bovis subsp bovis AF2122/97
ccucaaugaccaccggg

SEQ ID NO: 1075214 - RNA, 20 nt, Mycobacterium bovis subsp bovis AF2122/97
ccucaaugaccaccgggcgc

SEQ ID NO: 1075215 - RNA, 20 nt, Mycobacterium bovis subsp bovis AF2122/97
ccucaaguugguucaccgcg

SEQ ID NO: 1075216 - RNA, 21 nt, Mycobacterium bovis subsp bovis AF2122/97
ccucaaguugguucaccgcga

SEQ ID NO: 1075217 - RNA, 17 nt, Mycobacterium bovis subsp bovis AF2122/97
ccuaucguuaucgacac

SEQ ID NO: 1075218 - RNA, 19 nt, Mycobacterium bovis subsp bovis AF2122/97
ccuaucguuaucgacacca

SEQ ID NO: 1075219 - RNA, 17 nt, Mycobacterium bovis subsp bovis AF2122/97
ccuauggucaaccgcgc

SEQ ID NO: 1075220 - RNA, 18 nt, Mycobacterium bovis subsp bovis AF2122/97
ccuauggucaaccgcgcc

SEQ ID NO: 1075221 - RNA, 17 nt, Mycobacterium bovis subsp bovis AF2122/97
ccuagggcggcggcgcg

SEQ ID NO: 1075222 - RNA, 16 nt, Mycobacterium bovis subsp bovis AF2122/97
ccuagcuggugcgccc

SEQ ID NO: 1075223 - RNA, 14 nt, Mycobacterium bovis subsp bovis AF2122/97
ccuaggacaccggc

SEQ ID NO: 1075224 - RNA, 21 nt, Mycobacterium bovis subsp bovis AF2122/97
ccuagcgcaugucgauccggc

SEQ ID NO: 1075225 - RNA, 18 nt, Mycobacterium bovis subsp bovis AF2122/97
ccuagcgcgggcucggug

SEQ ID NO: 1075226 - RNA, 23 nt, Mycobacterium bovis subsp bovis AF2122/97
ccuagugccaggaucgcggcgcc

SEQ ID NO: 1075227 - RNA, 18 nt, Mycobacterium bovis subsp bovis AF2122/97
ccuagguagucggccucc

SEQ ID NO: 1075228 - RNA, 20 nt, Mycobacterium bovis subsp bovis AF2122/97
ccuagguucgcccagcccga

SEQ ID NO: 1075229 - RNA, 18 nt, Mycobacterium bovis subsp bovis AF2122/97
ccuaguccuggcucggca

SEQ ID NO: 1075230 - RNA, 20 nt, Mycobacterium bovis subsp bovis AF2122/97
ccggcgcguaguaaugcucg

SEQ ID NO: 1075231 - RNA, 16 nt, Mycobacterium bovis subsp bovis AF2122/97
ccggcgcuagcgccgc

SEQ ID NO: 1075232 - RNA, 18 nt, Mycobacterium bovis subsp bovis AF2122/97
ccggcgcuagcgccgcgc

SEQ ID NO: 1075233 - RNA, 18 nt, Mycobacterium bovis subsp bovis AF2122/97
ccggcgcuccacugacca

SEQ ID NO: 1075234 - RNA, 13 nt, Mycobacterium bovis subsp bovis AF2122/97
ccggcgcuccgcc

SEQ ID NO: 1075235 - RNA, 18 nt, Mycobacterium bovis subsp bovis AF2122/97
ccggcgcuccgccagaau

SEQ ID NO: 1075236 - RNA, 13 nt, Mycobacterium bovis subsp bovis AF2122/97
ccggcgcucgcgg

SEQ ID NO: 1075237 - RNA, 16 nt, Mycobacterium bovis subsp bovis AF2122/97
ccggcgcucgcggcgg

SEQ ID NO: 1075238 - RNA, 20 nt, Mycobacterium bovis subsp bovis AF2122/97
ccggcgcugcugccauugcc

SEQ ID NO: 1075239 - RNA, 12 nt, Mycobacterium bovis subsp bovis AF2122/97
ccggcgcugccc

SEQ ID NO: 1075240 - RNA, 18 nt, Mycobacterium bovis subsp bovis AF2122/97
ccggcgcuggcguggcca

SEQ ID NO: 1075241 - RNA, 18 nt, Mycobacterium bovis subsp bovis AF2122/97
ccggcgcuggugcgccac

SEQ ID NO: 1075242 - RNA, 23 nt, Mycobacterium bovis subsp bovis AF2122/97
ccggcggaaauggcgucgccggc

SEQ ID NO: 1075243 - RNA, 16 nt, Mycobacterium bovis subsp bovis AF2122/97
ccggcgcuuccgcugg

SEQ ID NO: 1075244 - RNA, 18 nt, Mycobacterium bovis subsp bovis AF2122/97
ccggcgcuuccgcugggu

SEQ ID NO: 1075245 - RNA, 16 nt, Mycobacterium bovis subsp bovis AF2122/97
ccggcgcugcccgggc

SEQ ID NO: 1075246 - RNA, 18 nt, Mycobacterium bovis subsp bovis AF2122/97
ccggcggacaccucgggc

SEQ ID NO: 1075247 - RNA, 17 nt, Mycobacterium bovis subsp bovis AF2122/97
ccggcggacccucgccg

SEQ ID NO: 1075248 - RNA, 18 nt, Mycobacterium bovis subsp bovis AF2122/97
ccggcggacgcccggcgc

SEQ ID NO: 1075249 - RNA, 21 nt, Mycobacterium bovis subsp bovis AF2122/97
ccggcggacgugaccagaucg

SEQ ID NO: 1075250 - RNA, 19 nt, Mycobacterium bovis subsp bovis AF2122/97
ccggcggagcgggccagca

SEQ ID NO: 1075251 - RNA, 21 nt, Mycobacterium bovis subsp bovis AF2122/97
ccggcggagcgggccagcacc

SEQ ID NO: 1075252 - RNA, 17 nt, Mycobacterium bovis subsp bovis AF2122/97
ccggcggaucugaucgg

SEQ ID NO: 1075253 - RNA, 13 nt, Mycobacterium bovis subsp bovis AF2122/97
ccggcggaucugg

SEQ ID NO: 1075254 - RNA, 21 nt, Mycobacterium bovis subsp bovis AF2122/97
ccggcggcaaacacugcggcc

SEQ ID NO: 1075255 - RNA, 22 nt, Mycobacterium bovis subsp bovis AF2122/97
ccggcggcaaagaacagccggc

SEQ ID NO: 1075256 - RNA, 17 nt, Mycobacterium bovis subsp bovis AF2122/97
ccggcggcagcggcgcc

SEQ ID NO: 1075257 - RNA, 23 nt, Mycobacterium bovis subsp bovis AF2122/97
ccggcggcagcggcgccgccugg

SEQ ID NO: 1075258 - RNA, 21 nt, Mycobacterium bovis subsp bovis AF2122/97
ccggcggcaucgaguucggcc

SEQ ID NO: 1075259 - RNA, 12 nt, Mycobacterium bovis subsp bovis AF2122/97
ccggcggcaggu

SEQ ID NO: 1075260 - RNA, 11 nt, Mycobacterium bovis subsp bovis AF2122/97
ccggcggccaa

SEQ ID NO: 1075261 - RNA, 12 nt, Mycobacterium bovis subsp bovis AF2122/97
ccggcggccgcc

SEQ ID NO: 1075262 - RNA, 13 nt, Mycobacterium bovis subsp bovis AF2122/97
ccggcggcccgcu

SEQ ID NO: 1075263 - RNA, 14 nt, Mycobacterium bovis subsp bovis AF2122/97
ccggcggcccgcuc

SEQ ID NO: 1075264 - RNA, 16 nt, Mycobacterium bovis subsp bovis AF2122/97
ccggcggcccgcucga

SEQ ID NO: 1075265 - RNA, 16 nt, Mycobacterium bovis subsp bovis AF2122/97
ccggcgcgcagccggg

SEQ ID NO: 1075266 - RNA, 20 nt, Mycobacterium bovis subsp bovis AF2122/97
ccggcgcgauccccgcgcug

SEQ ID NO: 1075267 - RNA, 14 nt, Mycobacterium bovis subsp bovis AF2122/97
ccggcgccuugguc

SEQ ID NO: 1075268 - RNA, 15 nt, Mycobacterium bovis subsp bovis AF2122/97
ccggcgccuuggucg

SEQ ID NO: 1075269 - RNA, 15 nt, Mycobacterium bovis subsp bovis AF2122/97
ccggcgcgcaccccg

SEQ ID NO: 1075270 - RNA, 14 nt, Mycobacterium bovis subsp bovis AF2122/97
ccggcgcgccccac

SEQ ID NO: 1075271 - RNA, 17 nt, Mycobacterium bovis subsp bovis AF2122/97
ccggcgcgccccaccgc

SEQ ID NO: 1075272 - RNA, 18 nt, Mycobacterium bovis subsp bovis AF2122/97
ccggcgcgccccaccgcg

SEQ ID NO: 1075273 - RNA, 21 nt, Mycobacterium bovis subsp bovis AF2122/97
ccggcgcgccccaccgcgccg

SEQ ID NO: 1075274 - RNA, 22 nt, Mycobacterium bovis subsp bovis AF2122/97
ccggcgcgccccaccgcgccga

SEQ ID NO: 1075275 - RNA, 17 nt, Mycobacterium bovis subsp bovis AF2122/97
ccggcgcgccccgccgc

SEQ ID NO: 1075276 - RNA, 20 nt, Mycobacterium bovis subsp bovis AF2122/97
ccggcgcgccaaacaccccg

SEQ ID NO: 1075277 - RNA, 12 nt, Mycobacterium bovis subsp bovis AF2122/97
ccggcgcgccgg

SEQ ID NO: 1075278 - RNA, 17 nt, Mycobacterium bovis subsp bovis AF2122/97
ccggcgcgccgggcggc

SEQ ID NO: 1075279 - RNA, 21 nt, Mycobacterium bovis subsp bovis AF2122/97
ccggcgcggagugcccagggc

SEQ ID NO: 1075280 - RNA, 23 nt, Mycobacterium bovis subsp bovis AF2122/97
ccggcgcggagugcccagggccg

SEQ ID NO: 1075281 - RNA, 14 nt, Mycobacterium bovis subsp bovis AF2122/97
ccggcgcggccgca

SEQ ID NO: 1075282 - RNA, 14 nt, Mycobacterium bovis subsp bovis AF2122/97
ccggcgcggccggc

SEQ ID NO: 1075283 - RNA, 16 nt, Mycobacterium bovis subsp bovis AF2122/97
ccggcgcggccggccg

SEQ ID NO: 1075284 - RNA, 17 nt, Mycobacterium bovis subsp bovis AF2122/97
ccggcgcggccggccgc

SEQ ID NO: 1075285 - RNA, 20 nt, Mycobacterium bovis subsp bovis AF2122/97
ccggcgcggccggccgcuca

SEQ ID NO: 1075286 - RNA, 16 nt, Mycobacterium bovis subsp bovis AF2122/97
ccggcgcggcggcguc

SEQ ID NO: 1075287 - RNA, 14 nt, Mycobacterium bovis subsp bovis AF2122/97
ccggcgcggcggac

SEQ ID NO: 1075288 - RNA, 22 nt, Mycobacterium bovis subsp bovis AF2122/97
ccggcgcgggcacgcccucguc

SEQ ID NO: 1075289 - RNA, 18 nt, Mycobacterium bovis subsp bovis AF2122/97
ccggcgcggcggcgucga

SEQ ID NO: 1075290 - RNA, 13 nt, Mycobacterium bovis subsp bovis AF2122/97
ccggcgcggcgua

SEQ ID NO: 1075291 - RNA, 13 nt, Mycobacterium bovis subsp bovis AF2122/97
ccggcgcgguggc

SEQ ID NO: 1075292 - RNA, 21 nt, Mycobacterium bovis subsp bovis AF2122/97
ccggcgcgguggccccgaugg

SEQ ID NO: 1075293 - RNA, 15 nt, Mycobacterium bovis subsp bovis AF2122/97
ccggcgcccaggccg

SEQ ID NO: 1075294 - RNA, 16 nt, Mycobacterium bovis subsp bovis AF2122/97
ccggcgcccaggccga

SEQ ID NO: 1075295 - RNA, 20 nt, Mycobacterium bovis subsp bovis AF2122/97
ccggcgccagcgccgccacc

SEQ ID NO: 1075296 - RNA, 13 nt, Mycobacterium bovis subsp bovis AF2122/97
ccggcgcccgccg

SEQ ID NO: 1075297 - RNA, 14 nt, Mycobacterium bovis subsp bovis AF2122/97
ccggcgcccgccgc

SEQ ID NO: 1075298 - RNA, 13 nt, Mycobacterium bovis subsp bovis AF2122/97
ccggcgcccagcg

SEQ ID NO: 1075299 - RNA, 17 nt, Mycobacterium bovis subsp bovis AF2122/97
ccggcgcccagcgccuc

SEQ ID NO: 1075300 - RNA, 16 nt, Mycobacterium bovis subsp bovis AF2122/97
ccggcgcccggggcgg

SEQ ID NO: 1075301 - RNA, 19 nt, Mycobacterium bovis subsp bovis AF2122/97
ccggcgcccggggcggugg

SEQ ID NO: 1075302 - RNA, 13 nt, Mycobacterium bovis subsp bovis AF2122/97
ccggcgcccgggu

SEQ ID NO: 1075303 - RNA, 13 nt, Mycobacterium bovis subsp bovis AF2122/97
ccggcgccgccac

SEQ ID NO: 1075304 - RNA, 20 nt, Mycobacterium bovis subsp bovis AF2122/97
ccggcgccgccacugccggc

SEQ ID NO: 1075305 - RNA, 21 nt, Mycobacterium bovis subsp bovis AF2122/97
ccggcgccgccacugccggca

SEQ ID NO: 1075306 - RNA, 18 nt, Mycobacterium bovis subsp bovis AF2122/97
ccggcgccgccagcacca

SEQ ID NO: 1075307 - RNA, 21 nt, Mycobacterium bovis subsp bovis AF2122/97
ccggcgccgccagcaccaccg

SEQ ID NO: 1075308 - RNA, 20 nt, Mycobacterium bovis subsp bovis AF2122/97
ccggcgccgccauugucgcc

SEQ ID NO: 1075309 - RNA, 17 nt, Mycobacterium bovis subsp bovis AF2122/97
ccggcgccgccggcacc

SEQ ID NO: 1075310 - RNA, 20 nt, Mycobacterium bovis subsp bovis AF2122/97
ccggcgccgccggcaccggg

SEQ ID NO: 1075311 - RNA, 14 nt, Mycobacterium bovis subsp bovis AF2122/97
ccggcgccgcccgc

SEQ ID NO: 1075312 - RNA, 23 nt, Mycobacterium bovis subsp bovis AF2122/97
ccggcgccgcccuugccgccggc

SEQ ID NO: 1075313 - RNA, 17 nt, Mycobacterium bovis subsp bovis AF2122/97
ccggcgccgccggugcc

SEQ ID NO: 1075314 - RNA, 19 nt, Mycobacterium bovis subsp bovis AF2122/97
ccggcgccgccggcgccgc

SEQ ID NO: 1075315 - RNA, 21 nt, Mycobacterium bovis subsp bovis AF2122/97
ccggcgccgccggcgccgccc

SEQ ID NO: 1075316 - RNA, 14 nt, Mycobacterium bovis subsp bovis AF2122/97
ccggcgccgccguc

SEQ ID NO: 1075317 - RNA, 17 nt, Mycobacterium bovis subsp bovis AF2122/97
ccggcgccgccgucgcc

SEQ ID NO: 1075318 - RNA, 17 nt, Mycobacterium bovis subsp bovis AF2122/97
ccggcgccgccgugcgg

SEQ ID NO: 1075319 - RNA, 21 nt, Mycobacterium bovis subsp bovis AF2122/97
ccggcgccgccguuaccgccg

SEQ ID NO: 1075320 - RNA, 17 nt, Mycobacterium bovis subsp bovis AF2122/97
ccggcgccggagccgcc

SEQ ID NO: 1075321 - RNA, 23 nt, Mycobacterium bovis subsp bovis AF2122/97
ccggcgccggaguugaagaagcc

SEQ ID NO: 1075322 - RNA, 14 nt, Mycobacterium bovis subsp bovis AF2122/97
ccggcgccgcgcgg

SEQ ID NO: 1075323 - RNA, 12 nt, Mycobacterium bovis subsp bovis AF2122/97
ccggcgccgcgc

SEQ ID NO: 1075324 - RNA, 16 nt, Mycobacterium bovis subsp bovis AF2122/97
ccggcgccggcuugga

SEQ ID NO: 1075325 - RNA, 23 nt, Mycobacterium bovis subsp bovis AF2122/97
ccggcgccucaucggacagcgcc

SEQ ID NO: 1075326 - RNA, 17 nt, Mycobacterium bovis subsp bovis AF2122/97
ccggcgccuccggcacc

SEQ ID NO: 1075327 - RNA, 13 nt, Mycobacterium bovis subsp bovis AF2122/97
ccggcgccguagc

SEQ ID NO: 1075328 - RNA, 17 nt, Mycobacterium bovis subsp bovis AF2122/97
ccggcgcagcgaccggu

SEQ ID NO: 1075329 - RNA, 16 nt, Mycobacterium bovis subsp bovis AF2122/97
ccggcgcaagcgccgc

SEQ ID NO: 1075330 - RNA, 20 nt, Mycobacterium bovis subsp bovis AF2122/97
ccggcgcacgaaaccgcagc

SEQ ID NO: 1075331 - RNA, 16 nt, Mycobacterium bovis subsp bovis AF2122/97
ccggcgcagcugccga

SEQ ID NO: 1075332 - RNA, 23 nt, Mycobacterium bovis subsp bovis AF2122/97
ccggcgcagguucucggugccga

SEQ ID NO: 1075333 - RNA, 14 nt, Mycobacterium bovis subsp bovis AF2122/97
ccggcgcagugcag

SEQ ID NO: 1075334 - RNA, 18 nt, Mycobacterium bovis subsp bovis AF2122/97
ccggcgcagugcgacucu

SEQ ID NO: 1075335 - RNA, 22 nt, Mycobacterium bovis subsp bovis AF2122/97
ccggcgcaguagccgaccagga

SEQ ID NO: 1075336 - RNA, 18 nt, Mycobacterium bovis subsp bovis AF2122/97
ccggcgccacccgcgccg

SEQ ID NO: 1075337 - RNA, 23 nt, Mycobacterium bovis subsp bovis AF2122/97
ccggcgccacccgcgccgcccgc

SEQ ID NO: 1075338 - RNA, 13 nt, Mycobacterium bovis subsp bovis AF2122/97
ccggcgccaccgc

SEQ ID NO: 1075339 - RNA, 16 nt, Mycobacterium bovis subsp bovis AF2122/97
ccggcgccaccgccgc

SEQ ID NO: 1075340 - RNA, 21 nt, Mycobacterium bovis subsp bovis AF2122/97
ccggcgccaccgccgcugccg

SEQ ID NO: 1075341 - RNA, 14 nt, Mycobacterium bovis subsp bovis AF2122/97
ccggcgccaccggc

SEQ ID NO: 1075342 - RNA, 15 nt, Mycobacterium bovis subsp bovis AF2122/97
ccggcgccaccggcg

SEQ ID NO: 1075343 - RNA, 19 nt, Mycobacterium bovis subsp bovis AF2122/97
ccggcgccaccggcgccgc

SEQ ID NO: 1075344 - RNA, 21 nt, Mycobacterium bovis subsp bovis AF2122/97
ccggcgccaccggcgccgccc

SEQ ID NO: 1075345 - RNA, 17 nt, Mycobacterium bovis subsp bovis AF2122/97
ccggcgccaccgucacc

SEQ ID NO: 1075346 - RNA, 18 nt, Mycobacterium bovis subsp bovis AF2122/97
ccggcgaaguuggugaca

SEQ ID NO: 1075347 - RNA, 24 nt, Mycobacterium bovis subsp bovis AF2122/97
ccggcgcauucccuugucggucga

SEQ ID NO: 1075348 - RNA, 16 nt, Mycobacterium bovis subsp bovis AF2122/97
ccggcgccacccccac

SEQ ID NO: 1075349 - RNA, 22 nt, Mycobacterium bovis subsp bovis AF2122/97
ccggcgccacccccaccgucgc

SEQ ID NO: 1075350 - RNA, 21 nt, Mycobacterium bovis subsp bovis AF2122/97
ccggcgcaccggagucgcccg

SEQ ID NO: 1075351 - RNA, 14 nt, Mycobacterium bovis subsp bovis AF2122/97
ccggcgcaccgucg

SEQ ID NO: 1075352 - RNA, 22 nt, Mycobacterium bovis subsp bovis AF2122/97
ccggcgcaccugggcugccggc

SEQ ID NO: 1075353 - RNA, 22 nt, Mycobacterium bovis subsp bovis AF2122/97
ccggcgaacugcgaucggccgc

SEQ ID NO: 1075354 - RNA, 17 nt, Mycobacterium bovis subsp bovis AF2122/97
ccggcgaacucgcgccg

SEQ ID NO: 1075355 - RNA, 18 nt, Mycobacterium bovis subsp bovis AF2122/97
ccggcgaacucgcgccga

SEQ ID NO: 1075356 - RNA, 12 nt, Mycobacterium bovis subsp bovis AF2122/97
ccggccugcacg

SEQ ID NO: 1075357 - RNA, 15 nt, Mycobacterium bovis subsp bovis AF2122/97
ccggccugcacggcg

SEQ ID NO: 1075358 - RNA, 13 nt, Mycobacterium bovis subsp bovis AF2122/97
ccggccucggcga

SEQ ID NO: 1075359 - RNA, 14 nt, Mycobacterium bovis subsp bovis AF2122/97
ccggccuuggcggc

SEQ ID NO: 1075360 - RNA, 20 nt, Mycobacterium bovis subsp bovis AF2122/97
ccggcgaaaagacugcgccg

SEQ ID NO: 1075361 - RNA, 22 nt, Mycobacterium bovis subsp bovis AF2122/97
ccggcgaaaagacugcgccgcc

SEQ ID NO: 1075362 - RNA, 18 nt, Mycobacterium bovis subsp bovis AF2122/97
ccgcuugacgcagcucgu

SEQ ID NO: 1075363 - RNA, 22 nt, Mycobacterium bovis subsp bovis AF2122/97
ccgcuugaucugggcugcggcc

SEQ ID NO: 1075364 - RNA, 17 nt, Mycobacterium bovis subsp bovis AF2122/97
ccgcuugcccgcgcagc

SEQ ID NO: 1075365 - RNA, 19 nt, Mycobacterium bovis subsp bovis AF2122/97
ccgcuugcccgcgcagcac

SEQ ID NO: 1075366 - RNA, 15 nt, Mycobacterium bovis subsp bovis AF2122/97
ccgcuuguccaccgu

SEQ ID NO: 1075367 - RNA, 14 nt, Mycobacterium bovis subsp bovis AF2122/97
ccgcuuggcccggc

SEQ ID NO: 1075368 - RNA, 16 nt, Mycobacterium bovis subsp bovis AF2122/97
ccgcuuggcccggcaa

SEQ ID NO: 1075369 - RNA, 16 nt, Mycobacterium bovis subsp bovis AF2122/97
ccgcuuggccgcugcc

SEQ ID NO: 1075370 - RNA, 16 nt, Mycobacterium bovis subsp bovis AF2122/97
ccgcuuugcgcgguca

SEQ ID NO: 1075371 - RNA, 19 nt, Mycobacterium bovis subsp bovis AF2122/97
ccgcuuguccaccgugcgg

SEQ ID NO: 1075372 - RNA, 23 nt, Mycobacterium bovis subsp bovis AF2122/97
ccgcuuucggaaaaccgcaccgu

SEQ ID NO: 1075373 - RNA, 18 nt, Mycobacterium bovis subsp bovis AF2122/97
ccgcuuucuuggcgggcg

SEQ ID NO: 1075374 - RNA, 20 nt, Mycobacterium bovis subsp bovis AF2122/97
ccgcuuucuuggcgggcgcc

SEQ ID NO: 1075375 - RNA, 16 nt, Mycobacterium bovis subsp bovis AF2122/97
ccggaaacgccagggg

SEQ ID NO: 1075376 - RNA, 22 nt, Mycobacterium bovis subsp bovis AF2122/97
ccggcaucuccaccgucgccgc

SEQ ID NO: 1075377 - RNA, 23 nt, Mycobacterium bovis subsp bovis AF2122/97
ccggcaucuccaccgucgccgcc

SEQ ID NO: 1075378 - RNA, 15 nt, Mycobacterium bovis subsp bovis AF2122/97
ccggcaugccagcca

SEQ ID NO: 1075379 - RNA, 17 nt, Mycobacterium bovis subsp bovis AF2122/97
ccggcaugcgugccggc

SEQ ID NO: 1075380 - RNA, 21 nt, Mycobacterium bovis subsp bovis AF2122/97
ccggcauuaggccggggucga

SEQ ID NO: 1075381 - RNA, 13 nt, Mycobacterium bovis subsp bovis AF2122/97
ccggcaugcccgc

SEQ ID NO: 1075382 - RNA, 24 nt, Mycobacterium bovis subsp bovis AF2122/97
ccggcaugcuggcgaucgcgacga

SEQ ID NO: 1075383 - RNA, 22 nt, Mycobacterium bovis subsp bovis AF2122/97
ccggcauuccguaggccacagc

SEQ ID NO: 1075384 - RNA, 14 nt, Mycobacterium bovis subsp bovis AF2122/97
ccggcauugaccca

SEQ ID NO: 1075385 - RNA, 15 nt, Mycobacterium bovis subsp bovis AF2122/97
ccggcauugagccgg

SEQ ID NO: 1075386 - RNA, 16 nt, Mycobacterium bovis subsp bovis AF2122/97
ccggccaccaccgcgc

SEQ ID NO: 1075387 - RNA, 17 nt, Mycobacterium bovis subsp bovis AF2122/97
ccggccaccaccgcgcc

SEQ ID NO: 1075388 - RNA, 19 nt, Mycobacterium bovis subsp bovis AF2122/97
ccggccaauggccugcagc

SEQ ID NO: 1075389 - RNA, 21 nt, Mycobacterium bovis subsp bovis AF2122/97
ccggccacaggaagcgaccgu

SEQ ID NO: 1075390 - RNA, 16 nt, Mycobacterium bovis subsp bovis AF2122/97
ccggcauugccgccgu

SEQ ID NO: 1075391 - RNA, 19 nt, Mycobacterium bovis subsp bovis AF2122/97
ccggcauugccgccguugc

SEQ ID NO: 1075392 - RNA, 23 nt, Mycobacterium bovis subsp bovis AF2122/97
ccggccaacagucgcagcacggc

SEQ ID NO: 1075393 - RNA, 14 nt, Mycobacterium bovis subsp bovis AF2122/97
ccggccaacgccgc

SEQ ID NO: 1075394 - RNA, 24 nt, Mycobacterium bovis subsp bovis AF2122/97
ccggccaacugggccgagcgcgcc

SEQ ID NO: 1075395 - RNA, 14 nt, Mycobacterium bovis subsp bovis AF2122/97
ccggccaccagggc

SEQ ID NO: 1075396 - RNA, 16 nt, Mycobacterium bovis subsp bovis AF2122/97
ccggccaccagggcca

SEQ ID NO: 1075397 - RNA, 18 nt, Mycobacterium bovis subsp bovis AF2122/97
ccggccaccagggccacc

SEQ ID NO: 1075398 - RNA, 18 nt, Mycobacterium bovis subsp bovis AF2122/97
ccggccaccaccgcgccg

SEQ ID NO: 1075399 - RNA, 19 nt, Mycobacterium bovis subsp bovis AF2122/97
ccggccaccaccgcgccgu

SEQ ID NO: 1075400 - RNA, 20 nt, Mycobacterium bovis subsp bovis AF2122/97
ccggccaccagcaugccugc

SEQ ID NO: 1075401 - RNA, 13 nt, Mycobacterium bovis subsp bovis AF2122/97
ccggccaccagcc

SEQ ID NO: 1075402 - RNA, 14 nt, Mycobacterium bovis subsp bovis AF2122/97
ccggccaccagccc

SEQ ID NO: 1075403 - RNA, 15 nt, Mycobacterium bovis subsp bovis AF2122/97
ccggccaccagcccg

SEQ ID NO: 1075404 - RNA, 22 nt, Mycobacterium bovis subsp bovis AF2122/97
ccggccacgauaaaugcuucga

SEQ ID NO: 1075405 - RNA, 21 nt, Mycobacterium bovis subsp bovis AF2122/97
ccggccacucaacgaccuggg

SEQ ID NO: 1075406 - RNA, 22 nt, Mycobacterium bovis subsp bovis AF2122/97
ccggccacuccaguacgguccg

SEQ ID NO: 1075407 - RNA, 19 nt, Mycobacterium bovis subsp bovis AF2122/97
ccggccacuccaugagccg

SEQ ID NO: 1075408 - RNA, 19 nt, Mycobacterium bovis subsp bovis AF2122/97
ccggccagacccuggccgu

SEQ ID NO: 1075409 - RNA, 22 nt, Mycobacterium bovis subsp bovis AF2122/97
ccggccagacccuggccguccc

SEQ ID NO: 1075410 - RNA, 20 nt, Mycobacterium bovis subsp bovis AF2122/97
ccggccagacggugcagcuc

SEQ ID NO: 1075411 - RNA, 19 nt, Mycobacterium bovis subsp bovis AF2122/97
ccggccagacucgcggucg

SEQ ID NO: 1075412 - RNA, 14 nt, Mycobacterium bovis subsp bovis AF2122/97
ccggccagcacucc

SEQ ID NO: 1075413 - RNA, 22 nt, Mycobacterium bovis subsp bovis AF2122/97
ccggccagccauggcagcgccg

SEQ ID NO: 1075414 - RNA, 13 nt, Mycobacterium bovis subsp bovis AF2122/97
ccggccagccgac

SEQ ID NO: 1075415 - RNA, 13 nt, Mycobacterium bovis subsp bovis AF2122/97
ccggccagccagc

SEQ ID NO: 1075416 - RNA, 18 nt, Mycobacterium bovis subsp bovis AF2122/97
ccggccagccagcgaucc

SEQ ID NO: 1075417 - RNA, 16 nt, Mycobacterium bovis subsp bovis AF2122/97
ccggccagcggcccgu

SEQ ID NO: 1075418 - RNA, 14 nt, Mycobacterium bovis subsp bovis AF2122/97
ccggccgcgcagau

SEQ ID NO: 1075419 - RNA, 16 nt, Mycobacterium bovis subsp bovis AF2122/97
ccggccgcgaccgcga

SEQ ID NO: 1075420 - RNA, 12 nt, Mycobacterium bovis subsp bovis AF2122/97
ccggccgcgacg

SEQ ID NO: 1075421 - RNA, 22 nt, Mycobacterium bovis subsp bovis AF2122/97
ccggccgcgcacccguccgccg

SEQ ID NO: 1075422 - RNA, 14 nt, Mycobacterium bovis subsp bovis AF2122/97
ccggccgagcgcac

SEQ ID NO: 1075423 - RNA, 14 nt, Mycobacterium bovis subsp bovis AF2122/97
ccggccgacccgga

SEQ ID NO: 1075424 - RNA, 16 nt, Mycobacterium bovis subsp bovis AF2122/97
ccggccgcgccggccc

SEQ ID NO: 1075425 - RNA, 14 nt, Mycobacterium bovis subsp bovis AF2122/97
ccggccgcgugacg

SEQ ID NO: 1075426 - RNA, 15 nt, Mycobacterium bovis subsp bovis AF2122/97
ccggccgcggcgccu

SEQ ID NO: 1075427 - RNA, 15 nt, Mycobacterium bovis subsp bovis AF2122/97
ccggccgcggcggcc

SEQ ID NO: 1075428 - RNA, 12 nt, Mycobacterium bovis subsp bovis AF2122/97
ccggccgcgcgc

SEQ ID NO: 1075429 - RNA, 15 nt, Mycobacterium bovis subsp bovis AF2122/97
ccggccgcguugggg

SEQ ID NO: 1075430 - RNA, 17 nt, Mycobacterium bovis subsp bovis AF2122/97
ccggccgcuauggcccg

SEQ ID NO: 1075431 - RNA, 20 nt, Mycobacterium bovis subsp bovis AF2122/97
ccggccgcuauggcccgggc

SEQ ID NO: 1075432 - RNA, 23 nt, Mycobacterium bovis subsp bovis AF2122/97
ccggccgcuauggcccgggccga

SEQ ID NO: 1075433 - RNA, 16 nt, Mycobacterium bovis subsp bovis AF2122/97
ccggccgcucaccccg

SEQ ID NO: 1075434 - RNA, 19 nt, Mycobacterium bovis subsp bovis AF2122/97
ccggccggacgggugcggg

SEQ ID NO: 1075435 - RNA, 23 nt, Mycobacterium bovis subsp bovis AF2122/97
ccggccggacgggugcgggccga

SEQ ID NO: 1075436 - RNA, 12 nt, Mycobacterium bovis subsp bovis AF2122/97
ccggccggcaau

SEQ ID NO: 1075437 - RNA, 13 nt, Mycobacterium bovis subsp bovis AF2122/97
ccggccgcuggcg

SEQ ID NO: 1075438 - RNA, 18 nt, Mycobacterium bovis subsp bovis AF2122/97
ccggccggaacgcccggc

SEQ ID NO: 1075439 - RNA, 20 nt, Mycobacterium bovis subsp bovis AF2122/97
ccggccguugggccaccggc

SEQ ID NO: 1075440 - RNA, 16 nt, Mycobacterium bovis subsp bovis AF2122/97
ccggccuagccgaugg

SEQ ID NO: 1075441 - RNA, 14 nt, Mycobacterium bovis subsp bovis AF2122/97
ccggccucaacacc

SEQ ID NO: 1075442 - RNA, 18 nt, Mycobacterium bovis subsp bovis AF2122/97
ccggccucaacacccggc

SEQ ID NO: 1075443 - RNA, 15 nt, Mycobacterium bovis subsp bovis AF2122/97
ccggccucgccgggg

SEQ ID NO: 1075444 - RNA, 15 nt, Mycobacterium bovis subsp bovis AF2122/97
ccggccggcccgggu

SEQ ID NO: 1075445 - RNA, 13 nt, Mycobacterium bovis subsp bovis AF2122/97
ccggccggcccau

SEQ ID NO: 1075446 - RNA, 21 nt, Mycobacterium bovis subsp bovis AF2122/97
ccggccggcgggccugcccgg

SEQ ID NO: 1075447 - RNA, 16 nt, Mycobacterium bovis subsp bovis AF2122/97
ccggcccugcucggcc

SEQ ID NO: 1075448 - RNA, 15 nt, Mycobacterium bovis subsp bovis AF2122/97
ccggccgacacgccg

SEQ ID NO: 1075449 - RNA, 22 nt, Mycobacterium bovis subsp bovis AF2122/97
ccggccccgcggccagcaccgg

SEQ ID NO: 1075450 - RNA, 22 nt, Mycobacterium bovis subsp bovis AF2122/97
ccggccgacacgccgaugccga

SEQ ID NO: 1075451 - RNA, 21 nt, Mycobacterium bovis subsp bovis AF2122/97
ccggccgaacgccucgccggc

SEQ ID NO: 1075452 - RNA, 15 nt, Mycobacterium bovis subsp bovis AF2122/97
ccggccgaaggcgcu

SEQ ID NO: 1075453 - RNA, 13 nt, Mycobacterium bovis subsp bovis AF2122/97
ccggccgacgaac

SEQ ID NO: 1075454 - RNA, 13 nt, Mycobacterium bovis subsp bovis AF2122/97
ccggccgacgcug

SEQ ID NO: 1075455 - RNA, 17 nt, Mycobacterium bovis subsp bovis AF2122/97
ccggccgacgugacaac

SEQ ID NO: 1075456 - RNA, 14 nt, Mycobacterium bovis subsp bovis AF2122/97
ccggcccgaugccg

SEQ ID NO: 1075457 - RNA, 23 nt, Mycobacterium bovis subsp bovis AF2122/97
ccggcccgaugccgaggaucgcg

SEQ ID NO: 1075458 - RNA, 23 nt, Mycobacterium bovis subsp bovis AF2122/97
ccggccccgggggaagcgccaaa

SEQ ID NO: 1075459 - RNA, 14 nt, Mycobacterium bovis subsp bovis AF2122/97
ccggccccguccga

SEQ ID NO: 1075460 - RNA, 15 nt, Mycobacterium bovis subsp bovis AF2122/97
ccggcccugccgccg

SEQ ID NO: 1075461 - RNA, 16 nt, Mycobacterium bovis subsp bovis AF2122/97
ccggcccugccgccgg

SEQ ID NO: 1075462 - RNA, 13 nt, Mycobacterium bovis subsp bovis AF2122/97
ccggcccugcggc

SEQ ID NO: 1075463 - RNA, 14 nt, Mycobacterium bovis subsp bovis AF2122/97
ccggccccgucguc

SEQ ID NO: 1075464 - RNA, 20 nt, Mycobacterium bovis subsp bovis AF2122/97
ccggccccgucgucuagcgg

SEQ ID NO: 1075465 - RNA, 12 nt, Mycobacterium bovis subsp bovis AF2122/97
ccggcccgacgg

SEQ ID NO: 1075466 - RNA, 17 nt, Mycobacterium bovis subsp bovis AF2122/97
ccggcccgcaacgcguc

SEQ ID NO: 1075467 - RNA, 19 nt, Mycobacterium bovis subsp bovis AF2122/97
ccggcccgcaacgcgucgg

SEQ ID NO: 1075468 - RNA, 15 nt, Mycobacterium bovis subsp bovis AF2122/97
ccggcccgcagcagc

SEQ ID NO: 1075469 - RNA, 16 nt, Mycobacterium bovis subsp bovis AF2122/97
ccggcccgcagcagca

SEQ ID NO: 1075470 - RNA, 15 nt, Mycobacterium bovis subsp bovis AF2122/97
ccggccauacgcgcg

SEQ ID NO: 1075471 - RNA, 16 nt, Mycobacterium bovis subsp bovis AF2122/97
ccggccauacgcgcgc

SEQ ID NO: 1075472 - RNA, 16 nt, Mycobacterium bovis subsp bovis AF2122/97
ccggccccgccggcgc

SEQ ID NO: 1075473 - RNA, 19 nt, Mycobacterium bovis subsp bovis AF2122/97
ccggccccgccggcgccgc

SEQ ID NO: 1075474 - RNA, 20 nt, Mycobacterium bovis subsp bovis AF2122/97
ccggccccgccgucaccgcc

SEQ ID NO: 1075475 - RNA, 21 nt, Mycobacterium bovis subsp bovis AF2122/97
ccggccccgccgucaccgccg

SEQ ID NO: 1075476 - RNA, 19 nt, Mycobacterium bovis subsp bovis AF2122/97
ccggccccgccgucgccgc

SEQ ID NO: 1075477 - RNA, 23 nt, Mycobacterium bovis subsp bovis AF2122/97
ccggccccgccgucgccgccggc

SEQ ID NO: 1075478 - RNA, 14 nt, Mycobacterium bovis subsp bovis AF2122/97
ccggccaucgcccg

SEQ ID NO: 1075479 - RNA, 16 nt, Mycobacterium bovis subsp bovis AF2122/97
ccggccccgccagcgc

SEQ ID NO: 1075480 - RNA, 18 nt, Mycobacterium bovis subsp bovis AF2122/97
ccggccccgccagcgccg

SEQ ID NO: 1075481 - RNA, 19 nt, Mycobacterium bovis subsp bovis AF2122/97
ccggccccgccagcgccgc

SEQ ID NO: 1075482 - RNA, 18 nt, Mycobacterium bovis subsp bovis AF2122/97
ccggccaggucgacaccg

SEQ ID NO: 1075483 - RNA, 19 nt, Mycobacterium bovis subsp bovis AF2122/97
ccggccagguauguccgcc

SEQ ID NO: 1075484 - RNA, 20 nt, Mycobacterium bovis subsp bovis AF2122/97
ccggccagguauguccgcca

SEQ ID NO: 1075485 - RNA, 22 nt, Mycobacterium bovis subsp bovis AF2122/97
ccggccagcgucgcaaggcccg

SEQ ID NO: 1075486 - RNA, 19 nt, Mycobacterium bovis subsp bovis AF2122/97
ccggccaggucgacaccgc

SEQ ID NO: 1075487 - RNA, 15 nt, Mycobacterium bovis subsp bovis AF2122/97
ccggccaggucgcga

SEQ ID NO: 1075488 - RNA, 15 nt, Mycobacterium bovis subsp bovis AF2122/97
ccggccaggugacgu

SEQ ID NO: 1075489 - RNA, 20 nt, Mycobacterium bovis subsp bovis AF2122/97
ccggccagugacaacgcgau

SEQ ID NO: 1075490 - RNA, 20 nt, Mycobacterium bovis subsp bovis AF2122/97
ccggcggcgcaucaccuccg

SEQ ID NO: 1075491 - RNA, 11 nt, Mycobacterium bovis subsp bovis AF2122/97
ccggcggcgcc

SEQ ID NO: 1075492 - RNA, 14 nt, Mycobacterium bovis subsp bovis AF2122/97
ccggcggcgguacc

SEQ ID NO: 1075493 - RNA, 15 nt, Mycobacterium bovis subsp bovis AF2122/97
ccggcggcggccgca

SEQ ID NO: 1075494 - RNA, 12 nt, Mycobacterium bovis subsp bovis AF2122/97
ccggcggcggcg

SEQ ID NO: 1075495 - RNA, 14 nt, Mycobacterium bovis subsp bovis AF2122/97
ccggcggcggcgcu

SEQ ID NO: 1075496 - RNA, 21 nt, Mycobacterium bovis subsp bovis AF2122/97
ccggcggcggcgcucggccau

SEQ ID NO: 1075497 - RNA, 21 nt, Mycobacterium bovis subsp bovis AF2122/97
ccggcggcgaagaagccggca

SEQ ID NO: 1075498 - RNA, 19 nt, Mycobacterium bovis subsp bovis AF2122/97
ccggcggcguccaucgcgc

SEQ ID NO: 1075499 - RNA, 23 nt, Mycobacterium bovis subsp bovis AF2122/97
ccggcggcggcggcccguuugcc

SEQ ID NO: 1075500 - RNA, 15 nt, Mycobacterium bovis subsp bovis AF2122/97
ccggcggcggugcgc

SEQ ID NO: 1075501 - RNA, 20 nt, Mycobacterium bovis subsp bovis AF2122/97
ccggcggcggugcgccccgc

SEQ ID NO: 1075502 - RNA, 21 nt, Mycobacterium bovis subsp bovis AF2122/97
ccggcggcucgggugcgcccg

SEQ ID NO: 1075503 - RNA, 23 nt, Mycobacterium bovis subsp bovis AF2122/97
ccggcggcucgggugcgcccggc

SEQ ID NO: 1075504 - RNA, 13 nt, Mycobacterium bovis subsp bovis AF2122/97
ccggcggcuucgc

SEQ ID NO: 1075505 - RNA, 18 nt, Mycobacterium bovis subsp bovis AF2122/97
ccggcgggaccgagaacu

SEQ ID NO: 1075506 - RNA, 18 nt, Mycobacterium bovis subsp bovis AF2122/97
ccggcgggcacaccgcac

SEQ ID NO: 1075507 - RNA, 19 nt, Mycobacterium bovis subsp bovis AF2122/97
ccggcgggcacaccgcacc

SEQ ID NO: 1075508 - RNA, 20 nt, Mycobacterium bovis subsp bovis AF2122/97
ccggcgggaugcgcgcccga

SEQ ID NO: 1075509 - RNA, 23 nt, Mycobacterium bovis subsp bovis AF2122/97
ccggcgggcacaccgcaccuggg

SEQ ID NO: 1075510 - RNA, 17 nt, Mycobacterium bovis subsp bovis AF2122/97
ccggcggcgacggcggc

SEQ ID NO: 1075511 - RNA, 18 nt, Mycobacterium bovis subsp bovis AF2122/97
ccggcggcgacggcggca

SEQ ID NO: 1075512 - RNA, 19 nt, Mycobacterium bovis subsp bovis AF2122/97
ccggcggcgacggcggcac

SEQ ID NO: 1075513 - RNA, 21 nt, Mycobacterium bovis subsp bovis AF2122/97
ccggcggcgacggcggcacgg

SEQ ID NO: 1075514 - RNA, 22 nt, Mycobacterium bovis subsp bovis AF2122/97
ccggcggcgacggugccaccgc

SEQ ID NO: 1075515 - RNA, 19 nt, Mycobacterium bovis subsp bovis AF2122/97
ccggcggcgacgucugcca

SEQ ID NO: 1075516 - RNA, 13 nt, Mycobacterium bovis subsp bovis AF2122/97
ccggcggcgacca

SEQ ID NO: 1075517 - RNA, 19 nt, Mycobacterium bovis subsp bovis AF2122/97
ccggcggcgaccagcucag

SEQ ID NO: 1075518 - RNA, 14 nt, Mycobacterium bovis subsp bovis AF2122/97
ccggcggcgacggc

SEQ ID NO: 1075519 - RNA, 15 nt, Mycobacterium bovis subsp bovis AF2122/97
ccggcggcgcaucac

SEQ ID NO: 1075520 - RNA, 14 nt, Mycobacterium bovis subsp bovis AF2122/97
ccggcggcgccggc

SEQ ID NO: 1075521 - RNA, 21 nt, Mycobacterium bovis subsp bovis AF2122/97
ccggcggcgccggccucgccg

SEQ ID NO: 1075522 - RNA, 14 nt, Mycobacterium bovis subsp bovis AF2122/97
ccggcggcgcgccc

SEQ ID NO: 1075523 - RNA, 18 nt, Mycobacterium bovis subsp bovis AF2122/97
ccggcggccgcggugccc

SEQ ID NO: 1075524 - RNA, 15 nt, Mycobacterium bovis subsp bovis AF2122/97
ccggcggccgcccag

SEQ ID NO: 1075525 - RNA, 17 nt, Mycobacterium bovis subsp bovis AF2122/97
ccggcgguucugcggcc

SEQ ID NO: 1075526 - RNA, 18 nt, Mycobacterium bovis subsp bovis AF2122/97
ccggcgguucugcggccg

SEQ ID NO: 1075527 - RNA, 19 nt, Mycobacterium bovis subsp bovis AF2122/97
ccggcgguucugcggccgc

SEQ ID NO: 1075528 - RNA, 19 nt, Mycobacterium bovis subsp bovis AF2122/97
ccggcggugccgucagcgg

SEQ ID NO: 1075529 - RNA, 18 nt, Mycobacterium bovis subsp bovis AF2122/97
ccggcggugccgucgccg

SEQ ID NO: 1075530 - RNA, 19 nt, Mycobacterium bovis subsp bovis AF2122/97
ccggcggugccgucgccgc

SEQ ID NO: 1075531 - RNA, 22 nt, Mycobacterium bovis subsp bovis AF2122/97
ccggcggugccgucgccgcccu

SEQ ID NO: 1075532 - RNA, 20 nt, Mycobacterium bovis subsp bovis AF2122/97
ccggcggucgggcccggcga

SEQ ID NO: 1075533 - RNA, 18 nt, Mycobacterium bovis subsp bovis AF2122/97
ccggcggucugcagugca

SEQ ID NO: 1075534 - RNA, 19 nt, Mycobacterium bovis subsp bovis AF2122/97
ccggcggucugcagugcag

SEQ ID NO: 1075535 - RNA, 23 nt, Mycobacterium bovis subsp bovis AF2122/97
ccggcggucgcguaccgguggaa

SEQ ID NO: 1075536 - RNA, 17 nt, Mycobacterium bovis subsp bovis AF2122/97
ccggcggugacggcggc

SEQ ID NO: 1075537 - RNA, 18 nt, Mycobacterium bovis subsp bovis AF2122/97
ccggcggugacggcggca

SEQ ID NO: 1075538 - RNA, 20 nt, Mycobacterium bovis subsp bovis AF2122/97
ccggcggugacggcggcaac

SEQ ID NO: 1075539 - RNA, 23 nt, Mycobacterium bovis subsp bovis AF2122/97
ccggcguaaccggcagcgguaag

SEQ ID NO: 1075540 - RNA, 15 nt, Mycobacterium bovis subsp bovis AF2122/97
ccggcguacgccgua

SEQ ID NO: 1075541 - RNA, 17 nt, Mycobacterium bovis subsp bovis AF2122/97
ccggcguacgccguacc

SEQ ID NO: 1075542 - RNA, 19 nt, Mycobacterium bovis subsp bovis AF2122/97
ccggcguacucggugaucg

SEQ ID NO: 1075543 - RNA, 13 nt, Mycobacterium bovis subsp bovis AF2122/97
ccggcguacuucg

SEQ ID NO: 1075544 - RNA, 17 nt, Mycobacterium bovis subsp bovis AF2122/97
ccggcguaggcaggauc

SEQ ID NO: 1075545 - RNA, 17 nt, Mycobacterium bovis subsp bovis AF2122/97
ccggcgucagccccgac

SEQ ID NO: 1075546 - RNA, 17 nt, Mycobacterium bovis subsp bovis AF2122/97
ccggcgggcucgcccgc

SEQ ID NO: 1075547 - RNA, 20 nt, Mycobacterium bovis subsp bovis AF2122/97
ccggcgggcucgcccgcuac

SEQ ID NO: 1075548 - RNA, 20 nt, Mycobacterium bovis subsp bovis AF2122/97
ccggcgggcgagugucagca

SEQ ID NO: 1075549 - RNA, 14 nt, Mycobacterium bovis subsp bovis AF2122/97
ccggcgggcggugg

SEQ ID NO: 1075550 - RNA, 20 nt, Mycobacterium bovis subsp bovis AF2122/97
ccggcgggcggugggcagca

SEQ ID NO: 1075551 - RNA, 14 nt, Mycobacterium bovis subsp bovis AF2122/97
ccggcggcggucug

SEQ ID NO: 1075552 - RNA, 23 nt, Mycobacterium bovis subsp bovis AF2122/97
ccggcgggcggugggcagcagcu

SEQ ID NO: 1075553 - RNA, 19 nt, Mycobacterium bovis subsp bovis AF2122/97
ccggcggucagcagcgccg

SEQ ID NO: 1075554 - RNA, 20 nt, Mycobacterium bovis subsp bovis AF2122/97
ccggcgguaccggagcagcu

SEQ ID NO: 1075555 - RNA, 13 nt, Mycobacterium bovis subsp bovis AF2122/97
ccggcgguagcca

SEQ ID NO: 1075556 - RNA, 23 nt, Mycobacterium bovis subsp bovis AF2122/97
ccggcgguagucggccagcucgc

SEQ ID NO: 1075557 - RNA, 20 nt, Mycobacterium bovis subsp bovis AF2122/97
ccggcgggugccgagcuggc

SEQ ID NO: 1075558 - RNA, 18 nt, Mycobacterium bovis subsp bovis AF2122/97
ccggcuccggcggugccg

SEQ ID NO: 1075559 - RNA, 17 nt, Mycobacterium bovis subsp bovis AF2122/97
ccggcuccgguaggcga

SEQ ID NO: 1075560 - RNA, 16 nt, Mycobacterium bovis subsp bovis AF2122/97
ccggcuccuccccggc

SEQ ID NO: 1075561 - RNA, 19 nt, Mycobacterium bovis subsp bovis AF2122/97
ccggcuccuccccggcccg

SEQ ID NO: 1075562 - RNA, 21 nt, Mycobacterium bovis subsp bovis AF2122/97
ccggcuccuccccggcccgcu

SEQ ID NO: 1075563 - RNA, 13 nt, Mycobacterium bovis subsp bovis AF2122/97
ccggcuccgccac

SEQ ID NO: 1075564 - RNA, 16 nt, Mycobacterium bovis subsp bovis AF2122/97
ccggcuccgccacugg

SEQ ID NO: 1075565 - RNA, 17 nt, Mycobacterium bovis subsp bovis AF2122/97
ccggcuccgccacuggc

SEQ ID NO: 1075566 - RNA, 12 nt, Mycobacterium bovis subsp bovis AF2122/97
ccggcuccgccg

SEQ ID NO: 1075567 - RNA, 16 nt, Mycobacterium bovis subsp bovis AF2122/97
ccggcuccgccguugc

SEQ ID NO: 1075568 - RNA, 23 nt, Mycobacterium bovis subsp bovis AF2122/97
ccggcuccgccguugccgccgcc

SEQ ID NO: 1075569 - RNA, 13 nt, Mycobacterium bovis subsp bovis AF2122/97
ccggcugaccggg

SEQ ID NO: 1075570 - RNA, 15 nt, Mycobacterium bovis subsp bovis AF2122/97
ccggcugaccggggc

SEQ ID NO: 1075571 - RNA, 19 nt, Mycobacterium bovis subsp bovis AF2122/97
ccggcugaccggggcgccc

SEQ ID NO: 1075572 - RNA, 20 nt, Mycobacterium bovis subsp bovis AF2122/97
ccggcugaccggggcgcccg

SEQ ID NO: 1075573 - RNA, 22 nt, Mycobacterium bovis subsp bovis AF2122/97
ccggcugaccggggcgcccggc

SEQ ID NO: 1075574 - RNA, 20 nt, Mycobacterium bovis subsp bovis AF2122/97
ccggcugacgaccaaccacc

SEQ ID NO: 1075575 - RNA, 21 nt, Mycobacterium bovis subsp bovis AF2122/97
ccggcugacgaccaaccaccg

SEQ ID NO: 1075576 - RNA, 16 nt, Mycobacterium bovis subsp bovis AF2122/97
ccggcucgagcucggc

SEQ ID NO: 1075577 - RNA, 22 nt, Mycobacterium bovis subsp bovis AF2122/97
ccggcucgagcucggcgaugcu

SEQ ID NO: 1075578 - RNA, 13 nt, Mycobacterium bovis subsp bovis AF2122/97
ccggcugccgcac

SEQ ID NO: 1075579 - RNA, 14 nt, Mycobacterium bovis subsp bovis AF2122/97
ccggcugccagcgc

SEQ ID NO: 1075580 - RNA, 17 nt, Mycobacterium bovis subsp bovis AF2122/97
ccggcugccagcgccgc

SEQ ID NO: 1075581 - RNA, 17 nt, Mycobacterium bovis subsp bovis AF2122/97
ccggcugcauccuccuc

SEQ ID NO: 1075582 - RNA, 20 nt, Mycobacterium bovis subsp bovis AF2122/97
ccggcugcaaccagcggcac

SEQ ID NO: 1075583 - RNA, 19 nt, Mycobacterium bovis subsp bovis AF2122/97
ccggcugaccgacccggac

SEQ ID NO: 1075584 - RNA, 21 nt, Mycobacterium bovis subsp bovis AF2122/97
ccggcugcaaccagcggcaca

SEQ ID NO: 1075585 - RNA, 16 nt, Mycobacterium bovis subsp bovis AF2122/97
ccggcguucccacugg

SEQ ID NO: 1075586 - RNA, 17 nt, Mycobacterium bovis subsp bovis AF2122/97
ccggcguucccacugga

SEQ ID NO: 1075587 - RNA, 19 nt, Mycobacterium bovis subsp bovis AF2122/97
ccggcguucaccugcgucg

SEQ ID NO: 1075588 - RNA, 23 nt, Mycobacterium bovis subsp bovis AF2122/97
ccggcguucccacuggaggucgu

SEQ ID NO: 1075589 - RNA, 17 nt, Mycobacterium bovis subsp bovis AF2122/97
ccggcguuggccauggc

SEQ ID NO: 1075590 - RNA, 14 nt, Mycobacterium bovis subsp bovis AF2122/97
ccggcguuggccau

SEQ ID NO: 1075591 - RNA, 22 nt, Mycobacterium bovis subsp bovis AF2122/97
ccggcguuguaguugcccacgu

SEQ ID NO: 1075592 - RNA, 19 nt, Mycobacterium bovis subsp bovis AF2122/97
ccggcguugccgccguugc

SEQ ID NO: 1075593 - RNA, 14 nt, Mycobacterium bovis subsp bovis AF2122/97
ccggcguugccgcc

SEQ ID NO: 1075594 - RNA, 16 nt, Mycobacterium bovis subsp bovis AF2122/97
ccggcguugccgccgu

SEQ ID NO: 1075595 - RNA, 19 nt, Mycobacterium bovis subsp bovis AF2122/97
ccggcguugccgccguucc

SEQ ID NO: 1075596 - RNA, 20 nt, Mycobacterium bovis subsp bovis AF2122/97
ccggcuccagcaccgugacc

SEQ ID NO: 1075597 - RNA, 18 nt, Mycobacterium bovis subsp bovis AF2122/97
ccggcuccagcaugggcg

SEQ ID NO: 1075598 - RNA, 17 nt, Mycobacterium bovis subsp bovis AF2122/97
ccggcuccacccuugcc

SEQ ID NO: 1075599 - RNA, 16 nt, Mycobacterium bovis subsp bovis AF2122/97
ccggcguuugggcauc

SEQ ID NO: 1075600 - RNA, 20 nt, Mycobacterium bovis subsp bovis AF2122/97
ccggcgucugcccgcccagc

SEQ ID NO: 1075601 - RNA, 21 nt, Mycobacterium bovis subsp bovis AF2122/97
ccggcgucucgcagcaacggc

SEQ ID NO: 1075602 - RNA, 18 nt, Mycobacterium bovis subsp bovis AF2122/97
ccggcgugcagcaccccc

SEQ ID NO: 1075603 - RNA, 16 nt, Mycobacterium bovis subsp bovis AF2122/97
ccggcgugcggcgagg

SEQ ID NO: 1075604 - RNA, 17 nt, Mycobacterium bovis subsp bovis AF2122/97
ccggcgugcgcaaggca

SEQ ID NO: 1075605 - RNA, 14 nt, Mycobacterium bovis subsp bovis AF2122/97
ccggcgugucgccg

SEQ ID NO: 1075606 - RNA, 18 nt, Mycobacterium bovis subsp bovis AF2122/97
ccggcgugucgccgccac

SEQ ID NO: 1075607 - RNA, 16 nt, Mycobacterium bovis subsp bovis AF2122/97
ccggcguggccccacc

SEQ ID NO: 1075608 - RNA, 19 nt, Mycobacterium bovis subsp bovis AF2122/97
ccggcgugggcaccuugcc

SEQ ID NO: 1075609 - RNA, 18 nt, Mycobacterium bovis subsp bovis AF2122/97
ccggcguauugcaccgcc

SEQ ID NO: 1075610 - RNA, 23 nt, Mycobacterium bovis subsp bovis AF2122/97
ccggcguacuucgacagcggcga

SEQ ID NO: 1075611 - RNA, 19 nt, Mycobacterium bovis subsp bovis AF2122/97
ccggcguccggagccccug

SEQ ID NO: 1075612 - RNA, 21 nt, Mycobacterium bovis subsp bovis AF2122/97
ccggcguccggagccccuguc

SEQ ID NO: 1075613 - RNA, 15 nt, Mycobacterium bovis subsp bovis AF2122/97
ccggcgucgagccgg

SEQ ID NO: 1075614 - RNA, 19 nt, Mycobacterium bovis subsp bovis AF2122/97
ccggcgucgaaggugacca

SEQ ID NO: 1075615 - RNA, 15 nt, Mycobacterium bovis subsp bovis AF2122/97
ccggcgucggcgccc

SEQ ID NO: 1075616 - RNA, 23 nt, Mycobacterium bovis subsp bovis AF2122/97
ccggcgucggcgcccagcucgau

SEQ ID NO: 1075617 - RNA, 21 nt, Mycobacterium bovis subsp bovis AF2122/97
ccggcgucgaugacgacgccg

SEQ ID NO: 1075618 - RNA, 21 nt, Mycobacterium bovis subsp bovis AF2122/97
ccggcgucgaaggugaccagg

SEQ ID NO: 1075619 - RNA, 21 nt, Mycobacterium bovis subsp bovis AF2122/97
ccggcgucgugaugggucacc

SEQ ID NO: 1075620 - RNA, 15 nt, Mycobacterium bovis subsp bovis AF2122/97
ccggcgucgcugccu

SEQ ID NO: 1075621 - RNA, 15 nt, Mycobacterium bovis subsp bovis AF2122/97
ccggcgucggcgcgg

SEQ ID NO: 1075622 - RNA, 17 nt, Mycobacterium bovis subsp bovis AF2122/97
ccggggcgcucgcgcgc

SEQ ID NO: 1075623 - RNA, 20 nt, Mycobacterium bovis subsp bovis AF2122/97
ccggggcggaaccugucaac

SEQ ID NO: 1075624 - RNA, 17 nt, Mycobacterium bovis subsp bovis AF2122/97
ccggggcgaugucggcu

SEQ ID NO: 1075625 - RNA, 21 nt, Mycobacterium bovis subsp bovis AF2122/97
ccggggcgaugucggcuggug

SEQ ID NO: 1075626 - RNA, 19 nt, Mycobacterium bovis subsp bovis AF2122/97
ccggggccuucggcccggu

SEQ ID NO: 1075627 - RNA, 23 nt, Mycobacterium bovis subsp bovis AF2122/97
ccggggccuucggcccggugguc

SEQ ID NO: 1075628 - RNA, 13 nt, Mycobacterium bovis subsp bovis AF2122/97
ccggggccgcugg

SEQ ID NO: 1075629 - RNA, 22 nt, Mycobacterium bovis subsp bovis AF2122/97
ccggggccccaugccgaccggc

SEQ ID NO: 1075630 - RNA, 12 nt, Mycobacterium bovis subsp bovis AF2122/97
ccggggccgccg

SEQ ID NO: 1075631 - RNA, 17 nt, Mycobacterium bovis subsp bovis AF2122/97
ccggggccgccgaugcc

SEQ ID NO: 1075632 - RNA, 14 nt, Mycobacterium bovis subsp bovis AF2122/97
ccggggcgcccggc

SEQ ID NO: 1075633 - RNA, 14 nt, Mycobacterium bovis subsp bovis AF2122/97
ccggggcagauggu

SEQ ID NO: 1075634 - RNA, 19 nt, Mycobacterium bovis subsp bovis AF2122/97
ccggggauaccggucagca

SEQ ID NO: 1075635 - RNA, 20 nt, Mycobacterium bovis subsp bovis AF2122/97
ccggggauaucacgacgccg

SEQ ID NO: 1075636 - RNA, 14 nt, Mycobacterium bovis subsp bovis AF2122/97
ccggggccacccgc

SEQ ID NO: 1075637 - RNA, 18 nt, Mycobacterium bovis subsp bovis AF2122/97
ccggggccacccgcagac

SEQ ID NO: 1075638 - RNA, 23 nt, Mycobacterium bovis subsp bovis AF2122/97
ccgggcuuacuugaucucggcga

SEQ ID NO: 1075639 - RNA, 18 nt, Mycobacterium bovis subsp bovis AF2122/97
ccgggcuuaggccgcggc

SEQ ID NO: 1075640 - RNA, 17 nt, Mycobacterium bovis subsp bovis AF2122/97
ccggggaaagccgcagc

SEQ ID NO: 1075641 - RNA, 16 nt, Mycobacterium bovis subsp bovis AF2122/97
ccggggaacgugaccc

SEQ ID NO: 1075642 - RNA, 19 nt, Mycobacterium bovis subsp bovis AF2122/97
ccgggcuuggccgcgccgg

SEQ ID NO: 1075643 - RNA, 17 nt, Mycobacterium bovis subsp bovis AF2122/97
ccggggaccucggcgau

SEQ ID NO: 1075644 - RNA, 18 nt, Mycobacterium bovis subsp bovis AF2122/97
ccggggaccucggcgauc

SEQ ID NO: 1075645 - RNA, 18 nt, Mycobacterium bovis subsp bovis AF2122/97
ccggggacgccgcggcgc

SEQ ID NO: 1075646 - RNA, 14 nt, Mycobacterium bovis subsp bovis AF2122/97
ccggggacgcgccc

SEQ ID NO: 1075647 - RNA, 15 nt, Mycobacterium bovis subsp bovis AF2122/97
ccggggacgggucgg

SEQ ID NO: 1075648 - RNA, 15 nt, Mycobacterium bovis subsp bovis AF2122/97
ccggggacagcccgg

SEQ ID NO: 1075649 - RNA, 16 nt, Mycobacterium bovis subsp bovis AF2122/97
ccggggacagcccggc

SEQ ID NO: 1075650 - RNA, 12 nt, Mycobacterium bovis subsp bovis AF2122/97
ccggggaccacg

SEQ ID NO: 1075651 - RNA, 17 nt, Mycobacterium bovis subsp bovis AF2122/97
ccgggcuguucggccau

SEQ ID NO: 1075652 - RNA, 20 nt, Mycobacterium bovis subsp bovis AF2122/97
ccgggcuguucggccauggc

SEQ ID NO: 1075653 - RNA, 22 nt, Mycobacterium bovis subsp bovis AF2122/97
ccgggcuggguaugcacccagg

SEQ ID NO: 1075654 - RNA, 14 nt, Mycobacterium bovis subsp bovis AF2122/97
ccgggcugccgccc

SEQ ID NO: 1075655 - RNA, 12 nt, Mycobacterium bovis subsp bovis AF2122/97
ccgggcuggcca

SEQ ID NO: 1075656 - RNA, 14 nt, Mycobacterium bovis subsp bovis AF2122/97
ccgggcuggccagc

SEQ ID NO: 1075657 - RNA, 15 nt, Mycobacterium bovis subsp bovis AF2122/97
ccgggcuggccagcg

SEQ ID NO: 1075658 - RNA, 18 nt, Mycobacterium bovis subsp bovis AF2122/97
ccgggcuggccagcgcgc

SEQ ID NO: 1075659 - RNA, 15 nt, Mycobacterium bovis subsp bovis AF2122/97
ccgggcuauccgcgg

SEQ ID NO: 1075660 - RNA, 17 nt, Mycobacterium bovis subsp bovis AF2122/97
ccgggcuauccgcggga

SEQ ID NO: 1075661 - RNA, 12 nt, Mycobacterium bovis subsp bovis AF2122/97
ccgggcucggcg

SEQ ID NO: 1075662 - RNA, 14 nt, Mycobacterium bovis subsp bovis AF2122/97
ccgggcucggcgaa

SEQ ID NO: 1075663 - RNA, 17 nt, Mycobacterium bovis subsp bovis AF2122/97
ccgggcugaggcggcga

SEQ ID NO: 1075664 - RNA, 20 nt, Mycobacterium bovis subsp bovis AF2122/97
ccgggcuccaauugcggccg

SEQ ID NO: 1075665 - RNA, 22 nt, Mycobacterium bovis subsp bovis AF2122/97
ccgggcuccaauugcggccgcg

SEQ ID NO: 1075666 - RNA, 21 nt, Mycobacterium bovis subsp bovis AF2122/97
ccgggcucggcgucgccgcca

SEQ ID NO: 1075667 - RNA, 14 nt, Mycobacterium bovis subsp bovis AF2122/97
ccgggcucuggcca

SEQ ID NO: 1075668 - RNA, 16 nt, Mycobacterium bovis subsp bovis AF2122/97
ccgggcgucgcuggug

SEQ ID NO: 1075669 - RNA, 17 nt, Mycobacterium bovis subsp bovis AF2122/97
ccgggcgugggugucgg

SEQ ID NO: 1075670 - RNA, 20 nt, Mycobacterium bovis subsp bovis AF2122/97
ccgggcgugcggcggcccau

SEQ ID NO: 1075671 - RNA, 17 nt, Mycobacterium bovis subsp bovis AF2122/97
ccgggcgucgucgguga

SEQ ID NO: 1075672 - RNA, 17 nt, Mycobacterium bovis subsp bovis AF2122/97
ccgggcguccgccggcg

SEQ ID NO: 1075673 - RNA, 15 nt, Mycobacterium bovis subsp bovis AF2122/97
ccgggccucggcgcc

SEQ ID NO: 1075674 - RNA, 21 nt, Mycobacterium bovis subsp bovis AF2122/97
ccgggccucggcgccgucgga

SEQ ID NO: 1075675 - RNA, 18 nt, Mycobacterium bovis subsp bovis AF2122/97
ccgggccugaaccacgcg

SEQ ID NO: 1075676 - RNA, 17 nt, Mycobacterium bovis subsp bovis AF2122/97
ccgggcgaauccggcgg

SEQ ID NO: 1075677 - RNA, 20 nt, Mycobacterium bovis subsp bovis AF2122/97
ccgggcgaauccggcgggug

SEQ ID NO: 1075678 - RNA, 16 nt, Mycobacterium bovis subsp bovis AF2122/97
ccgggcgaccaccacc

SEQ ID NO: 1075679 - RNA, 12 nt, Mycobacterium bovis subsp bovis AF2122/97
ccgggcgagccg

SEQ ID NO: 1075680 - RNA, 19 nt, Mycobacterium bovis subsp bovis AF2122/97
ccgggcgcaagcagcccgg

SEQ ID NO: 1075681 - RNA, 21 nt, Mycobacterium bovis subsp bovis AF2122/97
ccgggcgaguacaggcgcagc

SEQ ID NO: 1075682 - RNA, 20 nt, Mycobacterium bovis subsp bovis AF2122/97
ccgggcgaucaaagccagca

SEQ ID NO: 1075683 - RNA, 16 nt, Mycobacterium bovis subsp bovis AF2122/97
ccgggaugugcggcug

SEQ ID NO: 1075684 - RNA, 17 nt, Mycobacterium bovis subsp bovis AF2122/97
ccgggauuaugccggca

SEQ ID NO: 1075685 - RNA, 15 nt, Mycobacterium bovis subsp bovis AF2122/97
ccgggauugccgcca

SEQ ID NO: 1075686 - RNA, 16 nt, Mycobacterium bovis subsp bovis AF2122/97
ccgggauugccgucgg

SEQ ID NO: 1075687 - RNA, 14 nt, Mycobacterium bovis subsp bovis AF2122/97
ccgggcaaccagca

SEQ ID NO: 1075688 - RNA, 18 nt, Mycobacterium bovis subsp bovis AF2122/97
ccgggcaaccagcagcag

SEQ ID NO: 1075689 - RNA, 19 nt, Mycobacterium bovis subsp bovis AF2122/97
ccgggauggcucacccagg

SEQ ID NO: 1075690 - RNA, 13 nt, Mycobacterium bovis subsp bovis AF2122/97
ccgggaucugcuc

SEQ ID NO: 1075691 - RNA, 15 nt, Mycobacterium bovis subsp bovis AF2122/97
ccgggaucgucaggc

SEQ ID NO: 1075692 - RNA, 20 nt, Mycobacterium bovis subsp bovis AF2122/97
ccgggaucggggcaccgugc

SEQ ID NO: 1075693 - RNA, 16 nt, Mycobacterium bovis subsp bovis AF2122/97
ccgggaucccacggcg

SEQ ID NO: 1075694 - RNA, 20 nt, Mycobacterium bovis subsp bovis AF2122/97
ccgggauaguuuucggccgc

SEQ ID NO: 1075695 - RNA, 21 nt, Mycobacterium bovis subsp bovis AF2122/97
ccgggauaguuuucggccgcc

SEQ ID NO: 1075696 - RNA, 16 nt, Mycobacterium bovis subsp bovis AF2122/97
ccggcuucguccaccg

SEQ ID NO: 1075697 - RNA, 16 nt, Mycobacterium bovis subsp bovis AF2122/97
ccggcuucggccagca

SEQ ID NO: 1075698 - RNA, 15 nt, Mycobacterium bovis subsp bovis AF2122/97
ccggcuucgccgcgc

SEQ ID NO: 1075699 - RNA, 16 nt, Mycobacterium bovis subsp bovis AF2122/97
ccggcuucgccgcgcu

SEQ ID NO: 1075700 - RNA, 20 nt, Mycobacterium bovis subsp bovis AF2122/97
ccgggauaacccagcaccac

SEQ ID NO: 1075701 - RNA, 11 nt, Mycobacterium bovis subsp bovis AF2122/97
ccgggagucgg

SEQ ID NO: 1075702 - RNA, 16 nt, Mycobacterium bovis subsp bovis AF2122/97
ccgggagugcgccggc

SEQ ID NO: 1075703 - RNA, 21 nt, Mycobacterium bovis subsp bovis AF2122/97
ccgggagugcgccggcuggcg

SEQ ID NO: 1075704 - RNA, 15 nt, Mycobacterium bovis subsp bovis AF2122/97
ccgggaggccaccgc

SEQ ID NO: 1075705 - RNA, 17 nt, Mycobacterium bovis subsp bovis AF2122/97
ccgggaggccaccgcga

SEQ ID NO: 1075706 - RNA, 21 nt, Mycobacterium bovis subsp bovis AF2122/97
ccgggaggccggcuaccgcgc

SEQ ID NO: 1075707 - RNA, 18 nt, Mycobacterium bovis subsp bovis AF2122/97
ccggcuuaccggcgggcg

SEQ ID NO: 1075708 - RNA, 17 nt, Mycobacterium bovis subsp bovis AF2122/97
ccggcuguucucgccga

SEQ ID NO: 1075709 - RNA, 21 nt, Mycobacterium bovis subsp bovis AF2122/97
ccggcuuaaggcccuggccgc

SEQ ID NO: 1075710 - RNA, 22 nt, Mycobacterium bovis subsp bovis AF2122/97
ccggcuuaaggcccuggccgcg

SEQ ID NO: 1075711 - RNA, 13 nt, Mycobacterium bovis subsp bovis AF2122/97
ccggcuucgccca

SEQ ID NO: 1075712 - RNA, 19 nt, Mycobacterium bovis subsp bovis AF2122/97
ccggcuggugggacgcggc

SEQ ID NO: 1075713 - RNA, 21 nt, Mycobacterium bovis subsp bovis AF2122/97
ccggcuggugggacgcggccg

SEQ ID NO: 1075714 - RNA, 13 nt, Mycobacterium bovis subsp bovis AF2122/97
ccggcuguucucg

SEQ ID NO: 1075715 - RNA, 16 nt, Mycobacterium bovis subsp bovis AF2122/97
ccggcuguucucgccg

SEQ ID NO: 1075716 - RNA, 23 nt, Mycobacterium bovis subsp bovis AF2122/97
ccggcugccgcaccaaggccgcc

SEQ ID NO: 1075717 - RNA, 13 nt, Mycobacterium bovis subsp bovis AF2122/97
ccggcugucgguc

SEQ ID NO: 1075718 - RNA, 17 nt, Mycobacterium bovis subsp bovis AF2122/97
ccgggcagccgcacggu

SEQ ID NO: 1075719 - RNA, 15 nt, Mycobacterium bovis subsp bovis AF2122/97
ccgggcagccgcgcc

SEQ ID NO: 1075720 - RNA, 16 nt, Mycobacterium bovis subsp bovis AF2122/97
ccgggcagccgcgccg

SEQ ID NO: 1075721 - RNA, 15 nt, Mycobacterium bovis subsp bovis AF2122/97
ccgggcagcaucaac

SEQ ID NO: 1075722 - RNA, 19 nt, Mycobacterium bovis subsp bovis AF2122/97
ccgggcagcaucaacaccg

SEQ ID NO: 1075723 - RNA, 17 nt, Mycobacterium bovis subsp bovis AF2122/97
ccgggcagccccuccgc

SEQ ID NO: 1075724 - RNA, 19 nt, Mycobacterium bovis subsp bovis AF2122/97
ccgggcagccccuccgcgc

SEQ ID NO: 1075725 - RNA, 21 nt, Mycobacterium bovis subsp bovis AF2122/97
ccgggcagccccuccgcgccg

SEQ ID NO: 1075726 - RNA, 19 nt, Mycobacterium bovis subsp bovis AF2122/97
ccgggcaacggcggggccg

SEQ ID NO: 1075727 - RNA, 22 nt, Mycobacterium bovis subsp bovis AF2122/97
ccgggcaauacguagucgccga

SEQ ID NO: 1075728 - RNA, 14 nt, Mycobacterium bovis subsp bovis AF2122/97
ccgggcaaucgcuc

SEQ ID NO: 1075729 - RNA, 22 nt, Mycobacterium bovis subsp bovis AF2122/97
ccgggcagucaggccuagcgcg

SEQ ID NO: 1075730 - RNA, 17 nt, Mycobacterium bovis subsp bovis AF2122/97
ccgggcagucgagugcg

SEQ ID NO: 1075731 - RNA, 14 nt, Mycobacterium bovis subsp bovis AF2122/97
ccgggcagccgcac

SEQ ID NO: 1075732 - RNA, 24 nt, Mycobacterium bovis subsp bovis AF2122/97
ccgggcauccuucaccagcugcga

SEQ ID NO: 1075733 - RNA, 19 nt, Mycobacterium bovis subsp bovis AF2122/97
ccgggcagugcgcggcguc

SEQ ID NO: 1075734 - RNA, 21 nt, Mycobacterium bovis subsp bovis AF2122/97
ccgggcaugaucacacugccc

SEQ ID NO: 1075735 - RNA, 14 nt, Mycobacterium bovis subsp bovis AF2122/97
ccgggcccgccguc

SEQ ID NO: 1075736 - RNA, 15 nt, Mycobacterium bovis subsp bovis AF2122/97
ccgggcccgccgucu

SEQ ID NO: 1075737 - RNA, 15 nt, Mycobacterium bovis subsp bovis AF2122/97
ccgggcagcugggca

SEQ ID NO: 1075738 - RNA, 22 nt, Mycobacterium bovis subsp bovis AF2122/97
ccgggccgcggcggccagcgca

SEQ ID NO: 1075739 - RNA, 15 nt, Mycobacterium bovis subsp bovis AF2122/97
ccgggccgcguagug

SEQ ID NO: 1075740 - RNA, 14 nt, Mycobacterium bovis subsp bovis AF2122/97
ccgggccgcggcca

SEQ ID NO: 1075741 - RNA, 17 nt, Mycobacterium bovis subsp bovis AF2122/97
ccgggccgcggccacau

SEQ ID NO: 1075742 - RNA, 20 nt, Mycobacterium bovis subsp bovis AF2122/97
ccgggccgccucgaucgacu

SEQ ID NO: 1075743 - RNA, 19 nt, Mycobacterium bovis subsp bovis AF2122/97
ccgggccggucggugagcc

SEQ ID NO: 1075744 - RNA, 17 nt, Mycobacterium bovis subsp bovis AF2122/97
ccgggccguacggcgcg

SEQ ID NO: 1075745 - RNA, 17 nt, Mycobacterium bovis subsp bovis AF2122/97
ccgggccggccacgucg

SEQ ID NO: 1075746 - RNA, 18 nt, Mycobacterium bovis subsp bovis AF2122/97
ccgggccguguccgccgg

SEQ ID NO: 1075747 - RNA, 13 nt, Mycobacterium bovis subsp bovis AF2122/97
aaauugggugccg

SEQ ID NO: 1075748 - RNA, 16 nt, Mycobacterium bovis subsp bovis AF2122/97
cgacggaugaucagcg

SEQ ID NO: 1075749 - RNA, 21 nt, Mycobacterium bovis subsp bovis AF2122/97
cgacggacucccucgaucacg

SEQ ID NO: 1075750 - RNA, 22 nt, Mycobacterium bovis subsp bovis AF2122/97
cgacggacucccucgaucacgg

SEQ ID NO: 1075751 - RNA, 16 nt, Mycobacterium bovis subsp bovis AF2122/97
cgacggacuccggccg

SEQ ID NO: 1075752 - RNA, 22 nt, Mycobacterium bovis subsp bovis AF2122/97
cgacggacuccggccggccuag

SEQ ID NO: 1075753 - RNA, 18 nt, Mycobacterium bovis subsp bovis AF2122/97
cgacggaaucgucggcgc

SEQ ID NO: 1075754 - RNA, 19 nt, Mycobacterium bovis subsp bovis AF2122/97
cgacggaaucgucggcgcg

SEQ ID NO: 1075755 - RNA, 22 nt, Mycobacterium bovis subsp bovis AF2122/97
cgacgcuuucccgaugacgaag

SEQ ID NO: 1075756 - RNA, 14 nt, Mycobacterium bovis subsp bovis AF2122/97
cgacgcuuucccga

SEQ ID NO: 1075757 - RNA, 15 nt, Mycobacterium bovis subsp bovis AF2122/97
cgacgcuuucccgau

SEQ ID NO: 1075758 - RNA, 16 nt, Mycobacterium bovis subsp bovis AF2122/97
cgacgcugccgccagg

SEQ ID NO: 1075759 - RNA, 19 nt, Mycobacterium bovis subsp bovis AF2122/97
cgacgcugccgccaggcuc

SEQ ID NO: 1075760 - RNA, 17 nt, Mycobacterium bovis subsp bovis AF2122/97
cgacgccaugagcgcgc

SEQ ID NO: 1075761 - RNA, 20 nt, Mycobacterium bovis subsp bovis AF2122/97
cgacgccaugagcgcgccca

SEQ ID NO: 1075762 - RNA, 21 nt, Mycobacterium bovis subsp bovis AF2122/97
cgacgccaugagcgcgcccaa

SEQ ID NO: 1075763 - RNA, 22 nt, Mycobacterium bovis subsp bovis AF2122/97
cgacgccaugagcgcgcccaac

SEQ ID NO: 1075764 - RNA, 16 nt, Mycobacterium bovis subsp bovis AF2122/97
cgacgcuguggcucga

SEQ ID NO: 1075765 - RNA, 12 nt, Mycobacterium bovis subsp bovis AF2122/97
cgacgcuggcgg

SEQ ID NO: 1075766 - RNA, 14 nt, Mycobacterium bovis subsp bovis AF2122/97
cgacgcuggcggug

SEQ ID NO: 1075767 - RNA, 13 nt, Mycobacterium bovis subsp bovis AF2122/97
cgacgcuggucgg

SEQ ID NO: 1075768 - RNA, 19 nt, Mycobacterium bovis subsp bovis AF2122/97
cgacgauucgagcgguugc

SEQ ID NO: 1075769 - RNA, 16 nt, Mycobacterium bovis subsp bovis AF2122/97
cgacgauuaccagcgg

SEQ ID NO: 1075770 - RNA, 20 nt, Mycobacterium bovis subsp bovis AF2122/97
cgacgauuaccagcggcacc

SEQ ID NO: 1075771 - RNA, 21 nt, Mycobacterium bovis subsp bovis AF2122/97
cgacgauuaccagcggcaccg

SEQ ID NO: 1075772 - RNA, 22 nt, Mycobacterium bovis subsp bovis AF2122/97
cgacgauuaccagcggcaccgc

SEQ ID NO: 1075773 - RNA, 17 nt, Mycobacterium bovis subsp bovis AF2122/97
cgacgccagaacguggc

SEQ ID NO: 1075774 - RNA, 20 nt, Mycobacterium bovis subsp bovis AF2122/97
cgacgccaaugccgcggagg

SEQ ID NO: 1075775 - RNA, 21 nt, Mycobacterium bovis subsp bovis AF2122/97
cgacgccaaugccgcggaggc

SEQ ID NO: 1075776 - RNA, 15 nt, Mycobacterium bovis subsp bovis AF2122/97
cgacgccacgcgucu

SEQ ID NO: 1075777 - RNA, 13 nt, Mycobacterium bovis subsp bovis AF2122/97
cgacgccaacgcc

SEQ ID NO: 1075778 - RNA, 15 nt, Mycobacterium bovis subsp bovis AF2122/97
cgacgccaacgccag

SEQ ID NO: 1075779 - RNA, 12 nt, Mycobacterium bovis subsp bovis AF2122/97
cgacgccaccgc

SEQ ID NO: 1075780 - RNA, 20 nt, Mycobacterium bovis subsp bovis AF2122/97
cgacgccaccgccaccaccc

SEQ ID NO: 1075781 - RNA, 16 nt, Mycobacterium bovis subsp bovis AF2122/97
cgacgccaccgcgacu

SEQ ID NO: 1075782 - RNA, 15 nt, Mycobacterium bovis subsp bovis AF2122/97
cgacgccaguguugc

SEQ ID NO: 1075783 - RNA, 14 nt, Mycobacterium bovis subsp bovis AF2122/97
cgacgccagcugcc

SEQ ID NO: 1075784 - RNA, 19 nt, Mycobacterium bovis subsp bovis AF2122/97
cgacgccagcugcccgacg

SEQ ID NO: 1075785 - RNA, 14 nt, Mycobacterium bovis subsp bovis AF2122/97
cgacggcgccggca

SEQ ID NO: 1075786 - RNA, 18 nt, Mycobacterium bovis subsp bovis AF2122/97
cgacggcgccauuggcgu

SEQ ID NO: 1075787 - RNA, 12 nt, Mycobacterium bovis subsp bovis AF2122/97
cgacggcgccca

SEQ ID NO: 1075788 - RNA, 14 nt, Mycobacterium bovis subsp bovis AF2122/97
cgacggcgcccagc

SEQ ID NO: 1075789 - RNA, 16 nt, Mycobacterium bovis subsp bovis AF2122/97
cgacggcgcccagcgc

SEQ ID NO: 1075790 - RNA, 22 nt, Mycobacterium bovis subsp bovis AF2122/97
cgacggcgcccagcgcuagccg

SEQ ID NO: 1075791 - RNA, 13 nt, Mycobacterium bovis subsp bovis AF2122/97
cgacggcgcccau

SEQ ID NO: 1075792 - RNA, 15 nt, Mycobacterium bovis subsp bovis AF2122/97
cgacggcgacggcgc

SEQ ID NO: 1075793 - RNA, 16 nt, Mycobacterium bovis subsp bovis AF2122/97
cgacggcgaccaccgc

SEQ ID NO: 1075794 - RNA, 13 nt, Mycobacterium bovis subsp bovis AF2122/97
cgacggcgaccag

SEQ ID NO: 1075795 - RNA, 13 nt, Mycobacterium bovis subsp bovis AF2122/97
cgacggccgcggc

SEQ ID NO: 1075796 - RNA, 17 nt, Mycobacterium bovis subsp bovis AF2122/97
cgacggccgcggcgucg

SEQ ID NO: 1075797 - RNA, 16 nt, Mycobacterium bovis subsp bovis AF2122/97
cgacggccgccagcag

SEQ ID NO: 1075798 - RNA, 13 nt, Mycobacterium bovis subsp bovis AF2122/97
cgacggcccucga

SEQ ID NO: 1075799 - RNA, 19 nt, Mycobacterium bovis subsp bovis AF2122/97
cgacggcccucgagcagcg

SEQ ID NO: 1075800 - RNA, 18 nt, Mycobacterium bovis subsp bovis AF2122/97
cgacggccgacaacccgg

SEQ ID NO: 1075801 - RNA, 19 nt, Mycobacterium bovis subsp bovis AF2122/97
cgacggccgcggcgucgug

SEQ ID NO: 1075802 - RNA, 11 nt, Mycobacterium bovis subsp bovis AF2122/97
cgacggccgcu

SEQ ID NO: 1075803 - RNA, 16 nt, Mycobacterium bovis subsp bovis AF2122/97
cgacggccgcucgggc

SEQ ID NO: 1075804 - RNA, 18 nt, Mycobacterium bovis subsp bovis AF2122/97
cgacggccuggggcagcc

SEQ ID NO: 1075805 - RNA, 12 nt, Mycobacterium bovis subsp bovis AF2122/97
cgacggcagcuc

SEQ ID NO: 1075806 - RNA, 21 nt, Mycobacterium bovis subsp bovis AF2122/97
cgacggcaaaacacaccgaac

SEQ ID NO: 1075807 - RNA, 19 nt, Mycobacterium bovis subsp bovis AF2122/97
cgacggcaggcucgggcaa

SEQ ID NO: 1075808 - RNA, 20 nt, Mycobacterium bovis subsp bovis AF2122/97
cgacggcaagcacgguggcc

SEQ ID NO: 1075809 - RNA, 24 nt, Mycobacterium bovis subsp bovis AF2122/97
cgacggcaagcacgguggccgagc

SEQ ID NO: 1075810 - RNA, 13 nt, Mycobacterium bovis subsp bovis AF2122/97
cgacggcaagcca

SEQ ID NO: 1075811 - RNA, 19 nt, Mycobacterium bovis subsp bovis AF2122/97
cgacggcaaugcggggcaa

SEQ ID NO: 1075812 - RNA, 21 nt, Mycobacterium bovis subsp bovis AF2122/97
cgacggcauuucagcgcgccg

SEQ ID NO: 1075813 - RNA, 22 nt, Mycobacterium bovis subsp bovis AF2122/97
cgacggcauuucagcgcgccgc

SEQ ID NO: 1075814 - RNA, 19 nt, Mycobacterium bovis subsp bovis AF2122/97
cgacggccaagaucggcgc

SEQ ID NO: 1075815 - RNA, 14 nt, Mycobacterium bovis subsp bovis AF2122/97
cgacggccaccccg

SEQ ID NO: 1075816 - RNA, 18 nt, Mycobacterium bovis subsp bovis AF2122/97
cgacggccaccccgucgg

SEQ ID NO: 1075817 - RNA, 21 nt, Mycobacterium bovis subsp bovis AF2122/97
cgacggccaccccgucggggu

SEQ ID NO: 1075818 - RNA, 18 nt, Mycobacterium bovis subsp bovis AF2122/97
cgacggccagcgcgucgg

SEQ ID NO: 1075819 - RNA, 17 nt, Mycobacterium bovis subsp bovis AF2122/97
cgacggcccggugagcu

SEQ ID NO: 1075820 - RNA, 12 nt, Mycobacterium bovis subsp bovis AF2122/97
cgacggccagcc

SEQ ID NO: 1075821 - RNA, 13 nt, Mycobacterium bovis subsp bovis AF2122/97
cgacggccagccc

SEQ ID NO: 1075822 - RNA, 22 nt, Mycobacterium bovis subsp bovis AF2122/97
cgacggccagcccagcagguuc

SEQ ID NO: 1075823 - RNA, 20 nt, Mycobacterium bovis subsp bovis AF2122/97
cgacggccagcaagacgaug

SEQ ID NO: 1075824 - RNA, 23 nt, Mycobacterium bovis subsp bovis AF2122/97
cgacggccagcaagacgaugaca

SEQ ID NO: 1075825 - RNA, 14 nt, Mycobacterium bovis subsp bovis AF2122/97
cgacggcgccgccc

SEQ ID NO: 1075826 - RNA, 21 nt, Mycobacterium bovis subsp bovis AF2122/97
cgacggcgcccgcccgagccg

SEQ ID NO: 1075827 - RNA, 13 nt, Mycobacterium bovis subsp bovis AF2122/97
cgacggcgcccuu

SEQ ID NO: 1075828 - RNA, 14 nt, Mycobacterium bovis subsp bovis AF2122/97
cgacggcgccgaac

SEQ ID NO: 1075829 - RNA, 17 nt, Mycobacterium bovis subsp bovis AF2122/97
cgacggcggcacgggcg

SEQ ID NO: 1075830 - RNA, 12 nt, Mycobacterium bovis subsp bovis AF2122/97
cgacggcggcca

SEQ ID NO: 1075831 - RNA, 13 nt, Mycobacterium bovis subsp bovis AF2122/97
cgacggcggccaa

SEQ ID NO: 1075832 - RNA, 16 nt, Mycobacterium bovis subsp bovis AF2122/97
cgacggcgcggugcgc

SEQ ID NO: 1075833 - RNA, 22 nt, Mycobacterium bovis subsp bovis AF2122/97
cgacggcggccaaggucgaccc

SEQ ID NO: 1075834 - RNA, 17 nt, Mycobacterium bovis subsp bovis AF2122/97
cgacggcggccgccacu

SEQ ID NO: 1075835 - RNA, 23 nt, Mycobacterium bovis subsp bovis AF2122/97
cgacggcggccgccacuccgugc

SEQ ID NO: 1075836 - RNA, 12 nt, Mycobacterium bovis subsp bovis AF2122/97
cgacggcggccu

SEQ ID NO: 1075837 - RNA, 15 nt, Mycobacterium bovis subsp bovis AF2122/97
cgacggcggccuucg

SEQ ID NO: 1075838 - RNA, 19 nt, Mycobacterium bovis subsp bovis AF2122/97
cgacggcggcgucgaugag

SEQ ID NO: 1075839 - RNA, 14 nt, Mycobacterium bovis subsp bovis AF2122/97
cgacggcggcgucg

SEQ ID NO: 1075840 - RNA, 15 nt, Mycobacterium bovis subsp bovis AF2122/97
cgacggcggcgucga

SEQ ID NO: 1075841 - RNA, 23 nt, Mycobacterium bovis subsp bovis AF2122/97
cgacggcggccuucggccggcgu

SEQ ID NO: 1075842 - RNA, 17 nt, Mycobacterium bovis subsp bovis AF2122/97
cgacggcgucgacugcg

SEQ ID NO: 1075843 - RNA, 23 nt, Mycobacterium bovis subsp bovis AF2122/97
cgacggcgucgacugcgugccgc

SEQ ID NO: 1075844 - RNA, 14 nt, Mycobacterium bovis subsp bovis AF2122/97
cgacggcgucuucg

SEQ ID NO: 1075845 - RNA, 16 nt, Mycobacterium bovis subsp bovis AF2122/97
cgacgggaaagccacc

SEQ ID NO: 1075846 - RNA, 21 nt, Mycobacterium bovis subsp bovis AF2122/97
cgacgggaaccagcggucggc

SEQ ID NO: 1075847 - RNA, 15 nt, Mycobacterium bovis subsp bovis AF2122/97
cgacgggaaccucga

SEQ ID NO: 1075848 - RNA, 17 nt, Mycobacterium bovis subsp bovis AF2122/97
cgacggcugcgccgaac

SEQ ID NO: 1075849 - RNA, 21 nt, Mycobacterium bovis subsp bovis AF2122/97
cgacggcuccuccgguaucgg

SEQ ID NO: 1075850 - RNA, 14 nt, Mycobacterium bovis subsp bovis AF2122/97
cgacgggacaaccc

SEQ ID NO: 1075851 - RNA, 18 nt, Mycobacterium bovis subsp bovis AF2122/97
cgacgggagcgacgucgg

SEQ ID NO: 1075852 - RNA, 23 nt, Mycobacterium bovis subsp bovis AF2122/97
cgacgggaaccucgaccgucacc

SEQ ID NO: 1075853 - RNA, 18 nt, Mycobacterium bovis subsp bovis AF2122/97
cgacgggcacccgagccg

SEQ ID NO: 1075854 - RNA, 11 nt, Mycobacterium bovis subsp bovis AF2122/97
cgacgggccgc

SEQ ID NO: 1075855 - RNA, 14 nt, Mycobacterium bovis subsp bovis AF2122/97
cgacgggccgcgaa

SEQ ID NO: 1075856 - RNA, 14 nt, Mycobacterium bovis subsp bovis AF2122/97
cgacgggcacgcgg

SEQ ID NO: 1075857 - RNA, 20 nt, Mycobacterium bovis subsp bovis AF2122/97
cgacgggcgcaacgaccuau

SEQ ID NO: 1075858 - RNA, 12 nt, Mycobacterium bovis subsp bovis AF2122/97
cgacgggcgcca

SEQ ID NO: 1075859 - RNA, 20 nt, Mycobacterium bovis subsp bovis AF2122/97
cgacggggaacguccgcgcc

SEQ ID NO: 1075860 - RNA, 13 nt, Mycobacterium bovis subsp bovis AF2122/97
cgacggugccacc

SEQ ID NO: 1075861 - RNA, 17 nt, Mycobacterium bovis subsp bovis AF2122/97
cgacggugccaccgcga

SEQ ID NO: 1075862 - RNA, 18 nt, Mycobacterium bovis subsp bovis AF2122/97
cgacggugccaccgcgac

SEQ ID NO: 1075863 - RNA, 15 nt, Mycobacterium bovis subsp bovis AF2122/97
cgacggugccgucgg

SEQ ID NO: 1075864 - RNA, 13 nt, Mycobacterium bovis subsp bovis AF2122/97
cgacggugacgac

SEQ ID NO: 1075865 - RNA, 14 nt, Mycobacterium bovis subsp bovis AF2122/97
cgacgguggcgccg

SEQ ID NO: 1075866 - RNA, 18 nt, Mycobacterium bovis subsp bovis AF2122/97
cgacgguggcgccgucgg

SEQ ID NO: 1075867 - RNA, 22 nt, Mycobacterium bovis subsp bovis AF2122/97
cgacgguggcgccgucggccga

SEQ ID NO: 1075868 - RNA, 13 nt, Mycobacterium bovis subsp bovis AF2122/97
cgacggugaucag

SEQ ID NO: 1075869 - RNA, 20 nt, Mycobacterium bovis subsp bovis AF2122/97
cgacgguguagccgccggca

SEQ ID NO: 1075870 - RNA, 23 nt, Mycobacterium bovis subsp bovis AF2122/97
cgacgguguagccgccggcagug

SEQ ID NO: 1075871 - RNA, 15 nt, Mycobacterium bovis subsp bovis AF2122/97
cgacgguuugcaccg

SEQ ID NO: 1075872 - RNA, 21 nt, Mycobacterium bovis subsp bovis AF2122/97
cgacgguuugcaccgcggcca

SEQ ID NO: 1075873 - RNA, 18 nt, Mycobacterium bovis subsp bovis AF2122/97
cgacguaaugcgcugccg

SEQ ID NO: 1075874 - RNA, 19 nt, Mycobacterium bovis subsp bovis AF2122/97
cgacguaaugcgcugccgc

SEQ ID NO: 1075875 - RNA, 22 nt, Mycobacterium bovis subsp bovis AF2122/97
cgacggucacgguggugucagc

SEQ ID NO: 1075876 - RNA, 15 nt, Mycobacterium bovis subsp bovis AF2122/97
cgacggucaccggcg

SEQ ID NO: 1075877 - RNA, 16 nt, Mycobacterium bovis subsp bovis AF2122/97
cgacggucaccggcgc

SEQ ID NO: 1075878 - RNA, 15 nt, Mycobacterium bovis subsp bovis AF2122/97
cgacggucacggugg

SEQ ID NO: 1075879 - RNA, 16 nt, Mycobacterium bovis subsp bovis AF2122/97
cgacggucccggcacg

SEQ ID NO: 1075880 - RNA, 16 nt, Mycobacterium bovis subsp bovis AF2122/97
cgacggugaaccacca

SEQ ID NO: 1075881 - RNA, 17 nt, Mycobacterium bovis subsp bovis AF2122/97
cgacggugaaccaccac

SEQ ID NO: 1075882 - RNA, 19 nt, Mycobacterium bovis subsp bovis AF2122/97
cgacggugaaccaccacuu

SEQ ID NO: 1075883 - RNA, 14 nt, Mycobacterium bovis subsp bovis AF2122/97
cgacgggucggcgc

SEQ ID NO: 1075884 - RNA, 15 nt, Mycobacterium bovis subsp bovis AF2122/97
cgacgggucggcgcc

SEQ ID NO: 1075885 - RNA, 16 nt, Mycobacterium bovis subsp bovis AF2122/97
cgacgguaggcccgcg

SEQ ID NO: 1075886 - RNA, 15 nt, Mycobacterium bovis subsp bovis AF2122/97
cgacggucaacgaca

SEQ ID NO: 1075887 - RNA, 16 nt, Mycobacterium bovis subsp bovis AF2122/97
cgacggucaacgacau

SEQ ID NO: 1075888 - RNA, 22 nt, Mycobacterium bovis subsp bovis AF2122/97
cgacggucaaggugcgccgcca

SEQ ID NO: 1075889 - RNA, 14 nt, Mycobacterium bovis subsp bovis AF2122/97
cgacggucaccggc

SEQ ID NO: 1075890 - RNA, 21 nt, Mycobacterium bovis subsp bovis AF2122/97
cgacggggauggagccgguga

SEQ ID NO: 1075891 - RNA, 15 nt, Mycobacterium bovis subsp bovis AF2122/97
cgacggguccgggcc

SEQ ID NO: 1075892 - RNA, 23 nt, Mycobacterium bovis subsp bovis AF2122/97
cgacucggucucauagugcaggu

SEQ ID NO: 1075893 - RNA, 19 nt, Mycobacterium bovis subsp bovis AF2122/97
cgacucguggcgccacggc

SEQ ID NO: 1075894 - RNA, 20 nt, Mycobacterium bovis subsp bovis AF2122/97
cgacucguggcgccacggca

SEQ ID NO: 1075895 - RNA, 16 nt, Mycobacterium bovis subsp bovis AF2122/97
cgacucugugacgggc

SEQ ID NO: 1075896 - RNA, 17 nt, Mycobacterium bovis subsp bovis AF2122/97
cgacucugugacgggca

SEQ ID NO: 1075897 - RNA, 13 nt, Mycobacterium bovis subsp bovis AF2122/97
cgacucggccagg

SEQ ID NO: 1075898 - RNA, 22 nt, Mycobacterium bovis subsp bovis AF2122/97
cgacuagacgccgccgcugccg

SEQ ID NO: 1075899 - RNA, 15 nt, Mycobacterium bovis subsp bovis AF2122/97
cgacucggcaccgcg

SEQ ID NO: 1075900 - RNA, 13 nt, Mycobacterium bovis subsp bovis AF2122/97
cgacucggugcgg

SEQ ID NO: 1075901 - RNA, 15 nt, Mycobacterium bovis subsp bovis AF2122/97
cgacucggugcggug

SEQ ID NO: 1075902 - RNA, 23 nt, Mycobacterium bovis subsp bovis AF2122/97
cgacucggcggcgcggucgaagc

SEQ ID NO: 1075903 - RNA, 19 nt, Mycobacterium bovis subsp bovis AF2122/97
cgacugagaucgcuucccg

SEQ ID NO: 1075904 - RNA, 13 nt, Mycobacterium bovis subsp bovis AF2122/97
cgacugagaucgc

SEQ ID NO: 1075905 - RNA, 15 nt, Mycobacterium bovis subsp bovis AF2122/97
cgacugcaccuggcc

SEQ ID NO: 1075906 - RNA, 16 nt, Mycobacterium bovis subsp bovis AF2122/97
cgacugauccucgaug

SEQ ID NO: 1075907 - RNA, 13 nt, Mycobacterium bovis subsp bovis AF2122/97
cgacucgccggcg

SEQ ID NO: 1075908 - RNA, 14 nt, Mycobacterium bovis subsp bovis AF2122/97
cgacucgccggcga

SEQ ID NO: 1075909 - RNA, 14 nt, Mycobacterium bovis subsp bovis AF2122/97
cgacucggcaccgc

SEQ ID NO: 1075910 - RNA, 16 nt, Mycobacterium bovis subsp bovis AF2122/97
cgacucgaccgcgacg

SEQ ID NO: 1075911 - RNA, 20 nt, Mycobacterium bovis subsp bovis AF2122/97
cgacucgagagggaucacgc

SEQ ID NO: 1075912 - RNA, 20 nt, Mycobacterium bovis subsp bovis AF2122/97
cgacucgaggaccugcucgg

SEQ ID NO: 1075913 - RNA, 22 nt, Mycobacterium bovis subsp bovis AF2122/97
cgacucgauauaacccggcucc

SEQ ID NO: 1075914 - RNA, 16 nt, Mycobacterium bovis subsp bovis AF2122/97
cgacuaucggccgccg

SEQ ID NO: 1075915 - RNA, 17 nt, Mycobacterium bovis subsp bovis AF2122/97
cgacuaucggccgccgg

SEQ ID NO: 1075916 - RNA, 18 nt, Mycobacterium bovis subsp bovis AF2122/97
cgacuaucggccgccgga

SEQ ID NO: 1075917 - RNA, 18 nt, Mycobacterium bovis subsp bovis AF2122/97
cgacuacccagccagccg

SEQ ID NO: 1075918 - RNA, 19 nt, Mycobacterium bovis subsp bovis AF2122/97
cgacuacccagccagccgc

SEQ ID NO: 1075919 - RNA, 16 nt, Mycobacterium bovis subsp bovis AF2122/97
cgacguugcgaggccg

SEQ ID NO: 1075920 - RNA, 18 nt, Mycobacterium bovis subsp bovis AF2122/97
cgacguugcgaggccgca

SEQ ID NO: 1075921 - RNA, 20 nt, Mycobacterium bovis subsp bovis AF2122/97
cgacguugauccccagcucc

SEQ ID NO: 1075922 - RNA, 16 nt, Mycobacterium bovis subsp bovis AF2122/97
cgacguugaucgccau

SEQ ID NO: 1075923 - RNA, 20 nt, Mycobacterium bovis subsp bovis AF2122/97
cgacguugcuggcugggugg

SEQ ID NO: 1075924 - RNA, 21 nt, Mycobacterium bovis subsp bovis AF2122/97
cgacguugcuggcuggguggc

SEQ ID NO: 1075925 - RNA, 14 nt, Mycobacterium bovis subsp bovis AF2122/97
cgacguuggcggga

SEQ ID NO: 1075926 - RNA, 20 nt, Mycobacterium bovis subsp bovis AF2122/97
cgacguuggcgugcaccgca

SEQ ID NO: 1075927 - RNA, 13 nt, Mycobacterium bovis subsp bovis AF2122/97
cgacuaccaucgc

SEQ ID NO: 1075928 - RNA, 15 nt, Mycobacterium bovis subsp bovis AF2122/97
cgacuaccaucgccg

SEQ ID NO: 1075929 - RNA, 20 nt, Mycobacterium bovis subsp bovis AF2122/97
cgacuacacauucauccacc

SEQ ID NO: 1075930 - RNA, 15 nt, Mycobacterium bovis subsp bovis AF2122/97
cgacguagauggugg

SEQ ID NO: 1075931 - RNA, 17 nt, Mycobacterium bovis subsp bovis AF2122/97
cgacguagacgacgucg

SEQ ID NO: 1075932 - RNA, 18 nt, Mycobacterium bovis subsp bovis AF2122/97
cgacguaguugccggcuu

SEQ ID NO: 1075933 - RNA, 23 nt, Mycobacterium bovis subsp bovis AF2122/97
cgacguauucguuggggcugccg

SEQ ID NO: 1075934 - RNA, 17 nt, Mycobacterium bovis subsp bovis AF2122/97
cgacguauuggcgcagc

SEQ ID NO: 1075935 - RNA, 23 nt, Mycobacterium bovis subsp bovis AF2122/97
cgacguauuucgcccccuggaug

SEQ ID NO: 1075936 - RNA, 13 nt, Mycobacterium bovis subsp bovis AF2122/97
cgacguccaccag

SEQ ID NO: 1075937 - RNA, 17 nt, Mycobacterium bovis subsp bovis AF2122/97
cgacguccaucccggcg

SEQ ID NO: 1075938 - RNA, 19 nt, Mycobacterium bovis subsp bovis AF2122/97
cgacguccaucccggcgcc

SEQ ID NO: 1075939 - RNA, 16 nt, Mycobacterium bovis subsp bovis AF2122/97
cgacguccgaucggug

SEQ ID NO: 1075940 - RNA, 12 nt, Mycobacterium bovis subsp bovis AF2122/97
cgacguccacca

SEQ ID NO: 1075941 - RNA, 23 nt, Mycobacterium bovis subsp bovis AF2122/97
cgacguaguagcgaugcacccca

SEQ ID NO: 1075942 - RNA, 22 nt, Mycobacterium bovis subsp bovis AF2122/97
cgacgucaggcagcuccgccgc

SEQ ID NO: 1075943 - RNA, 22 nt, Mycobacterium bovis subsp bovis AF2122/97
cgacgucaggguauccacgccg

SEQ ID NO: 1075944 - RNA, 14 nt, Mycobacterium bovis subsp bovis AF2122/97
cgacguccgcgacu

SEQ ID NO: 1075945 - RNA, 15 nt, Mycobacterium bovis subsp bovis AF2122/97
cgacguccgcgacuu

SEQ ID NO: 1075946 - RNA, 16 nt, Mycobacterium bovis subsp bovis AF2122/97
aacaagguauggccgg

SEQ ID NO: 1075947 - RNA, 14 nt, Mycobacterium bovis subsp bovis AF2122/97
cgacguccucgacg

SEQ ID NO: 1075948 - RNA, 17 nt, Mycobacterium bovis subsp bovis AF2122/97
cgacguugaagccgccg

SEQ ID NO: 1075949 - RNA, 23 nt, Mycobacterium bovis subsp bovis AF2122/97
cgacguugaagccgccggaguug

SEQ ID NO: 1075950 - RNA, 20 nt, Mycobacterium bovis subsp bovis AF2122/97
cgagaauuccccagccgcau

SEQ ID NO: 1075951 - RNA, 14 nt, Mycobacterium bovis subsp bovis AF2122/97
cgagacgucggcgu

SEQ ID NO: 1075952 - RNA, 15 nt, Mycobacterium bovis subsp bovis AF2122/97
cgagacuccgccuug

SEQ ID NO: 1075953 - RNA, 14 nt, Mycobacterium bovis subsp bovis AF2122/97
cgagacuucgacgc

SEQ ID NO: 1075954 - RNA, 20 nt, Mycobacterium bovis subsp bovis AF2122/97
cgagacuucgacgcggcgac

SEQ ID NO: 1075955 - RNA, 22 nt, Mycobacterium bovis subsp bovis AF2122/97
cgagacuucgacgcggcgaccg

SEQ ID NO: 1075956 - RNA, 24 nt, Mycobacterium bovis subsp bovis AF2122/97
cgagacuugcuggcccgcacgaac

SEQ ID NO: 1075957 - RNA, 17 nt, Mycobacterium bovis subsp bovis AF2122/97
cgagaaucacggucauc

SEQ ID NO: 1075958 - RNA, 19 nt, Mycobacterium bovis subsp bovis AF2122/97
cgagaacugcucgauccgc

SEQ ID NO: 1075959 - RNA, 16 nt, Mycobacterium bovis subsp bovis AF2122/97
cgacugaucgccaccc

SEQ ID NO: 1075960 - RNA, 15 nt, Mycobacterium bovis subsp bovis AF2122/97
cgacugcagcggcgc

SEQ ID NO: 1075961 - RNA, 16 nt, Mycobacterium bovis subsp bovis AF2122/97
cgacugcagcggcgca

SEQ ID NO: 1075962 - RNA, 12 nt, Mycobacterium bovis subsp bovis AF2122/97
cgacugccaccg

SEQ ID NO: 1075963 - RNA, 18 nt, Mycobacterium bovis subsp bovis AF2122/97
cgacugccagcgccgcgg

SEQ ID NO: 1075964 - RNA, 19 nt, Mycobacterium bovis subsp bovis AF2122/97
cgacugcgucggcggcuuc

SEQ ID NO: 1075965 - RNA, 18 nt, Mycobacterium bovis subsp bovis AF2122/97
cgacugccguucagcggc

SEQ ID NO: 1075966 - RNA, 22 nt, Mycobacterium bovis subsp bovis AF2122/97
cgacugcgaaugcugggcccgc

SEQ ID NO: 1075967 - RNA, 19 nt, Mycobacterium bovis subsp bovis AF2122/97
cgacuggaucgcgauggcc

SEQ ID NO: 1075968 - RNA, 14 nt, Mycobacterium bovis subsp bovis AF2122/97
cgacuggccccgcc

SEQ ID NO: 1075969 - RNA, 18 nt, Mycobacterium bovis subsp bovis AF2122/97
cgacuggccccgccagcg

SEQ ID NO: 1075970 - RNA, 20 nt, Mycobacterium bovis subsp bovis AF2122/97
cgacuggccccgccagcggc

SEQ ID NO: 1075971 - RNA, 19 nt, Mycobacterium bovis subsp bovis AF2122/97
cgacuguccccguugagau

SEQ ID NO: 1075972 - RNA, 22 nt, Mycobacterium bovis subsp bovis AF2122/97
cgacugugaaucugacgacgcg

SEQ ID NO: 1075973 - RNA, 23 nt, Mycobacterium bovis subsp bovis AF2122/97
cgacugugaaucugacgacgcga

SEQ ID NO: 1075974 - RNA, 18 nt, Mycobacterium bovis subsp bovis AF2122/97
cgacugugcgccgcagcc

SEQ ID NO: 1075975 - RNA, 14 nt, Mycobacterium bovis subsp bovis AF2122/97
cgacuguggcgccg

SEQ ID NO: 1075976 - RNA, 17 nt, Mycobacterium bovis subsp bovis AF2122/97
cgacuguggcgccgccg

SEQ ID NO: 1075977 - RNA, 19 nt, Mycobacterium bovis subsp bovis AF2122/97
cgacuggguggugcucacc

SEQ ID NO: 1075978 - RNA, 14 nt, Mycobacterium bovis subsp bovis AF2122/97
cgacugggcgccca

SEQ ID NO: 1075979 - RNA, 17 nt, Mycobacterium bovis subsp bovis AF2122/97
cgacugggacgacgcca

SEQ ID NO: 1075980 - RNA, 14 nt, Mycobacterium bovis subsp bovis AF2122/97
cgacugggacgacg

SEQ ID NO: 1075981 - RNA, 16 nt, Mycobacterium bovis subsp bovis AF2122/97
cgagcacccgcaaugc

SEQ ID NO: 1075982 - RNA, 20 nt, Mycobacterium bovis subsp bovis AF2122/97
cgagcacccguugaucgcgg

SEQ ID NO: 1075983 - RNA, 18 nt, Mycobacterium bovis subsp bovis AF2122/97
cgagcaccccgacguucg

SEQ ID NO: 1075984 - RNA, 16 nt, Mycobacterium bovis subsp bovis AF2122/97
cgagcaccgacaccgg

SEQ ID NO: 1075985 - RNA, 20 nt, Mycobacterium bovis subsp bovis AF2122/97
cgagcaccauccggucccgc

SEQ ID NO: 1075986 - RNA, 14 nt, Mycobacterium bovis subsp bovis AF2122/97
cgagcacaccgucg

SEQ ID NO: 1075987 - RNA, 16 nt, Mycobacterium bovis subsp bovis AF2122/97
cgagcacccgcuccau

SEQ ID NO: 1075988 - RNA, 15 nt, Mycobacterium bovis subsp bovis AF2122/97
cgagcacccgcuggu

SEQ ID NO: 1075989 - RNA, 16 nt, Mycobacterium bovis subsp bovis AF2122/97
cgagcacccgcugguc

SEQ ID NO: 1075990 - RNA, 22 nt, Mycobacterium bovis subsp bovis AF2122/97
cgagcacaugcugccgcugcga

SEQ ID NO: 1075991 - RNA, 14 nt, Mycobacterium bovis subsp bovis AF2122/97
cgagcaccacccca

SEQ ID NO: 1075992 - RNA, 17 nt, Mycobacterium bovis subsp bovis AF2122/97
cgagcaccaccccagcg

SEQ ID NO: 1075993 - RNA, 19 nt, Mycobacterium bovis subsp bovis AF2122/97
cgagcaccaccccagcggc

SEQ ID NO: 1075994 - RNA, 14 nt, Mycobacterium bovis subsp bovis AF2122/97
cgagcaccacccgg

SEQ ID NO: 1075995 - RNA, 17 nt, Mycobacterium bovis subsp bovis AF2122/97
cgagcaccacccgggcc

SEQ ID NO: 1075996 - RNA, 19 nt, Mycobacterium bovis subsp bovis AF2122/97
cgagcaccacccgggccuc

SEQ ID NO: 1075997 - RNA, 19 nt, Mycobacterium bovis subsp bovis AF2122/97
cgagaucgcggcgacccgg

SEQ ID NO: 1075998 - RNA, 14 nt, Mycobacterium bovis subsp bovis AF2122/97
cgagcacacgucgg

SEQ ID NO: 1075999 - RNA, 21 nt, Mycobacterium bovis subsp bovis AF2122/97
cgagcacacuccuagccaacg

SEQ ID NO: 1076000 - RNA, 16 nt, Mycobacterium bovis subsp bovis AF2122/97
cgagcacacaacaccc

SEQ ID NO: 1076001 - RNA, 16 nt, Mycobacterium bovis subsp bovis AF2122/97
cgagaucaccgccacc

SEQ ID NO: 1076002 - RNA, 16 nt, Mycobacterium bovis subsp bovis AF2122/97
cgagaucaugccggcg

SEQ ID NO: 1076003 - RNA, 15 nt, Mycobacterium bovis subsp bovis AF2122/97
cgagaucagccggca

SEQ ID NO: 1076004 - RNA, 16 nt, Mycobacterium bovis subsp bovis AF2122/97
cgagaucagccggcag

SEQ ID NO: 1076005 - RNA, 19 nt, Mycobacterium bovis subsp bovis AF2122/97
cgagaucagccggcagcga

SEQ ID NO: 1076006 - RNA, 14 nt, Mycobacterium bovis subsp bovis AF2122/97
cgagaucgccgagc

SEQ ID NO: 1076007 - RNA, 15 nt, Mycobacterium bovis subsp bovis AF2122/97
cgagaucgccgagca

SEQ ID NO: 1076008 - RNA, 19 nt, Mycobacterium bovis subsp bovis AF2122/97
cgagauccuucgcguuggc

SEQ ID NO: 1076009 - RNA, 21 nt, Mycobacterium bovis subsp bovis AF2122/97
cgagaucagccggcagcgaga

SEQ ID NO: 1076010 - RNA, 20 nt, Mycobacterium bovis subsp bovis AF2122/97
cgagaucgccguugccggcg

SEQ ID NO: 1076011 - RNA, 14 nt, Mycobacterium bovis subsp bovis AF2122/97
cgagaucccagcgg

SEQ ID NO: 1076012 - RNA, 16 nt, Mycobacterium bovis subsp bovis AF2122/97
cgagaucccagcggga

SEQ ID NO: 1076013 - RNA, 14 nt, Mycobacterium bovis subsp bovis AF2122/97
cgagaucaccgcca

SEQ ID NO: 1076014 - RNA, 15 nt, Mycobacterium bovis subsp bovis AF2122/97
cgagaucaccgccac

SEQ ID NO: 1076015 - RNA, 18 nt, Mycobacterium bovis subsp bovis AF2122/97
cgagaucaaaaacguccg

SEQ ID NO: 1076016 - RNA, 14 nt, Mycobacterium bovis subsp bovis AF2122/97
cgagauagucggcc

SEQ ID NO: 1076017 - RNA, 16 nt, Mycobacterium bovis subsp bovis AF2122/97
cgagauagucggccgg

SEQ ID NO: 1076018 - RNA, 18 nt, Mycobacterium bovis subsp bovis AF2122/97
cgagagccuccauggccu

SEQ ID NO: 1076019 - RNA, 14 nt, Mycobacterium bovis subsp bovis AF2122/97
cgagagccucggcc

SEQ ID NO: 1076020 - RNA, 16 nt, Mycobacterium bovis subsp bovis AF2122/97
cgagagccucggccau

SEQ ID NO: 1076021 - RNA, 20 nt, Mycobacterium bovis subsp bovis AF2122/97
cgagagccccgaccagcaga

SEQ ID NO: 1076022 - RNA, 23 nt, Mycobacterium bovis subsp bovis AF2122/97
cgagagccccgaccagcagacca

SEQ ID NO: 1076023 - RNA, 15 nt, Mycobacterium bovis subsp bovis AF2122/97
cgagagccgaccggg

SEQ ID NO: 1076024 - RNA, 21 nt, Mycobacterium bovis subsp bovis AF2122/97
cgagagccgaccggguaaagc

SEQ ID NO: 1076025 - RNA, 17 nt, Mycobacterium bovis subsp bovis AF2122/97
cgagagccggcggcgac

SEQ ID NO: 1076026 - RNA, 18 nt, Mycobacterium bovis subsp bovis AF2122/97
cgacgacaaccggccaga

SEQ ID NO: 1076027 - RNA, 21 nt, Mycobacterium bovis subsp bovis AF2122/97
cgacgacaagguguggugaca

SEQ ID NO: 1076028 - RNA, 18 nt, Mycobacterium bovis subsp bovis AF2122/97
cgacgacaagugcccggc

SEQ ID NO: 1076029 - RNA, 23 nt, Mycobacterium bovis subsp bovis AF2122/97
cgacgacauacgagcagugaccg

SEQ ID NO: 1076030 - RNA, 17 nt, Mycobacterium bovis subsp bovis AF2122/97
cgacgacaucgguggcc

SEQ ID NO: 1076031 - RNA, 21 nt, Mycobacterium bovis subsp bovis AF2122/97
cgacgacaucgguggcccggu

SEQ ID NO: 1076032 - RNA, 18 nt, Mycobacterium bovis subsp bovis AF2122/97
cgacgacaucugcccagc

SEQ ID NO: 1076033 - RNA, 14 nt, Mycobacterium bovis subsp bovis AF2122/97
cgacgaccacacca

SEQ ID NO: 1076034 - RNA, 22 nt, Mycobacterium bovis subsp bovis AF2122/97
cgacgaccacaccacgauggcg

SEQ ID NO: 1076035 - RNA, 16 nt, Mycobacterium bovis subsp bovis AF2122/97
cgacgacguccucgac

SEQ ID NO: 1076036 - RNA, 18 nt, Mycobacterium bovis subsp bovis AF2122/97
cgacgacguccucgacga

SEQ ID NO: 1076037 - RNA, 22 nt, Mycobacterium bovis subsp bovis AF2122/97
cgacgacacguugacgaugugc

SEQ ID NO: 1076038 - RNA, 12 nt, Mycobacterium bovis subsp bovis AF2122/97
cgacgacggcga

SEQ ID NO: 1076039 - RNA, 19 nt, Mycobacterium bovis subsp bovis AF2122/97
cgacgacggcgacggcgcc

SEQ ID NO: 1076040 - RNA, 23 nt, Mycobacterium bovis subsp bovis AF2122/97
cgacgacuuggauggccgaaccc

SEQ ID NO: 1076041 - RNA, 24 nt, Mycobacterium bovis subsp bovis AF2122/97
cgacgacuccggcaagcacaccgc

SEQ ID NO: 1076042 - RNA, 14 nt, Mycobacterium bovis subsp bovis AF2122/97
cgacgacgggguug

SEQ ID NO: 1076043 - RNA, 23 nt, Mycobacterium bovis subsp bovis AF2122/97
cgacgaccagguaaugguggcgu

SEQ ID NO: 1076044 - RNA, 17 nt, Mycobacterium bovis subsp bovis AF2122/97
cgacgagacgaaccgcc

SEQ ID NO: 1076045 - RNA, 23 nt, Mycobacterium bovis subsp bovis AF2122/97
cgacgagacgcaaaaucgcccga

SEQ ID NO: 1076046 - RNA, 15 nt, Mycobacterium bovis subsp bovis AF2122/97
cgacgagacggcagg

SEQ ID NO: 1076047 - RNA, 20 nt, Mycobacterium bovis subsp bovis AF2122/97
cgacgagauagcauccgccc

SEQ ID NO: 1076048 - RNA, 17 nt, Mycobacterium bovis subsp bovis AF2122/97
cgacgagauugccgggc

SEQ ID NO: 1076049 - RNA, 18 nt, Mycobacterium bovis subsp bovis AF2122/97
cgacgagauugccgggcc

SEQ ID NO: 1076050 - RNA, 20 nt, Mycobacterium bovis subsp bovis AF2122/97
cgacgagauugccgggccgc

SEQ ID NO: 1076051 - RNA, 13 nt, Mycobacterium bovis subsp bovis AF2122/97
cgacgagcaacgc

SEQ ID NO: 1076052 - RNA, 15 nt, Mycobacterium bovis subsp bovis AF2122/97
cgacgaucagcacgu

SEQ ID NO: 1076053 - RNA, 19 nt, Mycobacterium bovis subsp bovis AF2122/97
cgacgagcaacgccacccg

SEQ ID NO: 1076054 - RNA, 20 nt, Mycobacterium bovis subsp bovis AF2122/97
cgacgaucagcacgucgcgg

SEQ ID NO: 1076055 - RNA, 14 nt, Mycobacterium bovis subsp bovis AF2122/97
cgacgauccgcacg

SEQ ID NO: 1076056 - RNA, 23 nt, Mycobacterium bovis subsp bovis AF2122/97
cgacgaucauauggccgccgaac

SEQ ID NO: 1076057 - RNA, 14 nt, Mycobacterium bovis subsp bovis AF2122/97
cgacgauccacggc

SEQ ID NO: 1076058 - RNA, 22 nt, Mycobacterium bovis subsp bovis AF2122/97
cgacgaucaacggaacaucguc

SEQ ID NO: 1076059 - RNA, 14 nt, Mycobacterium bovis subsp bovis AF2122/97
cgacgaugcgggcg

SEQ ID NO: 1076060 - RNA, 20 nt, Mycobacterium bovis subsp bovis AF2122/97
cgacgaugccucggcggccu

SEQ ID NO: 1076061 - RNA, 16 nt, Mycobacterium bovis subsp bovis AF2122/97
cgacgaucaacggaac

SEQ ID NO: 1076062 - RNA, 14 nt, Mycobacterium bovis subsp bovis AF2122/97
cgacgagucgccgc

SEQ ID NO: 1076063 - RNA, 14 nt, Mycobacterium bovis subsp bovis AF2122/97
cgacgagucggcgg

SEQ ID NO: 1076064 - RNA, 16 nt, Mycobacterium bovis subsp bovis AF2122/97
cgacgagugguccggc

SEQ ID NO: 1076065 - RNA, 21 nt, Mycobacterium bovis subsp bovis AF2122/97
cgacgagugguccggcggccg

SEQ ID NO: 1076066 - RNA, 12 nt, Mycobacterium bovis subsp bovis AF2122/97
cgacgagucgcc

SEQ ID NO: 1076067 - RNA, 17 nt, Mycobacterium bovis subsp bovis AF2122/97
cgacgagauccagcgcc

SEQ ID NO: 1076068 - RNA, 22 nt, Mycobacterium bovis subsp bovis AF2122/97
cgacgauagcggcccgaucacc

SEQ ID NO: 1076069 - RNA, 15 nt, Mycobacterium bovis subsp bovis AF2122/97
cgacgaaaggcgcgu

SEQ ID NO: 1076070 - RNA, 16 nt, Mycobacterium bovis subsp bovis AF2122/97
cgacgaaaggcgcguu

SEQ ID NO: 1076071 - RNA, 23 nt, Mycobacterium bovis subsp bovis AF2122/97
cgacgaaaggcucaaucgaugag

SEQ ID NO: 1076072 - RNA, 18 nt, Mycobacterium bovis subsp bovis AF2122/97
cgaccuuuugcggcaagc

SEQ ID NO: 1076073 - RNA, 16 nt, Mycobacterium bovis subsp bovis AF2122/97
cgaccuugcaccggcc

SEQ ID NO: 1076074 - RNA, 18 nt, Mycobacterium bovis subsp bovis AF2122/97
cgaccuugguguggggcg

SEQ ID NO: 1076075 - RNA, 13 nt, Mycobacterium bovis subsp bovis AF2122/97
cgacgaagucgca

SEQ ID NO: 1076076 - RNA, 20 nt, Mycobacterium bovis subsp bovis AF2122/97
cgacgaauaccgggaugcga

SEQ ID NO: 1076077 - RNA, 14 nt, Mycobacterium bovis subsp bovis AF2122/97
cgacgaagguggcg

SEQ ID NO: 1076078 - RNA, 20 nt, Mycobacterium bovis subsp bovis AF2122/97
cgacgaauguccgcagacga

SEQ ID NO: 1076079 - RNA, 18 nt, Mycobacterium bovis subsp bovis AF2122/97
cgacgaauaacgcggucg

SEQ ID NO: 1076080 - RNA, 21 nt, Mycobacterium bovis subsp bovis AF2122/97
cgacgaauaacgcggucggca

SEQ ID NO: 1076081 - RNA, 17 nt, Mycobacterium bovis subsp bovis AF2122/97
cgacgaauaccgggaug

SEQ ID NO: 1076082 - RNA, 18 nt, Mycobacterium bovis subsp bovis AF2122/97
cgaccuggucgcuggugc

SEQ ID NO: 1076083 - RNA, 20 nt, Mycobacterium bovis subsp bovis AF2122/97
cgaccugggacaguucgcgc

SEQ ID NO: 1076084 - RNA, 20 nt, Mycobacterium bovis subsp bovis AF2122/97
cgaccugcuggaucucggug

SEQ ID NO: 1076085 - RNA, 14 nt, Mycobacterium bovis subsp bovis AF2122/97
cgaccugcucgcug

SEQ ID NO: 1076086 - RNA, 15 nt, Mycobacterium bovis subsp bovis AF2122/97
cgaccuggacaaccu

SEQ ID NO: 1076087 - RNA, 16 nt, Mycobacterium bovis subsp bovis AF2122/97
cgaccuguaugccgcg

SEQ ID NO: 1076088 - RNA, 14 nt, Mycobacterium bovis subsp bovis AF2122/97
cgaccuguccaccc

SEQ ID NO: 1076089 - RNA, 15 nt, Mycobacterium bovis subsp bovis AF2122/97
cgaccuguccaccca

SEQ ID NO: 1076090 - RNA, 15 nt, Mycobacterium bovis subsp bovis AF2122/97
cgaccuguaugccgc

SEQ ID NO: 1076091 - RNA, 15 nt, Mycobacterium bovis subsp bovis AF2122/97
cgaccuucggcccgc

SEQ ID NO: 1076092 - RNA, 18 nt, Mycobacterium bovis subsp bovis AF2122/97
cgaccuucgggacaaagc

SEQ ID NO: 1076093 - RNA, 22 nt, Mycobacterium bovis subsp bovis AF2122/97
cgaccuucgggacaaagccgaa

SEQ ID NO: 1076094 - RNA, 16 nt, Mycobacterium bovis subsp bovis AF2122/97
cgaccuucucgaugcu

SEQ ID NO: 1076095 - RNA, 15 nt, Mycobacterium bovis subsp bovis AF2122/97
cgaccuguugucgug

SEQ ID NO: 1076096 - RNA, 15 nt, Mycobacterium bovis subsp bovis AF2122/97
cgaccucggcaacga

SEQ ID NO: 1076097 - RNA, 20 nt, Mycobacterium bovis subsp bovis AF2122/97
cgaccucggcaacgacugca

SEQ ID NO: 1076098 - RNA, 15 nt, Mycobacterium bovis subsp bovis AF2122/97
cgaccucgcggcgcu

SEQ ID NO: 1076099 - RNA, 14 nt, Mycobacterium bovis subsp bovis AF2122/97
cgaccucgccgcgc

SEQ ID NO: 1076100 - RNA, 15 nt, Mycobacterium bovis subsp bovis AF2122/97
cgaccucgccgcggc

SEQ ID NO: 1076101 - RNA, 19 nt, Mycobacterium bovis subsp bovis AF2122/97
cgaccugccggaccgcgga

SEQ ID NO: 1076102 - RNA, 20 nt, Mycobacterium bovis subsp bovis AF2122/97
cgaccugcgcgacggcgcug

SEQ ID NO: 1076103 - RNA, 20 nt, Mycobacterium bovis subsp bovis AF2122/97
cgaccugcucauccaccucg

SEQ ID NO: 1076104 - RNA, 15 nt, Mycobacterium bovis subsp bovis AF2122/97
cgaccugcucgauac

SEQ ID NO: 1076105 - RNA, 19 nt, Mycobacterium bovis subsp bovis AF2122/97
cgaccugcgcgagguuggc

SEQ ID NO: 1076106 - RNA, 23 nt, Mycobacterium bovis subsp bovis AF2122/97
cgaccugcgcgagguuggcguug

SEQ ID NO: 1076107 - RNA, 20 nt, Mycobacterium bovis subsp bovis AF2122/97
cgaccuccucgaugaccggc

SEQ ID NO: 1076108 - RNA, 16 nt, Mycobacterium bovis subsp bovis AF2122/97
cgaccuccucgaccag

SEQ ID NO: 1076109 - RNA, 19 nt, Mycobacterium bovis subsp bovis AF2122/97
cgaccuccggaaucgcccg

SEQ ID NO: 1076110 - RNA, 20 nt, Mycobacterium bovis subsp bovis AF2122/97
cgaccuccggaaucgcccgg

SEQ ID NO: 1076111 - RNA, 17 nt, Mycobacterium bovis subsp bovis AF2122/97
cgaccgucaugaagccg

SEQ ID NO: 1076112 - RNA, 23 nt, Mycobacterium bovis subsp bovis AF2122/97
cgaccgucaugaagccguugccg

SEQ ID NO: 1076113 - RNA, 20 nt, Mycobacterium bovis subsp bovis AF2122/97
cgaccguccgggucaccagc

SEQ ID NO: 1076114 - RNA, 19 nt, Mycobacterium bovis subsp bovis AF2122/97
cgaccgucgauuucgacga

SEQ ID NO: 1076115 - RNA, 21 nt, Mycobacterium bovis subsp bovis AF2122/97
cgaccgucgauuucgacgacc

SEQ ID NO: 1076116 - RNA, 16 nt, Mycobacterium bovis subsp bovis AF2122/97
cgaccgucgcgcugcc

SEQ ID NO: 1076117 - RNA, 17 nt, Mycobacterium bovis subsp bovis AF2122/97
cgaccgucgcgcugccg

SEQ ID NO: 1076118 - RNA, 21 nt, Mycobacterium bovis subsp bovis AF2122/97
cgaccgucgcgcugccggccg

SEQ ID NO: 1076119 - RNA, 22 nt, Mycobacterium bovis subsp bovis AF2122/97
cgaccgucgcgcugccggccgc

SEQ ID NO: 1076120 - RNA, 12 nt, Mycobacterium bovis subsp bovis AF2122/97
cgaccgucacgc

SEQ ID NO: 1076121 - RNA, 21 nt, Mycobacterium bovis subsp bovis AF2122/97
cgaccgucacgcguacgucgg

SEQ ID NO: 1076122 - RNA, 20 nt, Mycobacterium bovis subsp bovis AF2122/97
cgaccguauugaccagcggg

SEQ ID NO: 1076123 - RNA, 17 nt, Mycobacterium bovis subsp bovis AF2122/97
cgaccgucagggucacc

SEQ ID NO: 1076124 - RNA, 20 nt, Mycobacterium bovis subsp bovis AF2122/97
cgaccggucuggcgaugacg

SEQ ID NO: 1076125 - RNA, 13 nt, Mycobacterium bovis subsp bovis AF2122/97
cgaccggugaugu

SEQ ID NO: 1076126 - RNA, 17 nt, Mycobacterium bovis subsp bovis AF2122/97
cgaccgguggcaccggc

SEQ ID NO: 1076127 - RNA, 20 nt, Mycobacterium bovis subsp bovis AF2122/97
cgaccgguggcaccggcggc

SEQ ID NO: 1076128 - RNA, 22 nt, Mycobacterium bovis subsp bovis AF2122/97
cgaccgguggcaccggcggcga

SEQ ID NO: 1076129 - RNA, 14 nt, Mycobacterium bovis subsp bovis AF2122/97
cgaccggcccccgg

SEQ ID NO: 1076130 - RNA, 17 nt, Mycobacterium bovis subsp bovis AF2122/97
cgaccggcccccggucg

SEQ ID NO: 1076131 - RNA, 18 nt, Mycobacterium bovis subsp bovis AF2122/97
cgaccggcccccggucga

SEQ ID NO: 1076132 - RNA, 16 nt, Mycobacterium bovis subsp bovis AF2122/97
cgaccggccggccgcg

SEQ ID NO: 1076133 - RNA, 18 nt, Mycobacterium bovis subsp bovis AF2122/97
cgaccggccaacgccgcc

SEQ ID NO: 1076134 - RNA, 19 nt, Mycobacterium bovis subsp bovis AF2122/97
cgaccguauugaccagcgg

SEQ ID NO: 1076135 - RNA, 21 nt, Mycobacterium bovis subsp bovis AF2122/97
cgacccgguccacgccaggag

SEQ ID NO: 1076136 - RNA, 15 nt, Mycobacterium bovis subsp bovis AF2122/97
cgacccggucgacgg

SEQ ID NO: 1076137 - RNA, 12 nt, Mycobacterium bovis subsp bovis AF2122/97
cgacccggucac

SEQ ID NO: 1076138 - RNA, 23 nt, Mycobacterium bovis subsp bovis AF2122/97
cgacccgggucggcacgacccgg

SEQ ID NO: 1076139 - RNA, 18 nt, Mycobacterium bovis subsp bovis AF2122/97
cgacccgggggcgcccgg

SEQ ID NO: 1076140 - RNA, 19 nt, Mycobacterium bovis subsp bovis AF2122/97
cgacccggguagacaccgc

SEQ ID NO: 1076141 - RNA, 19 nt, Mycobacterium bovis subsp bovis AF2122/97
cgacccgggccggucggug

SEQ ID NO: 1076142 - RNA, 15 nt, Mycobacterium bovis subsp bovis AF2122/97
cgacccgggcgagcg

SEQ ID NO: 1076143 - RNA, 18 nt, Mycobacterium bovis subsp bovis AF2122/97
cgacccgggcgucccaau

SEQ ID NO: 1076144 - RNA, 20 nt, Mycobacterium bovis subsp bovis AF2122/97
cgacccgggccgcggcggcc

SEQ ID NO: 1076145 - RNA, 21 nt, Mycobacterium bovis subsp bovis AF2122/97
cgacccgggccgcggcggcca

SEQ ID NO: 1076146 - RNA, 15 nt, Mycobacterium bovis subsp bovis AF2122/97
cgacccgggccgguc

SEQ ID NO: 1076147 - RNA, 16 nt, Mycobacterium bovis subsp bovis AF2122/97
cgacccgccgacgccg

SEQ ID NO: 1076148 - RNA, 13 nt, Mycobacterium bovis subsp bovis AF2122/97
cgacccgccgaug

SEQ ID NO: 1076149 - RNA, 22 nt, Mycobacterium bovis subsp bovis AF2122/97
cgacccgccgaugaugcggcgc

SEQ ID NO: 1076150 - RNA, 13 nt, Mycobacterium bovis subsp bovis AF2122/97
cgacccgcccgaa

SEQ ID NO: 1076151 - RNA, 18 nt, Mycobacterium bovis subsp bovis AF2122/97
cgacccguaccagcccgu

SEQ ID NO: 1076152 - RNA, 17 nt, Mycobacterium bovis subsp bovis AF2122/97
cgacccggucgacgggu

SEQ ID NO: 1076153 - RNA, 19 nt, Mycobacterium bovis subsp bovis AF2122/97
cgacccggucgacgggucg

SEQ ID NO: 1076154 - RNA, 18 nt, Mycobacterium bovis subsp bovis AF2122/97
cgaccgccggaccgccgc

SEQ ID NO: 1076155 - RNA, 17 nt, Mycobacterium bovis subsp bovis AF2122/97
cgaccggcacccgcggc

SEQ ID NO: 1076156 - RNA, 18 nt, Mycobacterium bovis subsp bovis AF2122/97
cgaccggcacccgcggcg

SEQ ID NO: 1076157 - RNA, 21 nt, Mycobacterium bovis subsp bovis AF2122/97
cgaccggcacccgcggcgaac

SEQ ID NO: 1076158 - RNA, 20 nt, Mycobacterium bovis subsp bovis AF2122/97
cgaccggcagcgaugcggug

SEQ ID NO: 1076159 - RNA, 14 nt, Mycobacterium bovis subsp bovis AF2122/97
cgaccggcacccgc

SEQ ID NO: 1076160 - RNA, 16 nt, Mycobacterium bovis subsp bovis AF2122/97
cgaccggaaugcccgg

SEQ ID NO: 1076161 - RNA, 18 nt, Mycobacterium bovis subsp bovis AF2122/97
cgaccggaaugcccgggc

SEQ ID NO: 1076162 - RNA, 20 nt, Mycobacterium bovis subsp bovis AF2122/97
cgaccggaacguuccugcac

SEQ ID NO: 1076163 - RNA, 22 nt, Mycobacterium bovis subsp bovis AF2122/97
cgaccgcugguucucgcuguug

SEQ ID NO: 1076164 - RNA, 18 nt, Mycobacterium bovis subsp bovis AF2122/97
cgacccgucgaacgcgcg

SEQ ID NO: 1076165 - RNA, 22 nt, Mycobacterium bovis subsp bovis AF2122/97
cgaccgcgcaacaccucgucgg

SEQ ID NO: 1076166 - RNA, 21 nt, Mycobacterium bovis subsp bovis AF2122/97
cgaccgcguuguccgcggcca

SEQ ID NO: 1076167 - RNA, 23 nt, Mycobacterium bovis subsp bovis AF2122/97
cgaccgcuaacagauuguccggc

SEQ ID NO: 1076168 - RNA, 17 nt, Mycobacterium bovis subsp bovis AF2122/97
cgaccgcuaugaugccg

SEQ ID NO: 1076169 - RNA, 20 nt, Mycobacterium bovis subsp bovis AF2122/97
cgaccgcuaugaugccgccg

SEQ ID NO: 1076170 - RNA, 21 nt, Mycobacterium bovis subsp bovis AF2122/97
cgaccgcuaugaugccgccgg

SEQ ID NO: 1076171 - RNA, 24 nt, Mycobacterium bovis subsp bovis AF2122/97
cgaccgcuaugaugccgccggugc

SEQ ID NO: 1076172 - RNA, 19 nt, Mycobacterium bovis subsp bovis AF2122/97
cgaccgcgccauagcagag

SEQ ID NO: 1076173 - RNA, 14 nt, Mycobacterium bovis subsp bovis AF2122/97
cgaccgcgcccgcg

SEQ ID NO: 1076174 - RNA, 14 nt, Mycobacterium bovis subsp bovis AF2122/97
cgaccgcgcacggc

SEQ ID NO: 1076175 - RNA, 15 nt, Mycobacterium bovis subsp bovis AF2122/97
cgaccgcgacggcaa

SEQ ID NO: 1076176 - RNA, 19 nt, Mycobacterium bovis subsp bovis AF2122/97
cgacccgucccccgcacgc

SEQ ID NO: 1076177 - RNA, 18 nt, Mycobacterium bovis subsp bovis AF2122/97
cgaccgcgacccggccca

SEQ ID NO: 1076178 - RNA, 12 nt, Mycobacterium bovis subsp bovis AF2122/97
cgaccagcgcgc

SEQ ID NO: 1076179 - RNA, 14 nt, Mycobacterium bovis subsp bovis AF2122/97
cgaccagcuggccg

SEQ ID NO: 1076180 - RNA, 18 nt, Mycobacterium bovis subsp bovis AF2122/97
cgaccagcucagcugcgg

SEQ ID NO: 1076181 - RNA, 17 nt, Mycobacterium bovis subsp bovis AF2122/97
cgaccauccgaguuguc

SEQ ID NO: 1076182 - RNA, 21 nt, Mycobacterium bovis subsp bovis AF2122/97
cgaccauccgaguugucgccg

SEQ ID NO: 1076183 - RNA, 17 nt, Mycobacterium bovis subsp bovis AF2122/97
cgaccaucucaccgggc

SEQ ID NO: 1076184 - RNA, 20 nt, Mycobacterium bovis subsp bovis AF2122/97
cgaccaucucaccgggcccg

SEQ ID NO: 1076185 - RNA, 14 nt, Mycobacterium bovis subsp bovis AF2122/97
cgaccaucugaucg

SEQ ID NO: 1076186 - RNA, 17 nt, Mycobacterium bovis subsp bovis AF2122/97
cgaccaucugaucgggc

SEQ ID NO: 1076187 - RNA, 14 nt, Mycobacterium bovis subsp bovis AF2122/97
cgaccagcggccga

SEQ ID NO: 1076188 - RNA, 15 nt, Mycobacterium bovis subsp bovis AF2122/97
cgaccagcggccgac

SEQ ID NO: 1076189 - RNA, 21 nt, Mycobacterium bovis subsp bovis AF2122/97
cgaccagcacccgcucggccg

SEQ ID NO: 1076190 - RNA, 19 nt, Mycobacterium bovis subsp bovis AF2122/97
cgaccagagcuucgccgcg

SEQ ID NO: 1076191 - RNA, 15 nt, Mycobacterium bovis subsp bovis AF2122/97
cgaccagcacaccgg

SEQ ID NO: 1076192 - RNA, 12 nt, Mycobacterium bovis subsp bovis AF2122/97
cgaccagcacca

SEQ ID NO: 1076193 - RNA, 13 nt, Mycobacterium bovis subsp bovis AF2122/97
cgaccagcaccag

SEQ ID NO: 1076194 - RNA, 21 nt, Mycobacterium bovis subsp bovis AF2122/97
cgaccagcaccagaaccggug

SEQ ID NO: 1076195 - RNA, 15 nt, Mycobacterium bovis subsp bovis AF2122/97
cgaccagcgccgcac

SEQ ID NO: 1076196 - RNA, 14 nt, Mycobacterium bovis subsp bovis AF2122/97
cgaccagcgccgca

SEQ ID NO: 1076197 - RNA, 13 nt, Mycobacterium bovis subsp bovis AF2122/97
cgacccaacccga

SEQ ID NO: 1076198 - RNA, 15 nt, Mycobacterium bovis subsp bovis AF2122/97
cgaccaugcgaccgg

SEQ ID NO: 1076199 - RNA, 18 nt, Mycobacterium bovis subsp bovis AF2122/97
cgaccaugcgaccggcaa

SEQ ID NO: 1076200 - RNA, 16 nt, Mycobacterium bovis subsp bovis AF2122/97
cgaccaugccgaucgg

SEQ ID NO: 1076201 - RNA, 18 nt, Mycobacterium bovis subsp bovis AF2122/97
cgaccaugccgaucggcc

SEQ ID NO: 1076202 - RNA, 15 nt, Mycobacterium bovis subsp bovis AF2122/97
cgaccaugagccggc

SEQ ID NO: 1076203 - RNA, 13 nt, Mycobacterium bovis subsp bovis AF2122/97
cgaccaugagccg

SEQ ID NO: 1076204 - RNA, 14 nt, Mycobacterium bovis subsp bovis AF2122/97
cgaccaugagccgg

SEQ ID NO: 1076205 - RNA, 16 nt, Mycobacterium bovis subsp bovis AF2122/97
cgacccgacgcugguc

SEQ ID NO: 1076206 - RNA, 13 nt, Mycobacterium bovis subsp bovis AF2122/97
cgacccgaucacc

SEQ ID NO: 1076207 - RNA, 12 nt, Mycobacterium bovis subsp bovis AF2122/97
cgacccgcccau

SEQ ID NO: 1076208 - RNA, 18 nt, Mycobacterium bovis subsp bovis AF2122/97
cgacccgcagaccgccac

SEQ ID NO: 1076209 - RNA, 20 nt, Mycobacterium bovis subsp bovis AF2122/97
cgacccgaacugggcgaucg

SEQ ID NO: 1076210 - RNA, 21 nt, Mycobacterium bovis subsp bovis AF2122/97
cgaccccggugagcucuucgg

SEQ ID NO: 1076211 - RNA, 15 nt, Mycobacterium bovis subsp bovis AF2122/97
cgacccgaagccgac

SEQ ID NO: 1076212 - RNA, 16 nt, Mycobacterium bovis subsp bovis AF2122/97
cgaccacaggcaucgg

SEQ ID NO: 1076213 - RNA, 18 nt, Mycobacterium bovis subsp bovis AF2122/97
cgaccacaccacgauggc

SEQ ID NO: 1076214 - RNA, 13 nt, Mycobacterium bovis subsp bovis AF2122/97
cgaccaccaccgc

SEQ ID NO: 1076215 - RNA, 14 nt, Mycobacterium bovis subsp bovis AF2122/97
cgaccaccaccgcc

SEQ ID NO: 1076216 - RNA, 20 nt, Mycobacterium bovis subsp bovis AF2122/97
cgaccaccaccgccgccgaa

SEQ ID NO: 1076217 - RNA, 15 nt, Mycobacterium bovis subsp bovis AF2122/97
cgaccaccgccgggc

SEQ ID NO: 1076218 - RNA, 18 nt, Mycobacterium bovis subsp bovis AF2122/97
cgaccaccgcgaaagcac

SEQ ID NO: 1076219 - RNA, 16 nt, Mycobacterium bovis subsp bovis AF2122/97
cgaccaccgcggcugc

SEQ ID NO: 1076220 - RNA, 22 nt, Mycobacterium bovis subsp bovis AF2122/97
cgaccaccgcggcugcuccguc

SEQ ID NO: 1076221 - RNA, 12 nt, Mycobacterium bovis subsp bovis AF2122/97
cgaccaccgcgu

SEQ ID NO: 1076222 - RNA, 16 nt, Mycobacterium bovis subsp bovis AF2122/97
cgaccacccgcagggc

SEQ ID NO: 1076223 - RNA, 21 nt, Mycobacterium bovis subsp bovis AF2122/97
cgaccacccgcagggcaucgg

SEQ ID NO: 1076224 - RNA, 13 nt, Mycobacterium bovis subsp bovis AF2122/97
cgaccacccggau

SEQ ID NO: 1076225 - RNA, 13 nt, Mycobacterium bovis subsp bovis AF2122/97
cgaccaccgucac

SEQ ID NO: 1076226 - RNA, 18 nt, Mycobacterium bovis subsp bovis AF2122/97
cgaccaccguuugagcgg

SEQ ID NO: 1076227 - RNA, 18 nt, Mycobacterium bovis subsp bovis AF2122/97
cgaccaccggguagccgg

SEQ ID NO: 1076228 - RNA, 22 nt, Mycobacterium bovis subsp bovis AF2122/97
cgaccaccggaucgccgucggc

SEQ ID NO: 1076229 - RNA, 14 nt, Mycobacterium bovis subsp bovis AF2122/97
cgaccacgacguuc

SEQ ID NO: 1076230 - RNA, 20 nt, Mycobacterium bovis subsp bovis AF2122/97
cgaccaccuucugacgcggc

SEQ ID NO: 1076231 - RNA, 23 nt, Mycobacterium bovis subsp bovis AF2122/97
cgaccaccuucugacgcggccgg

SEQ ID NO: 1076232 - RNA, 15 nt, Mycobacterium bovis subsp bovis AF2122/97
cgaccacgcaccgcc

SEQ ID NO: 1076233 - RNA, 18 nt, Mycobacterium bovis subsp bovis AF2122/97
cgaccacgcaccgccccg

SEQ ID NO: 1076234 - RNA, 20 nt, Mycobacterium bovis subsp bovis AF2122/97
cgaccacgcaccgccccgcc

SEQ ID NO: 1076235 - RNA, 13 nt, Mycobacterium bovis subsp bovis AF2122/97
cgaccacgccgcc

SEQ ID NO: 1076236 - RNA, 14 nt, Mycobacterium bovis subsp bovis AF2122/97
cgaccacgccgccg

SEQ ID NO: 1076237 - RNA, 15 nt, Mycobacterium bovis subsp bovis AF2122/97
cgaccacgccgccgg

SEQ ID NO: 1076238 - RNA, 16 nt, Mycobacterium bovis subsp bovis AF2122/97
cgaccacgccgccggc

SEQ ID NO: 1076239 - RNA, 16 nt, Mycobacterium bovis subsp bovis AF2122/97
cgaccacggucugcca

SEQ ID NO: 1076240 - RNA, 19 nt, Mycobacterium bovis subsp bovis AF2122/97
cgaccacggcaccgaucaa

SEQ ID NO: 1076241 - RNA, 20 nt, Mycobacterium bovis subsp bovis AF2122/97
cgaccacucgagcgcucaca

SEQ ID NO: 1076242 - RNA, 18 nt, Mycobacterium bovis subsp bovis AF2122/97
cgaccagaaucgggccga

SEQ ID NO: 1076243 - RNA, 23 nt, Mycobacterium bovis subsp bovis AF2122/97
cgaccagaaucucgccgggcugc

SEQ ID NO: 1076244 - RNA, 17 nt, Mycobacterium bovis subsp bovis AF2122/97
cgaccagaacgacgccg

SEQ ID NO: 1076245 - RNA, 22 nt, Mycobacterium bovis subsp bovis AF2122/97
cgaccacgucggcgaacgcguc

SEQ ID NO: 1076246 - RNA, 17 nt, Mycobacterium bovis subsp bovis AF2122/97
cgacaucgucauccagg

SEQ ID NO: 1076247 - RNA, 17 nt, Mycobacterium bovis subsp bovis AF2122/97
cgacaucgucgcgacga

SEQ ID NO: 1076248 - RNA, 14 nt, Mycobacterium bovis subsp bovis AF2122/97
cgacaucggcccga

SEQ ID NO: 1076249 - RNA, 22 nt, Mycobacterium bovis subsp bovis AF2122/97
cgacaucguuggccgggcacgc

SEQ ID NO: 1076250 - RNA, 18 nt, Mycobacterium bovis subsp bovis AF2122/97
cgacaucgguggcccggu

SEQ ID NO: 1076251 - RNA, 16 nt, Mycobacterium bovis subsp bovis AF2122/97
cgacaugcgccgagau

SEQ ID NO: 1076252 - RNA, 22 nt, Mycobacterium bovis subsp bovis AF2122/97
cgacaugggcaggccgcguucg

SEQ ID NO: 1076253 - RNA, 18 nt, Mycobacterium bovis subsp bovis AF2122/97
cgacaugaggcugccgaa

SEQ ID NO: 1076254 - RNA, 20 nt, Mycobacterium bovis subsp bovis AF2122/97
cgacaugaucugccaccgcg

SEQ ID NO: 1076255 - RNA, 14 nt, Mycobacterium bovis subsp bovis AF2122/97
cgacaugaaccggu

SEQ ID NO: 1076256 - RNA, 16 nt, Mycobacterium bovis subsp bovis AF2122/97
cgacaugaaccggucg

SEQ ID NO: 1076257 - RNA, 14 nt, Mycobacterium bovis subsp bovis AF2122/97
cgacaugcagcgcc

SEQ ID NO: 1076258 - RNA, 15 nt, Mycobacterium bovis subsp bovis AF2122/97
cgacaugcagcgcca

SEQ ID NO: 1076259 - RNA, 18 nt, Mycobacterium bovis subsp bovis AF2122/97
cgaccaagagguucuccg

SEQ ID NO: 1076260 - RNA, 14 nt, Mycobacterium bovis subsp bovis AF2122/97
cgaccaaggccgac

SEQ ID NO: 1076261 - RNA, 18 nt, Mycobacterium bovis subsp bovis AF2122/97
cgaccaagguguccagca

SEQ ID NO: 1076262 - RNA, 20 nt, Mycobacterium bovis subsp bovis AF2122/97
cgaccaauuggucgagucga

SEQ ID NO: 1076263 - RNA, 23 nt, Mycobacterium bovis subsp bovis AF2122/97
cgaccaauucgaccgcgcggauc

SEQ ID NO: 1076264 - RNA, 15 nt, Mycobacterium bovis subsp bovis AF2122/97
cgaccaaugcagugc

SEQ ID NO: 1076265 - RNA, 20 nt, Mycobacterium bovis subsp bovis AF2122/97
cgaccaaugcagugcgaucg

SEQ ID NO: 1076266 - RNA, 20 nt, Mycobacterium bovis subsp bovis AF2122/97
cgaccaagguguccagcacc

SEQ ID NO: 1076267 - RNA, 23 nt, Mycobacterium bovis subsp bovis AF2122/97
cgaccaagguguccagcaccugc

SEQ ID NO: 1076268 - RNA, 24 nt, Mycobacterium bovis subsp bovis AF2122/97
cgaccaagucaugcccacgcugcc

SEQ ID NO: 1076269 - RNA, 13 nt, Mycobacterium bovis subsp bovis AF2122/97
cgaccaacacggu

SEQ ID NO: 1076270 - RNA, 14 nt, Mycobacterium bovis subsp bovis AF2122/97
cgaccaacacggua

SEQ ID NO: 1076271 - RNA, 14 nt, Mycobacterium bovis subsp bovis AF2122/97
cgaccaacacgucg

SEQ ID NO: 1076272 - RNA, 15 nt, Mycobacterium bovis subsp bovis AF2122/97
cgaccaacgcggugu

SEQ ID NO: 1076273 - RNA, 16 nt, Mycobacterium bovis subsp bovis AF2122/97
cgaccaacgcggugug

SEQ ID NO: 1076274 - RNA, 18 nt, Mycobacterium bovis subsp bovis AF2122/97
cgacauugggcgcggugc

SEQ ID NO: 1076275 - RNA, 18 nt, Mycobacterium bovis subsp bovis AF2122/97
cgacauuggucaccugcu

SEQ ID NO: 1076276 - RNA, 18 nt, Mycobacterium bovis subsp bovis AF2122/97
cgacaugggucggcuguc

SEQ ID NO: 1076277 - RNA, 18 nt, Mycobacterium bovis subsp bovis AF2122/97
cgacaugguccgaccagc

SEQ ID NO: 1076278 - RNA, 23 nt, Mycobacterium bovis subsp bovis AF2122/97
cgacaugucgaacgccccccacg

SEQ ID NO: 1076279 - RNA, 21 nt, Mycobacterium bovis subsp bovis AF2122/97
cgacauuggccgucaucgccg

SEQ ID NO: 1076280 - RNA, 15 nt, Mycobacterium bovis subsp bovis AF2122/97
cgacaucaccgaacg

SEQ ID NO: 1076281 - RNA, 17 nt, Mycobacterium bovis subsp bovis AF2122/97
cgacauccacaccgcgg

SEQ ID NO: 1076282 - RNA, 18 nt, Mycobacterium bovis subsp bovis AF2122/97
cgacaucaccaccgccgg

SEQ ID NO: 1076283 - RNA, 20 nt, Mycobacterium bovis subsp bovis AF2122/97
cgacaucaccaccgccgggg

SEQ ID NO: 1076284 - RNA, 21 nt, Mycobacterium bovis subsp bovis AF2122/97
cgacaucaccaccgaccugga

SEQ ID NO: 1076285 - RNA, 16 nt, Mycobacterium bovis subsp bovis AF2122/97
cgacaucaccaccgca

SEQ ID NO: 1076286 - RNA, 19 nt, Mycobacterium bovis subsp bovis AF2122/97
cgacaucaccaccgcacgg

SEQ ID NO: 1076287 - RNA, 13 nt, Mycobacterium bovis subsp bovis AF2122/97
cgacaucgagauc

SEQ ID NO: 1076288 - RNA, 15 nt, Mycobacterium bovis subsp bovis AF2122/97
cgacaucgagaucgc

SEQ ID NO: 1076289 - RNA, 21 nt, Mycobacterium bovis subsp bovis AF2122/97
cgacaucgagaucgccguugc

SEQ ID NO: 1076290 - RNA, 21 nt, Mycobacterium bovis subsp bovis AF2122/97
cgacaacaucgaaucagcucg

SEQ ID NO: 1076291 - RNA, 16 nt, Mycobacterium bovis subsp bovis AF2122/97
cgacaacaugcccguc

SEQ ID NO: 1076292 - RNA, 17 nt, Mycobacterium bovis subsp bovis AF2122/97
cgacaacaugcccguca

SEQ ID NO: 1076293 - RNA, 20 nt, Mycobacterium bovis subsp bovis AF2122/97
cgacaucaccaccgaccugg

SEQ ID NO: 1076294 - RNA, 19 nt, Mycobacterium bovis subsp bovis AF2122/97
cgaaugaucgucccgcggc

SEQ ID NO: 1076295 - RNA, 13 nt, Mycobacterium bovis subsp bovis AF2122/97
cgaaugcacgacg

SEQ ID NO: 1076296 - RNA, 16 nt, Mycobacterium bovis subsp bovis AF2122/97
cgaaugccaccucgac

SEQ ID NO: 1076297 - RNA, 14 nt, Mycobacterium bovis subsp bovis AF2122/97
cgaauuggcggaac

SEQ ID NO: 1076298 - RNA, 21 nt, Mycobacterium bovis subsp bovis AF2122/97
cgaauugcguucgccgcccgg

SEQ ID NO: 1076299 - RNA, 19 nt, Mycobacterium bovis subsp bovis AF2122/97
cgacaaacggcgacccagc

SEQ ID NO: 1076300 - RNA, 17 nt, Mycobacterium bovis subsp bovis AF2122/97
cgacaaaagccagggcc

SEQ ID NO: 1076301 - RNA, 14 nt, Mycobacterium bovis subsp bovis AF2122/97
cgacaaacagcgcc

SEQ ID NO: 1076302 - RNA, 12 nt, Mycobacterium bovis subsp bovis AF2122/97
cgacaaaagcca

SEQ ID NO: 1076303 - RNA, 21 nt, Mycobacterium bovis subsp bovis AF2122/97
cgacaacacgccgucgaccgg

SEQ ID NO: 1076304 - RNA, 19 nt, Mycobacterium bovis subsp bovis AF2122/97
cgacaaaucggucgacgau

SEQ ID NO: 1076305 - RNA, 22 nt, Mycobacterium bovis subsp bovis AF2122/97
cgacaaaucggucgacgaucuc

SEQ ID NO: 1076306 - RNA, 17 nt, Mycobacterium bovis subsp bovis AF2122/97
cgacaaagcggcugccc

SEQ ID NO: 1076307 - RNA, 19 nt, Mycobacterium bovis subsp bovis AF2122/97
cgacaaagcggcugcccga

SEQ ID NO: 1076308 - RNA, 14 nt, Mycobacterium bovis subsp bovis AF2122/97
ccucgucgcgucgc

SEQ ID NO: 1076309 - RNA, 15 nt, Mycobacterium bovis subsp bovis AF2122/97
ccucgucgauguucg

SEQ ID NO: 1076310 - RNA, 12 nt, Mycobacterium bovis subsp bovis AF2122/97
ccucgucgaugu

SEQ ID NO: 1076311 - RNA, 18 nt, Mycobacterium bovis subsp bovis AF2122/97
ccucgucgaucucgaucg

SEQ ID NO: 1076312 - RNA, 11 nt, Mycobacterium bovis subsp bovis AF2122/97
ccucgucgagg

SEQ ID NO: 1076313 - RNA, 20 nt, Mycobacterium bovis subsp bovis AF2122/97
ccucgucgagguccucgucg

SEQ ID NO: 1076314 - RNA, 23 nt, Mycobacterium bovis subsp bovis AF2122/97
ccucgucgacgucggcaucggcg

SEQ ID NO: 1076315 - RNA, 21 nt, Mycobacterium bovis subsp bovis AF2122/97
ccucgucgagagguucgccgu

SEQ ID NO: 1076316 - RNA, 21 nt, Mycobacterium bovis subsp bovis AF2122/97
ccugucauguccugggccgcc

SEQ ID NO: 1076317 - RNA, 22 nt, Mycobacterium bovis subsp bovis AF2122/97
ccucgucggcgucgagcucguc

SEQ ID NO: 1076318 - RNA, 20 nt, Mycobacterium bovis subsp bovis AF2122/97
ccucgucggcgacggccagc

SEQ ID NO: 1076319 - RNA, 15 nt, Mycobacterium bovis subsp bovis AF2122/97
ccucgucggccgaca

SEQ ID NO: 1076320 - RNA, 17 nt, Mycobacterium bovis subsp bovis AF2122/97
ccugugcggagccgcca

SEQ ID NO: 1076321 - RNA, 15 nt, Mycobacterium bovis subsp bovis AF2122/97
ccugugccgccggcg

SEQ ID NO: 1076322 - RNA, 12 nt, Mycobacterium bovis subsp bovis AF2122/97
ccugucgcacca

SEQ ID NO: 1076323 - RNA, 21 nt, Mycobacterium bovis subsp bovis AF2122/97
ccugucgcaccagauagaucg

SEQ ID NO: 1076324 - RNA, 13 nt, Mycobacterium bovis subsp bovis AF2122/97
ccugucgccgaug

SEQ ID NO: 1076325 - RNA, 15 nt, Mycobacterium bovis subsp bovis AF2122/97
ccugucccgccggcc

SEQ ID NO: 1076326 - RNA, 16 nt, Mycobacterium bovis subsp bovis AF2122/97
ccugucccgccggccc

SEQ ID NO: 1076327 - RNA, 18 nt, Mycobacterium bovis subsp bovis AF2122/97
ccuguccggcgccgaggu

SEQ ID NO: 1076328 - RNA, 21 nt, Mycobacterium bovis subsp bovis AF2122/97
ccugucgaagauccagcgcac

SEQ ID NO: 1076329 - RNA, 13 nt, Mycobacterium bovis subsp bovis AF2122/97
ccuguccgauaac

SEQ ID NO: 1076330 - RNA, 24 nt, Mycobacterium bovis subsp bovis AF2122/97
ccugugucgccgucgcggcacgcc

SEQ ID NO: 1076331 - RNA, 20 nt, Mycobacterium bovis subsp bovis AF2122/97
ccuguucaacuccggcaccg

SEQ ID NO: 1076332 - RNA, 20 nt, Mycobacterium bovis subsp bovis AF2122/97
ccuguuguugccccggucgg

SEQ ID NO: 1076333 - RNA, 16 nt, Mycobacterium bovis subsp bovis AF2122/97
ccuguugaacggccgc

SEQ ID NO: 1076334 - RNA, 17 nt, Mycobacterium bovis subsp bovis AF2122/97
ccuguucggcccgaggu

SEQ ID NO: 1076335 - RNA, 22 nt, Mycobacterium bovis subsp bovis AF2122/97
ccuuaucgagauauugcgcgcc

SEQ ID NO: 1076336 - RNA, 18 nt, Mycobacterium bovis subsp bovis AF2122/97
ccuuagcccggccgcgcc

SEQ ID NO: 1076337 - RNA, 16 nt, Mycobacterium bovis subsp bovis AF2122/97
ccuguuugcccaacag

SEQ ID NO: 1076338 - RNA, 21 nt, Mycobacterium bovis subsp bovis AF2122/97
ccuucgcuauggcggcuucga

SEQ ID NO: 1076339 - RNA, 23 nt, Mycobacterium bovis subsp bovis AF2122/97
ccuucgcgggagaacgugccgag

SEQ ID NO: 1076340 - RNA, 17 nt, Mycobacterium bovis subsp bovis AF2122/97
ccuucgccagcggcgcg

SEQ ID NO: 1076341 - RNA, 20 nt, Mycobacterium bovis subsp bovis AF2122/97
ccuucgcagcauguggccgc

SEQ ID NO: 1076342 - RNA, 17 nt, Mycobacterium bovis subsp bovis AF2122/97
ccuucgacaaguccgcg

SEQ ID NO: 1076343 - RNA, 15 nt, Mycobacterium bovis subsp bovis AF2122/97
ccuuccuggcgggcg

SEQ ID NO: 1076344 - RNA, 14 nt, Mycobacterium bovis subsp bovis AF2122/97
ccuuccgccgccgc

SEQ ID NO: 1076345 - RNA, 20 nt, Mycobacterium bovis subsp bovis AF2122/97
ccuuccguuggcggcucgcg

SEQ ID NO: 1076346 - RNA, 12 nt, Mycobacterium bovis subsp bovis AF2122/97
ccuucagccagu

SEQ ID NO: 1076347 - RNA, 18 nt, Mycobacterium bovis subsp bovis AF2122/97
ccuucaguucgacggugc

SEQ ID NO: 1076348 - RNA, 22 nt, Mycobacterium bovis subsp bovis AF2122/97
ccuucagcacggugaucagcag

SEQ ID NO: 1076349 - RNA, 14 nt, Mycobacterium bovis subsp bovis AF2122/97
ccuucagcggucgc

SEQ ID NO: 1076350 - RNA, 22 nt, Mycobacterium bovis subsp bovis AF2122/97
ccuugacgaucgagcugacgau

SEQ ID NO: 1076351 - RNA, 14 nt, Mycobacterium bovis subsp bovis AF2122/97
ccuugaccgggucg

SEQ ID NO: 1076352 - RNA, 18 nt, Mycobacterium bovis subsp bovis AF2122/97
ccuugagcaaaccgcgca

SEQ ID NO: 1076353 - RNA, 20 nt, Mycobacterium bovis subsp bovis AF2122/97
ccuugagcaaugacccgcgg

SEQ ID NO: 1076354 - RNA, 15 nt, Mycobacterium bovis subsp bovis AF2122/97
ccuugacgcggccac

SEQ ID NO: 1076355 - RNA, 20 nt, Mycobacterium bovis subsp bovis AF2122/97
ccuugaggcccugcggccac

SEQ ID NO: 1076356 - RNA, 21 nt, Mycobacterium bovis subsp bovis AF2122/97
ccuucuuguuggucccgauca

SEQ ID NO: 1076357 - RNA, 23 nt, Mycobacterium bovis subsp bovis AF2122/97
ccuucuuguuggucccgaucacc

SEQ ID NO: 1076358 - RNA, 17 nt, Mycobacterium bovis subsp bovis AF2122/97
ccuucuuugccggcgcc

SEQ ID NO: 1076359 - RNA, 15 nt, Mycobacterium bovis subsp bovis AF2122/97
ccuugaccacagcgg

SEQ ID NO: 1076360 - RNA, 15 nt, Mycobacterium bovis subsp bovis AF2122/97
ccuucgggcuggucg

SEQ ID NO: 1076361 - RNA, 19 nt, Mycobacterium bovis subsp bovis AF2122/97
ccuucggcgagcggugauu

SEQ ID NO: 1076362 - RNA, 22 nt, Mycobacterium bovis subsp bovis AF2122/97
ccuucggcccaugcagcggcga

SEQ ID NO: 1076363 - RNA, 15 nt, Mycobacterium bovis subsp bovis AF2122/97
ccuucgggguaguug

SEQ ID NO: 1076364 - RNA, 16 nt, Mycobacterium bovis subsp bovis AF2122/97
ccuucggugucgccga

SEQ ID NO: 1076365 - RNA, 16 nt, Mycobacterium bovis subsp bovis AF2122/97
ccuucgucgcggccgc

SEQ ID NO: 1076366 - RNA, 22 nt, Mycobacterium bovis subsp bovis AF2122/97
ccuucuccaccgaaaaguccgc

SEQ ID NO: 1076367 - RNA, 13 nt, Mycobacterium bovis subsp bovis AF2122/97
ccuucuccaucgu

SEQ ID NO: 1076368 - RNA, 19 nt, Mycobacterium bovis subsp bovis AF2122/97
ccuucuccccgaucagcac

SEQ ID NO: 1076369 - RNA, 13 nt, Mycobacterium bovis subsp bovis AF2122/97
ccuucucgccgcc

SEQ ID NO: 1076370 - RNA, 16 nt, Mycobacterium bovis subsp bovis AF2122/97
ccuucucgucggccag

SEQ ID NO: 1076371 - RNA, 21 nt, Mycobacterium bovis subsp bovis AF2122/97
ccuucucgucggccagugcgc

SEQ ID NO: 1076372 - RNA, 23 nt, Mycobacterium bovis subsp bovis AF2122/97
ccuucugacuaucucgcucgacg

SEQ ID NO: 1076373 - RNA, 23 nt, Mycobacterium bovis subsp bovis AF2122/97
ccuugcagcgcccccgcugccau

SEQ ID NO: 1076374 - RNA, 20 nt, Mycobacterium bovis subsp bovis AF2122/97
ccuugcagcgcguucggcac

SEQ ID NO: 1076375 - RNA, 22 nt, Mycobacterium bovis subsp bovis AF2122/97
ccuugaucgacaacgcggcacc

SEQ ID NO: 1076376 - RNA, 13 nt, Mycobacterium bovis subsp bovis AF2122/97
ccuugaucggcac

SEQ ID NO: 1076377 - RNA, 14 nt, Mycobacterium bovis subsp bovis AF2122/97
ccuugaggucaccc

SEQ ID NO: 1076378 - RNA, 14 nt, Mycobacterium bovis subsp bovis AF2122/97
ccuugauugccgcg

SEQ ID NO: 1076379 - RNA, 11 nt, Mycobacterium bovis subsp bovis AF2122/97
ccuugcacaag

SEQ ID NO: 1076380 - RNA, 23 nt, Mycobacterium bovis subsp bovis AF2122/97
ccuugaugccuuccgacgaccag

SEQ ID NO: 1076381 - RNA, 15 nt, Mycobacterium bovis subsp bovis AF2122/97
ccuugaugcggccgc

SEQ ID NO: 1076382 - RNA, 14 nt, Mycobacterium bovis subsp bovis AF2122/97
ccuugccgcccgcu

SEQ ID NO: 1076383 - RNA, 22 nt, Mycobacterium bovis subsp bovis AF2122/97
ccuugccgcccgcuccgccguc

SEQ ID NO: 1076384 - RNA, 12 nt, Mycobacterium bovis subsp bovis AF2122/97
ccuugccgccga

SEQ ID NO: 1076385 - RNA, 13 nt, Mycobacterium bovis subsp bovis AF2122/97
ccuugccgccgag

SEQ ID NO: 1076386 - RNA, 16 nt, Mycobacterium bovis subsp bovis AF2122/97
ccuugccgccggcccc

SEQ ID NO: 1076387 - RNA, 23 nt, Mycobacterium bovis subsp bovis AF2122/97
ccuugccgccggccccgccggcg

SEQ ID NO: 1076388 - RNA, 15 nt, Mycobacterium bovis subsp bovis AF2122/97
ccuugccgccggcgc

SEQ ID NO: 1076389 - RNA, 17 nt, Mycobacterium bovis subsp bovis AF2122/97
ccuugccgccggcgccg

SEQ ID NO: 1076390 - RNA, 16 nt, Mycobacterium bovis subsp bovis AF2122/97
ccuugcgcacaggcgc

SEQ ID NO: 1076391 - RNA, 12 nt, Mycobacterium bovis subsp bovis AF2122/97
ccuugcgccagc

SEQ ID NO: 1076392 - RNA, 14 nt, Mycobacterium bovis subsp bovis AF2122/97
ccuugcgcgcgcag

SEQ ID NO: 1076393 - RNA, 13 nt, Mycobacterium bovis subsp bovis AF2122/97
ccuuggccgccgg

SEQ ID NO: 1076394 - RNA, 12 nt, Mycobacterium bovis subsp bovis AF2122/97
ccuuggcgacca

SEQ ID NO: 1076395 - RNA, 20 nt, Mycobacterium bovis subsp bovis AF2122/97
ccuuggcgacgucgcgggug

SEQ ID NO: 1076396 - RNA, 21 nt, Mycobacterium bovis subsp bovis AF2122/97
ccuuggccaccaucgccgccg

SEQ ID NO: 1076397 - RNA, 14 nt, Mycobacterium bovis subsp bovis AF2122/97
ccuugggcaccacc

SEQ ID NO: 1076398 - RNA, 17 nt, Mycobacterium bovis subsp bovis AF2122/97
ccuugguagccggccgc

SEQ ID NO: 1076399 - RNA, 16 nt, Mycobacterium bovis subsp bovis AF2122/97
ccuugggcaccacccg

SEQ ID NO: 1076400 - RNA, 18 nt, Mycobacterium bovis subsp bovis AF2122/97
ccuugggcgacgcggcgc

SEQ ID NO: 1076401 - RNA, 21 nt, Mycobacterium bovis subsp bovis AF2122/97
ccuugggcguacucggcgcgc

SEQ ID NO: 1076402 - RNA, 13 nt, Mycobacterium bovis subsp bovis AF2122/97
ccuugcggccgcu

SEQ ID NO: 1076403 - RNA, 15 nt, Mycobacterium bovis subsp bovis AF2122/97
ccuugcucagcacgc

SEQ ID NO: 1076404 - RNA, 19 nt, Mycobacterium bovis subsp bovis AF2122/97
ccuuggcaagcacgcgacg

SEQ ID NO: 1076405 - RNA, 16 nt, Mycobacterium bovis subsp bovis AF2122/97
ccuuggcacccuccgc

SEQ ID NO: 1076406 - RNA, 19 nt, Mycobacterium bovis subsp bovis AF2122/97
ccuuggcacccuccgccgg

SEQ ID NO: 1076407 - RNA, 19 nt, Mycobacterium bovis subsp bovis AF2122/97
ccuugcugcgcgauggccg

SEQ ID NO: 1076408 - RNA, 13 nt, Mycobacterium bovis subsp bovis AF2122/97
ccuugguggccag

SEQ ID NO: 1076409 - RNA, 18 nt, Mycobacterium bovis subsp bovis AF2122/97
ccuuggucuucgccgucg

SEQ ID NO: 1076410 - RNA, 20 nt, Mycobacterium bovis subsp bovis AF2122/97
ccuuggucuucgccgucggc

SEQ ID NO: 1076411 - RNA, 13 nt, Mycobacterium bovis subsp bovis AF2122/97
ccuugucggcccc

SEQ ID NO: 1076412 - RNA, 13 nt, Mycobacterium bovis subsp bovis AF2122/97
ccuuguugccgcg

SEQ ID NO: 1076413 - RNA, 18 nt, Mycobacterium bovis subsp bovis AF2122/97
ccuuguuggccugcaacg

SEQ ID NO: 1076414 - RNA, 22 nt, Mycobacterium bovis subsp bovis AF2122/97
ccuuguugugguggagcggcgc

SEQ ID NO: 1076415 - RNA, 23 nt, Mycobacterium bovis subsp bovis AF2122/97
cgaaagcaccccaaaaccgccgg

SEQ ID NO: 1076416 - RNA, 17 nt, Mycobacterium bovis subsp bovis AF2122/97
cgaaagcacgugcacgg

SEQ ID NO: 1076417 - RNA, 17 nt, Mycobacterium bovis subsp bovis AF2122/97
cgaaagagaaggcggcg

SEQ ID NO: 1076418 - RNA, 19 nt, Mycobacterium bovis subsp bovis AF2122/97
cgaaagccaacucgaccga

SEQ ID NO: 1076419 - RNA, 23 nt, Mycobacterium bovis subsp bovis AF2122/97
cgaaacggugaaugugcauagca

SEQ ID NO: 1076420 - RNA, 16 nt, Mycobacterium bovis subsp bovis AF2122/97
cgaaacucaccagcac

SEQ ID NO: 1076421 - RNA, 17 nt, Mycobacterium bovis subsp bovis AF2122/97
cgaaacuucgcccgggc

SEQ ID NO: 1076422 - RNA, 20 nt, Mycobacterium bovis subsp bovis AF2122/97
cgaaacuucgcccgggccgc

SEQ ID NO: 1076423 - RNA, 14 nt, Mycobacterium bovis subsp bovis AF2122/97
cgaaagccgcggcc

SEQ ID NO: 1076424 - RNA, 20 nt, Mycobacterium bovis subsp bovis AF2122/97
cgaaagccuugccgucgagc

SEQ ID NO: 1076425 - RNA, 15 nt, Mycobacterium bovis subsp bovis AF2122/97
cgaaagcgucgagcu

SEQ ID NO: 1076426 - RNA, 17 nt, Mycobacterium bovis subsp bovis AF2122/97
cgaaagcgucgaucacc

SEQ ID NO: 1076427 - RNA, 14 nt, Mycobacterium bovis subsp bovis AF2122/97
cgaaacgccaccgu

SEQ ID NO: 1076428 - RNA, 22 nt, Mycobacterium bovis subsp bovis AF2122/97
cgaaacgccauacgucgccucg

SEQ ID NO: 1076429 - RNA, 14 nt, Mycobacterium bovis subsp bovis AF2122/97
cgaaacgcccgggc

SEQ ID NO: 1076430 - RNA, 21 nt, Mycobacterium bovis subsp bovis AF2122/97
cgaaacgcccgggcggcgucg

SEQ ID NO: 1076431 - RNA, 20 nt, Mycobacterium bovis subsp bovis AF2122/97
cgaaacgcccuugugaacgg

SEQ ID NO: 1076432 - RNA, 17 nt, Mycobacterium bovis subsp bovis AF2122/97
cgaaacgccgaccgcgc

SEQ ID NO: 1076433 - RNA, 12 nt, Mycobacterium bovis subsp bovis AF2122/97
cgaaaccgccgu

SEQ ID NO: 1076434 - RNA, 16 nt, Mycobacterium bovis subsp bovis AF2122/97
cgaaacgagccggugc

SEQ ID NO: 1076435 - RNA, 13 nt, Mycobacterium bovis subsp bovis AF2122/97
cgaaacgauggcc

SEQ ID NO: 1076436 - RNA, 17 nt, Mycobacterium bovis subsp bovis AF2122/97
cgaaaccggucagcaca

SEQ ID NO: 1076437 - RNA, 15 nt, Mycobacterium bovis subsp bovis AF2122/97
cgaaacccgauguua

SEQ ID NO: 1076438 - RNA, 14 nt, Mycobacterium bovis subsp bovis AF2122/97
cgaaacccagucgu

SEQ ID NO: 1076439 - RNA, 19 nt, Mycobacterium bovis subsp bovis AF2122/97
cgaaacagcuugcugcgca

SEQ ID NO: 1076440 - RNA, 17 nt, Mycobacterium bovis subsp bovis AF2122/97
cgaaaaguccgccgccu

SEQ ID NO: 1076441 - RNA, 22 nt, Mycobacterium bovis subsp bovis AF2122/97
cgaaacaccgucuggccguugc

SEQ ID NO: 1076442 - RNA, 14 nt, Mycobacterium bovis subsp bovis AF2122/97
cgaaacaugcgcca

SEQ ID NO: 1076443 - RNA, 13 nt, Mycobacterium bovis subsp bovis AF2122/97
cgaaacagcaccc

SEQ ID NO: 1076444 - RNA, 17 nt, Mycobacterium bovis subsp bovis AF2122/97
cgaaacagcacccagac

SEQ ID NO: 1076445 - RNA, 19 nt, Mycobacterium bovis subsp bovis AF2122/97
cgaaacagcacccagacga

SEQ ID NO: 1076446 - RNA, 19 nt, Mycobacterium bovis subsp bovis AF2122/97
ccuuucgugcaccgcgacc

SEQ ID NO: 1076447 - RNA, 19 nt, Mycobacterium bovis subsp bovis AF2122/97
ccuuucgcgccgcgaggca

SEQ ID NO: 1076448 - RNA, 23 nt, Mycobacterium bovis subsp bovis AF2122/97
ccuuuggcggugaugguggcaac

SEQ ID NO: 1076449 - RNA, 24 nt, Mycobacterium bovis subsp bovis AF2122/97
ccuuguuggcgaagucgucgaggu

SEQ ID NO: 1076450 - RNA, 20 nt, Mycobacterium bovis subsp bovis AF2122/97
cgaaaacauguuccacccgg

SEQ ID NO: 1076451 - RNA, 21 nt, Mycobacterium bovis subsp bovis AF2122/97
cgaaaaccucgaaaccguggc

SEQ ID NO: 1076452 - RNA, 13 nt, Mycobacterium bovis subsp bovis AF2122/97
cgaaaagccgugc

SEQ ID NO: 1076453 - RNA, 22 nt, Mycobacterium bovis subsp bovis AF2122/97
cgaaaagccgugcaccagcgac

SEQ ID NO: 1076454 - RNA, 13 nt, Mycobacterium bovis subsp bovis AF2122/97
ccuuuuucggcga

SEQ ID NO: 1076455 - RNA, 18 nt, Mycobacterium bovis subsp bovis AF2122/97
cgaaaaaaucgugcgggu

SEQ ID NO: 1076456 - RNA, 18 nt, Mycobacterium bovis subsp bovis AF2122/97
cgaagcccggggcgcucg

SEQ ID NO: 1076457 - RNA, 11 nt, Mycobacterium bovis subsp bovis AF2122/97
cgaagccgacc

SEQ ID NO: 1076458 - RNA, 20 nt, Mycobacterium bovis subsp bovis AF2122/97
cgaagccgccgggugcgccg

SEQ ID NO: 1076459 - RNA, 23 nt, Mycobacterium bovis subsp bovis AF2122/97
cgaagccgccgggugcgccguug

SEQ ID NO: 1076460 - RNA, 22 nt, Mycobacterium bovis subsp bovis AF2122/97
cgaagccgcgcaucugucgcgc

SEQ ID NO: 1076461 - RNA, 17 nt, Mycobacterium bovis subsp bovis AF2122/97
cgaagaccagcggcggc

SEQ ID NO: 1076462 - RNA, 17 nt, Mycobacterium bovis subsp bovis AF2122/97
cgaagcccgaucggcgg

SEQ ID NO: 1076463 - RNA, 15 nt, Mycobacterium bovis subsp bovis AF2122/97
cgaagcccgacugua

SEQ ID NO: 1076464 - RNA, 20 nt, Mycobacterium bovis subsp bovis AF2122/97
cgaagccagaucagccgccg

SEQ ID NO: 1076465 - RNA, 21 nt, Mycobacterium bovis subsp bovis AF2122/97
cgaagccagaucagccgccgc

SEQ ID NO: 1076466 - RNA, 14 nt, Mycobacterium bovis subsp bovis AF2122/97
cgaagcccagcacc

SEQ ID NO: 1076467 - RNA, 18 nt, Mycobacterium bovis subsp bovis AF2122/97
cgaagaccaggccgguga

SEQ ID NO: 1076468 - RNA, 17 nt, Mycobacterium bovis subsp bovis AF2122/97
cgaagaauaugccgaug

SEQ ID NO: 1076469 - RNA, 20 nt, Mycobacterium bovis subsp bovis AF2122/97
cgaagaauaugccgaugacc

SEQ ID NO: 1076470 - RNA, 22 nt, Mycobacterium bovis subsp bovis AF2122/97
cgaagaccaagagcgcgcagca

SEQ ID NO: 1076471 - RNA, 16 nt, Mycobacterium bovis subsp bovis AF2122/97
cgaagaaccggccgac

SEQ ID NO: 1076472 - RNA, 18 nt, Mycobacterium bovis subsp bovis AF2122/97
cgaagaaccggccgacga

SEQ ID NO: 1076473 - RNA, 16 nt, Mycobacterium bovis subsp bovis AF2122/97
cgaagaaccggucgca

SEQ ID NO: 1076474 - RNA, 20 nt, Mycobacterium bovis subsp bovis AF2122/97
cgaacucuacgguggugcgg

SEQ ID NO: 1076475 - RNA, 17 nt, Mycobacterium bovis subsp bovis AF2122/97
cgaacugaucgaccgcc

SEQ ID NO: 1076476 - RNA, 21 nt, Mycobacterium bovis subsp bovis AF2122/97
cgaagaacgacgccaccgcga

SEQ ID NO: 1076477 - RNA, 22 nt, Mycobacterium bovis subsp bovis AF2122/97
cgaagaagaacucggcgucgug

SEQ ID NO: 1076478 - RNA, 20 nt, Mycobacterium bovis subsp bovis AF2122/97
cgaagaagaacucggcgucg

SEQ ID NO: 1076479 - RNA, 20 nt, Mycobacterium bovis subsp bovis AF2122/97
cgaagaaccggucgcagugc

SEQ ID NO: 1076480 - RNA, 23 nt, Mycobacterium bovis subsp bovis AF2122/97
cgaagaaccugagcaccaagacc

SEQ ID NO: 1076481 - RNA, 20 nt, Mycobacterium bovis subsp bovis AF2122/97
cgaacucgcccagggugggg

SEQ ID NO: 1076482 - RNA, 16 nt, Mycobacterium bovis subsp bovis AF2122/97
cgaacucgccgucaua

SEQ ID NO: 1076483 - RNA, 15 nt, Mycobacterium bovis subsp bovis AF2122/97
cgaacucgcgccgag

SEQ ID NO: 1076484 - RNA, 13 nt, Mycobacterium bovis subsp bovis AF2122/97
cgaacucgggcaa

SEQ ID NO: 1076485 - RNA, 21 nt, Mycobacterium bovis subsp bovis AF2122/97
cgaacucuggauucuucagcg

SEQ ID NO: 1076486 - RNA, 14 nt, Mycobacterium bovis subsp bovis AF2122/97
cgaacucggccggg

SEQ ID NO: 1076487 - RNA, 15 nt, Mycobacterium bovis subsp bovis AF2122/97
cgaacucggccgggc

SEQ ID NO: 1076488 - RNA, 15 nt, Mycobacterium bovis subsp bovis AF2122/97
cgaacgccgucgacg

SEQ ID NO: 1076489 - RNA, 16 nt, Mycobacterium bovis subsp bovis AF2122/97
cgaacgccgucgacgc

SEQ ID NO: 1076490 - RNA, 16 nt, Mycobacterium bovis subsp bovis AF2122/97
cgaacgccucugcgau

SEQ ID NO: 1076491 - RNA, 19 nt, Mycobacterium bovis subsp bovis AF2122/97
cgaacgccucugcgaucag

SEQ ID NO: 1076492 - RNA, 17 nt, Mycobacterium bovis subsp bovis AF2122/97
cgaacgccucaccgacg

SEQ ID NO: 1076493 - RNA, 16 nt, Mycobacterium bovis subsp bovis AF2122/97
cgaacgccucgccggc

SEQ ID NO: 1076494 - RNA, 13 nt, Mycobacterium bovis subsp bovis AF2122/97
cgaacgcgaucga

SEQ ID NO: 1076495 - RNA, 17 nt, Mycobacterium bovis subsp bovis AF2122/97
cgaacgcgccggucagc

SEQ ID NO: 1076496 - RNA, 14 nt, Mycobacterium bovis subsp bovis AF2122/97
cgaacgcggccacc

SEQ ID NO: 1076497 - RNA, 16 nt, Mycobacterium bovis subsp bovis AF2122/97
cgaacgcgcgcagccg

SEQ ID NO: 1076498 - RNA, 12 nt, Mycobacterium bovis subsp bovis AF2122/97
cgaacgcggcgu

SEQ ID NO: 1076499 - RNA, 14 nt, Mycobacterium bovis subsp bovis AF2122/97
cgaacgcggcgucg

SEQ ID NO: 1076500 - RNA, 19 nt, Mycobacterium bovis subsp bovis AF2122/97
cgaacgcguccagcgcggc

SEQ ID NO: 1076501 - RNA, 15 nt, Mycobacterium bovis subsp bovis AF2122/97
cgaacgcuccaggcc

SEQ ID NO: 1076502 - RNA, 21 nt, Mycobacterium bovis subsp bovis AF2122/97
cgaacgcugaggaagcggcgg

SEQ ID NO: 1076503 - RNA, 20 nt, Mycobacterium bovis subsp bovis AF2122/97
cgaacgcggcgucgauaacc

SEQ ID NO: 1076504 - RNA, 16 nt, Mycobacterium bovis subsp bovis AF2122/97
cgaacgcuuccagcgu

SEQ ID NO: 1076505 - RNA, 14 nt, Mycobacterium bovis subsp bovis AF2122/97
cgaacgcuggcggc

SEQ ID NO: 1076506 - RNA, 20 nt, Mycobacterium bovis subsp bovis AF2122/97
cgaacgcuucaccucgucga

SEQ ID NO: 1076507 - RNA, 18 nt, Mycobacterium bovis subsp bovis AF2122/97
cgaacggauaccugggac

SEQ ID NO: 1076508 - RNA, 17 nt, Mycobacterium bovis subsp bovis AF2122/97
cgaacggaucucggugg

SEQ ID NO: 1076509 - RNA, 21 nt, Mycobacterium bovis subsp bovis AF2122/97
cgaacggauucccgcccagca

SEQ ID NO: 1076510 - RNA, 21 nt, Mycobacterium bovis subsp bovis AF2122/97
cgaacggcgcaguuggcacca

SEQ ID NO: 1076511 - RNA, 15 nt, Mycobacterium bovis subsp bovis AF2122/97
cgaacgggucggcga

SEQ ID NO: 1076512 - RNA, 14 nt, Mycobacterium bovis subsp bovis AF2122/97
cgaacuccgcggaa

SEQ ID NO: 1076513 - RNA, 21 nt, Mycobacterium bovis subsp bovis AF2122/97
cgaacuccgcggaacccagca

SEQ ID NO: 1076514 - RNA, 14 nt, Mycobacterium bovis subsp bovis AF2122/97
cgaacuccgcguug

SEQ ID NO: 1076515 - RNA, 17 nt, Mycobacterium bovis subsp bovis AF2122/97
cgaacgguagcacgguc

SEQ ID NO: 1076516 - RNA, 16 nt, Mycobacterium bovis subsp bovis AF2122/97
cgaagccggugccggc

SEQ ID NO: 1076517 - RNA, 17 nt, Mycobacterium bovis subsp bovis AF2122/97
cgaagccggugccggcg

SEQ ID NO: 1076518 - RNA, 20 nt, Mycobacterium bovis subsp bovis AF2122/97
cgaagccggugccggcguug

SEQ ID NO: 1076519 - RNA, 21 nt, Mycobacterium bovis subsp bovis AF2122/97
cgaagccgggucucggugcgg

SEQ ID NO: 1076520 - RNA, 15 nt, Mycobacterium bovis subsp bovis AF2122/97
cgaagccggcgccgg

SEQ ID NO: 1076521 - RNA, 16 nt, Mycobacterium bovis subsp bovis AF2122/97
cgaagccggcgccggc

SEQ ID NO: 1076522 - RNA, 15 nt, Mycobacterium bovis subsp bovis AF2122/97
cgaagccggcgcucg

SEQ ID NO: 1076523 - RNA, 18 nt, Mycobacterium bovis subsp bovis AF2122/97
cgaagccuugcagcgccc

SEQ ID NO: 1076524 - RNA, 12 nt, Mycobacterium bovis subsp bovis AF2122/97
cgaagccgggug

SEQ ID NO: 1076525 - RNA, 14 nt, Mycobacterium bovis subsp bovis AF2122/97
cgaagccgggugcu

SEQ ID NO: 1076526 - RNA, 21 nt, Mycobacterium bovis subsp bovis AF2122/97
cgaagcgggacugcagcgcgg

SEQ ID NO: 1076527 - RNA, 15 nt, Mycobacterium bovis subsp bovis AF2122/97
cgaagcgggcggaaa

SEQ ID NO: 1076528 - RNA, 12 nt, Mycobacterium bovis subsp bovis AF2122/97
cgaagcgaugcc

SEQ ID NO: 1076529 - RNA, 14 nt, Mycobacterium bovis subsp bovis AF2122/97
cgaagcgugcgccg

SEQ ID NO: 1076530 - RNA, 17 nt, Mycobacterium bovis subsp bovis AF2122/97
cgaagcgugcgccgacu

SEQ ID NO: 1076531 - RNA, 18 nt, Mycobacterium bovis subsp bovis AF2122/97
cgaagcucaucaccggcg

SEQ ID NO: 1076532 - RNA, 19 nt, Mycobacterium bovis subsp bovis AF2122/97
cgaagcucaucaccggcgc

SEQ ID NO: 1076533 - RNA, 18 nt, Mycobacterium bovis subsp bovis AF2122/97
cgaagcguugaccgcggu

SEQ ID NO: 1076534 - RNA, 13 nt, Mycobacterium bovis subsp bovis AF2122/97
cgaagcuagcgcc

SEQ ID NO: 1076535 - RNA, 20 nt, Mycobacterium bovis subsp bovis AF2122/97
cgaaggugaccaggcggacg

SEQ ID NO: 1076536 - RNA, 20 nt, Mycobacterium bovis subsp bovis AF2122/97
cgaagguguccuccagcugc

SEQ ID NO: 1076537 - RNA, 21 nt, Mycobacterium bovis subsp bovis AF2122/97
cgaagcuugacguugccgggc

SEQ ID NO: 1076538 - RNA, 22 nt, Mycobacterium bovis subsp bovis AF2122/97
cgaagcuugacguugccgggcu

SEQ ID NO: 1076539 - RNA, 18 nt, Mycobacterium bovis subsp bovis AF2122/97
cgaagcugugcccggcgc

SEQ ID NO: 1076540 - RNA, 19 nt, Mycobacterium bovis subsp bovis AF2122/97
cgaagcugugcccggcgcc

SEQ ID NO: 1076541 - RNA, 21 nt, Mycobacterium bovis subsp bovis AF2122/97
cgaagcugugcccggcgcccg

SEQ ID NO: 1076542 - RNA, 22 nt, Mycobacterium bovis subsp bovis AF2122/97
cgaaggugaugaacaccggcgc

SEQ ID NO: 1076543 - RNA, 23 nt, Mycobacterium bovis subsp bovis AF2122/97
cgaaggugaugaacaccggcgcc

SEQ ID NO: 1076544 - RNA, 19 nt, Mycobacterium bovis subsp bovis AF2122/97
cgaaggugaacgacauggg

SEQ ID NO: 1076545 - RNA, 19 nt, Mycobacterium bovis subsp bovis AF2122/97
cgaagcgauccggcugcgg

SEQ ID NO: 1076546 - RNA, 13 nt, Mycobacterium bovis subsp bovis AF2122/97
cgaagcucgcgcu

SEQ ID NO: 1076547 - RNA, 15 nt, Mycobacterium bovis subsp bovis AF2122/97
cgaagcuggcacgca

SEQ ID NO: 1076548 - RNA, 20 nt, Mycobacterium bovis subsp bovis AF2122/97
cgaagcuguagaccuggccg

SEQ ID NO: 1076549 - RNA, 19 nt, Mycobacterium bovis subsp bovis AF2122/97
cgaagugccuuccucggca

SEQ ID NO: 1076550 - RNA, 20 nt, Mycobacterium bovis subsp bovis AF2122/97
cgaagugccuuccucggcaa

SEQ ID NO: 1076551 - RNA, 21 nt, Mycobacterium bovis subsp bovis AF2122/97
cgaagugccuuccucggcaag

SEQ ID NO: 1076552 - RNA, 22 nt, Mycobacterium bovis subsp bovis AF2122/97
cgaaguagccgaccggcagcga

SEQ ID NO: 1076553 - RNA, 14 nt, Mycobacterium bovis subsp bovis AF2122/97
cgaaguagccgacc

SEQ ID NO: 1076554 - RNA, 17 nt, Mycobacterium bovis subsp bovis AF2122/97
cgaaguacuggccgccg

SEQ ID NO: 1076555 - RNA, 20 nt, Mycobacterium bovis subsp bovis AF2122/97
cgaaguacuggccgccgcgc

SEQ ID NO: 1076556 - RNA, 18 nt, Mycobacterium bovis subsp bovis AF2122/97
cgaagugcaggugcgggc

SEQ ID NO: 1076557 - RNA, 22 nt, Mycobacterium bovis subsp bovis AF2122/97
cgaagugcaggugcgggccggu

SEQ ID NO: 1076558 - RNA, 18 nt, Mycobacterium bovis subsp bovis AF2122/97
cgaaguucuccagcucga

SEQ ID NO: 1076559 - RNA, 20 nt, Mycobacterium bovis subsp bovis AF2122/97
cgaaguuugcgacgacgcca

SEQ ID NO: 1076560 - RNA, 20 nt, Mycobacterium bovis subsp bovis AF2122/97
cgaaguucucggugcgcagc

SEQ ID NO: 1076561 - RNA, 22 nt, Mycobacterium bovis subsp bovis AF2122/97
cgaauaacagcaggcauucccg

SEQ ID NO: 1076562 - RNA, 18 nt, Mycobacterium bovis subsp bovis AF2122/97
cgaaucgugcggcgaccg

SEQ ID NO: 1076563 - RNA, 18 nt, Mycobacterium bovis subsp bovis AF2122/97
cgaaucgggucggccgcu

SEQ ID NO: 1076564 - RNA, 16 nt, Mycobacterium bovis subsp bovis AF2122/97
cgaaucgcugccgccg

SEQ ID NO: 1076565 - RNA, 18 nt, Mycobacterium bovis subsp bovis AF2122/97
cgaaucgcugccgccgau

SEQ ID NO: 1076566 - RNA, 17 nt, Mycobacterium bovis subsp bovis AF2122/97
cgaaucgcuggugaagu

SEQ ID NO: 1076567 - RNA, 19 nt, Mycobacterium bovis subsp bovis AF2122/97
cgaaucggcccgugccaca

SEQ ID NO: 1076568 - RNA, 15 nt, Mycobacterium bovis subsp bovis AF2122/97
cgaaucugccggccg

SEQ ID NO: 1076569 - RNA, 16 nt, Mycobacterium bovis subsp bovis AF2122/97
cgaaucugccggccgg

SEQ ID NO: 1076570 - RNA, 19 nt, Mycobacterium bovis subsp bovis AF2122/97
cgaaugaagcccucgucgg

SEQ ID NO: 1076571 - RNA, 19 nt, Mycobacterium bovis subsp bovis AF2122/97
cgaaugacgauccagccca

SEQ ID NO: 1076572 - RNA, 20 nt, Mycobacterium bovis subsp bovis AF2122/97
cgaauagucggcaucgcgag

SEQ ID NO: 1076573 - RNA, 14 nt, Mycobacterium bovis subsp bovis AF2122/97
cgaauacggugcca

SEQ ID NO: 1076574 - RNA, 15 nt, Mycobacterium bovis subsp bovis AF2122/97
cgaauacccgcgggg

SEQ ID NO: 1076575 - RNA, 13 nt, Mycobacterium bovis subsp bovis AF2122/97
cgaauaccggugg

SEQ ID NO: 1076576 - RNA, 16 nt, Mycobacterium bovis subsp bovis AF2122/97
cgaauacgaccgucgc

SEQ ID NO: 1076577 - RNA, 17 nt, Mycobacterium bovis subsp bovis AF2122/97
cgaauacgaccgucgcg

SEQ ID NO: 1076578 - RNA, 18 nt, Mycobacterium bovis subsp bovis AF2122/97
cgaauacgaggacgacga

SEQ ID NO: 1076579 - RNA, 14 nt, Mycobacterium bovis subsp bovis AF2122/97
cgaaccgccgccgc

SEQ ID NO: 1076580 - RNA, 14 nt, Mycobacterium bovis subsp bovis AF2122/97
cgaaccgccgcugc

SEQ ID NO: 1076581 - RNA, 13 nt, Mycobacterium bovis subsp bovis AF2122/97
cgaaccgccggca

SEQ ID NO: 1076582 - RNA, 20 nt, Mycobacterium bovis subsp bovis AF2122/97
cgaacccucagccgcgccgg

SEQ ID NO: 1076583 - RNA, 15 nt, Mycobacterium bovis subsp bovis AF2122/97
cgaaccgacccggcc

SEQ ID NO: 1076584 - RNA, 22 nt, Mycobacterium bovis subsp bovis AF2122/97
cgaaccgcacggugaccacgcc

SEQ ID NO: 1076585 - RNA, 16 nt, Mycobacterium bovis subsp bovis AF2122/97
cgaaccgccggcaccg

SEQ ID NO: 1076586 - RNA, 18 nt, Mycobacterium bovis subsp bovis AF2122/97
cgaaccgccggcaccgcc

SEQ ID NO: 1076587 - RNA, 20 nt, Mycobacterium bovis subsp bovis AF2122/97
cgaaccgcguuaugccaggc

SEQ ID NO: 1076588 - RNA, 14 nt, Mycobacterium bovis subsp bovis AF2122/97
cgaaccgcucagcg

SEQ ID NO: 1076589 - RNA, 18 nt, Mycobacterium bovis subsp bovis AF2122/97
cgaaccgcuccgagcacc

SEQ ID NO: 1076590 - RNA, 18 nt, Mycobacterium bovis subsp bovis AF2122/97
cgaacccgccgaugcugc

SEQ ID NO: 1076591 - RNA, 20 nt, Mycobacterium bovis subsp bovis AF2122/97
cgaacccgccgaugcugccg

SEQ ID NO: 1076592 - RNA, 22 nt, Mycobacterium bovis subsp bovis AF2122/97
cgaacccggcggacgacgucgg

SEQ ID NO: 1076593 - RNA, 23 nt, Mycobacterium bovis subsp bovis AF2122/97
cgaacccgcgagguugaccacca

SEQ ID NO: 1076594 - RNA, 13 nt, Mycobacterium bovis subsp bovis AF2122/97
cgaacccgcguug

SEQ ID NO: 1076595 - RNA, 20 nt, Mycobacterium bovis subsp bovis AF2122/97
cgaacccccccgugcggugu

SEQ ID NO: 1076596 - RNA, 15 nt, Mycobacterium bovis subsp bovis AF2122/97
cgaacccaggcacaa

SEQ ID NO: 1076597 - RNA, 15 nt, Mycobacterium bovis subsp bovis AF2122/97
cgaacccaccgugcc

SEQ ID NO: 1076598 - RNA, 19 nt, Mycobacterium bovis subsp bovis AF2122/97
cgaacccacugcccgccga

SEQ ID NO: 1076599 - RNA, 22 nt, Mycobacterium bovis subsp bovis AF2122/97
cgaacccacugcccgccgacgc

SEQ ID NO: 1076600 - RNA, 12 nt, Mycobacterium bovis subsp bovis AF2122/97
cgaaccagcgcg

SEQ ID NO: 1076601 - RNA, 13 nt, Mycobacterium bovis subsp bovis AF2122/97
cgaaccagcgcgu

SEQ ID NO: 1076602 - RNA, 17 nt, Mycobacterium bovis subsp bovis AF2122/97
cgaaccagcuugcgccg

SEQ ID NO: 1076603 - RNA, 19 nt, Mycobacterium bovis subsp bovis AF2122/97
cgaaccagcuugcgccgca

SEQ ID NO: 1076604 - RNA, 17 nt, Mycobacterium bovis subsp bovis AF2122/97
cgaaccaguccucgggc

SEQ ID NO: 1076605 - RNA, 20 nt, Mycobacterium bovis subsp bovis AF2122/97
cgaaccaguccucgggcagg

SEQ ID NO: 1076606 - RNA, 23 nt, Mycobacterium bovis subsp bovis AF2122/97
cgaaccagucgaagaagacccgu

SEQ ID NO: 1076607 - RNA, 20 nt, Mycobacterium bovis subsp bovis AF2122/97
cgaaccacgcgcccgcacca

SEQ ID NO: 1076608 - RNA, 15 nt, Mycobacterium bovis subsp bovis AF2122/97
cgaaccaccgcguug

SEQ ID NO: 1076609 - RNA, 22 nt, Mycobacterium bovis subsp bovis AF2122/97
cgaaccagaguucggccagcgu

SEQ ID NO: 1076610 - RNA, 16 nt, Mycobacterium bovis subsp bovis AF2122/97
cgaacauggcacgcgg

SEQ ID NO: 1076611 - RNA, 23 nt, Mycobacterium bovis subsp bovis AF2122/97
cgaacauggccagcaucagcgcc

SEQ ID NO: 1076612 - RNA, 14 nt, Mycobacterium bovis subsp bovis AF2122/97
cgaacauggugcgg

SEQ ID NO: 1076613 - RNA, 15 nt, Mycobacterium bovis subsp bovis AF2122/97
cgaacauugcgccca

SEQ ID NO: 1076614 - RNA, 20 nt, Mycobacterium bovis subsp bovis AF2122/97
cgaacaucaccgucgcccgg

SEQ ID NO: 1076615 - RNA, 21 nt, Mycobacterium bovis subsp bovis AF2122/97
cgaacgaguccaacucggcca

SEQ ID NO: 1076616 - RNA, 16 nt, Mycobacterium bovis subsp bovis AF2122/97
cgaacgaaccgccgcc

SEQ ID NO: 1076617 - RNA, 20 nt, Mycobacterium bovis subsp bovis AF2122/97
cgaacgaggcgcccagcgac

SEQ ID NO: 1076618 - RNA, 16 nt, Mycobacterium bovis subsp bovis AF2122/97
cgaacgacggguccgg

SEQ ID NO: 1076619 - RNA, 18 nt, Mycobacterium bovis subsp bovis AF2122/97
cgaacgacggguccgggc

SEQ ID NO: 1076620 - RNA, 14 nt, Mycobacterium bovis subsp bovis AF2122/97
cgaacgacccuggc

SEQ ID NO: 1076621 - RNA, 14 nt, Mycobacterium bovis subsp bovis AF2122/97
cgaacgcagccagc

SEQ ID NO: 1076622 - RNA, 19 nt, Mycobacterium bovis subsp bovis AF2122/97
cgaacgcaugcucgaucgc

SEQ ID NO: 1076623 - RNA, 23 nt, Mycobacterium bovis subsp bovis AF2122/97
cgaacgcaugcucgaucgcguuc

SEQ ID NO: 1076624 - RNA, 12 nt, Mycobacterium bovis subsp bovis AF2122/97
cgaacgccacca

SEQ ID NO: 1076625 - RNA, 23 nt, Mycobacterium bovis subsp bovis AF2122/97
cgaacgccaccaccuccgcgucg

SEQ ID NO: 1076626 - RNA, 16 nt, Mycobacterium bovis subsp bovis AF2122/97
cgaacgcaacgccgau

SEQ ID NO: 1076627 - RNA, 16 nt, Mycobacterium bovis subsp bovis AF2122/97
cgaacgcaacagccga

SEQ ID NO: 1076628 - RNA, 18 nt, Mycobacterium bovis subsp bovis AF2122/97
cgaacgcaacagccgaac

SEQ ID NO: 1076629 - RNA, 17 nt, Mycobacterium bovis subsp bovis AF2122/97
cgaacgcccugacggug

SEQ ID NO: 1076630 - RNA, 16 nt, Mycobacterium bovis subsp bovis AF2122/97
cgaacgccgcccgcug

SEQ ID NO: 1076631 - RNA, 19 nt, Mycobacterium bovis subsp bovis AF2122/97
cgaaccggcaccagcggca

SEQ ID NO: 1076632 - RNA, 15 nt, Mycobacterium bovis subsp bovis AF2122/97
cgaaccggaucaucg

SEQ ID NO: 1076633 - RNA, 19 nt, Mycobacterium bovis subsp bovis AF2122/97
cgaaccggccaucgaccgu

SEQ ID NO: 1076634 - RNA, 16 nt, Mycobacterium bovis subsp bovis AF2122/97
cgaaccggcaccagcg

SEQ ID NO: 1076635 - RNA, 17 nt, Mycobacterium bovis subsp bovis AF2122/97
cgaaccggcaccagcgg

SEQ ID NO: 1076636 - RNA, 15 nt, Mycobacterium bovis subsp bovis AF2122/97
cgaaccgccggcugc

SEQ ID NO: 1076637 - RNA, 19 nt, Mycobacterium bovis subsp bovis AF2122/97
cgaaccggcccaccgacgg

SEQ ID NO: 1076638 - RNA, 18 nt, Mycobacterium bovis subsp bovis AF2122/97
cgaaccgguguagcagcg

SEQ ID NO: 1076639 - RNA, 19 nt, Mycobacterium bovis subsp bovis AF2122/97
cgaaccgguguagcagcgc

SEQ ID NO: 1076640 - RNA, 21 nt, Mycobacterium bovis subsp bovis AF2122/97
cgaaccgguguagcagcgcca

SEQ ID NO: 1076641 - RNA, 24 nt, Mycobacterium bovis subsp bovis AF2122/97
cgaaccgucucgcccccucuagcg

SEQ ID NO: 1076642 - RNA, 17 nt, Mycobacterium bovis subsp bovis AF2122/97
cgaaccguucggcgaca

SEQ ID NO: 1076643 - RNA, 19 nt, Mycobacterium bovis subsp bovis AF2122/97
cgaaccguuucgccggcgc

SEQ ID NO: 1076644 - RNA, 18 nt, Mycobacterium bovis subsp bovis AF2122/97
cgaaccugcggcagcgga

SEQ ID NO: 1076645 - RNA, 14 nt, Mycobacterium bovis subsp bovis AF2122/97
cgaaccugcucggc

SEQ ID NO: 1076646 - RNA, 19 nt, Mycobacterium bovis subsp bovis AF2122/97
cgaaccugcucggcgcgcc

SEQ ID NO: 1076647 - RNA, 19 nt, Mycobacterium bovis subsp bovis AF2122/97
cgaaaucgcccugacccgg

SEQ ID NO: 1076648 - RNA, 18 nt, Mycobacterium bovis subsp bovis AF2122/97
cgaaauccccugcgcugc

SEQ ID NO: 1076649 - RNA, 18 nt, Mycobacterium bovis subsp bovis AF2122/97
cgaaaucgacagcagcgc

SEQ ID NO: 1076650 - RNA, 20 nt, Mycobacterium bovis subsp bovis AF2122/97
cgaaaucgacagcagcgcga

SEQ ID NO: 1076651 - RNA, 14 nt, Mycobacterium bovis subsp bovis AF2122/97
cgaaaucgcacagc

SEQ ID NO: 1076652 - RNA, 18 nt, Mycobacterium bovis subsp bovis AF2122/97
cgaaaugcccaucaccag

SEQ ID NO: 1076653 - RNA, 20 nt, Mycobacterium bovis subsp bovis AF2122/97
cgaaaugccgggcccgacgu

SEQ ID NO: 1076654 - RNA, 17 nt, Mycobacterium bovis subsp bovis AF2122/97
cgaaaucgcacagcgca

SEQ ID NO: 1076655 - RNA, 18 nt, Mycobacterium bovis subsp bovis AF2122/97
cgaaaucgcacagcgcag

SEQ ID NO: 1076656 - RNA, 15 nt, Mycobacterium bovis subsp bovis AF2122/97
cgaaauacccagcgc

SEQ ID NO: 1076657 - RNA, 16 nt, Mycobacterium bovis subsp bovis AF2122/97
cgaaaucagcccgccc

SEQ ID NO: 1076658 - RNA, 20 nt, Mycobacterium bovis subsp bovis AF2122/97
cgaaaucaguucccgaaccc

SEQ ID NO: 1076659 - RNA, 20 nt, Mycobacterium bovis subsp bovis AF2122/97
cgaaauccacaaugcccggg

SEQ ID NO: 1076660 - RNA, 19 nt, Mycobacterium bovis subsp bovis AF2122/97
cgaaaguccugcagugcgg

SEQ ID NO: 1076661 - RNA, 18 nt, Mycobacterium bovis subsp bovis AF2122/97
cgaacaccagcgcgccgu

SEQ ID NO: 1076662 - RNA, 20 nt, Mycobacterium bovis subsp bovis AF2122/97
cgaacaccagcgcgccguag

SEQ ID NO: 1076663 - RNA, 14 nt, Mycobacterium bovis subsp bovis AF2122/97
cgaacaacgccgga

SEQ ID NO: 1076664 - RNA, 21 nt, Mycobacterium bovis subsp bovis AF2122/97
cgaaauguuggccguaccggu

SEQ ID NO: 1076665 - RNA, 14 nt, Mycobacterium bovis subsp bovis AF2122/97
cgaacaccgccgcg

SEQ ID NO: 1076666 - RNA, 15 nt, Mycobacterium bovis subsp bovis AF2122/97
cgaacaccgccgcgu

SEQ ID NO: 1076667 - RNA, 20 nt, Mycobacterium bovis subsp bovis AF2122/97
cgaacaccgccgcgucgagc

SEQ ID NO: 1076668 - RNA, 20 nt, Mycobacterium bovis subsp bovis AF2122/97
cgaacaauuucugcagccca

SEQ ID NO: 1076669 - RNA, 19 nt, Mycobacterium bovis subsp bovis AF2122/97
cgaacacaccgggcgggcu

SEQ ID NO: 1076670 - RNA, 17 nt, Mycobacterium bovis subsp bovis AF2122/97
cgaacaaccccgguuga

SEQ ID NO: 1076671 - RNA, 14 nt, Mycobacterium bovis subsp bovis AF2122/97
cgaaaugccggugc

SEQ ID NO: 1076672 - RNA, 17 nt, Mycobacterium bovis subsp bovis AF2122/97
cgaaaugccugcgcgau

SEQ ID NO: 1076673 - RNA, 15 nt, Mycobacterium bovis subsp bovis AF2122/97
cgaaaucggccagcu

SEQ ID NO: 1076674 - RNA, 18 nt, Mycobacterium bovis subsp bovis AF2122/97
cgaaauuccgggccuggc

SEQ ID NO: 1076675 - RNA, 14 nt, Mycobacterium bovis subsp bovis AF2122/97
cgaacaccucggca

SEQ ID NO: 1076676 - RNA, 22 nt, Mycobacterium bovis subsp bovis AF2122/97
cgaacaccucggcacggaccgc

SEQ ID NO: 1076677 - RNA, 16 nt, Mycobacterium bovis subsp bovis AF2122/97
cgaacaccgguaacgc

SEQ ID NO: 1076678 - RNA, 23 nt, Mycobacterium bovis subsp bovis AF2122/97
cgaacaccguccaauuggcgucg

SEQ ID NO: 1076679 - RNA, 18 nt, Mycobacterium bovis subsp bovis AF2122/97
cgaacacgucggccagug

SEQ ID NO: 1076680 - RNA, 18 nt, Mycobacterium bovis subsp bovis AF2122/97
cgaacagcgaaccggcug

SEQ ID NO: 1076681 - RNA, 18 nt, Mycobacterium bovis subsp bovis AF2122/97
cgaacagcgaagcaacgg

SEQ ID NO: 1076682 - RNA, 14 nt, Mycobacterium bovis subsp bovis AF2122/97
cgaacaccccgggc

SEQ ID NO: 1076683 - RNA, 16 nt, Mycobacterium bovis subsp bovis AF2122/97
cgaacagcaccgccgg

SEQ ID NO: 1076684 - RNA, 22 nt, Mycobacterium bovis subsp bovis AF2122/97
cgaacagcaccgccggcgacgg

SEQ ID NO: 1076685 - RNA, 17 nt, Mycobacterium bovis subsp bovis AF2122/97
cgaacagcucgaucagc

SEQ ID NO: 1076686 - RNA, 16 nt, Mycobacterium bovis subsp bovis AF2122/97
cgaacagcugcccgcc

SEQ ID NO: 1076687 - RNA, 16 nt, Mycobacterium bovis subsp bovis AF2122/97
cgaacagcuggacggc

SEQ ID NO: 1076688 - RNA, 20 nt, Mycobacterium bovis subsp bovis AF2122/97
cgaacagcuggacggccucc

SEQ ID NO: 1076689 - RNA, 22 nt, Mycobacterium bovis subsp bovis AF2122/97
cgaacagcggcacgaucggcag

SEQ ID NO: 1076690 - RNA, 14 nt, Mycobacterium bovis subsp bovis AF2122/97
cgaacagcggucca

SEQ ID NO: 1076691 - RNA, 19 nt, Mycobacterium bovis subsp bovis AF2122/97
cgaacagcgggggcagcgc

SEQ ID NO: 1076692 - RNA, 21 nt, Mycobacterium bovis subsp bovis AF2122/97
cgaacagcgggggcagcgcga

SEQ ID NO: 1076693 - RNA, 16 nt, Mycobacterium bovis subsp bovis AF2122/97
cgaacagggcugcgau

SEQ ID NO: 1076694 - RNA, 20 nt, Mycobacterium bovis subsp bovis AF2122/97
cgaacagggaggucgccgca

SEQ ID NO: 1076695 - RNA, 11 nt, Mycobacterium bovis subsp bovis AF2122/97
cgaacagucga

SEQ ID NO: 1076696 - RNA, 14 nt, Mycobacterium bovis subsp bovis AF2122/97
cgaacagucgcagc

SEQ ID NO: 1076697 - RNA, 14 nt, Mycobacterium bovis subsp bovis AF2122/97
cgaacagugacgcc

SEQ ID NO: 1076698 - RNA, 23 nt, Mycobacterium bovis subsp bovis AF2122/97
cgaacagugacgccacgaccgcc

SEQ ID NO: 1076699 - RNA, 18 nt, Mycobacterium bovis subsp bovis AF2122/97
cgaacaguucggcgagca

SEQ ID NO: 1076700 - RNA, 20 nt, Mycobacterium bovis subsp bovis AF2122/97
cgaacagugccucgcguucg

SEQ ID NO: 1076701 - RNA, 23 nt, Mycobacterium bovis subsp bovis AF2122/97
cgaacaguggggguccggcggcc

SEQ ID NO: 1076702 - RNA, 12 nt, Mycobacterium bovis subsp bovis AF2122/97
cgauccggucgg

SEQ ID NO: 1076703 - RNA, 20 nt, Mycobacterium bovis subsp bovis AF2122/97
cgauccggucggccaggccg

SEQ ID NO: 1076704 - RNA, 21 nt, Mycobacterium bovis subsp bovis AF2122/97
cgauccggucggccaggccgu

SEQ ID NO: 1076705 - RNA, 12 nt, Mycobacterium bovis subsp bovis AF2122/97
cgauccggugcc

SEQ ID NO: 1076706 - RNA, 13 nt, Mycobacterium bovis subsp bovis AF2122/97
cgauccggugccg

SEQ ID NO: 1076707 - RNA, 20 nt, Mycobacterium bovis subsp bovis AF2122/97
cgauccgguggcuggccgcc

SEQ ID NO: 1076708 - RNA, 19 nt, Mycobacterium bovis subsp bovis AF2122/97
cgauccgguuaugcgguac

SEQ ID NO: 1076709 - RNA, 17 nt, Mycobacterium bovis subsp bovis AF2122/97
cgauccggcugcgggaa

SEQ ID NO: 1076710 - RNA, 21 nt, Mycobacterium bovis subsp bovis AF2122/97
cgauccgguuaugcgguaccc

SEQ ID NO: 1076711 - RNA, 18 nt, Mycobacterium bovis subsp bovis AF2122/97
cgauccucgcccgcacca

SEQ ID NO: 1076712 - RNA, 18 nt, Mycobacterium bovis subsp bovis AF2122/97
cgauccugaccagccagg

SEQ ID NO: 1076713 - RNA, 14 nt, Mycobacterium bovis subsp bovis AF2122/97
cgauccugcccacc

SEQ ID NO: 1076714 - RNA, 16 nt, Mycobacterium bovis subsp bovis AF2122/97
cgauccugcccaccau

SEQ ID NO: 1076715 - RNA, 13 nt, Mycobacterium bovis subsp bovis AF2122/97
cgauccgcugcgc

SEQ ID NO: 1076716 - RNA, 21 nt, Mycobacterium bovis subsp bovis AF2122/97
cgauccggcaauugugcugcg

SEQ ID NO: 1076717 - RNA, 12 nt, Mycobacterium bovis subsp bovis AF2122/97
cgaucccggcgg

SEQ ID NO: 1076718 - RNA, 15 nt, Mycobacterium bovis subsp bovis AF2122/97
cgaucccgccggggc

SEQ ID NO: 1076719 - RNA, 13 nt, Mycobacterium bovis subsp bovis AF2122/97
cgaucccgcggcc

SEQ ID NO: 1076720 - RNA, 17 nt, Mycobacterium bovis subsp bovis AF2122/97
cgaucccgcggccgggc

SEQ ID NO: 1076721 - RNA, 18 nt, Mycobacterium bovis subsp bovis AF2122/97
cgaucccgcggccgggcc

SEQ ID NO: 1076722 - RNA, 12 nt, Mycobacterium bovis subsp bovis AF2122/97
cgaucccggccg

SEQ ID NO: 1076723 - RNA, 13 nt, Mycobacterium bovis subsp bovis AF2122/97
cgaucccggccgu

SEQ ID NO: 1076724 - RNA, 14 nt, Mycobacterium bovis subsp bovis AF2122/97
cgaucccggccguc

SEQ ID NO: 1076725 - RNA, 18 nt, Mycobacterium bovis subsp bovis AF2122/97
cgaucccggcgagcaccc

SEQ ID NO: 1076726 - RNA, 22 nt, Mycobacterium bovis subsp bovis AF2122/97
cgaucccggcgagcacccgcug

SEQ ID NO: 1076727 - RNA, 14 nt, Mycobacterium bovis subsp bovis AF2122/97
cgauccgccacgaa

SEQ ID NO: 1076728 - RNA, 19 nt, Mycobacterium bovis subsp bovis AF2122/97
cgauccgccacgaaucgcc

SEQ ID NO: 1076729 - RNA, 17 nt, Mycobacterium bovis subsp bovis AF2122/97
cgauccgcacgaucguc

SEQ ID NO: 1076730 - RNA, 17 nt, Mycobacterium bovis subsp bovis AF2122/97
cgauccgcacccggccg

SEQ ID NO: 1076731 - RNA, 18 nt, Mycobacterium bovis subsp bovis AF2122/97
cgauccgcacccggccgc

SEQ ID NO: 1076732 - RNA, 19 nt, Mycobacterium bovis subsp bovis AF2122/97
cgauccgcacccggccgcg

SEQ ID NO: 1076733 - RNA, 16 nt, Mycobacterium bovis subsp bovis AF2122/97
cgaucccguccgcgcc

SEQ ID NO: 1076734 - RNA, 21 nt, Mycobacterium bovis subsp bovis AF2122/97
cgaucccguccgcgcccaccg

SEQ ID NO: 1076735 - RNA, 21 nt, Mycobacterium bovis subsp bovis AF2122/97
cgauccgcaacaacgccgcga

SEQ ID NO: 1076736 - RNA, 14 nt, Mycobacterium bovis subsp bovis AF2122/97
cgauccgcacagca

SEQ ID NO: 1076737 - RNA, 12 nt, Mycobacterium bovis subsp bovis AF2122/97
cgauccgauaca

SEQ ID NO: 1076738 - RNA, 20 nt, Mycobacterium bovis subsp bovis AF2122/97
cgauccgauacagugcgcgg

SEQ ID NO: 1076739 - RNA, 15 nt, Mycobacterium bovis subsp bovis AF2122/97
cgauccacaggcuga

SEQ ID NO: 1076740 - RNA, 18 nt, Mycobacterium bovis subsp bovis AF2122/97
cgauccacaggcugaaga

SEQ ID NO: 1076741 - RNA, 21 nt, Mycobacterium bovis subsp bovis AF2122/97
cgauccacaggcugaagacga

SEQ ID NO: 1076742 - RNA, 15 nt, Mycobacterium bovis subsp bovis AF2122/97
cgaucauugcaccca

SEQ ID NO: 1076743 - RNA, 15 nt, Mycobacterium bovis subsp bovis AF2122/97
cgaucaugucggccg

SEQ ID NO: 1076744 - RNA, 19 nt, Mycobacterium bovis subsp bovis AF2122/97
cgaucaugucggccggggc

SEQ ID NO: 1076745 - RNA, 16 nt, Mycobacterium bovis subsp bovis AF2122/97
cgaucauggcggcagc

SEQ ID NO: 1076746 - RNA, 21 nt, Mycobacterium bovis subsp bovis AF2122/97
cgaucaucgggguggccacca

SEQ ID NO: 1076747 - RNA, 13 nt, Mycobacterium bovis subsp bovis AF2122/97
cgaucaucucguc

SEQ ID NO: 1076748 - RNA, 22 nt, Mycobacterium bovis subsp bovis AF2122/97
cgaucaucucgucgucgcggcc

SEQ ID NO: 1076749 - RNA, 23 nt, Mycobacterium bovis subsp bovis AF2122/97
cgaucaucucgucgucgcggccg

SEQ ID NO: 1076750 - RNA, 18 nt, Mycobacterium bovis subsp bovis AF2122/97
cgaucaugagcagcacgu

SEQ ID NO: 1076751 - RNA, 14 nt, Mycobacterium bovis subsp bovis AF2122/97
cgaucaucggcccc

SEQ ID NO: 1076752 - RNA, 19 nt, Mycobacterium bovis subsp bovis AF2122/97
cgaucaguucguggcuggc

SEQ ID NO: 1076753 - RNA, 23 nt, Mycobacterium bovis subsp bovis AF2122/97
cgaucaguucguggcuggcaugc

SEQ ID NO: 1076754 - RNA, 15 nt, Mycobacterium bovis subsp bovis AF2122/97
cgaucaucaugucgg

SEQ ID NO: 1076755 - RNA, 18 nt, Mycobacterium bovis subsp bovis AF2122/97
cgaucaucaugucggcgc

SEQ ID NO: 1076756 - RNA, 20 nt, Mycobacterium bovis subsp bovis AF2122/97
cgaucaucaugucggcgcag

SEQ ID NO: 1076757 - RNA, 20 nt, Mycobacterium bovis subsp bovis AF2122/97
cgauccccacaaucagcccg

SEQ ID NO: 1076758 - RNA, 21 nt, Mycobacterium bovis subsp bovis AF2122/97
cgauccccacaaucagcccga

SEQ ID NO: 1076759 - RNA, 15 nt, Mycobacterium bovis subsp bovis AF2122/97
cgauccccagcacca

SEQ ID NO: 1076760 - RNA, 17 nt, Mycobacterium bovis subsp bovis AF2122/97
cgauccccagcaccacg

SEQ ID NO: 1076761 - RNA, 22 nt, Mycobacterium bovis subsp bovis AF2122/97
cgauccccagcaccacggugac

SEQ ID NO: 1076762 - RNA, 18 nt, Mycobacterium bovis subsp bovis AF2122/97
cgauccagggccgacgcg

SEQ ID NO: 1076763 - RNA, 21 nt, Mycobacterium bovis subsp bovis AF2122/97
cgauccagugguaggccgccg

SEQ ID NO: 1076764 - RNA, 13 nt, Mycobacterium bovis subsp bovis AF2122/97
cgaucccaacgcc

SEQ ID NO: 1076765 - RNA, 16 nt, Mycobacterium bovis subsp bovis AF2122/97
cgaucccaacgcccgg

SEQ ID NO: 1076766 - RNA, 23 nt, Mycobacterium bovis subsp bovis AF2122/97
cgaucccaccggcuaugcuggcg

SEQ ID NO: 1076767 - RNA, 13 nt, Mycobacterium bovis subsp bovis AF2122/97
cgauccaggccag

SEQ ID NO: 1076768 - RNA, 12 nt, Mycobacterium bovis subsp bovis AF2122/97
cgauccagcgcu

SEQ ID NO: 1076769 - RNA, 17 nt, Mycobacterium bovis subsp bovis AF2122/97
cgauccagggccgacgc

SEQ ID NO: 1076770 - RNA, 15 nt, Mycobacterium bovis subsp bovis AF2122/97
cgauccaggccaguu

SEQ ID NO: 1076771 - RNA, 21 nt, Mycobacterium bovis subsp bovis AF2122/97
cgauccacugccgcgcgcccg

SEQ ID NO: 1076772 - RNA, 21 nt, Mycobacterium bovis subsp bovis AF2122/97
cgauccacuguagggccggug

SEQ ID NO: 1076773 - RNA, 20 nt, Mycobacterium bovis subsp bovis AF2122/97
cgauccagaacaacggcgcg

SEQ ID NO: 1076774 - RNA, 21 nt, Mycobacterium bovis subsp bovis AF2122/97
cgauccagaacaacggcgcgg

SEQ ID NO: 1076775 - RNA, 20 nt, Mycobacterium bovis subsp bovis AF2122/97
cgaucauugcacccaccccg

SEQ ID NO: 1076776 - RNA, 18 nt, Mycobacterium bovis subsp bovis AF2122/97
cgauccagcccaacucgg

SEQ ID NO: 1076777 - RNA, 22 nt, Mycobacterium bovis subsp bovis AF2122/97
cgauccagcaggccgucgauca

SEQ ID NO: 1076778 - RNA, 13 nt, Mycobacterium bovis subsp bovis AF2122/97
cgaucgauaucgg

SEQ ID NO: 1076779 - RNA, 14 nt, Mycobacterium bovis subsp bovis AF2122/97
cgaucgaggaguug

SEQ ID NO: 1076780 - RNA, 21 nt, Mycobacterium bovis subsp bovis AF2122/97
cgaucgcagacacugcugcgg

SEQ ID NO: 1076781 - RNA, 14 nt, Mycobacterium bovis subsp bovis AF2122/97
cgaucgccaaggcg

SEQ ID NO: 1076782 - RNA, 20 nt, Mycobacterium bovis subsp bovis AF2122/97
cgaucgcagugagcagccgg

SEQ ID NO: 1076783 - RNA, 18 nt, Mycobacterium bovis subsp bovis AF2122/97
cgaucgcauccgcgguug

SEQ ID NO: 1076784 - RNA, 22 nt, Mycobacterium bovis subsp bovis AF2122/97
cgaucgacgccgccacccggcg

SEQ ID NO: 1076785 - RNA, 16 nt, Mycobacterium bovis subsp bovis AF2122/97
cgaucgacgcucggcu

SEQ ID NO: 1076786 - RNA, 14 nt, Mycobacterium bovis subsp bovis AF2122/97
cgaucgacggucgu

SEQ ID NO: 1076787 - RNA, 20 nt, Mycobacterium bovis subsp bovis AF2122/97
cgaucgacucgaaccguuuc

SEQ ID NO: 1076788 - RNA, 17 nt, Mycobacterium bovis subsp bovis AF2122/97
cgaucgacugcagcccg

SEQ ID NO: 1076789 - RNA, 15 nt, Mycobacterium bovis subsp bovis AF2122/97
cgaucgagcaggccg

SEQ ID NO: 1076790 - RNA, 17 nt, Mycobacterium bovis subsp bovis AF2122/97
cgaucgagcaggccgcc

SEQ ID NO: 1076791 - RNA, 17 nt, Mycobacterium bovis subsp bovis AF2122/97
cgaucgagcccggagcg

SEQ ID NO: 1076792 - RNA, 21 nt, Mycobacterium bovis subsp bovis AF2122/97
cgaucgagcccggagcgguca

SEQ ID NO: 1076793 - RNA, 23 nt, Mycobacterium bovis subsp bovis AF2122/97
cgaucgaauugcguucgccgccc

SEQ ID NO: 1076794 - RNA, 19 nt, Mycobacterium bovis subsp bovis AF2122/97
cgaucgaauuaaagccacc

SEQ ID NO: 1076795 - RNA, 20 nt, Mycobacterium bovis subsp bovis AF2122/97
cgaucgaauuaaagccacca

SEQ ID NO: 1076796 - RNA, 18 nt, Mycobacterium bovis subsp bovis AF2122/97
cgaucgacccggucgacg

SEQ ID NO: 1076797 - RNA, 20 nt, Mycobacterium bovis subsp bovis AF2122/97
cgaucgacacccgcucggcc

SEQ ID NO: 1076798 - RNA, 21 nt, Mycobacterium bovis subsp bovis AF2122/97
cgaucgacaccgugaccgccg

SEQ ID NO: 1076799 - RNA, 13 nt, Mycobacterium bovis subsp bovis AF2122/97
cgaucgacagccc

SEQ ID NO: 1076800 - RNA, 16 nt, Mycobacterium bovis subsp bovis AF2122/97
cgaucgacagccccgc

SEQ ID NO: 1076801 - RNA, 21 nt, Mycobacterium bovis subsp bovis AF2122/97
cgaucgccaggccgagcccgg

SEQ ID NO: 1076802 - RNA, 19 nt, Mycobacterium bovis subsp bovis AF2122/97
cgaucgcccgugagcgccg

SEQ ID NO: 1076803 - RNA, 13 nt, Mycobacterium bovis subsp bovis AF2122/97
cgaucgcccgcug

SEQ ID NO: 1076804 - RNA, 12 nt, Mycobacterium bovis subsp bovis AF2122/97
cgaucgccgacg

SEQ ID NO: 1076805 - RNA, 16 nt, Mycobacterium bovis subsp bovis AF2122/97
cgaucgccgacgccag

SEQ ID NO: 1076806 - RNA, 14 nt, Mycobacterium bovis subsp bovis AF2122/97
cgaucgccgcgccg

SEQ ID NO: 1076807 - RNA, 17 nt, Mycobacterium bovis subsp bovis AF2122/97
cgaucgccgcgccguag

SEQ ID NO: 1076808 - RNA, 13 nt, Mycobacterium bovis subsp bovis AF2122/97
cgaucgccgcgcu

SEQ ID NO: 1076809 - RNA, 17 nt, Mycobacterium bovis subsp bovis AF2122/97
cgaucgccgcgcugguc

SEQ ID NO: 1076810 - RNA, 13 nt, Mycobacterium bovis subsp bovis AF2122/97
cgaucgccgcgcc

SEQ ID NO: 1076811 - RNA, 20 nt, Mycobacterium bovis subsp bovis AF2122/97
cgaucgcauccgcgguuggc

SEQ ID NO: 1076812 - RNA, 15 nt, Mycobacterium bovis subsp bovis AF2122/97
cgaucgccggccgcg

SEQ ID NO: 1076813 - RNA, 13 nt, Mycobacterium bovis subsp bovis AF2122/97
cgaucgcgagccc

SEQ ID NO: 1076814 - RNA, 16 nt, Mycobacterium bovis subsp bovis AF2122/97
cgaucgcgagcgagcc

SEQ ID NO: 1076815 - RNA, 19 nt, Mycobacterium bovis subsp bovis AF2122/97
cgaucgggaguccgguagc

SEQ ID NO: 1076816 - RNA, 12 nt, Mycobacterium bovis subsp bovis AF2122/97
cgaucggcggcg

SEQ ID NO: 1076817 - RNA, 13 nt, Mycobacterium bovis subsp bovis AF2122/97
cgaucggcggcgc

SEQ ID NO: 1076818 - RNA, 17 nt, Mycobacterium bovis subsp bovis AF2122/97
cgaucggcggcgcgccg

SEQ ID NO: 1076819 - RNA, 15 nt, Mycobacterium bovis subsp bovis AF2122/97
cgaucggcggcggcg

SEQ ID NO: 1076820 - RNA, 19 nt, Mycobacterium bovis subsp bovis AF2122/97
cgaucgggcuucggccaga

SEQ ID NO: 1076821 - RNA, 20 nt, Mycobacterium bovis subsp bovis AF2122/97
cgaucggcuugccugcgccg

SEQ ID NO: 1076822 - RNA, 14 nt, Mycobacterium bovis subsp bovis AF2122/97
cgaucgggcgucag

SEQ ID NO: 1076823 - RNA, 16 nt, Mycobacterium bovis subsp bovis AF2122/97
cgaucgggcccaccgc

SEQ ID NO: 1076824 - RNA, 18 nt, Mycobacterium bovis subsp bovis AF2122/97
cgaucgggcccagcagcg

SEQ ID NO: 1076825 - RNA, 20 nt, Mycobacterium bovis subsp bovis AF2122/97
cgaucgggcccagcagcgca

SEQ ID NO: 1076826 - RNA, 23 nt, Mycobacterium bovis subsp bovis AF2122/97
cgaucgggcccagcagcgcaacc

SEQ ID NO: 1076827 - RNA, 14 nt, Mycobacterium bovis subsp bovis AF2122/97
cgaucgggccggcg

SEQ ID NO: 1076828 - RNA, 21 nt, Mycobacterium bovis subsp bovis AF2122/97
cgaucgggccggcgcggucuc

SEQ ID NO: 1076829 - RNA, 20 nt, Mycobacterium bovis subsp bovis AF2122/97
cgaucggcagucccagcgcc

SEQ ID NO: 1076830 - RNA, 19 nt, Mycobacterium bovis subsp bovis AF2122/97
cgaucggcaaucgacucag

SEQ ID NO: 1076831 - RNA, 15 nt, Mycobacterium bovis subsp bovis AF2122/97
cgaucggcaggccgc

SEQ ID NO: 1076832 - RNA, 20 nt, Mycobacterium bovis subsp bovis AF2122/97
cgaucggcacuagcgagccg

SEQ ID NO: 1076833 - RNA, 13 nt, Mycobacterium bovis subsp bovis AF2122/97
cgaucggcagcca

SEQ ID NO: 1076834 - RNA, 21 nt, Mycobacterium bovis subsp bovis AF2122/97
cgaucggcaacccgcaccagg

SEQ ID NO: 1076835 - RNA, 14 nt, Mycobacterium bovis subsp bovis AF2122/97
cgaucgcggcgggc

SEQ ID NO: 1076836 - RNA, 14 nt, Mycobacterium bovis subsp bovis AF2122/97
cgaucggacgucgu

SEQ ID NO: 1076837 - RNA, 16 nt, Mycobacterium bovis subsp bovis AF2122/97
cgaucggcgcgccgau

SEQ ID NO: 1076838 - RNA, 18 nt, Mycobacterium bovis subsp bovis AF2122/97
cgaucggccaccaucgcc

SEQ ID NO: 1076839 - RNA, 13 nt, Mycobacterium bovis subsp bovis AF2122/97
cgaucggcccagc

SEQ ID NO: 1076840 - RNA, 22 nt, Mycobacterium bovis subsp bovis AF2122/97
cgaucggccaacagguccaccg

SEQ ID NO: 1076841 - RNA, 15 nt, Mycobacterium bovis subsp bovis AF2122/97
cgaucgcuccgcggc

SEQ ID NO: 1076842 - RNA, 18 nt, Mycobacterium bovis subsp bovis AF2122/97
cgaucgcuccgcggcgca

SEQ ID NO: 1076843 - RNA, 16 nt, Mycobacterium bovis subsp bovis AF2122/97
cgaucgcuugccccgc

SEQ ID NO: 1076844 - RNA, 18 nt, Mycobacterium bovis subsp bovis AF2122/97
cgaucgcuugccccgccg

SEQ ID NO: 1076845 - RNA, 15 nt, Mycobacterium bovis subsp bovis AF2122/97
cgaucggaggcccgc

SEQ ID NO: 1076846 - RNA, 17 nt, Mycobacterium bovis subsp bovis AF2122/97
cgaucggaggcccgcca

SEQ ID NO: 1076847 - RNA, 16 nt, Mycobacterium bovis subsp bovis AF2122/97
cgaucggaccaccagg

SEQ ID NO: 1076848 - RNA, 17 nt, Mycobacterium bovis subsp bovis AF2122/97
cgaucggaccaccaggg

SEQ ID NO: 1076849 - RNA, 16 nt, Mycobacterium bovis subsp bovis AF2122/97
cgaucgcguccgcgcu

SEQ ID NO: 1076850 - RNA, 13 nt, Mycobacterium bovis subsp bovis AF2122/97
cgaucgcgucggg

SEQ ID NO: 1076851 - RNA, 19 nt, Mycobacterium bovis subsp bovis AF2122/97
cgaucgcguuagccagguc

SEQ ID NO: 1076852 - RNA, 13 nt, Mycobacterium bovis subsp bovis AF2122/97
cgaucgcggcgcc

SEQ ID NO: 1076853 - RNA, 15 nt, Mycobacterium bovis subsp bovis AF2122/97
cgaucgcggcgccca

SEQ ID NO: 1076854 - RNA, 19 nt, Mycobacterium bovis subsp bovis AF2122/97
cgaucgcgacacggccauc

SEQ ID NO: 1076855 - RNA, 15 nt, Mycobacterium bovis subsp bovis AF2122/97
cgaucgcggcgagca

SEQ ID NO: 1076856 - RNA, 17 nt, Mycobacterium bovis subsp bovis AF2122/97
cgaucgcggcgcccagg

SEQ ID NO: 1076857 - RNA, 19 nt, Mycobacterium bovis subsp bovis AF2122/97
cgaucgcggcccgcagcgu

SEQ ID NO: 1076858 - RNA, 15 nt, Mycobacterium bovis subsp bovis AF2122/97
cgaucgcggcccggc

SEQ ID NO: 1076859 - RNA, 21 nt, Mycobacterium bovis subsp bovis AF2122/97
cgaucgcggcccggcccuccg

SEQ ID NO: 1076860 - RNA, 20 nt, Mycobacterium bovis subsp bovis AF2122/97
cgaucgcggcaaugaggccg

SEQ ID NO: 1076861 - RNA, 22 nt, Mycobacterium bovis subsp bovis AF2122/97
cgaucgcggcaaugaggccguc

SEQ ID NO: 1076862 - RNA, 15 nt, Mycobacterium bovis subsp bovis AF2122/97
cgaucgcggcaucga

SEQ ID NO: 1076863 - RNA, 22 nt, Mycobacterium bovis subsp bovis AF2122/97
cgaucgcggacccgucggcgug

SEQ ID NO: 1076864 - RNA, 18 nt, Mycobacterium bovis subsp bovis AF2122/97
cgaucgcgcgagcgaugg

SEQ ID NO: 1076865 - RNA, 21 nt, Mycobacterium bovis subsp bovis AF2122/97
cgaucgcgcgagcgaugggau

SEQ ID NO: 1076866 - RNA, 13 nt, Mycobacterium bovis subsp bovis AF2122/97
cgaucgcgccguc

SEQ ID NO: 1076867 - RNA, 22 nt, Mycobacterium bovis subsp bovis AF2122/97
cgaucgcgccugugcgcaaggc

SEQ ID NO: 1076868 - RNA, 15 nt, Mycobacterium bovis subsp bovis AF2122/97
cgaucgcgccaggcc

SEQ ID NO: 1076869 - RNA, 23 nt, Mycobacterium bovis subsp bovis AF2122/97
cgaucgugcgacgcaggaucaca

SEQ ID NO: 1076870 - RNA, 23 nt, Mycobacterium bovis subsp bovis AF2122/97
cgaucgugcggaaccugcucggc

SEQ ID NO: 1076871 - RNA, 13 nt, Mycobacterium bovis subsp bovis AF2122/97
cgaucgugcugcc

SEQ ID NO: 1076872 - RNA, 22 nt, Mycobacterium bovis subsp bovis AF2122/97
cgaucgucgacucggcggcgcg

SEQ ID NO: 1076873 - RNA, 13 nt, Mycobacterium bovis subsp bovis AF2122/97
cgaucgucgacgc

SEQ ID NO: 1076874 - RNA, 19 nt, Mycobacterium bovis subsp bovis AF2122/97
cgaucgucggguugucgcg

SEQ ID NO: 1076875 - RNA, 17 nt, Mycobacterium bovis subsp bovis AF2122/97
cgaucggugacgcgccg

SEQ ID NO: 1076876 - RNA, 15 nt, Mycobacterium bovis subsp bovis AF2122/97
cgaucggcccagccc

SEQ ID NO: 1076877 - RNA, 14 nt, Mycobacterium bovis subsp bovis AF2122/97
cgaucggucgaucg

SEQ ID NO: 1076878 - RNA, 16 nt, Mycobacterium bovis subsp bovis AF2122/97
cgaucgucacgcgggu

SEQ ID NO: 1076879 - RNA, 23 nt, Mycobacterium bovis subsp bovis AF2122/97
cgaucggugccagaaugccgaac

SEQ ID NO: 1076880 - RNA, 21 nt, Mycobacterium bovis subsp bovis AF2122/97
cgaucggugccgaagcugccc

SEQ ID NO: 1076881 - RNA, 22 nt, Mycobacterium bovis subsp bovis AF2122/97
cgaucggugccgaagcugccca

SEQ ID NO: 1076882 - RNA, 14 nt, Mycobacterium bovis subsp bovis AF2122/97
cgaucggugccggc

SEQ ID NO: 1076883 - RNA, 24 nt, Mycobacterium bovis subsp bovis AF2122/97
cgaucguagguacgcagggucugu

SEQ ID NO: 1076884 - RNA, 23 nt, Mycobacterium bovis subsp bovis AF2122/97
cgaucuccucuugcaccagggcc

SEQ ID NO: 1076885 - RNA, 20 nt, Mycobacterium bovis subsp bovis AF2122/97
cgaucucauccuccugcgcc

SEQ ID NO: 1076886 - RNA, 13 nt, Mycobacterium bovis subsp bovis AF2122/97
cgaucuccggcgg

SEQ ID NO: 1076887 - RNA, 21 nt, Mycobacterium bovis subsp bovis AF2122/97
cgaucuccgugagccggaccg

SEQ ID NO: 1076888 - RNA, 16 nt, Mycobacterium bovis subsp bovis AF2122/97
cgaucuccgccaaccg

SEQ ID NO: 1076889 - RNA, 16 nt, Mycobacterium bovis subsp bovis AF2122/97
cgaucuccaggcccgg

SEQ ID NO: 1076890 - RNA, 19 nt, Mycobacterium bovis subsp bovis AF2122/97
cgaucuccaggcccggcgg

SEQ ID NO: 1076891 - RNA, 15 nt, Mycobacterium bovis subsp bovis AF2122/97
cgaucucgaccagcg

SEQ ID NO: 1076892 - RNA, 21 nt, Mycobacterium bovis subsp bovis AF2122/97
cgaucucgagcaggcgcacca

SEQ ID NO: 1076893 - RNA, 23 nt, Mycobacterium bovis subsp bovis AF2122/97
cgaucucgaccguauugaccagc

SEQ ID NO: 1076894 - RNA, 14 nt, Mycobacterium bovis subsp bovis AF2122/97
cgaucucgaucauc

SEQ ID NO: 1076895 - RNA, 13 nt, Mycobacterium bovis subsp bovis AF2122/97
cgaucucgccgcc

SEQ ID NO: 1076896 - RNA, 17 nt, Mycobacterium bovis subsp bovis AF2122/97
cgaucucgccgccagcg

SEQ ID NO: 1076897 - RNA, 22 nt, Mycobacterium bovis subsp bovis AF2122/97
cgaucucgccggcgaagaccgc

SEQ ID NO: 1076898 - RNA, 12 nt, Mycobacterium bovis subsp bovis AF2122/97
cgaucucggcgg

SEQ ID NO: 1076899 - RNA, 23 nt, Mycobacterium bovis subsp bovis AF2122/97
cgaucucgcccagcgagcgccag

SEQ ID NO: 1076900 - RNA, 18 nt, Mycobacterium bovis subsp bovis AF2122/97
cgaugacguugacgucgg

SEQ ID NO: 1076901 - RNA, 14 nt, Mycobacterium bovis subsp bovis AF2122/97
cgaugacgcguuca

SEQ ID NO: 1076902 - RNA, 20 nt, Mycobacterium bovis subsp bovis AF2122/97
cgaugaccagggucugcuca

SEQ ID NO: 1076903 - RNA, 15 nt, Mycobacterium bovis subsp bovis AF2122/97
cgaugaccccggugg

SEQ ID NO: 1076904 - RNA, 13 nt, Mycobacterium bovis subsp bovis AF2122/97
cgaugacgccgug

SEQ ID NO: 1076905 - RNA, 15 nt, Mycobacterium bovis subsp bovis AF2122/97
cgaugacgccgugcu

SEQ ID NO: 1076906 - RNA, 17 nt, Mycobacterium bovis subsp bovis AF2122/97
cgaugaccacgccgacg

SEQ ID NO: 1076907 - RNA, 16 nt, Mycobacterium bovis subsp bovis AF2122/97
cgaugacaucggucag

SEQ ID NO: 1076908 - RNA, 15 nt, Mycobacterium bovis subsp bovis AF2122/97
cgaugacaucgguca

SEQ ID NO: 1076909 - RNA, 21 nt, Mycobacterium bovis subsp bovis AF2122/97
cgaugacagacaucgcgacga

SEQ ID NO: 1076910 - RNA, 16 nt, Mycobacterium bovis subsp bovis AF2122/97
cgaugacauaugacgg

SEQ ID NO: 1076911 - RNA, 17 nt, Mycobacterium bovis subsp bovis AF2122/97
cgaugacaucaccgacc

SEQ ID NO: 1076912 - RNA, 21 nt, Mycobacterium bovis subsp bovis AF2122/97
cgaugacaucaccgaccaacg

SEQ ID NO: 1076913 - RNA, 22 nt, Mycobacterium bovis subsp bovis AF2122/97
cgaugacaucaccgaccaacgc

SEQ ID NO: 1076914 - RNA, 19 nt, Mycobacterium bovis subsp bovis AF2122/97
cgaugaauucuuuggggcg

SEQ ID NO: 1076915 - RNA, 15 nt, Mycobacterium bovis subsp bovis AF2122/97
cgaucugcucgccga

SEQ ID NO: 1076916 - RNA, 15 nt, Mycobacterium bovis subsp bovis AF2122/97
cgaucugcagcgcgg

SEQ ID NO: 1076917 - RNA, 20 nt, Mycobacterium bovis subsp bovis AF2122/97
cgaucugcagcacucggugu

SEQ ID NO: 1076918 - RNA, 19 nt, Mycobacterium bovis subsp bovis AF2122/97
cgaucugcacgagugcggc

SEQ ID NO: 1076919 - RNA, 15 nt, Mycobacterium bovis subsp bovis AF2122/97
cgaucugcccccgcc

SEQ ID NO: 1076920 - RNA, 22 nt, Mycobacterium bovis subsp bovis AF2122/97
cgaucugcccggugauccacgc

SEQ ID NO: 1076921 - RNA, 16 nt, Mycobacterium bovis subsp bovis AF2122/97
cgaucugcgccaucac

SEQ ID NO: 1076922 - RNA, 15 nt, Mycobacterium bovis subsp bovis AF2122/97
cgaucugcaggccca

SEQ ID NO: 1076923 - RNA, 15 nt, Mycobacterium bovis subsp bovis AF2122/97
cgaucugcgcgucag

SEQ ID NO: 1076924 - RNA, 14 nt, Mycobacterium bovis subsp bovis AF2122/97
cgaucugcggcgcc

SEQ ID NO: 1076925 - RNA, 16 nt, Mycobacterium bovis subsp bovis AF2122/97
cgaucugcggcgcccg

SEQ ID NO: 1076926 - RNA, 17 nt, Mycobacterium bovis subsp bovis AF2122/97
cgaucugcggcgcccgg

SEQ ID NO: 1076927 - RNA, 22 nt, Mycobacterium bovis subsp bovis AF2122/97
cgaucugcggcgcccggucgag

SEQ ID NO: 1076928 - RNA, 22 nt, Mycobacterium bovis subsp bovis AF2122/97
cgaucugcguuugggucaucga

SEQ ID NO: 1076929 - RNA, 16 nt, Mycobacterium bovis subsp bovis AF2122/97
cgaucugcgggcgggu

SEQ ID NO: 1076930 - RNA, 16 nt, Mycobacterium bovis subsp bovis AF2122/97
cgaugaagcgucguug

SEQ ID NO: 1076931 - RNA, 20 nt, Mycobacterium bovis subsp bovis AF2122/97
cgaucucgucgcggucgauc

SEQ ID NO: 1076932 - RNA, 23 nt, Mycobacterium bovis subsp bovis AF2122/97
cgaucucuugguagugacugcga

SEQ ID NO: 1076933 - RNA, 19 nt, Mycobacterium bovis subsp bovis AF2122/97
cgaucucguuuucgcgcuu

SEQ ID NO: 1076934 - RNA, 19 nt, Mycobacterium bovis subsp bovis AF2122/97
cgaucucuaccagccgccc

SEQ ID NO: 1076935 - RNA, 15 nt, Mycobacterium bovis subsp bovis AF2122/97
cgaucucuccggcgg

SEQ ID NO: 1076936 - RNA, 12 nt, Mycobacterium bovis subsp bovis AF2122/97
cgaugccggcga

SEQ ID NO: 1076937 - RNA, 13 nt, Mycobacterium bovis subsp bovis AF2122/97
cgaugccggcgag

SEQ ID NO: 1076938 - RNA, 14 nt, Mycobacterium bovis subsp bovis AF2122/97
cgaugccggcuggc

SEQ ID NO: 1076939 - RNA, 19 nt, Mycobacterium bovis subsp bovis AF2122/97
cgaugccguaggcggccag

SEQ ID NO: 1076940 - RNA, 20 nt, Mycobacterium bovis subsp bovis AF2122/97
cgaugccguaggcggccagu

SEQ ID NO: 1076941 - RNA, 16 nt, Mycobacterium bovis subsp bovis AF2122/97
cgaugccgugccgggc

SEQ ID NO: 1076942 - RNA, 17 nt, Mycobacterium bovis subsp bovis AF2122/97
cgaugccgugccgggcc

SEQ ID NO: 1076943 - RNA, 12 nt, Mycobacterium bovis subsp bovis AF2122/97
cgaugcgaucga

SEQ ID NO: 1076944 - RNA, 15 nt, Mycobacterium bovis subsp bovis AF2122/97
cgaugcgaucgacga

SEQ ID NO: 1076945 - RNA, 23 nt, Mycobacterium bovis subsp bovis AF2122/97
cgaugcgcaacuucuucagcagc

SEQ ID NO: 1076946 - RNA, 12 nt, Mycobacterium bovis subsp bovis AF2122/97
cgaugcgcacca

SEQ ID NO: 1076947 - RNA, 14 nt, Mycobacterium bovis subsp bovis AF2122/97
cgaugcgcaccagc

SEQ ID NO: 1076948 - RNA, 15 nt, Mycobacterium bovis subsp bovis AF2122/97
cgaugcgcaccagca

SEQ ID NO: 1076949 - RNA, 18 nt, Mycobacterium bovis subsp bovis AF2122/97
cgaugcgcaccagcggcu

SEQ ID NO: 1076950 - RNA, 18 nt, Mycobacterium bovis subsp bovis AF2122/97
cgaugccuuccucggcaa

SEQ ID NO: 1076951 - RNA, 19 nt, Mycobacterium bovis subsp bovis AF2122/97
cgaugccuuccucggcaaa

SEQ ID NO: 1076952 - RNA, 20 nt, Mycobacterium bovis subsp bovis AF2122/97
cgaugccuucguagcggccg

SEQ ID NO: 1076953 - RNA, 21 nt, Mycobacterium bovis subsp bovis AF2122/97
cgaugccuucguagcggccgc

SEQ ID NO: 1076954 - RNA, 19 nt, Mycobacterium bovis subsp bovis AF2122/97
cgaugccucggcggccucg

SEQ ID NO: 1076955 - RNA, 14 nt, Mycobacterium bovis subsp bovis AF2122/97
cgaugcggcgacca

SEQ ID NO: 1076956 - RNA, 21 nt, Mycobacterium bovis subsp bovis AF2122/97
cgaugcgggccaucaagcgau

SEQ ID NO: 1076957 - RNA, 18 nt, Mycobacterium bovis subsp bovis AF2122/97
cgaugcgggccgccaggc

SEQ ID NO: 1076958 - RNA, 21 nt, Mycobacterium bovis subsp bovis AF2122/97
cgaugcgggccgccaggcggc

SEQ ID NO: 1076959 - RNA, 19 nt, Mycobacterium bovis subsp bovis AF2122/97
cgaugcggcgucgaacugc

SEQ ID NO: 1076960 - RNA, 23 nt, Mycobacterium bovis subsp bovis AF2122/97
cgaugcgguguagggcggcguug

SEQ ID NO: 1076961 - RNA, 20 nt, Mycobacterium bovis subsp bovis AF2122/97
cgaugcgguucucgagcucg

SEQ ID NO: 1076962 - RNA, 19 nt, Mycobacterium bovis subsp bovis AF2122/97
cgaugcguccgcccagccg

SEQ ID NO: 1076963 - RNA, 16 nt, Mycobacterium bovis subsp bovis AF2122/97
cgaugcgguaucgguc

SEQ ID NO: 1076964 - RNA, 17 nt, Mycobacterium bovis subsp bovis AF2122/97
cgaugcggguggcgccg

SEQ ID NO: 1076965 - RNA, 22 nt, Mycobacterium bovis subsp bovis AF2122/97
cgaugcggguggcgccggugcg

SEQ ID NO: 1076966 - RNA, 20 nt, Mycobacterium bovis subsp bovis AF2122/97
cgaugcgacgaaccucggcg

SEQ ID NO: 1076967 - RNA, 21 nt, Mycobacterium bovis subsp bovis AF2122/97
cgaugcgggcgccccaccggc

SEQ ID NO: 1076968 - RNA, 20 nt, Mycobacterium bovis subsp bovis AF2122/97
cgaugcggucgacgggcucg

SEQ ID NO: 1076969 - RNA, 15 nt, Mycobacterium bovis subsp bovis AF2122/97
cgaugcggucggcca

SEQ ID NO: 1076970 - RNA, 17 nt, Mycobacterium bovis subsp bovis AF2122/97
cgaugcggucggccaca

SEQ ID NO: 1076971 - RNA, 22 nt, Mycobacterium bovis subsp bovis AF2122/97
cgaugccagugcaucggucagc

SEQ ID NO: 1076972 - RNA, 14 nt, Mycobacterium bovis subsp bovis AF2122/97
cgaugcccaagccc

SEQ ID NO: 1076973 - RNA, 18 nt, Mycobacterium bovis subsp bovis AF2122/97
cgaugcccacgcacagca

SEQ ID NO: 1076974 - RNA, 13 nt, Mycobacterium bovis subsp bovis AF2122/97
cgaugcccaucac

SEQ ID NO: 1076975 - RNA, 21 nt, Mycobacterium bovis subsp bovis AF2122/97
cgaugcccucgauggccaggc

SEQ ID NO: 1076976 - RNA, 18 nt, Mycobacterium bovis subsp bovis AF2122/97
cgaugccgcgcagcgcgg

SEQ ID NO: 1076977 - RNA, 12 nt, Mycobacterium bovis subsp bovis AF2122/97
cgaugccgccgg

SEQ ID NO: 1076978 - RNA, 16 nt, Mycobacterium bovis subsp bovis AF2122/97
cgaugccgccggcccc

SEQ ID NO: 1076979 - RNA, 17 nt, Mycobacterium bovis subsp bovis AF2122/97
cgaugaugccgucgucg

SEQ ID NO: 1076980 - RNA, 18 nt, Mycobacterium bovis subsp bovis AF2122/97
cgaugaugccgucgucgu

SEQ ID NO: 1076981 - RNA, 14 nt, Mycobacterium bovis subsp bovis AF2122/97
cgaugaugcgcucg

SEQ ID NO: 1076982 - RNA, 14 nt, Mycobacterium bovis subsp bovis AF2122/97
cgaugaugcggcgc

SEQ ID NO: 1076983 - RNA, 22 nt, Mycobacterium bovis subsp bovis AF2122/97
cgaugaugccggacagcucgcg

SEQ ID NO: 1076984 - RNA, 17 nt, Mycobacterium bovis subsp bovis AF2122/97
cgaugaugcucgacaac

SEQ ID NO: 1076985 - RNA, 19 nt, Mycobacterium bovis subsp bovis AF2122/97
cgaugauggcgcgaucggu

SEQ ID NO: 1076986 - RNA, 17 nt, Mycobacterium bovis subsp bovis AF2122/97
cgaugaucuugccgcgg

SEQ ID NO: 1076987 - RNA, 21 nt, Mycobacterium bovis subsp bovis AF2122/97
cgaugaucuugccgcggcgca

SEQ ID NO: 1076988 - RNA, 14 nt, Mycobacterium bovis subsp bovis AF2122/97
cgaugaugaugacc

SEQ ID NO: 1076989 - RNA, 20 nt, Mycobacterium bovis subsp bovis AF2122/97
cgaugaugaugaccacauug

SEQ ID NO: 1076990 - RNA, 18 nt, Mycobacterium bovis subsp bovis AF2122/97
cgaugaucugugccgcua

SEQ ID NO: 1076991 - RNA, 21 nt, Mycobacterium bovis subsp bovis AF2122/97
cgaugaucugcuugccaccgc

SEQ ID NO: 1076992 - RNA, 21 nt, Mycobacterium bovis subsp bovis AF2122/97
cgaugaucucacccagcucgc

SEQ ID NO: 1076993 - RNA, 19 nt, Mycobacterium bovis subsp bovis AF2122/97
cgaugagcaugcccagcgc

SEQ ID NO: 1076994 - RNA, 20 nt, Mycobacterium bovis subsp bovis AF2122/97
cgaugagcccagccgcgggc

SEQ ID NO: 1076995 - RNA, 23 nt, Mycobacterium bovis subsp bovis AF2122/97
cgaugagcccagccgcgggccgc

SEQ ID NO: 1076996 - RNA, 22 nt, Mycobacterium bovis subsp bovis AF2122/97
cgaugacgguccuggcccgcug

SEQ ID NO: 1076997 - RNA, 21 nt, Mycobacterium bovis subsp bovis AF2122/97
cgaugacuacuccugagauga

SEQ ID NO: 1076998 - RNA, 20 nt, Mycobacterium bovis subsp bovis AF2122/97
cgaugacugaaucgaccgga

SEQ ID NO: 1076999 - RNA, 16 nt, Mycobacterium bovis subsp bovis AF2122/97
cgaugagcaugcccag

SEQ ID NO: 1077000 - RNA, 19 nt, Mycobacterium bovis subsp bovis AF2122/97
cgaggugauguuggccgcc

SEQ ID NO: 1077001 - RNA, 17 nt, Mycobacterium bovis subsp bovis AF2122/97
cgaggugacucggcacc

SEQ ID NO: 1077002 - RNA, 16 nt, Mycobacterium bovis subsp bovis AF2122/97
cgaggugagguugacc

SEQ ID NO: 1077003 - RNA, 19 nt, Mycobacterium bovis subsp bovis AF2122/97
cgaggugccggggccccau

SEQ ID NO: 1077004 - RNA, 23 nt, Mycobacterium bovis subsp bovis AF2122/97
cgaggugccgggguggcgcgcca

SEQ ID NO: 1077005 - RNA, 20 nt, Mycobacterium bovis subsp bovis AF2122/97
cgagguggcgcacaucgcga

SEQ ID NO: 1077006 - RNA, 15 nt, Mycobacterium bovis subsp bovis AF2122/97
cgaguaccggccagc

SEQ ID NO: 1077007 - RNA, 18 nt, Mycobacterium bovis subsp bovis AF2122/97
cgaguaccggccagccgc

SEQ ID NO: 1077008 - RNA, 20 nt, Mycobacterium bovis subsp bovis AF2122/97
cgaggugccgcgcagcugcc

SEQ ID NO: 1077009 - RNA, 17 nt, Mycobacterium bovis subsp bovis AF2122/97
cgagguggacaaaucga

SEQ ID NO: 1077010 - RNA, 22 nt, Mycobacterium bovis subsp bovis AF2122/97
cgaggugccguggauugcgcca

SEQ ID NO: 1077011 - RNA, 20 nt, Mycobacterium bovis subsp bovis AF2122/97
cgaggugccuguugcgacca

SEQ ID NO: 1077012 - RNA, 22 nt, Mycobacterium bovis subsp bovis AF2122/97
cgaggugcucggaucggcucgc

SEQ ID NO: 1077013 - RNA, 23 nt, Mycobacterium bovis subsp bovis AF2122/97
cgaggugcucggaucggcucgcc

SEQ ID NO: 1077014 - RNA, 17 nt, Mycobacterium bovis subsp bovis AF2122/97
cgaguccaggcagcuug

SEQ ID NO: 1077015 - RNA, 18 nt, Mycobacterium bovis subsp bovis AF2122/97
cgaguccaggcagcuugc

SEQ ID NO: 1077016 - RNA, 16 nt, Mycobacterium bovis subsp bovis AF2122/97
cgaguccaggccggca

SEQ ID NO: 1077017 - RNA, 23 nt, Mycobacterium bovis subsp bovis AF2122/97
cgaguccaacucggccaacgacg

SEQ ID NO: 1077018 - RNA, 14 nt, Mycobacterium bovis subsp bovis AF2122/97
cgaguccacagcgc

SEQ ID NO: 1077019 - RNA, 17 nt, Mycobacterium bovis subsp bovis AF2122/97
cgaguacgggcaggccg

SEQ ID NO: 1077020 - RNA, 21 nt, Mycobacterium bovis subsp bovis AF2122/97
cgaguacgggcaggccgcugg

SEQ ID NO: 1077021 - RNA, 16 nt, Mycobacterium bovis subsp bovis AF2122/97
cgaguagcugaccgag

SEQ ID NO: 1077022 - RNA, 22 nt, Mycobacterium bovis subsp bovis AF2122/97
cgaggggccggcucagucacgc

SEQ ID NO: 1077023 - RNA, 20 nt, Mycobacterium bovis subsp bovis AF2122/97
cgagggugaagacaccggcg

SEQ ID NO: 1077024 - RNA, 18 nt, Mycobacterium bovis subsp bovis AF2122/97
cgagggugaaguggcgca

SEQ ID NO: 1077025 - RNA, 13 nt, Mycobacterium bovis subsp bovis AF2122/97
cgaggugacggug

SEQ ID NO: 1077026 - RNA, 15 nt, Mycobacterium bovis subsp bovis AF2122/97
cgaggucugguagag

SEQ ID NO: 1077027 - RNA, 18 nt, Mycobacterium bovis subsp bovis AF2122/97
cgagggcugcguggcggg

SEQ ID NO: 1077028 - RNA, 15 nt, Mycobacterium bovis subsp bovis AF2122/97
cgagggcuaccggcg

SEQ ID NO: 1077029 - RNA, 19 nt, Mycobacterium bovis subsp bovis AF2122/97
cgagggcuaccggcgccgc

SEQ ID NO: 1077030 - RNA, 17 nt, Mycobacterium bovis subsp bovis AF2122/97
cgagggcgucgccgccg

SEQ ID NO: 1077031 - RNA, 13 nt, Mycobacterium bovis subsp bovis AF2122/97
cgaggggcggcaa

SEQ ID NO: 1077032 - RNA, 20 nt, Mycobacterium bovis subsp bovis AF2122/97
cgaggggcggcaaucggugg

SEQ ID NO: 1077033 - RNA, 17 nt, Mycobacterium bovis subsp bovis AF2122/97
cgagggcuugcaccugc

SEQ ID NO: 1077034 - RNA, 20 nt, Mycobacterium bovis subsp bovis AF2122/97
cgaggggagugucagcgcca

SEQ ID NO: 1077035 - RNA, 23 nt, Mycobacterium bovis subsp bovis AF2122/97
cgaggcgaguucgcgcacgucgg

SEQ ID NO: 1077036 - RNA, 12 nt, Mycobacterium bovis subsp bovis AF2122/97
cgaggcgaucac

SEQ ID NO: 1077037 - RNA, 16 nt, Mycobacterium bovis subsp bovis AF2122/97
cgaggcgaucaccgcg

SEQ ID NO: 1077038 - RNA, 17 nt, Mycobacterium bovis subsp bovis AF2122/97
cgaggcgaucaccgcgc

SEQ ID NO: 1077039 - RNA, 21 nt, Mycobacterium bovis subsp bovis AF2122/97
cgaggcgagacgcuccagugg

SEQ ID NO: 1077040 - RNA, 15 nt, Mycobacterium bovis subsp bovis AF2122/97
cgaggcgagcggcca

SEQ ID NO: 1077041 - RNA, 17 nt, Mycobacterium bovis subsp bovis AF2122/97
cgaggcgagcggccagu

SEQ ID NO: 1077042 - RNA, 15 nt, Mycobacterium bovis subsp bovis AF2122/97
cgaggccucggccag

SEQ ID NO: 1077043 - RNA, 22 nt, Mycobacterium bovis subsp bovis AF2122/97
cgaggccuaccaggcgcggccc

SEQ ID NO: 1077044 - RNA, 23 nt, Mycobacterium bovis subsp bovis AF2122/97
cgaggccuaccaggcgcggccca

SEQ ID NO: 1077045 - RNA, 14 nt, Mycobacterium bovis subsp bovis AF2122/97
cgaggccgucgcga

SEQ ID NO: 1077046 - RNA, 15 nt, Mycobacterium bovis subsp bovis AF2122/97
cgaggccuaccaggc

SEQ ID NO: 1077047 - RNA, 23 nt, Mycobacterium bovis subsp bovis AF2122/97
cgaggcgaagcgggacugcagcg

SEQ ID NO: 1077048 - RNA, 20 nt, Mycobacterium bovis subsp bovis AF2122/97
cgaggccucggccagcguca

SEQ ID NO: 1077049 - RNA, 18 nt, Mycobacterium bovis subsp bovis AF2122/97
cgaggccucggcggccgu

SEQ ID NO: 1077050 - RNA, 19 nt, Mycobacterium bovis subsp bovis AF2122/97
cgaggcgcccaacaggcgg

SEQ ID NO: 1077051 - RNA, 22 nt, Mycobacterium bovis subsp bovis AF2122/97
cgaggcgcucacccgccgcggu

SEQ ID NO: 1077052 - RNA, 14 nt, Mycobacterium bovis subsp bovis AF2122/97
cgaggcggcggucg

SEQ ID NO: 1077053 - RNA, 18 nt, Mycobacterium bovis subsp bovis AF2122/97
cgaggcggcggucgagcu

SEQ ID NO: 1077054 - RNA, 19 nt, Mycobacterium bovis subsp bovis AF2122/97
cgaggcggucuuguccagg

SEQ ID NO: 1077055 - RNA, 22 nt, Mycobacterium bovis subsp bovis AF2122/97
cgaggcguaaucaagcagcgug

SEQ ID NO: 1077056 - RNA, 17 nt, Mycobacterium bovis subsp bovis AF2122/97
cgaggcgucaccccggu

SEQ ID NO: 1077057 - RNA, 17 nt, Mycobacterium bovis subsp bovis AF2122/97
cgaggcggucgccgaau

SEQ ID NO: 1077058 - RNA, 23 nt, Mycobacterium bovis subsp bovis AF2122/97
cgaggcgucaccccggucccgcc

SEQ ID NO: 1077059 - RNA, 15 nt, Mycobacterium bovis subsp bovis AF2122/97
cgagggcauccgagc

SEQ ID NO: 1077060 - RNA, 19 nt, Mycobacterium bovis subsp bovis AF2122/97
cgagggccagcagccgcga

SEQ ID NO: 1077061 - RNA, 24 nt, Mycobacterium bovis subsp bovis AF2122/97
cgagggccagcaaguacgcgucgg

SEQ ID NO: 1077062 - RNA, 16 nt, Mycobacterium bovis subsp bovis AF2122/97
cgagggcggucagcgg

SEQ ID NO: 1077063 - RNA, 18 nt, Mycobacterium bovis subsp bovis AF2122/97
cgagggcggucagcggcc

SEQ ID NO: 1077064 - RNA, 19 nt, Mycobacterium bovis subsp bovis AF2122/97
cgagggcggucagcggcca

SEQ ID NO: 1077065 - RNA, 14 nt, Mycobacterium bovis subsp bovis AF2122/97
cgagggcgcgccgu

SEQ ID NO: 1077066 - RNA, 13 nt, Mycobacterium bovis subsp bovis AF2122/97
cgagggcgccggg

SEQ ID NO: 1077067 - RNA, 14 nt, Mycobacterium bovis subsp bovis AF2122/97
cgagcaccgcgaac

SEQ ID NO: 1077068 - RNA, 19 nt, Mycobacterium bovis subsp bovis AF2122/97
cgagcaccgacaccggccg

SEQ ID NO: 1077069 - RNA, 21 nt, Mycobacterium bovis subsp bovis AF2122/97
cgagcaccgacaccggccgcg

SEQ ID NO: 1077070 - RNA, 23 nt, Mycobacterium bovis subsp bovis AF2122/97
cgagcaccgcaaccacgccccga

SEQ ID NO: 1077071 - RNA, 19 nt, Mycobacterium bovis subsp bovis AF2122/97
cgagcaccggcugcggggc

SEQ ID NO: 1077072 - RNA, 22 nt, Mycobacterium bovis subsp bovis AF2122/97
cgagcgguugccuucuuggcgg

SEQ ID NO: 1077073 - RNA, 23 nt, Mycobacterium bovis subsp bovis AF2122/97
cgagcguaacgguaaccggcccg

SEQ ID NO: 1077074 - RNA, 22 nt, Mycobacterium bovis subsp bovis AF2122/97
cgagcgucagauccggccguug

SEQ ID NO: 1077075 - RNA, 23 nt, Mycobacterium bovis subsp bovis AF2122/97
cgagcgguggugagugcgucucg

SEQ ID NO: 1077076 - RNA, 14 nt, Mycobacterium bovis subsp bovis AF2122/97
cgagcggugccggc

SEQ ID NO: 1077077 - RNA, 15 nt, Mycobacterium bovis subsp bovis AF2122/97
cgagcggugccggcg

SEQ ID NO: 1077078 - RNA, 16 nt, Mycobacterium bovis subsp bovis AF2122/97
cgagcggugccggcgu

SEQ ID NO: 1077079 - RNA, 19 nt, Mycobacterium bovis subsp bovis AF2122/97
cgagcgguggcgucgucgg

SEQ ID NO: 1077080 - RNA, 17 nt, Mycobacterium bovis subsp bovis AF2122/97
cgagcggucgcgguagc

SEQ ID NO: 1077081 - RNA, 18 nt, Mycobacterium bovis subsp bovis AF2122/97
cgagcucguugcuggcgg

SEQ ID NO: 1077082 - RNA, 22 nt, Mycobacterium bovis subsp bovis AF2122/97
cgagcucguugcuggcggccag

SEQ ID NO: 1077083 - RNA, 23 nt, Mycobacterium bovis subsp bovis AF2122/97
cgagcucguugcuggcggccagc

SEQ ID NO: 1077084 - RNA, 24 nt, Mycobacterium bovis subsp bovis AF2122/97
cgagcucguugcuggcggccagca

SEQ ID NO: 1077085 - RNA, 15 nt, Mycobacterium bovis subsp bovis AF2122/97
cgagcucggucacca

SEQ ID NO: 1077086 - RNA, 12 nt, Mycobacterium bovis subsp bovis AF2122/97
cgagcucggcgc

SEQ ID NO: 1077087 - RNA, 21 nt, Mycobacterium bovis subsp bovis AF2122/97
cgagcucggcgaacggcacca

SEQ ID NO: 1077088 - RNA, 20 nt, Mycobacterium bovis subsp bovis AF2122/97
cgagcgugaagucacggcgg

SEQ ID NO: 1077089 - RNA, 18 nt, Mycobacterium bovis subsp bovis AF2122/97
cgagcucgccgcagcguc

SEQ ID NO: 1077090 - RNA, 19 nt, Mycobacterium bovis subsp bovis AF2122/97
cgagcucgccgcagcgucg

SEQ ID NO: 1077091 - RNA, 22 nt, Mycobacterium bovis subsp bovis AF2122/97
cgagcucggccccgccgccggu

SEQ ID NO: 1077092 - RNA, 11 nt, Mycobacterium bovis subsp bovis AF2122/97
cgagcucggcc

SEQ ID NO: 1077093 - RNA, 15 nt, Mycobacterium bovis subsp bovis AF2122/97
cgagcugacgauggc

SEQ ID NO: 1077094 - RNA, 19 nt, Mycobacterium bovis subsp bovis AF2122/97
cgagcugacgauggccagg

SEQ ID NO: 1077095 - RNA, 17 nt, Mycobacterium bovis subsp bovis AF2122/97
cgagcugacgccgagcu

SEQ ID NO: 1077096 - RNA, 18 nt, Mycobacterium bovis subsp bovis AF2122/97
cgagcugagcggccagca

SEQ ID NO: 1077097 - RNA, 19 nt, Mycobacterium bovis subsp bovis AF2122/97
cgagcugauacgcaugcga

SEQ ID NO: 1077098 - RNA, 22 nt, Mycobacterium bovis subsp bovis AF2122/97
cgagcucguccucgucuucguc

SEQ ID NO: 1077099 - RNA, 13 nt, Mycobacterium bovis subsp bovis AF2122/97
cgagcugaccacg

SEQ ID NO: 1077100 - RNA, 17 nt, Mycobacterium bovis subsp bovis AF2122/97
cgagcugauccgggugg

SEQ ID NO: 1077101 - RNA, 17 nt, Mycobacterium bovis subsp bovis AF2122/97
cgagcuguaggucagcg

SEQ ID NO: 1077102 - RNA, 17 nt, Mycobacterium bovis subsp bovis AF2122/97
cgagcugguuggcgccg

SEQ ID NO: 1077103 - RNA, 23 nt, Mycobacterium bovis subsp bovis AF2122/97
cgagcugucggcuuccuccucgg

SEQ ID NO: 1077104 - RNA, 15 nt, Mycobacterium bovis subsp bovis AF2122/97
cgagcuguggucacc

SEQ ID NO: 1077105 - RNA, 16 nt, Mycobacterium bovis subsp bovis AF2122/97
cgaggaucucggcgug

SEQ ID NO: 1077106 - RNA, 23 nt, Mycobacterium bovis subsp bovis AF2122/97
cgagcuuggccggcagguccauc

SEQ ID NO: 1077107 - RNA, 19 nt, Mycobacterium bovis subsp bovis AF2122/97
cgaggaucccgcugcacga

SEQ ID NO: 1077108 - RNA, 18 nt, Mycobacterium bovis subsp bovis AF2122/97
cgaggaucccgcugcacg

SEQ ID NO: 1077109 - RNA, 13 nt, Mycobacterium bovis subsp bovis AF2122/97
cgaggccagcggu

SEQ ID NO: 1077110 - RNA, 12 nt, Mycobacterium bovis subsp bovis AF2122/97
cgaggccgacga

SEQ ID NO: 1077111 - RNA, 23 nt, Mycobacterium bovis subsp bovis AF2122/97
cgaggccgcacgucgaccucggc

SEQ ID NO: 1077112 - RNA, 14 nt, Mycobacterium bovis subsp bovis AF2122/97
cgaggccgccaucg

SEQ ID NO: 1077113 - RNA, 17 nt, Mycobacterium bovis subsp bovis AF2122/97
cgaggccgccaucgccg

SEQ ID NO: 1077114 - RNA, 20 nt, Mycobacterium bovis subsp bovis AF2122/97
cgaggccgccaucgccgcca

SEQ ID NO: 1077115 - RNA, 22 nt, Mycobacterium bovis subsp bovis AF2122/97
cgaggccgccaucgccgccaac

SEQ ID NO: 1077116 - RNA, 18 nt, Mycobacterium bovis subsp bovis AF2122/97
cgaggaggcggucgauca

SEQ ID NO: 1077117 - RNA, 15 nt, Mycobacterium bovis subsp bovis AF2122/97
cgaggagggccgcga

SEQ ID NO: 1077118 - RNA, 22 nt, Mycobacterium bovis subsp bovis AF2122/97
cgaggacuggaaagcagcagcg

SEQ ID NO: 1077119 - RNA, 16 nt, Mycobacterium bovis subsp bovis AF2122/97
cgaggaacacgaugcc

SEQ ID NO: 1077120 - RNA, 23 nt, Mycobacterium bovis subsp bovis AF2122/97
cgagcuuuucgaccuucaccgcg

SEQ ID NO: 1077121 - RNA, 15 nt, Mycobacterium bovis subsp bovis AF2122/97
cgaggaaaccaccag

SEQ ID NO: 1077122 - RNA, 23 nt, Mycobacterium bovis subsp bovis AF2122/97
cgaggaaaucgcccucgucgcgg

SEQ ID NO: 1077123 - RNA, 19 nt, Mycobacterium bovis subsp bovis AF2122/97
cgagcuugccgucgcugac

SEQ ID NO: 1077124 - RNA, 18 nt, Mycobacterium bovis subsp bovis AF2122/97
cgagcuucagcgcgcugc

SEQ ID NO: 1077125 - RNA, 15 nt, Mycobacterium bovis subsp bovis AF2122/97
cgagcuucaucccgg

SEQ ID NO: 1077126 - RNA, 17 nt, Mycobacterium bovis subsp bovis AF2122/97
cgagcuuccacgccgga

SEQ ID NO: 1077127 - RNA, 16 nt, Mycobacterium bovis subsp bovis AF2122/97
cgaucagggugucgaa

SEQ ID NO: 1077128 - RNA, 20 nt, Mycobacterium bovis subsp bovis AF2122/97
cgaucagguucgucaggucc

SEQ ID NO: 1077129 - RNA, 14 nt, Mycobacterium bovis subsp bovis AF2122/97
cgaucaggcugccg

SEQ ID NO: 1077130 - RNA, 22 nt, Mycobacterium bovis subsp bovis AF2122/97
cgaucaguccgauuggugucgg

SEQ ID NO: 1077131 - RNA, 17 nt, Mycobacterium bovis subsp bovis AF2122/97
cgaucaguccggcguuc

SEQ ID NO: 1077132 - RNA, 18 nt, Mycobacterium bovis subsp bovis AF2122/97
cgaucagguuggcggcug

SEQ ID NO: 1077133 - RNA, 20 nt, Mycobacterium bovis subsp bovis AF2122/97
cgaucagguuggugcucagc

SEQ ID NO: 1077134 - RNA, 15 nt, Mycobacterium bovis subsp bovis AF2122/97
cgaucaggccgucgc

SEQ ID NO: 1077135 - RNA, 16 nt, Mycobacterium bovis subsp bovis AF2122/97
cgaucaggccgucgcc

SEQ ID NO: 1077136 - RNA, 18 nt, Mycobacterium bovis subsp bovis AF2122/97
cgaucaggccgucgccgg

SEQ ID NO: 1077137 - RNA, 17 nt, Mycobacterium bovis subsp bovis AF2122/97
cgaucaggccgacgucg

SEQ ID NO: 1077138 - RNA, 21 nt, Mycobacterium bovis subsp bovis AF2122/97
cgaucagcgaaccaccggcgc

SEQ ID NO: 1077139 - RNA, 15 nt, Mycobacterium bovis subsp bovis AF2122/97
cgaucagcgcggcgc

SEQ ID NO: 1077140 - RNA, 16 nt, Mycobacterium bovis subsp bovis AF2122/97
cgaucagcgcggcgcc

SEQ ID NO: 1077141 - RNA, 21 nt, Mycobacterium bovis subsp bovis AF2122/97
cgaucagcuugggcagcagcg

SEQ ID NO: 1077142 - RNA, 21 nt, Mycobacterium bovis subsp bovis AF2122/97
cgaucagcuccuguaacugcu

SEQ ID NO: 1077143 - RNA, 20 nt, Mycobacterium bovis subsp bovis AF2122/97
cgaucagcgacuccacccca

SEQ ID NO: 1077144 - RNA, 13 nt, Mycobacterium bovis subsp bovis AF2122/97
cgaucagcgaccc

SEQ ID NO: 1077145 - RNA, 23 nt, Mycobacterium bovis subsp bovis AF2122/97
cgaucagccgggugcgcacccgg

SEQ ID NO: 1077146 - RNA, 21 nt, Mycobacterium bovis subsp bovis AF2122/97
cgaucagccguggcagucgca

SEQ ID NO: 1077147 - RNA, 12 nt, Mycobacterium bovis subsp bovis AF2122/97
cgaucagcgcga

SEQ ID NO: 1077148 - RNA, 16 nt, Mycobacterium bovis subsp bovis AF2122/97
cgaucagcgcgacggu

SEQ ID NO: 1077149 - RNA, 23 nt, Mycobacterium bovis subsp bovis AF2122/97
cgaucagcgccggauccacaccg

SEQ ID NO: 1077150 - RNA, 21 nt, Mycobacterium bovis subsp bovis AF2122/97
cgaucagccgggugcgcaccc

SEQ ID NO: 1077151 - RNA, 16 nt, Mycobacterium bovis subsp bovis AF2122/97
cgaucagcagcgucgg

SEQ ID NO: 1077152 - RNA, 13 nt, Mycobacterium bovis subsp bovis AF2122/97
cgaucagccccag

SEQ ID NO: 1077153 - RNA, 18 nt, Mycobacterium bovis subsp bovis AF2122/97
cgaucaccucgcgggugc

SEQ ID NO: 1077154 - RNA, 18 nt, Mycobacterium bovis subsp bovis AF2122/97
cgaucaccugcagcacga

SEQ ID NO: 1077155 - RNA, 18 nt, Mycobacterium bovis subsp bovis AF2122/97
cgaucaccgcuugcuggc

SEQ ID NO: 1077156 - RNA, 13 nt, Mycobacterium bovis subsp bovis AF2122/97
cgaucacgauguc

SEQ ID NO: 1077157 - RNA, 14 nt, Mycobacterium bovis subsp bovis AF2122/97
cgaucacgaugucc

SEQ ID NO: 1077158 - RNA, 20 nt, Mycobacterium bovis subsp bovis AF2122/97
cgaucacgccggccucgccg

SEQ ID NO: 1077159 - RNA, 20 nt, Mycobacterium bovis subsp bovis AF2122/97
cgaucaccuucggccgaccg

SEQ ID NO: 1077160 - RNA, 21 nt, Mycobacterium bovis subsp bovis AF2122/97
cgaucaccuucggccgaccgg

SEQ ID NO: 1077161 - RNA, 20 nt, Mycobacterium bovis subsp bovis AF2122/97
cgaucacggcggccccggca

SEQ ID NO: 1077162 - RNA, 12 nt, Mycobacterium bovis subsp bovis AF2122/97
cgaucacgcugc

SEQ ID NO: 1077163 - RNA, 21 nt, Mycobacterium bovis subsp bovis AF2122/97
cgaucacgcugccccgccgcc

SEQ ID NO: 1077164 - RNA, 15 nt, Mycobacterium bovis subsp bovis AF2122/97
cgaucacggcaccga

SEQ ID NO: 1077165 - RNA, 17 nt, Mycobacterium bovis subsp bovis AF2122/97
cgaucaccuccgcgacg

SEQ ID NO: 1077166 - RNA, 19 nt, Mycobacterium bovis subsp bovis AF2122/97
cgaucaccuccgcgacggc

SEQ ID NO: 1077167 - RNA, 21 nt, Mycobacterium bovis subsp bovis AF2122/97
cgaucaccgagauggcgauca

SEQ ID NO: 1077168 - RNA, 21 nt, Mycobacterium bovis subsp bovis AF2122/97
cgaucacccccuggacuucgg

SEQ ID NO: 1077169 - RNA, 12 nt, Mycobacterium bovis subsp bovis AF2122/97
cgaucaccccgc

SEQ ID NO: 1077170 - RNA, 23 nt, Mycobacterium bovis subsp bovis AF2122/97
cgaucaccccgccaugcggcgcg

SEQ ID NO: 1077171 - RNA, 13 nt, Mycobacterium bovis subsp bovis AF2122/97
cgaucaccgccgg

SEQ ID NO: 1077172 - RNA, 16 nt, Mycobacterium bovis subsp bovis AF2122/97
cgaucaccgccggggc

SEQ ID NO: 1077173 - RNA, 16 nt, Mycobacterium bovis subsp bovis AF2122/97
cgaucaccgcgccgga

SEQ ID NO: 1077174 - RNA, 15 nt, Mycobacterium bovis subsp bovis AF2122/97
cgaucaccgcaucgg

SEQ ID NO: 1077175 - RNA, 19 nt, Mycobacterium bovis subsp bovis AF2122/97
cgaucagcaacucggccac

SEQ ID NO: 1077176 - RNA, 13 nt, Mycobacterium bovis subsp bovis AF2122/97
cgaucagcagccg

SEQ ID NO: 1077177 - RNA, 15 nt, Mycobacterium bovis subsp bovis AF2122/97
cgaucagcaccgacg

SEQ ID NO: 1077178 - RNA, 19 nt, Mycobacterium bovis subsp bovis AF2122/97
cgaucagcaccgacggcgc

SEQ ID NO: 1077179 - RNA, 23 nt, Mycobacterium bovis subsp bovis AF2122/97
cgaucagcaacucggccacggcg

SEQ ID NO: 1077180 - RNA, 13 nt, Mycobacterium bovis subsp bovis AF2122/97
cgaucacgucguc

SEQ ID NO: 1077181 - RNA, 19 nt, Mycobacterium bovis subsp bovis AF2122/97
cgaucacguacgccgccga

SEQ ID NO: 1077182 - RNA, 14 nt, Mycobacterium bovis subsp bovis AF2122/97
cgaucacggccguc

SEQ ID NO: 1077183 - RNA, 23 nt, Mycobacterium bovis subsp bovis AF2122/97
cgaucacgugguccaaccgggcc

SEQ ID NO: 1077184 - RNA, 19 nt, Mycobacterium bovis subsp bovis AF2122/97
cgaucacguggugcggccg

SEQ ID NO: 1077185 - RNA, 14 nt, Mycobacterium bovis subsp bovis AF2122/97
cgaucacuagcgcc

SEQ ID NO: 1077186 - RNA, 16 nt, Mycobacterium bovis subsp bovis AF2122/97
cgaucagauaguccgg

SEQ ID NO: 1077187 - RNA, 18 nt, Mycobacterium bovis subsp bovis AF2122/97
cgaucagaugcggcccgg

SEQ ID NO: 1077188 - RNA, 15 nt, Mycobacterium bovis subsp bovis AF2122/97
cgagucucgucgggu

SEQ ID NO: 1077189 - RNA, 21 nt, Mycobacterium bovis subsp bovis AF2122/97
cgagucgcgcuugggguccgg

SEQ ID NO: 1077190 - RNA, 16 nt, Mycobacterium bovis subsp bovis AF2122/97
cgagucgguugucggg

SEQ ID NO: 1077191 - RNA, 24 nt, Mycobacterium bovis subsp bovis AF2122/97
cgagucgguugucggggucgcagg

SEQ ID NO: 1077192 - RNA, 21 nt, Mycobacterium bovis subsp bovis AF2122/97
cgagugaacucguccugacgg

SEQ ID NO: 1077193 - RNA, 14 nt, Mycobacterium bovis subsp bovis AF2122/97
cgagucggcgggcg

SEQ ID NO: 1077194 - RNA, 16 nt, Mycobacterium bovis subsp bovis AF2122/97
cgagucggcggggcgg

SEQ ID NO: 1077195 - RNA, 17 nt, Mycobacterium bovis subsp bovis AF2122/97
cgaguccaggccggcag

SEQ ID NO: 1077196 - RNA, 15 nt, Mycobacterium bovis subsp bovis AF2122/97
cgaguccaggcugau

SEQ ID NO: 1077197 - RNA, 13 nt, Mycobacterium bovis subsp bovis AF2122/97
cgagugcagcggc

SEQ ID NO: 1077198 - RNA, 16 nt, Mycobacterium bovis subsp bovis AF2122/97
cgagugcagcggcgca

SEQ ID NO: 1077199 - RNA, 17 nt, Mycobacterium bovis subsp bovis AF2122/97
cgauaacaaggccgccg

SEQ ID NO: 1077200 - RNA, 20 nt, Mycobacterium bovis subsp bovis AF2122/97
cgauaacaaggccgccgccg

SEQ ID NO: 1077201 - RNA, 14 nt, Mycobacterium bovis subsp bovis AF2122/97
cgagugccaguccg

SEQ ID NO: 1077202 - RNA, 22 nt, Mycobacterium bovis subsp bovis AF2122/97
cgagugcccagcgaugcgcuca

SEQ ID NO: 1077203 - RNA, 16 nt, Mycobacterium bovis subsp bovis AF2122/97
cgagugccgccaccgc

SEQ ID NO: 1077204 - RNA, 19 nt, Mycobacterium bovis subsp bovis AF2122/97
cgauaaccgaaacucgacg

SEQ ID NO: 1077205 - RNA, 15 nt, Mycobacterium bovis subsp bovis AF2122/97
cgauaacacccgggc

SEQ ID NO: 1077206 - RNA, 16 nt, Mycobacterium bovis subsp bovis AF2122/97
cgauaacacccgggcc

SEQ ID NO: 1077207 - RNA, 24 nt, Mycobacterium bovis subsp bovis AF2122/97
cgagugccgccgucgccacgccca

SEQ ID NO: 1077208 - RNA, 18 nt, Mycobacterium bovis subsp bovis AF2122/97
cgauacuaaacaggccgc

SEQ ID NO: 1077209 - RNA, 19 nt, Mycobacterium bovis subsp bovis AF2122/97
cgauacuaaacaggccgcc

SEQ ID NO: 1077210 - RNA, 13 nt, Mycobacterium bovis subsp bovis AF2122/97
cgauacgggugug

SEQ ID NO: 1077211 - RNA, 20 nt, Mycobacterium bovis subsp bovis AF2122/97
cgauacggguguggccguug

SEQ ID NO: 1077212 - RNA, 21 nt, Mycobacterium bovis subsp bovis AF2122/97
cgauacggguguggccguuga

SEQ ID NO: 1077213 - RNA, 18 nt, Mycobacterium bovis subsp bovis AF2122/97
cgauagaacguagcgccc

SEQ ID NO: 1077214 - RNA, 19 nt, Mycobacterium bovis subsp bovis AF2122/97
cgauagaacguagcgccca

SEQ ID NO: 1077215 - RNA, 15 nt, Mycobacterium bovis subsp bovis AF2122/97
cgauacaccgacggg

SEQ ID NO: 1077216 - RNA, 14 nt, Mycobacterium bovis subsp bovis AF2122/97
cgauacagaucugg

SEQ ID NO: 1077217 - RNA, 17 nt, Mycobacterium bovis subsp bovis AF2122/97
cgauaacuaauuuggug

SEQ ID NO: 1077218 - RNA, 15 nt, Mycobacterium bovis subsp bovis AF2122/97
cgauaaggaccgcgc

SEQ ID NO: 1077219 - RNA, 19 nt, Mycobacterium bovis subsp bovis AF2122/97
cgauaagguucgugcguug

SEQ ID NO: 1077220 - RNA, 22 nt, Mycobacterium bovis subsp bovis AF2122/97
cgaucaacggaacaucgucauc

SEQ ID NO: 1077221 - RNA, 15 nt, Mycobacterium bovis subsp bovis AF2122/97
cgaucaacgcgcacc

SEQ ID NO: 1077222 - RNA, 22 nt, Mycobacterium bovis subsp bovis AF2122/97
cgaucaaugcgaugcggucguc

SEQ ID NO: 1077223 - RNA, 18 nt, Mycobacterium bovis subsp bovis AF2122/97
cgaucaaccccccgggcc

SEQ ID NO: 1077224 - RNA, 22 nt, Mycobacterium bovis subsp bovis AF2122/97
cgaucaacccuagggcggugcc

SEQ ID NO: 1077225 - RNA, 19 nt, Mycobacterium bovis subsp bovis AF2122/97
cgauaguucuggcccgcag

SEQ ID NO: 1077226 - RNA, 19 nt, Mycobacterium bovis subsp bovis AF2122/97
cgaucaccccggucggccc

SEQ ID NO: 1077227 - RNA, 14 nt, Mycobacterium bovis subsp bovis AF2122/97
cgaucacccgcagg

SEQ ID NO: 1077228 - RNA, 13 nt, Mycobacterium bovis subsp bovis AF2122/97
cgaucaccagccc

SEQ ID NO: 1077229 - RNA, 17 nt, Mycobacterium bovis subsp bovis AF2122/97
cgaucaccacggcguug

SEQ ID NO: 1077230 - RNA, 16 nt, Mycobacterium bovis subsp bovis AF2122/97
cgaucaccaccggcag

SEQ ID NO: 1077231 - RNA, 19 nt, Mycobacterium bovis subsp bovis AF2122/97
cgaucaccaccggcagaug

SEQ ID NO: 1077232 - RNA, 15 nt, Mycobacterium bovis subsp bovis AF2122/97
cgaucaauugcccgg

SEQ ID NO: 1077233 - RNA, 22 nt, Mycobacterium bovis subsp bovis AF2122/97
cgaucacacgguccgccacggc

SEQ ID NO: 1077234 - RNA, 22 nt, Mycobacterium bovis subsp bovis AF2122/97
cgaucacacguccgcgcaccgc

SEQ ID NO: 1077235 - RNA, 13 nt, Mycobacterium bovis subsp bovis AF2122/97
cgauagcccgcca

SEQ ID NO: 1077236 - RNA, 18 nt, Mycobacterium bovis subsp bovis AF2122/97
cgauagccgaaaaagacc

SEQ ID NO: 1077237 - RNA, 12 nt, Mycobacterium bovis subsp bovis AF2122/97
cgauagccgccg

SEQ ID NO: 1077238 - RNA, 17 nt, Mycobacterium bovis subsp bovis AF2122/97
cgauagccgccgcgguc

SEQ ID NO: 1077239 - RNA, 21 nt, Mycobacterium bovis subsp bovis AF2122/97
cgauagcgcggcaccagcacc

SEQ ID NO: 1077240 - RNA, 13 nt, Mycobacterium bovis subsp bovis AF2122/97
cgauagcggcgcc

SEQ ID NO: 1077241 - RNA, 17 nt, Mycobacterium bovis subsp bovis AF2122/97
cgauagcgaccgcggcc

SEQ ID NO: 1077242 - RNA, 23 nt, Mycobacterium bovis subsp bovis AF2122/97
cgauacuugcgcuguugcuggcg

SEQ ID NO: 1077243 - RNA, 15 nt, Mycobacterium bovis subsp bovis AF2122/97
cgauagaucgcgugg

SEQ ID NO: 1077244 - RNA, 14 nt, Mycobacterium bovis subsp bovis AF2122/97
cgcagauggcgagg

SEQ ID NO: 1077245 - RNA, 16 nt, Mycobacterium bovis subsp bovis AF2122/97
cgcagaucguccaccg

SEQ ID NO: 1077246 - RNA, 19 nt, Mycobacterium bovis subsp bovis AF2122/97
cgcagaucguccaccgccg

SEQ ID NO: 1077247 - RNA, 21 nt, Mycobacterium bovis subsp bovis AF2122/97
cgcagaucguccaccgccgac

SEQ ID NO: 1077248 - RNA, 21 nt, Mycobacterium bovis subsp bovis AF2122/97
cgcagauuugcuccagcgacg

SEQ ID NO: 1077249 - RNA, 15 nt, Mycobacterium bovis subsp bovis AF2122/97
cgcagcaacggcggc

SEQ ID NO: 1077250 - RNA, 22 nt, Mycobacterium bovis subsp bovis AF2122/97
cgcagcaacggcggcgucgcgg

SEQ ID NO: 1077251 - RNA, 16 nt, Mycobacterium bovis subsp bovis AF2122/97
cgcagaucaggguggc

SEQ ID NO: 1077252 - RNA, 19 nt, Mycobacterium bovis subsp bovis AF2122/97
cgcagaucaggguggcgcg

SEQ ID NO: 1077253 - RNA, 15 nt, Mycobacterium bovis subsp bovis AF2122/97
cgcagauccccgcca

SEQ ID NO: 1077254 - RNA, 18 nt, Mycobacterium bovis subsp bovis AF2122/97
cgcagauccccgccaccg

SEQ ID NO: 1077255 - RNA, 21 nt, Mycobacterium bovis subsp bovis AF2122/97
cgcagauccccgccaccgaac

SEQ ID NO: 1077256 - RNA, 18 nt, Mycobacterium bovis subsp bovis AF2122/97
cgcacucuuuccuuccgc

SEQ ID NO: 1077257 - RNA, 22 nt, Mycobacterium bovis subsp bovis AF2122/97
cgcacugaugucacccgcccga

SEQ ID NO: 1077258 - RNA, 16 nt, Mycobacterium bovis subsp bovis AF2122/97
cgcacucggcgguucc

SEQ ID NO: 1077259 - RNA, 13 nt, Mycobacterium bovis subsp bovis AF2122/97
cgcagaccgccac

SEQ ID NO: 1077260 - RNA, 14 nt, Mycobacterium bovis subsp bovis AF2122/97
cgcagacgccgacu

SEQ ID NO: 1077261 - RNA, 14 nt, Mycobacterium bovis subsp bovis AF2122/97
cgcagaccgccacc

SEQ ID NO: 1077262 - RNA, 16 nt, Mycobacterium bovis subsp bovis AF2122/97
cgcagaccgccaccgg

SEQ ID NO: 1077263 - RNA, 17 nt, Mycobacterium bovis subsp bovis AF2122/97
cgcagaccgccaccggc

SEQ ID NO: 1077264 - RNA, 19 nt, Mycobacterium bovis subsp bovis AF2122/97
cgcagaccgccaccggcug

SEQ ID NO: 1077265 - RNA, 16 nt, Mycobacterium bovis subsp bovis AF2122/97
cgcagaccguccagca

SEQ ID NO: 1077266 - RNA, 19 nt, Mycobacterium bovis subsp bovis AF2122/97
cgcagaccguccagcaaca

SEQ ID NO: 1077267 - RNA, 20 nt, Mycobacterium bovis subsp bovis AF2122/97
cgcagacgugguagccggcg

SEQ ID NO: 1077268 - RNA, 17 nt, Mycobacterium bovis subsp bovis AF2122/97
cgcagacucgccaccgc

SEQ ID NO: 1077269 - RNA, 21 nt, Mycobacterium bovis subsp bovis AF2122/97
cgcagacucgccaccgcggcg

SEQ ID NO: 1077270 - RNA, 17 nt, Mycobacterium bovis subsp bovis AF2122/97
cgcagagcaccgcgaac

SEQ ID NO: 1077271 - RNA, 18 nt, Mycobacterium bovis subsp bovis AF2122/97
cgcagagcguuccgcucg

SEQ ID NO: 1077272 - RNA, 16 nt, Mycobacterium bovis subsp bovis AF2122/97
cgcagaggcggcuggc

SEQ ID NO: 1077273 - RNA, 17 nt, Mycobacterium bovis subsp bovis AF2122/97
cgcagaggcggcuggcg

SEQ ID NO: 1077274 - RNA, 18 nt, Mycobacterium bovis subsp bovis AF2122/97
cgcagcagcaucggcacg

SEQ ID NO: 1077275 - RNA, 18 nt, Mycobacterium bovis subsp bovis AF2122/97
cgcagcaggggacgacca

SEQ ID NO: 1077276 - RNA, 19 nt, Mycobacterium bovis subsp bovis AF2122/97
cgcagcaggggacgaccau

SEQ ID NO: 1077277 - RNA, 20 nt, Mycobacterium bovis subsp bovis AF2122/97
cgcagcaggggacgaccaug

SEQ ID NO: 1077278 - RNA, 14 nt, Mycobacterium bovis subsp bovis AF2122/97
cgcagcagugcgaa

SEQ ID NO: 1077279 - RNA, 16 nt, Mycobacterium bovis subsp bovis AF2122/97
cgcagcaucacguccg

SEQ ID NO: 1077280 - RNA, 20 nt, Mycobacterium bovis subsp bovis AF2122/97
cgcagcaguuggucgcgguc

SEQ ID NO: 1077281 - RNA, 17 nt, Mycobacterium bovis subsp bovis AF2122/97
cgcagccagcugaacac

SEQ ID NO: 1077282 - RNA, 14 nt, Mycobacterium bovis subsp bovis AF2122/97
cgcagccagcgcca

SEQ ID NO: 1077283 - RNA, 19 nt, Mycobacterium bovis subsp bovis AF2122/97
cgcagccaggugucgucga

SEQ ID NO: 1077284 - RNA, 14 nt, Mycobacterium bovis subsp bovis AF2122/97
cgcagcaccgucgg

SEQ ID NO: 1077285 - RNA, 12 nt, Mycobacterium bovis subsp bovis AF2122/97
cgcagcaccguu

SEQ ID NO: 1077286 - RNA, 20 nt, Mycobacterium bovis subsp bovis AF2122/97
cgcagcaccguucgcagcac

SEQ ID NO: 1077287 - RNA, 14 nt, Mycobacterium bovis subsp bovis AF2122/97
cgcagcacggcacc

SEQ ID NO: 1077288 - RNA, 13 nt, Mycobacterium bovis subsp bovis AF2122/97
cgcagcacggcgg

SEQ ID NO: 1077289 - RNA, 18 nt, Mycobacterium bovis subsp bovis AF2122/97
cgcagcacggcggccacg

SEQ ID NO: 1077290 - RNA, 17 nt, Mycobacterium bovis subsp bovis AF2122/97
cgcagcagaccacaacg

SEQ ID NO: 1077291 - RNA, 22 nt, Mycobacterium bovis subsp bovis AF2122/97
cgcagcacucgcccaagcgcag

SEQ ID NO: 1077292 - RNA, 19 nt, Mycobacterium bovis subsp bovis AF2122/97
cgcagcacccugcgggccg

SEQ ID NO: 1077293 - RNA, 15 nt, Mycobacterium bovis subsp bovis AF2122/97
cgcagcaccacaucc

SEQ ID NO: 1077294 - RNA, 23 nt, Mycobacterium bovis subsp bovis AF2122/97
cgcagcaacggcggcgucgcggu

SEQ ID NO: 1077295 - RNA, 14 nt, Mycobacterium bovis subsp bovis AF2122/97
cgcagcaacucgac

SEQ ID NO: 1077296 - RNA, 19 nt, Mycobacterium bovis subsp bovis AF2122/97
cgcagcaacugggcggccu

SEQ ID NO: 1077297 - RNA, 15 nt, Mycobacterium bovis subsp bovis AF2122/97
cgcaccagcaccugc

SEQ ID NO: 1077298 - RNA, 15 nt, Mycobacterium bovis subsp bovis AF2122/97
cgcaccagcugucgg

SEQ ID NO: 1077299 - RNA, 15 nt, Mycobacterium bovis subsp bovis AF2122/97
cgcaccaggcggccg

SEQ ID NO: 1077300 - RNA, 15 nt, Mycobacterium bovis subsp bovis AF2122/97
cgcaccagggagccg

SEQ ID NO: 1077301 - RNA, 19 nt, Mycobacterium bovis subsp bovis AF2122/97
cgcaccggccgcuauggcc

SEQ ID NO: 1077302 - RNA, 22 nt, Mycobacterium bovis subsp bovis AF2122/97
cgcaccggccgcuauggcccgg

SEQ ID NO: 1077303 - RNA, 14 nt, Mycobacterium bovis subsp bovis AF2122/97
cgcaccggcgucgg

SEQ ID NO: 1077304 - RNA, 20 nt, Mycobacterium bovis subsp bovis AF2122/97
cgcaccggcgucggcgcggc

SEQ ID NO: 1077305 - RNA, 22 nt, Mycobacterium bovis subsp bovis AF2122/97
cgcaccggcgucggcgcggccg

SEQ ID NO: 1077306 - RNA, 15 nt, Mycobacterium bovis subsp bovis AF2122/97
cgcaccggcuggccc

SEQ ID NO: 1077307 - RNA, 17 nt, Mycobacterium bovis subsp bovis AF2122/97
cgcaccggcuggcccag

SEQ ID NO: 1077308 - RNA, 23 nt, Mycobacterium bovis subsp bovis AF2122/97
cgcaccggugauggugaccagca

SEQ ID NO: 1077309 - RNA, 17 nt, Mycobacterium bovis subsp bovis AF2122/97
cgcaccguagccgcugc

SEQ ID NO: 1077310 - RNA, 24 nt, Mycobacterium bovis subsp bovis AF2122/97
cgcaccguagccgcugcacguggc

SEQ ID NO: 1077311 - RNA, 21 nt, Mycobacterium bovis subsp bovis AF2122/97
cgcaccggggugugcgggcgg

SEQ ID NO: 1077312 - RNA, 22 nt, Mycobacterium bovis subsp bovis AF2122/97
cgcaccggguccuauccgggcc

SEQ ID NO: 1077313 - RNA, 23 nt, Mycobacterium bovis subsp bovis AF2122/97
cgcaccggguccuauccgggccc

SEQ ID NO: 1077314 - RNA, 15 nt, Mycobacterium bovis subsp bovis AF2122/97
cgcaccgguaccgac

SEQ ID NO: 1077315 - RNA, 20 nt, Mycobacterium bovis subsp bovis AF2122/97
cgcaccgugucuacgccggg

SEQ ID NO: 1077316 - RNA, 19 nt, Mycobacterium bovis subsp bovis AF2122/97
cgcaccgugugggccccgc

SEQ ID NO: 1077317 - RNA, 21 nt, Mycobacterium bovis subsp bovis AF2122/97
cgcaccgucgcuaugcgccgc

SEQ ID NO: 1077318 - RNA, 22 nt, Mycobacterium bovis subsp bovis AF2122/97
cgcaccgugggcccuucacugu

SEQ ID NO: 1077319 - RNA, 16 nt, Mycobacterium bovis subsp bovis AF2122/97
cgcaccgugccgacgc

SEQ ID NO: 1077320 - RNA, 22 nt, Mycobacterium bovis subsp bovis AF2122/97
cgcacggugccgccgucgauga

SEQ ID NO: 1077321 - RNA, 17 nt, Mycobacterium bovis subsp bovis AF2122/97
cgcacgguccacggugg

SEQ ID NO: 1077322 - RNA, 13 nt, Mycobacterium bovis subsp bovis AF2122/97
cgcacgggccacc

SEQ ID NO: 1077323 - RNA, 14 nt, Mycobacterium bovis subsp bovis AF2122/97
cgcacgggccacca

SEQ ID NO: 1077324 - RNA, 17 nt, Mycobacterium bovis subsp bovis AF2122/97
cgcacgggccaccagcg

SEQ ID NO: 1077325 - RNA, 19 nt, Mycobacterium bovis subsp bovis AF2122/97
cgcacgggccaccagcguc

SEQ ID NO: 1077326 - RNA, 23 nt, Mycobacterium bovis subsp bovis AF2122/97
cgcacucgaagaugucgucaccg

SEQ ID NO: 1077327 - RNA, 22 nt, Mycobacterium bovis subsp bovis AF2122/97
cgcacucgacggucaucgcugu

SEQ ID NO: 1077328 - RNA, 18 nt, Mycobacterium bovis subsp bovis AF2122/97
cgcacggugaccacgccg

SEQ ID NO: 1077329 - RNA, 20 nt, Mycobacterium bovis subsp bovis AF2122/97
cgcacggugaccacgccgug

SEQ ID NO: 1077330 - RNA, 15 nt, Mycobacterium bovis subsp bovis AF2122/97
cgcacucagucuggg

SEQ ID NO: 1077331 - RNA, 21 nt, Mycobacterium bovis subsp bovis AF2122/97
cgcacucauagaacucgccgc

SEQ ID NO: 1077332 - RNA, 14 nt, Mycobacterium bovis subsp bovis AF2122/97
cgcacucguugccg

SEQ ID NO: 1077333 - RNA, 17 nt, Mycobacterium bovis subsp bovis AF2122/97
cgcacucuagccgggug

SEQ ID NO: 1077334 - RNA, 18 nt, Mycobacterium bovis subsp bovis AF2122/97
cgcacucugaugucggga

SEQ ID NO: 1077335 - RNA, 18 nt, Mycobacterium bovis subsp bovis AF2122/97
cgcacuccacgaucggcc

SEQ ID NO: 1077336 - RNA, 14 nt, Mycobacterium bovis subsp bovis AF2122/97
cgcacucccgagcc

SEQ ID NO: 1077337 - RNA, 19 nt, Mycobacterium bovis subsp bovis AF2122/97
cgcacucccggcucggcca

SEQ ID NO: 1077338 - RNA, 20 nt, Mycobacterium bovis subsp bovis AF2122/97
cgcacucaucgccggaccgg

SEQ ID NO: 1077339 - RNA, 17 nt, Mycobacterium bovis subsp bovis AF2122/97
cgcacuccacgaucggc

SEQ ID NO: 1077340 - RNA, 18 nt, Mycobacterium bovis subsp bovis AF2122/97
cgcaccugcgcgcggccg

SEQ ID NO: 1077341 - RNA, 19 nt, Mycobacterium bovis subsp bovis AF2122/97
cgcaccugcgcgcggccgc

SEQ ID NO: 1077342 - RNA, 14 nt, Mycobacterium bovis subsp bovis AF2122/97
cgcaccugaucggu

SEQ ID NO: 1077343 - RNA, 14 nt, Mycobacterium bovis subsp bovis AF2122/97
cgcaccugcgauga

SEQ ID NO: 1077344 - RNA, 16 nt, Mycobacterium bovis subsp bovis AF2122/97
cgcaccugggcugccg

SEQ ID NO: 1077345 - RNA, 18 nt, Mycobacterium bovis subsp bovis AF2122/97
cgcaccugggcugccggc

SEQ ID NO: 1077346 - RNA, 19 nt, Mycobacterium bovis subsp bovis AF2122/97
cgcaccugggcugccggcc

SEQ ID NO: 1077347 - RNA, 19 nt, Mycobacterium bovis subsp bovis AF2122/97
cgcaccugggucgacgaga

SEQ ID NO: 1077348 - RNA, 16 nt, Mycobacterium bovis subsp bovis AF2122/97
cgcacgaaaccgcagc

SEQ ID NO: 1077349 - RNA, 19 nt, Mycobacterium bovis subsp bovis AF2122/97
cgcaccuugaccgucgcgc

SEQ ID NO: 1077350 - RNA, 18 nt, Mycobacterium bovis subsp bovis AF2122/97
cgcacggccuccggaccg

SEQ ID NO: 1077351 - RNA, 16 nt, Mycobacterium bovis subsp bovis AF2122/97
cgcacggcgucggcca

SEQ ID NO: 1077352 - RNA, 20 nt, Mycobacterium bovis subsp bovis AF2122/97
cgcacggcgucggccaccgc

SEQ ID NO: 1077353 - RNA, 22 nt, Mycobacterium bovis subsp bovis AF2122/97
cgcacggcgucggccaccgccu

SEQ ID NO: 1077354 - RNA, 21 nt, Mycobacterium bovis subsp bovis AF2122/97
cgcaccgugccgacgccccga

SEQ ID NO: 1077355 - RNA, 21 nt, Mycobacterium bovis subsp bovis AF2122/97
cgcacggcgccgacccgauca

SEQ ID NO: 1077356 - RNA, 18 nt, Mycobacterium bovis subsp bovis AF2122/97
cgauggccacccgguggc

SEQ ID NO: 1077357 - RNA, 18 nt, Mycobacterium bovis subsp bovis AF2122/97
cgauggcccuuccggccg

SEQ ID NO: 1077358 - RNA, 19 nt, Mycobacterium bovis subsp bovis AF2122/97
cgauuucggcgaccggccg

SEQ ID NO: 1077359 - RNA, 18 nt, Mycobacterium bovis subsp bovis AF2122/97
cgauuucggcgccggcgu

SEQ ID NO: 1077360 - RNA, 17 nt, Mycobacterium bovis subsp bovis AF2122/97
cgauuuugcgucucgcg

SEQ ID NO: 1077361 - RNA, 20 nt, Mycobacterium bovis subsp bovis AF2122/97
cgauuuugcgucucgcgcag

SEQ ID NO: 1077362 - RNA, 19 nt, Mycobacterium bovis subsp bovis AF2122/97
cgauuuugcgucugcucgc

SEQ ID NO: 1077363 - RNA, 15 nt, Mycobacterium bovis subsp bovis AF2122/97
cgauuucccaugcaa

SEQ ID NO: 1077364 - RNA, 16 nt, Mycobacterium bovis subsp bovis AF2122/97
cgauggccagcacggu

SEQ ID NO: 1077365 - RNA, 13 nt, Mycobacterium bovis subsp bovis AF2122/97
cgauggcagcgcc

SEQ ID NO: 1077366 - RNA, 22 nt, Mycobacterium bovis subsp bovis AF2122/97
cgauggcagcgccgauggccgc

SEQ ID NO: 1077367 - RNA, 13 nt, Mycobacterium bovis subsp bovis AF2122/97
cgauggcaggggc

SEQ ID NO: 1077368 - RNA, 21 nt, Mycobacterium bovis subsp bovis AF2122/97
cgauggcaccacuacaucgau

SEQ ID NO: 1077369 - RNA, 15 nt, Mycobacterium bovis subsp bovis AF2122/97
cgauggcaccggcgu

SEQ ID NO: 1077370 - RNA, 20 nt, Mycobacterium bovis subsp bovis AF2122/97
cgauggccagcacgguguug

SEQ ID NO: 1077371 - RNA, 23 nt, Mycobacterium bovis subsp bovis AF2122/97
cgaugcucacuacccgcaacgag

SEQ ID NO: 1077372 - RNA, 15 nt, Mycobacterium bovis subsp bovis AF2122/97
cgaugcucgccguug

SEQ ID NO: 1077373 - RNA, 15 nt, Mycobacterium bovis subsp bovis AF2122/97
cgaugcugccagcca

SEQ ID NO: 1077374 - RNA, 13 nt, Mycobacterium bovis subsp bovis AF2122/97
cgaugcugccgcc

SEQ ID NO: 1077375 - RNA, 14 nt, Mycobacterium bovis subsp bovis AF2122/97
cgaugcugccgccg

SEQ ID NO: 1077376 - RNA, 16 nt, Mycobacterium bovis subsp bovis AF2122/97
cgaugcugccgccgcc

SEQ ID NO: 1077377 - RNA, 21 nt, Mycobacterium bovis subsp bovis AF2122/97
cgaugcugaacacgcagccga

SEQ ID NO: 1077378 - RNA, 11 nt, Mycobacterium bovis subsp bovis AF2122/97
cgaugcugacg

SEQ ID NO: 1077379 - RNA, 20 nt, Mycobacterium bovis subsp bovis AF2122/97
cgaugcugacgaugcggucg

SEQ ID NO: 1077380 - RNA, 15 nt, Mycobacterium bovis subsp bovis AF2122/97
cgaugcugacggugg

SEQ ID NO: 1077381 - RNA, 17 nt, Mycobacterium bovis subsp bovis AF2122/97
cgcaagaaugccgccga

SEQ ID NO: 1077382 - RNA, 12 nt, Mycobacterium bovis subsp bovis AF2122/97
cgcaagcagcgc

SEQ ID NO: 1077383 - RNA, 15 nt, Mycobacterium bovis subsp bovis AF2122/97
cgcaagcgccgcgcu

SEQ ID NO: 1077384 - RNA, 19 nt, Mycobacterium bovis subsp bovis AF2122/97
cgcaagcgccgcgcuugcg

SEQ ID NO: 1077385 - RNA, 22 nt, Mycobacterium bovis subsp bovis AF2122/97
cgcaagcgcggcgaagccgggu

SEQ ID NO: 1077386 - RNA, 22 nt, Mycobacterium bovis subsp bovis AF2122/97
cgcaacuacggcguccccgaca

SEQ ID NO: 1077387 - RNA, 16 nt, Mycobacterium bovis subsp bovis AF2122/97
cgcaacggugaucagc

SEQ ID NO: 1077388 - RNA, 21 nt, Mycobacterium bovis subsp bovis AF2122/97
cgcaacucccagcacgguggc

SEQ ID NO: 1077389 - RNA, 17 nt, Mycobacterium bovis subsp bovis AF2122/97
cgcaagaaucagcagca

SEQ ID NO: 1077390 - RNA, 20 nt, Mycobacterium bovis subsp bovis AF2122/97
cgcaagaaucagcagcagcg

SEQ ID NO: 1077391 - RNA, 18 nt, Mycobacterium bovis subsp bovis AF2122/97
cgcaacuucuucagcagc

SEQ ID NO: 1077392 - RNA, 16 nt, Mycobacterium bovis subsp bovis AF2122/97
cgcaacaccucaccgc

SEQ ID NO: 1077393 - RNA, 18 nt, Mycobacterium bovis subsp bovis AF2122/97
cgcaacaccucaccgcgg

SEQ ID NO: 1077394 - RNA, 14 nt, Mycobacterium bovis subsp bovis AF2122/97
cgcaacaccgccaa

SEQ ID NO: 1077395 - RNA, 20 nt, Mycobacterium bovis subsp bovis AF2122/97
cgcaacagcucggccaggcu

SEQ ID NO: 1077396 - RNA, 23 nt, Mycobacterium bovis subsp bovis AF2122/97
cgcaacgcgugcgcaucagcggu

SEQ ID NO: 1077397 - RNA, 15 nt, Mycobacterium bovis subsp bovis AF2122/97
cgcaacacgggcgcc

SEQ ID NO: 1077398 - RNA, 19 nt, Mycobacterium bovis subsp bovis AF2122/97
cgcaacaccaucagcgaca

SEQ ID NO: 1077399 - RNA, 20 nt, Mycobacterium bovis subsp bovis AF2122/97
cgcaacaccccccguccacc

SEQ ID NO: 1077400 - RNA, 21 nt, Mycobacterium bovis subsp bovis AF2122/97
cgcaacaccccccguccaccg

SEQ ID NO: 1077401 - RNA, 21 nt, Mycobacterium bovis subsp bovis AF2122/97
cgcaacaaccgguuggcgauc

SEQ ID NO: 1077402 - RNA, 21 nt, Mycobacterium bovis subsp bovis AF2122/97
cgcaaaggccccggugacgcc

SEQ ID NO: 1077403 - RNA, 20 nt, Mycobacterium bovis subsp bovis AF2122/97
cgauuuugcgucugcucgcc

SEQ ID NO: 1077404 - RNA, 15 nt, Mycobacterium bovis subsp bovis AF2122/97
cgcacaaguggucga

SEQ ID NO: 1077405 - RNA, 16 nt, Mycobacterium bovis subsp bovis AF2122/97
cgcacagcagcaccgc

SEQ ID NO: 1077406 - RNA, 17 nt, Mycobacterium bovis subsp bovis AF2122/97
cgcacagcagcaccgcg

SEQ ID NO: 1077407 - RNA, 19 nt, Mycobacterium bovis subsp bovis AF2122/97
cgcacagcagcaccgcgac

SEQ ID NO: 1077408 - RNA, 17 nt, Mycobacterium bovis subsp bovis AF2122/97
cgcacagcaccacaucg

SEQ ID NO: 1077409 - RNA, 19 nt, Mycobacterium bovis subsp bovis AF2122/97
cgcacagccgcuuggcgcg

SEQ ID NO: 1077410 - RNA, 16 nt, Mycobacterium bovis subsp bovis AF2122/97
cgcacagcccgaugcc

SEQ ID NO: 1077411 - RNA, 17 nt, Mycobacterium bovis subsp bovis AF2122/97
cgcacacuaccgccgcg

SEQ ID NO: 1077412 - RNA, 20 nt, Mycobacterium bovis subsp bovis AF2122/97
cgcacacuaccgccgcgacc

SEQ ID NO: 1077413 - RNA, 21 nt, Mycobacterium bovis subsp bovis AF2122/97
cgcacacucucggugaacgcc

SEQ ID NO: 1077414 - RNA, 12 nt, Mycobacterium bovis subsp bovis AF2122/97
cgcacacgcgug

SEQ ID NO: 1077415 - RNA, 13 nt, Mycobacterium bovis subsp bovis AF2122/97
cgcacacgaucgc

SEQ ID NO: 1077416 - RNA, 19 nt, Mycobacterium bovis subsp bovis AF2122/97
cgcacaccaacaccgcggc

SEQ ID NO: 1077417 - RNA, 20 nt, Mycobacterium bovis subsp bovis AF2122/97
cgcacaccaacaccgcggcg

SEQ ID NO: 1077418 - RNA, 20 nt, Mycobacterium bovis subsp bovis AF2122/97
cgcacauggugggucgacga

SEQ ID NO: 1077419 - RNA, 23 nt, Mycobacterium bovis subsp bovis AF2122/97
cgcacaggauuuucucggggugg

SEQ ID NO: 1077420 - RNA, 13 nt, Mycobacterium bovis subsp bovis AF2122/97
cgcacaggugcca

SEQ ID NO: 1077421 - RNA, 22 nt, Mycobacterium bovis subsp bovis AF2122/97
cgcacaggugccaaacgccgcc

SEQ ID NO: 1077422 - RNA, 17 nt, Mycobacterium bovis subsp bovis AF2122/97
cgcaaucguuggccaug

SEQ ID NO: 1077423 - RNA, 20 nt, Mycobacterium bovis subsp bovis AF2122/97
cgcaauauccggccgagccg

SEQ ID NO: 1077424 - RNA, 15 nt, Mycobacterium bovis subsp bovis AF2122/97
cgcaauaugccacag

SEQ ID NO: 1077425 - RNA, 18 nt, Mycobacterium bovis subsp bovis AF2122/97
cgcaaucauccgaucgcc

SEQ ID NO: 1077426 - RNA, 23 nt, Mycobacterium bovis subsp bovis AF2122/97
cgcaaucaggaaccgcucgucac

SEQ ID NO: 1077427 - RNA, 19 nt, Mycobacterium bovis subsp bovis AF2122/97
cgcaaugcaucgcggcggc

SEQ ID NO: 1077428 - RNA, 19 nt, Mycobacterium bovis subsp bovis AF2122/97
cgcaaugcgcgcgauggcg

SEQ ID NO: 1077429 - RNA, 13 nt, Mycobacterium bovis subsp bovis AF2122/97
cgcaaugcgggcc

SEQ ID NO: 1077430 - RNA, 17 nt, Mycobacterium bovis subsp bovis AF2122/97
cgcaauucccaucggcc

SEQ ID NO: 1077431 - RNA, 15 nt, Mycobacterium bovis subsp bovis AF2122/97
cgcaauuccggugau

SEQ ID NO: 1077432 - RNA, 20 nt, Mycobacterium bovis subsp bovis AF2122/97
cgcaauuccggugaucgcgg

SEQ ID NO: 1077433 - RNA, 16 nt, Mycobacterium bovis subsp bovis AF2122/97
cgcaaugacgucgucg

SEQ ID NO: 1077434 - RNA, 19 nt, Mycobacterium bovis subsp bovis AF2122/97
cgcaaugacgucgucggcc

SEQ ID NO: 1077435 - RNA, 20 nt, Mycobacterium bovis subsp bovis AF2122/97
cgcaaugacgucgucggcca

SEQ ID NO: 1077436 - RNA, 18 nt, Mycobacterium bovis subsp bovis AF2122/97
cgcaaugaccugcagcgc

SEQ ID NO: 1077437 - RNA, 14 nt, Mycobacterium bovis subsp bovis AF2122/97
cgcaagcgcggcga

SEQ ID NO: 1077438 - RNA, 22 nt, Mycobacterium bovis subsp bovis AF2122/97
cgcaauagcgacagcagcgcca

SEQ ID NO: 1077439 - RNA, 13 nt, Mycobacterium bovis subsp bovis AF2122/97
cgcaagucgaugu

SEQ ID NO: 1077440 - RNA, 23 nt, Mycobacterium bovis subsp bovis AF2122/97
cgccaccacaugcgagucgcacu

SEQ ID NO: 1077441 - RNA, 22 nt, Mycobacterium bovis subsp bovis AF2122/97
cgccacccgacaugcgccgaga

SEQ ID NO: 1077442 - RNA, 15 nt, Mycobacterium bovis subsp bovis AF2122/97
cgccaccccgcgcgc

SEQ ID NO: 1077443 - RNA, 20 nt, Mycobacterium bovis subsp bovis AF2122/97
cgccaccccgcguaugccag

SEQ ID NO: 1077444 - RNA, 22 nt, Mycobacterium bovis subsp bovis AF2122/97
cgccaccaaauccgcaaggacc

SEQ ID NO: 1077445 - RNA, 22 nt, Mycobacterium bovis subsp bovis AF2122/97
cgccaccgaagccgccgggugc

SEQ ID NO: 1077446 - RNA, 19 nt, Mycobacterium bovis subsp bovis AF2122/97
cgccaccgaacagucgagu

SEQ ID NO: 1077447 - RNA, 13 nt, Mycobacterium bovis subsp bovis AF2122/97
cgccaccgaacgc

SEQ ID NO: 1077448 - RNA, 21 nt, Mycobacterium bovis subsp bovis AF2122/97
cgccaccgaacgcaccgaaac

SEQ ID NO: 1077449 - RNA, 13 nt, Mycobacterium bovis subsp bovis AF2122/97
cgccacccggcgg

SEQ ID NO: 1077450 - RNA, 16 nt, Mycobacterium bovis subsp bovis AF2122/97
cgccacccggcgggcg

SEQ ID NO: 1077451 - RNA, 18 nt, Mycobacterium bovis subsp bovis AF2122/97
cgccacccgguccggccc

SEQ ID NO: 1077452 - RNA, 19 nt, Mycobacterium bovis subsp bovis AF2122/97
cgccacccgguccggcccg

SEQ ID NO: 1077453 - RNA, 16 nt, Mycobacterium bovis subsp bovis AF2122/97
cgccacccgcgccgcc

SEQ ID NO: 1077454 - RNA, 18 nt, Mycobacterium bovis subsp bovis AF2122/97
cgccacccgcgccgcccg

SEQ ID NO: 1077455 - RNA, 15 nt, Mycobacterium bovis subsp bovis AF2122/97
cgccacccgcggugc

SEQ ID NO: 1077456 - RNA, 14 nt, Mycobacterium bovis subsp bovis AF2122/97
cgccacccgccaac

SEQ ID NO: 1077457 - RNA, 15 nt, Mycobacterium bovis subsp bovis AF2122/97
cgccacagucgucga

SEQ ID NO: 1077458 - RNA, 13 nt, Mycobacterium bovis subsp bovis AF2122/97
cgccacaucgugg

SEQ ID NO: 1077459 - RNA, 17 nt, Mycobacterium bovis subsp bovis AF2122/97
cgccacauacaccggcc

SEQ ID NO: 1077460 - RNA, 19 nt, Mycobacterium bovis subsp bovis AF2122/97
cgccacauacaccggccgg

SEQ ID NO: 1077461 - RNA, 21 nt, Mycobacterium bovis subsp bovis AF2122/97
cgccacauacaccggccgguc

SEQ ID NO: 1077462 - RNA, 20 nt, Mycobacterium bovis subsp bovis AF2122/97
cgccacacccggcacacccu

SEQ ID NO: 1077463 - RNA, 14 nt, Mycobacterium bovis subsp bovis AF2122/97
cgccacaccaugau

SEQ ID NO: 1077464 - RNA, 23 nt, Mycobacterium bovis subsp bovis AF2122/97
cgccacaccaugauugccaggac

SEQ ID NO: 1077465 - RNA, 20 nt, Mycobacterium bovis subsp bovis AF2122/97
cgccacacccaaaccggccc

SEQ ID NO: 1077466 - RNA, 16 nt, Mycobacterium bovis subsp bovis AF2122/97
cgccacaccgccgcca

SEQ ID NO: 1077467 - RNA, 21 nt, Mycobacterium bovis subsp bovis AF2122/97
cgccacaccggggcggccgac

SEQ ID NO: 1077468 - RNA, 14 nt, Mycobacterium bovis subsp bovis AF2122/97
cgccacacggggcc

SEQ ID NO: 1077469 - RNA, 15 nt, Mycobacterium bovis subsp bovis AF2122/97
cgccacacggggccg

SEQ ID NO: 1077470 - RNA, 16 nt, Mycobacterium bovis subsp bovis AF2122/97
cgccacacggggccgc

SEQ ID NO: 1077471 - RNA, 17 nt, Mycobacterium bovis subsp bovis AF2122/97
cgccacacggggccgcc

SEQ ID NO: 1077472 - RNA, 19 nt, Mycobacterium bovis subsp bovis AF2122/97
cgcaugucgauccggcgcc

SEQ ID NO: 1077473 - RNA, 20 nt, Mycobacterium bovis subsp bovis AF2122/97
cgcaugucgauccggcgcca

SEQ ID NO: 1077474 - RNA, 14 nt, Mycobacterium bovis subsp bovis AF2122/97
cgcauggucgacga

SEQ ID NO: 1077475 - RNA, 19 nt, Mycobacterium bovis subsp bovis AF2122/97
cgcaugggucauggcgcug

SEQ ID NO: 1077476 - RNA, 20 nt, Mycobacterium bovis subsp bovis AF2122/97
cgcauggugggugccggcgu

SEQ ID NO: 1077477 - RNA, 22 nt, Mycobacterium bovis subsp bovis AF2122/97
cgcauggugggugccggcgucg

SEQ ID NO: 1077478 - RNA, 17 nt, Mycobacterium bovis subsp bovis AF2122/97
cgcauggugguggguga

SEQ ID NO: 1077479 - RNA, 20 nt, Mycobacterium bovis subsp bovis AF2122/97
cgccaacaacuucucgucga

SEQ ID NO: 1077480 - RNA, 18 nt, Mycobacterium bovis subsp bovis AF2122/97
cgcaugucggacacgugg

SEQ ID NO: 1077481 - RNA, 16 nt, Mycobacterium bovis subsp bovis AF2122/97
cgcaugucgggccagg

SEQ ID NO: 1077482 - RNA, 19 nt, Mycobacterium bovis subsp bovis AF2122/97
cgcaugucgggccaggcga

SEQ ID NO: 1077483 - RNA, 21 nt, Mycobacterium bovis subsp bovis AF2122/97
cgcaugugaaagacaacccgc

SEQ ID NO: 1077484 - RNA, 18 nt, Mycobacterium bovis subsp bovis AF2122/97
cgcauguucuccacgccg

SEQ ID NO: 1077485 - RNA, 13 nt, Mycobacterium bovis subsp bovis AF2122/97
cgccaacaccggc

SEQ ID NO: 1077486 - RNA, 20 nt, Mycobacterium bovis subsp bovis AF2122/97
cgccaacaccggcaucgcga

SEQ ID NO: 1077487 - RNA, 15 nt, Mycobacterium bovis subsp bovis AF2122/97
cgccaacaccaacca

SEQ ID NO: 1077488 - RNA, 18 nt, Mycobacterium bovis subsp bovis AF2122/97
cgccaacaccaaccagug

SEQ ID NO: 1077489 - RNA, 19 nt, Mycobacterium bovis subsp bovis AF2122/97
cgccaacaucuccgcgucg

SEQ ID NO: 1077490 - RNA, 20 nt, Mycobacterium bovis subsp bovis AF2122/97
cgccaacaucuccgcgucgg

SEQ ID NO: 1077491 - RNA, 16 nt, Mycobacterium bovis subsp bovis AF2122/97
cgccaaccagucgcac

SEQ ID NO: 1077492 - RNA, 20 nt, Mycobacterium bovis subsp bovis AF2122/97
cgccaaccccaacaucccgg

SEQ ID NO: 1077493 - RNA, 14 nt, Mycobacterium bovis subsp bovis AF2122/97
cgccaacccggcca

SEQ ID NO: 1077494 - RNA, 18 nt, Mycobacterium bovis subsp bovis AF2122/97
cgccaaccuuugcguugc

SEQ ID NO: 1077495 - RNA, 21 nt, Mycobacterium bovis subsp bovis AF2122/97
cgccaacgccaaaacggucga

SEQ ID NO: 1077496 - RNA, 16 nt, Mycobacterium bovis subsp bovis AF2122/97
cgccacaccaacgucg

SEQ ID NO: 1077497 - RNA, 13 nt, Mycobacterium bovis subsp bovis AF2122/97
cgccacaccauga

SEQ ID NO: 1077498 - RNA, 17 nt, Mycobacterium bovis subsp bovis AF2122/97
cgccacaaacccgauga

SEQ ID NO: 1077499 - RNA, 18 nt, Mycobacterium bovis subsp bovis AF2122/97
cgccaauugugcugaccg

SEQ ID NO: 1077500 - RNA, 21 nt, Mycobacterium bovis subsp bovis AF2122/97
cgccaacgccagcaccagcgu

SEQ ID NO: 1077501 - RNA, 13 nt, Mycobacterium bovis subsp bovis AF2122/97
cgccaacgccacg

SEQ ID NO: 1077502 - RNA, 17 nt, Mycobacterium bovis subsp bovis AF2122/97
cgccaacgccacggcaa

SEQ ID NO: 1077503 - RNA, 13 nt, Mycobacterium bovis subsp bovis AF2122/97
cgccaacgccagc

SEQ ID NO: 1077504 - RNA, 14 nt, Mycobacterium bovis subsp bovis AF2122/97
cgcauccgcaccga

SEQ ID NO: 1077505 - RNA, 12 nt, Mycobacterium bovis subsp bovis AF2122/97
cgcauccgcgac

SEQ ID NO: 1077506 - RNA, 13 nt, Mycobacterium bovis subsp bovis AF2122/97
cgcauccgcgacg

SEQ ID NO: 1077507 - RNA, 16 nt, Mycobacterium bovis subsp bovis AF2122/97
cgcauccgcgguuggc

SEQ ID NO: 1077508 - RNA, 15 nt, Mycobacterium bovis subsp bovis AF2122/97
cgcauccccagcaca

SEQ ID NO: 1077509 - RNA, 16 nt, Mycobacterium bovis subsp bovis AF2122/97
cgcauccccagcacaa

SEQ ID NO: 1077510 - RNA, 18 nt, Mycobacterium bovis subsp bovis AF2122/97
cgcauccggucucggccg

SEQ ID NO: 1077511 - RNA, 20 nt, Mycobacterium bovis subsp bovis AF2122/97
cgcauccggucucggccgag

SEQ ID NO: 1077512 - RNA, 23 nt, Mycobacterium bovis subsp bovis AF2122/97
cgcauccgguuuggucgccgcgu

SEQ ID NO: 1077513 - RNA, 16 nt, Mycobacterium bovis subsp bovis AF2122/97
cgcauccggcaagccg

SEQ ID NO: 1077514 - RNA, 13 nt, Mycobacterium bovis subsp bovis AF2122/97
cgcaucgaguccg

SEQ ID NO: 1077515 - RNA, 19 nt, Mycobacterium bovis subsp bovis AF2122/97
cgcaucgcacgggccacca

SEQ ID NO: 1077516 - RNA, 21 nt, Mycobacterium bovis subsp bovis AF2122/97
cgcaucgcacgggccaccagc

SEQ ID NO: 1077517 - RNA, 12 nt, Mycobacterium bovis subsp bovis AF2122/97
cgcaucgccaau

SEQ ID NO: 1077518 - RNA, 22 nt, Mycobacterium bovis subsp bovis AF2122/97
cgcaucgccaaugcccaggugu

SEQ ID NO: 1077519 - RNA, 13 nt, Mycobacterium bovis subsp bovis AF2122/97
cgcaucgccacca

SEQ ID NO: 1077520 - RNA, 20 nt, Mycobacterium bovis subsp bovis AF2122/97
cgcaucgccucaccacgucg

SEQ ID NO: 1077521 - RNA, 21 nt, Mycobacterium bovis subsp bovis AF2122/97
cgcaucgccucaccacgucga

SEQ ID NO: 1077522 - RNA, 18 nt, Mycobacterium bovis subsp bovis AF2122/97
cgcaucgccuccucgacg

SEQ ID NO: 1077523 - RNA, 21 nt, Mycobacterium bovis subsp bovis AF2122/97
cgcaucgccuccucgacgucg

SEQ ID NO: 1077524 - RNA, 14 nt, Mycobacterium bovis subsp bovis AF2122/97
cgcaucgccgcugg

SEQ ID NO: 1077525 - RNA, 22 nt, Mycobacterium bovis subsp bovis AF2122/97
cgcaucgccaccaucaccgccu

SEQ ID NO: 1077526 - RNA, 19 nt, Mycobacterium bovis subsp bovis AF2122/97
cgcaucggccaacaccacu

SEQ ID NO: 1077527 - RNA, 13 nt, Mycobacterium bovis subsp bovis AF2122/97
cgcaucggccagc

SEQ ID NO: 1077528 - RNA, 20 nt, Mycobacterium bovis subsp bovis AF2122/97
cgcaugcacgucaucggcug

SEQ ID NO: 1077529 - RNA, 22 nt, Mycobacterium bovis subsp bovis AF2122/97
cgcaugcacgucaucggcuggc

SEQ ID NO: 1077530 - RNA, 12 nt, Mycobacterium bovis subsp bovis AF2122/97
cgcaugccccga

SEQ ID NO: 1077531 - RNA, 14 nt, Mycobacterium bovis subsp bovis AF2122/97
cgcaugccggcgca

SEQ ID NO: 1077532 - RNA, 19 nt, Mycobacterium bovis subsp bovis AF2122/97
cgcaugccggcgcaccaca

SEQ ID NO: 1077533 - RNA, 19 nt, Mycobacterium bovis subsp bovis AF2122/97
cgcaugcgcgcgccggugc

SEQ ID NO: 1077534 - RNA, 16 nt, Mycobacterium bovis subsp bovis AF2122/97
cgcaugcgcuccggcg

SEQ ID NO: 1077535 - RNA, 18 nt, Mycobacterium bovis subsp bovis AF2122/97
cgcaugcgcuccggcgcg

SEQ ID NO: 1077536 - RNA, 17 nt, Mycobacterium bovis subsp bovis AF2122/97
cgcaugcucgaucgcgu

SEQ ID NO: 1077537 - RNA, 18 nt, Mycobacterium bovis subsp bovis AF2122/97
cgcaugcucagcaucguc

SEQ ID NO: 1077538 - RNA, 18 nt, Mycobacterium bovis subsp bovis AF2122/97
cgcaugcguaugcccacg

SEQ ID NO: 1077539 - RNA, 18 nt, Mycobacterium bovis subsp bovis AF2122/97
cgcauggacgcgaugacc

SEQ ID NO: 1077540 - RNA, 23 nt, Mycobacterium bovis subsp bovis AF2122/97
cgcauggacgcgaugaccgcacc

SEQ ID NO: 1077541 - RNA, 13 nt, Mycobacterium bovis subsp bovis AF2122/97
cgcauggacgcga

SEQ ID NO: 1077542 - RNA, 16 nt, Mycobacterium bovis subsp bovis AF2122/97
cgcaugaucgcaccga

SEQ ID NO: 1077543 - RNA, 17 nt, Mycobacterium bovis subsp bovis AF2122/97
cgcaugagggcaucgag

SEQ ID NO: 1077544 - RNA, 21 nt, Mycobacterium bovis subsp bovis AF2122/97
cgcaugcaagucaaacgccgu

SEQ ID NO: 1077545 - RNA, 22 nt, Mycobacterium bovis subsp bovis AF2122/97
cgcaucucgagcaugcccagcg

SEQ ID NO: 1077546 - RNA, 14 nt, Mycobacterium bovis subsp bovis AF2122/97
cgcaucuuugaacg

SEQ ID NO: 1077547 - RNA, 15 nt, Mycobacterium bovis subsp bovis AF2122/97
cgcaucggcggggcc

SEQ ID NO: 1077548 - RNA, 21 nt, Mycobacterium bovis subsp bovis AF2122/97
cgcaucggcggggcccacacg

SEQ ID NO: 1077549 - RNA, 12 nt, Mycobacterium bovis subsp bovis AF2122/97
cgcaucgguguc

SEQ ID NO: 1077550 - RNA, 14 nt, Mycobacterium bovis subsp bovis AF2122/97
cgcaucgucagcga

SEQ ID NO: 1077551 - RNA, 12 nt, Mycobacterium bovis subsp bovis AF2122/97
cgcagccagcgc

SEQ ID NO: 1077552 - RNA, 13 nt, Mycobacterium bovis subsp bovis AF2122/97
cgcagcccgucgg

SEQ ID NO: 1077553 - RNA, 12 nt, Mycobacterium bovis subsp bovis AF2122/97
cgcagcccguga

SEQ ID NO: 1077554 - RNA, 14 nt, Mycobacterium bovis subsp bovis AF2122/97
cgcagccccucguc

SEQ ID NO: 1077555 - RNA, 14 nt, Mycobacterium bovis subsp bovis AF2122/97
cgcagccgggcacc

SEQ ID NO: 1077556 - RNA, 20 nt, Mycobacterium bovis subsp bovis AF2122/97
cgcagccgggcaccacccuu

SEQ ID NO: 1077557 - RNA, 16 nt, Mycobacterium bovis subsp bovis AF2122/97
cgcagccgggcaccga

SEQ ID NO: 1077558 - RNA, 14 nt, Mycobacterium bovis subsp bovis AF2122/97
cgcagccugcagcg

SEQ ID NO: 1077559 - RNA, 13 nt, Mycobacterium bovis subsp bovis AF2122/97
cgcagccggugag

SEQ ID NO: 1077560 - RNA, 20 nt, Mycobacterium bovis subsp bovis AF2122/97
cgcaggaagcccacgaucgc

SEQ ID NO: 1077561 - RNA, 16 nt, Mycobacterium bovis subsp bovis AF2122/97
cgcagccugccgauga

SEQ ID NO: 1077562 - RNA, 17 nt, Mycobacterium bovis subsp bovis AF2122/97
cgcagcgaaaacccggu

SEQ ID NO: 1077563 - RNA, 20 nt, Mycobacterium bovis subsp bovis AF2122/97
cgcagcgaaaacccggucgg

SEQ ID NO: 1077564 - RNA, 22 nt, Mycobacterium bovis subsp bovis AF2122/97
cgcaggagguugggaacagccu

SEQ ID NO: 1077565 - RNA, 18 nt, Mycobacterium bovis subsp bovis AF2122/97
cgcaggagcgcgaugacc

SEQ ID NO: 1077566 - RNA, 18 nt, Mycobacterium bovis subsp bovis AF2122/97
cgcaggacgcugccggug

SEQ ID NO: 1077567 - RNA, 19 nt, Mycobacterium bovis subsp bovis AF2122/97
cgcaggaucacacuggccu

SEQ ID NO: 1077568 - RNA, 19 nt, Mycobacterium bovis subsp bovis AF2122/97
cgcaggauucccagucgcg

SEQ ID NO: 1077569 - RNA, 13 nt, Mycobacterium bovis subsp bovis AF2122/97
cgcaggaucggcg

SEQ ID NO: 1077570 - RNA, 14 nt, Mycobacterium bovis subsp bovis AF2122/97
cgcaggaucggcgg

SEQ ID NO: 1077571 - RNA, 16 nt, Mycobacterium bovis subsp bovis AF2122/97
cgcaggcacaucgcga

SEQ ID NO: 1077572 - RNA, 13 nt, Mycobacterium bovis subsp bovis AF2122/97
cgcaggcaccccg

SEQ ID NO: 1077573 - RNA, 13 nt, Mycobacterium bovis subsp bovis AF2122/97
cgcaggucggcca

SEQ ID NO: 1077574 - RNA, 15 nt, Mycobacterium bovis subsp bovis AF2122/97
cgcaggugggcguug

SEQ ID NO: 1077575 - RNA, 12 nt, Mycobacterium bovis subsp bovis AF2122/97
cgcaggugguga

SEQ ID NO: 1077576 - RNA, 23 nt, Mycobacterium bovis subsp bovis AF2122/97
cgcaggugggcguuggcgacgaa

SEQ ID NO: 1077577 - RNA, 19 nt, Mycobacterium bovis subsp bovis AF2122/97
cgcaggugcugggcgaggu

SEQ ID NO: 1077578 - RNA, 23 nt, Mycobacterium bovis subsp bovis AF2122/97
cgcagggaucaccccggccggcu

SEQ ID NO: 1077579 - RNA, 14 nt, Mycobacterium bovis subsp bovis AF2122/97
cgcagggaucgcag

SEQ ID NO: 1077580 - RNA, 17 nt, Mycobacterium bovis subsp bovis AF2122/97
cgcagggaucgcaggga

SEQ ID NO: 1077581 - RNA, 13 nt, Mycobacterium bovis subsp bovis AF2122/97
cgcaggcuugccg

SEQ ID NO: 1077582 - RNA, 14 nt, Mycobacterium bovis subsp bovis AF2122/97
cgcaggcuugccga

SEQ ID NO: 1077583 - RNA, 20 nt, Mycobacterium bovis subsp bovis AF2122/97
cgcaggccaugggaaccgac

SEQ ID NO: 1077584 - RNA, 16 nt, Mycobacterium bovis subsp bovis AF2122/97
cgcaguucaucgggca

SEQ ID NO: 1077585 - RNA, 23 nt, Mycobacterium bovis subsp bovis AF2122/97
cgcagugggcaauccggucagcg

SEQ ID NO: 1077586 - RNA, 19 nt, Mycobacterium bovis subsp bovis AF2122/97
cgcaguucggucagcgccu

SEQ ID NO: 1077587 - RNA, 19 nt, Mycobacterium bovis subsp bovis AF2122/97
cgcaguucggucgucucgg

SEQ ID NO: 1077588 - RNA, 20 nt, Mycobacterium bovis subsp bovis AF2122/97
cgcaguggagggcccggccg

SEQ ID NO: 1077589 - RNA, 17 nt, Mycobacterium bovis subsp bovis AF2122/97
cgcagugcaccgcgucg

SEQ ID NO: 1077590 - RNA, 20 nt, Mycobacterium bovis subsp bovis AF2122/97
cgcagugcaccgcgucguag

SEQ ID NO: 1077591 - RNA, 14 nt, Mycobacterium bovis subsp bovis AF2122/97
cgcagugcaccgcg

SEQ ID NO: 1077592 - RNA, 14 nt, Mycobacterium bovis subsp bovis AF2122/97
cgcagugagcagcc

SEQ ID NO: 1077593 - RNA, 15 nt, Mycobacterium bovis subsp bovis AF2122/97
cgcagugagcagccg

SEQ ID NO: 1077594 - RNA, 20 nt, Mycobacterium bovis subsp bovis AF2122/97
cgcagugagcagccggaccg

SEQ ID NO: 1077595 - RNA, 22 nt, Mycobacterium bovis subsp bovis AF2122/97
cgcagugacguuccgcucgccg

SEQ ID NO: 1077596 - RNA, 23 nt, Mycobacterium bovis subsp bovis AF2122/97
cgcagugacguuuguuggcuguc

SEQ ID NO: 1077597 - RNA, 20 nt, Mycobacterium bovis subsp bovis AF2122/97
cgcaguagccgaccaggacc

SEQ ID NO: 1077598 - RNA, 12 nt, Mycobacterium bovis subsp bovis AF2122/97
cgcagucgauga

SEQ ID NO: 1077599 - RNA, 22 nt, Mycobacterium bovis subsp bovis AF2122/97
cgcagucgaugagugacggucc

SEQ ID NO: 1077600 - RNA, 14 nt, Mycobacterium bovis subsp bovis AF2122/97
cgcagucccagcac

SEQ ID NO: 1077601 - RNA, 14 nt, Mycobacterium bovis subsp bovis AF2122/97
cgcagucgcugggu

SEQ ID NO: 1077602 - RNA, 17 nt, Mycobacterium bovis subsp bovis AF2122/97
cgcagucgcuggguggc

SEQ ID NO: 1077603 - RNA, 23 nt, Mycobacterium bovis subsp bovis AF2122/97
cgcagucuuguugcuuugcuggc

SEQ ID NO: 1077604 - RNA, 17 nt, Mycobacterium bovis subsp bovis AF2122/97
cgcagucggucacgcgg

SEQ ID NO: 1077605 - RNA, 21 nt, Mycobacterium bovis subsp bovis AF2122/97
cgcaguauucacagucgcucg

SEQ ID NO: 1077606 - RNA, 20 nt, Mycobacterium bovis subsp bovis AF2122/97
cgcagguuggauacggugcg

SEQ ID NO: 1077607 - RNA, 17 nt, Mycobacterium bovis subsp bovis AF2122/97
cgcauaggccccgccag

SEQ ID NO: 1077608 - RNA, 18 nt, Mycobacterium bovis subsp bovis AF2122/97
cgcauagggccaccgccg

SEQ ID NO: 1077609 - RNA, 21 nt, Mycobacterium bovis subsp bovis AF2122/97
cgcauagggccaccgccgccu

SEQ ID NO: 1077610 - RNA, 21 nt, Mycobacterium bovis subsp bovis AF2122/97
cgcauaccuuccagaucgcgg

SEQ ID NO: 1077611 - RNA, 21 nt, Mycobacterium bovis subsp bovis AF2122/97
cgcauacgcggcuuugacgcc

SEQ ID NO: 1077612 - RNA, 22 nt, Mycobacterium bovis subsp bovis AF2122/97
cgcauacgcggcuuugacgccc

SEQ ID NO: 1077613 - RNA, 14 nt, Mycobacterium bovis subsp bovis AF2122/97
cgcauaacgccagu

SEQ ID NO: 1077614 - RNA, 21 nt, Mycobacterium bovis subsp bovis AF2122/97
cgcaguuuggcggcgcgcagc

SEQ ID NO: 1077615 - RNA, 12 nt, Mycobacterium bovis subsp bovis AF2122/97
cgcauaagcccc

SEQ ID NO: 1077616 - RNA, 19 nt, Mycobacterium bovis subsp bovis AF2122/97
cgcauaagcccccgacacg

SEQ ID NO: 1077617 - RNA, 18 nt, Mycobacterium bovis subsp bovis AF2122/97
cgcauaagcccccgcacg

SEQ ID NO: 1077618 - RNA, 16 nt, Mycobacterium bovis subsp bovis AF2122/97
cgcaucaggucggugg

SEQ ID NO: 1077619 - RNA, 23 nt, Mycobacterium bovis subsp bovis AF2122/97
cgcaucagcuuuugcaccggacc

SEQ ID NO: 1077620 - RNA, 17 nt, Mycobacterium bovis subsp bovis AF2122/97
cgcaucaucgcccaccg

SEQ ID NO: 1077621 - RNA, 15 nt, Mycobacterium bovis subsp bovis AF2122/97
cgcauccagccgugc

SEQ ID NO: 1077622 - RNA, 19 nt, Mycobacterium bovis subsp bovis AF2122/97
cgcauccagccgugcggcg

SEQ ID NO: 1077623 - RNA, 19 nt, Mycobacterium bovis subsp bovis AF2122/97
cgcaucaccacccgaccgc

SEQ ID NO: 1077624 - RNA, 14 nt, Mycobacterium bovis subsp bovis AF2122/97
cgcaucagcgguac

SEQ ID NO: 1077625 - RNA, 22 nt, Mycobacterium bovis subsp bovis AF2122/97
cgcaucacccgggaugaccacc

SEQ ID NO: 1077626 - RNA, 23 nt, Mycobacterium bovis subsp bovis AF2122/97
cgcaucacccgggaugaccaccg

SEQ ID NO: 1077627 - RNA, 14 nt, Mycobacterium bovis subsp bovis AF2122/97
cgccgagguggaca

SEQ ID NO: 1077628 - RNA, 18 nt, Mycobacterium bovis subsp bovis AF2122/97
cgccgaggucgguucggc

SEQ ID NO: 1077629 - RNA, 22 nt, Mycobacterium bovis subsp bovis AF2122/97
cgccgaggcauugcuguguugc

SEQ ID NO: 1077630 - RNA, 20 nt, Mycobacterium bovis subsp bovis AF2122/97
cgccgaggucgguucggccg

SEQ ID NO: 1077631 - RNA, 22 nt, Mycobacterium bovis subsp bovis AF2122/97
cgccgaggucgguucggccgga

SEQ ID NO: 1077632 - RNA, 14 nt, Mycobacterium bovis subsp bovis AF2122/97
cgccgaggucuccg

SEQ ID NO: 1077633 - RNA, 17 nt, Mycobacterium bovis subsp bovis AF2122/97
cgccgaggucuccggug

SEQ ID NO: 1077634 - RNA, 18 nt, Mycobacterium bovis subsp bovis AF2122/97
cgccgaggucuccggugc

SEQ ID NO: 1077635 - RNA, 19 nt, Mycobacterium bovis subsp bovis AF2122/97
cgccgaguaccggccagcc

SEQ ID NO: 1077636 - RNA, 21 nt, Mycobacterium bovis subsp bovis AF2122/97
cgccgaguaccggccagccgc

SEQ ID NO: 1077637 - RNA, 19 nt, Mycobacterium bovis subsp bovis AF2122/97
cgccgaguauuggucggug

SEQ ID NO: 1077638 - RNA, 20 nt, Mycobacterium bovis subsp bovis AF2122/97
cgccgaguauuggucggugg

SEQ ID NO: 1077639 - RNA, 14 nt, Mycobacterium bovis subsp bovis AF2122/97
cgccgauccggugg

SEQ ID NO: 1077640 - RNA, 21 nt, Mycobacterium bovis subsp bovis AF2122/97
cgccgauccgguggcuggccg

SEQ ID NO: 1077641 - RNA, 13 nt, Mycobacterium bovis subsp bovis AF2122/97
cgccgaugccacc

SEQ ID NO: 1077642 - RNA, 17 nt, Mycobacterium bovis subsp bovis AF2122/97
cgccgaugccaccgcuu

SEQ ID NO: 1077643 - RNA, 16 nt, Mycobacterium bovis subsp bovis AF2122/97
cgccgaugacggugua

SEQ ID NO: 1077644 - RNA, 18 nt, Mycobacterium bovis subsp bovis AF2122/97
cgccgaugaugcggcgca

SEQ ID NO: 1077645 - RNA, 20 nt, Mycobacterium bovis subsp bovis AF2122/97
cgccgaugaugcggcgcagc

SEQ ID NO: 1077646 - RNA, 21 nt, Mycobacterium bovis subsp bovis AF2122/97
cgccgaugaugcggcgcagcg

SEQ ID NO: 1077647 - RNA, 21 nt, Mycobacterium bovis subsp bovis AF2122/97
cgccgaugauggacaccagcc

SEQ ID NO: 1077648 - RNA, 16 nt, Mycobacterium bovis subsp bovis AF2122/97
cgccgaugaugcggcg

SEQ ID NO: 1077649 - RNA, 11 nt, Mycobacterium bovis subsp bovis AF2122/97
cgccgaugccg

SEQ ID NO: 1077650 - RNA, 13 nt, Mycobacterium bovis subsp bovis AF2122/97
cgccgaugccgcc

SEQ ID NO: 1077651 - RNA, 18 nt, Mycobacterium bovis subsp bovis AF2122/97
cgccgaugccgccggccc

SEQ ID NO: 1077652 - RNA, 18 nt, Mycobacterium bovis subsp bovis AF2122/97
cgccgaucuucgcgcgcu

SEQ ID NO: 1077653 - RNA, 20 nt, Mycobacterium bovis subsp bovis AF2122/97
cgccgaucgaaccgcugcuc

SEQ ID NO: 1077654 - RNA, 24 nt, Mycobacterium bovis subsp bovis AF2122/97
cgccgaucggcaccgugucgacgg

SEQ ID NO: 1077655 - RNA, 15 nt, Mycobacterium bovis subsp bovis AF2122/97
cgccgaugacggugu

SEQ ID NO: 1077656 - RNA, 21 nt, Mycobacterium bovis subsp bovis AF2122/97
cgccgaucgggcuucggccag

SEQ ID NO: 1077657 - RNA, 18 nt, Mycobacterium bovis subsp bovis AF2122/97
cgccgaugaacguggcga

SEQ ID NO: 1077658 - RNA, 18 nt, Mycobacterium bovis subsp bovis AF2122/97
cgccgaucggcaccgugu

SEQ ID NO: 1077659 - RNA, 19 nt, Mycobacterium bovis subsp bovis AF2122/97
cgccgaucggcaccguguc

SEQ ID NO: 1077660 - RNA, 14 nt, Mycobacterium bovis subsp bovis AF2122/97
cgccgacggccagc

SEQ ID NO: 1077661 - RNA, 16 nt, Mycobacterium bovis subsp bovis AF2122/97
cgccgacggcgccccg

SEQ ID NO: 1077662 - RNA, 15 nt, Mycobacterium bovis subsp bovis AF2122/97
cgccgacggcgacca

SEQ ID NO: 1077663 - RNA, 18 nt, Mycobacterium bovis subsp bovis AF2122/97
cgccgacggcgaccaccg

SEQ ID NO: 1077664 - RNA, 18 nt, Mycobacterium bovis subsp bovis AF2122/97
cgccgagcaggucggcaa

SEQ ID NO: 1077665 - RNA, 17 nt, Mycobacterium bovis subsp bovis AF2122/97
cgccgagcccgggccgu

SEQ ID NO: 1077666 - RNA, 14 nt, Mycobacterium bovis subsp bovis AF2122/97
cgccgacuacgaag

SEQ ID NO: 1077667 - RNA, 20 nt, Mycobacterium bovis subsp bovis AF2122/97
cgccgacguauagaccaggu

SEQ ID NO: 1077668 - RNA, 14 nt, Mycobacterium bovis subsp bovis AF2122/97
cgccgacgucgacg

SEQ ID NO: 1077669 - RNA, 24 nt, Mycobacterium bovis subsp bovis AF2122/97
cgccgacgucgacgccggccagcg

SEQ ID NO: 1077670 - RNA, 14 nt, Mycobacterium bovis subsp bovis AF2122/97
cgccgagcggacca

SEQ ID NO: 1077671 - RNA, 17 nt, Mycobacterium bovis subsp bovis AF2122/97
cgccgagcggaccaccg

SEQ ID NO: 1077672 - RNA, 16 nt, Mycobacterium bovis subsp bovis AF2122/97
cgccgagcgcgccgaa

SEQ ID NO: 1077673 - RNA, 23 nt, Mycobacterium bovis subsp bovis AF2122/97
cgccgagcgcgccgaaggccgcc

SEQ ID NO: 1077674 - RNA, 19 nt, Mycobacterium bovis subsp bovis AF2122/97
cgccgagcggaccaccgcu

SEQ ID NO: 1077675 - RNA, 22 nt, Mycobacterium bovis subsp bovis AF2122/97
cgccgagcggaccaccgcucgc

SEQ ID NO: 1077676 - RNA, 20 nt, Mycobacterium bovis subsp bovis AF2122/97
cgccgagcgccaguucgcgg

SEQ ID NO: 1077677 - RNA, 16 nt, Mycobacterium bovis subsp bovis AF2122/97
cgccgagcggugccgg

SEQ ID NO: 1077678 - RNA, 14 nt, Mycobacterium bovis subsp bovis AF2122/97
cgccgagcuagauc

SEQ ID NO: 1077679 - RNA, 21 nt, Mycobacterium bovis subsp bovis AF2122/97
cgccgagcgugaaccuggcga

SEQ ID NO: 1077680 - RNA, 20 nt, Mycobacterium bovis subsp bovis AF2122/97
cgccgagcgugaagucacgg

SEQ ID NO: 1077681 - RNA, 24 nt, Mycobacterium bovis subsp bovis AF2122/97
cgccgagcggaccaccgcucgcca

SEQ ID NO: 1077682 - RNA, 17 nt, Mycobacterium bovis subsp bovis AF2122/97
cgccgaggacgccggcg

SEQ ID NO: 1077683 - RNA, 22 nt, Mycobacterium bovis subsp bovis AF2122/97
cgccgaggacgccggcgccgcc

SEQ ID NO: 1077684 - RNA, 14 nt, Mycobacterium bovis subsp bovis AF2122/97
cgccgagcucgguc

SEQ ID NO: 1077685 - RNA, 18 nt, Mycobacterium bovis subsp bovis AF2122/97
cgccgagcucggucacca

SEQ ID NO: 1077686 - RNA, 21 nt, Mycobacterium bovis subsp bovis AF2122/97
cgccgagcucggucaccacgg

SEQ ID NO: 1077687 - RNA, 23 nt, Mycobacterium bovis subsp bovis AF2122/97
cgccgagcucggucaccacggcg

SEQ ID NO: 1077688 - RNA, 22 nt, Mycobacterium bovis subsp bovis AF2122/97
cgccgaggaaaccaccaguggc

SEQ ID NO: 1077689 - RNA, 21 nt, Mycobacterium bovis subsp bovis AF2122/97
cgccgagcugguugacggcga

SEQ ID NO: 1077690 - RNA, 15 nt, Mycobacterium bovis subsp bovis AF2122/97
cgccgagcugugcgc

SEQ ID NO: 1077691 - RNA, 15 nt, Mycobacterium bovis subsp bovis AF2122/97
cgccgagcuggcaac

SEQ ID NO: 1077692 - RNA, 21 nt, Mycobacterium bovis subsp bovis AF2122/97
cgccgagcuggcaacgccgcg

SEQ ID NO: 1077693 - RNA, 15 nt, Mycobacterium bovis subsp bovis AF2122/97
cgccgagcuggcgcg

SEQ ID NO: 1077694 - RNA, 11 nt, Mycobacterium bovis subsp bovis AF2122/97
cgccgaaguag

SEQ ID NO: 1077695 - RNA, 18 nt, Mycobacterium bovis subsp bovis AF2122/97
cgccgaaguagacggugg

SEQ ID NO: 1077696 - RNA, 17 nt, Mycobacterium bovis subsp bovis AF2122/97
cgccgaaguagccgacc

SEQ ID NO: 1077697 - RNA, 20 nt, Mycobacterium bovis subsp bovis AF2122/97
cgccgaauccgacgucgacg

SEQ ID NO: 1077698 - RNA, 21 nt, Mycobacterium bovis subsp bovis AF2122/97
cgccgaauccgacgucgacga

SEQ ID NO: 1077699 - RNA, 21 nt, Mycobacterium bovis subsp bovis AF2122/97
cgccgaaguuccagccgacgg

SEQ ID NO: 1077700 - RNA, 23 nt, Mycobacterium bovis subsp bovis AF2122/97
cgccgaaucgcgggcugaccaac

SEQ ID NO: 1077701 - RNA, 13 nt, Mycobacterium bovis subsp bovis AF2122/97
cgccgaaucggca

SEQ ID NO: 1077702 - RNA, 14 nt, Mycobacterium bovis subsp bovis AF2122/97
cgccgaaucggcag

SEQ ID NO: 1077703 - RNA, 16 nt, Mycobacterium bovis subsp bovis AF2122/97
cgccgaaucggcaguu

SEQ ID NO: 1077704 - RNA, 14 nt, Mycobacterium bovis subsp bovis AF2122/97
cgccgacaccggcu

SEQ ID NO: 1077705 - RNA, 18 nt, Mycobacterium bovis subsp bovis AF2122/97
cgccgacacccucgggca

SEQ ID NO: 1077706 - RNA, 19 nt, Mycobacterium bovis subsp bovis AF2122/97
cgccgacaccaccggcgcc

SEQ ID NO: 1077707 - RNA, 20 nt, Mycobacterium bovis subsp bovis AF2122/97
cgccgacaccaccggcgccg

SEQ ID NO: 1077708 - RNA, 22 nt, Mycobacterium bovis subsp bovis AF2122/97
cgccgacaccaccggcgccgcc

SEQ ID NO: 1077709 - RNA, 14 nt, Mycobacterium bovis subsp bovis AF2122/97
cgccgacaaccccg

SEQ ID NO: 1077710 - RNA, 17 nt, Mycobacterium bovis subsp bovis AF2122/97
cgccgacaaccccgcca

SEQ ID NO: 1077711 - RNA, 15 nt, Mycobacterium bovis subsp bovis AF2122/97
cgccgaauggcggug

SEQ ID NO: 1077712 - RNA, 17 nt, Mycobacterium bovis subsp bovis AF2122/97
cgccgaaugccaccucg

SEQ ID NO: 1077713 - RNA, 20 nt, Mycobacterium bovis subsp bovis AF2122/97
cgccgaaugccaccucgacg

SEQ ID NO: 1077714 - RNA, 17 nt, Mycobacterium bovis subsp bovis AF2122/97
cgccgaaucggcaguug

SEQ ID NO: 1077715 - RNA, 20 nt, Mycobacterium bovis subsp bovis AF2122/97
cgccgaaucucaccgucaac

SEQ ID NO: 1077716 - RNA, 14 nt, Mycobacterium bovis subsp bovis AF2122/97
cgccgaaugccacc

SEQ ID NO: 1077717 - RNA, 20 nt, Mycobacterium bovis subsp bovis AF2122/97
cgccgacaaaagccagggcc

SEQ ID NO: 1077718 - RNA, 21 nt, Mycobacterium bovis subsp bovis AF2122/97
cgccgacaaaagccagggccg

SEQ ID NO: 1077719 - RNA, 19 nt, Mycobacterium bovis subsp bovis AF2122/97
cgccgacaccggcugaccg

SEQ ID NO: 1077720 - RNA, 21 nt, Mycobacterium bovis subsp bovis AF2122/97
cgccgacaccggcugaccgac

SEQ ID NO: 1077721 - RNA, 23 nt, Mycobacterium bovis subsp bovis AF2122/97
cgccgacagccgauccgaucgca

SEQ ID NO: 1077722 - RNA, 20 nt, Mycobacterium bovis subsp bovis AF2122/97
cgccgacaggccggccacca

SEQ ID NO: 1077723 - RNA, 16 nt, Mycobacterium bovis subsp bovis AF2122/97
cgccgacauggcggug

SEQ ID NO: 1077724 - RNA, 16 nt, Mycobacterium bovis subsp bovis AF2122/97
cgccgaccacccggau

SEQ ID NO: 1077725 - RNA, 14 nt, Mycobacterium bovis subsp bovis AF2122/97
cgccgaccaccgcu

SEQ ID NO: 1077726 - RNA, 18 nt, Mycobacterium bovis subsp bovis AF2122/97
cgccgaccagcuugaccg

SEQ ID NO: 1077727 - RNA, 22 nt, Mycobacterium bovis subsp bovis AF2122/97
cgccgaccagcuugaccgacca

SEQ ID NO: 1077728 - RNA, 21 nt, Mycobacterium bovis subsp bovis AF2122/97
cgccgaccuugauuccugccc

SEQ ID NO: 1077729 - RNA, 12 nt, Mycobacterium bovis subsp bovis AF2122/97
cgccgaccugga

SEQ ID NO: 1077730 - RNA, 15 nt, Mycobacterium bovis subsp bovis AF2122/97
cgccgaccuggacaa

SEQ ID NO: 1077731 - RNA, 19 nt, Mycobacterium bovis subsp bovis AF2122/97
cgccgacgaaggcgacggu

SEQ ID NO: 1077732 - RNA, 14 nt, Mycobacterium bovis subsp bovis AF2122/97
cgccgacgaaaucg

SEQ ID NO: 1077733 - RNA, 19 nt, Mycobacterium bovis subsp bovis AF2122/97
cgccgacgacuccggcaag

SEQ ID NO: 1077734 - RNA, 18 nt, Mycobacterium bovis subsp bovis AF2122/97
cgccgacgauuaccagcg

SEQ ID NO: 1077735 - RNA, 22 nt, Mycobacterium bovis subsp bovis AF2122/97
cgccgacgacuccggcaagcac

SEQ ID NO: 1077736 - RNA, 15 nt, Mycobacterium bovis subsp bovis AF2122/97
cgccgacgccgauac

SEQ ID NO: 1077737 - RNA, 16 nt, Mycobacterium bovis subsp bovis AF2122/97
cgccgacgccgccggc

SEQ ID NO: 1077738 - RNA, 17 nt, Mycobacterium bovis subsp bovis AF2122/97
cgccgacgccgccggca

SEQ ID NO: 1077739 - RNA, 18 nt, Mycobacterium bovis subsp bovis AF2122/97
cgccgacgccgccggcac

SEQ ID NO: 1077740 - RNA, 17 nt, Mycobacterium bovis subsp bovis AF2122/97
cgccgacgccagaacgu

SEQ ID NO: 1077741 - RNA, 21 nt, Mycobacterium bovis subsp bovis AF2122/97
cgccgacgccagauccuucaa

SEQ ID NO: 1077742 - RNA, 14 nt, Mycobacterium bovis subsp bovis AF2122/97
cgccgacggcaagg

SEQ ID NO: 1077743 - RNA, 21 nt, Mycobacterium bovis subsp bovis AF2122/97
cgccgacgccgccggccccgc

SEQ ID NO: 1077744 - RNA, 16 nt, Mycobacterium bovis subsp bovis AF2122/97
cgccgaccgcgccgca

SEQ ID NO: 1077745 - RNA, 22 nt, Mycobacterium bovis subsp bovis AF2122/97
cgccgaccggcccgcauccgca

SEQ ID NO: 1077746 - RNA, 23 nt, Mycobacterium bovis subsp bovis AF2122/97
cgccgaccggcccgcauccgcac

SEQ ID NO: 1077747 - RNA, 15 nt, Mycobacterium bovis subsp bovis AF2122/97
cgccgaccgguggca

SEQ ID NO: 1077748 - RNA, 17 nt, Mycobacterium bovis subsp bovis AF2122/97
cgccgaccgguggcacc

SEQ ID NO: 1077749 - RNA, 17 nt, Mycobacterium bovis subsp bovis AF2122/97
cgccgaccuagucaccu

SEQ ID NO: 1077750 - RNA, 15 nt, Mycobacterium bovis subsp bovis AF2122/97
cgccgaccucaucgg

SEQ ID NO: 1077751 - RNA, 18 nt, Mycobacterium bovis subsp bovis AF2122/97
cgccgacccguaccagcc

SEQ ID NO: 1077752 - RNA, 18 nt, Mycobacterium bovis subsp bovis AF2122/97
cgccgacccgcgcgccgg

SEQ ID NO: 1077753 - RNA, 20 nt, Mycobacterium bovis subsp bovis AF2122/97
cgccgacccgcgcgccggcg

SEQ ID NO: 1077754 - RNA, 12 nt, Mycobacterium bovis subsp bovis AF2122/97
cgccgaccgaca

SEQ ID NO: 1077755 - RNA, 20 nt, Mycobacterium bovis subsp bovis AF2122/97
cgccgaccgacaccaccagg

SEQ ID NO: 1077756 - RNA, 23 nt, Mycobacterium bovis subsp bovis AF2122/97
cgccgacccuagauaugcacccg

SEQ ID NO: 1077757 - RNA, 15 nt, Mycobacterium bovis subsp bovis AF2122/97
cgccgaccgacgucg

SEQ ID NO: 1077758 - RNA, 19 nt, Mycobacterium bovis subsp bovis AF2122/97
cgccgaccaucucaccggg

SEQ ID NO: 1077759 - RNA, 22 nt, Mycobacterium bovis subsp bovis AF2122/97
cgcccguagacccacagucgcc

SEQ ID NO: 1077760 - RNA, 18 nt, Mycobacterium bovis subsp bovis AF2122/97
cgcccggucgagccagcg

SEQ ID NO: 1077761 - RNA, 15 nt, Mycobacterium bovis subsp bovis AF2122/97
cgcccguauugaugc

SEQ ID NO: 1077762 - RNA, 17 nt, Mycobacterium bovis subsp bovis AF2122/97
cgcccguaucggcuucg

SEQ ID NO: 1077763 - RNA, 20 nt, Mycobacterium bovis subsp bovis AF2122/97
cgcccgguucagcgcuggca

SEQ ID NO: 1077764 - RNA, 17 nt, Mycobacterium bovis subsp bovis AF2122/97
cgcccggucgagccagc

SEQ ID NO: 1077765 - RNA, 13 nt, Mycobacterium bovis subsp bovis AF2122/97
cgcccgguccgcc

SEQ ID NO: 1077766 - RNA, 16 nt, Mycobacterium bovis subsp bovis AF2122/97
cgcccggucucgacgg

SEQ ID NO: 1077767 - RNA, 23 nt, Mycobacterium bovis subsp bovis AF2122/97
cgcccggucucgacggcggccgc

SEQ ID NO: 1077768 - RNA, 21 nt, Mycobacterium bovis subsp bovis AF2122/97
cgcccggugcgucgugguggc

SEQ ID NO: 1077769 - RNA, 17 nt, Mycobacterium bovis subsp bovis AF2122/97
cgcccgguguguucggc

SEQ ID NO: 1077770 - RNA, 21 nt, Mycobacterium bovis subsp bovis AF2122/97
cgcccgucgcugggaggcgcg

SEQ ID NO: 1077771 - RNA, 16 nt, Mycobacterium bovis subsp bovis AF2122/97
cgcccgucuccagcac

SEQ ID NO: 1077772 - RNA, 20 nt, Mycobacterium bovis subsp bovis AF2122/97
cgcccgucguagguggccgg

SEQ ID NO: 1077773 - RNA, 20 nt, Mycobacterium bovis subsp bovis AF2122/97
cgcccgucuuccagccaggc

SEQ ID NO: 1077774 - RNA, 19 nt, Mycobacterium bovis subsp bovis AF2122/97
cgcccuagcuggugcgccc

SEQ ID NO: 1077775 - RNA, 14 nt, Mycobacterium bovis subsp bovis AF2122/97
cgcccucaccgccu

SEQ ID NO: 1077776 - RNA, 21 nt, Mycobacterium bovis subsp bovis AF2122/97
cgcccucacgccaaguccgcu

SEQ ID NO: 1077777 - RNA, 21 nt, Mycobacterium bovis subsp bovis AF2122/97
cgcccucaguucacguucggc

SEQ ID NO: 1077778 - RNA, 16 nt, Mycobacterium bovis subsp bovis AF2122/97
cgcccucagccgcggc

SEQ ID NO: 1077779 - RNA, 18 nt, Mycobacterium bovis subsp bovis AF2122/97
cgcccucagccgcggcca

SEQ ID NO: 1077780 - RNA, 18 nt, Mycobacterium bovis subsp bovis AF2122/97
cgcccucauaggccugca

SEQ ID NO: 1077781 - RNA, 22 nt, Mycobacterium bovis subsp bovis AF2122/97
cgcccucauaggccugcagccg

SEQ ID NO: 1077782 - RNA, 23 nt, Mycobacterium bovis subsp bovis AF2122/97
cgcccuagcuggugcgcccgacg

SEQ ID NO: 1077783 - RNA, 16 nt, Mycobacterium bovis subsp bovis AF2122/97
cgcccguguugaagaa

SEQ ID NO: 1077784 - RNA, 15 nt, Mycobacterium bovis subsp bovis AF2122/97
cgcccgugagcgccg

SEQ ID NO: 1077785 - RNA, 23 nt, Mycobacterium bovis subsp bovis AF2122/97
cgcccgugcggcucgccggcggc

SEQ ID NO: 1077786 - RNA, 13 nt, Mycobacterium bovis subsp bovis AF2122/97
cgcccgugccgcc

SEQ ID NO: 1077787 - RNA, 14 nt, Mycobacterium bovis subsp bovis AF2122/97
cgcccgugccgccc

SEQ ID NO: 1077788 - RNA, 19 nt, Mycobacterium bovis subsp bovis AF2122/97
cgcccgugccgcccgcgcc

SEQ ID NO: 1077789 - RNA, 20 nt, Mycobacterium bovis subsp bovis AF2122/97
cgcccgugccgcccgcgccg

SEQ ID NO: 1077790 - RNA, 23 nt, Mycobacterium bovis subsp bovis AF2122/97
cgcccgugccgcccgcgccgccc

SEQ ID NO: 1077791 - RNA, 18 nt, Mycobacterium bovis subsp bovis AF2122/97
cgcccuccuuggcguugc

SEQ ID NO: 1077792 - RNA, 17 nt, Mycobacterium bovis subsp bovis AF2122/97
cgcccuccuggcgggug

SEQ ID NO: 1077793 - RNA, 18 nt, Mycobacterium bovis subsp bovis AF2122/97
cgcccucgaucgccacga

SEQ ID NO: 1077794 - RNA, 16 nt, Mycobacterium bovis subsp bovis AF2122/97
cgcccucgaucgccac

SEQ ID NO: 1077795 - RNA, 16 nt, Mycobacterium bovis subsp bovis AF2122/97
cgcccucgacgccgcg

SEQ ID NO: 1077796 - RNA, 17 nt, Mycobacterium bovis subsp bovis AF2122/97
cgcccucgacgccgcgc

SEQ ID NO: 1077797 - RNA, 18 nt, Mycobacterium bovis subsp bovis AF2122/97
cgcccucgacgccgcgca

SEQ ID NO: 1077798 - RNA, 16 nt, Mycobacterium bovis subsp bovis AF2122/97
cgcccucgucgaucgc

SEQ ID NO: 1077799 - RNA, 23 nt, Mycobacterium bovis subsp bovis AF2122/97
cgcccugacacccaucgaccgcc

SEQ ID NO: 1077800 - RNA, 20 nt, Mycobacterium bovis subsp bovis AF2122/97
cgcccugaagggccgccucg

SEQ ID NO: 1077801 - RNA, 20 nt, Mycobacterium bovis subsp bovis AF2122/97
cgcccugacacaacaccggc

SEQ ID NO: 1077802 - RNA, 12 nt, Mycobacterium bovis subsp bovis AF2122/97
cgcccugcggau

SEQ ID NO: 1077803 - RNA, 20 nt, Mycobacterium bovis subsp bovis AF2122/97
cgcccugcgccacacccggc

SEQ ID NO: 1077804 - RNA, 21 nt, Mycobacterium bovis subsp bovis AF2122/97
cgcccucgucgaucgccgcga

SEQ ID NO: 1077805 - RNA, 20 nt, Mycobacterium bovis subsp bovis AF2122/97
cgcccugacgguggugaccg

SEQ ID NO: 1077806 - RNA, 18 nt, Mycobacterium bovis subsp bovis AF2122/97
cgcccugcagacgggugg

SEQ ID NO: 1077807 - RNA, 20 nt, Mycobacterium bovis subsp bovis AF2122/97
cgcccugagaacacguucgg

SEQ ID NO: 1077808 - RNA, 13 nt, Mycobacterium bovis subsp bovis AF2122/97
cgcccuugccgcc

SEQ ID NO: 1077809 - RNA, 17 nt, Mycobacterium bovis subsp bovis AF2122/97
cgcccuugccgccgagg

SEQ ID NO: 1077810 - RNA, 18 nt, Mycobacterium bovis subsp bovis AF2122/97
cgcccuugccgccggccc

SEQ ID NO: 1077811 - RNA, 20 nt, Mycobacterium bovis subsp bovis AF2122/97
cgcccuugccgccggccccg

SEQ ID NO: 1077812 - RNA, 21 nt, Mycobacterium bovis subsp bovis AF2122/97
cgcccuugccgccggccccgc

SEQ ID NO: 1077813 - RNA, 16 nt, Mycobacterium bovis subsp bovis AF2122/97
cgcccuugccgccagc

SEQ ID NO: 1077814 - RNA, 19 nt, Mycobacterium bovis subsp bovis AF2122/97
cgccgaaaaccucgaaacc

SEQ ID NO: 1077815 - RNA, 17 nt, Mycobacterium bovis subsp bovis AF2122/97
cgccgaaaaugccgccc

SEQ ID NO: 1077816 - RNA, 18 nt, Mycobacterium bovis subsp bovis AF2122/97
cgccgaaaaugccgccca

SEQ ID NO: 1077817 - RNA, 19 nt, Mycobacterium bovis subsp bovis AF2122/97
cgccgaaaaugccgcccag

SEQ ID NO: 1077818 - RNA, 19 nt, Mycobacterium bovis subsp bovis AF2122/97
cgcccuucagcacggugau

SEQ ID NO: 1077819 - RNA, 17 nt, Mycobacterium bovis subsp bovis AF2122/97
cgcccuuaagccggcgc

SEQ ID NO: 1077820 - RNA, 16 nt, Mycobacterium bovis subsp bovis AF2122/97
cgcccuugagccgccg

SEQ ID NO: 1077821 - RNA, 18 nt, Mycobacterium bovis subsp bovis AF2122/97
cgcccuuagggucgccgc

SEQ ID NO: 1077822 - RNA, 17 nt, Mycobacterium bovis subsp bovis AF2122/97
cgcccuggccgccggcc

SEQ ID NO: 1077823 - RNA, 20 nt, Mycobacterium bovis subsp bovis AF2122/97
cgcccuggccgccggccccg

SEQ ID NO: 1077824 - RNA, 15 nt, Mycobacterium bovis subsp bovis AF2122/97
cgcccuggacgucgg

SEQ ID NO: 1077825 - RNA, 16 nt, Mycobacterium bovis subsp bovis AF2122/97
cgcccuggccgcccug

SEQ ID NO: 1077826 - RNA, 16 nt, Mycobacterium bovis subsp bovis AF2122/97
cgcccugguccaggcc

SEQ ID NO: 1077827 - RNA, 13 nt, Mycobacterium bovis subsp bovis AF2122/97
cgcccuguucggc

SEQ ID NO: 1077828 - RNA, 23 nt, Mycobacterium bovis subsp bovis AF2122/97
cgcccuggugucgaucguugccg

SEQ ID NO: 1077829 - RNA, 15 nt, Mycobacterium bovis subsp bovis AF2122/97
cgcccugggcgccgg

SEQ ID NO: 1077830 - RNA, 17 nt, Mycobacterium bovis subsp bovis AF2122/97
cgcccugggcgccggcg

SEQ ID NO: 1077831 - RNA, 23 nt, Mycobacterium bovis subsp bovis AF2122/97
cgcccugggcgccggcguccgga

SEQ ID NO: 1077832 - RNA, 18 nt, Mycobacterium bovis subsp bovis AF2122/97
cgccgaagcgggcccgca

SEQ ID NO: 1077833 - RNA, 22 nt, Mycobacterium bovis subsp bovis AF2122/97
cgccgaagcgggcccgcagguc

SEQ ID NO: 1077834 - RNA, 21 nt, Mycobacterium bovis subsp bovis AF2122/97
cgccgaagcucaucgccgcua

SEQ ID NO: 1077835 - RNA, 22 nt, Mycobacterium bovis subsp bovis AF2122/97
cgccgaagcucaucgccgcuac

SEQ ID NO: 1077836 - RNA, 22 nt, Mycobacterium bovis subsp bovis AF2122/97
cgccgaacgugcaaccacggcg

SEQ ID NO: 1077837 - RNA, 16 nt, Mycobacterium bovis subsp bovis AF2122/97
cgccgaagccggaccg

SEQ ID NO: 1077838 - RNA, 14 nt, Mycobacterium bovis subsp bovis AF2122/97
cgccgaaggccgcc

SEQ ID NO: 1077839 - RNA, 15 nt, Mycobacterium bovis subsp bovis AF2122/97
cgccgaaggccgcca

SEQ ID NO: 1077840 - RNA, 18 nt, Mycobacterium bovis subsp bovis AF2122/97
cgccgaagcgaugccgug

SEQ ID NO: 1077841 - RNA, 13 nt, Mycobacterium bovis subsp bovis AF2122/97
cgccgaagcgccg

SEQ ID NO: 1077842 - RNA, 20 nt, Mycobacterium bovis subsp bovis AF2122/97
cgccgaagcgccgcuuggcg

SEQ ID NO: 1077843 - RNA, 19 nt, Mycobacterium bovis subsp bovis AF2122/97
cgccgaagaaggugacgau

SEQ ID NO: 1077844 - RNA, 21 nt, Mycobacterium bovis subsp bovis AF2122/97
cgccgaagagucgugccgccg

SEQ ID NO: 1077845 - RNA, 23 nt, Mycobacterium bovis subsp bovis AF2122/97
cgccgaagagucgugccgccgca

SEQ ID NO: 1077846 - RNA, 14 nt, Mycobacterium bovis subsp bovis AF2122/97
cgccgaagccgcgc

SEQ ID NO: 1077847 - RNA, 17 nt, Mycobacterium bovis subsp bovis AF2122/97
cgccgaacgcgagguuc

SEQ ID NO: 1077848 - RNA, 16 nt, Mycobacterium bovis subsp bovis AF2122/97
cgccgaacgccaccac

SEQ ID NO: 1077849 - RNA, 17 nt, Mycobacterium bovis subsp bovis AF2122/97
cgccgaacgccaccacc

SEQ ID NO: 1077850 - RNA, 15 nt, Mycobacterium bovis subsp bovis AF2122/97
cgccgaacagugcgg

SEQ ID NO: 1077851 - RNA, 20 nt, Mycobacterium bovis subsp bovis AF2122/97
cgccgaacagugcggucccg

SEQ ID NO: 1077852 - RNA, 16 nt, Mycobacterium bovis subsp bovis AF2122/97
cgccgaacguguugac

SEQ ID NO: 1077853 - RNA, 23 nt, Mycobacterium bovis subsp bovis AF2122/97
cgccgaacguguugaccaggcuc

SEQ ID NO: 1077854 - RNA, 22 nt, Mycobacterium bovis subsp bovis AF2122/97
cgccgaacugcuugcgcaucgc

SEQ ID NO: 1077855 - RNA, 17 nt, Mycobacterium bovis subsp bovis AF2122/97
cgccgaacgccagcagc

SEQ ID NO: 1077856 - RNA, 16 nt, Mycobacterium bovis subsp bovis AF2122/97
cgccgaacagcgacgc

SEQ ID NO: 1077857 - RNA, 17 nt, Mycobacterium bovis subsp bovis AF2122/97
cgccgaacaccucggca

SEQ ID NO: 1077858 - RNA, 21 nt, Mycobacterium bovis subsp bovis AF2122/97
cgccgaacacgcacacgaucg

SEQ ID NO: 1077859 - RNA, 19 nt, Mycobacterium bovis subsp bovis AF2122/97
cgccgaacaccgagugcgg

SEQ ID NO: 1077860 - RNA, 17 nt, Mycobacterium bovis subsp bovis AF2122/97
cgccgaacaccgccgcg

SEQ ID NO: 1077861 - RNA, 20 nt, Mycobacterium bovis subsp bovis AF2122/97
cgccgaacaccgccgcgucg

SEQ ID NO: 1077862 - RNA, 15 nt, Mycobacterium bovis subsp bovis AF2122/97
cgccgaacgccacca

SEQ ID NO: 1077863 - RNA, 17 nt, Mycobacterium bovis subsp bovis AF2122/97
cgccgaaagccuugccg

SEQ ID NO: 1077864 - RNA, 21 nt, Mycobacterium bovis subsp bovis AF2122/97
cgccgaaagccuugccgucga

SEQ ID NO: 1077865 - RNA, 14 nt, Mycobacterium bovis subsp bovis AF2122/97
cgccgaaagggucg

SEQ ID NO: 1077866 - RNA, 18 nt, Mycobacterium bovis subsp bovis AF2122/97
cgccgaaagggucgacgu

SEQ ID NO: 1077867 - RNA, 22 nt, Mycobacterium bovis subsp bovis AF2122/97
cgccgaaacucaagccacgucg

SEQ ID NO: 1077868 - RNA, 18 nt, Mycobacterium bovis subsp bovis AF2122/97
cgccgaaacucaccagca

SEQ ID NO: 1077869 - RNA, 18 nt, Mycobacterium bovis subsp bovis AF2122/97
cgccgaaaucggccagcu

SEQ ID NO: 1077870 - RNA, 22 nt, Mycobacterium bovis subsp bovis AF2122/97
cgccgaaaucaguugcgcucca

SEQ ID NO: 1077871 - RNA, 16 nt, Mycobacterium bovis subsp bovis AF2122/97
cgccgaaaucggccag

SEQ ID NO: 1077872 - RNA, 17 nt, Mycobacterium bovis subsp bovis AF2122/97
cgccgaaaucggccagc

SEQ ID NO: 1077873 - RNA, 15 nt, Mycobacterium bovis subsp bovis AF2122/97
cgccgaacaccacac

SEQ ID NO: 1077874 - RNA, 17 nt, Mycobacterium bovis subsp bovis AF2122/97
cgccgaacaccacaccg

SEQ ID NO: 1077875 - RNA, 24 nt, Mycobacterium bovis subsp bovis AF2122/97
cgcccgcgagagaguucgcaugcu

SEQ ID NO: 1077876 - RNA, 21 nt, Mycobacterium bovis subsp bovis AF2122/97
cgcccgccuucauuacccguu

SEQ ID NO: 1077877 - RNA, 20 nt, Mycobacterium bovis subsp bovis AF2122/97
cgcccgcgaaccgcggaucg

SEQ ID NO: 1077878 - RNA, 22 nt, Mycobacterium bovis subsp bovis AF2122/97
cgcccgcgagcuguaggucagc

SEQ ID NO: 1077879 - RNA, 17 nt, Mycobacterium bovis subsp bovis AF2122/97
cgcccgcgccaccggca

SEQ ID NO: 1077880 - RNA, 18 nt, Mycobacterium bovis subsp bovis AF2122/97
cgcccgcgccaccggcac

SEQ ID NO: 1077881 - RNA, 22 nt, Mycobacterium bovis subsp bovis AF2122/97
cgcccgcgccaccggcaccgcc

SEQ ID NO: 1077882 - RNA, 16 nt, Mycobacterium bovis subsp bovis AF2122/97
cgcccgcgccaccagc

SEQ ID NO: 1077883 - RNA, 19 nt, Mycobacterium bovis subsp bovis AF2122/97
cgcccgcgcccccggugcc

SEQ ID NO: 1077884 - RNA, 14 nt, Mycobacterium bovis subsp bovis AF2122/97
cgcccgcgccgccg

SEQ ID NO: 1077885 - RNA, 15 nt, Mycobacterium bovis subsp bovis AF2122/97
cgcccgcgccgccgc

SEQ ID NO: 1077886 - RNA, 18 nt, Mycobacterium bovis subsp bovis AF2122/97
cgcccgcgccgccgccac

SEQ ID NO: 1077887 - RNA, 17 nt, Mycobacterium bovis subsp bovis AF2122/97
cgcccgcgccgccggac

SEQ ID NO: 1077888 - RNA, 14 nt, Mycobacterium bovis subsp bovis AF2122/97
cgcccgcgcggcca

SEQ ID NO: 1077889 - RNA, 18 nt, Mycobacterium bovis subsp bovis AF2122/97
cgcccgcgccuccguugc

SEQ ID NO: 1077890 - RNA, 15 nt, Mycobacterium bovis subsp bovis AF2122/97
cgcccgcgcgguggc

SEQ ID NO: 1077891 - RNA, 12 nt, Mycobacterium bovis subsp bovis AF2122/97
cgcccgcgcuga

SEQ ID NO: 1077892 - RNA, 13 nt, Mycobacterium bovis subsp bovis AF2122/97
cgcccgcggccgc

SEQ ID NO: 1077893 - RNA, 18 nt, Mycobacterium bovis subsp bovis AF2122/97
cgcccgcggccguggugg

SEQ ID NO: 1077894 - RNA, 14 nt, Mycobacterium bovis subsp bovis AF2122/97
cgcccgccggcaac

SEQ ID NO: 1077895 - RNA, 15 nt, Mycobacterium bovis subsp bovis AF2122/97
cgcccgccgcggcag

SEQ ID NO: 1077896 - RNA, 22 nt, Mycobacterium bovis subsp bovis AF2122/97
cgcccgccggcgcgagccggcu

SEQ ID NO: 1077897 - RNA, 17 nt, Mycobacterium bovis subsp bovis AF2122/97
cgcccgccucgaccgcc

SEQ ID NO: 1077898 - RNA, 19 nt, Mycobacterium bovis subsp bovis AF2122/97
cgcccgccucgaccgccag

SEQ ID NO: 1077899 - RNA, 20 nt, Mycobacterium bovis subsp bovis AF2122/97
cgcccgccucgaccgccagc

SEQ ID NO: 1077900 - RNA, 17 nt, Mycobacterium bovis subsp bovis AF2122/97
cgcccgccaucagcccg

SEQ ID NO: 1077901 - RNA, 20 nt, Mycobacterium bovis subsp bovis AF2122/97
cgcccgccaucagcccggcg

SEQ ID NO: 1077902 - RNA, 15 nt, Mycobacterium bovis subsp bovis AF2122/97
cgcccgcccaccucg

SEQ ID NO: 1077903 - RNA, 18 nt, Mycobacterium bovis subsp bovis AF2122/97
cgcccgcccaccucgauc

SEQ ID NO: 1077904 - RNA, 15 nt, Mycobacterium bovis subsp bovis AF2122/97
cgcccgccccgcgcc

SEQ ID NO: 1077905 - RNA, 23 nt, Mycobacterium bovis subsp bovis AF2122/97
cgcccgacgaugugcacggugug

SEQ ID NO: 1077906 - RNA, 22 nt, Mycobacterium bovis subsp bovis AF2122/97
cgcccgacgaggaugucgauga

SEQ ID NO: 1077907 - RNA, 16 nt, Mycobacterium bovis subsp bovis AF2122/97
cgcccgacgccagcug

SEQ ID NO: 1077908 - RNA, 22 nt, Mycobacterium bovis subsp bovis AF2122/97
cgcccgagaccgggcaacggcg

SEQ ID NO: 1077909 - RNA, 19 nt, Mycobacterium bovis subsp bovis AF2122/97
cgcccgagccggugccacu

SEQ ID NO: 1077910 - RNA, 21 nt, Mycobacterium bovis subsp bovis AF2122/97
cgcccgaggcgagacgcucca

SEQ ID NO: 1077911 - RNA, 21 nt, Mycobacterium bovis subsp bovis AF2122/97
cgcccgagucgugcguugccg

SEQ ID NO: 1077912 - RNA, 16 nt, Mycobacterium bovis subsp bovis AF2122/97
cgcccgagucucgucg

SEQ ID NO: 1077913 - RNA, 19 nt, Mycobacterium bovis subsp bovis AF2122/97
cgcccgagucucgucgggu

SEQ ID NO: 1077914 - RNA, 21 nt, Mycobacterium bovis subsp bovis AF2122/97
cgcccgaguuaaacgcagcgg

SEQ ID NO: 1077915 - RNA, 16 nt, Mycobacterium bovis subsp bovis AF2122/97
cgcccgaguugaagaa

SEQ ID NO: 1077916 - RNA, 15 nt, Mycobacterium bovis subsp bovis AF2122/97
cgcccgauacgccac

SEQ ID NO: 1077917 - RNA, 18 nt, Mycobacterium bovis subsp bovis AF2122/97
cgcccgauacgccaccgg

SEQ ID NO: 1077918 - RNA, 19 nt, Mycobacterium bovis subsp bovis AF2122/97
cgcccgauacgccaccggc

SEQ ID NO: 1077919 - RNA, 20 nt, Mycobacterium bovis subsp bovis AF2122/97
cgcccgauacgccaccggca

SEQ ID NO: 1077920 - RNA, 19 nt, Mycobacterium bovis subsp bovis AF2122/97
cgcccgaucgauaucggca

SEQ ID NO: 1077921 - RNA, 18 nt, Mycobacterium bovis subsp bovis AF2122/97
cgcccgaucggcggaucg

SEQ ID NO: 1077922 - RNA, 21 nt, Mycobacterium bovis subsp bovis AF2122/97
cgcccgcaggacgcugccggu

SEQ ID NO: 1077923 - RNA, 23 nt, Mycobacterium bovis subsp bovis AF2122/97
cgcccgcaggacgcugccggugu

SEQ ID NO: 1077924 - RNA, 19 nt, Mycobacterium bovis subsp bovis AF2122/97
cgcccgcagggccgccgcg

SEQ ID NO: 1077925 - RNA, 22 nt, Mycobacterium bovis subsp bovis AF2122/97
cgcccgcagguggcuguucacc

SEQ ID NO: 1077926 - RNA, 23 nt, Mycobacterium bovis subsp bovis AF2122/97
cgcccgcaucgcggcaucgacgc

SEQ ID NO: 1077927 - RNA, 15 nt, Mycobacterium bovis subsp bovis AF2122/97
cgcccgccaccggag

SEQ ID NO: 1077928 - RNA, 18 nt, Mycobacterium bovis subsp bovis AF2122/97
cgcccgcaccagcugucg

SEQ ID NO: 1077929 - RNA, 15 nt, Mycobacterium bovis subsp bovis AF2122/97
cgcccgaugcgccag

SEQ ID NO: 1077930 - RNA, 22 nt, Mycobacterium bovis subsp bovis AF2122/97
cgcccgcaauuguucgcggccg

SEQ ID NO: 1077931 - RNA, 15 nt, Mycobacterium bovis subsp bovis AF2122/97
cgcccgcaccaccgg

SEQ ID NO: 1077932 - RNA, 17 nt, Mycobacterium bovis subsp bovis AF2122/97
cgcccgcaccaccggcc

SEQ ID NO: 1077933 - RNA, 14 nt, Mycobacterium bovis subsp bovis AF2122/97
cgcccgcacccaug

SEQ ID NO: 1077934 - RNA, 15 nt, Mycobacterium bovis subsp bovis AF2122/97
cgcccgcacccauga

SEQ ID NO: 1077935 - RNA, 20 nt, Mycobacterium bovis subsp bovis AF2122/97
cgcccgcaauuguucgcggc

SEQ ID NO: 1077936 - RNA, 20 nt, Mycobacterium bovis subsp bovis AF2122/97
cgcccggaccacuguuggug

SEQ ID NO: 1077937 - RNA, 16 nt, Mycobacterium bovis subsp bovis AF2122/97
cgcccggcgugucgcc

SEQ ID NO: 1077938 - RNA, 20 nt, Mycobacterium bovis subsp bovis AF2122/97
cgcccggcgugucgccgcca

SEQ ID NO: 1077939 - RNA, 16 nt, Mycobacterium bovis subsp bovis AF2122/97
cgcccggguugaccgc

SEQ ID NO: 1077940 - RNA, 21 nt, Mycobacterium bovis subsp bovis AF2122/97
cgcccggcuuuugcgcccagc

SEQ ID NO: 1077941 - RNA, 19 nt, Mycobacterium bovis subsp bovis AF2122/97
cgcccggcggaucccgagg

SEQ ID NO: 1077942 - RNA, 13 nt, Mycobacterium bovis subsp bovis AF2122/97
cgcccgggcguug

SEQ ID NO: 1077943 - RNA, 13 nt, Mycobacterium bovis subsp bovis AF2122/97
cgcccggucacgc

SEQ ID NO: 1077944 - RNA, 20 nt, Mycobacterium bovis subsp bovis AF2122/97
cgcccgggucccggcagcug

SEQ ID NO: 1077945 - RNA, 21 nt, Mycobacterium bovis subsp bovis AF2122/97
cgcccggucacgcugugcggu

SEQ ID NO: 1077946 - RNA, 18 nt, Mycobacterium bovis subsp bovis AF2122/97
cgcccgcuccuccggcac

SEQ ID NO: 1077947 - RNA, 23 nt, Mycobacterium bovis subsp bovis AF2122/97
cgcccgcuaccaacgcaacacgg

SEQ ID NO: 1077948 - RNA, 18 nt, Mycobacterium bovis subsp bovis AF2122/97
cgcccgcuacggcagccc

SEQ ID NO: 1077949 - RNA, 20 nt, Mycobacterium bovis subsp bovis AF2122/97
cgcccgcuacggcagcccgu

SEQ ID NO: 1077950 - RNA, 15 nt, Mycobacterium bovis subsp bovis AF2122/97
cgcccgcuccaacac

SEQ ID NO: 1077951 - RNA, 23 nt, Mycobacterium bovis subsp bovis AF2122/97
cgcccgcuccaacacccgccggu

SEQ ID NO: 1077952 - RNA, 14 nt, Mycobacterium bovis subsp bovis AF2122/97
cgcccgcgggcagu

SEQ ID NO: 1077953 - RNA, 23 nt, Mycobacterium bovis subsp bovis AF2122/97
cgcccgcgugacgcuuggccaau

SEQ ID NO: 1077954 - RNA, 20 nt, Mycobacterium bovis subsp bovis AF2122/97
cgcccgcuccuccggcacca

SEQ ID NO: 1077955 - RNA, 13 nt, Mycobacterium bovis subsp bovis AF2122/97
cgcccgcucgaug

SEQ ID NO: 1077956 - RNA, 15 nt, Mycobacterium bovis subsp bovis AF2122/97
cgcccgcucggccgc

SEQ ID NO: 1077957 - RNA, 16 nt, Mycobacterium bovis subsp bovis AF2122/97
cgcccgcucggccgca

SEQ ID NO: 1077958 - RNA, 17 nt, Mycobacterium bovis subsp bovis AF2122/97
cgcccgcucggccgcag

SEQ ID NO: 1077959 - RNA, 15 nt, Mycobacterium bovis subsp bovis AF2122/97
cgcccgcugcggcgg

SEQ ID NO: 1077960 - RNA, 19 nt, Mycobacterium bovis subsp bovis AF2122/97
cgcccgcugggcucgcugc

SEQ ID NO: 1077961 - RNA, 16 nt, Mycobacterium bovis subsp bovis AF2122/97
cgcccgcugccgucgg

SEQ ID NO: 1077962 - RNA, 15 nt, Mycobacterium bovis subsp bovis AF2122/97
cgcccggcccgccac

SEQ ID NO: 1077963 - RNA, 13 nt, Mycobacterium bovis subsp bovis AF2122/97
cgcccggccccgc

SEQ ID NO: 1077964 - RNA, 14 nt, Mycobacterium bovis subsp bovis AF2122/97
cgcccggccccgca

SEQ ID NO: 1077965 - RNA, 12 nt, Mycobacterium bovis subsp bovis AF2122/97
cgcccggccagg

SEQ ID NO: 1077966 - RNA, 14 nt, Mycobacterium bovis subsp bovis AF2122/97
cgcccggccaagcc

SEQ ID NO: 1077967 - RNA, 15 nt, Mycobacterium bovis subsp bovis AF2122/97
cgcccggccaagccg

SEQ ID NO: 1077968 - RNA, 19 nt, Mycobacterium bovis subsp bovis AF2122/97
cgcccggccaggucgacac

SEQ ID NO: 1077969 - RNA, 16 nt, Mycobacterium bovis subsp bovis AF2122/97
cgcccggcgcaagcgc

SEQ ID NO: 1077970 - RNA, 21 nt, Mycobacterium bovis subsp bovis AF2122/97
cgcccggcgcaccaucgcggc

SEQ ID NO: 1077971 - RNA, 14 nt, Mycobacterium bovis subsp bovis AF2122/97
cgcccggccgguuc

SEQ ID NO: 1077972 - RNA, 16 nt, Mycobacterium bovis subsp bovis AF2122/97
cgcccggauguccgcc

SEQ ID NO: 1077973 - RNA, 19 nt, Mycobacterium bovis subsp bovis AF2122/97
cgcccggauguccgccgac

SEQ ID NO: 1077974 - RNA, 23 nt, Mycobacterium bovis subsp bovis AF2122/97
cgcccggaucucggcguaggcga

SEQ ID NO: 1077975 - RNA, 19 nt, Mycobacterium bovis subsp bovis AF2122/97
cgcccggacccaaagcacu

SEQ ID NO: 1077976 - RNA, 16 nt, Mycobacterium bovis subsp bovis AF2122/97
cgccccgaugaccgcc

SEQ ID NO: 1077977 - RNA, 19 nt, Mycobacterium bovis subsp bovis AF2122/97
cgccccgaugaccgccuug

SEQ ID NO: 1077978 - RNA, 17 nt, Mycobacterium bovis subsp bovis AF2122/97
cgccccgaucggccacc

SEQ ID NO: 1077979 - RNA, 14 nt, Mycobacterium bovis subsp bovis AF2122/97
cgccccgaucggug

SEQ ID NO: 1077980 - RNA, 18 nt, Mycobacterium bovis subsp bovis AF2122/97
cgccccgaucggugacgc

SEQ ID NO: 1077981 - RNA, 17 nt, Mycobacterium bovis subsp bovis AF2122/97
cgccccgccgcacgcac

SEQ ID NO: 1077982 - RNA, 13 nt, Mycobacterium bovis subsp bovis AF2122/97
cgccccgcguguc

SEQ ID NO: 1077983 - RNA, 12 nt, Mycobacterium bovis subsp bovis AF2122/97
cgccccgcguug

SEQ ID NO: 1077984 - RNA, 19 nt, Mycobacterium bovis subsp bovis AF2122/97
cgccccgcgcccaacgcgg

SEQ ID NO: 1077985 - RNA, 12 nt, Mycobacterium bovis subsp bovis AF2122/97
cgccccggagcc

SEQ ID NO: 1077986 - RNA, 15 nt, Mycobacterium bovis subsp bovis AF2122/97
cgccccggccaggac

SEQ ID NO: 1077987 - RNA, 12 nt, Mycobacterium bovis subsp bovis AF2122/97
cgccccggccgc

SEQ ID NO: 1077988 - RNA, 21 nt, Mycobacterium bovis subsp bovis AF2122/97
cgccccggccgcuggcguuga

SEQ ID NO: 1077989 - RNA, 17 nt, Mycobacterium bovis subsp bovis AF2122/97
cgccccggcgcggccag

SEQ ID NO: 1077990 - RNA, 16 nt, Mycobacterium bovis subsp bovis AF2122/97
cgccccguaaucggug

SEQ ID NO: 1077991 - RNA, 21 nt, Mycobacterium bovis subsp bovis AF2122/97
cgccccguugugucaccggcg

SEQ ID NO: 1077992 - RNA, 20 nt, Mycobacterium bovis subsp bovis AF2122/97
cgccccucacguggacugac

SEQ ID NO: 1077993 - RNA, 15 nt, Mycobacterium bovis subsp bovis AF2122/97
cgcccgaagccgggc

SEQ ID NO: 1077994 - RNA, 16 nt, Mycobacterium bovis subsp bovis AF2122/97
cgcccgaagccgggcc

SEQ ID NO: 1077995 - RNA, 22 nt, Mycobacterium bovis subsp bovis AF2122/97
cgcccgacccaucaccagcggc

SEQ ID NO: 1077996 - RNA, 21 nt, Mycobacterium bovis subsp bovis AF2122/97
cgcccgaagaaugggauggca

SEQ ID NO: 1077997 - RNA, 16 nt, Mycobacterium bovis subsp bovis AF2122/97
cgccccugguccaccc

SEQ ID NO: 1077998 - RNA, 13 nt, Mycobacterium bovis subsp bovis AF2122/97
cgcccccgcccgu

SEQ ID NO: 1077999 - RNA, 17 nt, Mycobacterium bovis subsp bovis AF2122/97
cgcccccgccggccgcg

SEQ ID NO: 1078000 - RNA, 18 nt, Mycobacterium bovis subsp bovis AF2122/97
cgcccccggugccguugg

SEQ ID NO: 1078001 - RNA, 19 nt, Mycobacterium bovis subsp bovis AF2122/97
cgcccccuggauggcgccc

SEQ ID NO: 1078002 - RNA, 22 nt, Mycobacterium bovis subsp bovis AF2122/97
cgccccagugcucaucgacaau

SEQ ID NO: 1078003 - RNA, 16 nt, Mycobacterium bovis subsp bovis AF2122/97
cgccccaguucgacgg

SEQ ID NO: 1078004 - RNA, 12 nt, Mycobacterium bovis subsp bovis AF2122/97
cgccccagcugc

SEQ ID NO: 1078005 - RNA, 21 nt, Mycobacterium bovis subsp bovis AF2122/97
cgccccauacuugcgccgacu

SEQ ID NO: 1078006 - RNA, 15 nt, Mycobacterium bovis subsp bovis AF2122/97
cgccccccacggccc

SEQ ID NO: 1078007 - RNA, 20 nt, Mycobacterium bovis subsp bovis AF2122/97
cgcccccagcagcugcgaua

SEQ ID NO: 1078008 - RNA, 19 nt, Mycobacterium bovis subsp bovis AF2122/97
cgccccagggggcgugccg

SEQ ID NO: 1078009 - RNA, 13 nt, Mycobacterium bovis subsp bovis AF2122/97
cgccccaccggcc

SEQ ID NO: 1078010 - RNA, 22 nt, Mycobacterium bovis subsp bovis AF2122/97
cgcccauucccauaucgaucgg

SEQ ID NO: 1078011 - RNA, 17 nt, Mycobacterium bovis subsp bovis AF2122/97
cgccccacuugccgggc

SEQ ID NO: 1078012 - RNA, 16 nt, Mycobacterium bovis subsp bovis AF2122/97
cgcccauuucggcacg

SEQ ID NO: 1078013 - RNA, 18 nt, Mycobacterium bovis subsp bovis AF2122/97
cgcccauuucggcacgaa

SEQ ID NO: 1078014 - RNA, 18 nt, Mycobacterium bovis subsp bovis AF2122/97
cgcccauuucggcccgaa

SEQ ID NO: 1078015 - RNA, 15 nt, Mycobacterium bovis subsp bovis AF2122/97
cgcccauuggccagg

SEQ ID NO: 1078016 - RNA, 20 nt, Mycobacterium bovis subsp bovis AF2122/97
cgcccauuggguaaccagcg

SEQ ID NO: 1078017 - RNA, 21 nt, Mycobacterium bovis subsp bovis AF2122/97
cgcccauuggguaaccagcgc

SEQ ID NO: 1078018 - RNA, 24 nt, Mycobacterium bovis subsp bovis AF2122/97
cgcccauugacguagaccgucgau

SEQ ID NO: 1078019 - RNA, 22 nt, Mycobacterium bovis subsp bovis AF2122/97
cgcccauggcgucgaaccaguc

SEQ ID NO: 1078020 - RNA, 20 nt, Mycobacterium bovis subsp bovis AF2122/97
cgcccaugcugacacgacau

SEQ ID NO: 1078021 - RNA, 14 nt, Mycobacterium bovis subsp bovis AF2122/97
cgcccaggcgaccg

SEQ ID NO: 1078022 - RNA, 15 nt, Mycobacterium bovis subsp bovis AF2122/97
cgcccaggcgaccgc

SEQ ID NO: 1078023 - RNA, 20 nt, Mycobacterium bovis subsp bovis AF2122/97
cgcccaggcgaccgcugagg

SEQ ID NO: 1078024 - RNA, 15 nt, Mycobacterium bovis subsp bovis AF2122/97
cgcccaggcgcgacg

SEQ ID NO: 1078025 - RNA, 17 nt, Mycobacterium bovis subsp bovis AF2122/97
cgcccagggugucugug

SEQ ID NO: 1078026 - RNA, 19 nt, Mycobacterium bovis subsp bovis AF2122/97
cgcccaggugaucgcgagg

SEQ ID NO: 1078027 - RNA, 18 nt, Mycobacterium bovis subsp bovis AF2122/97
cgcccaugaccggccgcc

SEQ ID NO: 1078028 - RNA, 17 nt, Mycobacterium bovis subsp bovis AF2122/97
cgcccaucgcgacggcc

SEQ ID NO: 1078029 - RNA, 18 nt, Mycobacterium bovis subsp bovis AF2122/97
cgcccauagcugccggcc

SEQ ID NO: 1078030 - RNA, 19 nt, Mycobacterium bovis subsp bovis AF2122/97
cgcccaucccgguuccggc

SEQ ID NO: 1078031 - RNA, 18 nt, Mycobacterium bovis subsp bovis AF2122/97
cgcccagugaaucggacc

SEQ ID NO: 1078032 - RNA, 19 nt, Mycobacterium bovis subsp bovis AF2122/97
cgcccagcgcccgcgcggc

SEQ ID NO: 1078033 - RNA, 23 nt, Mycobacterium bovis subsp bovis AF2122/97
cgcccagcugucauccccggcca

SEQ ID NO: 1078034 - RNA, 20 nt, Mycobacterium bovis subsp bovis AF2122/97
cgcccaggaagccgagacca

SEQ ID NO: 1078035 - RNA, 17 nt, Mycobacterium bovis subsp bovis AF2122/97
cgcccaggagcaccucg

SEQ ID NO: 1078036 - RNA, 16 nt, Mycobacterium bovis subsp bovis AF2122/97
cgcccagcucgauacc

SEQ ID NO: 1078037 - RNA, 12 nt, Mycobacterium bovis subsp bovis AF2122/97
cgccaccggcac

SEQ ID NO: 1078038 - RNA, 15 nt, Mycobacterium bovis subsp bovis AF2122/97
cgccaccggcaccgc

SEQ ID NO: 1078039 - RNA, 16 nt, Mycobacterium bovis subsp bovis AF2122/97
cgccaccggcaccgcc

SEQ ID NO: 1078040 - RNA, 18 nt, Mycobacterium bovis subsp bovis AF2122/97
cgcccagcgagcgccagg

SEQ ID NO: 1078041 - RNA, 19 nt, Mycobacterium bovis subsp bovis AF2122/97
cgcccagcgacaacaccac

SEQ ID NO: 1078042 - RNA, 12 nt, Mycobacterium bovis subsp bovis AF2122/97
cgcccagcgacc

SEQ ID NO: 1078043 - RNA, 15 nt, Mycobacterium bovis subsp bovis AF2122/97
cgcccagcgacccgg

SEQ ID NO: 1078044 - RNA, 20 nt, Mycobacterium bovis subsp bovis AF2122/97
cgcccagcgacccggccagc

SEQ ID NO: 1078045 - RNA, 21 nt, Mycobacterium bovis subsp bovis AF2122/97
cgcccagcgacccggccagcg

SEQ ID NO: 1078046 - RNA, 15 nt, Mycobacterium bovis subsp bovis AF2122/97
cgccaccgccagcgu

SEQ ID NO: 1078047 - RNA, 17 nt, Mycobacterium bovis subsp bovis AF2122/97
cgccaccgccagcgucg

SEQ ID NO: 1078048 - RNA, 16 nt, Mycobacterium bovis subsp bovis AF2122/97
cgccaccgcacgcacg

SEQ ID NO: 1078049 - RNA, 22 nt, Mycobacterium bovis subsp bovis AF2122/97
cgccaccgccggcagcaucggc

SEQ ID NO: 1078050 - RNA, 14 nt, Mycobacterium bovis subsp bovis AF2122/97
cgccaccgcgguca

SEQ ID NO: 1078051 - RNA, 12 nt, Mycobacterium bovis subsp bovis AF2122/97
cgccaccgcggc

SEQ ID NO: 1078052 - RNA, 14 nt, Mycobacterium bovis subsp bovis AF2122/97
cgccaccgcggcga

SEQ ID NO: 1078053 - RNA, 15 nt, Mycobacterium bovis subsp bovis AF2122/97
cgccgcggucggacc

SEQ ID NO: 1078054 - RNA, 19 nt, Mycobacterium bovis subsp bovis AF2122/97
cgccgcgguagacgccgcc

SEQ ID NO: 1078055 - RNA, 21 nt, Mycobacterium bovis subsp bovis AF2122/97
cgccgcggucggaccacccgg

SEQ ID NO: 1078056 - RNA, 23 nt, Mycobacterium bovis subsp bovis AF2122/97
cgccgcggucggaccacccggcg

SEQ ID NO: 1078057 - RNA, 21 nt, Mycobacterium bovis subsp bovis AF2122/97
cgccgcggucgugaucagcag

SEQ ID NO: 1078058 - RNA, 19 nt, Mycobacterium bovis subsp bovis AF2122/97
cgccgcgucauucaccgcg

SEQ ID NO: 1078059 - RNA, 16 nt, Mycobacterium bovis subsp bovis AF2122/97
cgccgcguggcuggcg

SEQ ID NO: 1078060 - RNA, 20 nt, Mycobacterium bovis subsp bovis AF2122/97
cgccgcgugccgcaacgacu

SEQ ID NO: 1078061 - RNA, 17 nt, Mycobacterium bovis subsp bovis AF2122/97
cgccgcgggcuccccgg

SEQ ID NO: 1078062 - RNA, 13 nt, Mycobacterium bovis subsp bovis AF2122/97
cgccgcgggucgc

SEQ ID NO: 1078063 - RNA, 16 nt, Mycobacterium bovis subsp bovis AF2122/97
cgccgcgggcgccggu

SEQ ID NO: 1078064 - RNA, 21 nt, Mycobacterium bovis subsp bovis AF2122/97
cgccgcggcuugucgccccau

SEQ ID NO: 1078065 - RNA, 18 nt, Mycobacterium bovis subsp bovis AF2122/97
cgccgcgggacaccaccg

SEQ ID NO: 1078066 - RNA, 23 nt, Mycobacterium bovis subsp bovis AF2122/97
cgccgcgggacagauggcggccg

SEQ ID NO: 1078067 - RNA, 21 nt, Mycobacterium bovis subsp bovis AF2122/97
cgccgcggcuacaucggcggc

SEQ ID NO: 1078068 - RNA, 14 nt, Mycobacterium bovis subsp bovis AF2122/97
cgccgcggccaggu

SEQ ID NO: 1078069 - RNA, 18 nt, Mycobacterium bovis subsp bovis AF2122/97
cgccgcggccgccguccc

SEQ ID NO: 1078070 - RNA, 14 nt, Mycobacterium bovis subsp bovis AF2122/97
cgccgcggccggcg

SEQ ID NO: 1078071 - RNA, 13 nt, Mycobacterium bovis subsp bovis AF2122/97
cgccgcggcgccc

SEQ ID NO: 1078072 - RNA, 15 nt, Mycobacterium bovis subsp bovis AF2122/97
cgccgcggcgcccgg

SEQ ID NO: 1078073 - RNA, 14 nt, Mycobacterium bovis subsp bovis AF2122/97
cgccgcggcgccgg

SEQ ID NO: 1078074 - RNA, 18 nt, Mycobacterium bovis subsp bovis AF2122/97
cgccgcgcguuccagcac

SEQ ID NO: 1078075 - RNA, 14 nt, Mycobacterium bovis subsp bovis AF2122/97
cgccgcgcguucca

SEQ ID NO: 1078076 - RNA, 16 nt, Mycobacterium bovis subsp bovis AF2122/97
cgccgcgcguucggcg

SEQ ID NO: 1078077 - RNA, 14 nt, Mycobacterium bovis subsp bovis AF2122/97
cgccgcgcucgacg

SEQ ID NO: 1078078 - RNA, 19 nt, Mycobacterium bovis subsp bovis AF2122/97
cgccgcgcccggcgcaagc

SEQ ID NO: 1078079 - RNA, 20 nt, Mycobacterium bovis subsp bovis AF2122/97
cgccgcgccgauuccaccgc

SEQ ID NO: 1078080 - RNA, 12 nt, Mycobacterium bovis subsp bovis AF2122/97
cgccgcgccgca

SEQ ID NO: 1078081 - RNA, 12 nt, Mycobacterium bovis subsp bovis AF2122/97
cgccgcgcgggu

SEQ ID NO: 1078082 - RNA, 13 nt, Mycobacterium bovis subsp bovis AF2122/97
cgccgcgcgucgc

SEQ ID NO: 1078083 - RNA, 15 nt, Mycobacterium bovis subsp bovis AF2122/97
cgccgcgcgucgcga

SEQ ID NO: 1078084 - RNA, 14 nt, Mycobacterium bovis subsp bovis AF2122/97
cgccgcgcggcuug

SEQ ID NO: 1078085 - RNA, 15 nt, Mycobacterium bovis subsp bovis AF2122/97
cgccgccgucggcga

SEQ ID NO: 1078086 - RNA, 15 nt, Mycobacterium bovis subsp bovis AF2122/97
cgccgccguugccga

SEQ ID NO: 1078087 - RNA, 16 nt, Mycobacterium bovis subsp bovis AF2122/97
cgccgccguuaccgcc

SEQ ID NO: 1078088 - RNA, 20 nt, Mycobacterium bovis subsp bovis AF2122/97
cgccgccguuaccgccggcg

SEQ ID NO: 1078089 - RNA, 17 nt, Mycobacterium bovis subsp bovis AF2122/97
cgccgccguugccgauc

SEQ ID NO: 1078090 - RNA, 17 nt, Mycobacterium bovis subsp bovis AF2122/97
cgccgccguugccgccg

SEQ ID NO: 1078091 - RNA, 20 nt, Mycobacterium bovis subsp bovis AF2122/97
cgccgccguugccgccggcg

SEQ ID NO: 1078092 - RNA, 21 nt, Mycobacterium bovis subsp bovis AF2122/97
cgccgccguugccgccggcgc

SEQ ID NO: 1078093 - RNA, 22 nt, Mycobacterium bovis subsp bovis AF2122/97
cgccgccguugccgccggcgcc

SEQ ID NO: 1078094 - RNA, 21 nt, Mycobacterium bovis subsp bovis AF2122/97
cgccgccguugccgccggugu

SEQ ID NO: 1078095 - RNA, 23 nt, Mycobacterium bovis subsp bovis AF2122/97
cgccgccguuggcucgagccgcc

SEQ ID NO: 1078096 - RNA, 12 nt, Mycobacterium bovis subsp bovis AF2122/97
cgccgccguugu

SEQ ID NO: 1078097 - RNA, 16 nt, Mycobacterium bovis subsp bovis AF2122/97
cgccgccuccgccgag

SEQ ID NO: 1078098 - RNA, 19 nt, Mycobacterium bovis subsp bovis AF2122/97
cgccgccuccgccgaggcc

SEQ ID NO: 1078099 - RNA, 22 nt, Mycobacterium bovis subsp bovis AF2122/97
cgccgccuccgccgaggccgcc

SEQ ID NO: 1078100 - RNA, 16 nt, Mycobacterium bovis subsp bovis AF2122/97
cgccgccucgggcacc

SEQ ID NO: 1078101 - RNA, 20 nt, Mycobacterium bovis subsp bovis AF2122/97
cgccgcgaugccacccaaca

SEQ ID NO: 1078102 - RNA, 13 nt, Mycobacterium bovis subsp bovis AF2122/97
cgccgcgauggcg

SEQ ID NO: 1078103 - RNA, 17 nt, Mycobacterium bovis subsp bovis AF2122/97
cgccgcgaugacggugc

SEQ ID NO: 1078104 - RNA, 12 nt, Mycobacterium bovis subsp bovis AF2122/97
cgccgccucguc

SEQ ID NO: 1078105 - RNA, 12 nt, Mycobacterium bovis subsp bovis AF2122/97
cgccgcgcccgg

SEQ ID NO: 1078106 - RNA, 16 nt, Mycobacterium bovis subsp bovis AF2122/97
cgccgcgccccgcggc

SEQ ID NO: 1078107 - RNA, 16 nt, Mycobacterium bovis subsp bovis AF2122/97
cgccgcgcagccgcuc

SEQ ID NO: 1078108 - RNA, 21 nt, Mycobacterium bovis subsp bovis AF2122/97
cgccgcgcagccgcucgacgg

SEQ ID NO: 1078109 - RNA, 16 nt, Mycobacterium bovis subsp bovis AF2122/97
cgccgcgcagccggcc

SEQ ID NO: 1078110 - RNA, 21 nt, Mycobacterium bovis subsp bovis AF2122/97
cgccgcgcagccggcccgucg

SEQ ID NO: 1078111 - RNA, 22 nt, Mycobacterium bovis subsp bovis AF2122/97
cgccgcgaugacggugccgacc

SEQ ID NO: 1078112 - RNA, 19 nt, Mycobacterium bovis subsp bovis AF2122/97
cgccgcgcaccgaccgcac

SEQ ID NO: 1078113 - RNA, 11 nt, Mycobacterium bovis subsp bovis AF2122/97
cgccgccgggc

SEQ ID NO: 1078114 - RNA, 16 nt, Mycobacterium bovis subsp bovis AF2122/97
cgccgccggaucgccg

SEQ ID NO: 1078115 - RNA, 21 nt, Mycobacterium bovis subsp bovis AF2122/97
cgccgccgcuguugaucgaca

SEQ ID NO: 1078116 - RNA, 22 nt, Mycobacterium bovis subsp bovis AF2122/97
cgccgccggacccaccgucacc

SEQ ID NO: 1078117 - RNA, 16 nt, Mycobacterium bovis subsp bovis AF2122/97
cgccgccgcgggcgcc

SEQ ID NO: 1078118 - RNA, 18 nt, Mycobacterium bovis subsp bovis AF2122/97
cgccgccgcgggcgccgg

SEQ ID NO: 1078119 - RNA, 15 nt, Mycobacterium bovis subsp bovis AF2122/97
cgccgccgcugccgc

SEQ ID NO: 1078120 - RNA, 16 nt, Mycobacterium bovis subsp bovis AF2122/97
cgccgccgcugccgcc

SEQ ID NO: 1078121 - RNA, 22 nt, Mycobacterium bovis subsp bovis AF2122/97
cgccgccgggucgaacgcaugc

SEQ ID NO: 1078122 - RNA, 14 nt, Mycobacterium bovis subsp bovis AF2122/97
cgccgccgggcagu

SEQ ID NO: 1078123 - RNA, 12 nt, Mycobacterium bovis subsp bovis AF2122/97
cgccgccggugc

SEQ ID NO: 1078124 - RNA, 16 nt, Mycobacterium bovis subsp bovis AF2122/97
cgccgccgucaccgcc

SEQ ID NO: 1078125 - RNA, 19 nt, Mycobacterium bovis subsp bovis AF2122/97
cgccgccgucaccgcccuu

SEQ ID NO: 1078126 - RNA, 22 nt, Mycobacterium bovis subsp bovis AF2122/97
cgccgccggugucgggcuguca

SEQ ID NO: 1078127 - RNA, 22 nt, Mycobacterium bovis subsp bovis AF2122/97
cgccgccggugccaccggcugg

SEQ ID NO: 1078128 - RNA, 14 nt, Mycobacterium bovis subsp bovis AF2122/97
cgccgccggugcca

SEQ ID NO: 1078129 - RNA, 16 nt, Mycobacterium bovis subsp bovis AF2122/97
cgccgccggugccacc

SEQ ID NO: 1078130 - RNA, 19 nt, Mycobacterium bovis subsp bovis AF2122/97
cgccgccggugccaccgac

SEQ ID NO: 1078131 - RNA, 20 nt, Mycobacterium bovis subsp bovis AF2122/97
cgccgccggugccaccgacg

SEQ ID NO: 1078132 - RNA, 22 nt, Mycobacterium bovis subsp bovis AF2122/97
cgccgauguggccggcgauggc

SEQ ID NO: 1078133 - RNA, 15 nt, Mycobacterium bovis subsp bovis AF2122/97
cgccgauguggccgg

SEQ ID NO: 1078134 - RNA, 14 nt, Mycobacterium bovis subsp bovis AF2122/97
cgccgauguggccg

SEQ ID NO: 1078135 - RNA, 14 nt, Mycobacterium bovis subsp bovis AF2122/97
cgccgccgccgacg

SEQ ID NO: 1078136 - RNA, 15 nt, Mycobacterium bovis subsp bovis AF2122/97
cgccgccgccgacga

SEQ ID NO: 1078137 - RNA, 18 nt, Mycobacterium bovis subsp bovis AF2122/97
cgccgccgcgagcgccgg

SEQ ID NO: 1078138 - RNA, 14 nt, Mycobacterium bovis subsp bovis AF2122/97
cgccgccgccgggu

SEQ ID NO: 1078139 - RNA, 14 nt, Mycobacterium bovis subsp bovis AF2122/97
cgccgccgccgcca

SEQ ID NO: 1078140 - RNA, 14 nt, Mycobacterium bovis subsp bovis AF2122/97
cgccgauggccgca

SEQ ID NO: 1078141 - RNA, 13 nt, Mycobacterium bovis subsp bovis AF2122/97
cgccgaugccggc

SEQ ID NO: 1078142 - RNA, 13 nt, Mycobacterium bovis subsp bovis AF2122/97
cgccgaugcggug

SEQ ID NO: 1078143 - RNA, 16 nt, Mycobacterium bovis subsp bovis AF2122/97
cgccgaugcugccgcc

SEQ ID NO: 1078144 - RNA, 18 nt, Mycobacterium bovis subsp bovis AF2122/97
cgccgaugcugccgccgc

SEQ ID NO: 1078145 - RNA, 20 nt, Mycobacterium bovis subsp bovis AF2122/97
cgccgauggcuuggugccca

SEQ ID NO: 1078146 - RNA, 23 nt, Mycobacterium bovis subsp bovis AF2122/97
cgccgaugggaaccgaaucggca

SEQ ID NO: 1078147 - RNA, 18 nt, Mycobacterium bovis subsp bovis AF2122/97
cgccggcccggugaugaa

SEQ ID NO: 1078148 - RNA, 15 nt, Mycobacterium bovis subsp bovis AF2122/97
cgccggccgccagcg

SEQ ID NO: 1078149 - RNA, 15 nt, Mycobacterium bovis subsp bovis AF2122/97
cgccggccaguucgg

SEQ ID NO: 1078150 - RNA, 17 nt, Mycobacterium bovis subsp bovis AF2122/97
cgccggccgcacgccgg

SEQ ID NO: 1078151 - RNA, 20 nt, Mycobacterium bovis subsp bovis AF2122/97
cgccggccgcacgccggcca

SEQ ID NO: 1078152 - RNA, 20 nt, Mycobacterium bovis subsp bovis AF2122/97
cgccggccggaacgcccggc

SEQ ID NO: 1078153 - RNA, 13 nt, Mycobacterium bovis subsp bovis AF2122/97
cgccggccggcag

SEQ ID NO: 1078154 - RNA, 14 nt, Mycobacterium bovis subsp bovis AF2122/97
cgccggccggcagg

SEQ ID NO: 1078155 - RNA, 12 nt, Mycobacterium bovis subsp bovis AF2122/97
cgccggccggcc

SEQ ID NO: 1078156 - RNA, 14 nt, Mycobacterium bovis subsp bovis AF2122/97
cgccggccggcgca

SEQ ID NO: 1078157 - RNA, 13 nt, Mycobacterium bovis subsp bovis AF2122/97
cgccggccgcgcc

SEQ ID NO: 1078158 - RNA, 13 nt, Mycobacterium bovis subsp bovis AF2122/97
cgccggccgcgca

SEQ ID NO: 1078159 - RNA, 18 nt, Mycobacterium bovis subsp bovis AF2122/97
cgccggccgcgugacgua

SEQ ID NO: 1078160 - RNA, 14 nt, Mycobacterium bovis subsp bovis AF2122/97
cgccggccggcgcg

SEQ ID NO: 1078161 - RNA, 16 nt, Mycobacterium bovis subsp bovis AF2122/97
cgccggccggcgcggu

SEQ ID NO: 1078162 - RNA, 22 nt, Mycobacterium bovis subsp bovis AF2122/97
cgccggcgccacccgcgccgcc

SEQ ID NO: 1078163 - RNA, 14 nt, Mycobacterium bovis subsp bovis AF2122/97
cgccggcgccaccg

SEQ ID NO: 1078164 - RNA, 13 nt, Mycobacterium bovis subsp bovis AF2122/97
cgccggcgccacc

SEQ ID NO: 1078165 - RNA, 14 nt, Mycobacterium bovis subsp bovis AF2122/97
cgccggcgcccagg

SEQ ID NO: 1078166 - RNA, 14 nt, Mycobacterium bovis subsp bovis AF2122/97
cgccggcgccgaac

SEQ ID NO: 1078167 - RNA, 15 nt, Mycobacterium bovis subsp bovis AF2122/97
cgccggcgccaccgu

SEQ ID NO: 1078168 - RNA, 17 nt, Mycobacterium bovis subsp bovis AF2122/97
cgccggcgccaccgucg

SEQ ID NO: 1078169 - RNA, 23 nt, Mycobacterium bovis subsp bovis AF2122/97
cgccggcgccaccgucgccguac

SEQ ID NO: 1078170 - RNA, 23 nt, Mycobacterium bovis subsp bovis AF2122/97
cgccggcgccaccguugccgaac

SEQ ID NO: 1078171 - RNA, 22 nt, Mycobacterium bovis subsp bovis AF2122/97
cgccggcgccagcagaucuccg

SEQ ID NO: 1078172 - RNA, 15 nt, Mycobacterium bovis subsp bovis AF2122/97
cgccggcgccagcgc

SEQ ID NO: 1078173 - RNA, 19 nt, Mycobacterium bovis subsp bovis AF2122/97
cgccggcgccagcgccgcc

SEQ ID NO: 1078174 - RNA, 20 nt, Mycobacterium bovis subsp bovis AF2122/97
cgccggcgccagcgccgcca

SEQ ID NO: 1078175 - RNA, 22 nt, Mycobacterium bovis subsp bovis AF2122/97
cgccggcgccagcgccgccacc

SEQ ID NO: 1078176 - RNA, 13 nt, Mycobacterium bovis subsp bovis AF2122/97
cgccggcgccggc

SEQ ID NO: 1078177 - RNA, 14 nt, Mycobacterium bovis subsp bovis AF2122/97
cgccggcgccggca

SEQ ID NO: 1078178 - RNA, 16 nt, Mycobacterium bovis subsp bovis AF2122/97
cgccggccaccagccg

SEQ ID NO: 1078179 - RNA, 18 nt, Mycobacterium bovis subsp bovis AF2122/97
cgccggcggacgcccggc

SEQ ID NO: 1078180 - RNA, 19 nt, Mycobacterium bovis subsp bovis AF2122/97
cgccggcggacgcccggcg

SEQ ID NO: 1078181 - RNA, 14 nt, Mycobacterium bovis subsp bovis AF2122/97
cgccggcgccgccc

SEQ ID NO: 1078182 - RNA, 15 nt, Mycobacterium bovis subsp bovis AF2122/97
cgccggcgccgccca

SEQ ID NO: 1078183 - RNA, 16 nt, Mycobacterium bovis subsp bovis AF2122/97
cgccggcgccgcccgc

SEQ ID NO: 1078184 - RNA, 17 nt, Mycobacterium bovis subsp bovis AF2122/97
cgccggcgccgccgaug

SEQ ID NO: 1078185 - RNA, 20 nt, Mycobacterium bovis subsp bovis AF2122/97
cgccggcgccgccgaugccg

SEQ ID NO: 1078186 - RNA, 17 nt, Mycobacterium bovis subsp bovis AF2122/97
cgccggcgccgccggcg

SEQ ID NO: 1078187 - RNA, 17 nt, Mycobacterium bovis subsp bovis AF2122/97
cgccggcgccgccguuc

SEQ ID NO: 1078188 - RNA, 23 nt, Mycobacterium bovis subsp bovis AF2122/97
cgccggcgccgccguucccgccg

SEQ ID NO: 1078189 - RNA, 19 nt, Mycobacterium bovis subsp bovis AF2122/97
cgccggcggccgcggugcc

SEQ ID NO: 1078190 - RNA, 13 nt, Mycobacterium bovis subsp bovis AF2122/97
aacaccgacgaca

SEQ ID NO: 1078191 - RNA, 13 nt, Mycobacterium bovis subsp bovis AF2122/97
aacaccgacgacg

SEQ ID NO: 1078192 - RNA, 11 nt, Mycobacterium bovis subsp bovis AF2122/97
aacaccgcacg

SEQ ID NO: 1078193 - RNA, 18 nt, Mycobacterium bovis subsp bovis AF2122/97
cgccggcggguggccccc

SEQ ID NO: 1078194 - RNA, 19 nt, Mycobacterium bovis subsp bovis AF2122/97
cgccggcggguggcccccg

SEQ ID NO: 1078195 - RNA, 16 nt, Mycobacterium bovis subsp bovis AF2122/97
cgccggcgggcugucg

SEQ ID NO: 1078196 - RNA, 20 nt, Mycobacterium bovis subsp bovis AF2122/97
aacaccgccagcaugacacc

SEQ ID NO: 1078197 - RNA, 15 nt, Mycobacterium bovis subsp bovis AF2122/97
cgccggcgggcgagu

SEQ ID NO: 1078198 - RNA, 20 nt, Mycobacterium bovis subsp bovis AF2122/97
cgccggcgggcgcgggcgcc

SEQ ID NO: 1078199 - RNA, 21 nt, Mycobacterium bovis subsp bovis AF2122/97
cgccggcgggcgcgggcgccg

SEQ ID NO: 1078200 - RNA, 21 nt, Mycobacterium bovis subsp bovis AF2122/97
cgccggcgguagucggccagc

SEQ ID NO: 1078201 - RNA, 13 nt, Mycobacterium bovis subsp bovis AF2122/97
cgccggcggucgc

SEQ ID NO: 1078202 - RNA, 15 nt, Mycobacterium bovis subsp bovis AF2122/97
cgccggcggugaugu

SEQ ID NO: 1078203 - RNA, 16 nt, Mycobacterium bovis subsp bovis AF2122/97
cgccggcgucggcgcc

SEQ ID NO: 1078204 - RNA, 22 nt, Mycobacterium bovis subsp bovis AF2122/97
cgccggcgucggcgcccagcuc

SEQ ID NO: 1078205 - RNA, 15 nt, Mycobacterium bovis subsp bovis AF2122/97
cgccggcgucgagcc

SEQ ID NO: 1078206 - RNA, 20 nt, Mycobacterium bovis subsp bovis AF2122/97
cgccggcuccacccuugccg

SEQ ID NO: 1078207 - RNA, 22 nt, Mycobacterium bovis subsp bovis AF2122/97
cgccggcuaccgccuugucggc

SEQ ID NO: 1078208 - RNA, 21 nt, Mycobacterium bovis subsp bovis AF2122/97
cgccggcuccgccacuggcgc

SEQ ID NO: 1078209 - RNA, 23 nt, Mycobacterium bovis subsp bovis AF2122/97
cgccggcuccgccacuggcgccg

SEQ ID NO: 1078210 - RNA, 14 nt, Mycobacterium bovis subsp bovis AF2122/97
cgccggcuccggcg

SEQ ID NO: 1078211 - RNA, 18 nt, Mycobacterium bovis subsp bovis AF2122/97
cgccggcuccggcggugc

SEQ ID NO: 1078212 - RNA, 22 nt, Mycobacterium bovis subsp bovis AF2122/97
cgccggcucgucgauccccgca

SEQ ID NO: 1078213 - RNA, 20 nt, Mycobacterium bovis subsp bovis AF2122/97
cgccggcucuccggugauca

SEQ ID NO: 1078214 - RNA, 23 nt, Mycobacterium bovis subsp bovis AF2122/97
cgccggcucuccggugaucaccg

SEQ ID NO: 1078215 - RNA, 13 nt, Mycobacterium bovis subsp bovis AF2122/97
cgccggcugccac

SEQ ID NO: 1078216 - RNA, 20 nt, Mycobacterium bovis subsp bovis AF2122/97
cgccggcugccacacaggcg

SEQ ID NO: 1078217 - RNA, 22 nt, Mycobacterium bovis subsp bovis AF2122/97
cgccggcuucggguguucgcgc

SEQ ID NO: 1078218 - RNA, 17 nt, Mycobacterium bovis subsp bovis AF2122/97
cgccggcuucgcccaga

SEQ ID NO: 1078219 - RNA, 23 nt, Mycobacterium bovis subsp bovis AF2122/97
cgccggcuucgcccagagccgcu

SEQ ID NO: 1078220 - RNA, 20 nt, Mycobacterium bovis subsp bovis AF2122/97
cgccggcuuggauaccguca

SEQ ID NO: 1078221 - RNA, 17 nt, Mycobacterium bovis subsp bovis AF2122/97
cgccgggaaacaccggc

SEQ ID NO: 1078222 - RNA, 18 nt, Mycobacterium bovis subsp bovis AF2122/97
cgccgggaaacaccggcu

SEQ ID NO: 1078223 - RNA, 17 nt, Mycobacterium bovis subsp bovis AF2122/97
cgccggauucgaugaca

SEQ ID NO: 1078224 - RNA, 17 nt, Mycobacterium bovis subsp bovis AF2122/97
cgccggacugcggcccg

SEQ ID NO: 1078225 - RNA, 22 nt, Mycobacterium bovis subsp bovis AF2122/97
cgccggauucgcccgggcguug

SEQ ID NO: 1078226 - RNA, 17 nt, Mycobacterium bovis subsp bovis AF2122/97
cgccggcaacccagugu

SEQ ID NO: 1078227 - RNA, 15 nt, Mycobacterium bovis subsp bovis AF2122/97
cgccggcaaccggga

SEQ ID NO: 1078228 - RNA, 14 nt, Mycobacterium bovis subsp bovis AF2122/97
cgccggcaacgcgg

SEQ ID NO: 1078229 - RNA, 16 nt, Mycobacterium bovis subsp bovis AF2122/97
cgccggcaauaccgcc

SEQ ID NO: 1078230 - RNA, 21 nt, Mycobacterium bovis subsp bovis AF2122/97
cgccggcaauaccgccagcgc

SEQ ID NO: 1078231 - RNA, 22 nt, Mycobacterium bovis subsp bovis AF2122/97
cgccggcaauaccgccagcgcc

SEQ ID NO: 1078232 - RNA, 23 nt, Mycobacterium bovis subsp bovis AF2122/97
cgccggcaauaccgccagcgcca

SEQ ID NO: 1078233 - RNA, 15 nt, Mycobacterium bovis subsp bovis AF2122/97
cgccggcacccgccg

SEQ ID NO: 1078234 - RNA, 13 nt, Mycobacterium bovis subsp bovis AF2122/97
cgccggcaccgac

SEQ ID NO: 1078235 - RNA, 14 nt, Mycobacterium bovis subsp bovis AF2122/97
cgccggcaccgacg

SEQ ID NO: 1078236 - RNA, 17 nt, Mycobacterium bovis subsp bovis AF2122/97
cgccggcaccgacgucg

SEQ ID NO: 1078237 - RNA, 11 nt, Mycobacterium bovis subsp bovis AF2122/97
cgccggcaccg

SEQ ID NO: 1078238 - RNA, 14 nt, Mycobacterium bovis subsp bovis AF2122/97
cgccggcaccgcca

SEQ ID NO: 1078239 - RNA, 14 nt, Mycobacterium bovis subsp bovis AF2122/97
cgccggcaccgccg

SEQ ID NO: 1078240 - RNA, 17 nt, Mycobacterium bovis subsp bovis AF2122/97
cgccggcaccgccgccc

SEQ ID NO: 1078241 - RNA, 17 nt, Mycobacterium bovis subsp bovis AF2122/97
cgccggcaccgccggcg

SEQ ID NO: 1078242 - RNA, 14 nt, Mycobacterium bovis subsp bovis AF2122/97
cgccggcaccggcc

SEQ ID NO: 1078243 - RNA, 13 nt, Mycobacterium bovis subsp bovis AF2122/97
cgccggcaccggg

SEQ ID NO: 1078244 - RNA, 15 nt, Mycobacterium bovis subsp bovis AF2122/97
cgccggcaucgcgca

SEQ ID NO: 1078245 - RNA, 16 nt, Mycobacterium bovis subsp bovis AF2122/97
cgccggcaucgcgcgc

SEQ ID NO: 1078246 - RNA, 22 nt, Mycobacterium bovis subsp bovis AF2122/97
cgccggcaucggucagcgcggc

SEQ ID NO: 1078247 - RNA, 17 nt, Mycobacterium bovis subsp bovis AF2122/97
cgccggcaucgucgacg

SEQ ID NO: 1078248 - RNA, 16 nt, Mycobacterium bovis subsp bovis AF2122/97
cgccggcaugccagcc

SEQ ID NO: 1078249 - RNA, 16 nt, Mycobacterium bovis subsp bovis AF2122/97
cgccggcaucuccacc

SEQ ID NO: 1078250 - RNA, 19 nt, Mycobacterium bovis subsp bovis AF2122/97
cgccggcaucuccaccguc

SEQ ID NO: 1078251 - RNA, 22 nt, Mycobacterium bovis subsp bovis AF2122/97
cgccggcaucuccaccgucgcc

SEQ ID NO: 1078252 - RNA, 12 nt, Mycobacterium bovis subsp bovis AF2122/97
cgccggccaccc

SEQ ID NO: 1078253 - RNA, 13 nt, Mycobacterium bovis subsp bovis AF2122/97
cgccggccacccg

SEQ ID NO: 1078254 - RNA, 14 nt, Mycobacterium bovis subsp bovis AF2122/97
cgccggccacccgc

SEQ ID NO: 1078255 - RNA, 18 nt, Mycobacterium bovis subsp bovis AF2122/97
cgccggccacccgcgcga

SEQ ID NO: 1078256 - RNA, 17 nt, Mycobacterium bovis subsp bovis AF2122/97
cgccggcaugccagcca

SEQ ID NO: 1078257 - RNA, 14 nt, Mycobacterium bovis subsp bovis AF2122/97
cgccggccaccagc

SEQ ID NO: 1078258 - RNA, 12 nt, Mycobacterium bovis subsp bovis AF2122/97
cgccggccagcg

SEQ ID NO: 1078259 - RNA, 16 nt, Mycobacterium bovis subsp bovis AF2122/97
cgccggccagcggcca

SEQ ID NO: 1078260 - RNA, 22 nt, Mycobacterium bovis subsp bovis AF2122/97
cgccggccagcggccauccggc

SEQ ID NO: 1078261 - RNA, 14 nt, Mycobacterium bovis subsp bovis AF2122/97
cgccggccagcguc

SEQ ID NO: 1078262 - RNA, 15 nt, Mycobacterium bovis subsp bovis AF2122/97
cgccggccagcgucg

SEQ ID NO: 1078263 - RNA, 16 nt, Mycobacterium bovis subsp bovis AF2122/97
cgccggccagcgucgc

SEQ ID NO: 1078264 - RNA, 12 nt, Mycobacterium bovis subsp bovis AF2122/97
cgccggccacca

SEQ ID NO: 1078265 - RNA, 15 nt, Mycobacterium bovis subsp bovis AF2122/97
cgccggagccgccca

SEQ ID NO: 1078266 - RNA, 16 nt, Mycobacterium bovis subsp bovis AF2122/97
cgccggagccgcccaa

SEQ ID NO: 1078267 - RNA, 22 nt, Mycobacterium bovis subsp bovis AF2122/97
cgccggagaugaucauguggug

SEQ ID NO: 1078268 - RNA, 15 nt, Mycobacterium bovis subsp bovis AF2122/97
cgccggagccaacgg

SEQ ID NO: 1078269 - RNA, 20 nt, Mycobacterium bovis subsp bovis AF2122/97
cgccggagccaacggccaag

SEQ ID NO: 1078270 - RNA, 22 nt, Mycobacterium bovis subsp bovis AF2122/97
cgccggagaucuugcgcaaugc

SEQ ID NO: 1078271 - RNA, 14 nt, Mycobacterium bovis subsp bovis AF2122/97
cgccggagaugauc

SEQ ID NO: 1078272 - RNA, 15 nt, Mycobacterium bovis subsp bovis AF2122/97
cgccggagacccggg

SEQ ID NO: 1078273 - RNA, 23 nt, Mycobacterium bovis subsp bovis AF2122/97
cgccggagacccgggugcuguga

SEQ ID NO: 1078274 - RNA, 16 nt, Mycobacterium bovis subsp bovis AF2122/97
cgccggacccgccggg

SEQ ID NO: 1078275 - RNA, 14 nt, Mycobacterium bovis subsp bovis AF2122/97
cgccggacccgucg

SEQ ID NO: 1078276 - RNA, 19 nt, Mycobacterium bovis subsp bovis AF2122/97
cgccggaccgguguggcgc

SEQ ID NO: 1078277 - RNA, 13 nt, Mycobacterium bovis subsp bovis AF2122/97
cgccggacgggug

SEQ ID NO: 1078278 - RNA, 16 nt, Mycobacterium bovis subsp bovis AF2122/97
cgccgcuugacgcagc

SEQ ID NO: 1078279 - RNA, 17 nt, Mycobacterium bovis subsp bovis AF2122/97
cgccgcuugacgcagcu

SEQ ID NO: 1078280 - RNA, 18 nt, Mycobacterium bovis subsp bovis AF2122/97
cgccgcuugacgcagcuc

SEQ ID NO: 1078281 - RNA, 20 nt, Mycobacterium bovis subsp bovis AF2122/97
cgccgcuuucgccggcgcca

SEQ ID NO: 1078282 - RNA, 22 nt, Mycobacterium bovis subsp bovis AF2122/97
cgccgcuuucuuggcgggcgcc

SEQ ID NO: 1078283 - RNA, 21 nt, Mycobacterium bovis subsp bovis AF2122/97
cgccgcuguugaucgacaccg

SEQ ID NO: 1078284 - RNA, 20 nt, Mycobacterium bovis subsp bovis AF2122/97
cgccgcugggugaccaggaa

SEQ ID NO: 1078285 - RNA, 20 nt, Mycobacterium bovis subsp bovis AF2122/97
cgccgcuaccccagccggca

SEQ ID NO: 1078286 - RNA, 21 nt, Mycobacterium bovis subsp bovis AF2122/97
cgccgcuaccccagccggcag

SEQ ID NO: 1078287 - RNA, 16 nt, Mycobacterium bovis subsp bovis AF2122/97
cgccgcgucuaccaac

SEQ ID NO: 1078288 - RNA, 19 nt, Mycobacterium bovis subsp bovis AF2122/97
cgccgcgugcugcggcugg

SEQ ID NO: 1078289 - RNA, 19 nt, Mycobacterium bovis subsp bovis AF2122/97
cgccgcguggcuggcggcg

SEQ ID NO: 1078290 - RNA, 20 nt, Mycobacterium bovis subsp bovis AF2122/97
cgccgcgugguuccggcgug

SEQ ID NO: 1078291 - RNA, 19 nt, Mycobacterium bovis subsp bovis AF2122/97
cgccgcuaacgcaccugcg

SEQ ID NO: 1078292 - RNA, 17 nt, Mycobacterium bovis subsp bovis AF2122/97
cgccgcuaaccggaccu

SEQ ID NO: 1078293 - RNA, 15 nt, Mycobacterium bovis subsp bovis AF2122/97
cgccgcuaacgcacc

SEQ ID NO: 1078294 - RNA, 12 nt, Mycobacterium bovis subsp bovis AF2122/97
cgccgucgaacc

SEQ ID NO: 1078295 - RNA, 15 nt, Mycobacterium bovis subsp bovis AF2122/97
cgccgucgaccggcg

SEQ ID NO: 1078296 - RNA, 12 nt, Mycobacterium bovis subsp bovis AF2122/97
cgccgucgacgu

SEQ ID NO: 1078297 - RNA, 12 nt, Mycobacterium bovis subsp bovis AF2122/97
cgccgucggccg

SEQ ID NO: 1078298 - RNA, 13 nt, Mycobacterium bovis subsp bovis AF2122/97
cgccgucggcgac

SEQ ID NO: 1078299 - RNA, 12 nt, Mycobacterium bovis subsp bovis AF2122/97
cgccgucggcgc

SEQ ID NO: 1078300 - RNA, 17 nt, Mycobacterium bovis subsp bovis AF2122/97
cgccgucggcgccggca

SEQ ID NO: 1078301 - RNA, 13 nt, Mycobacterium bovis subsp bovis AF2122/97
cgccgucggcgcg

SEQ ID NO: 1078302 - RNA, 16 nt, Mycobacterium bovis subsp bovis AF2122/97
cgccgucggacaccgc

SEQ ID NO: 1078303 - RNA, 18 nt, Mycobacterium bovis subsp bovis AF2122/97
cgccgucggagccggcca

SEQ ID NO: 1078304 - RNA, 19 nt, Mycobacterium bovis subsp bovis AF2122/97
cgccgucggagccggccac

SEQ ID NO: 1078305 - RNA, 22 nt, Mycobacterium bovis subsp bovis AF2122/97
cgccgucggagccggccaccuc

SEQ ID NO: 1078306 - RNA, 18 nt, Mycobacterium bovis subsp bovis AF2122/97
cgccgucgaccggcggga

SEQ ID NO: 1078307 - RNA, 15 nt, Mycobacterium bovis subsp bovis AF2122/97
cgccgucggcgcgca

SEQ ID NO: 1078308 - RNA, 22 nt, Mycobacterium bovis subsp bovis AF2122/97
cgccgucggugggugccagccg

SEQ ID NO: 1078309 - RNA, 17 nt, Mycobacterium bovis subsp bovis AF2122/97
cgccgucggugccgccg

SEQ ID NO: 1078310 - RNA, 19 nt, Mycobacterium bovis subsp bovis AF2122/97
cgccgucggugccgccgcc

SEQ ID NO: 1078311 - RNA, 20 nt, Mycobacterium bovis subsp bovis AF2122/97
cgccgucggugccgccgccg

SEQ ID NO: 1078312 - RNA, 17 nt, Mycobacterium bovis subsp bovis AF2122/97
cgccgucggcggugagc

SEQ ID NO: 1078313 - RNA, 16 nt, Mycobacterium bovis subsp bovis AF2122/97
cgccgucgugccaccg

SEQ ID NO: 1078314 - RNA, 17 nt, Mycobacterium bovis subsp bovis AF2122/97
cgccgucgugccaccgu

SEQ ID NO: 1078315 - RNA, 22 nt, Mycobacterium bovis subsp bovis AF2122/97
cgccgucguugcccgacccgcc

SEQ ID NO: 1078316 - RNA, 20 nt, Mycobacterium bovis subsp bovis AF2122/97
cgccgucguugugccggucg

SEQ ID NO: 1078317 - RNA, 20 nt, Mycobacterium bovis subsp bovis AF2122/97
cgccgucuagcacacgcuug

SEQ ID NO: 1078318 - RNA, 17 nt, Mycobacterium bovis subsp bovis AF2122/97
cgccgucucugccacgc

SEQ ID NO: 1078319 - RNA, 15 nt, Mycobacterium bovis subsp bovis AF2122/97
cgccgucucugccac

SEQ ID NO: 1078320 - RNA, 15 nt, Mycobacterium bovis subsp bovis AF2122/97
cgccgucucgcggug

SEQ ID NO: 1078321 - RNA, 16 nt, Mycobacterium bovis subsp bovis AF2122/97
cgccgucucgcggugc

SEQ ID NO: 1078322 - RNA, 22 nt, Mycobacterium bovis subsp bovis AF2122/97
cgccgucucgcggugcggcaac

SEQ ID NO: 1078323 - RNA, 15 nt, Mycobacterium bovis subsp bovis AF2122/97
cgccgucucgaagcu

SEQ ID NO: 1078324 - RNA, 15 nt, Mycobacterium bovis subsp bovis AF2122/97
cgccgucgucgcgca

SEQ ID NO: 1078325 - RNA, 17 nt, Mycobacterium bovis subsp bovis AF2122/97
cgccgugaccaggugcc

SEQ ID NO: 1078326 - RNA, 23 nt, Mycobacterium bovis subsp bovis AF2122/97
cgccgugaccaggugccaggaug

SEQ ID NO: 1078327 - RNA, 22 nt, Mycobacterium bovis subsp bovis AF2122/97
cgccgugcugggugacaccggu

SEQ ID NO: 1078328 - RNA, 21 nt, Mycobacterium bovis subsp bovis AF2122/97
cgccguggacgaucaacccgg

SEQ ID NO: 1078329 - RNA, 13 nt, Mycobacterium bovis subsp bovis AF2122/97
cgccguggccgca

SEQ ID NO: 1078330 - RNA, 13 nt, Mycobacterium bovis subsp bovis AF2122/97
cgccguggcccgc

SEQ ID NO: 1078331 - RNA, 15 nt, Mycobacterium bovis subsp bovis AF2122/97
cgccguggcgcgguc

SEQ ID NO: 1078332 - RNA, 16 nt, Mycobacterium bovis subsp bovis AF2122/97
cgccguggcgcggucg

SEQ ID NO: 1078333 - RNA, 14 nt, Mycobacterium bovis subsp bovis AF2122/97
cgccguggccugaa

SEQ ID NO: 1078334 - RNA, 16 nt, Mycobacterium bovis subsp bovis AF2122/97
cgccguggcgucggug

SEQ ID NO: 1078335 - RNA, 17 nt, Mycobacterium bovis subsp bovis AF2122/97
cgccguggcgucggugg

SEQ ID NO: 1078336 - RNA, 12 nt, Mycobacterium bovis subsp bovis AF2122/97
cgccguggugcg

SEQ ID NO: 1078337 - RNA, 19 nt, Mycobacterium bovis subsp bovis AF2122/97
cgccgugguugcacguucg

SEQ ID NO: 1078338 - RNA, 22 nt, Mycobacterium bovis subsp bovis AF2122/97
cgccgugguugcacguucggcg

SEQ ID NO: 1078339 - RNA, 15 nt, Mycobacterium bovis subsp bovis AF2122/97
cgccgugggccuguu

SEQ ID NO: 1078340 - RNA, 15 nt, Mycobacterium bovis subsp bovis AF2122/97
cgccguggguguuga

SEQ ID NO: 1078341 - RNA, 18 nt, Mycobacterium bovis subsp bovis AF2122/97
cgccguggugcgcauggc

SEQ ID NO: 1078342 - RNA, 23 nt, Mycobacterium bovis subsp bovis AF2122/97
cgccgucuuggcccgguccgcca

SEQ ID NO: 1078343 - RNA, 22 nt, Mycobacterium bovis subsp bovis AF2122/97
cgccgugacccauucucggccg

SEQ ID NO: 1078344 - RNA, 20 nt, Mycobacterium bovis subsp bovis AF2122/97
cgccgugaucagcucgcgca

SEQ ID NO: 1078345 - RNA, 19 nt, Mycobacterium bovis subsp bovis AF2122/97
cgccgugaguucacguucg

SEQ ID NO: 1078346 - RNA, 17 nt, Mycobacterium bovis subsp bovis AF2122/97
cgccgugaucagcucgc

SEQ ID NO: 1078347 - RNA, 14 nt, Mycobacterium bovis subsp bovis AF2122/97
cgccgugcccccgg

SEQ ID NO: 1078348 - RNA, 16 nt, Mycobacterium bovis subsp bovis AF2122/97
cgccgugccgcggcga

SEQ ID NO: 1078349 - RNA, 12 nt, Mycobacterium bovis subsp bovis AF2122/97
cgccgugcgccg

SEQ ID NO: 1078350 - RNA, 14 nt, Mycobacterium bovis subsp bovis AF2122/97
cgccgggcacgaac

SEQ ID NO: 1078351 - RNA, 16 nt, Mycobacterium bovis subsp bovis AF2122/97
cgccgggcaucggcgg

SEQ ID NO: 1078352 - RNA, 15 nt, Mycobacterium bovis subsp bovis AF2122/97
cgccgggccaggccg

SEQ ID NO: 1078353 - RNA, 14 nt, Mycobacterium bovis subsp bovis AF2122/97
cgccgggcaucggu

SEQ ID NO: 1078354 - RNA, 15 nt, Mycobacterium bovis subsp bovis AF2122/97
cgccgggcaacgcga

SEQ ID NO: 1078355 - RNA, 17 nt, Mycobacterium bovis subsp bovis AF2122/97
cgccgggcaacgcgaac

SEQ ID NO: 1078356 - RNA, 22 nt, Mycobacterium bovis subsp bovis AF2122/97
cgccgggcaaggccaccgucgc

SEQ ID NO: 1078357 - RNA, 22 nt, Mycobacterium bovis subsp bovis AF2122/97
cgccgggauuaugccggcaacc

SEQ ID NO: 1078358 - RNA, 16 nt, Mycobacterium bovis subsp bovis AF2122/97
cgccggcuggcggccu

SEQ ID NO: 1078359 - RNA, 16 nt, Mycobacterium bovis subsp bovis AF2122/97
cgccgggaacauccca

SEQ ID NO: 1078360 - RNA, 17 nt, Mycobacterium bovis subsp bovis AF2122/97
cgccgggauaucgucga

SEQ ID NO: 1078361 - RNA, 13 nt, Mycobacterium bovis subsp bovis AF2122/97
cgccggucgucag

SEQ ID NO: 1078362 - RNA, 22 nt, Mycobacterium bovis subsp bovis AF2122/97
cgccggugccgccugcgccgcc

SEQ ID NO: 1078363 - RNA, 23 nt, Mycobacterium bovis subsp bovis AF2122/97
cgccggugccgccugcgccgcca

SEQ ID NO: 1078364 - RNA, 22 nt, Mycobacterium bovis subsp bovis AF2122/97
cgccggugccggccagacucgc

SEQ ID NO: 1078365 - RNA, 21 nt, Mycobacterium bovis subsp bovis AF2122/97
cgccggugcggacuucgaugu

SEQ ID NO: 1078366 - RNA, 11 nt, Mycobacterium bovis subsp bovis AF2122/97
cgccgguggca

SEQ ID NO: 1078367 - RNA, 12 nt, Mycobacterium bovis subsp bovis AF2122/97
cgccggugcuga

SEQ ID NO: 1078368 - RNA, 22 nt, Mycobacterium bovis subsp bovis AF2122/97
cgccggugacgaugaccgcgcg

SEQ ID NO: 1078369 - RNA, 16 nt, Mycobacterium bovis subsp bovis AF2122/97
cgccggugccgccggg

SEQ ID NO: 1078370 - RNA, 23 nt, Mycobacterium bovis subsp bovis AF2122/97
cgccggugccgccgucgccgcca

SEQ ID NO: 1078371 - RNA, 17 nt, Mycobacterium bovis subsp bovis AF2122/97
cgccggugacgacgucg

SEQ ID NO: 1078372 - RNA, 23 nt, Mycobacterium bovis subsp bovis AF2122/97
cgccggugacgggguugaccgcc

SEQ ID NO: 1078373 - RNA, 16 nt, Mycobacterium bovis subsp bovis AF2122/97
cgccgucagaacaccg

SEQ ID NO: 1078374 - RNA, 22 nt, Mycobacterium bovis subsp bovis AF2122/97
cgccgucaccgucauugccacc

SEQ ID NO: 1078375 - RNA, 18 nt, Mycobacterium bovis subsp bovis AF2122/97
cgccgucaccgcccuugc

SEQ ID NO: 1078376 - RNA, 14 nt, Mycobacterium bovis subsp bovis AF2122/97
cgccgucaccgccg

SEQ ID NO: 1078377 - RNA, 19 nt, Mycobacterium bovis subsp bovis AF2122/97
cgccgucaccgaucgaaca

SEQ ID NO: 1078378 - RNA, 18 nt, Mycobacterium bovis subsp bovis AF2122/97
cgccgucaccgccguugc

SEQ ID NO: 1078379 - RNA, 18 nt, Mycobacterium bovis subsp bovis AF2122/97
cgccgucagaacaccggc

SEQ ID NO: 1078380 - RNA, 15 nt, Mycobacterium bovis subsp bovis AF2122/97
cgccgucagcccagg

SEQ ID NO: 1078381 - RNA, 17 nt, Mycobacterium bovis subsp bovis AF2122/97
cgccgucagcccaggug

SEQ ID NO: 1078382 - RNA, 21 nt, Mycobacterium bovis subsp bovis AF2122/97
cgccgucccgauacggccggc

SEQ ID NO: 1078383 - RNA, 23 nt, Mycobacterium bovis subsp bovis AF2122/97
cgccgucccgauacggccggccg

SEQ ID NO: 1078384 - RNA, 19 nt, Mycobacterium bovis subsp bovis AF2122/97
cgccggugugcgcaccccg

SEQ ID NO: 1078385 - RNA, 13 nt, Mycobacterium bovis subsp bovis AF2122/97
cgccggugucggg

SEQ ID NO: 1078386 - RNA, 17 nt, Mycobacterium bovis subsp bovis AF2122/97
cgccggugucgggcugu

SEQ ID NO: 1078387 - RNA, 14 nt, Mycobacterium bovis subsp bovis AF2122/97
cgccgguguugccg

SEQ ID NO: 1078388 - RNA, 18 nt, Mycobacterium bovis subsp bovis AF2122/97
cgccgguuacccggaccg

SEQ ID NO: 1078389 - RNA, 14 nt, Mycobacterium bovis subsp bovis AF2122/97
cgccgguucagacg

SEQ ID NO: 1078390 - RNA, 19 nt, Mycobacterium bovis subsp bovis AF2122/97
cgccgguguccuuggccgc

SEQ ID NO: 1078391 - RNA, 22 nt, Mycobacterium bovis subsp bovis AF2122/97
cgccgguguccuuggccgccac

SEQ ID NO: 1078392 - RNA, 18 nt, Mycobacterium bovis subsp bovis AF2122/97
cgccgguuccgccggccc

SEQ ID NO: 1078393 - RNA, 20 nt, Mycobacterium bovis subsp bovis AF2122/97
cgccgguuccgccggcccca

SEQ ID NO: 1078394 - RNA, 23 nt, Mycobacterium bovis subsp bovis AF2122/97
cgccgguuccgccggccccaccg

SEQ ID NO: 1078395 - RNA, 20 nt, Mycobacterium bovis subsp bovis AF2122/97
cgccgguggccgcgcugguc

SEQ ID NO: 1078396 - RNA, 14 nt, Mycobacterium bovis subsp bovis AF2122/97
cgccgguggcgccg

SEQ ID NO: 1078397 - RNA, 20 nt, Mycobacterium bovis subsp bovis AF2122/97
cgccgguggcagagccgccg

SEQ ID NO: 1078398 - RNA, 21 nt, Mycobacterium bovis subsp bovis AF2122/97
cgccgguggcagagccgccgu

SEQ ID NO: 1078399 - RNA, 17 nt, Mycobacterium bovis subsp bovis AF2122/97
cgccgguggcacccgcg

SEQ ID NO: 1078400 - RNA, 20 nt, Mycobacterium bovis subsp bovis AF2122/97
cgccgguggcacccgcgucg

SEQ ID NO: 1078401 - RNA, 16 nt, Mycobacterium bovis subsp bovis AF2122/97
cgccgguggugccggc

SEQ ID NO: 1078402 - RNA, 18 nt, Mycobacterium bovis subsp bovis AF2122/97
cgccgguggugccggcgc

SEQ ID NO: 1078403 - RNA, 22 nt, Mycobacterium bovis subsp bovis AF2122/97
cgccgguggugccggcgccgcc

SEQ ID NO: 1078404 - RNA, 14 nt, Mycobacterium bovis subsp bovis AF2122/97
cgccggugguaccg

SEQ ID NO: 1078405 - RNA, 17 nt, Mycobacterium bovis subsp bovis AF2122/97
cgccggugguaccggcg

SEQ ID NO: 1078406 - RNA, 19 nt, Mycobacterium bovis subsp bovis AF2122/97
cgccggugguaccggcggc

SEQ ID NO: 1078407 - RNA, 20 nt, Mycobacterium bovis subsp bovis AF2122/97
cgccggugguaccggcggcg

SEQ ID NO: 1078408 - RNA, 21 nt, Mycobacterium bovis subsp bovis AF2122/97
cgccggugggcgguccgcguc

SEQ ID NO: 1078409 - RNA, 18 nt, Mycobacterium bovis subsp bovis AF2122/97
cgccgguggggucggucu

SEQ ID NO: 1078410 - RNA, 20 nt, Mycobacterium bovis subsp bovis AF2122/97
cgccucgagguauucgcgca

SEQ ID NO: 1078411 - RNA, 16 nt, Mycobacterium bovis subsp bovis AF2122/97
cgccuccaccgccgcg

SEQ ID NO: 1078412 - RNA, 20 nt, Mycobacterium bovis subsp bovis AF2122/97
cgccucgauggcgguggcga

SEQ ID NO: 1078413 - RNA, 23 nt, Mycobacterium bovis subsp bovis AF2122/97
cgccucgauggcgguggcgaggu

SEQ ID NO: 1078414 - RNA, 23 nt, Mycobacterium bovis subsp bovis AF2122/97
cgccucgaugguuuucucgaagu

SEQ ID NO: 1078415 - RNA, 20 nt, Mycobacterium bovis subsp bovis AF2122/97
cgccucgcccagcaaggccc

SEQ ID NO: 1078416 - RNA, 15 nt, Mycobacterium bovis subsp bovis AF2122/97
cgccucgccggccac

SEQ ID NO: 1078417 - RNA, 19 nt, Mycobacterium bovis subsp bovis AF2122/97
cgccucggacacggcagcc

SEQ ID NO: 1078418 - RNA, 18 nt, Mycobacterium bovis subsp bovis AF2122/97
cgccuauccaaagacccc

SEQ ID NO: 1078419 - RNA, 22 nt, Mycobacterium bovis subsp bovis AF2122/97
cgccuagcgagcgcacaccggc

SEQ ID NO: 1078420 - RNA, 23 nt, Mycobacterium bovis subsp bovis AF2122/97
cgccuagcgagcgcacaccggcu

SEQ ID NO: 1078421 - RNA, 21 nt, Mycobacterium bovis subsp bovis AF2122/97
cgccuaggaguuccucgaucg

SEQ ID NO: 1078422 - RNA, 19 nt, Mycobacterium bovis subsp bovis AF2122/97
cgccucggcaucgccgcgg

SEQ ID NO: 1078423 - RNA, 17 nt, Mycobacterium bovis subsp bovis AF2122/97
cgccucggcaucgccgc

SEQ ID NO: 1078424 - RNA, 16 nt, Mycobacterium bovis subsp bovis AF2122/97
cgccucggcggccagc

SEQ ID NO: 1078425 - RNA, 19 nt, Mycobacterium bovis subsp bovis AF2122/97
cgccucggcggccagcucg

SEQ ID NO: 1078426 - RNA, 14 nt, Mycobacterium bovis subsp bovis AF2122/97
cgccucggcggcca

SEQ ID NO: 1078427 - RNA, 16 nt, Mycobacterium bovis subsp bovis AF2122/97
cgccucucgguccaca

SEQ ID NO: 1078428 - RNA, 16 nt, Mycobacterium bovis subsp bovis AF2122/97
cgccucugcucagccg

SEQ ID NO: 1078429 - RNA, 12 nt, Mycobacterium bovis subsp bovis AF2122/97
cgccucgugcgu

SEQ ID NO: 1078430 - RNA, 21 nt, Mycobacterium bovis subsp bovis AF2122/97
cgccugaaacgauugcugcgg

SEQ ID NO: 1078431 - RNA, 22 nt, Mycobacterium bovis subsp bovis AF2122/97
cgccugaauaggucgguccgca

SEQ ID NO: 1078432 - RNA, 23 nt, Mycobacterium bovis subsp bovis AF2122/97
cgccugcagguuuccggccugca

SEQ ID NO: 1078433 - RNA, 12 nt, Mycobacterium bovis subsp bovis AF2122/97
cgccugccaccg

SEQ ID NO: 1078434 - RNA, 14 nt, Mycobacterium bovis subsp bovis AF2122/97
cgccugccaccggc

SEQ ID NO: 1078435 - RNA, 15 nt, Mycobacterium bovis subsp bovis AF2122/97
cgccugccaccggcg

SEQ ID NO: 1078436 - RNA, 16 nt, Mycobacterium bovis subsp bovis AF2122/97
cgccugccccacccgc

SEQ ID NO: 1078437 - RNA, 17 nt, Mycobacterium bovis subsp bovis AF2122/97
cgccugccccacccgcg

SEQ ID NO: 1078438 - RNA, 21 nt, Mycobacterium bovis subsp bovis AF2122/97
cgccugcccccgcgcgcacgg

SEQ ID NO: 1078439 - RNA, 23 nt, Mycobacterium bovis subsp bovis AF2122/97
cgccugacgaaguccaccacgac

SEQ ID NO: 1078440 - RNA, 20 nt, Mycobacterium bovis subsp bovis AF2122/97
cgccugacgguaaaugucga

SEQ ID NO: 1078441 - RNA, 14 nt, Mycobacterium bovis subsp bovis AF2122/97
cgccugaccgccac

SEQ ID NO: 1078442 - RNA, 16 nt, Mycobacterium bovis subsp bovis AF2122/97
cgccugaccgccaccg

SEQ ID NO: 1078443 - RNA, 17 nt, Mycobacterium bovis subsp bovis AF2122/97
cgccugaccgccaccgu

SEQ ID NO: 1078444 - RNA, 21 nt, Mycobacterium bovis subsp bovis AF2122/97
cgccugacgaaguccaccacg

SEQ ID NO: 1078445 - RNA, 22 nt, Mycobacterium bovis subsp bovis AF2122/97
cgccguuacggagggcacgggu

SEQ ID NO: 1078446 - RNA, 17 nt, Mycobacterium bovis subsp bovis AF2122/97
cgccguucccaccacca

SEQ ID NO: 1078447 - RNA, 18 nt, Mycobacterium bovis subsp bovis AF2122/97
cgccguucccaccaccac

SEQ ID NO: 1078448 - RNA, 20 nt, Mycobacterium bovis subsp bovis AF2122/97
cgccguucccaccaccaccg

SEQ ID NO: 1078449 - RNA, 17 nt, Mycobacterium bovis subsp bovis AF2122/97
cgccgugugcaucggcg

SEQ ID NO: 1078450 - RNA, 17 nt, Mycobacterium bovis subsp bovis AF2122/97
cgccguuaccgacgccg

SEQ ID NO: 1078451 - RNA, 19 nt, Mycobacterium bovis subsp bovis AF2122/97
cgccguuaccgagcccgaa

SEQ ID NO: 1078452 - RNA, 14 nt, Mycobacterium bovis subsp bovis AF2122/97
cgccguuaccgccg

SEQ ID NO: 1078453 - RNA, 15 nt, Mycobacterium bovis subsp bovis AF2122/97
cgccguuaccgccgc

SEQ ID NO: 1078454 - RNA, 15 nt, Mycobacterium bovis subsp bovis AF2122/97
cgccguuaccgccgu

SEQ ID NO: 1078455 - RNA, 16 nt, Mycobacterium bovis subsp bovis AF2122/97
cgccguuaccgccguu

SEQ ID NO: 1078456 - RNA, 18 nt, Mycobacterium bovis subsp bovis AF2122/97
cgccguuaccgccguugc

SEQ ID NO: 1078457 - RNA, 19 nt, Mycobacterium bovis subsp bovis AF2122/97
cgccguucgcucccccgcu

SEQ ID NO: 1078458 - RNA, 21 nt, Mycobacterium bovis subsp bovis AF2122/97
cgccguucgcucccccgcuac

SEQ ID NO: 1078459 - RNA, 20 nt, Mycobacterium bovis subsp bovis AF2122/97
cgccguucccacccacgccg

SEQ ID NO: 1078460 - RNA, 23 nt, Mycobacterium bovis subsp bovis AF2122/97
cgccguucccaccaccaccgccg

SEQ ID NO: 1078461 - RNA, 17 nt, Mycobacterium bovis subsp bovis AF2122/97
cgccguucccacccacg

SEQ ID NO: 1078462 - RNA, 18 nt, Mycobacterium bovis subsp bovis AF2122/97
cgccguucccgccggcgc

SEQ ID NO: 1078463 - RNA, 20 nt, Mycobacterium bovis subsp bovis AF2122/97
cgccguucccgccggcgccg

SEQ ID NO: 1078464 - RNA, 22 nt, Mycobacterium bovis subsp bovis AF2122/97
cgccguucgcucccccgcuacg

SEQ ID NO: 1078465 - RNA, 19 nt, Mycobacterium bovis subsp bovis AF2122/97
cgccguucucgcgcagguc

SEQ ID NO: 1078466 - RNA, 15 nt, Mycobacterium bovis subsp bovis AF2122/97
cgccguucucgcgca

SEQ ID NO: 1078467 - RNA, 15 nt, Mycobacterium bovis subsp bovis AF2122/97
cgccguugccggcga

SEQ ID NO: 1078468 - RNA, 21 nt, Mycobacterium bovis subsp bovis AF2122/97
cgccguugccggcguugccgc

SEQ ID NO: 1078469 - RNA, 23 nt, Mycobacterium bovis subsp bovis AF2122/97
cgccguugccggcguugccgccg

SEQ ID NO: 1078470 - RNA, 17 nt, Mycobacterium bovis subsp bovis AF2122/97
cgccguugccgccguca

SEQ ID NO: 1078471 - RNA, 18 nt, Mycobacterium bovis subsp bovis AF2122/97
cgccguugccgccgucgc

SEQ ID NO: 1078472 - RNA, 20 nt, Mycobacterium bovis subsp bovis AF2122/97
cgccguugccgccaucaccg

SEQ ID NO: 1078473 - RNA, 14 nt, Mycobacterium bovis subsp bovis AF2122/97
cgccguugccgccc

SEQ ID NO: 1078474 - RNA, 18 nt, Mycobacterium bovis subsp bovis AF2122/97
cgccguugccgccgacgc

SEQ ID NO: 1078475 - RNA, 23 nt, Mycobacterium bovis subsp bovis AF2122/97
cgccguugccgccgacgccgccg

SEQ ID NO: 1078476 - RNA, 15 nt, Mycobacterium bovis subsp bovis AF2122/97
cgccguugccgccgg

SEQ ID NO: 1078477 - RNA, 19 nt, Mycobacterium bovis subsp bovis AF2122/97
cgccguugccgccggcgcc

SEQ ID NO: 1078478 - RNA, 22 nt, Mycobacterium bovis subsp bovis AF2122/97
cgccguugccgccggcgccgcc

SEQ ID NO: 1078479 - RNA, 15 nt, Mycobacterium bovis subsp bovis AF2122/97
cgccguugccgccgu

SEQ ID NO: 1078480 - RNA, 13 nt, Mycobacterium bovis subsp bovis AF2122/97
cgccguugccacc

SEQ ID NO: 1078481 - RNA, 14 nt, Mycobacterium bovis subsp bovis AF2122/97
cgccguugccaccg

SEQ ID NO: 1078482 - RNA, 15 nt, Mycobacterium bovis subsp bovis AF2122/97
cgccguugccaccgg

SEQ ID NO: 1078483 - RNA, 15 nt, Mycobacterium bovis subsp bovis AF2122/97
cgccguugccaccgu

SEQ ID NO: 1078484 - RNA, 15 nt, Mycobacterium bovis subsp bovis AF2122/97
cgccguugcccccgu

SEQ ID NO: 1078485 - RNA, 21 nt, Mycobacterium bovis subsp bovis AF2122/97
cgccguugcccccguugccgc

SEQ ID NO: 1078486 - RNA, 22 nt, Mycobacterium bovis subsp bovis AF2122/97
cgccguugccgaucaccacggc

SEQ ID NO: 1078487 - RNA, 23 nt, Mycobacterium bovis subsp bovis AF2122/97
cgccguugccaccguugccgccg

SEQ ID NO: 1078488 - RNA, 14 nt, Mycobacterium bovis subsp bovis AF2122/97
cgccguugccgcca

SEQ ID NO: 1078489 - RNA, 22 nt, Mycobacterium bovis subsp bovis AF2122/97
cgccguucucgcgcaggucgcc

SEQ ID NO: 1078490 - RNA, 15 nt, Mycobacterium bovis subsp bovis AF2122/97
cgccguugaacggca

SEQ ID NO: 1078491 - RNA, 14 nt, Mycobacterium bovis subsp bovis AF2122/97
cgccguugacgccg

SEQ ID NO: 1078492 - RNA, 15 nt, Mycobacterium bovis subsp bovis AF2122/97
cgccguugacgccgu

SEQ ID NO: 1078493 - RNA, 21 nt, Mycobacterium bovis subsp bovis AF2122/97
cgccguugaacggcaccagcg

SEQ ID NO: 1078494 - RNA, 16 nt, Mycobacterium bovis subsp bovis AF2122/97
cgccguugaugucggc

SEQ ID NO: 1078495 - RNA, 19 nt, Mycobacterium bovis subsp bovis AF2122/97
cgccguugaugucggcagg

SEQ ID NO: 1078496 - RNA, 20 nt, Mycobacterium bovis subsp bovis AF2122/97
cgccguuggcucgagccgcc

SEQ ID NO: 1078497 - RNA, 15 nt, Mycobacterium bovis subsp bovis AF2122/97
cgccguugggccgcg

SEQ ID NO: 1078498 - RNA, 23 nt, Mycobacterium bovis subsp bovis AF2122/97
cgccguuggggccguucaaccgg

SEQ ID NO: 1078499 - RNA, 21 nt, Mycobacterium bovis subsp bovis AF2122/97
cgccguugccgccgucgccgc

SEQ ID NO: 1078500 - RNA, 21 nt, Mycobacterium bovis subsp bovis AF2122/97
cgccguugccguacagcccgg

SEQ ID NO: 1078501 - RNA, 15 nt, Mycobacterium bovis subsp bovis AF2122/97
cgccguugccguugg

SEQ ID NO: 1078502 - RNA, 22 nt, Mycobacterium bovis subsp bovis AF2122/97
cgccguugccguuggugccgcc

SEQ ID NO: 1078503 - RNA, 20 nt, Mycobacterium bovis subsp bovis AF2122/97
cgccguuuggccucacccgg

SEQ ID NO: 1078504 - RNA, 23 nt, Mycobacterium bovis subsp bovis AF2122/97
cgccguuguugaggaugacgacg

SEQ ID NO: 1078505 - RNA, 14 nt, Mycobacterium bovis subsp bovis AF2122/97
cgccuaaacccgug

SEQ ID NO: 1078506 - RNA, 15 nt, Mycobacterium bovis subsp bovis AF2122/97
cgccuacaccggcgc

SEQ ID NO: 1078507 - RNA, 19 nt, Mycobacterium bovis subsp bovis AF2122/97
cgccuacaccggcgcucaa

SEQ ID NO: 1078508 - RNA, 20 nt, Mycobacterium bovis subsp bovis AF2122/97
cgccuaccagcaccgggaug

SEQ ID NO: 1078509 - RNA, 21 nt, Mycobacterium bovis subsp bovis AF2122/97
aacacgccgucgaccggcggg

SEQ ID NO: 1078510 - RNA, 15 nt, Mycobacterium bovis subsp bovis AF2122/97
aacacgucgcgguag

SEQ ID NO: 1078511 - RNA, 15 nt, Mycobacterium bovis subsp bovis AF2122/97
aacagaauucgaccg

SEQ ID NO: 1078512 - RNA, 21 nt, Mycobacterium bovis subsp bovis AF2122/97
cgcucaaugaucgcggcggcg

SEQ ID NO: 1078513 - RNA, 19 nt, Mycobacterium bovis subsp bovis AF2122/97
cgcucaaugcggucaacga

SEQ ID NO: 1078514 - RNA, 18 nt, Mycobacterium bovis subsp bovis AF2122/97
cgcucacauacagcaggc

SEQ ID NO: 1078515 - RNA, 14 nt, Mycobacterium bovis subsp bovis AF2122/97
cgcucaccaccgac

SEQ ID NO: 1078516 - RNA, 16 nt, Mycobacterium bovis subsp bovis AF2122/97
cgcucauaggccggcg

SEQ ID NO: 1078517 - RNA, 13 nt, Mycobacterium bovis subsp bovis AF2122/97
cgcucaguuuggc

SEQ ID NO: 1078518 - RNA, 14 nt, Mycobacterium bovis subsp bovis AF2122/97
cgcucauccagcgc

SEQ ID NO: 1078519 - RNA, 15 nt, Mycobacterium bovis subsp bovis AF2122/97
cgcucaucgaccgcg

SEQ ID NO: 1078520 - RNA, 19 nt, Mycobacterium bovis subsp bovis AF2122/97
cgcucaugaccgcucggag

SEQ ID NO: 1078521 - RNA, 21 nt, Mycobacterium bovis subsp bovis AF2122/97
cgcucaucugcgcgcggaagc

SEQ ID NO: 1078522 - RNA, 20 nt, Mycobacterium bovis subsp bovis AF2122/97
cgcuccaaaagccucagccg

SEQ ID NO: 1078523 - RNA, 16 nt, Mycobacterium bovis subsp bovis AF2122/97
cgcucaacgggccgca

SEQ ID NO: 1078524 - RNA, 19 nt, Mycobacterium bovis subsp bovis AF2122/97
cgcucaacgggccgcaucg

SEQ ID NO: 1078525 - RNA, 20 nt, Mycobacterium bovis subsp bovis AF2122/97
cgcuaugaggcagucguuga

SEQ ID NO: 1078526 - RNA, 17 nt, Mycobacterium bovis subsp bovis AF2122/97
cgcuaugaugccgccgg

SEQ ID NO: 1078527 - RNA, 19 nt, Mycobacterium bovis subsp bovis AF2122/97
cgcguugacucugcgucca

SEQ ID NO: 1078528 - RNA, 14 nt, Mycobacterium bovis subsp bovis AF2122/97
cgcguucugguugu

SEQ ID NO: 1078529 - RNA, 19 nt, Mycobacterium bovis subsp bovis AF2122/97
cgcguugaugaccgccgcc

SEQ ID NO: 1078530 - RNA, 20 nt, Mycobacterium bovis subsp bovis AF2122/97
cgcguugaugaccgccgccg

SEQ ID NO: 1078531 - RNA, 17 nt, Mycobacterium bovis subsp bovis AF2122/97
cgcguugcacagcagcg

SEQ ID NO: 1078532 - RNA, 23 nt, Mycobacterium bovis subsp bovis AF2122/97
cgcguugagcucaauggcuucga

SEQ ID NO: 1078533 - RNA, 17 nt, Mycobacterium bovis subsp bovis AF2122/97
cgcguugccaaagccca

SEQ ID NO: 1078534 - RNA, 22 nt, Mycobacterium bovis subsp bovis AF2122/97
cgcguugagcucaauggcuucg

SEQ ID NO: 1078535 - RNA, 21 nt, Mycobacterium bovis subsp bovis AF2122/97
cgcguucaggaugccaggacg

SEQ ID NO: 1078536 - RNA, 15 nt, Mycobacterium bovis subsp bovis AF2122/97
cgcuaggacggcgcg

SEQ ID NO: 1078537 - RNA, 20 nt, Mycobacterium bovis subsp bovis AF2122/97
cgcuaggacggcugccguca

SEQ ID NO: 1078538 - RNA, 15 nt, Mycobacterium bovis subsp bovis AF2122/97
cgcuagcgccgcgcu

SEQ ID NO: 1078539 - RNA, 20 nt, Mycobacterium bovis subsp bovis AF2122/97
cgcuagccagggaucagccg

SEQ ID NO: 1078540 - RNA, 19 nt, Mycobacterium bovis subsp bovis AF2122/97
cgcuagccccgaucaucga

SEQ ID NO: 1078541 - RNA, 17 nt, Mycobacterium bovis subsp bovis AF2122/97
cgcuagccgggcgcgcc

SEQ ID NO: 1078542 - RNA, 18 nt, Mycobacterium bovis subsp bovis AF2122/97
cgcuagccgggcgcgccg

SEQ ID NO: 1078543 - RNA, 20 nt, Mycobacterium bovis subsp bovis AF2122/97
cgcuagggugagcccgggau

SEQ ID NO: 1078544 - RNA, 15 nt, Mycobacterium bovis subsp bovis AF2122/97
cgcuagucgucggcg

SEQ ID NO: 1078545 - RNA, 16 nt, Mycobacterium bovis subsp bovis AF2122/97
cgcuagucgucggcgc

SEQ ID NO: 1078546 - RNA, 15 nt, Mycobacterium bovis subsp bovis AF2122/97
cgcuaggaacgccac

SEQ ID NO: 1078547 - RNA, 22 nt, Mycobacterium bovis subsp bovis AF2122/97
cgcgucggaauacaacagcugg

SEQ ID NO: 1078548 - RNA, 20 nt, Mycobacterium bovis subsp bovis AF2122/97
cgcgucgcuguuggcgaagg

SEQ ID NO: 1078549 - RNA, 15 nt, Mycobacterium bovis subsp bovis AF2122/97
cgcgucggucaccga

SEQ ID NO: 1078550 - RNA, 15 nt, Mycobacterium bovis subsp bovis AF2122/97
cgcgucgucccagug

SEQ ID NO: 1078551 - RNA, 22 nt, Mycobacterium bovis subsp bovis AF2122/97
cgcgucguagcgcucgugaccg

SEQ ID NO: 1078552 - RNA, 23 nt, Mycobacterium bovis subsp bovis AF2122/97
cgcgucggugugguccucgauca

SEQ ID NO: 1078553 - RNA, 23 nt, Mycobacterium bovis subsp bovis AF2122/97
cgcgucggucgcggacagguagu

SEQ ID NO: 1078554 - RNA, 14 nt, Mycobacterium bovis subsp bovis AF2122/97
cgcgucgucgcgcu

SEQ ID NO: 1078555 - RNA, 16 nt, Mycobacterium bovis subsp bovis AF2122/97
cgcgucguugccgggg

SEQ ID NO: 1078556 - RNA, 19 nt, Mycobacterium bovis subsp bovis AF2122/97
cgcguagguggcacagucc

SEQ ID NO: 1078557 - RNA, 17 nt, Mycobacterium bovis subsp bovis AF2122/97
cgcguagguggccagcg

SEQ ID NO: 1078558 - RNA, 18 nt, Mycobacterium bovis subsp bovis AF2122/97
cgcguagguggccagcgc

SEQ ID NO: 1078559 - RNA, 23 nt, Mycobacterium bovis subsp bovis AF2122/97
cgcguaguccaggccgucguugc

SEQ ID NO: 1078560 - RNA, 22 nt, Mycobacterium bovis subsp bovis AF2122/97
cgcguaguccgcauccgcgacg

SEQ ID NO: 1078561 - RNA, 22 nt, Mycobacterium bovis subsp bovis AF2122/97
cgcguaguaaugcucgacguag

SEQ ID NO: 1078562 - RNA, 13 nt, Mycobacterium bovis subsp bovis AF2122/97
cgcgucaaacacc

SEQ ID NO: 1078563 - RNA, 14 nt, Mycobacterium bovis subsp bovis AF2122/97
cgcguaucccagau

SEQ ID NO: 1078564 - RNA, 13 nt, Mycobacterium bovis subsp bovis AF2122/97
cgcgucgccgaug

SEQ ID NO: 1078565 - RNA, 12 nt, Mycobacterium bovis subsp bovis AF2122/97
cgcgucgcccgc

SEQ ID NO: 1078566 - RNA, 13 nt, Mycobacterium bovis subsp bovis AF2122/97
cgcgucgccgaaa

SEQ ID NO: 1078567 - RNA, 14 nt, Mycobacterium bovis subsp bovis AF2122/97
cgcgucgccggccu

SEQ ID NO: 1078568 - RNA, 19 nt, Mycobacterium bovis subsp bovis AF2122/97
cgcgucaaccgaucggucg

SEQ ID NO: 1078569 - RNA, 23 nt, Mycobacterium bovis subsp bovis AF2122/97
cgcgucaagucugugcucacggc

SEQ ID NO: 1078570 - RNA, 12 nt, Mycobacterium bovis subsp bovis AF2122/97
cgcgucaacgcu

SEQ ID NO: 1078571 - RNA, 21 nt, Mycobacterium bovis subsp bovis AF2122/97
cgcgucaacgcuguugucguc

SEQ ID NO: 1078572 - RNA, 15 nt, Mycobacterium bovis subsp bovis AF2122/97
cgcgucacaccagcg

SEQ ID NO: 1078573 - RNA, 17 nt, Mycobacterium bovis subsp bovis AF2122/97
cgcguggcgcaccaccg

SEQ ID NO: 1078574 - RNA, 22 nt, Mycobacterium bovis subsp bovis AF2122/97
cgcguggcgcaccaccgccccg

SEQ ID NO: 1078575 - RNA, 23 nt, Mycobacterium bovis subsp bovis AF2122/97
cgcguggcgcaccaccgccccgc

SEQ ID NO: 1078576 - RNA, 19 nt, Mycobacterium bovis subsp bovis AF2122/97
cgcguggcggggccgcgcc

SEQ ID NO: 1078577 - RNA, 16 nt, Mycobacterium bovis subsp bovis AF2122/97
cgcguguaccgcgacg

SEQ ID NO: 1078578 - RNA, 19 nt, Mycobacterium bovis subsp bovis AF2122/97
cgcguguaccgcgacguag

SEQ ID NO: 1078579 - RNA, 20 nt, Mycobacterium bovis subsp bovis AF2122/97
cgcgugucugggaccccgcu

SEQ ID NO: 1078580 - RNA, 16 nt, Mycobacterium bovis subsp bovis AF2122/97
cgcguggucgccccga

SEQ ID NO: 1078581 - RNA, 15 nt, Mycobacterium bovis subsp bovis AF2122/97
cgcguggucgggaac

SEQ ID NO: 1078582 - RNA, 20 nt, Mycobacterium bovis subsp bovis AF2122/97
cgcguggugcugaccgcgcc

SEQ ID NO: 1078583 - RNA, 14 nt, Mycobacterium bovis subsp bovis AF2122/97
cgcguucaacaccg

SEQ ID NO: 1078584 - RNA, 21 nt, Mycobacterium bovis subsp bovis AF2122/97
cgcguucaacaccgccgaccu

SEQ ID NO: 1078585 - RNA, 15 nt, Mycobacterium bovis subsp bovis AF2122/97
cgcgugugcgucgca

SEQ ID NO: 1078586 - RNA, 18 nt, Mycobacterium bovis subsp bovis AF2122/97
cgcguuaugccaggcgca

SEQ ID NO: 1078587 - RNA, 13 nt, Mycobacterium bovis subsp bovis AF2122/97
cgcgucucgagcg

SEQ ID NO: 1078588 - RNA, 15 nt, Mycobacterium bovis subsp bovis AF2122/97
cgcgucucgagcgcg

SEQ ID NO: 1078589 - RNA, 19 nt, Mycobacterium bovis subsp bovis AF2122/97
cgcgucucgagcgcgccgc

SEQ ID NO: 1078590 - RNA, 19 nt, Mycobacterium bovis subsp bovis AF2122/97
cgcgucucggugcagcagc

SEQ ID NO: 1078591 - RNA, 22 nt, Mycobacterium bovis subsp bovis AF2122/97
cgcgucguugucgucgccggcg

SEQ ID NO: 1078592 - RNA, 19 nt, Mycobacterium bovis subsp bovis AF2122/97
cgcgucuacgucguccagc

SEQ ID NO: 1078593 - RNA, 20 nt, Mycobacterium bovis subsp bovis AF2122/97
cgcgucuacgucguccagca

SEQ ID NO: 1078594 - RNA, 14 nt, Mycobacterium bovis subsp bovis AF2122/97
cgcgucugcucggc

SEQ ID NO: 1078595 - RNA, 13 nt, Mycobacterium bovis subsp bovis AF2122/97
cgcgucugcucgc

SEQ ID NO: 1078596 - RNA, 20 nt, Mycobacterium bovis subsp bovis AF2122/97
cgcgucucggugcagcagcg

SEQ ID NO: 1078597 - RNA, 20 nt, Mycobacterium bovis subsp bovis AF2122/97
cgcgucugcucgccagcggg

SEQ ID NO: 1078598 - RNA, 19 nt, Mycobacterium bovis subsp bovis AF2122/97
cgcgucugcucggcggugc

SEQ ID NO: 1078599 - RNA, 15 nt, Mycobacterium bovis subsp bovis AF2122/97
cgcgugcuuggcagc

SEQ ID NO: 1078600 - RNA, 23 nt, Mycobacterium bovis subsp bovis AF2122/97
cgcguggaguggugauccagccg

SEQ ID NO: 1078601 - RNA, 15 nt, Mycobacterium bovis subsp bovis AF2122/97
cgcguggaucgcgcu

SEQ ID NO: 1078602 - RNA, 17 nt, Mycobacterium bovis subsp bovis AF2122/97
cgcgugcugcggcuggu

SEQ ID NO: 1078603 - RNA, 15 nt, Mycobacterium bovis subsp bovis AF2122/97
cgcguggcaccgaca

SEQ ID NO: 1078604 - RNA, 14 nt, Mycobacterium bovis subsp bovis AF2122/97
cgcguggcauccag

SEQ ID NO: 1078605 - RNA, 23 nt, Mycobacterium bovis subsp bovis AF2122/97
cgcgucuuggugcgcgucagccg

SEQ ID NO: 1078606 - RNA, 21 nt, Mycobacterium bovis subsp bovis AF2122/97
cgcgugcugccguauccaggc

SEQ ID NO: 1078607 - RNA, 14 nt, Mycobacterium bovis subsp bovis AF2122/97
cgcgugcugcggac

SEQ ID NO: 1078608 - RNA, 18 nt, Mycobacterium bovis subsp bovis AF2122/97
cgcuccacguacgcggcu

SEQ ID NO: 1078609 - RNA, 21 nt, Mycobacterium bovis subsp bovis AF2122/97
cgcuccacguacgcggcugcg

SEQ ID NO: 1078610 - RNA, 12 nt, Mycobacterium bovis subsp bovis AF2122/97
cgcuccaccacg

SEQ ID NO: 1078611 - RNA, 16 nt, Mycobacterium bovis subsp bovis AF2122/97
cgcuccaccacgaccg

SEQ ID NO: 1078612 - RNA, 18 nt, Mycobacterium bovis subsp bovis AF2122/97
cgcuccaccacgaccgcg

SEQ ID NO: 1078613 - RNA, 21 nt, Mycobacterium bovis subsp bovis AF2122/97
cgcucauucgugcccgggcgg

SEQ ID NO: 1078614 - RNA, 20 nt, Mycobacterium bovis subsp bovis AF2122/97
cgcuccagauggggcucgag

SEQ ID NO: 1078615 - RNA, 15 nt, Mycobacterium bovis subsp bovis AF2122/97
cgcuccagcacccgc

SEQ ID NO: 1078616 - RNA, 17 nt, Mycobacterium bovis subsp bovis AF2122/97
cgcuccagccgcgcguc

SEQ ID NO: 1078617 - RNA, 19 nt, Mycobacterium bovis subsp bovis AF2122/97
cgcuccagcucggccagug

SEQ ID NO: 1078618 - RNA, 23 nt, Mycobacterium bovis subsp bovis AF2122/97
cgcucgcccaggaagccgagacc

SEQ ID NO: 1078619 - RNA, 15 nt, Mycobacterium bovis subsp bovis AF2122/97
cgcucgcccgccgcc

SEQ ID NO: 1078620 - RNA, 19 nt, Mycobacterium bovis subsp bovis AF2122/97
cgcucgcccgccgccacca

SEQ ID NO: 1078621 - RNA, 14 nt, Mycobacterium bovis subsp bovis AF2122/97
cgcucgcaccgccc

SEQ ID NO: 1078622 - RNA, 19 nt, Mycobacterium bovis subsp bovis AF2122/97
cgcucgcaccgcccgccga

SEQ ID NO: 1078623 - RNA, 13 nt, Mycobacterium bovis subsp bovis AF2122/97
cgcucgcaggccg

SEQ ID NO: 1078624 - RNA, 16 nt, Mycobacterium bovis subsp bovis AF2122/97
cgcucgauggcggcca

SEQ ID NO: 1078625 - RNA, 17 nt, Mycobacterium bovis subsp bovis AF2122/97
cgcucgauggcggccac

SEQ ID NO: 1078626 - RNA, 13 nt, Mycobacterium bovis subsp bovis AF2122/97
cgcucgcacccgc

SEQ ID NO: 1078627 - RNA, 21 nt, Mycobacterium bovis subsp bovis AF2122/97
cgcucgaucggcagccagggc

SEQ ID NO: 1078628 - RNA, 18 nt, Mycobacterium bovis subsp bovis AF2122/97
cgcucgagguggucucgg

SEQ ID NO: 1078629 - RNA, 15 nt, Mycobacterium bovis subsp bovis AF2122/97
cgcucgaucgcguug

SEQ ID NO: 1078630 - RNA, 19 nt, Mycobacterium bovis subsp bovis AF2122/97
cgcucgaucggcagccagg

SEQ ID NO: 1078631 - RNA, 16 nt, Mycobacterium bovis subsp bovis AF2122/97
cgcucgagguggucuc

SEQ ID NO: 1078632 - RNA, 13 nt, Mycobacterium bovis subsp bovis AF2122/97
cgcucgagcagcg

SEQ ID NO: 1078633 - RNA, 18 nt, Mycobacterium bovis subsp bovis AF2122/97
cgcucgagcaggcuggcg

SEQ ID NO: 1078634 - RNA, 22 nt, Mycobacterium bovis subsp bovis AF2122/97
cgcucgagcaggcuggcguugg

SEQ ID NO: 1078635 - RNA, 14 nt, Mycobacterium bovis subsp bovis AF2122/97
cgcucggccgccgg

SEQ ID NO: 1078636 - RNA, 18 nt, Mycobacterium bovis subsp bovis AF2122/97
cgcucggccauagcgccg

SEQ ID NO: 1078637 - RNA, 15 nt, Mycobacterium bovis subsp bovis AF2122/97
cgcucggccgcagcc

SEQ ID NO: 1078638 - RNA, 16 nt, Mycobacterium bovis subsp bovis AF2122/97
cgcucggccgcagcca

SEQ ID NO: 1078639 - RNA, 21 nt, Mycobacterium bovis subsp bovis AF2122/97
cgcucggccgcagccagcggu

SEQ ID NO: 1078640 - RNA, 12 nt, Mycobacterium bovis subsp bovis AF2122/97
cgcucggccugc

SEQ ID NO: 1078641 - RNA, 22 nt, Mycobacterium bovis subsp bovis AF2122/97
cgcucggcgccacggugucgcg

SEQ ID NO: 1078642 - RNA, 14 nt, Mycobacterium bovis subsp bovis AF2122/97
cgcucggcgcgcgg

SEQ ID NO: 1078643 - RNA, 15 nt, Mycobacterium bovis subsp bovis AF2122/97
cgcucggcgcgcggg

SEQ ID NO: 1078644 - RNA, 15 nt, Mycobacterium bovis subsp bovis AF2122/97
cgcucggcagccggc

SEQ ID NO: 1078645 - RNA, 12 nt, Mycobacterium bovis subsp bovis AF2122/97
cgcucggaguug

SEQ ID NO: 1078646 - RNA, 15 nt, Mycobacterium bovis subsp bovis AF2122/97
cgcucgcugcagcag

SEQ ID NO: 1078647 - RNA, 20 nt, Mycobacterium bovis subsp bovis AF2122/97
cgcucggcaaccugcgacca

SEQ ID NO: 1078648 - RNA, 12 nt, Mycobacterium bovis subsp bovis AF2122/97
cgcucggcagcc

SEQ ID NO: 1078649 - RNA, 13 nt, Mycobacterium bovis subsp bovis AF2122/97
cgcucggcagccg

SEQ ID NO: 1078650 - RNA, 15 nt, Mycobacterium bovis subsp bovis AF2122/97
cgcucgccgagcugu

SEQ ID NO: 1078651 - RNA, 17 nt, Mycobacterium bovis subsp bovis AF2122/97
cgcucgcccgcggccgu

SEQ ID NO: 1078652 - RNA, 20 nt, Mycobacterium bovis subsp bovis AF2122/97
cgcucgcccgcggccguggu

SEQ ID NO: 1078653 - RNA, 15 nt, Mycobacterium bovis subsp bovis AF2122/97
cgcucgcggcgacca

SEQ ID NO: 1078654 - RNA, 17 nt, Mycobacterium bovis subsp bovis AF2122/97
cgcucgcggcggcgcug

SEQ ID NO: 1078655 - RNA, 16 nt, Mycobacterium bovis subsp bovis AF2122/97
cgcucgcgccaggucg

SEQ ID NO: 1078656 - RNA, 15 nt, Mycobacterium bovis subsp bovis AF2122/97
cgcucgcgccagguc

SEQ ID NO: 1078657 - RNA, 23 nt, Mycobacterium bovis subsp bovis AF2122/97
cgcucgcgaagccgguucgccca

SEQ ID NO: 1078658 - RNA, 19 nt, Mycobacterium bovis subsp bovis AF2122/97
cgcucgcgcaagcggaccc

SEQ ID NO: 1078659 - RNA, 16 nt, Mycobacterium bovis subsp bovis AF2122/97
cgcucgcucaccggcu

SEQ ID NO: 1078660 - RNA, 15 nt, Mycobacterium bovis subsp bovis AF2122/97
cgcucgcucacgccg

SEQ ID NO: 1078661 - RNA, 13 nt, Mycobacterium bovis subsp bovis AF2122/97
cgcucgcgccagg

SEQ ID NO: 1078662 - RNA, 17 nt, Mycobacterium bovis subsp bovis AF2122/97
cgcucucggcgauuuug

SEQ ID NO: 1078663 - RNA, 15 nt, Mycobacterium bovis subsp bovis AF2122/97
cgcucugcgaguucg

SEQ ID NO: 1078664 - RNA, 15 nt, Mycobacterium bovis subsp bovis AF2122/97
cgcucugcggccacg

SEQ ID NO: 1078665 - RNA, 12 nt, Mycobacterium bovis subsp bovis AF2122/97
cgcucugcgcgg

SEQ ID NO: 1078666 - RNA, 13 nt, Mycobacterium bovis subsp bovis AF2122/97
cgcucugcgcggc

SEQ ID NO: 1078667 - RNA, 21 nt, Mycobacterium bovis subsp bovis AF2122/97
cgcucugugucgccgaucacc

SEQ ID NO: 1078668 - RNA, 15 nt, Mycobacterium bovis subsp bovis AF2122/97
cgcucuggucgucga

SEQ ID NO: 1078669 - RNA, 18 nt, Mycobacterium bovis subsp bovis AF2122/97
cgcucuggugucgucggu

SEQ ID NO: 1078670 - RNA, 22 nt, Mycobacterium bovis subsp bovis AF2122/97
cgcucugugucgccgaucaccg

SEQ ID NO: 1078671 - RNA, 21 nt, Mycobacterium bovis subsp bovis AF2122/97
cgcugaacuagggucgggguc

SEQ ID NO: 1078672 - RNA, 14 nt, Mycobacterium bovis subsp bovis AF2122/97
cgcugaacucaacg

SEQ ID NO: 1078673 - RNA, 14 nt, Mycobacterium bovis subsp bovis AF2122/97
cgcugaaaucggug

SEQ ID NO: 1078674 - RNA, 24 nt, Mycobacterium bovis subsp bovis AF2122/97
cgcugaacagacggcucagcgugc

SEQ ID NO: 1078675 - RNA, 18 nt, Mycobacterium bovis subsp bovis AF2122/97
cgcugaagccgacgaucc

SEQ ID NO: 1078676 - RNA, 16 nt, Mycobacterium bovis subsp bovis AF2122/97
cgcugaagccgcugga

SEQ ID NO: 1078677 - RNA, 19 nt, Mycobacterium bovis subsp bovis AF2122/97
cgcugacccgggccgggcc

SEQ ID NO: 1078678 - RNA, 22 nt, Mycobacterium bovis subsp bovis AF2122/97
cgcugaccacaaccgugagcac

SEQ ID NO: 1078679 - RNA, 16 nt, Mycobacterium bovis subsp bovis AF2122/97
cgcugaauuggcgccg

SEQ ID NO: 1078680 - RNA, 22 nt, Mycobacterium bovis subsp bovis AF2122/97
cgcugaauuggcgccgaugacc

SEQ ID NO: 1078681 - RNA, 14 nt, Mycobacterium bovis subsp bovis AF2122/97
cgcugaaugcgccg

SEQ ID NO: 1078682 - RNA, 18 nt, Mycobacterium bovis subsp bovis AF2122/97
cgcugaaugcgccgugga

SEQ ID NO: 1078683 - RNA, 15 nt, Mycobacterium bovis subsp bovis AF2122/97
cgcucgggcgcgcuc

SEQ ID NO: 1078684 - RNA, 16 nt, Mycobacterium bovis subsp bovis AF2122/97
cgcucggcgugucggg

SEQ ID NO: 1078685 - RNA, 22 nt, Mycobacterium bovis subsp bovis AF2122/97
cgcucggcggggaccgcgguca

SEQ ID NO: 1078686 - RNA, 14 nt, Mycobacterium bovis subsp bovis AF2122/97
cgcucggcggucgg

SEQ ID NO: 1078687 - RNA, 22 nt, Mycobacterium bovis subsp bovis AF2122/97
cgcucggucuccaccaccgacg

SEQ ID NO: 1078688 - RNA, 14 nt, Mycobacterium bovis subsp bovis AF2122/97
cgcucggucgccac

SEQ ID NO: 1078689 - RNA, 17 nt, Mycobacterium bovis subsp bovis AF2122/97
cgcucggucgccaccgc

SEQ ID NO: 1078690 - RNA, 19 nt, Mycobacterium bovis subsp bovis AF2122/97
cgcucggucgccaccgccg

SEQ ID NO: 1078691 - RNA, 12 nt, Mycobacterium bovis subsp bovis AF2122/97
cgcucgguuugc

SEQ ID NO: 1078692 - RNA, 15 nt, Mycobacterium bovis subsp bovis AF2122/97
cgcucggugccgccc

SEQ ID NO: 1078693 - RNA, 17 nt, Mycobacterium bovis subsp bovis AF2122/97
cgcucggugcugcgccg

SEQ ID NO: 1078694 - RNA, 18 nt, Mycobacterium bovis subsp bovis AF2122/97
cgcucggugcugcgccga

SEQ ID NO: 1078695 - RNA, 15 nt, Mycobacterium bovis subsp bovis AF2122/97
cgcucgggcugccgc

SEQ ID NO: 1078696 - RNA, 16 nt, Mycobacterium bovis subsp bovis AF2122/97
cgcucguagaaccggg

SEQ ID NO: 1078697 - RNA, 19 nt, Mycobacterium bovis subsp bovis AF2122/97
cgcucguagaaucggcuca

SEQ ID NO: 1078698 - RNA, 18 nt, Mycobacterium bovis subsp bovis AF2122/97
cgcucgucguccggccac

SEQ ID NO: 1078699 - RNA, 24 nt, Mycobacterium bovis subsp bovis AF2122/97
cgcucgucguccggccacgguccg

SEQ ID NO: 1078700 - RNA, 18 nt, Mycobacterium bovis subsp bovis AF2122/97
cgcucgucgaaguagccg

SEQ ID NO: 1078701 - RNA, 13 nt, Mycobacterium bovis subsp bovis AF2122/97
cgcucgucgaucu

SEQ ID NO: 1078702 - RNA, 16 nt, Mycobacterium bovis subsp bovis AF2122/97
cgcucgucgccggugg

SEQ ID NO: 1078703 - RNA, 18 nt, Mycobacterium bovis subsp bovis AF2122/97
cgcucgugacgaucagcg

SEQ ID NO: 1078704 - RNA, 14 nt, Mycobacterium bovis subsp bovis AF2122/97
cgcucguggucgac

SEQ ID NO: 1078705 - RNA, 20 nt, Mycobacterium bovis subsp bovis AF2122/97
cgcucguggucgacgugauc

SEQ ID NO: 1078706 - RNA, 23 nt, Mycobacterium bovis subsp bovis AF2122/97
cgcucguggucgacgugaucgcg

SEQ ID NO: 1078707 - RNA, 22 nt, Mycobacterium bovis subsp bovis AF2122/97
cgcucguugguucagcucgagg

SEQ ID NO: 1078708 - RNA, 22 nt, Mycobacterium bovis subsp bovis AF2122/97
cgcggacccgcagcugcggauc

SEQ ID NO: 1078709 - RNA, 16 nt, Mycobacterium bovis subsp bovis AF2122/97
cgcggacccgcgcguc

SEQ ID NO: 1078710 - RNA, 22 nt, Mycobacterium bovis subsp bovis AF2122/97
cgcggacccgcgcgucgcccag

SEQ ID NO: 1078711 - RNA, 23 nt, Mycobacterium bovis subsp bovis AF2122/97
cgcggaccgcgaaugugaucacc

SEQ ID NO: 1078712 - RNA, 21 nt, Mycobacterium bovis subsp bovis AF2122/97
cgcggaccucgaagcccagca

SEQ ID NO: 1078713 - RNA, 15 nt, Mycobacterium bovis subsp bovis AF2122/97
cgcggaccucggcga

SEQ ID NO: 1078714 - RNA, 12 nt, Mycobacterium bovis subsp bovis AF2122/97
cgcggaccucga

SEQ ID NO: 1078715 - RNA, 14 nt, Mycobacterium bovis subsp bovis AF2122/97
cgcggcccgcagcg

SEQ ID NO: 1078716 - RNA, 18 nt, Mycobacterium bovis subsp bovis AF2122/97
cgcggcccgccucggcgg

SEQ ID NO: 1078717 - RNA, 22 nt, Mycobacterium bovis subsp bovis AF2122/97
cgcggcccgccucggcggcggc

SEQ ID NO: 1078718 - RNA, 13 nt, Mycobacterium bovis subsp bovis AF2122/97
cgcggcccgccga

SEQ ID NO: 1078719 - RNA, 12 nt, Mycobacterium bovis subsp bovis AF2122/97
cgcggcccgaga

SEQ ID NO: 1078720 - RNA, 20 nt, Mycobacterium bovis subsp bovis AF2122/97
cgcggcccggcccuccgggc

SEQ ID NO: 1078721 - RNA, 17 nt, Mycobacterium bovis subsp bovis AF2122/97
cgcggcccggacgucgg

SEQ ID NO: 1078722 - RNA, 18 nt, Mycobacterium bovis subsp bovis AF2122/97
cgcggcccggacgucggc

SEQ ID NO: 1078723 - RNA, 13 nt, Mycobacterium bovis subsp bovis AF2122/97
cgcggcccucgau

SEQ ID NO: 1078724 - RNA, 18 nt, Mycobacterium bovis subsp bovis AF2122/97
cgcggcccucgaugccgc

SEQ ID NO: 1078725 - RNA, 19 nt, Mycobacterium bovis subsp bovis AF2122/97
cgcggcccucgaugccgcg

SEQ ID NO: 1078726 - RNA, 21 nt, Mycobacterium bovis subsp bovis AF2122/97
cgcggccggaauacccggccc

SEQ ID NO: 1078727 - RNA, 13 nt, Mycobacterium bovis subsp bovis AF2122/97
cgcggccgcggug

SEQ ID NO: 1078728 - RNA, 17 nt, Mycobacterium bovis subsp bovis AF2122/97
cgcggccgcggugacgg

SEQ ID NO: 1078729 - RNA, 15 nt, Mycobacterium bovis subsp bovis AF2122/97
cgcggccggccgccc

SEQ ID NO: 1078730 - RNA, 15 nt, Mycobacterium bovis subsp bovis AF2122/97
cgcggccggcgcucg

SEQ ID NO: 1078731 - RNA, 14 nt, Mycobacterium bovis subsp bovis AF2122/97
cgcggcgaucugcg

SEQ ID NO: 1078732 - RNA, 17 nt, Mycobacterium bovis subsp bovis AF2122/97
cgcggcgaucgcuccgc

SEQ ID NO: 1078733 - RNA, 22 nt, Mycobacterium bovis subsp bovis AF2122/97
cgcggcgaucgcuccgcggcgc

SEQ ID NO: 1078734 - RNA, 16 nt, Mycobacterium bovis subsp bovis AF2122/97
cgcggcgccauagccg

SEQ ID NO: 1078735 - RNA, 14 nt, Mycobacterium bovis subsp bovis AF2122/97
cgcggcgcccagga

SEQ ID NO: 1078736 - RNA, 18 nt, Mycobacterium bovis subsp bovis AF2122/97
aacagauuguccggccgg

SEQ ID NO: 1078737 - RNA, 21 nt, Mycobacterium bovis subsp bovis AF2122/97
aacagcaauuuuccgucgaug

SEQ ID NO: 1078738 - RNA, 14 nt, Mycobacterium bovis subsp bovis AF2122/97
cgcggcgcccggcg

SEQ ID NO: 1078739 - RNA, 13 nt, Mycobacterium bovis subsp bovis AF2122/97
cgcggccggcggc

SEQ ID NO: 1078740 - RNA, 18 nt, Mycobacterium bovis subsp bovis AF2122/97
cgcggccggcggccgccc

SEQ ID NO: 1078741 - RNA, 14 nt, Mycobacterium bovis subsp bovis AF2122/97
cgcggacccgucgg

SEQ ID NO: 1078742 - RNA, 23 nt, Mycobacterium bovis subsp bovis AF2122/97
cgcggccggcgcucgcggcggcg

SEQ ID NO: 1078743 - RNA, 17 nt, Mycobacterium bovis subsp bovis AF2122/97
cgcggccguagugcacg

SEQ ID NO: 1078744 - RNA, 16 nt, Mycobacterium bovis subsp bovis AF2122/97
cgcggccggguggccc

SEQ ID NO: 1078745 - RNA, 14 nt, Mycobacterium bovis subsp bovis AF2122/97
cgcggccggcgucg

SEQ ID NO: 1078746 - RNA, 12 nt, Mycobacterium bovis subsp bovis AF2122/97
cgcggccgugaa

SEQ ID NO: 1078747 - RNA, 14 nt, Mycobacterium bovis subsp bovis AF2122/97
cgcggccgucgcgg

SEQ ID NO: 1078748 - RNA, 18 nt, Mycobacterium bovis subsp bovis AF2122/97
cgcggccgugaacggcgc

SEQ ID NO: 1078749 - RNA, 22 nt, Mycobacterium bovis subsp bovis AF2122/97
cgcggccgugaacggcgcgggc

SEQ ID NO: 1078750 - RNA, 17 nt, Mycobacterium bovis subsp bovis AF2122/97
cgcggccguggaugucg

SEQ ID NO: 1078751 - RNA, 17 nt, Mycobacterium bovis subsp bovis AF2122/97
cgcggccgucgcgggac

SEQ ID NO: 1078752 - RNA, 19 nt, Mycobacterium bovis subsp bovis AF2122/97
cgcggcgaguggcuccauc

SEQ ID NO: 1078753 - RNA, 12 nt, Mycobacterium bovis subsp bovis AF2122/97
cgcggcggucgu

SEQ ID NO: 1078754 - RNA, 19 nt, Mycobacterium bovis subsp bovis AF2122/97
cgcggcgucggucgggugg

SEQ ID NO: 1078755 - RNA, 22 nt, Mycobacterium bovis subsp bovis AF2122/97
cgcggcgucgucgaugaugccg

SEQ ID NO: 1078756 - RNA, 16 nt, Mycobacterium bovis subsp bovis AF2122/97
cgcggcgugcgcggug

SEQ ID NO: 1078757 - RNA, 20 nt, Mycobacterium bovis subsp bovis AF2122/97
cgcggcgugcgcggugaugg

SEQ ID NO: 1078758 - RNA, 16 nt, Mycobacterium bovis subsp bovis AF2122/97
cgcggcguguacgucg

SEQ ID NO: 1078759 - RNA, 16 nt, Mycobacterium bovis subsp bovis AF2122/97
cgcggcuacaucggcg

SEQ ID NO: 1078760 - RNA, 21 nt, Mycobacterium bovis subsp bovis AF2122/97
cgcggcuacaucggcggcguc

SEQ ID NO: 1078761 - RNA, 17 nt, Mycobacterium bovis subsp bovis AF2122/97
cgcggcguguacgucga

SEQ ID NO: 1078762 - RNA, 20 nt, Mycobacterium bovis subsp bovis AF2122/97
cgcggcguuguugcggaucg

SEQ ID NO: 1078763 - RNA, 18 nt, Mycobacterium bovis subsp bovis AF2122/97
cgcggcguuucccggguc

SEQ ID NO: 1078764 - RNA, 18 nt, Mycobacterium bovis subsp bovis AF2122/97
cgcggcuuugacgcccgg

SEQ ID NO: 1078765 - RNA, 19 nt, Mycobacterium bovis subsp bovis AF2122/97
cgcggcuuugacgcccggc

SEQ ID NO: 1078766 - RNA, 22 nt, Mycobacterium bovis subsp bovis AF2122/97
cgcggcuuugacgcccggcacc

SEQ ID NO: 1078767 - RNA, 15 nt, Mycobacterium bovis subsp bovis AF2122/97
cgcggcuugucgcgg

SEQ ID NO: 1078768 - RNA, 18 nt, Mycobacterium bovis subsp bovis AF2122/97
cgcggcuugucgcggugc

SEQ ID NO: 1078769 - RNA, 19 nt, Mycobacterium bovis subsp bovis AF2122/97
cgcggcuugucgcggugcg

SEQ ID NO: 1078770 - RNA, 18 nt, Mycobacterium bovis subsp bovis AF2122/97
cgcgggagguacccccag

SEQ ID NO: 1078771 - RNA, 14 nt, Mycobacterium bovis subsp bovis AF2122/97
cgcgggccaagccg

SEQ ID NO: 1078772 - RNA, 16 nt, Mycobacterium bovis subsp bovis AF2122/97
cgcgggccaccacgcg

SEQ ID NO: 1078773 - RNA, 21 nt, Mycobacterium bovis subsp bovis AF2122/97
cgcgggccaccacgcgccgca

SEQ ID NO: 1078774 - RNA, 12 nt, Mycobacterium bovis subsp bovis AF2122/97
cgcgggccaccg

SEQ ID NO: 1078775 - RNA, 22 nt, Mycobacterium bovis subsp bovis AF2122/97
cgcgggcccgcgcggcgguguc

SEQ ID NO: 1078776 - RNA, 13 nt, Mycobacterium bovis subsp bovis AF2122/97
cgcgggccgacca

SEQ ID NO: 1078777 - RNA, 24 nt, Mycobacterium bovis subsp bovis AF2122/97
cgcgggaagucccgaguggccggu

SEQ ID NO: 1078778 - RNA, 15 nt, Mycobacterium bovis subsp bovis AF2122/97
cgcgggaacgaugcc

SEQ ID NO: 1078779 - RNA, 17 nt, Mycobacterium bovis subsp bovis AF2122/97
cgcgggaaaacggggug

SEQ ID NO: 1078780 - RNA, 21 nt, Mycobacterium bovis subsp bovis AF2122/97
cgcgggaaacguuccagcuug

SEQ ID NO: 1078781 - RNA, 19 nt, Mycobacterium bovis subsp bovis AF2122/97
cgcgggaacgaugccgccg

SEQ ID NO: 1078782 - RNA, 22 nt, Mycobacterium bovis subsp bovis AF2122/97
cgcgggaacgaugccgccggcg

SEQ ID NO: 1078783 - RNA, 17 nt, Mycobacterium bovis subsp bovis AF2122/97
cgcgggacacgucgcgc

SEQ ID NO: 1078784 - RNA, 17 nt, Mycobacterium bovis subsp bovis AF2122/97
cgcgggaccuucgagcc

SEQ ID NO: 1078785 - RNA, 18 nt, Mycobacterium bovis subsp bovis AF2122/97
cgcgggagaaaacggcgg

SEQ ID NO: 1078786 - RNA, 22 nt, Mycobacterium bovis subsp bovis AF2122/97
cgcgggagaaaacggcggcgcc

SEQ ID NO: 1078787 - RNA, 14 nt, Mycobacterium bovis subsp bovis AF2122/97
cgcggcggagugca

SEQ ID NO: 1078788 - RNA, 17 nt, Mycobacterium bovis subsp bovis AF2122/97
cgcggcggagugcaugu

SEQ ID NO: 1078789 - RNA, 20 nt, Mycobacterium bovis subsp bovis AF2122/97
cgcggcggagugcauguccg

SEQ ID NO: 1078790 - RNA, 18 nt, Mycobacterium bovis subsp bovis AF2122/97
cgcggcgcuggcugcggu

SEQ ID NO: 1078791 - RNA, 21 nt, Mycobacterium bovis subsp bovis AF2122/97
cgcggcggaccguccgacggc

SEQ ID NO: 1078792 - RNA, 17 nt, Mycobacterium bovis subsp bovis AF2122/97
cgcggcggagccgggug

SEQ ID NO: 1078793 - RNA, 21 nt, Mycobacterium bovis subsp bovis AF2122/97
cgcggcggaacaccgacgaca

SEQ ID NO: 1078794 - RNA, 15 nt, Mycobacterium bovis subsp bovis AF2122/97
cgcggcgcgcggggc

SEQ ID NO: 1078795 - RNA, 14 nt, Mycobacterium bovis subsp bovis AF2122/97
cgcggcgcgcugaa

SEQ ID NO: 1078796 - RNA, 20 nt, Mycobacterium bovis subsp bovis AF2122/97
cgcggcgccgucgucagcgg

SEQ ID NO: 1078797 - RNA, 20 nt, Mycobacterium bovis subsp bovis AF2122/97
aacagcaccaguguggcgau

SEQ ID NO: 1078798 - RNA, 20 nt, Mycobacterium bovis subsp bovis AF2122/97
cgcguacaggccggccacca

SEQ ID NO: 1078799 - RNA, 15 nt, Mycobacterium bovis subsp bovis AF2122/97
cgcguaccacggugg

SEQ ID NO: 1078800 - RNA, 19 nt, Mycobacterium bovis subsp bovis AF2122/97
cgcgguuucggcgucaccg

SEQ ID NO: 1078801 - RNA, 17 nt, Mycobacterium bovis subsp bovis AF2122/97
cgcguaauucgacuucg

SEQ ID NO: 1078802 - RNA, 16 nt, Mycobacterium bovis subsp bovis AF2122/97
cgcgguuguuucggcg

SEQ ID NO: 1078803 - RNA, 18 nt, Mycobacterium bovis subsp bovis AF2122/97
cgcgguuguuucggcgug

SEQ ID NO: 1078804 - RNA, 14 nt, Mycobacterium bovis subsp bovis AF2122/97
cgcgguuucggcga

SEQ ID NO: 1078805 - RNA, 16 nt, Mycobacterium bovis subsp bovis AF2122/97
cgcgguuucggcguca

SEQ ID NO: 1078806 - RNA, 19 nt, Mycobacterium bovis subsp bovis AF2122/97
cgcgguuuggcgacgucga

SEQ ID NO: 1078807 - RNA, 18 nt, Mycobacterium bovis subsp bovis AF2122/97
cgcguaaaccggcugacc

SEQ ID NO: 1078808 - RNA, 23 nt, Mycobacterium bovis subsp bovis AF2122/97
cgcguaaaccggcugaccggggc

SEQ ID NO: 1078809 - RNA, 22 nt, Mycobacterium bovis subsp bovis AF2122/97
cgcguaaaggccuugggcggca

SEQ ID NO: 1078810 - RNA, 14 nt, Mycobacterium bovis subsp bovis AF2122/97
cgcgguuggcagug

SEQ ID NO: 1078811 - RNA, 16 nt, Mycobacterium bovis subsp bovis AF2122/97
cgcgguuguccuccga

SEQ ID NO: 1078812 - RNA, 18 nt, Mycobacterium bovis subsp bovis AF2122/97
cgcgguugugacggugaa

SEQ ID NO: 1078813 - RNA, 15 nt, Mycobacterium bovis subsp bovis AF2122/97
cgcgguucgaugaca

SEQ ID NO: 1078814 - RNA, 15 nt, Mycobacterium bovis subsp bovis AF2122/97
cgcgguguugcggug

SEQ ID NO: 1078815 - RNA, 17 nt, Mycobacterium bovis subsp bovis AF2122/97
cgcgguguuggacgcgg

SEQ ID NO: 1078816 - RNA, 15 nt, Mycobacterium bovis subsp bovis AF2122/97
cgcgguucaacacca

SEQ ID NO: 1078817 - RNA, 17 nt, Mycobacterium bovis subsp bovis AF2122/97
cgcgguucaccacgucg

SEQ ID NO: 1078818 - RNA, 21 nt, Mycobacterium bovis subsp bovis AF2122/97
cgcggugucuucucgucgaac

SEQ ID NO: 1078819 - RNA, 17 nt, Mycobacterium bovis subsp bovis AF2122/97
cgcggugcgcgugacga

SEQ ID NO: 1078820 - RNA, 18 nt, Mycobacterium bovis subsp bovis AF2122/97
cgcggugcgcgugacgac

SEQ ID NO: 1078821 - RNA, 14 nt, Mycobacterium bovis subsp bovis AF2122/97
cgcgguggaccggg

SEQ ID NO: 1078822 - RNA, 20 nt, Mycobacterium bovis subsp bovis AF2122/97
cgcgguggaugcgaugcgcg

SEQ ID NO: 1078823 - RNA, 22 nt, Mycobacterium bovis subsp bovis AF2122/97
cgcggugugccggucuccgaac

SEQ ID NO: 1078824 - RNA, 15 nt, Mycobacterium bovis subsp bovis AF2122/97
cgcggugugcggcag

SEQ ID NO: 1078825 - RNA, 17 nt, Mycobacterium bovis subsp bovis AF2122/97
cgcggugugcggcagcc

SEQ ID NO: 1078826 - RNA, 18 nt, Mycobacterium bovis subsp bovis AF2122/97
cgcggugugcggcagccc

SEQ ID NO: 1078827 - RNA, 23 nt, Mycobacterium bovis subsp bovis AF2122/97
cgcgguggaugcgaugcgcgccg

SEQ ID NO: 1078828 - RNA, 15 nt, Mycobacterium bovis subsp bovis AF2122/97
cgcggucggcgugca

SEQ ID NO: 1078829 - RNA, 14 nt, Mycobacterium bovis subsp bovis AF2122/97
cgcggucggcagcg

SEQ ID NO: 1078830 - RNA, 22 nt, Mycobacterium bovis subsp bovis AF2122/97
cgcggucggaccacccggcgcg

SEQ ID NO: 1078831 - RNA, 18 nt, Mycobacterium bovis subsp bovis AF2122/97
cgcggucggagucgagca

SEQ ID NO: 1078832 - RNA, 20 nt, Mycobacterium bovis subsp bovis AF2122/97
cgcggucggcagcgacgccg

SEQ ID NO: 1078833 - RNA, 14 nt, Mycobacterium bovis subsp bovis AF2122/97
cgcggucggccacc

SEQ ID NO: 1078834 - RNA, 19 nt, Mycobacterium bovis subsp bovis AF2122/97
cgcggugccgccaccggcg

SEQ ID NO: 1078835 - RNA, 23 nt, Mycobacterium bovis subsp bovis AF2122/97
cgcggugccgccaccggcgucca

SEQ ID NO: 1078836 - RNA, 14 nt, Mycobacterium bovis subsp bovis AF2122/97
cgcggugccggccg

SEQ ID NO: 1078837 - RNA, 14 nt, Mycobacterium bovis subsp bovis AF2122/97
cgcggugcgcguga

SEQ ID NO: 1078838 - RNA, 15 nt, Mycobacterium bovis subsp bovis AF2122/97
cgcggucggccacca

SEQ ID NO: 1078839 - RNA, 14 nt, Mycobacterium bovis subsp bovis AF2122/97
cgcggugcgcgcaa

SEQ ID NO: 1078840 - RNA, 15 nt, Mycobacterium bovis subsp bovis AF2122/97
cgcggucaccccggc

SEQ ID NO: 1078841 - RNA, 18 nt, Mycobacterium bovis subsp bovis AF2122/97
cgcggucagccauguccg

SEQ ID NO: 1078842 - RNA, 21 nt, Mycobacterium bovis subsp bovis AF2122/97
cgcggucgauguccgcagcac

SEQ ID NO: 1078843 - RNA, 22 nt, Mycobacterium bovis subsp bovis AF2122/97
cgcggucgauguccgcagcacc

SEQ ID NO: 1078844 - RNA, 13 nt, Mycobacterium bovis subsp bovis AF2122/97
cgcggucgaggug

SEQ ID NO: 1078845 - RNA, 17 nt, Mycobacterium bovis subsp bovis AF2122/97
cgcggucgaucaggccg

SEQ ID NO: 1078846 - RNA, 19 nt, Mycobacterium bovis subsp bovis AF2122/97
cgcggucgccaagaucggg

SEQ ID NO: 1078847 - RNA, 16 nt, Mycobacterium bovis subsp bovis AF2122/97
cgcggucgcugcgaug

SEQ ID NO: 1078848 - RNA, 12 nt, Mycobacterium bovis subsp bovis AF2122/97
cgcggucggacc

SEQ ID NO: 1078849 - RNA, 21 nt, Mycobacterium bovis subsp bovis AF2122/97
cgcggucaaauccagcagcca

SEQ ID NO: 1078850 - RNA, 15 nt, Mycobacterium bovis subsp bovis AF2122/97
cgcgguagucguugc

SEQ ID NO: 1078851 - RNA, 19 nt, Mycobacterium bovis subsp bovis AF2122/97
cgcgguaguugucccgccg

SEQ ID NO: 1078852 - RNA, 13 nt, Mycobacterium bovis subsp bovis AF2122/97
cgcggucaccgcg

SEQ ID NO: 1078853 - RNA, 16 nt, Mycobacterium bovis subsp bovis AF2122/97
cgcggucaccgcguca

SEQ ID NO: 1078854 - RNA, 14 nt, Mycobacterium bovis subsp bovis AF2122/97
cgcgguagcucguc

SEQ ID NO: 1078855 - RNA, 13 nt, Mycobacterium bovis subsp bovis AF2122/97
cgcgguagcgccg

SEQ ID NO: 1078856 - RNA, 16 nt, Mycobacterium bovis subsp bovis AF2122/97
cgcgguagcgccguga

SEQ ID NO: 1078857 - RNA, 19 nt, Mycobacterium bovis subsp bovis AF2122/97
cgcgguaggugcaugucga

SEQ ID NO: 1078858 - RNA, 19 nt, Mycobacterium bovis subsp bovis AF2122/97
cgcgggccgaggccgucgc

SEQ ID NO: 1078859 - RNA, 14 nt, Mycobacterium bovis subsp bovis AF2122/97
cgcgggccgcgucg

SEQ ID NO: 1078860 - RNA, 21 nt, Mycobacterium bovis subsp bovis AF2122/97
cgcgggccgccaucucguagg

SEQ ID NO: 1078861 - RNA, 20 nt, Mycobacterium bovis subsp bovis AF2122/97
cgcgggccuggcccacgccg

SEQ ID NO: 1078862 - RNA, 16 nt, Mycobacterium bovis subsp bovis AF2122/97
cgcgggccggcgacug

SEQ ID NO: 1078863 - RNA, 14 nt, Mycobacterium bovis subsp bovis AF2122/97
cgcgggcggcaucg

SEQ ID NO: 1078864 - RNA, 15 nt, Mycobacterium bovis subsp bovis AF2122/97
cgcgggcggcaucgc

SEQ ID NO: 1078865 - RNA, 18 nt, Mycobacterium bovis subsp bovis AF2122/97
cgcgggcucgguggcgga

SEQ ID NO: 1078866 - RNA, 13 nt, Mycobacterium bovis subsp bovis AF2122/97
cgcgggcucacau

SEQ ID NO: 1078867 - RNA, 13 nt, Mycobacterium bovis subsp bovis AF2122/97
cgcgggcguugcu

SEQ ID NO: 1078868 - RNA, 13 nt, Mycobacterium bovis subsp bovis AF2122/97
cgcgggcguuggc

SEQ ID NO: 1078869 - RNA, 17 nt, Mycobacterium bovis subsp bovis AF2122/97
cgcgggcguuggccagc

SEQ ID NO: 1078870 - RNA, 18 nt, Mycobacterium bovis subsp bovis AF2122/97
cgcgggcguuggccagca

SEQ ID NO: 1078871 - RNA, 19 nt, Mycobacterium bovis subsp bovis AF2122/97
cgcgggcguuggccagcag

SEQ ID NO: 1078872 - RNA, 22 nt, Mycobacterium bovis subsp bovis AF2122/97
cgcgggcgguaaucgcgagacc

SEQ ID NO: 1078873 - RNA, 19 nt, Mycobacterium bovis subsp bovis AF2122/97
cgcggggcaucggugcggu

SEQ ID NO: 1078874 - RNA, 22 nt, Mycobacterium bovis subsp bovis AF2122/97
cgcggggcaucggugcgguucg

SEQ ID NO: 1078875 - RNA, 17 nt, Mycobacterium bovis subsp bovis AF2122/97
cgcggggccgccgcggc

SEQ ID NO: 1078876 - RNA, 18 nt, Mycobacterium bovis subsp bovis AF2122/97
cgcggggccgccgcggcc

SEQ ID NO: 1078877 - RNA, 18 nt, Mycobacterium bovis subsp bovis AF2122/97
cgcggggccggaugacga

SEQ ID NO: 1078878 - RNA, 20 nt, Mycobacterium bovis subsp bovis AF2122/97
cgcggggaaucacccacucg

SEQ ID NO: 1078879 - RNA, 13 nt, Mycobacterium bovis subsp bovis AF2122/97
cgcgggguggcgg

SEQ ID NO: 1078880 - RNA, 14 nt, Mycobacterium bovis subsp bovis AF2122/97
cgcgggguggcggc

SEQ ID NO: 1078881 - RNA, 19 nt, Mycobacterium bovis subsp bovis AF2122/97
cgcgggguggcggcgcugc

SEQ ID NO: 1078882 - RNA, 20 nt, Mycobacterium bovis subsp bovis AF2122/97
cgcgggggugggcgugacgg

SEQ ID NO: 1078883 - RNA, 21 nt, Mycobacterium bovis subsp bovis AF2122/97
cgcggggcggccugcccgccg

SEQ ID NO: 1078884 - RNA, 19 nt, Mycobacterium bovis subsp bovis AF2122/97
cgcgggggcggccggcggc

SEQ ID NO: 1078885 - RNA, 19 nt, Mycobacterium bovis subsp bovis AF2122/97
cgcgggucgugccagcagc

SEQ ID NO: 1078886 - RNA, 13 nt, Mycobacterium bovis subsp bovis AF2122/97
cgcgggucacgac

SEQ ID NO: 1078887 - RNA, 15 nt, Mycobacterium bovis subsp bovis AF2122/97
cgcggguccagccac

SEQ ID NO: 1078888 - RNA, 13 nt, Mycobacterium bovis subsp bovis AF2122/97
cgcgggucccggc

SEQ ID NO: 1078889 - RNA, 15 nt, Mycobacterium bovis subsp bovis AF2122/97
cgcgggucccggccg

SEQ ID NO: 1078890 - RNA, 18 nt, Mycobacterium bovis subsp bovis AF2122/97
aacagcgucaaccggucc

SEQ ID NO: 1078891 - RNA, 18 nt, Mycobacterium bovis subsp bovis AF2122/97
cgcgggucguccggcggc

SEQ ID NO: 1078892 - RNA, 20 nt, Mycobacterium bovis subsp bovis AF2122/97
cgcgggugaucuccaccggc

SEQ ID NO: 1078893 - RNA, 22 nt, Mycobacterium bovis subsp bovis AF2122/97
cgcgggugaucuccaccggcga

SEQ ID NO: 1078894 - RNA, 21 nt, Mycobacterium bovis subsp bovis AF2122/97
cgcgggugcgcugcagcgaga

SEQ ID NO: 1078895 - RNA, 17 nt, Mycobacterium bovis subsp bovis AF2122/97
cgcgggugccgacgucg

SEQ ID NO: 1078896 - RNA, 15 nt, Mycobacterium bovis subsp bovis AF2122/97
cgcgggugaccaggc

SEQ ID NO: 1078897 - RNA, 13 nt, Mycobacterium bovis subsp bovis AF2122/97
cgcgggugcgccg

SEQ ID NO: 1078898 - RNA, 15 nt, Mycobacterium bovis subsp bovis AF2122/97
cgcgggugcgccggc

SEQ ID NO: 1078899 - RNA, 16 nt, Mycobacterium bovis subsp bovis AF2122/97
cgcgguagccgaccga

SEQ ID NO: 1078900 - RNA, 19 nt, Mycobacterium bovis subsp bovis AF2122/97
cgcgguagccgcggccaca

SEQ ID NO: 1078901 - RNA, 23 nt, Mycobacterium bovis subsp bovis AF2122/97
cgcgggugcgcugcagcgagacc

SEQ ID NO: 1078902 - RNA, 13 nt, Mycobacterium bovis subsp bovis AF2122/97
cgcgggugcggca

SEQ ID NO: 1078903 - RNA, 18 nt, Mycobacterium bovis subsp bovis AF2122/97
cgcggguggcagcggcga

SEQ ID NO: 1078904 - RNA, 18 nt, Mycobacterium bovis subsp bovis AF2122/97
aacagcggggugugcggu

SEQ ID NO: 1078905 - RNA, 13 nt, Mycobacterium bovis subsp bovis AF2122/97
aacagcggcacga

SEQ ID NO: 1078906 - RNA, 13 nt, Mycobacterium bovis subsp bovis AF2122/97
aacagcgcgucgg

SEQ ID NO: 1078907 - RNA, 13 nt, Mycobacterium bovis subsp bovis AF2122/97
aacagcgcgccgg

SEQ ID NO: 1078908 - RNA, 13 nt, Mycobacterium bovis subsp bovis AF2122/97
aacagcgauccga

SEQ ID NO: 1078909 - RNA, 19 nt, Mycobacterium bovis subsp bovis AF2122/97
aacagcgucuggccgucgc

SEQ ID NO: 1078910 - RNA, 21 nt, Mycobacterium bovis subsp bovis AF2122/97
aacagcgggggcagcgcgaac

SEQ ID NO: 1078911 - RNA, 16 nt, Mycobacterium bovis subsp bovis AF2122/97
aacagcugcccgccag

SEQ ID NO: 1078912 - RNA, 13 nt, Mycobacterium bovis subsp bovis AF2122/97
cgcgcggcggccg

SEQ ID NO: 1078913 - RNA, 12 nt, Mycobacterium bovis subsp bovis AF2122/97
cgcgcggcucga

SEQ ID NO: 1078914 - RNA, 15 nt, Mycobacterium bovis subsp bovis AF2122/97
cgcgcgggccgccgc

SEQ ID NO: 1078915 - RNA, 20 nt, Mycobacterium bovis subsp bovis AF2122/97
cgcgcgggguggcggcgcug

SEQ ID NO: 1078916 - RNA, 13 nt, Mycobacterium bovis subsp bovis AF2122/97
cgcgcggugcggc

SEQ ID NO: 1078917 - RNA, 16 nt, Mycobacterium bovis subsp bovis AF2122/97
cgcgcguaauccgagc

SEQ ID NO: 1078918 - RNA, 18 nt, Mycobacterium bovis subsp bovis AF2122/97
cgcgcguaauccgagcgc

SEQ ID NO: 1078919 - RNA, 23 nt, Mycobacterium bovis subsp bovis AF2122/97
cgcgcguaauccgagcgcggcgg

SEQ ID NO: 1078920 - RNA, 19 nt, Mycobacterium bovis subsp bovis AF2122/97
cgcgcggugauggucaccg

SEQ ID NO: 1078921 - RNA, 17 nt, Mycobacterium bovis subsp bovis AF2122/97
cgcgcgguagucgucgc

SEQ ID NO: 1078922 - RNA, 12 nt, Mycobacterium bovis subsp bovis AF2122/97
cgcgcgguggcg

SEQ ID NO: 1078923 - RNA, 18 nt, Mycobacterium bovis subsp bovis AF2122/97
cgcgcgguggcggucgcc

SEQ ID NO: 1078924 - RNA, 16 nt, Mycobacterium bovis subsp bovis AF2122/97
cgcgcgguacugcgca

SEQ ID NO: 1078925 - RNA, 14 nt, Mycobacterium bovis subsp bovis AF2122/97
cgcgcuaaugucga

SEQ ID NO: 1078926 - RNA, 18 nt, Mycobacterium bovis subsp bovis AF2122/97
cgcgcgugugccugaguu

SEQ ID NO: 1078927 - RNA, 16 nt, Mycobacterium bovis subsp bovis AF2122/97
cgcgcguugcggucaa

SEQ ID NO: 1078928 - RNA, 14 nt, Mycobacterium bovis subsp bovis AF2122/97
cgcgcguugcgguc

SEQ ID NO: 1078929 - RNA, 17 nt, Mycobacterium bovis subsp bovis AF2122/97
cgcgcuaaccuuggcga

SEQ ID NO: 1078930 - RNA, 17 nt, Mycobacterium bovis subsp bovis AF2122/97
cgcgcuaccagcucacg

SEQ ID NO: 1078931 - RNA, 19 nt, Mycobacterium bovis subsp bovis AF2122/97
cgcgcuacgcggccgaggu

SEQ ID NO: 1078932 - RNA, 14 nt, Mycobacterium bovis subsp bovis AF2122/97
cgcgcucaacggcg

SEQ ID NO: 1078933 - RNA, 13 nt, Mycobacterium bovis subsp bovis AF2122/97
cgcgcucaccgac

SEQ ID NO: 1078934 - RNA, 14 nt, Mycobacterium bovis subsp bovis AF2122/97
cgcgcucaccgggg

SEQ ID NO: 1078935 - RNA, 14 nt, Mycobacterium bovis subsp bovis AF2122/97
cgcgcucaccgacg

SEQ ID NO: 1078936 - RNA, 19 nt, Mycobacterium bovis subsp bovis AF2122/97
cgcgcucaccgacgcugac

SEQ ID NO: 1078937 - RNA, 19 nt, Mycobacterium bovis subsp bovis AF2122/97
cgcgcucaccggggccguc

SEQ ID NO: 1078938 - RNA, 21 nt, Mycobacterium bovis subsp bovis AF2122/97
cgcgcucaccggggccgucgg

SEQ ID NO: 1078939 - RNA, 24 nt, Mycobacterium bovis subsp bovis AF2122/97
cgcgcucaccggggccgucggcaa

SEQ ID NO: 1078940 - RNA, 18 nt, Mycobacterium bovis subsp bovis AF2122/97
cgcgcucaucgaccgcgg

SEQ ID NO: 1078941 - RNA, 23 nt, Mycobacterium bovis subsp bovis AF2122/97
cgcgcucaucgaccgcggccggg

SEQ ID NO: 1078942 - RNA, 17 nt, Mycobacterium bovis subsp bovis AF2122/97
cgcgcucaucgcggcga

SEQ ID NO: 1078943 - RNA, 20 nt, Mycobacterium bovis subsp bovis AF2122/97
cgcgcucauguucucgaccg

SEQ ID NO: 1078944 - RNA, 21 nt, Mycobacterium bovis subsp bovis AF2122/97
cgcgcuccaacaaugccagcu

SEQ ID NO: 1078945 - RNA, 13 nt, Mycobacterium bovis subsp bovis AF2122/97
cgcgcucagguca

SEQ ID NO: 1078946 - RNA, 19 nt, Mycobacterium bovis subsp bovis AF2122/97
cgcgcuacgucaagccgug

SEQ ID NO: 1078947 - RNA, 17 nt, Mycobacterium bovis subsp bovis AF2122/97
cgcgcucagcuccggcg

SEQ ID NO: 1078948 - RNA, 13 nt, Mycobacterium bovis subsp bovis AF2122/97
cgcgcguccgggc

SEQ ID NO: 1078949 - RNA, 14 nt, Mycobacterium bovis subsp bovis AF2122/97
cgcgcguccgucgg

SEQ ID NO: 1078950 - RNA, 15 nt, Mycobacterium bovis subsp bovis AF2122/97
cgcgcguuguggcga

SEQ ID NO: 1078951 - RNA, 17 nt, Mycobacterium bovis subsp bovis AF2122/97
cgcgcguuuagucuccg

SEQ ID NO: 1078952 - RNA, 16 nt, Mycobacterium bovis subsp bovis AF2122/97
cgcgcguucggcgcug

SEQ ID NO: 1078953 - RNA, 22 nt, Mycobacterium bovis subsp bovis AF2122/97
cgcgcguucggcgcugaucgcg

SEQ ID NO: 1078954 - RNA, 14 nt, Mycobacterium bovis subsp bovis AF2122/97
cgcgcguugaaguc

SEQ ID NO: 1078955 - RNA, 18 nt, Mycobacterium bovis subsp bovis AF2122/97
cgcgcguugaagucgccg

SEQ ID NO: 1078956 - RNA, 20 nt, Mycobacterium bovis subsp bovis AF2122/97
cgcgcguugaagucgccggu

SEQ ID NO: 1078957 - RNA, 21 nt, Mycobacterium bovis subsp bovis AF2122/97
cgcgcguggucgccccgauga

SEQ ID NO: 1078958 - RNA, 14 nt, Mycobacterium bovis subsp bovis AF2122/97
cgcgcguucggcga

SEQ ID NO: 1078959 - RNA, 17 nt, Mycobacterium bovis subsp bovis AF2122/97
cgcgcguucggcgagca

SEQ ID NO: 1078960 - RNA, 15 nt, Mycobacterium bovis subsp bovis AF2122/97
cgcgcguucggcgcu

SEQ ID NO: 1078961 - RNA, 20 nt, Mycobacterium bovis subsp bovis AF2122/97
cgcgcugcgcgacugauccu

SEQ ID NO: 1078962 - RNA, 18 nt, Mycobacterium bovis subsp bovis AF2122/97
cgcgcugcggcccacacc

SEQ ID NO: 1078963 - RNA, 19 nt, Mycobacterium bovis subsp bovis AF2122/97
cgcgcuggacaacggcggu

SEQ ID NO: 1078964 - RNA, 19 nt, Mycobacterium bovis subsp bovis AF2122/97
cgcgcugcugucgauuucg

SEQ ID NO: 1078965 - RNA, 13 nt, Mycobacterium bovis subsp bovis AF2122/97
cgcgcuggcgccc

SEQ ID NO: 1078966 - RNA, 22 nt, Mycobacterium bovis subsp bovis AF2122/97
cgcgcuggcgcccuugccggcg

SEQ ID NO: 1078967 - RNA, 20 nt, Mycobacterium bovis subsp bovis AF2122/97
cgcgcuggcgccggccagcc

SEQ ID NO: 1078968 - RNA, 14 nt, Mycobacterium bovis subsp bovis AF2122/97
cgcgcuggcgggcg

SEQ ID NO: 1078969 - RNA, 14 nt, Mycobacterium bovis subsp bovis AF2122/97
cgcgcugggcugcc

SEQ ID NO: 1078970 - RNA, 20 nt, Mycobacterium bovis subsp bovis AF2122/97
cgcgcugggcccgagcgcgc

SEQ ID NO: 1078971 - RNA, 18 nt, Mycobacterium bovis subsp bovis AF2122/97
cgcgcuggcuacccaccg

SEQ ID NO: 1078972 - RNA, 20 nt, Mycobacterium bovis subsp bovis AF2122/97
cgcggacaugacagccccgc

SEQ ID NO: 1078973 - RNA, 23 nt, Mycobacterium bovis subsp bovis AF2122/97
cgcggacagguagucgccgguca

SEQ ID NO: 1078974 - RNA, 17 nt, Mycobacterium bovis subsp bovis AF2122/97
cgcggaacaccgaggcg

SEQ ID NO: 1078975 - RNA, 20 nt, Mycobacterium bovis subsp bovis AF2122/97
cgcggaacgcgucgccgacg

SEQ ID NO: 1078976 - RNA, 23 nt, Mycobacterium bovis subsp bovis AF2122/97
cgcggaacgcgucgccgacgccg

SEQ ID NO: 1078977 - RNA, 15 nt, Mycobacterium bovis subsp bovis AF2122/97
cgcggaacgcgucgc

SEQ ID NO: 1078978 - RNA, 21 nt, Mycobacterium bovis subsp bovis AF2122/97
cgcggaaaccaucgccagccg

SEQ ID NO: 1078979 - RNA, 16 nt, Mycobacterium bovis subsp bovis AF2122/97
cgcggaaaccaucgcc

SEQ ID NO: 1078980 - RNA, 18 nt, Mycobacterium bovis subsp bovis AF2122/97
cgcggaaaccaucgccag

SEQ ID NO: 1078981 - RNA, 12 nt, Mycobacterium bovis subsp bovis AF2122/97
cgcgcugggcgc

SEQ ID NO: 1078982 - RNA, 22 nt, Mycobacterium bovis subsp bovis AF2122/97
cgcgcuuucgagugcagcggcg

SEQ ID NO: 1078983 - RNA, 16 nt, Mycobacterium bovis subsp bovis AF2122/97
cgcgcugaaggccggu

SEQ ID NO: 1078984 - RNA, 14 nt, Mycobacterium bovis subsp bovis AF2122/97
cgcgcucggccagc

SEQ ID NO: 1078985 - RNA, 17 nt, Mycobacterium bovis subsp bovis AF2122/97
cgcgcucgggcgagauc

SEQ ID NO: 1078986 - RNA, 16 nt, Mycobacterium bovis subsp bovis AF2122/97
cgcgcucggugccgcc

SEQ ID NO: 1078987 - RNA, 10 nt, Mycobacterium bovis subsp bovis AF2122/97
cgcgcugcca

SEQ ID NO: 1078988 - RNA, 14 nt, Mycobacterium bovis subsp bovis AF2122/97
cgcgcugagguggc

SEQ ID NO: 1078989 - RNA, 21 nt, Mycobacterium bovis subsp bovis AF2122/97
cgcgcugccaguucuuggcga

SEQ ID NO: 1078990 - RNA, 12 nt, Mycobacterium bovis subsp bovis AF2122/97
cgcgcugccggc

SEQ ID NO: 1078991 - RNA, 15 nt, Mycobacterium bovis subsp bovis AF2122/97
cgcgcucggccagca

SEQ ID NO: 1078992 - RNA, 18 nt, Mycobacterium bovis subsp bovis AF2122/97
cgcgcucgcucaccggcg

SEQ ID NO: 1078993 - RNA, 19 nt, Mycobacterium bovis subsp bovis AF2122/97
cgcgcucgcucaccggcug

SEQ ID NO: 1078994 - RNA, 20 nt, Mycobacterium bovis subsp bovis AF2122/97
cgcgcucgcucaccggcugg

SEQ ID NO: 1078995 - RNA, 22 nt, Mycobacterium bovis subsp bovis AF2122/97
cgcgcucgcucaccggcuggug

SEQ ID NO: 1078996 - RNA, 14 nt, Mycobacterium bovis subsp bovis AF2122/97
cgcgcucgcucacc

SEQ ID NO: 1078997 - RNA, 12 nt, Mycobacterium bovis subsp bovis AF2122/97
cgcgcucgcgca

SEQ ID NO: 1078998 - RNA, 12 nt, Mycobacterium bovis subsp bovis AF2122/97
cgcgcucccggc

SEQ ID NO: 1078999 - RNA, 14 nt, Mycobacterium bovis subsp bovis AF2122/97
cgcgcucgauggcg

SEQ ID NO: 1079000 - RNA, 16 nt, Mycobacterium bovis subsp bovis AF2122/97
cgcgcucgauggcggc

SEQ ID NO: 1079001 - RNA, 17 nt, Mycobacterium bovis subsp bovis AF2122/97
cgcgcucgauggcggcc

SEQ ID NO: 1079002 - RNA, 15 nt, Mycobacterium bovis subsp bovis AF2122/97
cgcgcucgcccagga

SEQ ID NO: 1079003 - RNA, 16 nt, Mycobacterium bovis subsp bovis AF2122/97
cgcgcucccggcgucu

SEQ ID NO: 1079004 - RNA, 22 nt, Mycobacterium bovis subsp bovis AF2122/97
cgcgcuccaacaaugccagcug

SEQ ID NO: 1079005 - RNA, 17 nt, Mycobacterium bovis subsp bovis AF2122/97
cgcgccggucgccgacg

SEQ ID NO: 1079006 - RNA, 13 nt, Mycobacterium bovis subsp bovis AF2122/97
cgcgccggucguc

SEQ ID NO: 1079007 - RNA, 17 nt, Mycobacterium bovis subsp bovis AF2122/97
cgcgccguaguucuccg

SEQ ID NO: 1079008 - RNA, 17 nt, Mycobacterium bovis subsp bovis AF2122/97
cgcgccguacguucacc

SEQ ID NO: 1079009 - RNA, 21 nt, Mycobacterium bovis subsp bovis AF2122/97
cgcgccguacguucaccaccg

SEQ ID NO: 1079010 - RNA, 17 nt, Mycobacterium bovis subsp bovis AF2122/97
cgcgccguagaccagca

SEQ ID NO: 1079011 - RNA, 19 nt, Mycobacterium bovis subsp bovis AF2122/97
cgcgccguagaccagcagg

SEQ ID NO: 1079012 - RNA, 16 nt, Mycobacterium bovis subsp bovis AF2122/97
cgcgccgucucgaagc

SEQ ID NO: 1079013 - RNA, 20 nt, Mycobacterium bovis subsp bovis AF2122/97
cgcgccgucggcgaugaagu

SEQ ID NO: 1079014 - RNA, 22 nt, Mycobacterium bovis subsp bovis AF2122/97
cgcgccguaacagccggccgga

SEQ ID NO: 1079015 - RNA, 16 nt, Mycobacterium bovis subsp bovis AF2122/97
cgcgccgucggguucc

SEQ ID NO: 1079016 - RNA, 19 nt, Mycobacterium bovis subsp bovis AF2122/97
cgcgccgucgucgaccacg

SEQ ID NO: 1079017 - RNA, 22 nt, Mycobacterium bovis subsp bovis AF2122/97
cgcgccgucgucgaccacgacg

SEQ ID NO: 1079018 - RNA, 23 nt, Mycobacterium bovis subsp bovis AF2122/97
cgcgccguggacgaucaacccgg

SEQ ID NO: 1079019 - RNA, 13 nt, Mycobacterium bovis subsp bovis AF2122/97
cgcgccguucacc

SEQ ID NO: 1079020 - RNA, 23 nt, Mycobacterium bovis subsp bovis AF2122/97
cgcgccguucacccuggugguca

SEQ ID NO: 1079021 - RNA, 14 nt, Mycobacterium bovis subsp bovis AF2122/97
cgcgccugcccggg

SEQ ID NO: 1079022 - RNA, 18 nt, Mycobacterium bovis subsp bovis AF2122/97
cgcgccugccucaccgcc

SEQ ID NO: 1079023 - RNA, 18 nt, Mycobacterium bovis subsp bovis AF2122/97
cgcgccuggagcgaucuc

SEQ ID NO: 1079024 - RNA, 22 nt, Mycobacterium bovis subsp bovis AF2122/97
cgcgccugcgccacccgcggug

SEQ ID NO: 1079025 - RNA, 19 nt, Mycobacterium bovis subsp bovis AF2122/97
cgcgccugccucaccgccg

SEQ ID NO: 1079026 - RNA, 19 nt, Mycobacterium bovis subsp bovis AF2122/97
cgcgccuccguugccccca

SEQ ID NO: 1079027 - RNA, 19 nt, Mycobacterium bovis subsp bovis AF2122/97
cgcgccguucgccugguca

SEQ ID NO: 1079028 - RNA, 21 nt, Mycobacterium bovis subsp bovis AF2122/97
cgcgccguucgccuggucacc

SEQ ID NO: 1079029 - RNA, 18 nt, Mycobacterium bovis subsp bovis AF2122/97
cgcgccguucugaucugc

SEQ ID NO: 1079030 - RNA, 21 nt, Mycobacterium bovis subsp bovis AF2122/97
cgcgccguucugaucugcgca

SEQ ID NO: 1079031 - RNA, 22 nt, Mycobacterium bovis subsp bovis AF2122/97
cgcgcgagauccuucgcguugg

SEQ ID NO: 1079032 - RNA, 19 nt, Mycobacterium bovis subsp bovis AF2122/97
cgcgcgacuuucugcgcgu

SEQ ID NO: 1079033 - RNA, 16 nt, Mycobacterium bovis subsp bovis AF2122/97
cgcgcgaugcuggcga

SEQ ID NO: 1079034 - RNA, 18 nt, Mycobacterium bovis subsp bovis AF2122/97
cgcgcgcaacccugccgc

SEQ ID NO: 1079035 - RNA, 19 nt, Mycobacterium bovis subsp bovis AF2122/97
cgcgcgcacgccaccggga

SEQ ID NO: 1079036 - RNA, 23 nt, Mycobacterium bovis subsp bovis AF2122/97
cgcgcgcagaucguccaccgccg

SEQ ID NO: 1079037 - RNA, 22 nt, Mycobacterium bovis subsp bovis AF2122/97
cgcgcgcagaugagcgcggcga

SEQ ID NO: 1079038 - RNA, 16 nt, Mycobacterium bovis subsp bovis AF2122/97
cgcgcgacaacccggc

SEQ ID NO: 1079039 - RNA, 21 nt, Mycobacterium bovis subsp bovis AF2122/97
cgcgcgacaacccggcgucga

SEQ ID NO: 1079040 - RNA, 23 nt, Mycobacterium bovis subsp bovis AF2122/97
cgcgcgaacgucaaccgggcggc

SEQ ID NO: 1079041 - RNA, 13 nt, Mycobacterium bovis subsp bovis AF2122/97
cgcgcgaacccca

SEQ ID NO: 1079042 - RNA, 15 nt, Mycobacterium bovis subsp bovis AF2122/97
cgcgcgaaccgcucc

SEQ ID NO: 1079043 - RNA, 20 nt, Mycobacterium bovis subsp bovis AF2122/97
cgcgcgaccauacccgcgcg

SEQ ID NO: 1079044 - RNA, 13 nt, Mycobacterium bovis subsp bovis AF2122/97
cgcgcgacggccg

SEQ ID NO: 1079045 - RNA, 15 nt, Mycobacterium bovis subsp bovis AF2122/97
cgcgcgacggccggg

SEQ ID NO: 1079046 - RNA, 19 nt, Mycobacterium bovis subsp bovis AF2122/97
cgcgccuugcuuccgggac

SEQ ID NO: 1079047 - RNA, 21 nt, Mycobacterium bovis subsp bovis AF2122/97
cgcgccuugauggucuccacc

SEQ ID NO: 1079048 - RNA, 18 nt, Mycobacterium bovis subsp bovis AF2122/97
cgcgccuucacgcuggcc

SEQ ID NO: 1079049 - RNA, 17 nt, Mycobacterium bovis subsp bovis AF2122/97
cgcgccugugccaccgc

SEQ ID NO: 1079050 - RNA, 19 nt, Mycobacterium bovis subsp bovis AF2122/97
cgcgccugugccaccgcug

SEQ ID NO: 1079051 - RNA, 13 nt, Mycobacterium bovis subsp bovis AF2122/97
cgcgcgccggcga

SEQ ID NO: 1079052 - RNA, 12 nt, Mycobacterium bovis subsp bovis AF2122/97
cgcgcgccggcu

SEQ ID NO: 1079053 - RNA, 13 nt, Mycobacterium bovis subsp bovis AF2122/97
cgcgcgccggcgg

SEQ ID NO: 1079054 - RNA, 14 nt, Mycobacterium bovis subsp bovis AF2122/97
cgcgcgcgauggac

SEQ ID NO: 1079055 - RNA, 14 nt, Mycobacterium bovis subsp bovis AF2122/97
cgcgcgcggcguag

SEQ ID NO: 1079056 - RNA, 23 nt, Mycobacterium bovis subsp bovis AF2122/97
cgcgcgcccgaaugcgacgucgu

SEQ ID NO: 1079057 - RNA, 16 nt, Mycobacterium bovis subsp bovis AF2122/97
cgcgcgcccgauccgg

SEQ ID NO: 1079058 - RNA, 17 nt, Mycobacterium bovis subsp bovis AF2122/97
cgcgcgcccgauccggu

SEQ ID NO: 1079059 - RNA, 13 nt, Mycobacterium bovis subsp bovis AF2122/97
cgcgcgccgagcc

SEQ ID NO: 1079060 - RNA, 16 nt, Mycobacterium bovis subsp bovis AF2122/97
cgcgcgccgagcccgg

SEQ ID NO: 1079061 - RNA, 14 nt, Mycobacterium bovis subsp bovis AF2122/97
cgcgcgccgcagcg

SEQ ID NO: 1079062 - RNA, 12 nt, Mycobacterium bovis subsp bovis AF2122/97
cgcgcgccgcga

SEQ ID NO: 1079063 - RNA, 14 nt, Mycobacterium bovis subsp bovis AF2122/97
cgcgcgccgcgacg

SEQ ID NO: 1079064 - RNA, 15 nt, Mycobacterium bovis subsp bovis AF2122/97
cgcgcgccgcgacga

SEQ ID NO: 1079065 - RNA, 14 nt, Mycobacterium bovis subsp bovis AF2122/97
cgcgcgccgcuggg

SEQ ID NO: 1079066 - RNA, 15 nt, Mycobacterium bovis subsp bovis AF2122/97
cgcgcgcaggccgcc

SEQ ID NO: 1079067 - RNA, 16 nt, Mycobacterium bovis subsp bovis AF2122/97
cgcgcgcagcugacgu

SEQ ID NO: 1079068 - RNA, 14 nt, Mycobacterium bovis subsp bovis AF2122/97
cgcgcgccagcucg

SEQ ID NO: 1079069 - RNA, 18 nt, Mycobacterium bovis subsp bovis AF2122/97
cgcgcgccagcucggcgg

SEQ ID NO: 1079070 - RNA, 16 nt, Mycobacterium bovis subsp bovis AF2122/97
cgcgcgcaucgcgccu

SEQ ID NO: 1079071 - RNA, 17 nt, Mycobacterium bovis subsp bovis AF2122/97
cgcgcgccaucgccucc

SEQ ID NO: 1079072 - RNA, 17 nt, Mycobacterium bovis subsp bovis AF2122/97
cgcgcgccauuggcggu

SEQ ID NO: 1079073 - RNA, 22 nt, Mycobacterium bovis subsp bovis AF2122/97
cgcgcggccagcccacucgucg

SEQ ID NO: 1079074 - RNA, 16 nt, Mycobacterium bovis subsp bovis AF2122/97
cgcgcggcccgccgag

SEQ ID NO: 1079075 - RNA, 22 nt, Mycobacterium bovis subsp bovis AF2122/97
cgcgcggcaccgauggcgcacc

SEQ ID NO: 1079076 - RNA, 14 nt, Mycobacterium bovis subsp bovis AF2122/97
cgcgcggccgcgcu

SEQ ID NO: 1079077 - RNA, 21 nt, Mycobacterium bovis subsp bovis AF2122/97
cgcgcggcgcagcaccgucgg

SEQ ID NO: 1079078 - RNA, 15 nt, Mycobacterium bovis subsp bovis AF2122/97
cgcgcggcgccgcaa

SEQ ID NO: 1079079 - RNA, 16 nt, Mycobacterium bovis subsp bovis AF2122/97
cgcgcggcgcgaucgu

SEQ ID NO: 1079080 - RNA, 12 nt, Mycobacterium bovis subsp bovis AF2122/97
cgcgcggcaccg

SEQ ID NO: 1079081 - RNA, 19 nt, Mycobacterium bovis subsp bovis AF2122/97
cgcgcggauggguacgaca

SEQ ID NO: 1079082 - RNA, 20 nt, Mycobacterium bovis subsp bovis AF2122/97
cgcgcggcaccgauggcgca

SEQ ID NO: 1079083 - RNA, 20 nt, Mycobacterium bovis subsp bovis AF2122/97
cgcgcggauggccucggcga

SEQ ID NO: 1079084 - RNA, 16 nt, Mycobacterium bovis subsp bovis AF2122/97
cgcgcggaucggcggc

SEQ ID NO: 1079085 - RNA, 20 nt, Mycobacterium bovis subsp bovis AF2122/97
cgcgcggaucggcggccgcg

SEQ ID NO: 1079086 - RNA, 15 nt, Mycobacterium bovis subsp bovis AF2122/97
cgcgcggaagcucau

SEQ ID NO: 1079087 - RNA, 19 nt, Mycobacterium bovis subsp bovis AF2122/97
cgcgcggagaccccgcgcg

SEQ ID NO: 1079088 - RNA, 23 nt, Mycobacterium bovis subsp bovis AF2122/97
cgcgcgcucgcucaccggcuggu

SEQ ID NO: 1079089 - RNA, 18 nt, Mycobacterium bovis subsp bovis AF2122/97
cgcgcgcucgcucaccgg

SEQ ID NO: 1079090 - RNA, 15 nt, Mycobacterium bovis subsp bovis AF2122/97
cgcgcgcucgcccag

SEQ ID NO: 1079091 - RNA, 12 nt, Mycobacterium bovis subsp bovis AF2122/97
cgcgcgcucgcg

SEQ ID NO: 1079092 - RNA, 13 nt, Mycobacterium bovis subsp bovis AF2122/97
cgcgcgcugcgca

SEQ ID NO: 1079093 - RNA, 14 nt, Mycobacterium bovis subsp bovis AF2122/97
cgcgcgcugagccg

SEQ ID NO: 1079094 - RNA, 16 nt, Mycobacterium bovis subsp bovis AF2122/97
cgcgcgcugagccgua

SEQ ID NO: 1079095 - RNA, 22 nt, Mycobacterium bovis subsp bovis AF2122/97
cgcgcgcugggcgcgcucaucg

SEQ ID NO: 1079096 - RNA, 13 nt, Mycobacterium bovis subsp bovis AF2122/97
cgcgcgcugggcg

SEQ ID NO: 1079097 - RNA, 12 nt, Mycobacterium bovis subsp bovis AF2122/97
cgcgccgagccc

SEQ ID NO: 1079098 - RNA, 17 nt, Mycobacterium bovis subsp bovis AF2122/97
cgcgccgaccucaucgg

SEQ ID NO: 1079099 - RNA, 20 nt, Mycobacterium bovis subsp bovis AF2122/97
cgcgccgaccucaucggcac

SEQ ID NO: 1079100 - RNA, 14 nt, Mycobacterium bovis subsp bovis AF2122/97
cgcgccgacggcca

SEQ ID NO: 1079101 - RNA, 13 nt, Mycobacterium bovis subsp bovis AF2122/97
cgcgcccggcgcu

SEQ ID NO: 1079102 - RNA, 13 nt, Mycobacterium bovis subsp bovis AF2122/97
cgcgcccggcgca

SEQ ID NO: 1079103 - RNA, 12 nt, Mycobacterium bovis subsp bovis AF2122/97
cgcgcccguccc

SEQ ID NO: 1079104 - RNA, 13 nt, Mycobacterium bovis subsp bovis AF2122/97
cgcgccccaccgc

SEQ ID NO: 1079105 - RNA, 17 nt, Mycobacterium bovis subsp bovis AF2122/97
cgcgccccaccgcgccg

SEQ ID NO: 1079106 - RNA, 17 nt, Mycobacterium bovis subsp bovis AF2122/97
cgcgccccaguucgacg

SEQ ID NO: 1079107 - RNA, 15 nt, Mycobacterium bovis subsp bovis AF2122/97
cgcgcccgcggccgc

SEQ ID NO: 1079108 - RNA, 20 nt, Mycobacterium bovis subsp bovis AF2122/97
cgcgcccgcggccgccagcg

SEQ ID NO: 1079109 - RNA, 13 nt, Mycobacterium bovis subsp bovis AF2122/97
cgcgcccgcgggc

SEQ ID NO: 1079110 - RNA, 16 nt, Mycobacterium bovis subsp bovis AF2122/97
cgcgccggccccgggg

SEQ ID NO: 1079111 - RNA, 13 nt, Mycobacterium bovis subsp bovis AF2122/97
cgcgccggucgcc

SEQ ID NO: 1079112 - RNA, 16 nt, Mycobacterium bovis subsp bovis AF2122/97
cgcgccggacagcgca

SEQ ID NO: 1079113 - RNA, 18 nt, Mycobacterium bovis subsp bovis AF2122/97
cgcgccgaguugcccggg

SEQ ID NO: 1079114 - RNA, 21 nt, Mycobacterium bovis subsp bovis AF2122/97
cgcgccgagcgugaagucacg

SEQ ID NO: 1079115 - RNA, 13 nt, Mycobacterium bovis subsp bovis AF2122/97
cgcgccgaucacc

SEQ ID NO: 1079116 - RNA, 21 nt, Mycobacterium bovis subsp bovis AF2122/97
cgcgccgcccgcuccuccggc

SEQ ID NO: 1079117 - RNA, 13 nt, Mycobacterium bovis subsp bovis AF2122/97
cgcgccgccccgc

SEQ ID NO: 1079118 - RNA, 16 nt, Mycobacterium bovis subsp bovis AF2122/97
cgcgccgccccgcucg

SEQ ID NO: 1079119 - RNA, 14 nt, Mycobacterium bovis subsp bovis AF2122/97
cgcgccgccgcuac

SEQ ID NO: 1079120 - RNA, 23 nt, Mycobacterium bovis subsp bovis AF2122/97
cgcgccgccgcuacccccgaugg

SEQ ID NO: 1079121 - RNA, 17 nt, Mycobacterium bovis subsp bovis AF2122/97
cgcgcacuugcguggcg

SEQ ID NO: 1079122 - RNA, 20 nt, Mycobacterium bovis subsp bovis AF2122/97
cgcgcagccgggcaccgaac

SEQ ID NO: 1079123 - RNA, 14 nt, Mycobacterium bovis subsp bovis AF2122/97
cgcgcagccgccgc

SEQ ID NO: 1079124 - RNA, 17 nt, Mycobacterium bovis subsp bovis AF2122/97
cgcgcagccgcucgacg

SEQ ID NO: 1079125 - RNA, 14 nt, Mycobacterium bovis subsp bovis AF2122/97
cgcgcagccggccc

SEQ ID NO: 1079126 - RNA, 12 nt, Mycobacterium bovis subsp bovis AF2122/97
cgcgcagcgcga

SEQ ID NO: 1079127 - RNA, 18 nt, Mycobacterium bovis subsp bovis AF2122/97
cgcgcagcgccgccaccc

SEQ ID NO: 1079128 - RNA, 14 nt, Mycobacterium bovis subsp bovis AF2122/97
cgcgcagcgauucg

SEQ ID NO: 1079129 - RNA, 17 nt, Mycobacterium bovis subsp bovis AF2122/97
cgcgcagcgcgaugucg

SEQ ID NO: 1079130 - RNA, 16 nt, Mycobacterium bovis subsp bovis AF2122/97
cgcgcagcgguccgcc

SEQ ID NO: 1079131 - RNA, 18 nt, Mycobacterium bovis subsp bovis AF2122/97
cgcgcagcgguccgccgc

SEQ ID NO: 1079132 - RNA, 19 nt, Mycobacterium bovis subsp bovis AF2122/97
cgcgcagguagcgccgcac

SEQ ID NO: 1079133 - RNA, 18 nt, Mycobacterium bovis subsp bovis AF2122/97
cgcgcagguagucgacga

SEQ ID NO: 1079134 - RNA, 17 nt, Mycobacterium bovis subsp bovis AF2122/97
cgcgcaucugcucggca

SEQ ID NO: 1079135 - RNA, 23 nt, Mycobacterium bovis subsp bovis AF2122/97
cgcgccagcucggcggcagcggc

SEQ ID NO: 1079136 - RNA, 19 nt, Mycobacterium bovis subsp bovis AF2122/97
cgcgccaggcuugcggcac

SEQ ID NO: 1079137 - RNA, 19 nt, Mycobacterium bovis subsp bovis AF2122/97
cgcgccaggucggugacga

SEQ ID NO: 1079138 - RNA, 15 nt, Mycobacterium bovis subsp bovis AF2122/97
cgcgccaggucggug

SEQ ID NO: 1079139 - RNA, 15 nt, Mycobacterium bovis subsp bovis AF2122/97
cgcgccaccuccgac

SEQ ID NO: 1079140 - RNA, 21 nt, Mycobacterium bovis subsp bovis AF2122/97
cgcgccaccuccgacgggcga

SEQ ID NO: 1079141 - RNA, 18 nt, Mycobacterium bovis subsp bovis AF2122/97
cgcgccacgcacccggca

SEQ ID NO: 1079142 - RNA, 15 nt, Mycobacterium bovis subsp bovis AF2122/97
cgcgccaccggcacc

SEQ ID NO: 1079143 - RNA, 17 nt, Mycobacterium bovis subsp bovis AF2122/97
cgcgccaccggcaccgc

SEQ ID NO: 1079144 - RNA, 21 nt, Mycobacterium bovis subsp bovis AF2122/97
cgcgccaccggcaccgccugc

SEQ ID NO: 1079145 - RNA, 16 nt, Mycobacterium bovis subsp bovis AF2122/97
cgcgccagcuugucgg

SEQ ID NO: 1079146 - RNA, 15 nt, Mycobacterium bovis subsp bovis AF2122/97
cgcgccaccgagccc

SEQ ID NO: 1079147 - RNA, 23 nt, Mycobacterium bovis subsp bovis AF2122/97
cgcgccaccgagcccuccagggc

SEQ ID NO: 1079148 - RNA, 16 nt, Mycobacterium bovis subsp bovis AF2122/97
cgcgccacccagcacc

SEQ ID NO: 1079149 - RNA, 16 nt, Mycobacterium bovis subsp bovis AF2122/97
cgcgccaccagcaccg

SEQ ID NO: 1079150 - RNA, 22 nt, Mycobacterium bovis subsp bovis AF2122/97
cgcgccaccagcaccgccgcug

SEQ ID NO: 1079151 - RNA, 22 nt, Mycobacterium bovis subsp bovis AF2122/97
cgcgccaacagaugccacccag

SEQ ID NO: 1079152 - RNA, 16 nt, Mycobacterium bovis subsp bovis AF2122/97
cgcgcaucgcggccga

SEQ ID NO: 1079153 - RNA, 14 nt, Mycobacterium bovis subsp bovis AF2122/97
cgcgcaugccccga

SEQ ID NO: 1079154 - RNA, 16 nt, Mycobacterium bovis subsp bovis AF2122/97
cgcgcauuucaccggg

SEQ ID NO: 1079155 - RNA, 21 nt, Mycobacterium bovis subsp bovis AF2122/97
cgcgcauuucguggcgcgccg

SEQ ID NO: 1079156 - RNA, 18 nt, Mycobacterium bovis subsp bovis AF2122/97
cgcgcauuuuucgccagc

SEQ ID NO: 1079157 - RNA, 20 nt, Mycobacterium bovis subsp bovis AF2122/97
cgcgcauuuuucgccagcug

SEQ ID NO: 1079158 - RNA, 22 nt, Mycobacterium bovis subsp bovis AF2122/97
cgcgcauguuaugagcgcucgg

SEQ ID NO: 1079159 - RNA, 17 nt, Mycobacterium bovis subsp bovis AF2122/97
cgcgacgucugccaggc

SEQ ID NO: 1079160 - RNA, 14 nt, Mycobacterium bovis subsp bovis AF2122/97
cgcgacggcgccgg

SEQ ID NO: 1079161 - RNA, 15 nt, Mycobacterium bovis subsp bovis AF2122/97
cgcgacggcgccggc

SEQ ID NO: 1079162 - RNA, 16 nt, Mycobacterium bovis subsp bovis AF2122/97
cgcgacggcgccggca

SEQ ID NO: 1079163 - RNA, 16 nt, Mycobacterium bovis subsp bovis AF2122/97
cgcgacggaccaucuc

SEQ ID NO: 1079164 - RNA, 13 nt, Mycobacterium bovis subsp bovis AF2122/97
cgcgacggcgccc

SEQ ID NO: 1079165 - RNA, 23 nt, Mycobacterium bovis subsp bovis AF2122/97
cgcgacugcaccuggccgcccgc

SEQ ID NO: 1079166 - RNA, 17 nt, Mycobacterium bovis subsp bovis AF2122/97
cgcgacuaccaucgccg

SEQ ID NO: 1079167 - RNA, 16 nt, Mycobacterium bovis subsp bovis AF2122/97
cgcgacugauccucga

SEQ ID NO: 1079168 - RNA, 18 nt, Mycobacterium bovis subsp bovis AF2122/97
cgcgacuagacgccgccg

SEQ ID NO: 1079169 - RNA, 12 nt, Mycobacterium bovis subsp bovis AF2122/97
cgcgacggcagg

SEQ ID NO: 1079170 - RNA, 19 nt, Mycobacterium bovis subsp bovis AF2122/97
cgcgacguugaacucgagu

SEQ ID NO: 1079171 - RNA, 14 nt, Mycobacterium bovis subsp bovis AF2122/97
cgcgacuaccaucg

SEQ ID NO: 1079172 - RNA, 12 nt, Mycobacterium bovis subsp bovis AF2122/97
cgccugcccgaa

SEQ ID NO: 1079173 - RNA, 20 nt, Mycobacterium bovis subsp bovis AF2122/97
cgccugcccgaaccaccacc

SEQ ID NO: 1079174 - RNA, 23 nt, Mycobacterium bovis subsp bovis AF2122/97
cgccugcccgaaccaccaccggc

SEQ ID NO: 1079175 - RNA, 18 nt, Mycobacterium bovis subsp bovis AF2122/97
cgccugcgcggcugccgu

SEQ ID NO: 1079176 - RNA, 17 nt, Mycobacterium bovis subsp bovis AF2122/97
cgccugcuccaccgucg

SEQ ID NO: 1079177 - RNA, 14 nt, Mycobacterium bovis subsp bovis AF2122/97
cgccugcgggaacg

SEQ ID NO: 1079178 - RNA, 21 nt, Mycobacterium bovis subsp bovis AF2122/97
cgccugcucgucggccaccgc

SEQ ID NO: 1079179 - RNA, 14 nt, Mycobacterium bovis subsp bovis AF2122/97
cgcgacggcaacgu

SEQ ID NO: 1079180 - RNA, 13 nt, Mycobacterium bovis subsp bovis AF2122/97
cgcgacggcaagc

SEQ ID NO: 1079181 - RNA, 23 nt, Mycobacterium bovis subsp bovis AF2122/97
cgcgacggcaagcacgguggccg

SEQ ID NO: 1079182 - RNA, 12 nt, Mycobacterium bovis subsp bovis AF2122/97
cgcgacggcacg

SEQ ID NO: 1079183 - RNA, 19 nt, Mycobacterium bovis subsp bovis AF2122/97
cgcgacggcacgaucaucg

SEQ ID NO: 1079184 - RNA, 22 nt, Mycobacterium bovis subsp bovis AF2122/97
cgcgagcagacgcuaaagcccc

SEQ ID NO: 1079185 - RNA, 20 nt, Mycobacterium bovis subsp bovis AF2122/97
cgcgagcagacgugggcgcu

SEQ ID NO: 1079186 - RNA, 24 nt, Mycobacterium bovis subsp bovis AF2122/97
cgcgagcagacgugggcgcuggug

SEQ ID NO: 1079187 - RNA, 14 nt, Mycobacterium bovis subsp bovis AF2122/97
cgcgagcagcccgg

SEQ ID NO: 1079188 - RNA, 21 nt, Mycobacterium bovis subsp bovis AF2122/97
cgcgagcagcuacagcuugcg

SEQ ID NO: 1079189 - RNA, 21 nt, Mycobacterium bovis subsp bovis AF2122/97
cgcgagcagacgcaaaaucgc

SEQ ID NO: 1079190 - RNA, 15 nt, Mycobacterium bovis subsp bovis AF2122/97
cgcgagcagacgcgg

SEQ ID NO: 1079191 - RNA, 14 nt, Mycobacterium bovis subsp bovis AF2122/97
cgcgagaucagccg

SEQ ID NO: 1079192 - RNA, 12 nt, Mycobacterium bovis subsp bovis AF2122/97
cgcgagaucggg

SEQ ID NO: 1079193 - RNA, 19 nt, Mycobacterium bovis subsp bovis AF2122/97
cgcgagaucagccggcagc

SEQ ID NO: 1079194 - RNA, 20 nt, Mycobacterium bovis subsp bovis AF2122/97
cgcgagaucagccggcagcg

SEQ ID NO: 1079195 - RNA, 17 nt, Mycobacterium bovis subsp bovis AF2122/97
cgcgagauccuucgcgu

SEQ ID NO: 1079196 - RNA, 14 nt, Mycobacterium bovis subsp bovis AF2122/97
cgcgagagccggcg

SEQ ID NO: 1079197 - RNA, 17 nt, Mycobacterium bovis subsp bovis AF2122/97
cgcgagagccggcggcg

SEQ ID NO: 1079198 - RNA, 16 nt, Mycobacterium bovis subsp bovis AF2122/97
cgcgacuugcaccccg

SEQ ID NO: 1079199 - RNA, 20 nt, Mycobacterium bovis subsp bovis AF2122/97
cgcgacuuucugcgcguggg

SEQ ID NO: 1079200 - RNA, 17 nt, Mycobacterium bovis subsp bovis AF2122/97
cgcgagaauucgcggga

SEQ ID NO: 1079201 - RNA, 16 nt, Mycobacterium bovis subsp bovis AF2122/97
cgcgauagauacccgc

SEQ ID NO: 1079202 - RNA, 14 nt, Mycobacterium bovis subsp bovis AF2122/97
cgcgauagccgccg

SEQ ID NO: 1079203 - RNA, 16 nt, Mycobacterium bovis subsp bovis AF2122/97
cgcgauagccgccgcg

SEQ ID NO: 1079204 - RNA, 18 nt, Mycobacterium bovis subsp bovis AF2122/97
cgcgauagccgccgcggu

SEQ ID NO: 1079205 - RNA, 21 nt, Mycobacterium bovis subsp bovis AF2122/97
cgcgaucccaacgcccgggcg

SEQ ID NO: 1079206 - RNA, 21 nt, Mycobacterium bovis subsp bovis AF2122/97
cgcgauccccgcgcugagcac

SEQ ID NO: 1079207 - RNA, 18 nt, Mycobacterium bovis subsp bovis AF2122/97
cgcgaucccggccgucgc

SEQ ID NO: 1079208 - RNA, 12 nt, Mycobacterium bovis subsp bovis AF2122/97
cgcgcacgcgug

SEQ ID NO: 1079209 - RNA, 17 nt, Mycobacterium bovis subsp bovis AF2122/97
cgcgcacgcgugccgca

SEQ ID NO: 1079210 - RNA, 14 nt, Mycobacterium bovis subsp bovis AF2122/97
cgcgcacggcgucg

SEQ ID NO: 1079211 - RNA, 13 nt, Mycobacterium bovis subsp bovis AF2122/97
cgcgcacucgacg

SEQ ID NO: 1079212 - RNA, 20 nt, Mycobacterium bovis subsp bovis AF2122/97
cgcgcacucgacggucaucg

SEQ ID NO: 1079213 - RNA, 12 nt, Mycobacterium bovis subsp bovis AF2122/97
cgcgcacgucga

SEQ ID NO: 1079214 - RNA, 17 nt, Mycobacterium bovis subsp bovis AF2122/97
cgcgcaccccggcauac

SEQ ID NO: 1079215 - RNA, 14 nt, Mycobacterium bovis subsp bovis AF2122/97
cgcgcacgccaccg

SEQ ID NO: 1079216 - RNA, 20 nt, Mycobacterium bovis subsp bovis AF2122/97
cgcgcaccaccgcggcggcg

SEQ ID NO: 1079217 - RNA, 13 nt, Mycobacterium bovis subsp bovis AF2122/97
cgcgcaccaacac

SEQ ID NO: 1079218 - RNA, 18 nt, Mycobacterium bovis subsp bovis AF2122/97
cgcgcaccaacaccagcg

SEQ ID NO: 1079219 - RNA, 21 nt, Mycobacterium bovis subsp bovis AF2122/97
cgcgcacauaggcgaucgcau

SEQ ID NO: 1079220 - RNA, 22 nt, Mycobacterium bovis subsp bovis AF2122/97
cgcgcaacuuccauuuucgcca

SEQ ID NO: 1079221 - RNA, 21 nt, Mycobacterium bovis subsp bovis AF2122/97
cgcgcaacguagccagcagcg

SEQ ID NO: 1079222 - RNA, 21 nt, Mycobacterium bovis subsp bovis AF2122/97
cgcgaugcgccuugacgaucg

SEQ ID NO: 1079223 - RNA, 22 nt, Mycobacterium bovis subsp bovis AF2122/97
cgcgaugcucaaugugccgccg

SEQ ID NO: 1079224 - RNA, 23 nt, Mycobacterium bovis subsp bovis AF2122/97
cgcgaugcucaaugugccgccgg

SEQ ID NO: 1079225 - RNA, 17 nt, Mycobacterium bovis subsp bovis AF2122/97
cgcgauggcgguccacc

SEQ ID NO: 1079226 - RNA, 18 nt, Mycobacterium bovis subsp bovis AF2122/97
cgcgauggcgguccaccg

SEQ ID NO: 1079227 - RNA, 19 nt, Mycobacterium bovis subsp bovis AF2122/97
cgcgaugcgcaccagcggc

SEQ ID NO: 1079228 - RNA, 22 nt, Mycobacterium bovis subsp bovis AF2122/97
cgcgauggccaucaucgacggu

SEQ ID NO: 1079229 - RNA, 17 nt, Mycobacterium bovis subsp bovis AF2122/97
cgcgauggcagcgccga

SEQ ID NO: 1079230 - RNA, 20 nt, Mycobacterium bovis subsp bovis AF2122/97
cgcgauggcagcgccgaugg

SEQ ID NO: 1079231 - RNA, 20 nt, Mycobacterium bovis subsp bovis AF2122/97
cgcgaugggagcccggcggc

SEQ ID NO: 1079232 - RNA, 21 nt, Mycobacterium bovis subsp bovis AF2122/97
cgcgaugggagcccggcggcc

SEQ ID NO: 1079233 - RNA, 20 nt, Mycobacterium bovis subsp bovis AF2122/97
cgcgaugggcccagcggccg

SEQ ID NO: 1079234 - RNA, 19 nt, Mycobacterium bovis subsp bovis AF2122/97
cgcgcaacgcuggaggcga

SEQ ID NO: 1079235 - RNA, 20 nt, Mycobacterium bovis subsp bovis AF2122/97
cgcgcaacgcuggaggcgau

SEQ ID NO: 1079236 - RNA, 15 nt, Mycobacterium bovis subsp bovis AF2122/97
cgcgaugcaacucga

SEQ ID NO: 1079237 - RNA, 23 nt, Mycobacterium bovis subsp bovis AF2122/97
cgcgaugcagugcgacccgggcg

SEQ ID NO: 1079238 - RNA, 14 nt, Mycobacterium bovis subsp bovis AF2122/97
cgcgaugaucgcau

SEQ ID NO: 1079239 - RNA, 14 nt, Mycobacterium bovis subsp bovis AF2122/97
cgcgaugauggcgg

SEQ ID NO: 1079240 - RNA, 19 nt, Mycobacterium bovis subsp bovis AF2122/97
cgcgaugauggcgguaccg

SEQ ID NO: 1079241 - RNA, 14 nt, Mycobacterium bovis subsp bovis AF2122/97
cgcgaugaccgcac

SEQ ID NO: 1079242 - RNA, 15 nt, Mycobacterium bovis subsp bovis AF2122/97
cgcgaugaccucggc

SEQ ID NO: 1079243 - RNA, 16 nt, Mycobacterium bovis subsp bovis AF2122/97
cgcgaugaccucggcg

SEQ ID NO: 1079244 - RNA, 17 nt, Mycobacterium bovis subsp bovis AF2122/97
cgcgaugaccucggcga

SEQ ID NO: 1079245 - RNA, 20 nt, Mycobacterium bovis subsp bovis AF2122/97
cgcgaucgcagugagcagcc

SEQ ID NO: 1079246 - RNA, 19 nt, Mycobacterium bovis subsp bovis AF2122/97
cgcgaugaccucggcgaug

SEQ ID NO: 1079247 - RNA, 20 nt, Mycobacterium bovis subsp bovis AF2122/97
cgcgaugaccucggcgaugu

SEQ ID NO: 1079248 - RNA, 22 nt, Mycobacterium bovis subsp bovis AF2122/97
cgcgaugaccucggcgaugucg

SEQ ID NO: 1079249 - RNA, 13 nt, Mycobacterium bovis subsp bovis AF2122/97
cgcgaugagcggc

SEQ ID NO: 1079250 - RNA, 21 nt, Mycobacterium bovis subsp bovis AF2122/97
cgcgaugagcggcgcggcaaa

SEQ ID NO: 1079251 - RNA, 22 nt, Mycobacterium bovis subsp bovis AF2122/97
cgcgaucgacgcucggcuaugg

SEQ ID NO: 1079252 - RNA, 14 nt, Mycobacterium bovis subsp bovis AF2122/97
cgcgaucgacggug

SEQ ID NO: 1079253 - RNA, 16 nt, Mycobacterium bovis subsp bovis AF2122/97
cgcgaucgacgguguc

SEQ ID NO: 1079254 - RNA, 13 nt, Mycobacterium bovis subsp bovis AF2122/97
cgcgaucgccgac

SEQ ID NO: 1079255 - RNA, 12 nt, Mycobacterium bovis subsp bovis AF2122/97
cgcgaucgacgc

SEQ ID NO: 1079256 - RNA, 16 nt, Mycobacterium bovis subsp bovis AF2122/97
cgcgaucgacgcucgg

SEQ ID NO: 1079257 - RNA, 19 nt, Mycobacterium bovis subsp bovis AF2122/97
cggcccccaagcucugcgu

SEQ ID NO: 1079258 - RNA, 13 nt, Mycobacterium bovis subsp bovis AF2122/97
cggccccaggggc

SEQ ID NO: 1079259 - RNA, 20 nt, Mycobacterium bovis subsp bovis AF2122/97
cggccccaccgacagcccca

SEQ ID NO: 1079260 - RNA, 14 nt, Mycobacterium bovis subsp bovis AF2122/97
cggccccaccggua

SEQ ID NO: 1079261 - RNA, 20 nt, Mycobacterium bovis subsp bovis AF2122/97
cggccccaccgguaccgcca

SEQ ID NO: 1079262 - RNA, 22 nt, Mycobacterium bovis subsp bovis AF2122/97
cggccccaccgguaccgccacu

SEQ ID NO: 1079263 - RNA, 12 nt, Mycobacterium bovis subsp bovis AF2122/97
cggcccggccga

SEQ ID NO: 1079264 - RNA, 15 nt, Mycobacterium bovis subsp bovis AF2122/97
cggcccggcaggacu

SEQ ID NO: 1079265 - RNA, 18 nt, Mycobacterium bovis subsp bovis AF2122/97
cggcccuccaccgguguu

SEQ ID NO: 1079266 - RNA, 24 nt, Mycobacterium bovis subsp bovis AF2122/97
cggcccggcacccggugagaagaa

SEQ ID NO: 1079267 - RNA, 12 nt, Mycobacterium bovis subsp bovis AF2122/97
cggcccugcggc

SEQ ID NO: 1079268 - RNA, 16 nt, Mycobacterium bovis subsp bovis AF2122/97
cggcccugccgccggc

SEQ ID NO: 1079269 - RNA, 21 nt, Mycobacterium bovis subsp bovis AF2122/97
cggcccugccgccggccccgc

SEQ ID NO: 1079270 - RNA, 20 nt, Mycobacterium bovis subsp bovis AF2122/97
cggcccucgaauucggccgg

SEQ ID NO: 1079271 - RNA, 22 nt, Mycobacterium bovis subsp bovis AF2122/97
cggcccucgagcagugccgugc

SEQ ID NO: 1079272 - RNA, 17 nt, Mycobacterium bovis subsp bovis AF2122/97
cggcccucgaugccgcg

SEQ ID NO: 1079273 - RNA, 16 nt, Mycobacterium bovis subsp bovis AF2122/97
cggcccugaacgguuc

SEQ ID NO: 1079274 - RNA, 17 nt, Mycobacterium bovis subsp bovis AF2122/97
cggcccugagcugccga

SEQ ID NO: 1079275 - RNA, 20 nt, Mycobacterium bovis subsp bovis AF2122/97
cggcccugagcugccgagcg

SEQ ID NO: 1079276 - RNA, 15 nt, Mycobacterium bovis subsp bovis AF2122/97
cggcccugcucgccg

SEQ ID NO: 1079277 - RNA, 15 nt, Mycobacterium bovis subsp bovis AF2122/97
cggcccuucaccagc

SEQ ID NO: 1079278 - RNA, 14 nt, Mycobacterium bovis subsp bovis AF2122/97
cggcccuucgacga

SEQ ID NO: 1079279 - RNA, 17 nt, Mycobacterium bovis subsp bovis AF2122/97
cggccgacacgccgaug

SEQ ID NO: 1079280 - RNA, 22 nt, Mycobacterium bovis subsp bovis AF2122/97
cggcccuggacauaccggcccg

SEQ ID NO: 1079281 - RNA, 17 nt, Mycobacterium bovis subsp bovis AF2122/97
cggccgaccucggcaac

SEQ ID NO: 1079282 - RNA, 12 nt, Mycobacterium bovis subsp bovis AF2122/97
cggccgacccgg

SEQ ID NO: 1079283 - RNA, 14 nt, Mycobacterium bovis subsp bovis AF2122/97
cggccgacccggau

SEQ ID NO: 1079284 - RNA, 19 nt, Mycobacterium bovis subsp bovis AF2122/97
cggccgacgcuggcggugu

SEQ ID NO: 1079285 - RNA, 13 nt, Mycobacterium bovis subsp bovis AF2122/97
cggccgacgggug

SEQ ID NO: 1079286 - RNA, 13 nt, Mycobacterium bovis subsp bovis AF2122/97
cggccgagacggc

SEQ ID NO: 1079287 - RNA, 17 nt, Mycobacterium bovis subsp bovis AF2122/97
cggccgagacggcguug

SEQ ID NO: 1079288 - RNA, 15 nt, Mycobacterium bovis subsp bovis AF2122/97
cggccgagcgcaccg

SEQ ID NO: 1079289 - RNA, 15 nt, Mycobacterium bovis subsp bovis AF2122/97
cggccgacgaucaua

SEQ ID NO: 1079290 - RNA, 20 nt, Mycobacterium bovis subsp bovis AF2122/97
cggccgagccguugcgccuc

SEQ ID NO: 1079291 - RNA, 16 nt, Mycobacterium bovis subsp bovis AF2122/97
cggccgaggcggucuu

SEQ ID NO: 1079292 - RNA, 15 nt, Mycobacterium bovis subsp bovis AF2122/97
cggccgaguaccagc

SEQ ID NO: 1079293 - RNA, 16 nt, Mycobacterium bovis subsp bovis AF2122/97
cggccgaguaccagcc

SEQ ID NO: 1079294 - RNA, 18 nt, Mycobacterium bovis subsp bovis AF2122/97
cggccgaguaccagccca

SEQ ID NO: 1079295 - RNA, 23 nt, Mycobacterium bovis subsp bovis AF2122/97
cggccgaguaccagcccaccggc

SEQ ID NO: 1079296 - RNA, 21 nt, Mycobacterium bovis subsp bovis AF2122/97
cggccgagggauugccgugcu

SEQ ID NO: 1079297 - RNA, 15 nt, Mycobacterium bovis subsp bovis AF2122/97
cggccgaggucaccc

SEQ ID NO: 1079298 - RNA, 21 nt, Mycobacterium bovis subsp bovis AF2122/97
cggccgagcgcacuggggagg

SEQ ID NO: 1079299 - RNA, 22 nt, Mycobacterium bovis subsp bovis AF2122/97
cggccgaucagcagcuguuggc

SEQ ID NO: 1079300 - RNA, 15 nt, Mycobacterium bovis subsp bovis AF2122/97
cggccgcagccagca

SEQ ID NO: 1079301 - RNA, 15 nt, Mycobacterium bovis subsp bovis AF2122/97
cggccgcagccagcg

SEQ ID NO: 1079302 - RNA, 13 nt, Mycobacterium bovis subsp bovis AF2122/97
cggccgcaggcga

SEQ ID NO: 1079303 - RNA, 16 nt, Mycobacterium bovis subsp bovis AF2122/97
cggccgcagcggccag

SEQ ID NO: 1079304 - RNA, 18 nt, Mycobacterium bovis subsp bovis AF2122/97
cggccgcauccccgguac

SEQ ID NO: 1079305 - RNA, 18 nt, Mycobacterium bovis subsp bovis AF2122/97
cggccgcauucgugacga

SEQ ID NO: 1079306 - RNA, 15 nt, Mycobacterium bovis subsp bovis AF2122/97
cggccgcaucgccca

SEQ ID NO: 1079307 - RNA, 16 nt, Mycobacterium bovis subsp bovis AF2122/97
cggccgcaucggucaa

SEQ ID NO: 1079308 - RNA, 18 nt, Mycobacterium bovis subsp bovis AF2122/97
cggccgcaggcgaacacc

SEQ ID NO: 1079309 - RNA, 19 nt, Mycobacterium bovis subsp bovis AF2122/97
cggccgcauucgugacgag

SEQ ID NO: 1079310 - RNA, 20 nt, Mycobacterium bovis subsp bovis AF2122/97
cggccgccaacuccagcacc

SEQ ID NO: 1079311 - RNA, 19 nt, Mycobacterium bovis subsp bovis AF2122/97
cggccgcccguaaaccgau

SEQ ID NO: 1079312 - RNA, 15 nt, Mycobacterium bovis subsp bovis AF2122/97
cggccgccgacguug

SEQ ID NO: 1079313 - RNA, 14 nt, Mycobacterium bovis subsp bovis AF2122/97
cggccgccgagacg

SEQ ID NO: 1079314 - RNA, 15 nt, Mycobacterium bovis subsp bovis AF2122/97
cggccgccgagacga

SEQ ID NO: 1079315 - RNA, 12 nt, Mycobacterium bovis subsp bovis AF2122/97
cggccgccgagu

SEQ ID NO: 1079316 - RNA, 16 nt, Mycobacterium bovis subsp bovis AF2122/97
cggccgccgcggcuug

SEQ ID NO: 1079317 - RNA, 12 nt, Mycobacterium bovis subsp bovis AF2122/97
cggccgccgcgu

SEQ ID NO: 1079318 - RNA, 14 nt, Mycobacterium bovis subsp bovis AF2122/97
cggccgccgcgucg

SEQ ID NO: 1079319 - RNA, 16 nt, Mycobacterium bovis subsp bovis AF2122/97
cggccgccgcgucgac

SEQ ID NO: 1079320 - RNA, 13 nt, Mycobacterium bovis subsp bovis AF2122/97
cggccgccgcguu

SEQ ID NO: 1079321 - RNA, 12 nt, Mycobacterium bovis subsp bovis AF2122/97
cggccgcggcga

SEQ ID NO: 1079322 - RNA, 12 nt, Mycobacterium bovis subsp bovis AF2122/97
cggccgccgagg

SEQ ID NO: 1079323 - RNA, 16 nt, Mycobacterium bovis subsp bovis AF2122/97
cggccgcggucggcca

SEQ ID NO: 1079324 - RNA, 12 nt, Mycobacterium bovis subsp bovis AF2122/97
cggccgcggguu

SEQ ID NO: 1079325 - RNA, 13 nt, Mycobacterium bovis subsp bovis AF2122/97
cggccgcggcggc

SEQ ID NO: 1079326 - RNA, 16 nt, Mycobacterium bovis subsp bovis AF2122/97
cggccgcggcggcccc

SEQ ID NO: 1079327 - RNA, 12 nt, Mycobacterium bovis subsp bovis AF2122/97
cggccgcugggc

SEQ ID NO: 1079328 - RNA, 18 nt, Mycobacterium bovis subsp bovis AF2122/97
cggccgcuucggcgguca

SEQ ID NO: 1079329 - RNA, 15 nt, Mycobacterium bovis subsp bovis AF2122/97
cggccgcuggcguug

SEQ ID NO: 1079330 - RNA, 18 nt, Mycobacterium bovis subsp bovis AF2122/97
cggccgcgucacggaccu

SEQ ID NO: 1079331 - RNA, 12 nt, Mycobacterium bovis subsp bovis AF2122/97
cggccgcggugu

SEQ ID NO: 1079332 - RNA, 20 nt, Mycobacterium bovis subsp bovis AF2122/97
cggccgcggugacggcggcu

SEQ ID NO: 1079333 - RNA, 22 nt, Mycobacterium bovis subsp bovis AF2122/97
cggccgcggugacggcggcugu

SEQ ID NO: 1079334 - RNA, 21 nt, Mycobacterium bovis subsp bovis AF2122/97
cggccggacaacagagucacc

SEQ ID NO: 1079335 - RNA, 14 nt, Mycobacterium bovis subsp bovis AF2122/97
cggccggagccgcc

SEQ ID NO: 1079336 - RNA, 16 nt, Mycobacterium bovis subsp bovis AF2122/97
cggccggagccgccgg

SEQ ID NO: 1079337 - RNA, 17 nt, Mycobacterium bovis subsp bovis AF2122/97
cggccggaguccgucgg

SEQ ID NO: 1079338 - RNA, 20 nt, Mycobacterium bovis subsp bovis AF2122/97
cggccggaguccgucgggga

SEQ ID NO: 1079339 - RNA, 20 nt, Mycobacterium bovis subsp bovis AF2122/97
cggccgcuugagcgaguugc

SEQ ID NO: 1079340 - RNA, 21 nt, Mycobacterium bovis subsp bovis AF2122/97
cggccgccucguacggaccgu

SEQ ID NO: 1079341 - RNA, 14 nt, Mycobacterium bovis subsp bovis AF2122/97
cggccggcaagcag

SEQ ID NO: 1079342 - RNA, 22 nt, Mycobacterium bovis subsp bovis AF2122/97
cggccggaugagcgaacgccag

SEQ ID NO: 1079343 - RNA, 14 nt, Mycobacterium bovis subsp bovis AF2122/97
cggccggcggccgc

SEQ ID NO: 1079344 - RNA, 15 nt, Mycobacterium bovis subsp bovis AF2122/97
cggccggcgcucgcg

SEQ ID NO: 1079345 - RNA, 17 nt, Mycobacterium bovis subsp bovis AF2122/97
cggccggcgggccugcc

SEQ ID NO: 1079346 - RNA, 14 nt, Mycobacterium bovis subsp bovis AF2122/97
cggccggcggucgg

SEQ ID NO: 1079347 - RNA, 17 nt, Mycobacterium bovis subsp bovis AF2122/97
cggccggcuagcgguuu

SEQ ID NO: 1079348 - RNA, 12 nt, Mycobacterium bovis subsp bovis AF2122/97
cggccggcggcg

SEQ ID NO: 1079349 - RNA, 13 nt, Mycobacterium bovis subsp bovis AF2122/97
cggccggcgucgg

SEQ ID NO: 1079350 - RNA, 14 nt, Mycobacterium bovis subsp bovis AF2122/97
cggccggcgugcca

SEQ ID NO: 1079351 - RNA, 17 nt, Mycobacterium bovis subsp bovis AF2122/97
cggccggcgugccagca

SEQ ID NO: 1079352 - RNA, 13 nt, Mycobacterium bovis subsp bovis AF2122/97
cggccggcucguc

SEQ ID NO: 1079353 - RNA, 15 nt, Mycobacterium bovis subsp bovis AF2122/97
cggccggcucguccg

SEQ ID NO: 1079354 - RNA, 14 nt, Mycobacterium bovis subsp bovis AF2122/97
cggccgggcccucc

SEQ ID NO: 1079355 - RNA, 19 nt, Mycobacterium bovis subsp bovis AF2122/97
cggccgggcggucgagucc

SEQ ID NO: 1079356 - RNA, 14 nt, Mycobacterium bovis subsp bovis AF2122/97
cggccggggccacc

SEQ ID NO: 1079357 - RNA, 22 nt, Mycobacterium bovis subsp bovis AF2122/97
cggccgggcuccccaagucgac

SEQ ID NO: 1079358 - RNA, 22 nt, Mycobacterium bovis subsp bovis AF2122/97
cggccuuaggugaccaggguga

SEQ ID NO: 1079359 - RNA, 21 nt, Mycobacterium bovis subsp bovis AF2122/97
cggccuucucgccguguucga

SEQ ID NO: 1079360 - RNA, 24 nt, Mycobacterium bovis subsp bovis AF2122/97
cggccuguuuuggguagcggauca

SEQ ID NO: 1079361 - RNA, 16 nt, Mycobacterium bovis subsp bovis AF2122/97
cggccuugacgcacga

SEQ ID NO: 1079362 - RNA, 19 nt, Mycobacterium bovis subsp bovis AF2122/97
cggccuugagcacccgaua

SEQ ID NO: 1079363 - RNA, 17 nt, Mycobacterium bovis subsp bovis AF2122/97
cggccugguacucccgc

SEQ ID NO: 1079364 - RNA, 19 nt, Mycobacterium bovis subsp bovis AF2122/97
cggccugguacucccgcga

SEQ ID NO: 1079365 - RNA, 22 nt, Mycobacterium bovis subsp bovis AF2122/97
cggccugguacucccgcgaucg

SEQ ID NO: 1079366 - RNA, 15 nt, Mycobacterium bovis subsp bovis AF2122/97
cggccuggucggcca

SEQ ID NO: 1079367 - RNA, 16 nt, Mycobacterium bovis subsp bovis AF2122/97
cggccuggugcucaac

SEQ ID NO: 1079368 - RNA, 18 nt, Mycobacterium bovis subsp bovis AF2122/97
cggccuguucgccgucgc

SEQ ID NO: 1079369 - RNA, 21 nt, Mycobacterium bovis subsp bovis AF2122/97
cggccuguucggcggcugcca

SEQ ID NO: 1079370 - RNA, 15 nt, Mycobacterium bovis subsp bovis AF2122/97
cggccugcaccagcg

SEQ ID NO: 1079371 - RNA, 19 nt, Mycobacterium bovis subsp bovis AF2122/97
cggccugcacggcgcugac

SEQ ID NO: 1079372 - RNA, 14 nt, Mycobacterium bovis subsp bovis AF2122/97
cggccugcccgccg

SEQ ID NO: 1079373 - RNA, 12 nt, Mycobacterium bovis subsp bovis AF2122/97
cggccugccgcu

SEQ ID NO: 1079374 - RNA, 20 nt, Mycobacterium bovis subsp bovis AF2122/97
cggccugggccagccgcuca

SEQ ID NO: 1079375 - RNA, 19 nt, Mycobacterium bovis subsp bovis AF2122/97
cggccuggggcagccgggc

SEQ ID NO: 1079376 - RNA, 22 nt, Mycobacterium bovis subsp bovis AF2122/97
cggccugcagcgaugacgacca

SEQ ID NO: 1079377 - RNA, 18 nt, Mycobacterium bovis subsp bovis AF2122/97
cggccucgaccucuucgg

SEQ ID NO: 1079378 - RNA, 15 nt, Mycobacterium bovis subsp bovis AF2122/97
cggccuccgggccau

SEQ ID NO: 1079379 - RNA, 21 nt, Mycobacterium bovis subsp bovis AF2122/97
cggccucgagacggucgauca

SEQ ID NO: 1079380 - RNA, 15 nt, Mycobacterium bovis subsp bovis AF2122/97
cggccuccucgucgc

SEQ ID NO: 1079381 - RNA, 14 nt, Mycobacterium bovis subsp bovis AF2122/97
cggccucgccgaag

SEQ ID NO: 1079382 - RNA, 17 nt, Mycobacterium bovis subsp bovis AF2122/97
cggccucgccggggcaa

SEQ ID NO: 1079383 - RNA, 19 nt, Mycobacterium bovis subsp bovis AF2122/97
cggccucgccggggcaaac

SEQ ID NO: 1079384 - RNA, 15 nt, Mycobacterium bovis subsp bovis AF2122/97
cggccucgccggcgc

SEQ ID NO: 1079385 - RNA, 15 nt, Mycobacterium bovis subsp bovis AF2122/97
cggccucugaccagc

SEQ ID NO: 1079386 - RNA, 17 nt, Mycobacterium bovis subsp bovis AF2122/97
cggccucugaccagccg

SEQ ID NO: 1079387 - RNA, 19 nt, Mycobacterium bovis subsp bovis AF2122/97
cggccucugaccagccggu

SEQ ID NO: 1079388 - RNA, 13 nt, Mycobacterium bovis subsp bovis AF2122/97
cggccucggcggu

SEQ ID NO: 1079389 - RNA, 20 nt, Mycobacterium bovis subsp bovis AF2122/97
cggccucgucgauguucgcc

SEQ ID NO: 1079390 - RNA, 13 nt, Mycobacterium bovis subsp bovis AF2122/97
cggccugaccggc

SEQ ID NO: 1079391 - RNA, 19 nt, Mycobacterium bovis subsp bovis AF2122/97
cggccugaccggcucgccg

SEQ ID NO: 1079392 - RNA, 13 nt, Mycobacterium bovis subsp bovis AF2122/97
cggccggggcgaa

SEQ ID NO: 1079393 - RNA, 17 nt, Mycobacterium bovis subsp bovis AF2122/97
cggccgggucgcgcugg

SEQ ID NO: 1079394 - RNA, 20 nt, Mycobacterium bovis subsp bovis AF2122/97
cggccgggucgcgcuggcgc

SEQ ID NO: 1079395 - RNA, 20 nt, Mycobacterium bovis subsp bovis AF2122/97
cggccggguuaucggcagca

SEQ ID NO: 1079396 - RNA, 17 nt, Mycobacterium bovis subsp bovis AF2122/97
cggccggguggcccggc

SEQ ID NO: 1079397 - RNA, 18 nt, Mycobacterium bovis subsp bovis AF2122/97
cggccggguguagcucgg

SEQ ID NO: 1079398 - RNA, 21 nt, Mycobacterium bovis subsp bovis AF2122/97
cggccggguguagcucggacc

SEQ ID NO: 1079399 - RNA, 14 nt, Mycobacterium bovis subsp bovis AF2122/97
cggccggucgagac

SEQ ID NO: 1079400 - RNA, 13 nt, Mycobacterium bovis subsp bovis AF2122/97
cggccgguacacg

SEQ ID NO: 1079401 - RNA, 23 nt, Mycobacterium bovis subsp bovis AF2122/97
cggccgguagaucuucggccgca

SEQ ID NO: 1079402 - RNA, 22 nt, Mycobacterium bovis subsp bovis AF2122/97
cggccggguuaucggcagcagg

SEQ ID NO: 1079403 - RNA, 16 nt, Mycobacterium bovis subsp bovis AF2122/97
cggccggguucgcguc

SEQ ID NO: 1079404 - RNA, 18 nt, Mycobacterium bovis subsp bovis AF2122/97
cggccggugcccgggcgu

SEQ ID NO: 1079405 - RNA, 22 nt, Mycobacterium bovis subsp bovis AF2122/97
cggccgguggaaaccgggcgaa

SEQ ID NO: 1079406 - RNA, 20 nt, Mycobacterium bovis subsp bovis AF2122/97
cggccgguauuucggcgacu

SEQ ID NO: 1079407 - RNA, 20 nt, Mycobacterium bovis subsp bovis AF2122/97
cggccgguggguagccagcg

SEQ ID NO: 1079408 - RNA, 17 nt, Mycobacterium bovis subsp bovis AF2122/97
cggccgguuggccagcc

SEQ ID NO: 1079409 - RNA, 15 nt, Mycobacterium bovis subsp bovis AF2122/97
cggccgucauggccc

SEQ ID NO: 1079410 - RNA, 16 nt, Mycobacterium bovis subsp bovis AF2122/97
cggccgucauggcccg

SEQ ID NO: 1079411 - RNA, 16 nt, Mycobacterium bovis subsp bovis AF2122/97
cggccgucccgcgagc

SEQ ID NO: 1079412 - RNA, 17 nt, Mycobacterium bovis subsp bovis AF2122/97
cggccgucccgcgagca

SEQ ID NO: 1079413 - RNA, 15 nt, Mycobacterium bovis subsp bovis AF2122/97
cggccgucggccgga

SEQ ID NO: 1079414 - RNA, 13 nt, Mycobacterium bovis subsp bovis AF2122/97
cggccgucgaugg

SEQ ID NO: 1079415 - RNA, 22 nt, Mycobacterium bovis subsp bovis AF2122/97
cggccgucgauugcaggucggc

SEQ ID NO: 1079416 - RNA, 16 nt, Mycobacterium bovis subsp bovis AF2122/97
cggccgucggcgggca

SEQ ID NO: 1079417 - RNA, 21 nt, Mycobacterium bovis subsp bovis AF2122/97
cggccgucgggacggccaaca

SEQ ID NO: 1079418 - RNA, 13 nt, Mycobacterium bovis subsp bovis AF2122/97
cggccgucgggca

SEQ ID NO: 1079419 - RNA, 20 nt, Mycobacterium bovis subsp bovis AF2122/97
cggccgugaacggcgcgggc

SEQ ID NO: 1079420 - RNA, 18 nt, Mycobacterium bovis subsp bovis AF2122/97
cggccgugaauucgccga

SEQ ID NO: 1079421 - RNA, 17 nt, Mycobacterium bovis subsp bovis AF2122/97
cggccgugaugucccgc

SEQ ID NO: 1079422 - RNA, 23 nt, Mycobacterium bovis subsp bovis AF2122/97
cggccgugaauucgccgaacggu

SEQ ID NO: 1079423 - RNA, 14 nt, Mycobacterium bovis subsp bovis AF2122/97
cggccgugaccgag

SEQ ID NO: 1079424 - RNA, 19 nt, Mycobacterium bovis subsp bovis AF2122/97
cggccgugaccgagccgcg

SEQ ID NO: 1079425 - RNA, 17 nt, Mycobacterium bovis subsp bovis AF2122/97
cggccgugccgccgaca

SEQ ID NO: 1079426 - RNA, 18 nt, Mycobacterium bovis subsp bovis AF2122/97
cggccgugccgccgacac

SEQ ID NO: 1079427 - RNA, 20 nt, Mycobacterium bovis subsp bovis AF2122/97
cggccguggaaagccggcgu

SEQ ID NO: 1079428 - RNA, 19 nt, Mycobacterium bovis subsp bovis AF2122/97
cggccguggccucgauguc

SEQ ID NO: 1079429 - RNA, 18 nt, Mycobacterium bovis subsp bovis AF2122/97
cggccgugucgggcgcga

SEQ ID NO: 1079430 - RNA, 19 nt, Mycobacterium bovis subsp bovis AF2122/97
cggccgugucgggcgcgaa

SEQ ID NO: 1079431 - RNA, 17 nt, Mycobacterium bovis subsp bovis AF2122/97
cggccguugggccaccg

SEQ ID NO: 1079432 - RNA, 19 nt, Mycobacterium bovis subsp bovis AF2122/97
cggccguugggccaccggc

SEQ ID NO: 1079433 - RNA, 22 nt, Mycobacterium bovis subsp bovis AF2122/97
cggccguugggccaccggcgcc

SEQ ID NO: 1079434 - RNA, 13 nt, Mycobacterium bovis subsp bovis AF2122/97
cggccuccaucgc

SEQ ID NO: 1079435 - RNA, 15 nt, Mycobacterium bovis subsp bovis AF2122/97
cggccuccaucgcga

SEQ ID NO: 1079436 - RNA, 14 nt, Mycobacterium bovis subsp bovis AF2122/97
cggccuccgccgag

SEQ ID NO: 1079437 - RNA, 16 nt, Mycobacterium bovis subsp bovis AF2122/97
cggccucccgggccgc

SEQ ID NO: 1079438 - RNA, 19 nt, Mycobacterium bovis subsp bovis AF2122/97
cggccucccgggccgccgc

SEQ ID NO: 1079439 - RNA, 16 nt, Mycobacterium bovis subsp bovis AF2122/97
cggccuccaucgcgac

SEQ ID NO: 1079440 - RNA, 21 nt, Mycobacterium bovis subsp bovis AF2122/97
cggccucaguacagcgcguug

SEQ ID NO: 1079441 - RNA, 23 nt, Mycobacterium bovis subsp bovis AF2122/97
cggccucaguacagcgcguuggc

SEQ ID NO: 1079442 - RNA, 18 nt, Mycobacterium bovis subsp bovis AF2122/97
cggccuccaccacgucgg

SEQ ID NO: 1079443 - RNA, 14 nt, Mycobacterium bovis subsp bovis AF2122/97
cggccuccaccacg

SEQ ID NO: 1079444 - RNA, 15 nt, Mycobacterium bovis subsp bovis AF2122/97
cggccuccaccacgu

SEQ ID NO: 1079445 - RNA, 21 nt, Mycobacterium bovis subsp bovis AF2122/97
cggccuagggaaaggcgccgg

SEQ ID NO: 1079446 - RNA, 18 nt, Mycobacterium bovis subsp bovis AF2122/97
cggccuagggcggcggcg

SEQ ID NO: 1079447 - RNA, 20 nt, Mycobacterium bovis subsp bovis AF2122/97
cggccagcagcagugccacc

SEQ ID NO: 1079448 - RNA, 14 nt, Mycobacterium bovis subsp bovis AF2122/97
cggccagcagcaga

SEQ ID NO: 1079449 - RNA, 15 nt, Mycobacterium bovis subsp bovis AF2122/97
cggccagcagcgacu

SEQ ID NO: 1079450 - RNA, 22 nt, Mycobacterium bovis subsp bovis AF2122/97
cggccagcaggaugaugaccgc

SEQ ID NO: 1079451 - RNA, 18 nt, Mycobacterium bovis subsp bovis AF2122/97
cggccagcaucagcucga

SEQ ID NO: 1079452 - RNA, 16 nt, Mycobacterium bovis subsp bovis AF2122/97
cggccagcaucgggug

SEQ ID NO: 1079453 - RNA, 20 nt, Mycobacterium bovis subsp bovis AF2122/97
cggccagcaguagaucggau

SEQ ID NO: 1079454 - RNA, 17 nt, Mycobacterium bovis subsp bovis AF2122/97
cggccagcccagccggg

SEQ ID NO: 1079455 - RNA, 20 nt, Mycobacterium bovis subsp bovis AF2122/97
cggccagccagcgggcgaug

SEQ ID NO: 1079456 - RNA, 13 nt, Mycobacterium bovis subsp bovis AF2122/97
cggccagccgcgg

SEQ ID NO: 1079457 - RNA, 13 nt, Mycobacterium bovis subsp bovis AF2122/97
cggccagccgacg

SEQ ID NO: 1079458 - RNA, 17 nt, Mycobacterium bovis subsp bovis AF2122/97
cggccagccgcuccacg

SEQ ID NO: 1079459 - RNA, 17 nt, Mycobacterium bovis subsp bovis AF2122/97
cggccagccgacgcggc

SEQ ID NO: 1079460 - RNA, 13 nt, Mycobacterium bovis subsp bovis AF2122/97
cggccagccgcac

SEQ ID NO: 1079461 - RNA, 15 nt, Mycobacterium bovis subsp bovis AF2122/97
cggccagcgcgucgg

SEQ ID NO: 1079462 - RNA, 14 nt, Mycobacterium bovis subsp bovis AF2122/97
cggccagcggcccg

SEQ ID NO: 1079463 - RNA, 16 nt, Mycobacterium bovis subsp bovis AF2122/97
cggccagcggcccguc

SEQ ID NO: 1079464 - RNA, 19 nt, Mycobacterium bovis subsp bovis AF2122/97
cggccagcgggaacacacc

SEQ ID NO: 1079465 - RNA, 15 nt, Mycobacterium bovis subsp bovis AF2122/97
cggccaggccacggg

SEQ ID NO: 1079466 - RNA, 21 nt, Mycobacterium bovis subsp bovis AF2122/97
cggccagcgucagcuguuugc

SEQ ID NO: 1079467 - RNA, 17 nt, Mycobacterium bovis subsp bovis AF2122/97
cggccacucaacgaccu

SEQ ID NO: 1079468 - RNA, 22 nt, Mycobacterium bovis subsp bovis AF2122/97
cggccacucgggacuucccgcg

SEQ ID NO: 1079469 - RNA, 20 nt, Mycobacterium bovis subsp bovis AF2122/97
cggccacugauucgcaggcu

SEQ ID NO: 1079470 - RNA, 19 nt, Mycobacterium bovis subsp bovis AF2122/97
cggccagaaacccggcgac

SEQ ID NO: 1079471 - RNA, 19 nt, Mycobacterium bovis subsp bovis AF2122/97
cggccagaaagaucgguug

SEQ ID NO: 1079472 - RNA, 20 nt, Mycobacterium bovis subsp bovis AF2122/97
cggccagaaagaucgguuga

SEQ ID NO: 1079473 - RNA, 15 nt, Mycobacterium bovis subsp bovis AF2122/97
cggccacucgcccga

SEQ ID NO: 1079474 - RNA, 12 nt, Mycobacterium bovis subsp bovis AF2122/97
cggccagacggu

SEQ ID NO: 1079475 - RNA, 15 nt, Mycobacterium bovis subsp bovis AF2122/97
cggccagagccgcgc

SEQ ID NO: 1079476 - RNA, 21 nt, Mycobacterium bovis subsp bovis AF2122/97
cggccagagccgcgcgccggu

SEQ ID NO: 1079477 - RNA, 21 nt, Mycobacterium bovis subsp bovis AF2122/97
cggccagauagguuccaccgg

SEQ ID NO: 1079478 - RNA, 19 nt, Mycobacterium bovis subsp bovis AF2122/97
cggccagacggugcagcuc

SEQ ID NO: 1079479 - RNA, 19 nt, Mycobacterium bovis subsp bovis AF2122/97
cggccagcacuccgcgggg

SEQ ID NO: 1079480 - RNA, 14 nt, Mycobacterium bovis subsp bovis AF2122/97
cggccacgccgaug

SEQ ID NO: 1079481 - RNA, 14 nt, Mycobacterium bovis subsp bovis AF2122/97
cggccacgccggcg

SEQ ID NO: 1079482 - RNA, 15 nt, Mycobacterium bovis subsp bovis AF2122/97
cggccacgucccaga

SEQ ID NO: 1079483 - RNA, 17 nt, Mycobacterium bovis subsp bovis AF2122/97
cggccacggcgucggcc

SEQ ID NO: 1079484 - RNA, 20 nt, Mycobacterium bovis subsp bovis AF2122/97
cggccacggcgucggccacc

SEQ ID NO: 1079485 - RNA, 21 nt, Mycobacterium bovis subsp bovis AF2122/97
cggccacggcgucggccaccc

SEQ ID NO: 1079486 - RNA, 15 nt, Mycobacterium bovis subsp bovis AF2122/97
cggccacgagucgca

SEQ ID NO: 1079487 - RNA, 13 nt, Mycobacterium bovis subsp bovis AF2122/97
cggccacgccgau

SEQ ID NO: 1079488 - RNA, 14 nt, Mycobacterium bovis subsp bovis AF2122/97
cggcccaccggucg

SEQ ID NO: 1079489 - RNA, 14 nt, Mycobacterium bovis subsp bovis AF2122/97
cggcccaccgacgg

SEQ ID NO: 1079490 - RNA, 17 nt, Mycobacterium bovis subsp bovis AF2122/97
cggcccaccggucgcgc

SEQ ID NO: 1079491 - RNA, 14 nt, Mycobacterium bovis subsp bovis AF2122/97
cggcccacgguguc

SEQ ID NO: 1079492 - RNA, 23 nt, Mycobacterium bovis subsp bovis AF2122/97
cggcccaccucaccgaucucgac

SEQ ID NO: 1079493 - RNA, 23 nt, Mycobacterium bovis subsp bovis AF2122/97
cggcccagcccuucagcguccug

SEQ ID NO: 1079494 - RNA, 16 nt, Mycobacterium bovis subsp bovis AF2122/97
cggcccagaucgguug

SEQ ID NO: 1079495 - RNA, 18 nt, Mycobacterium bovis subsp bovis AF2122/97
cggcccacucucgccacg

SEQ ID NO: 1079496 - RNA, 23 nt, Mycobacterium bovis subsp bovis AF2122/97
cggcccaugaucucggcgaacgc

SEQ ID NO: 1079497 - RNA, 16 nt, Mycobacterium bovis subsp bovis AF2122/97
cggcccaugcagcggc

SEQ ID NO: 1079498 - RNA, 12 nt, Mycobacterium bovis subsp bovis AF2122/97
cggccccaccgg

SEQ ID NO: 1079499 - RNA, 15 nt, Mycobacterium bovis subsp bovis AF2122/97
cggccccaccggcac

SEQ ID NO: 1079500 - RNA, 17 nt, Mycobacterium bovis subsp bovis AF2122/97
cggccccaccggcaccc

SEQ ID NO: 1079501 - RNA, 19 nt, Mycobacterium bovis subsp bovis AF2122/97
cggcccauugucgaucacc

SEQ ID NO: 1079502 - RNA, 19 nt, Mycobacterium bovis subsp bovis AF2122/97
cggccauggcacugccggc

SEQ ID NO: 1079503 - RNA, 21 nt, Mycobacterium bovis subsp bovis AF2122/97
cggccauggcacugccggcac

SEQ ID NO: 1079504 - RNA, 22 nt, Mycobacterium bovis subsp bovis AF2122/97
cggccauggcacugccggcacg

SEQ ID NO: 1079505 - RNA, 15 nt, Mycobacterium bovis subsp bovis AF2122/97
cggccauggcgcgca

SEQ ID NO: 1079506 - RNA, 20 nt, Mycobacterium bovis subsp bovis AF2122/97
cggccauggcgcgcaaccgc

SEQ ID NO: 1079507 - RNA, 17 nt, Mycobacterium bovis subsp bovis AF2122/97
cggccaugccuucggug

SEQ ID NO: 1079508 - RNA, 15 nt, Mycobacterium bovis subsp bovis AF2122/97
cggccaucugcucgu

SEQ ID NO: 1079509 - RNA, 17 nt, Mycobacterium bovis subsp bovis AF2122/97
cggccauagcgccgcgc

SEQ ID NO: 1079510 - RNA, 15 nt, Mycobacterium bovis subsp bovis AF2122/97
cggccaucucgucga

SEQ ID NO: 1079511 - RNA, 21 nt, Mycobacterium bovis subsp bovis AF2122/97
cggccaucagaaccuccucgg

SEQ ID NO: 1079512 - RNA, 12 nt, Mycobacterium bovis subsp bovis AF2122/97
cggccaggccgg

SEQ ID NO: 1079513 - RNA, 11 nt, Mycobacterium bovis subsp bovis AF2122/97
cggccaggccg

SEQ ID NO: 1079514 - RNA, 15 nt, Mycobacterium bovis subsp bovis AF2122/97
cggccaggccgucgg

SEQ ID NO: 1079515 - RNA, 19 nt, Mycobacterium bovis subsp bovis AF2122/97
cggccaggccgucggcguc

SEQ ID NO: 1079516 - RNA, 15 nt, Mycobacterium bovis subsp bovis AF2122/97
cggccaggcgcgacg

SEQ ID NO: 1079517 - RNA, 21 nt, Mycobacterium bovis subsp bovis AF2122/97
cggccaggcgcgacguagacg

SEQ ID NO: 1079518 - RNA, 22 nt, Mycobacterium bovis subsp bovis AF2122/97
cggccagguaauugccgaccgc

SEQ ID NO: 1079519 - RNA, 17 nt, Mycobacterium bovis subsp bovis AF2122/97
cggccaggucgagcacc

SEQ ID NO: 1079520 - RNA, 15 nt, Mycobacterium bovis subsp bovis AF2122/97
cggccagugcucgca

SEQ ID NO: 1079521 - RNA, 16 nt, Mycobacterium bovis subsp bovis AF2122/97
cggccaggucgacacc

SEQ ID NO: 1079522 - RNA, 17 nt, Mycobacterium bovis subsp bovis AF2122/97
cggccaggucgacaccg

SEQ ID NO: 1079523 - RNA, 14 nt, Mycobacterium bovis subsp bovis AF2122/97
cggccaggucgacg

SEQ ID NO: 1079524 - RNA, 20 nt, Mycobacterium bovis subsp bovis AF2122/97
cggccagggugcccucggcc

SEQ ID NO: 1079525 - RNA, 19 nt, Mycobacterium bovis subsp bovis AF2122/97
cggccagguauguccgcca

SEQ ID NO: 1079526 - RNA, 21 nt, Mycobacterium bovis subsp bovis AF2122/97
cggccaguugcacaucggugg

SEQ ID NO: 1079527 - RNA, 22 nt, Mycobacterium bovis subsp bovis AF2122/97
cggccaguugcacaucgguggu

SEQ ID NO: 1079528 - RNA, 18 nt, Mycobacterium bovis subsp bovis AF2122/97
cggccauacgcgcgcggu

SEQ ID NO: 1079529 - RNA, 19 nt, Mycobacterium bovis subsp bovis AF2122/97
cggccauacgcgcgcgguc

SEQ ID NO: 1079530 - RNA, 23 nt, Mycobacterium bovis subsp bovis AF2122/97
cggccauacgcgcgcggucgagg

SEQ ID NO: 1079531 - RNA, 15 nt, Mycobacterium bovis subsp bovis AF2122/97
cggccauagcgccgc

SEQ ID NO: 1079532 - RNA, 20 nt, Mycobacterium bovis subsp bovis AF2122/97
cggccaguucggcggccgcc

SEQ ID NO: 1079533 - RNA, 21 nt, Mycobacterium bovis subsp bovis AF2122/97
cggccaguucggcggccgccg

SEQ ID NO: 1079534 - RNA, 22 nt, Mycobacterium bovis subsp bovis AF2122/97
cggccaguucggcggccgccgc

SEQ ID NO: 1079535 - RNA, 17 nt, Mycobacterium bovis subsp bovis AF2122/97
cggccaggucgacgggc

SEQ ID NO: 1079536 - RNA, 15 nt, Mycobacterium bovis subsp bovis AF2122/97
cggccaggucgacgg

SEQ ID NO: 1079537 - RNA, 13 nt, Mycobacterium bovis subsp bovis AF2122/97
cggcaugggccgg

SEQ ID NO: 1079538 - RNA, 17 nt, Mycobacterium bovis subsp bovis AF2122/97
cggcaugggccggcgcc

SEQ ID NO: 1079539 - RNA, 18 nt, Mycobacterium bovis subsp bovis AF2122/97
cggcaugggccggcgccg

SEQ ID NO: 1079540 - RNA, 19 nt, Mycobacterium bovis subsp bovis AF2122/97
cggcaugggccggcgccgc

SEQ ID NO: 1079541 - RNA, 23 nt, Mycobacterium bovis subsp bovis AF2122/97
cggcaugggccggcgccgcacca

SEQ ID NO: 1079542 - RNA, 21 nt, Mycobacterium bovis subsp bovis AF2122/97
cggcaugggucgugcaggcga

SEQ ID NO: 1079543 - RNA, 17 nt, Mycobacterium bovis subsp bovis AF2122/97
cggcaugugacaucggg

SEQ ID NO: 1079544 - RNA, 18 nt, Mycobacterium bovis subsp bovis AF2122/97
cggcauguagaguaucga

SEQ ID NO: 1079545 - RNA, 22 nt, Mycobacterium bovis subsp bovis AF2122/97
cggcauguucagcccgaacucg

SEQ ID NO: 1079546 - RNA, 15 nt, Mycobacterium bovis subsp bovis AF2122/97
cggcauguaccgacc

SEQ ID NO: 1079547 - RNA, 20 nt, Mycobacterium bovis subsp bovis AF2122/97
cggcaucgaguucggcccgc

SEQ ID NO: 1079548 - RNA, 14 nt, Mycobacterium bovis subsp bovis AF2122/97
cggcaucgacgcgg

SEQ ID NO: 1079549 - RNA, 21 nt, Mycobacterium bovis subsp bovis AF2122/97
cggcaucgacgcggccaacga

SEQ ID NO: 1079550 - RNA, 14 nt, Mycobacterium bovis subsp bovis AF2122/97
cggcaucgacugcc

SEQ ID NO: 1079551 - RNA, 20 nt, Mycobacterium bovis subsp bovis AF2122/97
cggcaucgaagugcggcccg

SEQ ID NO: 1079552 - RNA, 22 nt, Mycobacterium bovis subsp bovis AF2122/97
cggcaucgacugccagcgccgc

SEQ ID NO: 1079553 - RNA, 19 nt, Mycobacterium bovis subsp bovis AF2122/97
cggcaucgagacgcacggc

SEQ ID NO: 1079554 - RNA, 17 nt, Mycobacterium bovis subsp bovis AF2122/97
cggcaucgccgagcucg

SEQ ID NO: 1079555 - RNA, 22 nt, Mycobacterium bovis subsp bovis AF2122/97
cggccacaccgucacgccaccg

SEQ ID NO: 1079556 - RNA, 23 nt, Mycobacterium bovis subsp bovis AF2122/97
cggccacaccgucacgccaccgc

SEQ ID NO: 1079557 - RNA, 15 nt, Mycobacterium bovis subsp bovis AF2122/97
cggccaauugcgccg

SEQ ID NO: 1079558 - RNA, 16 nt, Mycobacterium bovis subsp bovis AF2122/97
cggccaauugcgccgc

SEQ ID NO: 1079559 - RNA, 17 nt, Mycobacterium bovis subsp bovis AF2122/97
cggccaauugcgccgcc

SEQ ID NO: 1079560 - RNA, 23 nt, Mycobacterium bovis subsp bovis AF2122/97
cggccaauugcgccgccaacucc

SEQ ID NO: 1079561 - RNA, 19 nt, Mycobacterium bovis subsp bovis AF2122/97
cggcauugcccgagcccag

SEQ ID NO: 1079562 - RNA, 22 nt, Mycobacterium bovis subsp bovis AF2122/97
cggccaauggugggcgagcugc

SEQ ID NO: 1079563 - RNA, 15 nt, Mycobacterium bovis subsp bovis AF2122/97
cggcauugccagccg

SEQ ID NO: 1079564 - RNA, 15 nt, Mycobacterium bovis subsp bovis AF2122/97
cggcauugaucggug

SEQ ID NO: 1079565 - RNA, 17 nt, Mycobacterium bovis subsp bovis AF2122/97
cggcauugaucggugcc

SEQ ID NO: 1079566 - RNA, 15 nt, Mycobacterium bovis subsp bovis AF2122/97
cggcauugccgccgu

SEQ ID NO: 1079567 - RNA, 17 nt, Mycobacterium bovis subsp bovis AF2122/97
cggcauugccgccguug

SEQ ID NO: 1079568 - RNA, 18 nt, Mycobacterium bovis subsp bovis AF2122/97
cggcauugccgccguugc

SEQ ID NO: 1079569 - RNA, 16 nt, Mycobacterium bovis subsp bovis AF2122/97
cggcauugcgcaggau

SEQ ID NO: 1079570 - RNA, 14 nt, Mycobacterium bovis subsp bovis AF2122/97
cggcauuggcgucg

SEQ ID NO: 1079571 - RNA, 21 nt, Mycobacterium bovis subsp bovis AF2122/97
cggcauugguaccggcuucgu

SEQ ID NO: 1079572 - RNA, 18 nt, Mycobacterium bovis subsp bovis AF2122/97
cggcauuaggccgggguc

SEQ ID NO: 1079573 - RNA, 20 nt, Mycobacterium bovis subsp bovis AF2122/97
cggcauguuccuugcggccg

SEQ ID NO: 1079574 - RNA, 22 nt, Mycobacterium bovis subsp bovis AF2122/97
cggcauguuccuugcggccgcu

SEQ ID NO: 1079575 - RNA, 23 nt, Mycobacterium bovis subsp bovis AF2122/97
cggcauuccacaggggccagcgc

SEQ ID NO: 1079576 - RNA, 14 nt, Mycobacterium bovis subsp bovis AF2122/97
cggcauucgcacca

SEQ ID NO: 1079577 - RNA, 17 nt, Mycobacterium bovis subsp bovis AF2122/97
cggcauucgcaccaccu

SEQ ID NO: 1079578 - RNA, 17 nt, Mycobacterium bovis subsp bovis AF2122/97
cggcauucucgagcacc

SEQ ID NO: 1079579 - RNA, 19 nt, Mycobacterium bovis subsp bovis AF2122/97
cggcauucucgagcacccg

SEQ ID NO: 1079580 - RNA, 23 nt, Mycobacterium bovis subsp bovis AF2122/97
cggcauugacccauccggcucgg

SEQ ID NO: 1079581 - RNA, 19 nt, Mycobacterium bovis subsp bovis AF2122/97
cggcauugagccgggcuau

SEQ ID NO: 1079582 - RNA, 17 nt, Mycobacterium bovis subsp bovis AF2122/97
cggccaccggcgucugc

SEQ ID NO: 1079583 - RNA, 16 nt, Mycobacterium bovis subsp bovis AF2122/97
cggccaccgcggcguu

SEQ ID NO: 1079584 - RNA, 16 nt, Mycobacterium bovis subsp bovis AF2122/97
cggccaccgccgccgc

SEQ ID NO: 1079585 - RNA, 12 nt, Mycobacterium bovis subsp bovis AF2122/97
cggccaccgccg

SEQ ID NO: 1079586 - RNA, 15 nt, Mycobacterium bovis subsp bovis AF2122/97
cggccaccgcgcaac

SEQ ID NO: 1079587 - RNA, 18 nt, Mycobacterium bovis subsp bovis AF2122/97
cggccaccgagucgauca

SEQ ID NO: 1079588 - RNA, 18 nt, Mycobacterium bovis subsp bovis AF2122/97
cggccaccgcacgcuggc

SEQ ID NO: 1079589 - RNA, 20 nt, Mycobacterium bovis subsp bovis AF2122/97
cggccaccucggugcggaac

SEQ ID NO: 1079590 - RNA, 23 nt, Mycobacterium bovis subsp bovis AF2122/97
cggccaccucggugcggaacacc

SEQ ID NO: 1079591 - RNA, 14 nt, Mycobacterium bovis subsp bovis AF2122/97
cggccaccucaucg

SEQ ID NO: 1079592 - RNA, 18 nt, Mycobacterium bovis subsp bovis AF2122/97
cggccaccucaucgccau

SEQ ID NO: 1079593 - RNA, 15 nt, Mycobacterium bovis subsp bovis AF2122/97
cggccaccugcucgu

SEQ ID NO: 1079594 - RNA, 14 nt, Mycobacterium bovis subsp bovis AF2122/97
cggccaccgggguc

SEQ ID NO: 1079595 - RNA, 17 nt, Mycobacterium bovis subsp bovis AF2122/97
cggccaccugcuggccg

SEQ ID NO: 1079596 - RNA, 16 nt, Mycobacterium bovis subsp bovis AF2122/97
cggccaccuggucggc

SEQ ID NO: 1079597 - RNA, 17 nt, Mycobacterium bovis subsp bovis AF2122/97
cggccaccuggucggca

SEQ ID NO: 1079598 - RNA, 15 nt, Mycobacterium bovis subsp bovis AF2122/97
cggccaccagggcca

SEQ ID NO: 1079599 - RNA, 18 nt, Mycobacterium bovis subsp bovis AF2122/97
cggccaccagggccaccg

SEQ ID NO: 1079600 - RNA, 19 nt, Mycobacterium bovis subsp bovis AF2122/97
cggccaccagggccaccgc

SEQ ID NO: 1079601 - RNA, 15 nt, Mycobacterium bovis subsp bovis AF2122/97
cggccaccaggugcc

SEQ ID NO: 1079602 - RNA, 18 nt, Mycobacterium bovis subsp bovis AF2122/97
cggccacccacauggcgg

SEQ ID NO: 1079603 - RNA, 19 nt, Mycobacterium bovis subsp bovis AF2122/97
cggccacccacauggcggc

SEQ ID NO: 1079604 - RNA, 21 nt, Mycobacterium bovis subsp bovis AF2122/97
cggccaccaaccucaucgcgg

SEQ ID NO: 1079605 - RNA, 14 nt, Mycobacterium bovis subsp bovis AF2122/97
cggccaccaucgcc

SEQ ID NO: 1079606 - RNA, 12 nt, Mycobacterium bovis subsp bovis AF2122/97
cggccaccccac

SEQ ID NO: 1079607 - RNA, 17 nt, Mycobacterium bovis subsp bovis AF2122/97
cggccaccccacagucg

SEQ ID NO: 1079608 - RNA, 15 nt, Mycobacterium bovis subsp bovis AF2122/97
cggccacccgcgacg

SEQ ID NO: 1079609 - RNA, 20 nt, Mycobacterium bovis subsp bovis AF2122/97
cggccacccggacauagccg

SEQ ID NO: 1079610 - RNA, 15 nt, Mycobacterium bovis subsp bovis AF2122/97
cggccacccggucca

SEQ ID NO: 1079611 - RNA, 19 nt, Mycobacterium bovis subsp bovis AF2122/97
cggccaccgaccgcaugau

SEQ ID NO: 1079612 - RNA, 23 nt, Mycobacterium bovis subsp bovis AF2122/97
cggccaccaacucggcgaccugc

SEQ ID NO: 1079613 - RNA, 14 nt, Mycobacterium bovis subsp bovis AF2122/97
cggccaccacaacg

SEQ ID NO: 1079614 - RNA, 18 nt, Mycobacterium bovis subsp bovis AF2122/97
cggccaccaaccucaucg

SEQ ID NO: 1079615 - RNA, 13 nt, Mycobacterium bovis subsp bovis AF2122/97
cggccaccaccag

SEQ ID NO: 1079616 - RNA, 14 nt, Mycobacterium bovis subsp bovis AF2122/97
cggccaccaccagg

SEQ ID NO: 1079617 - RNA, 17 nt, Mycobacterium bovis subsp bovis AF2122/97
cggccacaaccucgucg

SEQ ID NO: 1079618 - RNA, 17 nt, Mycobacterium bovis subsp bovis AF2122/97
cggccacauaccaccac

SEQ ID NO: 1079619 - RNA, 20 nt, Mycobacterium bovis subsp bovis AF2122/97
cggccacauaccaccacgug

SEQ ID NO: 1079620 - RNA, 15 nt, Mycobacterium bovis subsp bovis AF2122/97
cggccacaucgccag

SEQ ID NO: 1079621 - RNA, 21 nt, Mycobacterium bovis subsp bovis AF2122/97
cggccacaccuuggccgccgg

SEQ ID NO: 1079622 - RNA, 22 nt, Mycobacterium bovis subsp bovis AF2122/97
cggccacaugccacagcggcga

SEQ ID NO: 1079623 - RNA, 17 nt, Mycobacterium bovis subsp bovis AF2122/97
cggcagcucccgccacg

SEQ ID NO: 1079624 - RNA, 22 nt, Mycobacterium bovis subsp bovis AF2122/97
aacaggucuacccggucgccgg

SEQ ID NO: 1079625 - RNA, 15 nt, Mycobacterium bovis subsp bovis AF2122/97
cggcacgaucggcag

SEQ ID NO: 1079626 - RNA, 20 nt, Mycobacterium bovis subsp bovis AF2122/97
cggcacgaucaucggggugg

SEQ ID NO: 1079627 - RNA, 22 nt, Mycobacterium bovis subsp bovis AF2122/97
cggcacgaucaucgggguggcc

SEQ ID NO: 1079628 - RNA, 13 nt, Mycobacterium bovis subsp bovis AF2122/97
cggcacgacccgg

SEQ ID NO: 1079629 - RNA, 15 nt, Mycobacterium bovis subsp bovis AF2122/97
cggcacgacccggga

SEQ ID NO: 1079630 - RNA, 17 nt, Mycobacterium bovis subsp bovis AF2122/97
cggcacgacccgggaag

SEQ ID NO: 1079631 - RNA, 17 nt, Mycobacterium bovis subsp bovis AF2122/97
cggcacgaccgcucccg

SEQ ID NO: 1079632 - RNA, 22 nt, Mycobacterium bovis subsp bovis AF2122/97
aacagugacgccacgaccgccg

SEQ ID NO: 1079633 - RNA, 16 nt, Mycobacterium bovis subsp bovis AF2122/97
cggcacgaccaccgga

SEQ ID NO: 1079634 - RNA, 19 nt, Mycobacterium bovis subsp bovis AF2122/97
cggcaggaaugccgcgggg

SEQ ID NO: 1079635 - RNA, 14 nt, Mycobacterium bovis subsp bovis AF2122/97
cggcagcuggcgca

SEQ ID NO: 1079636 - RNA, 23 nt, Mycobacterium bovis subsp bovis AF2122/97
cggcagcuggcgcagccugccga

SEQ ID NO: 1079637 - RNA, 16 nt, Mycobacterium bovis subsp bovis AF2122/97
cggcagcuucucgccg

SEQ ID NO: 1079638 - RNA, 20 nt, Mycobacterium bovis subsp bovis AF2122/97
cggcagcuucucgccgacga

SEQ ID NO: 1079639 - RNA, 17 nt, Mycobacterium bovis subsp bovis AF2122/97
cggcagcuuugacgccc

SEQ ID NO: 1079640 - RNA, 20 nt, Mycobacterium bovis subsp bovis AF2122/97
cggcagcuuugacgcccucg

SEQ ID NO: 1079641 - RNA, 19 nt, Mycobacterium bovis subsp bovis AF2122/97
cggcagcuugcagugccgc

SEQ ID NO: 1079642 - RNA, 22 nt, Mycobacterium bovis subsp bovis AF2122/97
cggcagcuugcagugccgccgg

SEQ ID NO: 1079643 - RNA, 23 nt, Mycobacterium bovis subsp bovis AF2122/97
cggcaggcccggaggguucggac

SEQ ID NO: 1079644 - RNA, 14 nt, Mycobacterium bovis subsp bovis AF2122/97
cggcaggccgacca

SEQ ID NO: 1079645 - RNA, 16 nt, Mycobacterium bovis subsp bovis AF2122/97
cggcaggcagcucggc

SEQ ID NO: 1079646 - RNA, 13 nt, Mycobacterium bovis subsp bovis AF2122/97
cggcaggcagggc

SEQ ID NO: 1079647 - RNA, 21 nt, Mycobacterium bovis subsp bovis AF2122/97
cggcaggcagggcagcccggc

SEQ ID NO: 1079648 - RNA, 12 nt, Mycobacterium bovis subsp bovis AF2122/97
cggcagggcccc

SEQ ID NO: 1079649 - RNA, 14 nt, Mycobacterium bovis subsp bovis AF2122/97
cggcagggccccca

SEQ ID NO: 1079650 - RNA, 20 nt, Mycobacterium bovis subsp bovis AF2122/97
cggcaggguggccagcaggc

SEQ ID NO: 1079651 - RNA, 15 nt, Mycobacterium bovis subsp bovis AF2122/97
cggcagguaccaccg

SEQ ID NO: 1079652 - RNA, 20 nt, Mycobacterium bovis subsp bovis AF2122/97
cggcagguaccaccgcggug

SEQ ID NO: 1079653 - RNA, 16 nt, Mycobacterium bovis subsp bovis AF2122/97
cggcagggcggugcca

SEQ ID NO: 1079654 - RNA, 19 nt, Mycobacterium bovis subsp bovis AF2122/97
cggcaggucuucgcugucg

SEQ ID NO: 1079655 - RNA, 18 nt, Mycobacterium bovis subsp bovis AF2122/97
cggcauagcggcccaucg

SEQ ID NO: 1079656 - RNA, 19 nt, Mycobacterium bovis subsp bovis AF2122/97
cggcauagcucagaccggc

SEQ ID NO: 1079657 - RNA, 21 nt, Mycobacterium bovis subsp bovis AF2122/97
cggcauagcucagaccggcgc

SEQ ID NO: 1079658 - RNA, 19 nt, Mycobacterium bovis subsp bovis AF2122/97
cggcauagccgaacagcgg

SEQ ID NO: 1079659 - RNA, 21 nt, Mycobacterium bovis subsp bovis AF2122/97
cggcauagaucgggucguugg

SEQ ID NO: 1079660 - RNA, 21 nt, Mycobacterium bovis subsp bovis AF2122/97
cggcauccgguucgccgccgu

SEQ ID NO: 1079661 - RNA, 15 nt, Mycobacterium bovis subsp bovis AF2122/97
cggcaucccgccaca

SEQ ID NO: 1079662 - RNA, 22 nt, Mycobacterium bovis subsp bovis AF2122/97
cggcauccccaguugugcggcc

SEQ ID NO: 1079663 - RNA, 21 nt, Mycobacterium bovis subsp bovis AF2122/97
cggcauccuguggcggggcaa

SEQ ID NO: 1079664 - RNA, 21 nt, Mycobacterium bovis subsp bovis AF2122/97
cggcaucccggaacgccgcca

SEQ ID NO: 1079665 - RNA, 23 nt, Mycobacterium bovis subsp bovis AF2122/97
cggcauccagcuucgcucggguc

SEQ ID NO: 1079666 - RNA, 16 nt, Mycobacterium bovis subsp bovis AF2122/97
cggcaucaacgcgggc

SEQ ID NO: 1079667 - RNA, 23 nt, Mycobacterium bovis subsp bovis AF2122/97
cggagauguaguccucgguggcc

SEQ ID NO: 1079668 - RNA, 23 nt, Mycobacterium bovis subsp bovis AF2122/97
cggagcaauuccacgaucggcuc

SEQ ID NO: 1079669 - RNA, 19 nt, Mycobacterium bovis subsp bovis AF2122/97
cggagcaauuccacgaucg

SEQ ID NO: 1079670 - RNA, 18 nt, Mycobacterium bovis subsp bovis AF2122/97
cggagccacucggcccgg

SEQ ID NO: 1079671 - RNA, 23 nt, Mycobacterium bovis subsp bovis AF2122/97
cggagccaggacgacgccgacga

SEQ ID NO: 1079672 - RNA, 20 nt, Mycobacterium bovis subsp bovis AF2122/97
cggagcccacacgcucacgg

SEQ ID NO: 1079673 - RNA, 22 nt, Mycobacterium bovis subsp bovis AF2122/97
cggagcccacacgcucacgggc

SEQ ID NO: 1079674 - RNA, 15 nt, Mycobacterium bovis subsp bovis AF2122/97
cggagaugaacucgg

SEQ ID NO: 1079675 - RNA, 13 nt, Mycobacterium bovis subsp bovis AF2122/97
cggagaucgccac

SEQ ID NO: 1079676 - RNA, 16 nt, Mycobacterium bovis subsp bovis AF2122/97
cggagauaccggaccc

SEQ ID NO: 1079677 - RNA, 21 nt, Mycobacterium bovis subsp bovis AF2122/97
cggagauaccggaccccaacg

SEQ ID NO: 1079678 - RNA, 19 nt, Mycobacterium bovis subsp bovis AF2122/97
cggagauacgggccaccgu

SEQ ID NO: 1079679 - RNA, 15 nt, Mycobacterium bovis subsp bovis AF2122/97
cggagacgucuucgg

SEQ ID NO: 1079680 - RNA, 22 nt, Mycobacterium bovis subsp bovis AF2122/97
cggacuugaccagagcacgggc

SEQ ID NO: 1079681 - RNA, 23 nt, Mycobacterium bovis subsp bovis AF2122/97
cggacuugaccagagcacgggcu

SEQ ID NO: 1079682 - RNA, 23 nt, Mycobacterium bovis subsp bovis AF2122/97
cggacuucguuccgugccgagcu

SEQ ID NO: 1079683 - RNA, 19 nt, Mycobacterium bovis subsp bovis AF2122/97
cggacuucccgcgcgagcc

SEQ ID NO: 1079684 - RNA, 20 nt, Mycobacterium bovis subsp bovis AF2122/97
cggacuucccgcgcgagccg

SEQ ID NO: 1079685 - RNA, 15 nt, Mycobacterium bovis subsp bovis AF2122/97
cggacuucgaugucg

SEQ ID NO: 1079686 - RNA, 13 nt, Mycobacterium bovis subsp bovis AF2122/97
cggacuucgccgc

SEQ ID NO: 1079687 - RNA, 17 nt, Mycobacterium bovis subsp bovis AF2122/97
cggacuucgccgcccgc

SEQ ID NO: 1079688 - RNA, 13 nt, Mycobacterium bovis subsp bovis AF2122/97
cggagaaaagcgc

SEQ ID NO: 1079689 - RNA, 17 nt, Mycobacterium bovis subsp bovis AF2122/97
cggagaccgccucgucg

SEQ ID NO: 1079690 - RNA, 15 nt, Mycobacterium bovis subsp bovis AF2122/97
cggagaccggccggg

SEQ ID NO: 1079691 - RNA, 14 nt, Mycobacterium bovis subsp bovis AF2122/97
cggagacgaucgcc

SEQ ID NO: 1079692 - RNA, 13 nt, Mycobacterium bovis subsp bovis AF2122/97
cggagacgucgcc

SEQ ID NO: 1079693 - RNA, 20 nt, Mycobacterium bovis subsp bovis AF2122/97
cggagacccguccggagaau

SEQ ID NO: 1079694 - RNA, 17 nt, Mycobacterium bovis subsp bovis AF2122/97
cggagaccccgcgcgcu

SEQ ID NO: 1079695 - RNA, 13 nt, Mycobacterium bovis subsp bovis AF2122/97
cggagaccagcgu

SEQ ID NO: 1079696 - RNA, 15 nt, Mycobacterium bovis subsp bovis AF2122/97
cggagaccagcgucu

SEQ ID NO: 1079697 - RNA, 17 nt, Mycobacterium bovis subsp bovis AF2122/97
cggagaauagaucaggg

SEQ ID NO: 1079698 - RNA, 22 nt, Mycobacterium bovis subsp bovis AF2122/97
cggagaauagaucagggcucgc

SEQ ID NO: 1079699 - RNA, 20 nt, Mycobacterium bovis subsp bovis AF2122/97
cggagaauuccgcuagguca

SEQ ID NO: 1079700 - RNA, 16 nt, Mycobacterium bovis subsp bovis AF2122/97
cggagaaggcgcgggc

SEQ ID NO: 1079701 - RNA, 20 nt, Mycobacterium bovis subsp bovis AF2122/97
cggagaaggcgcgggcgacg

SEQ ID NO: 1079702 - RNA, 23 nt, Mycobacterium bovis subsp bovis AF2122/97
cggagaauuccgcuaggucaggu

SEQ ID NO: 1079703 - RNA, 14 nt, Mycobacterium bovis subsp bovis AF2122/97
cggagacacccgcc

SEQ ID NO: 1079704 - RNA, 20 nt, Mycobacterium bovis subsp bovis AF2122/97
cggagacacccgccaggccg

SEQ ID NO: 1079705 - RNA, 22 nt, Mycobacterium bovis subsp bovis AF2122/97
cggagcgguguggucgcaggau

SEQ ID NO: 1079706 - RNA, 14 nt, Mycobacterium bovis subsp bovis AF2122/97
cggagcgauccggc

SEQ ID NO: 1079707 - RNA, 16 nt, Mycobacterium bovis subsp bovis AF2122/97
cggagcuagacccguc

SEQ ID NO: 1079708 - RNA, 15 nt, Mycobacterium bovis subsp bovis AF2122/97
cggagcucacgccgg

SEQ ID NO: 1079709 - RNA, 16 nt, Mycobacterium bovis subsp bovis AF2122/97
cggaggcgaccccggc

SEQ ID NO: 1079710 - RNA, 17 nt, Mycobacterium bovis subsp bovis AF2122/97
cggaggcgaccccggcc

SEQ ID NO: 1079711 - RNA, 14 nt, Mycobacterium bovis subsp bovis AF2122/97
cggaggcgaccacg

SEQ ID NO: 1079712 - RNA, 19 nt, Mycobacterium bovis subsp bovis AF2122/97
cggaggcgaccacgucggc

SEQ ID NO: 1079713 - RNA, 23 nt, Mycobacterium bovis subsp bovis AF2122/97
cggaggcgaccacgucggcgaac

SEQ ID NO: 1079714 - RNA, 21 nt, Mycobacterium bovis subsp bovis AF2122/97
cggaggcaagcaaccggugcg

SEQ ID NO: 1079715 - RNA, 13 nt, Mycobacterium bovis subsp bovis AF2122/97
cggaggccgccgc

SEQ ID NO: 1079716 - RNA, 14 nt, Mycobacterium bovis subsp bovis AF2122/97
cggaggccgccgcg

SEQ ID NO: 1079717 - RNA, 16 nt, Mycobacterium bovis subsp bovis AF2122/97
cggaggccgccgcgcc

SEQ ID NO: 1079718 - RNA, 17 nt, Mycobacterium bovis subsp bovis AF2122/97
cggagccgccgacucgg

SEQ ID NO: 1079719 - RNA, 12 nt, Mycobacterium bovis subsp bovis AF2122/97
cggagccgucga

SEQ ID NO: 1079720 - RNA, 14 nt, Mycobacterium bovis subsp bovis AF2122/97
cggagccgucgagc

SEQ ID NO: 1079721 - RNA, 20 nt, Mycobacterium bovis subsp bovis AF2122/97
cggagccgucgagcagccga

SEQ ID NO: 1079722 - RNA, 21 nt, Mycobacterium bovis subsp bovis AF2122/97
cggagccgucgcaucaggucg

SEQ ID NO: 1079723 - RNA, 13 nt, Mycobacterium bovis subsp bovis AF2122/97
cggagcgggccag

SEQ ID NO: 1079724 - RNA, 17 nt, Mycobacterium bovis subsp bovis AF2122/97
cggagcgggccagcacc

SEQ ID NO: 1079725 - RNA, 17 nt, Mycobacterium bovis subsp bovis AF2122/97
cggagcgggcuccggcu

SEQ ID NO: 1079726 - RNA, 17 nt, Mycobacterium bovis subsp bovis AF2122/97
cggagcgggugcgggcg

SEQ ID NO: 1079727 - RNA, 16 nt, Mycobacterium bovis subsp bovis AF2122/97
cggagcggucagcgga

SEQ ID NO: 1079728 - RNA, 12 nt, Mycobacterium bovis subsp bovis AF2122/97
cggagccgcuac

SEQ ID NO: 1079729 - RNA, 13 nt, Mycobacterium bovis subsp bovis AF2122/97
cggagccggccac

SEQ ID NO: 1079730 - RNA, 17 nt, Mycobacterium bovis subsp bovis AF2122/97
cggagccggccaccucg

SEQ ID NO: 1079731 - RNA, 13 nt, Mycobacterium bovis subsp bovis AF2122/97
cggagccgccgcu

SEQ ID NO: 1079732 - RNA, 12 nt, Mycobacterium bovis subsp bovis AF2122/97
cggagccgccgg

SEQ ID NO: 1079733 - RNA, 13 nt, Mycobacterium bovis subsp bovis AF2122/97
cggagccgccggc

SEQ ID NO: 1079734 - RNA, 15 nt, Mycobacterium bovis subsp bovis AF2122/97
cggagccgccggccc

SEQ ID NO: 1079735 - RNA, 16 nt, Mycobacterium bovis subsp bovis AF2122/97
cggagccgccggcccc

SEQ ID NO: 1079736 - RNA, 22 nt, Mycobacterium bovis subsp bovis AF2122/97
cggagccgccggccccgccagc

SEQ ID NO: 1079737 - RNA, 14 nt, Mycobacterium bovis subsp bovis AF2122/97
cggagccgccggcg

SEQ ID NO: 1079738 - RNA, 15 nt, Mycobacterium bovis subsp bovis AF2122/97
cggagccgccggcgg

SEQ ID NO: 1079739 - RNA, 16 nt, Mycobacterium bovis subsp bovis AF2122/97
cggagccgccggcggu

SEQ ID NO: 1079740 - RNA, 19 nt, Mycobacterium bovis subsp bovis AF2122/97
cggagccgccggcggugau

SEQ ID NO: 1079741 - RNA, 14 nt, Mycobacterium bovis subsp bovis AF2122/97
cggagccgaugacc

SEQ ID NO: 1079742 - RNA, 18 nt, Mycobacterium bovis subsp bovis AF2122/97
cggagccgaugaccugcc

SEQ ID NO: 1079743 - RNA, 16 nt, Mycobacterium bovis subsp bovis AF2122/97
cggagccgaugaucga

SEQ ID NO: 1079744 - RNA, 17 nt, Mycobacterium bovis subsp bovis AF2122/97
cggagccgagccgauau

SEQ ID NO: 1079745 - RNA, 17 nt, Mycobacterium bovis subsp bovis AF2122/97
cggagcccugaccgggg

SEQ ID NO: 1079746 - RNA, 20 nt, Mycobacterium bovis subsp bovis AF2122/97
cggauacauuucgucgucgc

SEQ ID NO: 1079747 - RNA, 15 nt, Mycobacterium bovis subsp bovis AF2122/97
cggauacagccgccg

SEQ ID NO: 1079748 - RNA, 15 nt, Mycobacterium bovis subsp bovis AF2122/97
cggauacagccacgc

SEQ ID NO: 1079749 - RNA, 23 nt, Mycobacterium bovis subsp bovis AF2122/97
cggauaaucauccgagcgguggu

SEQ ID NO: 1079750 - RNA, 20 nt, Mycobacterium bovis subsp bovis AF2122/97
cggauaauucaacagcaccg

SEQ ID NO: 1079751 - RNA, 23 nt, Mycobacterium bovis subsp bovis AF2122/97
cggauaauucaacagcaccgcga

SEQ ID NO: 1079752 - RNA, 15 nt, Mycobacterium bovis subsp bovis AF2122/97
cggauaggccgcgcg

SEQ ID NO: 1079753 - RNA, 19 nt, Mycobacterium bovis subsp bovis AF2122/97
cggauagcaccggcacccg

SEQ ID NO: 1079754 - RNA, 18 nt, Mycobacterium bovis subsp bovis AF2122/97
cggauagcaccggcaccc

SEQ ID NO: 1079755 - RNA, 18 nt, Mycobacterium bovis subsp bovis AF2122/97
cggauacccagccggccu

SEQ ID NO: 1079756 - RNA, 14 nt, Mycobacterium bovis subsp bovis AF2122/97
cggauagacggcga

SEQ ID NO: 1079757 - RNA, 17 nt, Mycobacterium bovis subsp bovis AF2122/97
cggauagacggcgacga

SEQ ID NO: 1079758 - RNA, 14 nt, Mycobacterium bovis subsp bovis AF2122/97
cggauacggcgaca

SEQ ID NO: 1079759 - RNA, 16 nt, Mycobacterium bovis subsp bovis AF2122/97
cggaucaggcccgggc

SEQ ID NO: 1079760 - RNA, 21 nt, Mycobacterium bovis subsp bovis AF2122/97
cggaucaccgcgcccgccgcg

SEQ ID NO: 1079761 - RNA, 22 nt, Mycobacterium bovis subsp bovis AF2122/97
cggaucaccgcgcccgccgcgg

SEQ ID NO: 1079762 - RNA, 16 nt, Mycobacterium bovis subsp bovis AF2122/97
cggaucaccaucgccg

SEQ ID NO: 1079763 - RNA, 20 nt, Mycobacterium bovis subsp bovis AF2122/97
cggaucaccaucgccgccgc

SEQ ID NO: 1079764 - RNA, 22 nt, Mycobacterium bovis subsp bovis AF2122/97
cggaucaccaucgccgccgcgc

SEQ ID NO: 1079765 - RNA, 16 nt, Mycobacterium bovis subsp bovis AF2122/97
cggauaucgaccaccg

SEQ ID NO: 1079766 - RNA, 19 nt, Mycobacterium bovis subsp bovis AF2122/97
cggauagugguugcggccg

SEQ ID NO: 1079767 - RNA, 16 nt, Mycobacterium bovis subsp bovis AF2122/97
cggaucaacaggccgg

SEQ ID NO: 1079768 - RNA, 20 nt, Mycobacterium bovis subsp bovis AF2122/97
cggaucaacaggccggcucg

SEQ ID NO: 1079769 - RNA, 20 nt, Mycobacterium bovis subsp bovis AF2122/97
cggaucaaccccacacccgg

SEQ ID NO: 1079770 - RNA, 13 nt, Mycobacterium bovis subsp bovis AF2122/97
cggaucaagagcg

SEQ ID NO: 1079771 - RNA, 19 nt, Mycobacterium bovis subsp bovis AF2122/97
cggaucaagcgcacaaacg

SEQ ID NO: 1079772 - RNA, 17 nt, Mycobacterium bovis subsp bovis AF2122/97
cggaggguugccgccga

SEQ ID NO: 1079773 - RNA, 23 nt, Mycobacterium bovis subsp bovis AF2122/97
cggaguaagcgauucccaaccgg

SEQ ID NO: 1079774 - RNA, 14 nt, Mycobacterium bovis subsp bovis AF2122/97
cggaggugccggcg

SEQ ID NO: 1079775 - RNA, 17 nt, Mycobacterium bovis subsp bovis AF2122/97
cggaggugccggcgcca

SEQ ID NO: 1079776 - RNA, 17 nt, Mycobacterium bovis subsp bovis AF2122/97
cggaggcugggcugagg

SEQ ID NO: 1079777 - RNA, 16 nt, Mycobacterium bovis subsp bovis AF2122/97
cggaggcgggugcggc

SEQ ID NO: 1079778 - RNA, 16 nt, Mycobacterium bovis subsp bovis AF2122/97
cggaggcggaccaggc

SEQ ID NO: 1079779 - RNA, 22 nt, Mycobacterium bovis subsp bovis AF2122/97
cggaggcggaccaggccgcgcg

SEQ ID NO: 1079780 - RNA, 23 nt, Mycobacterium bovis subsp bovis AF2122/97
cggagucaccagcaacagcccga

SEQ ID NO: 1079781 - RNA, 19 nt, Mycobacterium bovis subsp bovis AF2122/97
cggagucgacggucacggu

SEQ ID NO: 1079782 - RNA, 14 nt, Mycobacterium bovis subsp bovis AF2122/97
cggagucgacgguu

SEQ ID NO: 1079783 - RNA, 18 nt, Mycobacterium bovis subsp bovis AF2122/97
cggagucgagcacaccga

SEQ ID NO: 1079784 - RNA, 21 nt, Mycobacterium bovis subsp bovis AF2122/97
cggaguccgucgacaccgcgg

SEQ ID NO: 1079785 - RNA, 20 nt, Mycobacterium bovis subsp bovis AF2122/97
cggaguccgucggggacauc

SEQ ID NO: 1079786 - RNA, 22 nt, Mycobacterium bovis subsp bovis AF2122/97
cggaguccgucggggacauccg

SEQ ID NO: 1079787 - RNA, 12 nt, Mycobacterium bovis subsp bovis AF2122/97
cggagucgacgg

SEQ ID NO: 1079788 - RNA, 13 nt, Mycobacterium bovis subsp bovis AF2122/97
cggagucgcccgg

SEQ ID NO: 1079789 - RNA, 19 nt, Mycobacterium bovis subsp bovis AF2122/97
cggagucgcccgguccgcc

SEQ ID NO: 1079790 - RNA, 22 nt, Mycobacterium bovis subsp bovis AF2122/97
cggauaacccagcggcgccacg

SEQ ID NO: 1079791 - RNA, 21 nt, Mycobacterium bovis subsp bovis AF2122/97
cggauaacccguggcgguugc

SEQ ID NO: 1079792 - RNA, 16 nt, Mycobacterium bovis subsp bovis AF2122/97
cggauaaccggcaugc

SEQ ID NO: 1079793 - RNA, 16 nt, Mycobacterium bovis subsp bovis AF2122/97
cggaguuggcccgacg

SEQ ID NO: 1079794 - RNA, 18 nt, Mycobacterium bovis subsp bovis AF2122/97
cggaguucgcugacggcc

SEQ ID NO: 1079795 - RNA, 16 nt, Mycobacterium bovis subsp bovis AF2122/97
cggaguucugcgauca

SEQ ID NO: 1079796 - RNA, 18 nt, Mycobacterium bovis subsp bovis AF2122/97
cggaguugaagaagcccg

SEQ ID NO: 1079797 - RNA, 18 nt, Mycobacterium bovis subsp bovis AF2122/97
cggagugucgaugcgcgc

SEQ ID NO: 1079798 - RNA, 22 nt, Mycobacterium bovis subsp bovis AF2122/97
cggagugucgaugcgcgccggc

SEQ ID NO: 1079799 - RNA, 21 nt, Mycobacterium bovis subsp bovis AF2122/97
cggaguucaagguguucuggc

SEQ ID NO: 1079800 - RNA, 15 nt, Mycobacterium bovis subsp bovis AF2122/97
cggaguuccgccauu

SEQ ID NO: 1079801 - RNA, 23 nt, Mycobacterium bovis subsp bovis AF2122/97
cggaguuccgccauugccguccg

SEQ ID NO: 1079802 - RNA, 16 nt, Mycobacterium bovis subsp bovis AF2122/97
cggagucgcgcagggc

SEQ ID NO: 1079803 - RNA, 23 nt, Mycobacterium bovis subsp bovis AF2122/97
cggaguugucgacggccaccccg

SEQ ID NO: 1079804 - RNA, 17 nt, Mycobacterium bovis subsp bovis AF2122/97
cggaguuuaagacgccc

SEQ ID NO: 1079805 - RNA, 18 nt, Mycobacterium bovis subsp bovis AF2122/97
cggaguuuaagacgcccg

SEQ ID NO: 1079806 - RNA, 20 nt, Mycobacterium bovis subsp bovis AF2122/97
cggaguugaagaagcccgac

SEQ ID NO: 1079807 - RNA, 22 nt, Mycobacterium bovis subsp bovis AF2122/97
cggaguugaagaagcccgacga

SEQ ID NO: 1079808 - RNA, 21 nt, Mycobacterium bovis subsp bovis AF2122/97
cggaguuuaagacgcccgagu

SEQ ID NO: 1079809 - RNA, 23 nt, Mycobacterium bovis subsp bovis AF2122/97
cggacgaacgccgucgacgcggc

SEQ ID NO: 1079810 - RNA, 14 nt, Mycobacterium bovis subsp bovis AF2122/97
cggacgagcgucag

SEQ ID NO: 1079811 - RNA, 19 nt, Mycobacterium bovis subsp bovis AF2122/97
cggacgcacgauccgcacc

SEQ ID NO: 1079812 - RNA, 14 nt, Mycobacterium bovis subsp bovis AF2122/97
cggacgccgcgccg

SEQ ID NO: 1079813 - RNA, 18 nt, Mycobacterium bovis subsp bovis AF2122/97
cggacgccgcgccggcgg

SEQ ID NO: 1079814 - RNA, 20 nt, Mycobacterium bovis subsp bovis AF2122/97
cggacgccgcgccggcgggc

SEQ ID NO: 1079815 - RNA, 20 nt, Mycobacterium bovis subsp bovis AF2122/97
cggacgcaacacccgggcga

SEQ ID NO: 1079816 - RNA, 16 nt, Mycobacterium bovis subsp bovis AF2122/97
cggacgcaacacccgg

SEQ ID NO: 1079817 - RNA, 21 nt, Mycobacterium bovis subsp bovis AF2122/97
cggacgauggcgucggccagg

SEQ ID NO: 1079818 - RNA, 22 nt, Mycobacterium bovis subsp bovis AF2122/97
cggacgauggcgucggccagga

SEQ ID NO: 1079819 - RNA, 20 nt, Mycobacterium bovis subsp bovis AF2122/97
cggaccuggguggcgucgcg

SEQ ID NO: 1079820 - RNA, 20 nt, Mycobacterium bovis subsp bovis AF2122/97
cggaccuuccgggugaaguu

SEQ ID NO: 1079821 - RNA, 14 nt, Mycobacterium bovis subsp bovis AF2122/97
cggaccuucggcgg

SEQ ID NO: 1079822 - RNA, 21 nt, Mycobacterium bovis subsp bovis AF2122/97
cggaccuucggcggugccacc

SEQ ID NO: 1079823 - RNA, 21 nt, Mycobacterium bovis subsp bovis AF2122/97
cggacgaacgccgucgacgcg

SEQ ID NO: 1079824 - RNA, 15 nt, Mycobacterium bovis subsp bovis AF2122/97
cggaccuuguuggcc

SEQ ID NO: 1079825 - RNA, 22 nt, Mycobacterium bovis subsp bovis AF2122/97
cggacgaaaucggcggcgucca

SEQ ID NO: 1079826 - RNA, 15 nt, Mycobacterium bovis subsp bovis AF2122/97
cggaccugcgccggu

SEQ ID NO: 1079827 - RNA, 17 nt, Mycobacterium bovis subsp bovis AF2122/97
cggaccugcgccgguga

SEQ ID NO: 1079828 - RNA, 14 nt, Mycobacterium bovis subsp bovis AF2122/97
cggaccucgcccau

SEQ ID NO: 1079829 - RNA, 16 nt, Mycobacterium bovis subsp bovis AF2122/97
cggaccucgcccauga

SEQ ID NO: 1079830 - RNA, 16 nt, Mycobacterium bovis subsp bovis AF2122/97
cggaccucggcgaccu

SEQ ID NO: 1079831 - RNA, 18 nt, Mycobacterium bovis subsp bovis AF2122/97
cggaccucggcgaccugc

SEQ ID NO: 1079832 - RNA, 13 nt, Mycobacterium bovis subsp bovis AF2122/97
cggaccucggcgg

SEQ ID NO: 1079833 - RNA, 16 nt, Mycobacterium bovis subsp bovis AF2122/97
cggaccgucguggcgg

SEQ ID NO: 1079834 - RNA, 23 nt, Mycobacterium bovis subsp bovis AF2122/97
cggaccgucuuuggugccgagca

SEQ ID NO: 1079835 - RNA, 18 nt, Mycobacterium bovis subsp bovis AF2122/97
cggaccguccgacggcgg

SEQ ID NO: 1079836 - RNA, 15 nt, Mycobacterium bovis subsp bovis AF2122/97
cggaccgucgccggu

SEQ ID NO: 1079837 - RNA, 12 nt, Mycobacterium bovis subsp bovis AF2122/97
cggaccguuucg

SEQ ID NO: 1079838 - RNA, 18 nt, Mycobacterium bovis subsp bovis AF2122/97
cggacgggaugcuugguc

SEQ ID NO: 1079839 - RNA, 17 nt, Mycobacterium bovis subsp bovis AF2122/97
cggacgggugcagcgca

SEQ ID NO: 1079840 - RNA, 13 nt, Mycobacterium bovis subsp bovis AF2122/97
cggacgugccggu

SEQ ID NO: 1079841 - RNA, 14 nt, Mycobacterium bovis subsp bovis AF2122/97
cggacgugccgguc

SEQ ID NO: 1079842 - RNA, 20 nt, Mycobacterium bovis subsp bovis AF2122/97
cggacgucgacuuguugggc

SEQ ID NO: 1079843 - RNA, 15 nt, Mycobacterium bovis subsp bovis AF2122/97
cggacgucgccccgu

SEQ ID NO: 1079844 - RNA, 19 nt, Mycobacterium bovis subsp bovis AF2122/97
cggacgucggcggccguca

SEQ ID NO: 1079845 - RNA, 19 nt, Mycobacterium bovis subsp bovis AF2122/97
cggacgucgugaccggcgg

SEQ ID NO: 1079846 - RNA, 18 nt, Mycobacterium bovis subsp bovis AF2122/97
cggacguaggcaccccgg

SEQ ID NO: 1079847 - RNA, 17 nt, Mycobacterium bovis subsp bovis AF2122/97
cggacgggugcgggccg

SEQ ID NO: 1079848 - RNA, 17 nt, Mycobacterium bovis subsp bovis AF2122/97
cggacggcagccgggcg

SEQ ID NO: 1079849 - RNA, 20 nt, Mycobacterium bovis subsp bovis AF2122/97
cggacggauucgaaggucgg

SEQ ID NO: 1079850 - RNA, 12 nt, Mycobacterium bovis subsp bovis AF2122/97
cggacgcgccgg

SEQ ID NO: 1079851 - RNA, 13 nt, Mycobacterium bovis subsp bovis AF2122/97
cggacggcgucga

SEQ ID NO: 1079852 - RNA, 22 nt, Mycobacterium bovis subsp bovis AF2122/97
cggacggcguuuccuucgacga

SEQ ID NO: 1079853 - RNA, 12 nt, Mycobacterium bovis subsp bovis AF2122/97
cggacugcagcg

SEQ ID NO: 1079854 - RNA, 18 nt, Mycobacterium bovis subsp bovis AF2122/97
cggacugcggcccgaccc

SEQ ID NO: 1079855 - RNA, 18 nt, Mycobacterium bovis subsp bovis AF2122/97
cggacugcagcgcggccg

SEQ ID NO: 1079856 - RNA, 14 nt, Mycobacterium bovis subsp bovis AF2122/97
cggacugacgucga

SEQ ID NO: 1079857 - RNA, 21 nt, Mycobacterium bovis subsp bovis AF2122/97
cggacugagagauggucgggc

SEQ ID NO: 1079858 - RNA, 23 nt, Mycobacterium bovis subsp bovis AF2122/97
cggacucggaauucggcgucgug

SEQ ID NO: 1079859 - RNA, 13 nt, Mycobacterium bovis subsp bovis AF2122/97
cggacuccggccg

SEQ ID NO: 1079860 - RNA, 16 nt, Mycobacterium bovis subsp bovis AF2122/97
cggacuccggccggcc

SEQ ID NO: 1079861 - RNA, 14 nt, Mycobacterium bovis subsp bovis AF2122/97
cggacucgccgacg

SEQ ID NO: 1079862 - RNA, 15 nt, Mycobacterium bovis subsp bovis AF2122/97
cggacucgccgacgu

SEQ ID NO: 1079863 - RNA, 16 nt, Mycobacterium bovis subsp bovis AF2122/97
cggacucccucgauca

SEQ ID NO: 1079864 - RNA, 14 nt, Mycobacterium bovis subsp bovis AF2122/97
cggacuaccgccgg

SEQ ID NO: 1079865 - RNA, 13 nt, Mycobacterium bovis subsp bovis AF2122/97
cggacccgaccgu

SEQ ID NO: 1079866 - RNA, 12 nt, Mycobacterium bovis subsp bovis AF2122/97
cggacccgcagc

SEQ ID NO: 1079867 - RNA, 16 nt, Mycobacterium bovis subsp bovis AF2122/97
cggacccgcagcugcg

SEQ ID NO: 1079868 - RNA, 17 nt, Mycobacterium bovis subsp bovis AF2122/97
cggacccgcagcugcgg

SEQ ID NO: 1079869 - RNA, 20 nt, Mycobacterium bovis subsp bovis AF2122/97
cggacccgcagcugcggauc

SEQ ID NO: 1079870 - RNA, 21 nt, Mycobacterium bovis subsp bovis AF2122/97
cggacccgcccuugccgccga

SEQ ID NO: 1079871 - RNA, 22 nt, Mycobacterium bovis subsp bovis AF2122/97
cggacccgcccuugccgccgag

SEQ ID NO: 1079872 - RNA, 14 nt, Mycobacterium bovis subsp bovis AF2122/97
cggacccgccgggu

SEQ ID NO: 1079873 - RNA, 19 nt, Mycobacterium bovis subsp bovis AF2122/97
cggacccgccggguccgcc

SEQ ID NO: 1079874 - RNA, 18 nt, Mycobacterium bovis subsp bovis AF2122/97
cggacccacccgcaccgc

SEQ ID NO: 1079875 - RNA, 21 nt, Mycobacterium bovis subsp bovis AF2122/97
cggacccaccgucacccccga

SEQ ID NO: 1079876 - RNA, 22 nt, Mycobacterium bovis subsp bovis AF2122/97
cggacccaccgucacccccgau

SEQ ID NO: 1079877 - RNA, 15 nt, Mycobacterium bovis subsp bovis AF2122/97
cggacccaccucgua

SEQ ID NO: 1079878 - RNA, 20 nt, Mycobacterium bovis subsp bovis AF2122/97
cggacccacccgcaccgccg

SEQ ID NO: 1079879 - RNA, 22 nt, Mycobacterium bovis subsp bovis AF2122/97
cggacccacccgcaccgccggc

SEQ ID NO: 1079880 - RNA, 12 nt, Mycobacterium bovis subsp bovis AF2122/97
cggacccaccgu

SEQ ID NO: 1079881 - RNA, 15 nt, Mycobacterium bovis subsp bovis AF2122/97
cggacccaccgucac

SEQ ID NO: 1079882 - RNA, 16 nt, Mycobacterium bovis subsp bovis AF2122/97
cggaccaucgccaggc

SEQ ID NO: 1079883 - RNA, 18 nt, Mycobacterium bovis subsp bovis AF2122/97
cggaccaucgccaggccc

SEQ ID NO: 1079884 - RNA, 17 nt, Mycobacterium bovis subsp bovis AF2122/97
cggaccaucagcgucga

SEQ ID NO: 1079885 - RNA, 14 nt, Mycobacterium bovis subsp bovis AF2122/97
cggaccagcugccg

SEQ ID NO: 1079886 - RNA, 15 nt, Mycobacterium bovis subsp bovis AF2122/97
cggaccagcugccgg

SEQ ID NO: 1079887 - RNA, 16 nt, Mycobacterium bovis subsp bovis AF2122/97
cggaccagcugccggc

SEQ ID NO: 1079888 - RNA, 17 nt, Mycobacterium bovis subsp bovis AF2122/97
cggaccagcugccggcg

SEQ ID NO: 1079889 - RNA, 18 nt, Mycobacterium bovis subsp bovis AF2122/97
cggaccagcugccggcga

SEQ ID NO: 1079890 - RNA, 21 nt, Mycobacterium bovis subsp bovis AF2122/97
cggaccagcugccggcgacca

SEQ ID NO: 1079891 - RNA, 15 nt, Mycobacterium bovis subsp bovis AF2122/97
cggaccaggccgcgc

SEQ ID NO: 1079892 - RNA, 16 nt, Mycobacterium bovis subsp bovis AF2122/97
cggaccaggccgcgcg

SEQ ID NO: 1079893 - RNA, 16 nt, Mycobacterium bovis subsp bovis AF2122/97
cggaccacuguuggug

SEQ ID NO: 1079894 - RNA, 21 nt, Mycobacterium bovis subsp bovis AF2122/97
cggaccacuguuggugccgcc

SEQ ID NO: 1079895 - RNA, 15 nt, Mycobacterium bovis subsp bovis AF2122/97
cggaccagcgccgga

SEQ ID NO: 1079896 - RNA, 18 nt, Mycobacterium bovis subsp bovis AF2122/97
cggaccagcgccggaccg

SEQ ID NO: 1079897 - RNA, 13 nt, Mycobacterium bovis subsp bovis AF2122/97
cggaccagcugcc

SEQ ID NO: 1079898 - RNA, 22 nt, Mycobacterium bovis subsp bovis AF2122/97
cggaccgaugacgaucggcggc

SEQ ID NO: 1079899 - RNA, 14 nt, Mycobacterium bovis subsp bovis AF2122/97
cggaccgaccggcu

SEQ ID NO: 1079900 - RNA, 18 nt, Mycobacterium bovis subsp bovis AF2122/97
cggaccgaccggcucacg

SEQ ID NO: 1079901 - RNA, 13 nt, Mycobacterium bovis subsp bovis AF2122/97
cggacccuuccgc

SEQ ID NO: 1079902 - RNA, 15 nt, Mycobacterium bovis subsp bovis AF2122/97
cggacccggugcacg

SEQ ID NO: 1079903 - RNA, 12 nt, Mycobacterium bovis subsp bovis AF2122/97
cggacccgucgg

SEQ ID NO: 1079904 - RNA, 15 nt, Mycobacterium bovis subsp bovis AF2122/97
cggacccgucggcgu

SEQ ID NO: 1079905 - RNA, 22 nt, Mycobacterium bovis subsp bovis AF2122/97
cggaccgcggauuccagcgcgu

SEQ ID NO: 1079906 - RNA, 22 nt, Mycobacterium bovis subsp bovis AF2122/97
cggaccgauuucuuuaccagca

SEQ ID NO: 1079907 - RNA, 19 nt, Mycobacterium bovis subsp bovis AF2122/97
cggaccgcaacgacggccg

SEQ ID NO: 1079908 - RNA, 21 nt, Mycobacterium bovis subsp bovis AF2122/97
cggaccgggggaagcgguagc

SEQ ID NO: 1079909 - RNA, 13 nt, Mycobacterium bovis subsp bovis AF2122/97
cggaccgcgacgg

SEQ ID NO: 1079910 - RNA, 19 nt, Mycobacterium bovis subsp bovis AF2122/97
cggaccggcuuccccagca

SEQ ID NO: 1079911 - RNA, 19 nt, Mycobacterium bovis subsp bovis AF2122/97
cggacagggugcgcuugcg

SEQ ID NO: 1079912 - RNA, 19 nt, Mycobacterium bovis subsp bovis AF2122/97
cggacagguaacgcgguuc

SEQ ID NO: 1079913 - RNA, 14 nt, Mycobacterium bovis subsp bovis AF2122/97
cggacagguagucg

SEQ ID NO: 1079914 - RNA, 15 nt, Mycobacterium bovis subsp bovis AF2122/97
cggacagggcggcaa

SEQ ID NO: 1079915 - RNA, 21 nt, Mycobacterium bovis subsp bovis AF2122/97
cggacagggcggcaacggcgg

SEQ ID NO: 1079916 - RNA, 14 nt, Mycobacterium bovis subsp bovis AF2122/97
cgcugagcacggcg

SEQ ID NO: 1079917 - RNA, 18 nt, Mycobacterium bovis subsp bovis AF2122/97
cggacaugcgggcagcac

SEQ ID NO: 1079918 - RNA, 14 nt, Mycobacterium bovis subsp bovis AF2122/97
cggacauaccgcga

SEQ ID NO: 1079919 - RNA, 19 nt, Mycobacterium bovis subsp bovis AF2122/97
cggacauccgggccgagcg

SEQ ID NO: 1079920 - RNA, 15 nt, Mycobacterium bovis subsp bovis AF2122/97
cggacaucaccggca

SEQ ID NO: 1079921 - RNA, 16 nt, Mycobacterium bovis subsp bovis AF2122/97
cggaccacccggcgcg

SEQ ID NO: 1079922 - RNA, 12 nt, Mycobacterium bovis subsp bovis AF2122/97
cggaccaccgcc

SEQ ID NO: 1079923 - RNA, 18 nt, Mycobacterium bovis subsp bovis AF2122/97
cggacaucguugacccgg

SEQ ID NO: 1079924 - RNA, 19 nt, Mycobacterium bovis subsp bovis AF2122/97
cggaccagagugguggcga

SEQ ID NO: 1079925 - RNA, 18 nt, Mycobacterium bovis subsp bovis AF2122/97
cgcugaccuuuucccgca

SEQ ID NO: 1079926 - RNA, 19 nt, Mycobacterium bovis subsp bovis AF2122/97
cgcugacgaagcacaguuc

SEQ ID NO: 1079927 - RNA, 13 nt, Mycobacterium bovis subsp bovis AF2122/97
cgcugacgacccu

SEQ ID NO: 1079928 - RNA, 19 nt, Mycobacterium bovis subsp bovis AF2122/97
cgcugacgacccuccgcac

SEQ ID NO: 1079929 - RNA, 16 nt, Mycobacterium bovis subsp bovis AF2122/97
cggcaccgccggcgcc

SEQ ID NO: 1079930 - RNA, 17 nt, Mycobacterium bovis subsp bovis AF2122/97
cggcaccgccggcgcca

SEQ ID NO: 1079931 - RNA, 18 nt, Mycobacterium bovis subsp bovis AF2122/97
cggcaccgccggcgccca

SEQ ID NO: 1079932 - RNA, 20 nt, Mycobacterium bovis subsp bovis AF2122/97
cggcaccgccggcgcccagg

SEQ ID NO: 1079933 - RNA, 22 nt, Mycobacterium bovis subsp bovis AF2122/97
cggcaccgccggcgcccaggcc

SEQ ID NO: 1079934 - RNA, 13 nt, Mycobacterium bovis subsp bovis AF2122/97
cggcaccgccggc

SEQ ID NO: 1079935 - RNA, 18 nt, Mycobacterium bovis subsp bovis AF2122/97
cggcaccgccggcaccgc

SEQ ID NO: 1079936 - RNA, 21 nt, Mycobacterium bovis subsp bovis AF2122/97
cggcaccgccggcaccgccgg

SEQ ID NO: 1079937 - RNA, 14 nt, Mycobacterium bovis subsp bovis AF2122/97
cggcaccgccggcu

SEQ ID NO: 1079938 - RNA, 14 nt, Mycobacterium bovis subsp bovis AF2122/97
cggcaccgccggug

SEQ ID NO: 1079939 - RNA, 16 nt, Mycobacterium bovis subsp bovis AF2122/97
cggcaccccacggcca

SEQ ID NO: 1079940 - RNA, 11 nt, Mycobacterium bovis subsp bovis AF2122/97
cggcaccgccg

SEQ ID NO: 1079941 - RNA, 11 nt, Mycobacterium bovis subsp bovis AF2122/97
cggcaccgccu

SEQ ID NO: 1079942 - RNA, 12 nt, Mycobacterium bovis subsp bovis AF2122/97
cggcaccgcgcc

SEQ ID NO: 1079943 - RNA, 14 nt, Mycobacterium bovis subsp bovis AF2122/97
cggcaccgcgccca

SEQ ID NO: 1079944 - RNA, 14 nt, Mycobacterium bovis subsp bovis AF2122/97
cggcaccgcgccgg

SEQ ID NO: 1079945 - RNA, 15 nt, Mycobacterium bovis subsp bovis AF2122/97
cggcaccgcgccggc

SEQ ID NO: 1079946 - RNA, 17 nt, Mycobacterium bovis subsp bovis AF2122/97
cggcaccgcgccggcgg

SEQ ID NO: 1079947 - RNA, 22 nt, Mycobacterium bovis subsp bovis AF2122/97
cggcaccgcggauaggccgcgc

SEQ ID NO: 1079948 - RNA, 23 nt, Mycobacterium bovis subsp bovis AF2122/97
cggcaccgcggauaggccgcgcg

SEQ ID NO: 1079949 - RNA, 14 nt, Mycobacterium bovis subsp bovis AF2122/97
cggcaccgcggccg

SEQ ID NO: 1079950 - RNA, 16 nt, Mycobacterium bovis subsp bovis AF2122/97
cggcaccagguugccg

SEQ ID NO: 1079951 - RNA, 21 nt, Mycobacterium bovis subsp bovis AF2122/97
cggcaccagcgggucggcggu

SEQ ID NO: 1079952 - RNA, 20 nt, Mycobacterium bovis subsp bovis AF2122/97
cggcaccagguugccgaggu

SEQ ID NO: 1079953 - RNA, 15 nt, Mycobacterium bovis subsp bovis AF2122/97
cggcacccccgacga

SEQ ID NO: 1079954 - RNA, 18 nt, Mycobacterium bovis subsp bovis AF2122/97
cggcacccccgacgagau

SEQ ID NO: 1079955 - RNA, 18 nt, Mycobacterium bovis subsp bovis AF2122/97
cggcacccccgucgccac

SEQ ID NO: 1079956 - RNA, 20 nt, Mycobacterium bovis subsp bovis AF2122/97
cggcacccccgucgccaccg

SEQ ID NO: 1079957 - RNA, 21 nt, Mycobacterium bovis subsp bovis AF2122/97
cggcacccccgucgccaccga

SEQ ID NO: 1079958 - RNA, 20 nt, Mycobacterium bovis subsp bovis AF2122/97
cggcacccagucggcgccgc

SEQ ID NO: 1079959 - RNA, 21 nt, Mycobacterium bovis subsp bovis AF2122/97
cggcacccagucggcgccgcc

SEQ ID NO: 1079960 - RNA, 23 nt, Mycobacterium bovis subsp bovis AF2122/97
cggcacccagucggcgccgccgu

SEQ ID NO: 1079961 - RNA, 14 nt, Mycobacterium bovis subsp bovis AF2122/97
cggcaccagcaccg

SEQ ID NO: 1079962 - RNA, 21 nt, Mycobacterium bovis subsp bovis AF2122/97
cggcacccaaccaggccgcga

SEQ ID NO: 1079963 - RNA, 23 nt, Mycobacterium bovis subsp bovis AF2122/97
cggcaccgcugccgcugccgaag

SEQ ID NO: 1079964 - RNA, 15 nt, Mycobacterium bovis subsp bovis AF2122/97
cggcaccgucucgca

SEQ ID NO: 1079965 - RNA, 21 nt, Mycobacterium bovis subsp bovis AF2122/97
cggcaccgguuuucgccggcu

SEQ ID NO: 1079966 - RNA, 20 nt, Mycobacterium bovis subsp bovis AF2122/97
cggcaccguagagcaugccg

SEQ ID NO: 1079967 - RNA, 17 nt, Mycobacterium bovis subsp bovis AF2122/97
cggcaccggccgugccg

SEQ ID NO: 1079968 - RNA, 21 nt, Mycobacterium bovis subsp bovis AF2122/97
cggcaccggccgugccgccga

SEQ ID NO: 1079969 - RNA, 22 nt, Mycobacterium bovis subsp bovis AF2122/97
cggcaccggccgugccgccgac

SEQ ID NO: 1079970 - RNA, 16 nt, Mycobacterium bovis subsp bovis AF2122/97
cggcaccggggcugcc

SEQ ID NO: 1079971 - RNA, 15 nt, Mycobacterium bovis subsp bovis AF2122/97
cggcaccggugccca

SEQ ID NO: 1079972 - RNA, 21 nt, Mycobacterium bovis subsp bovis AF2122/97
cggcaccggugcccaccaccg

SEQ ID NO: 1079973 - RNA, 11 nt, Mycobacterium bovis subsp bovis AF2122/97
cggcaccgcgc

SEQ ID NO: 1079974 - RNA, 16 nt, Mycobacterium bovis subsp bovis AF2122/97
cggcaccgcugccgcu

SEQ ID NO: 1079975 - RNA, 12 nt, Mycobacterium bovis subsp bovis AF2122/97
cggcaccgugcg

SEQ ID NO: 1079976 - RNA, 16 nt, Mycobacterium bovis subsp bovis AF2122/97
cggcaccgugucgacg

SEQ ID NO: 1079977 - RNA, 19 nt, Mycobacterium bovis subsp bovis AF2122/97
cggcaccgucucgcaccgc

SEQ ID NO: 1079978 - RNA, 22 nt, Mycobacterium bovis subsp bovis AF2122/97
cggcaccuccagcaccaccgga

SEQ ID NO: 1079979 - RNA, 16 nt, Mycobacterium bovis subsp bovis AF2122/97
cggcaccagcggcacc

SEQ ID NO: 1079980 - RNA, 18 nt, Mycobacterium bovis subsp bovis AF2122/97
cggcaccagcgcgcgccg

SEQ ID NO: 1079981 - RNA, 19 nt, Mycobacterium bovis subsp bovis AF2122/97
cggcaccagcgcgcgccga

SEQ ID NO: 1079982 - RNA, 15 nt, Mycobacterium bovis subsp bovis AF2122/97
cggcaccacgucgac

SEQ ID NO: 1079983 - RNA, 14 nt, Mycobacterium bovis subsp bovis AF2122/97
cggcaccacgucga

SEQ ID NO: 1079984 - RNA, 18 nt, Mycobacterium bovis subsp bovis AF2122/97
cggcaccagcagccagcc

SEQ ID NO: 1079985 - RNA, 16 nt, Mycobacterium bovis subsp bovis AF2122/97
cggcaccaccgcgacc

SEQ ID NO: 1079986 - RNA, 12 nt, Mycobacterium bovis subsp bovis AF2122/97
cggcaccacgau

SEQ ID NO: 1079987 - RNA, 14 nt, Mycobacterium bovis subsp bovis AF2122/97
cggcaccaccgcga

SEQ ID NO: 1079988 - RNA, 16 nt, Mycobacterium bovis subsp bovis AF2122/97
cggcaccaaugcggug

SEQ ID NO: 1079989 - RNA, 20 nt, Mycobacterium bovis subsp bovis AF2122/97
cggcaccaaugcggugacaa

SEQ ID NO: 1079990 - RNA, 20 nt, Mycobacterium bovis subsp bovis AF2122/97
cggcaccaacgccaccgucg

SEQ ID NO: 1079991 - RNA, 18 nt, Mycobacterium bovis subsp bovis AF2122/97
cggcacacccaucaccgc

SEQ ID NO: 1079992 - RNA, 19 nt, Mycobacterium bovis subsp bovis AF2122/97
cggcacacccaucaccgcc

SEQ ID NO: 1079993 - RNA, 16 nt, Mycobacterium bovis subsp bovis AF2122/97
cggcacacccaucacc

SEQ ID NO: 1079994 - RNA, 17 nt, Mycobacterium bovis subsp bovis AF2122/97
cggcaauuuucugcugc

SEQ ID NO: 1079995 - RNA, 15 nt, Mycobacterium bovis subsp bovis AF2122/97
cggcacaggcggcca

SEQ ID NO: 1079996 - RNA, 18 nt, Mycobacterium bovis subsp bovis AF2122/97
cggcacaugcgcguccag

SEQ ID NO: 1079997 - RNA, 18 nt, Mycobacterium bovis subsp bovis AF2122/97
cggcacauugaucgacgg

SEQ ID NO: 1079998 - RNA, 20 nt, Mycobacterium bovis subsp bovis AF2122/97
cggcacauugaucgacggcc

SEQ ID NO: 1079999 - RNA, 23 nt, Mycobacterium bovis subsp bovis AF2122/97
cggcacauugaucgacggccagc

SEQ ID NO: 1080000 - RNA, 13 nt, Mycobacterium bovis subsp bovis AF2122/97
cggcaccaaccac

SEQ ID NO: 1080001 - RNA, 16 nt, Mycobacterium bovis subsp bovis AF2122/97
cggcaccaaccaccga

SEQ ID NO: 1080002 - RNA, 17 nt, Mycobacterium bovis subsp bovis AF2122/97
cggcaccaaccaccgac

SEQ ID NO: 1080003 - RNA, 19 nt, Mycobacterium bovis subsp bovis AF2122/97
cggcaauugcgguucgaac

SEQ ID NO: 1080004 - RNA, 16 nt, Mycobacterium bovis subsp bovis AF2122/97
cggcacaaucggcgcc

SEQ ID NO: 1080005 - RNA, 19 nt, Mycobacterium bovis subsp bovis AF2122/97
cggcaauggccagcaccac

SEQ ID NO: 1080006 - RNA, 15 nt, Mycobacterium bovis subsp bovis AF2122/97
cggcaaugacggccu

SEQ ID NO: 1080007 - RNA, 19 nt, Mycobacterium bovis subsp bovis AF2122/97
cggcaaugacggccugcac

SEQ ID NO: 1080008 - RNA, 12 nt, Mycobacterium bovis subsp bovis AF2122/97
cggcaaucucga

SEQ ID NO: 1080009 - RNA, 18 nt, Mycobacterium bovis subsp bovis AF2122/97
cggcaaucggcggcaccc

SEQ ID NO: 1080010 - RNA, 13 nt, Mycobacterium bovis subsp bovis AF2122/97
cggcaaucggguc

SEQ ID NO: 1080011 - RNA, 12 nt, Mycobacterium bovis subsp bovis AF2122/97
cggcaaucggug

SEQ ID NO: 1080012 - RNA, 16 nt, Mycobacterium bovis subsp bovis AF2122/97
cggcaauacuccgcug

SEQ ID NO: 1080013 - RNA, 17 nt, Mycobacterium bovis subsp bovis AF2122/97
cggcaaucaggucgucg

SEQ ID NO: 1080014 - RNA, 14 nt, Mycobacterium bovis subsp bovis AF2122/97
cggcaagucgacgc

SEQ ID NO: 1080015 - RNA, 14 nt, Mycobacterium bovis subsp bovis AF2122/97
cggcaauacccgcc

SEQ ID NO: 1080016 - RNA, 16 nt, Mycobacterium bovis subsp bovis AF2122/97
cggcaauacccgccgc

SEQ ID NO: 1080017 - RNA, 18 nt, Mycobacterium bovis subsp bovis AF2122/97
cggcaauacccgccgcga

SEQ ID NO: 1080018 - RNA, 18 nt, Mycobacterium bovis subsp bovis AF2122/97
cggcaauaccgaaccggu

SEQ ID NO: 1080019 - RNA, 19 nt, Mycobacterium bovis subsp bovis AF2122/97
cggcaauaccgaaccggug

SEQ ID NO: 1080020 - RNA, 15 nt, Mycobacterium bovis subsp bovis AF2122/97
cggcaauaccgccag

SEQ ID NO: 1080021 - RNA, 14 nt, Mycobacterium bovis subsp bovis AF2122/97
cggcaauaccggca

SEQ ID NO: 1080022 - RNA, 14 nt, Mycobacterium bovis subsp bovis AF2122/97
cggcaagcgugacc

SEQ ID NO: 1080023 - RNA, 23 nt, Mycobacterium bovis subsp bovis AF2122/97
cggcaagcgugacccgccggcga

SEQ ID NO: 1080024 - RNA, 13 nt, Mycobacterium bovis subsp bovis AF2122/97
cggcaagauccgg

SEQ ID NO: 1080025 - RNA, 17 nt, Mycobacterium bovis subsp bovis AF2122/97
cggcaagcacgguggcc

SEQ ID NO: 1080026 - RNA, 18 nt, Mycobacterium bovis subsp bovis AF2122/97
cggcaagcacgguggccg

SEQ ID NO: 1080027 - RNA, 14 nt, Mycobacterium bovis subsp bovis AF2122/97
cggcaagcagucgg

SEQ ID NO: 1080028 - RNA, 15 nt, Mycobacterium bovis subsp bovis AF2122/97
cggcaagccacgccg

SEQ ID NO: 1080029 - RNA, 16 nt, Mycobacterium bovis subsp bovis AF2122/97
cggcaagccacgccgg

SEQ ID NO: 1080030 - RNA, 14 nt, Mycobacterium bovis subsp bovis AF2122/97
cggcaaggcggauc

SEQ ID NO: 1080031 - RNA, 15 nt, Mycobacterium bovis subsp bovis AF2122/97
cggcaagcucgacga

SEQ ID NO: 1080032 - RNA, 17 nt, Mycobacterium bovis subsp bovis AF2122/97
cggcaagccaaccagcc

SEQ ID NO: 1080033 - RNA, 14 nt, Mycobacterium bovis subsp bovis AF2122/97
cggcaagcucgacg

SEQ ID NO: 1080034 - RNA, 21 nt, Mycobacterium bovis subsp bovis AF2122/97
cggcaaggguggggccggcgg

SEQ ID NO: 1080035 - RNA, 15 nt, Mycobacterium bovis subsp bovis AF2122/97
cggcaagggcggcaa

SEQ ID NO: 1080036 - RNA, 17 nt, Mycobacterium bovis subsp bovis AF2122/97
cggcaagggcggcaacg

SEQ ID NO: 1080037 - RNA, 16 nt, Mycobacterium bovis subsp bovis AF2122/97
cggcaacagcaccagu

SEQ ID NO: 1080038 - RNA, 17 nt, Mycobacterium bovis subsp bovis AF2122/97
cggcaaaguuggccgcc

SEQ ID NO: 1080039 - RNA, 14 nt, Mycobacterium bovis subsp bovis AF2122/97
cggcaacagcgcca

SEQ ID NO: 1080040 - RNA, 16 nt, Mycobacterium bovis subsp bovis AF2122/97
cggcaacagcgccaag

SEQ ID NO: 1080041 - RNA, 13 nt, Mycobacterium bovis subsp bovis AF2122/97
cggcaaccagcga

SEQ ID NO: 1080042 - RNA, 13 nt, Mycobacterium bovis subsp bovis AF2122/97
cggcaacaucagc

SEQ ID NO: 1080043 - RNA, 24 nt, Mycobacterium bovis subsp bovis AF2122/97
cggcaacaugagcgucgcugaccg

SEQ ID NO: 1080044 - RNA, 15 nt, Mycobacterium bovis subsp bovis AF2122/97
cggcaaccgccgcca

SEQ ID NO: 1080045 - RNA, 17 nt, Mycobacterium bovis subsp bovis AF2122/97
cggcaaccgccgccacc

SEQ ID NO: 1080046 - RNA, 18 nt, Mycobacterium bovis subsp bovis AF2122/97
cggcaaccgccgccacca

SEQ ID NO: 1080047 - RNA, 23 nt, Mycobacterium bovis subsp bovis AF2122/97
cggcaaccgccgccaccagggcg

SEQ ID NO: 1080048 - RNA, 17 nt, Mycobacterium bovis subsp bovis AF2122/97
cggcaaccgccgugugc

SEQ ID NO: 1080049 - RNA, 12 nt, Mycobacterium bovis subsp bovis AF2122/97
cggcaaccggga

SEQ ID NO: 1080050 - RNA, 18 nt, Mycobacterium bovis subsp bovis AF2122/97
cggcaacaaagucgccau

SEQ ID NO: 1080051 - RNA, 20 nt, Mycobacterium bovis subsp bovis AF2122/97
cggcaacccugcccggcccg

SEQ ID NO: 1080052 - RNA, 21 nt, Mycobacterium bovis subsp bovis AF2122/97
cggcaacccugcccggcccgc

SEQ ID NO: 1080053 - RNA, 22 nt, Mycobacterium bovis subsp bovis AF2122/97
cggcaacccugcccggcccgcc

SEQ ID NO: 1080054 - RNA, 15 nt, Mycobacterium bovis subsp bovis AF2122/97
cggcaacccgcacca

SEQ ID NO: 1080055 - RNA, 14 nt, Mycobacterium bovis subsp bovis AF2122/97
cggcaacccacacg

SEQ ID NO: 1080056 - RNA, 17 nt, Mycobacterium bovis subsp bovis AF2122/97
cggcaaccaccggccgc

SEQ ID NO: 1080057 - RNA, 21 nt, Mycobacterium bovis subsp bovis AF2122/97
cggcaacgaggucugcggccg

SEQ ID NO: 1080058 - RNA, 17 nt, Mycobacterium bovis subsp bovis AF2122/97
cggcaacgacccgccgc

SEQ ID NO: 1080059 - RNA, 18 nt, Mycobacterium bovis subsp bovis AF2122/97
cggcaacggcgcgccgac

SEQ ID NO: 1080060 - RNA, 15 nt, Mycobacterium bovis subsp bovis AF2122/97
cggcaacggcggauc

SEQ ID NO: 1080061 - RNA, 13 nt, Mycobacterium bovis subsp bovis AF2122/97
cggcaacggcggc

SEQ ID NO: 1080062 - RNA, 21 nt, Mycobacterium bovis subsp bovis AF2122/97
cggcaacggcggcaucggcgg

SEQ ID NO: 1080063 - RNA, 20 nt, Mycobacterium bovis subsp bovis AF2122/97
cggcaaccugcgaccaggcg

SEQ ID NO: 1080064 - RNA, 22 nt, Mycobacterium bovis subsp bovis AF2122/97
cggcaacgaucgacaccagggc

SEQ ID NO: 1080065 - RNA, 23 nt, Mycobacterium bovis subsp bovis AF2122/97
cggcaacgcggccuugcgcacag

SEQ ID NO: 1080066 - RNA, 16 nt, Mycobacterium bovis subsp bovis AF2122/97
cggcaacgcggucugc

SEQ ID NO: 1080067 - RNA, 21 nt, Mycobacterium bovis subsp bovis AF2122/97
cggcaacggcucgucgaacau

SEQ ID NO: 1080068 - RNA, 16 nt, Mycobacterium bovis subsp bovis AF2122/97
cggcaacgggggcgcc

SEQ ID NO: 1080069 - RNA, 17 nt, Mycobacterium bovis subsp bovis AF2122/97
cggcaacgggggcgccg

SEQ ID NO: 1080070 - RNA, 18 nt, Mycobacterium bovis subsp bovis AF2122/97
cggcaacgggggcgccgg

SEQ ID NO: 1080071 - RNA, 14 nt, Mycobacterium bovis subsp bovis AF2122/97
cggcaacgugcggu

SEQ ID NO: 1080072 - RNA, 14 nt, Mycobacterium bovis subsp bovis AF2122/97
cggcaagcacaccg

SEQ ID NO: 1080073 - RNA, 15 nt, Mycobacterium bovis subsp bovis AF2122/97
cggcaagcacaccgc

SEQ ID NO: 1080074 - RNA, 16 nt, Mycobacterium bovis subsp bovis AF2122/97
cggcaagcacaccgcc

SEQ ID NO: 1080075 - RNA, 20 nt, Mycobacterium bovis subsp bovis AF2122/97
cggcaagcacaccgccagcg

SEQ ID NO: 1080076 - RNA, 22 nt, Mycobacterium bovis subsp bovis AF2122/97
cggcaagcacaccgccagcggc

SEQ ID NO: 1080077 - RNA, 19 nt, Mycobacterium bovis subsp bovis AF2122/97
cggcaagaccgaacagcgg

SEQ ID NO: 1080078 - RNA, 15 nt, Mycobacterium bovis subsp bovis AF2122/97
cggaucgcucccguc

SEQ ID NO: 1080079 - RNA, 13 nt, Mycobacterium bovis subsp bovis AF2122/97
cggaucggcaccc

SEQ ID NO: 1080080 - RNA, 15 nt, Mycobacterium bovis subsp bovis AF2122/97
cggaucggcgccgca

SEQ ID NO: 1080081 - RNA, 15 nt, Mycobacterium bovis subsp bovis AF2122/97
cggaucggcggaccg

SEQ ID NO: 1080082 - RNA, 23 nt, Mycobacterium bovis subsp bovis AF2122/97
cggaucggcggaccgcagcguga

SEQ ID NO: 1080083 - RNA, 13 nt, Mycobacterium bovis subsp bovis AF2122/97
cggaucggcggcc

SEQ ID NO: 1080084 - RNA, 16 nt, Mycobacterium bovis subsp bovis AF2122/97
cggaucggcggccgcg

SEQ ID NO: 1080085 - RNA, 20 nt, Mycobacterium bovis subsp bovis AF2122/97
cggaucggcggccgcgacca

SEQ ID NO: 1080086 - RNA, 15 nt, Mycobacterium bovis subsp bovis AF2122/97
cggaucggcggccgg

SEQ ID NO: 1080087 - RNA, 19 nt, Mycobacterium bovis subsp bovis AF2122/97
cggaucggcggccggcacg

SEQ ID NO: 1080088 - RNA, 19 nt, Mycobacterium bovis subsp bovis AF2122/97
cggaucgacuucgacgaca

SEQ ID NO: 1080089 - RNA, 18 nt, Mycobacterium bovis subsp bovis AF2122/97
cggaucgauuccgccgca

SEQ ID NO: 1080090 - RNA, 18 nt, Mycobacterium bovis subsp bovis AF2122/97
cggaucgauucgucgcgg

SEQ ID NO: 1080091 - RNA, 15 nt, Mycobacterium bovis subsp bovis AF2122/97
cggaucgccaggccg

SEQ ID NO: 1080092 - RNA, 16 nt, Mycobacterium bovis subsp bovis AF2122/97
cggaucgccaggccgu

SEQ ID NO: 1080093 - RNA, 19 nt, Mycobacterium bovis subsp bovis AF2122/97
cggaucgccaggccgucgg

SEQ ID NO: 1080094 - RNA, 19 nt, Mycobacterium bovis subsp bovis AF2122/97
cggaucgccggggacgccg

SEQ ID NO: 1080095 - RNA, 14 nt, Mycobacterium bovis subsp bovis AF2122/97
cggaucgccgucgc

SEQ ID NO: 1080096 - RNA, 19 nt, Mycobacterium bovis subsp bovis AF2122/97
cggaucgcggucagcgggu

SEQ ID NO: 1080097 - RNA, 18 nt, Mycobacterium bovis subsp bovis AF2122/97
cggaucgcggcggcgugc

SEQ ID NO: 1080098 - RNA, 13 nt, Mycobacterium bovis subsp bovis AF2122/97
cggauccgcccgc

SEQ ID NO: 1080099 - RNA, 14 nt, Mycobacterium bovis subsp bovis AF2122/97
cggauccggccagg

SEQ ID NO: 1080100 - RNA, 14 nt, Mycobacterium bovis subsp bovis AF2122/97
cggaucgaagacca

SEQ ID NO: 1080101 - RNA, 23 nt, Mycobacterium bovis subsp bovis AF2122/97
cggaucgaccgccagcgccgcca

SEQ ID NO: 1080102 - RNA, 19 nt, Mycobacterium bovis subsp bovis AF2122/97
cggaucgaccaauucgacc

SEQ ID NO: 1080103 - RNA, 15 nt, Mycobacterium bovis subsp bovis AF2122/97
cggauccgggcgugg

SEQ ID NO: 1080104 - RNA, 14 nt, Mycobacterium bovis subsp bovis AF2122/97
cggauccgaugaca

SEQ ID NO: 1080105 - RNA, 20 nt, Mycobacterium bovis subsp bovis AF2122/97
cggauccauuagcacaucgc

SEQ ID NO: 1080106 - RNA, 13 nt, Mycobacterium bovis subsp bovis AF2122/97
cggaucccaccac

SEQ ID NO: 1080107 - RNA, 15 nt, Mycobacterium bovis subsp bovis AF2122/97
cggaucccaccaccg

SEQ ID NO: 1080108 - RNA, 14 nt, Mycobacterium bovis subsp bovis AF2122/97
cggaucccgaggcg

SEQ ID NO: 1080109 - RNA, 19 nt, Mycobacterium bovis subsp bovis AF2122/97
cggaucccgaggcgcccaa

SEQ ID NO: 1080110 - RNA, 19 nt, Mycobacterium bovis subsp bovis AF2122/97
cggauccauuagcacaucg

SEQ ID NO: 1080111 - RNA, 23 nt, Mycobacterium bovis subsp bovis AF2122/97
cggaucacucccccacacacccg

SEQ ID NO: 1080112 - RNA, 16 nt, Mycobacterium bovis subsp bovis AF2122/97
cggaucaucgccgcgg

SEQ ID NO: 1080113 - RNA, 20 nt, Mycobacterium bovis subsp bovis AF2122/97
cggaucaucgccgcggccag

SEQ ID NO: 1080114 - RNA, 20 nt, Mycobacterium bovis subsp bovis AF2122/97
cggaucauccuucgccggcg

SEQ ID NO: 1080115 - RNA, 22 nt, Mycobacterium bovis subsp bovis AF2122/97
cggaucauccuucgccggcgcc

SEQ ID NO: 1080116 - RNA, 23 nt, Mycobacterium bovis subsp bovis AF2122/97
cggaucauccuucgccggcgcca

SEQ ID NO: 1080117 - RNA, 15 nt, Mycobacterium bovis subsp bovis AF2122/97
cggaucauucugcgg

SEQ ID NO: 1080118 - RNA, 17 nt, Mycobacterium bovis subsp bovis AF2122/97
cggaucauucugcggcc

SEQ ID NO: 1080119 - RNA, 14 nt, Mycobacterium bovis subsp bovis AF2122/97
cggaugcccgcaac

SEQ ID NO: 1080120 - RNA, 13 nt, Mycobacterium bovis subsp bovis AF2122/97
cggaugccggucg

SEQ ID NO: 1080121 - RNA, 20 nt, Mycobacterium bovis subsp bovis AF2122/97
cggaugccggucggcgucga

SEQ ID NO: 1080122 - RNA, 15 nt, Mycobacterium bovis subsp bovis AF2122/97
cggaugcgcaaccgc

SEQ ID NO: 1080123 - RNA, 20 nt, Mycobacterium bovis subsp bovis AF2122/97
cggaugcaacccggugaugg

SEQ ID NO: 1080124 - RNA, 20 nt, Mycobacterium bovis subsp bovis AF2122/97
cggaugagcucggccaucag

SEQ ID NO: 1080125 - RNA, 15 nt, Mycobacterium bovis subsp bovis AF2122/97
cggaucugacggcgc

SEQ ID NO: 1080126 - RNA, 21 nt, Mycobacterium bovis subsp bovis AF2122/97
cggaucugacggcgccgucga

SEQ ID NO: 1080127 - RNA, 16 nt, Mycobacterium bovis subsp bovis AF2122/97
cggaucugggcggccu

SEQ ID NO: 1080128 - RNA, 17 nt, Mycobacterium bovis subsp bovis AF2122/97
cggaucuggugggugcg

SEQ ID NO: 1080129 - RNA, 19 nt, Mycobacterium bovis subsp bovis AF2122/97
cggaugacaccgaccgggu

SEQ ID NO: 1080130 - RNA, 22 nt, Mycobacterium bovis subsp bovis AF2122/97
cggaucgugcccuguccggcgc

SEQ ID NO: 1080131 - RNA, 16 nt, Mycobacterium bovis subsp bovis AF2122/97
cggaucguggcgcccg

SEQ ID NO: 1080132 - RNA, 21 nt, Mycobacterium bovis subsp bovis AF2122/97
cggaucggcuaccuaacccgc

SEQ ID NO: 1080133 - RNA, 14 nt, Mycobacterium bovis subsp bovis AF2122/97
cggaucguugaggu

SEQ ID NO: 1080134 - RNA, 23 nt, Mycobacterium bovis subsp bovis AF2122/97
cggaucgucgaacagcaccgccg

SEQ ID NO: 1080135 - RNA, 23 nt, Mycobacterium bovis subsp bovis AF2122/97
cggaucgucgugcacggcggcca

SEQ ID NO: 1080136 - RNA, 19 nt, Mycobacterium bovis subsp bovis AF2122/97
cggaucgugcccuguccgg

SEQ ID NO: 1080137 - RNA, 22 nt, Mycobacterium bovis subsp bovis AF2122/97
cggaucgucgaacagcaccgcc

SEQ ID NO: 1080138 - RNA, 16 nt, Mycobacterium bovis subsp bovis AF2122/97
cggaucgggaccggga

SEQ ID NO: 1080139 - RNA, 14 nt, Mycobacterium bovis subsp bovis AF2122/97
cggauugccgcgcg

SEQ ID NO: 1080140 - RNA, 15 nt, Mycobacterium bovis subsp bovis AF2122/97
cggauucgggcgaag

SEQ ID NO: 1080141 - RNA, 12 nt, Mycobacterium bovis subsp bovis AF2122/97
cggauugagcac

SEQ ID NO: 1080142 - RNA, 16 nt, Mycobacterium bovis subsp bovis AF2122/97
cggauugagcacgcgc

SEQ ID NO: 1080143 - RNA, 15 nt, Mycobacterium bovis subsp bovis AF2122/97
cggauugcagcgcga

SEQ ID NO: 1080144 - RNA, 24 nt, Mycobacterium bovis subsp bovis AF2122/97
cggauugcagcgcgauggccuggc

SEQ ID NO: 1080145 - RNA, 21 nt, Mycobacterium bovis subsp bovis AF2122/97
cggauucgguuagcgcggcca

SEQ ID NO: 1080146 - RNA, 12 nt, Mycobacterium bovis subsp bovis AF2122/97
cggauucggcgc

SEQ ID NO: 1080147 - RNA, 13 nt, Mycobacterium bovis subsp bovis AF2122/97
cggauucggcgcu

SEQ ID NO: 1080148 - RNA, 14 nt, Mycobacterium bovis subsp bovis AF2122/97
cggauuccucguca

SEQ ID NO: 1080149 - RNA, 23 nt, Mycobacterium bovis subsp bovis AF2122/97
cggauuccucgucaccgcgacca

SEQ ID NO: 1080150 - RNA, 16 nt, Mycobacterium bovis subsp bovis AF2122/97
cggauucgcccgggcg

SEQ ID NO: 1080151 - RNA, 16 nt, Mycobacterium bovis subsp bovis AF2122/97
cggauuccggcaucgg

SEQ ID NO: 1080152 - RNA, 20 nt, Mycobacterium bovis subsp bovis AF2122/97
cggauuccggcucgucaggu

SEQ ID NO: 1080153 - RNA, 18 nt, Mycobacterium bovis subsp bovis AF2122/97
cggauuccagcagccugc

SEQ ID NO: 1080154 - RNA, 14 nt, Mycobacterium bovis subsp bovis AF2122/97
cggauuccagcgcg

SEQ ID NO: 1080155 - RNA, 21 nt, Mycobacterium bovis subsp bovis AF2122/97
cggauuauucgcgguagccgc

SEQ ID NO: 1080156 - RNA, 15 nt, Mycobacterium bovis subsp bovis AF2122/97
cggauucacgcaccg

SEQ ID NO: 1080157 - RNA, 20 nt, Mycobacterium bovis subsp bovis AF2122/97
cggauucacgcaccggcgca

SEQ ID NO: 1080158 - RNA, 13 nt, Mycobacterium bovis subsp bovis AF2122/97
cggauuggugggc

SEQ ID NO: 1080159 - RNA, 22 nt, Mycobacterium bovis subsp bovis AF2122/97
cggauuucgucgggcaccgcca

SEQ ID NO: 1080160 - RNA, 15 nt, Mycobacterium bovis subsp bovis AF2122/97
cggcaaaacacaccg

SEQ ID NO: 1080161 - RNA, 17 nt, Mycobacterium bovis subsp bovis AF2122/97
cggcaaaacacaccgaa

SEQ ID NO: 1080162 - RNA, 18 nt, Mycobacterium bovis subsp bovis AF2122/97
cggcaaaauaaccguuga

SEQ ID NO: 1080163 - RNA, 17 nt, Mycobacterium bovis subsp bovis AF2122/97
cggcaaaggacgucgac

SEQ ID NO: 1080164 - RNA, 21 nt, Mycobacterium bovis subsp bovis AF2122/97
cggcaaaggauucgcgcgaau

SEQ ID NO: 1080165 - RNA, 22 nt, Mycobacterium bovis subsp bovis AF2122/97
cggcaaaggauuucaccguggg

SEQ ID NO: 1080166 - RNA, 19 nt, Mycobacterium bovis subsp bovis AF2122/97
cggcaaagaacagccggcc

SEQ ID NO: 1080167 - RNA, 18 nt, Mycobacterium bovis subsp bovis AF2122/97
cggcaaaccugaguccgg

SEQ ID NO: 1080168 - RNA, 20 nt, Mycobacterium bovis subsp bovis AF2122/97
cggcaaaccaagcgcgccag

SEQ ID NO: 1080169 - RNA, 18 nt, Mycobacterium bovis subsp bovis AF2122/97
cggcaaaccaguuggcga

SEQ ID NO: 1080170 - RNA, 22 nt, Mycobacterium bovis subsp bovis AF2122/97
cggauggccgccuuggcuucga

SEQ ID NO: 1080171 - RNA, 23 nt, Mycobacterium bovis subsp bovis AF2122/97
cggauggccucgaacgccgcccg

SEQ ID NO: 1080172 - RNA, 16 nt, Mycobacterium bovis subsp bovis AF2122/97
cggauggccccgccaa

SEQ ID NO: 1080173 - RNA, 22 nt, Mycobacterium bovis subsp bovis AF2122/97
cggaugcugucagcagcccauu

SEQ ID NO: 1080174 - RNA, 20 nt, Mycobacterium bovis subsp bovis AF2122/97
cggaugcugucagcagccca

SEQ ID NO: 1080175 - RNA, 20 nt, Mycobacterium bovis subsp bovis AF2122/97
cggaugcucaggucaccggc

SEQ ID NO: 1080176 - RNA, 22 nt, Mycobacterium bovis subsp bovis AF2122/97
cggaugcucaggucaccggccg

SEQ ID NO: 1080177 - RNA, 23 nt, Mycobacterium bovis subsp bovis AF2122/97
cggaugcucaggucaccggccgc

SEQ ID NO: 1080178 - RNA, 12 nt, Mycobacterium bovis subsp bovis AF2122/97
cggaugcgcggc

SEQ ID NO: 1080179 - RNA, 13 nt, Mycobacterium bovis subsp bovis AF2122/97
cggaugucgacga

SEQ ID NO: 1080180 - RNA, 16 nt, Mycobacterium bovis subsp bovis AF2122/97
cggaugucgacgagca

SEQ ID NO: 1080181 - RNA, 21 nt, Mycobacterium bovis subsp bovis AF2122/97
cggaugucgacgagcaccgcg

SEQ ID NO: 1080182 - RNA, 18 nt, Mycobacterium bovis subsp bovis AF2122/97
cggaugucgcccaaccga

SEQ ID NO: 1080183 - RNA, 15 nt, Mycobacterium bovis subsp bovis AF2122/97
cggauggugugucgg

SEQ ID NO: 1080184 - RNA, 17 nt, Mycobacterium bovis subsp bovis AF2122/97
cggauggugugucgggu

SEQ ID NO: 1080185 - RNA, 14 nt, Mycobacterium bovis subsp bovis AF2122/97
cggauguccgccga

SEQ ID NO: 1080186 - RNA, 15 nt, Mycobacterium bovis subsp bovis AF2122/97
cggauguccgccgac

SEQ ID NO: 1080187 - RNA, 17 nt, Mycobacterium bovis subsp bovis AF2122/97
cggauguccgccgacgu

SEQ ID NO: 1080188 - RNA, 14 nt, Mycobacterium bovis subsp bovis AF2122/97
cggauggucggcca

SEQ ID NO: 1080189 - RNA, 16 nt, Mycobacterium bovis subsp bovis AF2122/97
cggauggucggccacg

SEQ ID NO: 1080190 - RNA, 19 nt, Mycobacterium bovis subsp bovis AF2122/97
cggauggucggccacgcgc

SEQ ID NO: 1080191 - RNA, 13 nt, Mycobacterium bovis subsp bovis AF2122/97
cggauggcgucga

SEQ ID NO: 1080192 - RNA, 20 nt, Mycobacterium bovis subsp bovis AF2122/97
cggaugucucggcaccacag

SEQ ID NO: 1080193 - RNA, 16 nt, Mycobacterium bovis subsp bovis AF2122/97
cggauuaagucggcgg

SEQ ID NO: 1080194 - RNA, 17 nt, Mycobacterium bovis subsp bovis AF2122/97
cggaugucucggcacca

SEQ ID NO: 1080195 - RNA, 18 nt, Mycobacterium bovis subsp bovis AF2122/97
cggauguuggucggcuga

SEQ ID NO: 1080196 - RNA, 18 nt, Mycobacterium bovis subsp bovis AF2122/97
cggauguggugucgaugc

SEQ ID NO: 1080197 - RNA, 20 nt, Mycobacterium bovis subsp bovis AF2122/97
cggauguguucuccugcccu

SEQ ID NO: 1080198 - RNA, 15 nt, Mycobacterium bovis subsp bovis AF2122/97
cggaugucgucgacc

SEQ ID NO: 1080199 - RNA, 21 nt, Mycobacterium bovis subsp bovis AF2122/97
cggaugucgucgaccaggcca

SEQ ID NO: 1080200 - RNA, 16 nt, Mycobacterium bovis subsp bovis AF2122/97
cggcgcccauagcacc

SEQ ID NO: 1080201 - RNA, 18 nt, Mycobacterium bovis subsp bovis AF2122/97
cggcgcccauagcaccuc

SEQ ID NO: 1080202 - RNA, 15 nt, Mycobacterium bovis subsp bovis AF2122/97
cggcgcccaucgcga

SEQ ID NO: 1080203 - RNA, 15 nt, Mycobacterium bovis subsp bovis AF2122/97
cggcgcccgccaccg

SEQ ID NO: 1080204 - RNA, 16 nt, Mycobacterium bovis subsp bovis AF2122/97
cggcgcccgccaccgg

SEQ ID NO: 1080205 - RNA, 16 nt, Mycobacterium bovis subsp bovis AF2122/97
cggcgcccgcucggcc

SEQ ID NO: 1080206 - RNA, 18 nt, Mycobacterium bovis subsp bovis AF2122/97
cggcgcccgcucggccgc

SEQ ID NO: 1080207 - RNA, 22 nt, Mycobacterium bovis subsp bovis AF2122/97
cggcgccgcccgcgccaccagc

SEQ ID NO: 1080208 - RNA, 21 nt, Mycobacterium bovis subsp bovis AF2122/97
cggcgcccucaugucgggcaa

SEQ ID NO: 1080209 - RNA, 20 nt, Mycobacterium bovis subsp bovis AF2122/97
cggcgcccuccuuggcguug

SEQ ID NO: 1080210 - RNA, 15 nt, Mycobacterium bovis subsp bovis AF2122/97
cggcgcccggggcgg

SEQ ID NO: 1080211 - RNA, 13 nt, Mycobacterium bovis subsp bovis AF2122/97
cggcgcccggggu

SEQ ID NO: 1080212 - RNA, 21 nt, Mycobacterium bovis subsp bovis AF2122/97
cggcgcccgagauccccaaau

SEQ ID NO: 1080213 - RNA, 23 nt, Mycobacterium bovis subsp bovis AF2122/97
cggcgccgcccgcgccgccgcca

SEQ ID NO: 1080214 - RNA, 12 nt, Mycobacterium bovis subsp bovis AF2122/97
cggcgccgccgg

SEQ ID NO: 1080215 - RNA, 13 nt, Mycobacterium bovis subsp bovis AF2122/97
cggcgccgccggc

SEQ ID NO: 1080216 - RNA, 14 nt, Mycobacterium bovis subsp bovis AF2122/97
cggcgccgccggcg

SEQ ID NO: 1080217 - RNA, 22 nt, Mycobacterium bovis subsp bovis AF2122/97
cggcgccgccggugccaccggc

SEQ ID NO: 1080218 - RNA, 23 nt, Mycobacterium bovis subsp bovis AF2122/97
cggcgccgccggugccaccggcu

SEQ ID NO: 1080219 - RNA, 14 nt, Mycobacterium bovis subsp bovis AF2122/97
cggcgccgccguug

SEQ ID NO: 1080220 - RNA, 22 nt, Mycobacterium bovis subsp bovis AF2122/97
cggcgccgccuggacgccgccg

SEQ ID NO: 1080221 - RNA, 15 nt, Mycobacterium bovis subsp bovis AF2122/97
cggcgccgccgucgu

SEQ ID NO: 1080222 - RNA, 13 nt, Mycobacterium bovis subsp bovis AF2122/97
cggcgccgccguu

SEQ ID NO: 1080223 - RNA, 22 nt, Mycobacterium bovis subsp bovis AF2122/97
cggcgccgccguuaccgccggc

SEQ ID NO: 1080224 - RNA, 15 nt, Mycobacterium bovis subsp bovis AF2122/97
cggcgccgcgggugc

SEQ ID NO: 1080225 - RNA, 14 nt, Mycobacterium bovis subsp bovis AF2122/97
cggcgccggaguug

SEQ ID NO: 1080226 - RNA, 16 nt, Mycobacterium bovis subsp bovis AF2122/97
cggcgccggagccgcc

SEQ ID NO: 1080227 - RNA, 18 nt, Mycobacterium bovis subsp bovis AF2122/97
cggcgccggagccgccca

SEQ ID NO: 1080228 - RNA, 22 nt, Mycobacterium bovis subsp bovis AF2122/97
cggcgccaucgggucacccccg

SEQ ID NO: 1080229 - RNA, 17 nt, Mycobacterium bovis subsp bovis AF2122/97
cggcgccauagccgcga

SEQ ID NO: 1080230 - RNA, 22 nt, Mycobacterium bovis subsp bovis AF2122/97
cggcgccauagccgcgacccgc

SEQ ID NO: 1080231 - RNA, 21 nt, Mycobacterium bovis subsp bovis AF2122/97
cggcgccauggaucccacgag

SEQ ID NO: 1080232 - RNA, 16 nt, Mycobacterium bovis subsp bovis AF2122/97
cggcgccauucgcccc

SEQ ID NO: 1080233 - RNA, 22 nt, Mycobacterium bovis subsp bovis AF2122/97
cggcgccauuggcgucccgcaa

SEQ ID NO: 1080234 - RNA, 16 nt, Mycobacterium bovis subsp bovis AF2122/97
cggcgcccacaucguc

SEQ ID NO: 1080235 - RNA, 18 nt, Mycobacterium bovis subsp bovis AF2122/97
cggcgcccacaucgucgg

SEQ ID NO: 1080236 - RNA, 14 nt, Mycobacterium bovis subsp bovis AF2122/97
cggcgcccagcgcc

SEQ ID NO: 1080237 - RNA, 15 nt, Mycobacterium bovis subsp bovis AF2122/97
cggcgcccagcgccu

SEQ ID NO: 1080238 - RNA, 18 nt, Mycobacterium bovis subsp bovis AF2122/97
cggcgcccagcgccucga

SEQ ID NO: 1080239 - RNA, 17 nt, Mycobacterium bovis subsp bovis AF2122/97
cggcgcccagcucgucg

SEQ ID NO: 1080240 - RNA, 15 nt, Mycobacterium bovis subsp bovis AF2122/97
cggcgcccaggccga

SEQ ID NO: 1080241 - RNA, 18 nt, Mycobacterium bovis subsp bovis AF2122/97
cggcgcaccugggcugcc

SEQ ID NO: 1080242 - RNA, 19 nt, Mycobacterium bovis subsp bovis AF2122/97
cggcgcaccugggcugccg

SEQ ID NO: 1080243 - RNA, 15 nt, Mycobacterium bovis subsp bovis AF2122/97
cggcgcagccgguga

SEQ ID NO: 1080244 - RNA, 19 nt, Mycobacterium bovis subsp bovis AF2122/97
cggcgcaccgucgcggguc

SEQ ID NO: 1080245 - RNA, 15 nt, Mycobacterium bovis subsp bovis AF2122/97
cggcgcagcgaccgg

SEQ ID NO: 1080246 - RNA, 13 nt, Mycobacterium bovis subsp bovis AF2122/97
cggcgcagcgacg

SEQ ID NO: 1080247 - RNA, 12 nt, Mycobacterium bovis subsp bovis AF2122/97
cggcgcagcugu

SEQ ID NO: 1080248 - RNA, 20 nt, Mycobacterium bovis subsp bovis AF2122/97
cggcgcagcuaacccgccac

SEQ ID NO: 1080249 - RNA, 13 nt, Mycobacterium bovis subsp bovis AF2122/97
cggcgcagggacu

SEQ ID NO: 1080250 - RNA, 21 nt, Mycobacterium bovis subsp bovis AF2122/97
cggcgcagggacugugggggc

SEQ ID NO: 1080251 - RNA, 23 nt, Mycobacterium bovis subsp bovis AF2122/97
cggcgccaguauggccgccaccg

SEQ ID NO: 1080252 - RNA, 14 nt, Mycobacterium bovis subsp bovis AF2122/97
cggcgcaggcgugc

SEQ ID NO: 1080253 - RNA, 21 nt, Mycobacterium bovis subsp bovis AF2122/97
cggccuuggcgacgucggcgg

SEQ ID NO: 1080254 - RNA, 17 nt, Mycobacterium bovis subsp bovis AF2122/97
cggccuugugcucgaug

SEQ ID NO: 1080255 - RNA, 15 nt, Mycobacterium bovis subsp bovis AF2122/97
cggccuuuuccgggu

SEQ ID NO: 1080256 - RNA, 22 nt, Mycobacterium bovis subsp bovis AF2122/97
cggccuuggcgacgucgcgggu

SEQ ID NO: 1080257 - RNA, 22 nt, Mycobacterium bovis subsp bovis AF2122/97
cggcgaucgaggugacggugac

SEQ ID NO: 1080258 - RNA, 15 nt, Mycobacterium bovis subsp bovis AF2122/97
cggcgaucgcauggu

SEQ ID NO: 1080259 - RNA, 21 nt, Mycobacterium bovis subsp bovis AF2122/97
cggcgaaaaccaucgcuugcg

SEQ ID NO: 1080260 - RNA, 16 nt, Mycobacterium bovis subsp bovis AF2122/97
cggcgaaacucgucga

SEQ ID NO: 1080261 - RNA, 16 nt, Mycobacterium bovis subsp bovis AF2122/97
cggcgaaacccgggau

SEQ ID NO: 1080262 - RNA, 21 nt, Mycobacterium bovis subsp bovis AF2122/97
cggcgaaaagacugcgccgcc

SEQ ID NO: 1080263 - RNA, 20 nt, Mycobacterium bovis subsp bovis AF2122/97
cggccuuuccagcaccccga

SEQ ID NO: 1080264 - RNA, 21 nt, Mycobacterium bovis subsp bovis AF2122/97
cggccuuuccagcaccccgau

SEQ ID NO: 1080265 - RNA, 20 nt, Mycobacterium bovis subsp bovis AF2122/97
cggccuugugcucgaugcga

SEQ ID NO: 1080266 - RNA, 17 nt, Mycobacterium bovis subsp bovis AF2122/97
cggcgaucucgucgcgg

SEQ ID NO: 1080267 - RNA, 14 nt, Mycobacterium bovis subsp bovis AF2122/97
cggcgaucucgucg

SEQ ID NO: 1080268 - RNA, 16 nt, Mycobacterium bovis subsp bovis AF2122/97
cggcgaucucgaccgu

SEQ ID NO: 1080269 - RNA, 18 nt, Mycobacterium bovis subsp bovis AF2122/97
cggcgaugaacgggaucg

SEQ ID NO: 1080270 - RNA, 22 nt, Mycobacterium bovis subsp bovis AF2122/97
cggcgaucuccggcggaucugg

SEQ ID NO: 1080271 - RNA, 19 nt, Mycobacterium bovis subsp bovis AF2122/97
cggcgaucuccggcggauc

SEQ ID NO: 1080272 - RNA, 14 nt, Mycobacterium bovis subsp bovis AF2122/97
cggcgaucgggcgg

SEQ ID NO: 1080273 - RNA, 15 nt, Mycobacterium bovis subsp bovis AF2122/97
cggcgaucgggcggg

SEQ ID NO: 1080274 - RNA, 15 nt, Mycobacterium bovis subsp bovis AF2122/97
cggcgaucgcuccgc

SEQ ID NO: 1080275 - RNA, 18 nt, Mycobacterium bovis subsp bovis AF2122/97
cggcgaucgcuccgcggc

SEQ ID NO: 1080276 - RNA, 21 nt, Mycobacterium bovis subsp bovis AF2122/97
cggcgaucgcuccgcggcgca

SEQ ID NO: 1080277 - RNA, 20 nt, Mycobacterium bovis subsp bovis AF2122/97
cggcgaugauggcgcgaucg

SEQ ID NO: 1080278 - RNA, 20 nt, Mycobacterium bovis subsp bovis AF2122/97
cggcgaugauguugagcugg

SEQ ID NO: 1080279 - RNA, 14 nt, Mycobacterium bovis subsp bovis AF2122/97
cggcgaugcagccg

SEQ ID NO: 1080280 - RNA, 15 nt, Mycobacterium bovis subsp bovis AF2122/97
cggcgaugcagccgg

SEQ ID NO: 1080281 - RNA, 16 nt, Mycobacterium bovis subsp bovis AF2122/97
cggcgaugcagccggg

SEQ ID NO: 1080282 - RNA, 18 nt, Mycobacterium bovis subsp bovis AF2122/97
cggcgaugaccgggcgau

SEQ ID NO: 1080283 - RNA, 21 nt, Mycobacterium bovis subsp bovis AF2122/97
cggcgaugaccgggcgauucg

SEQ ID NO: 1080284 - RNA, 22 nt, Mycobacterium bovis subsp bovis AF2122/97
cggcgaugaucaccagucgcug

SEQ ID NO: 1080285 - RNA, 18 nt, Mycobacterium bovis subsp bovis AF2122/97
cggcgaugaugacggcgg

SEQ ID NO: 1080286 - RNA, 22 nt, Mycobacterium bovis subsp bovis AF2122/97
cggcgaugaugacggcggcccg

SEQ ID NO: 1080287 - RNA, 17 nt, Mycobacterium bovis subsp bovis AF2122/97
cggcgaugauggcgcga

SEQ ID NO: 1080288 - RNA, 15 nt, Mycobacterium bovis subsp bovis AF2122/97
cggcgaugcgcacca

SEQ ID NO: 1080289 - RNA, 14 nt, Mycobacterium bovis subsp bovis AF2122/97
cggcgaugggccgg

SEQ ID NO: 1080290 - RNA, 14 nt, Mycobacterium bovis subsp bovis AF2122/97
cggcgauggcgcgc

SEQ ID NO: 1080291 - RNA, 14 nt, Mycobacterium bovis subsp bovis AF2122/97
cggcgaugcagcca

SEQ ID NO: 1080292 - RNA, 13 nt, Mycobacterium bovis subsp bovis AF2122/97
cggcgcaccaucg

SEQ ID NO: 1080293 - RNA, 21 nt, Mycobacterium bovis subsp bovis AF2122/97
cggcgcaccaucgcggccgcu

SEQ ID NO: 1080294 - RNA, 22 nt, Mycobacterium bovis subsp bovis AF2122/97
cggcgcaccggagucgcccggu

SEQ ID NO: 1080295 - RNA, 14 nt, Mycobacterium bovis subsp bovis AF2122/97
cggcgaugucgcgc

SEQ ID NO: 1080296 - RNA, 21 nt, Mycobacterium bovis subsp bovis AF2122/97
cggcgcacaaacauacgccac

SEQ ID NO: 1080297 - RNA, 18 nt, Mycobacterium bovis subsp bovis AF2122/97
cggcgaugguagucgcga

SEQ ID NO: 1080298 - RNA, 15 nt, Mycobacterium bovis subsp bovis AF2122/97
cggcgaugggccggu

SEQ ID NO: 1080299 - RNA, 12 nt, Mycobacterium bovis subsp bovis AF2122/97
cggcgaugucga

SEQ ID NO: 1080300 - RNA, 15 nt, Mycobacterium bovis subsp bovis AF2122/97
cggcggcaaccgccg

SEQ ID NO: 1080301 - RNA, 16 nt, Mycobacterium bovis subsp bovis AF2122/97
cggcggcaaccgccgc

SEQ ID NO: 1080302 - RNA, 19 nt, Mycobacterium bovis subsp bovis AF2122/97
cggcggcaaccgccgccac

SEQ ID NO: 1080303 - RNA, 20 nt, Mycobacterium bovis subsp bovis AF2122/97
cggcggcaacggcggcaucg

SEQ ID NO: 1080304 - RNA, 22 nt, Mycobacterium bovis subsp bovis AF2122/97
cggcggcaacggcggcgacggc

SEQ ID NO: 1080305 - RNA, 20 nt, Mycobacterium bovis subsp bovis AF2122/97
cggcggacaccucgggcgcc

SEQ ID NO: 1080306 - RNA, 18 nt, Mycobacterium bovis subsp bovis AF2122/97
cggcggaccguccgacgg

SEQ ID NO: 1080307 - RNA, 21 nt, Mycobacterium bovis subsp bovis AF2122/97
cggcggaccguccgacggcgg

SEQ ID NO: 1080308 - RNA, 18 nt, Mycobacterium bovis subsp bovis AF2122/97
cggcggcaagugcggaac

SEQ ID NO: 1080309 - RNA, 20 nt, Mycobacterium bovis subsp bovis AF2122/97
cggcggacaggcccgguggc

SEQ ID NO: 1080310 - RNA, 17 nt, Mycobacterium bovis subsp bovis AF2122/97
cggcggcaacgguggca

SEQ ID NO: 1080311 - RNA, 14 nt, Mycobacterium bovis subsp bovis AF2122/97
cggcggcaagggug

SEQ ID NO: 1080312 - RNA, 18 nt, Mycobacterium bovis subsp bovis AF2122/97
cggcggcaagggugguga

SEQ ID NO: 1080313 - RNA, 19 nt, Mycobacterium bovis subsp bovis AF2122/97
cggcggcaaggguggugac

SEQ ID NO: 1080314 - RNA, 16 nt, Mycobacterium bovis subsp bovis AF2122/97
cggcggaagcggcggc

SEQ ID NO: 1080315 - RNA, 19 nt, Mycobacterium bovis subsp bovis AF2122/97
cggcggaaggacggcagcc

SEQ ID NO: 1080316 - RNA, 16 nt, Mycobacterium bovis subsp bovis AF2122/97
cggcggaagaccggau

SEQ ID NO: 1080317 - RNA, 15 nt, Mycobacterium bovis subsp bovis AF2122/97
cggcggaaggcgucg

SEQ ID NO: 1080318 - RNA, 13 nt, Mycobacterium bovis subsp bovis AF2122/97
cggcggacccggu

SEQ ID NO: 1080319 - RNA, 21 nt, Mycobacterium bovis subsp bovis AF2122/97
cggcggacccgcucgcggcga

SEQ ID NO: 1080320 - RNA, 16 nt, Mycobacterium bovis subsp bovis AF2122/97
cggcggcacuggugcc

SEQ ID NO: 1080321 - RNA, 18 nt, Mycobacterium bovis subsp bovis AF2122/97
cggcggcacuggugcccg

SEQ ID NO: 1080322 - RNA, 14 nt, Mycobacterium bovis subsp bovis AF2122/97
cggcggcagcggcg

SEQ ID NO: 1080323 - RNA, 15 nt, Mycobacterium bovis subsp bovis AF2122/97
cggcggcagcggcga

SEQ ID NO: 1080324 - RNA, 13 nt, Mycobacterium bovis subsp bovis AF2122/97
cggcggcagcggc

SEQ ID NO: 1080325 - RNA, 15 nt, Mycobacterium bovis subsp bovis AF2122/97
cggcggcaggccggc

SEQ ID NO: 1080326 - RNA, 20 nt, Mycobacterium bovis subsp bovis AF2122/97
cggcggcaggccggccaccg

SEQ ID NO: 1080327 - RNA, 22 nt, Mycobacterium bovis subsp bovis AF2122/97
cggcggcaggccggccaccgag

SEQ ID NO: 1080328 - RNA, 20 nt, Mycobacterium bovis subsp bovis AF2122/97
cggcggcagcggcgccgccu

SEQ ID NO: 1080329 - RNA, 15 nt, Mycobacterium bovis subsp bovis AF2122/97
cggcggcagcggcgg

SEQ ID NO: 1080330 - RNA, 14 nt, Mycobacterium bovis subsp bovis AF2122/97
cggcggcacccggg

SEQ ID NO: 1080331 - RNA, 17 nt, Mycobacterium bovis subsp bovis AF2122/97
cggcggcacccgggugg

SEQ ID NO: 1080332 - RNA, 13 nt, Mycobacterium bovis subsp bovis AF2122/97
cggcggcacccgg

SEQ ID NO: 1080333 - RNA, 18 nt, Mycobacterium bovis subsp bovis AF2122/97
cggcggcacuacgcagcc

SEQ ID NO: 1080334 - RNA, 13 nt, Mycobacterium bovis subsp bovis AF2122/97
cggcggcacgggc

SEQ ID NO: 1080335 - RNA, 16 nt, Mycobacterium bovis subsp bovis AF2122/97
cggcggcacgcucgcg

SEQ ID NO: 1080336 - RNA, 18 nt, Mycobacterium bovis subsp bovis AF2122/97
cggcggcacgcucgcgca

SEQ ID NO: 1080337 - RNA, 14 nt, Mycobacterium bovis subsp bovis AF2122/97
cggcggcacgcucg

SEQ ID NO: 1080338 - RNA, 22 nt, Mycobacterium bovis subsp bovis AF2122/97
cggcgcguacggaaccaccgga

SEQ ID NO: 1080339 - RNA, 12 nt, Mycobacterium bovis subsp bovis AF2122/97
cggcgcguccgc

SEQ ID NO: 1080340 - RNA, 14 nt, Mycobacterium bovis subsp bovis AF2122/97
cggcgcguccgggc

SEQ ID NO: 1080341 - RNA, 14 nt, Mycobacterium bovis subsp bovis AF2122/97
cggcgcgucgcgga

SEQ ID NO: 1080342 - RNA, 14 nt, Mycobacterium bovis subsp bovis AF2122/97
cggcgcgucguugc

SEQ ID NO: 1080343 - RNA, 13 nt, Mycobacterium bovis subsp bovis AF2122/97
cggcgcgugcggu

SEQ ID NO: 1080344 - RNA, 21 nt, Mycobacterium bovis subsp bovis AF2122/97
cggcgcgugcgguggcgcgca

SEQ ID NO: 1080345 - RNA, 19 nt, Mycobacterium bovis subsp bovis AF2122/97
cggcgcguggugccuacac

SEQ ID NO: 1080346 - RNA, 21 nt, Mycobacterium bovis subsp bovis AF2122/97
cggcgcguggcaccaccaagg

SEQ ID NO: 1080347 - RNA, 21 nt, Mycobacterium bovis subsp bovis AF2122/97
cggcgcguucgucgucgcuga

SEQ ID NO: 1080348 - RNA, 20 nt, Mycobacterium bovis subsp bovis AF2122/97
cggcgcugaucgcgcgcacc

SEQ ID NO: 1080349 - RNA, 15 nt, Mycobacterium bovis subsp bovis AF2122/97
cggcgcugcccgggc

SEQ ID NO: 1080350 - RNA, 19 nt, Mycobacterium bovis subsp bovis AF2122/97
cggcgcugcccgggcugcc

SEQ ID NO: 1080351 - RNA, 21 nt, Mycobacterium bovis subsp bovis AF2122/97
cggcgcugcccgggcugccgc

SEQ ID NO: 1080352 - RNA, 21 nt, Mycobacterium bovis subsp bovis AF2122/97
cggcgcugcagcugcucgucg

SEQ ID NO: 1080353 - RNA, 14 nt, Mycobacterium bovis subsp bovis AF2122/97
cggcgcugcgcacc

SEQ ID NO: 1080354 - RNA, 19 nt, Mycobacterium bovis subsp bovis AF2122/97
cggcgcugcgcaccgccgc

SEQ ID NO: 1080355 - RNA, 20 nt, Mycobacterium bovis subsp bovis AF2122/97
cggcgcugcgcaccgccgcg

SEQ ID NO: 1080356 - RNA, 13 nt, Mycobacterium bovis subsp bovis AF2122/97
cggcgcuguggcg

SEQ ID NO: 1080357 - RNA, 12 nt, Mycobacterium bovis subsp bovis AF2122/97
cggcgcgccgac

SEQ ID NO: 1080358 - RNA, 15 nt, Mycobacterium bovis subsp bovis AF2122/97
cggcgcgccgggcgg

SEQ ID NO: 1080359 - RNA, 18 nt, Mycobacterium bovis subsp bovis AF2122/97
cggcgcgccggucgccga

SEQ ID NO: 1080360 - RNA, 14 nt, Mycobacterium bovis subsp bovis AF2122/97
cggcgcggccagcu

SEQ ID NO: 1080361 - RNA, 14 nt, Mycobacterium bovis subsp bovis AF2122/97
cggcgcggccgcaa

SEQ ID NO: 1080362 - RNA, 14 nt, Mycobacterium bovis subsp bovis AF2122/97
cggcgcggccgcag

SEQ ID NO: 1080363 - RNA, 20 nt, Mycobacterium bovis subsp bovis AF2122/97
cggcgcggccgcagccagca

SEQ ID NO: 1080364 - RNA, 15 nt, Mycobacterium bovis subsp bovis AF2122/97
cggcgcggccggccg

SEQ ID NO: 1080365 - RNA, 16 nt, Mycobacterium bovis subsp bovis AF2122/97
cggcgcggccggccgc

SEQ ID NO: 1080366 - RNA, 17 nt, Mycobacterium bovis subsp bovis AF2122/97
cggcgcggccggccgcu

SEQ ID NO: 1080367 - RNA, 12 nt, Mycobacterium bovis subsp bovis AF2122/97
cggcgcggcgga

SEQ ID NO: 1080368 - RNA, 13 nt, Mycobacterium bovis subsp bovis AF2122/97
cggcgcgggucgg

SEQ ID NO: 1080369 - RNA, 17 nt, Mycobacterium bovis subsp bovis AF2122/97
cggcgcgggucggcgac

SEQ ID NO: 1080370 - RNA, 15 nt, Mycobacterium bovis subsp bovis AF2122/97
cggcgcgggugcgga

SEQ ID NO: 1080371 - RNA, 14 nt, Mycobacterium bovis subsp bovis AF2122/97
cggcgcggucucgg

SEQ ID NO: 1080372 - RNA, 19 nt, Mycobacterium bovis subsp bovis AF2122/97
cggcgcgguggggcgcgcc

SEQ ID NO: 1080373 - RNA, 22 nt, Mycobacterium bovis subsp bovis AF2122/97
cggcgcgguuucggcgucaccg

SEQ ID NO: 1080374 - RNA, 21 nt, Mycobacterium bovis subsp bovis AF2122/97
cggcgcgguuucggcgucacc

SEQ ID NO: 1080375 - RNA, 18 nt, Mycobacterium bovis subsp bovis AF2122/97
cggcgccguagugcgcau

SEQ ID NO: 1080376 - RNA, 23 nt, Mycobacterium bovis subsp bovis AF2122/97
cggcgccguagugcgcaucgccg

SEQ ID NO: 1080377 - RNA, 20 nt, Mycobacterium bovis subsp bovis AF2122/97
cggcgccgguuucgaggcga

SEQ ID NO: 1080378 - RNA, 21 nt, Mycobacterium bovis subsp bovis AF2122/97
cggcgccggcaucuccaccgu

SEQ ID NO: 1080379 - RNA, 21 nt, Mycobacterium bovis subsp bovis AF2122/97
cggcgccggugguaccggcgg

SEQ ID NO: 1080380 - RNA, 13 nt, Mycobacterium bovis subsp bovis AF2122/97
cggcgccguugcc

SEQ ID NO: 1080381 - RNA, 21 nt, Mycobacterium bovis subsp bovis AF2122/97
cggcgccgugaucagcucgcg

SEQ ID NO: 1080382 - RNA, 18 nt, Mycobacterium bovis subsp bovis AF2122/97
cggcgccgucggagccgg

SEQ ID NO: 1080383 - RNA, 14 nt, Mycobacterium bovis subsp bovis AF2122/97
cggcgccgucguug

SEQ ID NO: 1080384 - RNA, 22 nt, Mycobacterium bovis subsp bovis AF2122/97
cggcgccgucguugugccgguc

SEQ ID NO: 1080385 - RNA, 14 nt, Mycobacterium bovis subsp bovis AF2122/97
cggcgccgucucga

SEQ ID NO: 1080386 - RNA, 21 nt, Mycobacterium bovis subsp bovis AF2122/97
cggcgccgucgcccagcguga

SEQ ID NO: 1080387 - RNA, 12 nt, Mycobacterium bovis subsp bovis AF2122/97
cggcgccgucga

SEQ ID NO: 1080388 - RNA, 22 nt, Mycobacterium bovis subsp bovis AF2122/97
cggcgccgucgaaauacccggu

SEQ ID NO: 1080389 - RNA, 15 nt, Mycobacterium bovis subsp bovis AF2122/97
cggcgcgcaccucgg

SEQ ID NO: 1080390 - RNA, 11 nt, Mycobacterium bovis subsp bovis AF2122/97
cggcgcgcacc

SEQ ID NO: 1080391 - RNA, 14 nt, Mycobacterium bovis subsp bovis AF2122/97
cggcgcgccgacca

SEQ ID NO: 1080392 - RNA, 18 nt, Mycobacterium bovis subsp bovis AF2122/97
cggcgcgccgaccaccgc

SEQ ID NO: 1080393 - RNA, 16 nt, Mycobacterium bovis subsp bovis AF2122/97
cggcgcgagccgcacg

SEQ ID NO: 1080394 - RNA, 16 nt, Mycobacterium bovis subsp bovis AF2122/97
cggcgccgugucaccg

SEQ ID NO: 1080395 - RNA, 15 nt, Mycobacterium bovis subsp bovis AF2122/97
cggcgcgacgcccga

SEQ ID NO: 1080396 - RNA, 16 nt, Mycobacterium bovis subsp bovis AF2122/97
cggcgcgaccgcggcg

SEQ ID NO: 1080397 - RNA, 17 nt, Mycobacterium bovis subsp bovis AF2122/97
cggcgcgaccgcggcga

SEQ ID NO: 1080398 - RNA, 18 nt, Mycobacterium bovis subsp bovis AF2122/97
cggcgcgauagauacccg

SEQ ID NO: 1080399 - RNA, 18 nt, Mycobacterium bovis subsp bovis AF2122/97
cggcgcgagccgcacgau

SEQ ID NO: 1080400 - RNA, 24 nt, Mycobacterium bovis subsp bovis AF2122/97
cggcgcgagccgcacgaugccggg

SEQ ID NO: 1080401 - RNA, 15 nt, Mycobacterium bovis subsp bovis AF2122/97
cggcgcgagccggcu

SEQ ID NO: 1080402 - RNA, 12 nt, Mycobacterium bovis subsp bovis AF2122/97
cggcgcgagccu

SEQ ID NO: 1080403 - RNA, 15 nt, Mycobacterium bovis subsp bovis AF2122/97
cggcgccgucgauga

SEQ ID NO: 1080404 - RNA, 16 nt, Mycobacterium bovis subsp bovis AF2122/97
cggcgcgagccugcuc

SEQ ID NO: 1080405 - RNA, 18 nt, Mycobacterium bovis subsp bovis AF2122/97
cggcgcgaucgacgcucg

SEQ ID NO: 1080406 - RNA, 15 nt, Mycobacterium bovis subsp bovis AF2122/97
cggcggcuucgccga

SEQ ID NO: 1080407 - RNA, 16 nt, Mycobacterium bovis subsp bovis AF2122/97
cggcgggaugcgcgcc

SEQ ID NO: 1080408 - RNA, 14 nt, Mycobacterium bovis subsp bovis AF2122/97
cggcgggauccucg

SEQ ID NO: 1080409 - RNA, 15 nt, Mycobacterium bovis subsp bovis AF2122/97
cggcgggauccucga

SEQ ID NO: 1080410 - RNA, 13 nt, Mycobacterium bovis subsp bovis AF2122/97
cggcgggcccgcc

SEQ ID NO: 1080411 - RNA, 14 nt, Mycobacterium bovis subsp bovis AF2122/97
cggcgggcccgccg

SEQ ID NO: 1080412 - RNA, 15 nt, Mycobacterium bovis subsp bovis AF2122/97
cggcgggcccgccgg

SEQ ID NO: 1080413 - RNA, 19 nt, Mycobacterium bovis subsp bovis AF2122/97
cggcgggcccgccggcccc

SEQ ID NO: 1080414 - RNA, 20 nt, Mycobacterium bovis subsp bovis AF2122/97
cggcgggcagauggugaagu

SEQ ID NO: 1080415 - RNA, 20 nt, Mycobacterium bovis subsp bovis AF2122/97
cggcgggccgcgcggcgaca

SEQ ID NO: 1080416 - RNA, 15 nt, Mycobacterium bovis subsp bovis AF2122/97
cggcgggccugcccg

SEQ ID NO: 1080417 - RNA, 13 nt, Mycobacterium bovis subsp bovis AF2122/97
cggcgggcgacau

SEQ ID NO: 1080418 - RNA, 13 nt, Mycobacterium bovis subsp bovis AF2122/97
cggcgggcgagcc

SEQ ID NO: 1080419 - RNA, 15 nt, Mycobacterium bovis subsp bovis AF2122/97
cggcgggcaccuccg

SEQ ID NO: 1080420 - RNA, 21 nt, Mycobacterium bovis subsp bovis AF2122/97
cggcgggcgauuucggcgccg

SEQ ID NO: 1080421 - RNA, 14 nt, Mycobacterium bovis subsp bovis AF2122/97
cggcgggcgguggg

SEQ ID NO: 1080422 - RNA, 16 nt, Mycobacterium bovis subsp bovis AF2122/97
cggcgggcggcagcga

SEQ ID NO: 1080423 - RNA, 23 nt, Mycobacterium bovis subsp bovis AF2122/97
cggcgggcucgcuucaggcaccg

SEQ ID NO: 1080424 - RNA, 22 nt, Mycobacterium bovis subsp bovis AF2122/97
cggcgggcucuacucgcggccg

SEQ ID NO: 1080425 - RNA, 16 nt, Mycobacterium bovis subsp bovis AF2122/97
cggcggggaccgcggu

SEQ ID NO: 1080426 - RNA, 24 nt, Mycobacterium bovis subsp bovis AF2122/97
cggcggggacucugccacccagca

SEQ ID NO: 1080427 - RNA, 13 nt, Mycobacterium bovis subsp bovis AF2122/97
cggcggggccggc

SEQ ID NO: 1080428 - RNA, 15 nt, Mycobacterium bovis subsp bovis AF2122/97
cggcggggccggcgg

SEQ ID NO: 1080429 - RNA, 16 nt, Mycobacterium bovis subsp bovis AF2122/97
cggcggggccggcggc

SEQ ID NO: 1080430 - RNA, 14 nt, Mycobacterium bovis subsp bovis AF2122/97
cggcggcgucggga

SEQ ID NO: 1080431 - RNA, 16 nt, Mycobacterium bovis subsp bovis AF2122/97
cggcggcgucuucguc

SEQ ID NO: 1080432 - RNA, 12 nt, Mycobacterium bovis subsp bovis AF2122/97
cggcggcgucgg

SEQ ID NO: 1080433 - RNA, 15 nt, Mycobacterium bovis subsp bovis AF2122/97
cggcggcgucgcggu

SEQ ID NO: 1080434 - RNA, 15 nt, Mycobacterium bovis subsp bovis AF2122/97
cggcggcgucgaggg

SEQ ID NO: 1080435 - RNA, 14 nt, Mycobacterium bovis subsp bovis AF2122/97
cggcggcgucgcgg

SEQ ID NO: 1080436 - RNA, 17 nt, Mycobacterium bovis subsp bovis AF2122/97
cggcggcgguaucggca

SEQ ID NO: 1080437 - RNA, 20 nt, Mycobacterium bovis subsp bovis AF2122/97
cggcggcggugguaccggcg

SEQ ID NO: 1080438 - RNA, 13 nt, Mycobacterium bovis subsp bovis AF2122/97
cggcggcgucgac

SEQ ID NO: 1080439 - RNA, 17 nt, Mycobacterium bovis subsp bovis AF2122/97
cggcggcguccaccugc

SEQ ID NO: 1080440 - RNA, 14 nt, Mycobacterium bovis subsp bovis AF2122/97
cggcggcggcccgu

SEQ ID NO: 1080441 - RNA, 13 nt, Mycobacterium bovis subsp bovis AF2122/97
cggcggcggcacg

SEQ ID NO: 1080442 - RNA, 14 nt, Mycobacterium bovis subsp bovis AF2122/97
cggcggcggcgucg

SEQ ID NO: 1080443 - RNA, 14 nt, Mycobacterium bovis subsp bovis AF2122/97
cggcggcggcuuca

SEQ ID NO: 1080444 - RNA, 14 nt, Mycobacterium bovis subsp bovis AF2122/97
cggcggcucccggg

SEQ ID NO: 1080445 - RNA, 16 nt, Mycobacterium bovis subsp bovis AF2122/97
cggcggcucgggugcg

SEQ ID NO: 1080446 - RNA, 22 nt, Mycobacterium bovis subsp bovis AF2122/97
cggcggcucgggugcgcccggc

SEQ ID NO: 1080447 - RNA, 13 nt, Mycobacterium bovis subsp bovis AF2122/97
cggcggcuaccga

SEQ ID NO: 1080448 - RNA, 20 nt, Mycobacterium bovis subsp bovis AF2122/97
cggcggcuacuagcgguguc

SEQ ID NO: 1080449 - RNA, 15 nt, Mycobacterium bovis subsp bovis AF2122/97
cggcggcuaggcacc

SEQ ID NO: 1080450 - RNA, 19 nt, Mycobacterium bovis subsp bovis AF2122/97
cggcggcgugcuccugccc

SEQ ID NO: 1080451 - RNA, 14 nt, Mycobacterium bovis subsp bovis AF2122/97
cggcggcgucuucg

SEQ ID NO: 1080452 - RNA, 12 nt, Mycobacterium bovis subsp bovis AF2122/97
cggcggcugcca

SEQ ID NO: 1080453 - RNA, 12 nt, Mycobacterium bovis subsp bovis AF2122/97
cggcggcugccg

SEQ ID NO: 1080454 - RNA, 17 nt, Mycobacterium bovis subsp bovis AF2122/97
cggcggcugaaccgcug

SEQ ID NO: 1080455 - RNA, 17 nt, Mycobacterium bovis subsp bovis AF2122/97
cggcggcuuuggccgcc

SEQ ID NO: 1080456 - RNA, 24 nt, Mycobacterium bovis subsp bovis AF2122/97
cggcgggaaacacguucucaccac

SEQ ID NO: 1080457 - RNA, 15 nt, Mycobacterium bovis subsp bovis AF2122/97
cggcggcuuggccgc

SEQ ID NO: 1080458 - RNA, 18 nt, Mycobacterium bovis subsp bovis AF2122/97
cggcggcugaaccgcugg

SEQ ID NO: 1080459 - RNA, 19 nt, Mycobacterium bovis subsp bovis AF2122/97
cggcggcuguugcggcggc

SEQ ID NO: 1080460 - RNA, 18 nt, Mycobacterium bovis subsp bovis AF2122/97
cggcggcuucguggcggc

SEQ ID NO: 1080461 - RNA, 22 nt, Mycobacterium bovis subsp bovis AF2122/97
cggcggccagcauuagccaggc

SEQ ID NO: 1080462 - RNA, 13 nt, Mycobacterium bovis subsp bovis AF2122/97
cggcggccagccg

SEQ ID NO: 1080463 - RNA, 21 nt, Mycobacterium bovis subsp bovis AF2122/97
cggcggcagguagaucagcau

SEQ ID NO: 1080464 - RNA, 13 nt, Mycobacterium bovis subsp bovis AF2122/97
cggcggccagcga

SEQ ID NO: 1080465 - RNA, 18 nt, Mycobacterium bovis subsp bovis AF2122/97
cggcggccagcucggcca

SEQ ID NO: 1080466 - RNA, 14 nt, Mycobacterium bovis subsp bovis AF2122/97
cggcggccagcucg

SEQ ID NO: 1080467 - RNA, 14 nt, Mycobacterium bovis subsp bovis AF2122/97
cggcggccaggucg

SEQ ID NO: 1080468 - RNA, 19 nt, Mycobacterium bovis subsp bovis AF2122/97
cggcggccaguacgaucuc

SEQ ID NO: 1080469 - RNA, 13 nt, Mycobacterium bovis subsp bovis AF2122/97
cggcggccgagcg

SEQ ID NO: 1080470 - RNA, 21 nt, Mycobacterium bovis subsp bovis AF2122/97
cggcggccauggcgggucggu

SEQ ID NO: 1080471 - RNA, 24 nt, Mycobacterium bovis subsp bovis AF2122/97
cggcggccauggcgggucggucgg

SEQ ID NO: 1080472 - RNA, 12 nt, Mycobacterium bovis subsp bovis AF2122/97
cggcggccgcag

SEQ ID NO: 1080473 - RNA, 20 nt, Mycobacterium bovis subsp bovis AF2122/97
cggcggccaucccgcguucg

SEQ ID NO: 1080474 - RNA, 13 nt, Mycobacterium bovis subsp bovis AF2122/97
cggcggccgccgc

SEQ ID NO: 1080475 - RNA, 13 nt, Mycobacterium bovis subsp bovis AF2122/97
cggcggccgccag

SEQ ID NO: 1080476 - RNA, 15 nt, Mycobacterium bovis subsp bovis AF2122/97
cggcggccgcccaga

SEQ ID NO: 1080477 - RNA, 16 nt, Mycobacterium bovis subsp bovis AF2122/97
cggcggccggcgccgg

SEQ ID NO: 1080478 - RNA, 14 nt, Mycobacterium bovis subsp bovis AF2122/97
cggcggccgcggcu

SEQ ID NO: 1080479 - RNA, 20 nt, Mycobacterium bovis subsp bovis AF2122/97
cggcggccgcgugcucgccg

SEQ ID NO: 1080480 - RNA, 14 nt, Mycobacterium bovis subsp bovis AF2122/97
cggcggccggcacg

SEQ ID NO: 1080481 - RNA, 18 nt, Mycobacterium bovis subsp bovis AF2122/97
cggcggccggcacgggcg

SEQ ID NO: 1080482 - RNA, 20 nt, Mycobacterium bovis subsp bovis AF2122/97
cggcggccgugucgggcgcg

SEQ ID NO: 1080483 - RNA, 15 nt, Mycobacterium bovis subsp bovis AF2122/97
cggcggccgcgacca

SEQ ID NO: 1080484 - RNA, 16 nt, Mycobacterium bovis subsp bovis AF2122/97
cggcggccgguagauc

SEQ ID NO: 1080485 - RNA, 12 nt, Mycobacterium bovis subsp bovis AF2122/97
cggcggccguca

SEQ ID NO: 1080486 - RNA, 15 nt, Mycobacterium bovis subsp bovis AF2122/97
cggcggccgucaccg

SEQ ID NO: 1080487 - RNA, 13 nt, Mycobacterium bovis subsp bovis AF2122/97
cggcggcgccgcc

SEQ ID NO: 1080488 - RNA, 17 nt, Mycobacterium bovis subsp bovis AF2122/97
cggcggcgccgcccaac

SEQ ID NO: 1080489 - RNA, 13 nt, Mycobacterium bovis subsp bovis AF2122/97
cggcggcgccggu

SEQ ID NO: 1080490 - RNA, 20 nt, Mycobacterium bovis subsp bovis AF2122/97
cggcggcgccggccucgccg

SEQ ID NO: 1080491 - RNA, 15 nt, Mycobacterium bovis subsp bovis AF2122/97
cggcggcgccggcgc

SEQ ID NO: 1080492 - RNA, 13 nt, Mycobacterium bovis subsp bovis AF2122/97
cggcggcgccgga

SEQ ID NO: 1080493 - RNA, 14 nt, Mycobacterium bovis subsp bovis AF2122/97
cggcggcgcccggc

SEQ ID NO: 1080494 - RNA, 16 nt, Mycobacterium bovis subsp bovis AF2122/97
cggcggcgccgguggu

SEQ ID NO: 1080495 - RNA, 14 nt, Mycobacterium bovis subsp bovis AF2122/97
cggcggcgcgccga

SEQ ID NO: 1080496 - RNA, 18 nt, Mycobacterium bovis subsp bovis AF2122/97
cggcggcgcuggucgcgg

SEQ ID NO: 1080497 - RNA, 15 nt, Mycobacterium bovis subsp bovis AF2122/97
cggcggcgcucuucg

SEQ ID NO: 1080498 - RNA, 20 nt, Mycobacterium bovis subsp bovis AF2122/97
cggcggccuggcacccgggg

SEQ ID NO: 1080499 - RNA, 20 nt, Mycobacterium bovis subsp bovis AF2122/97
cggcggccugggccagccgc

SEQ ID NO: 1080500 - RNA, 21 nt, Mycobacterium bovis subsp bovis AF2122/97
cggcggcgaagaagccggcaa

SEQ ID NO: 1080501 - RNA, 14 nt, Mycobacterium bovis subsp bovis AF2122/97
cggcggcgacgugu

SEQ ID NO: 1080502 - RNA, 12 nt, Mycobacterium bovis subsp bovis AF2122/97
cggcggcgacgu

SEQ ID NO: 1080503 - RNA, 16 nt, Mycobacterium bovis subsp bovis AF2122/97
cggcggcgacgucugc

SEQ ID NO: 1080504 - RNA, 16 nt, Mycobacterium bovis subsp bovis AF2122/97
cggcggcgacggcggc

SEQ ID NO: 1080505 - RNA, 13 nt, Mycobacterium bovis subsp bovis AF2122/97
cggcggcgacggu

SEQ ID NO: 1080506 - RNA, 23 nt, Mycobacterium bovis subsp bovis AF2122/97
cggcggcgacggugccaccgcga

SEQ ID NO: 1080507 - RNA, 19 nt, Mycobacterium bovis subsp bovis AF2122/97
cggcggcgacgagcgcagc

SEQ ID NO: 1080508 - RNA, 22 nt, Mycobacterium bovis subsp bovis AF2122/97
cggcggccuucggccggcgugu

SEQ ID NO: 1080509 - RNA, 23 nt, Mycobacterium bovis subsp bovis AF2122/97
cggcggcgaccgccagcguggag

SEQ ID NO: 1080510 - RNA, 18 nt, Mycobacterium bovis subsp bovis AF2122/97
cggcggucggcugggcga

SEQ ID NO: 1080511 - RNA, 12 nt, Mycobacterium bovis subsp bovis AF2122/97
cggcggucggga

SEQ ID NO: 1080512 - RNA, 15 nt, Mycobacterium bovis subsp bovis AF2122/97
cggcggucgggcccg

SEQ ID NO: 1080513 - RNA, 22 nt, Mycobacterium bovis subsp bovis AF2122/97
cggcggucgggcccggcgagcu

SEQ ID NO: 1080514 - RNA, 22 nt, Mycobacterium bovis subsp bovis AF2122/97
cggcggucguugauuucggcgg

SEQ ID NO: 1080515 - RNA, 16 nt, Mycobacterium bovis subsp bovis AF2122/97
cggcggucgccagucg

SEQ ID NO: 1080516 - RNA, 21 nt, Mycobacterium bovis subsp bovis AF2122/97
cggcggucgccagucgauucg

SEQ ID NO: 1080517 - RNA, 13 nt, Mycobacterium bovis subsp bovis AF2122/97
cggcggucgccag

SEQ ID NO: 1080518 - RNA, 21 nt, Mycobacterium bovis subsp bovis AF2122/97
cggcggucccugaagccagcg

SEQ ID NO: 1080519 - RNA, 14 nt, Mycobacterium bovis subsp bovis AF2122/97
cggcggucgagcga

SEQ ID NO: 1080520 - RNA, 13 nt, Mycobacterium bovis subsp bovis AF2122/97
cggcggucgccgc

SEQ ID NO: 1080521 - RNA, 16 nt, Mycobacterium bovis subsp bovis AF2122/97
cggcggucgccgcgcg

SEQ ID NO: 1080522 - RNA, 22 nt, Mycobacterium bovis subsp bovis AF2122/97
cggcggucgccuccggggugaa

SEQ ID NO: 1080523 - RNA, 15 nt, Mycobacterium bovis subsp bovis AF2122/97
cggcggucucggcgu

SEQ ID NO: 1080524 - RNA, 18 nt, Mycobacterium bovis subsp bovis AF2122/97
cggcggucucggcgucga

SEQ ID NO: 1080525 - RNA, 20 nt, Mycobacterium bovis subsp bovis AF2122/97
cggcggucucggcgucgacc

SEQ ID NO: 1080526 - RNA, 21 nt, Mycobacterium bovis subsp bovis AF2122/97
cggcggucugagacucgucga

SEQ ID NO: 1080527 - RNA, 19 nt, Mycobacterium bovis subsp bovis AF2122/97
cggcggucuuggcgcgccc

SEQ ID NO: 1080528 - RNA, 20 nt, Mycobacterium bovis subsp bovis AF2122/97
cggcggugaagugggcguug

SEQ ID NO: 1080529 - RNA, 15 nt, Mycobacterium bovis subsp bovis AF2122/97
cggcggugacggcgg

SEQ ID NO: 1080530 - RNA, 16 nt, Mycobacterium bovis subsp bovis AF2122/97
cggcggugacggcggc

SEQ ID NO: 1080531 - RNA, 15 nt, Mycobacterium bovis subsp bovis AF2122/97
cggcggugacggugc

SEQ ID NO: 1080532 - RNA, 22 nt, Mycobacterium bovis subsp bovis AF2122/97
cggcggugcagcagggcgcgca

SEQ ID NO: 1080533 - RNA, 14 nt, Mycobacterium bovis subsp bovis AF2122/97
cggcgguggccagc

SEQ ID NO: 1080534 - RNA, 18 nt, Mycobacterium bovis subsp bovis AF2122/97
cggcggugcgccccgcgu

SEQ ID NO: 1080535 - RNA, 15 nt, Mycobacterium bovis subsp bovis AF2122/97
cggcggugcgggugg

SEQ ID NO: 1080536 - RNA, 22 nt, Mycobacterium bovis subsp bovis AF2122/97
cggcggugcggguggugccggc

SEQ ID NO: 1080537 - RNA, 23 nt, Mycobacterium bovis subsp bovis AF2122/97
cggcggugcggguggugccggcg

SEQ ID NO: 1080538 - RNA, 19 nt, Mycobacterium bovis subsp bovis AF2122/97
cggcggugccgugcucacg

SEQ ID NO: 1080539 - RNA, 16 nt, Mycobacterium bovis subsp bovis AF2122/97
cggcggugccgguggu

SEQ ID NO: 1080540 - RNA, 18 nt, Mycobacterium bovis subsp bovis AF2122/97
cggcggugccggugguga

SEQ ID NO: 1080541 - RNA, 17 nt, Mycobacterium bovis subsp bovis AF2122/97
cggcggugccgcggcua

SEQ ID NO: 1080542 - RNA, 15 nt, Mycobacterium bovis subsp bovis AF2122/97
cggcggugcccagca

SEQ ID NO: 1080543 - RNA, 18 nt, Mycobacterium bovis subsp bovis AF2122/97
cggcggugcccagcagcg

SEQ ID NO: 1080544 - RNA, 21 nt, Mycobacterium bovis subsp bovis AF2122/97
cggcggugcccagcagcgcga

SEQ ID NO: 1080545 - RNA, 19 nt, Mycobacterium bovis subsp bovis AF2122/97
cggcggugauguggaugcc

SEQ ID NO: 1080546 - RNA, 19 nt, Mycobacterium bovis subsp bovis AF2122/97
cggcgguaguacucgcgca

SEQ ID NO: 1080547 - RNA, 18 nt, Mycobacterium bovis subsp bovis AF2122/97
cggcgguaccgccgcggu

SEQ ID NO: 1080548 - RNA, 20 nt, Mycobacterium bovis subsp bovis AF2122/97
cggcgguagccgaccagcgc

SEQ ID NO: 1080549 - RNA, 15 nt, Mycobacterium bovis subsp bovis AF2122/97
cggcgguaccgccgc

SEQ ID NO: 1080550 - RNA, 23 nt, Mycobacterium bovis subsp bovis AF2122/97
cggcgguaccgccgcugccggug

SEQ ID NO: 1080551 - RNA, 21 nt, Mycobacterium bovis subsp bovis AF2122/97
cggcgguaccggaaucggcgg

SEQ ID NO: 1080552 - RNA, 23 nt, Mycobacterium bovis subsp bovis AF2122/97
cggcgguaccggaaucggcggcg

SEQ ID NO: 1080553 - RNA, 21 nt, Mycobacterium bovis subsp bovis AF2122/97
cggcgguaccggagcagcuca

SEQ ID NO: 1080554 - RNA, 16 nt, Mycobacterium bovis subsp bovis AF2122/97
cggcgguagccgacca

SEQ ID NO: 1080555 - RNA, 14 nt, Mycobacterium bovis subsp bovis AF2122/97
cggcgguaccgccg

SEQ ID NO: 1080556 - RNA, 21 nt, Mycobacterium bovis subsp bovis AF2122/97
cggcggguggcccccgccggc

SEQ ID NO: 1080557 - RNA, 18 nt, Mycobacterium bovis subsp bovis AF2122/97
cggcgguaagggcgggcu

SEQ ID NO: 1080558 - RNA, 20 nt, Mycobacterium bovis subsp bovis AF2122/97
cggcggguuuucucgccguu

SEQ ID NO: 1080559 - RNA, 20 nt, Mycobacterium bovis subsp bovis AF2122/97
cggcgguaaagcucaccaca

SEQ ID NO: 1080560 - RNA, 20 nt, Mycobacterium bovis subsp bovis AF2122/97
cggcgguaaaugccugccca

SEQ ID NO: 1080561 - RNA, 15 nt, Mycobacterium bovis subsp bovis AF2122/97
cggcggucaccaccg

SEQ ID NO: 1080562 - RNA, 19 nt, Mycobacterium bovis subsp bovis AF2122/97
cggcggucaccaccgaccc

SEQ ID NO: 1080563 - RNA, 16 nt, Mycobacterium bovis subsp bovis AF2122/97
cggcgguagucggcca

SEQ ID NO: 1080564 - RNA, 17 nt, Mycobacterium bovis subsp bovis AF2122/97
cggcgguagucggccag

SEQ ID NO: 1080565 - RNA, 18 nt, Mycobacterium bovis subsp bovis AF2122/97
cggcgguagucggccagc

SEQ ID NO: 1080566 - RNA, 21 nt, Mycobacterium bovis subsp bovis AF2122/97
cggcgguagucggccagcucg

SEQ ID NO: 1080567 - RNA, 18 nt, Mycobacterium bovis subsp bovis AF2122/97
cggcggucagcagcgccg

SEQ ID NO: 1080568 - RNA, 21 nt, Mycobacterium bovis subsp bovis AF2122/97
cggcggucagcagcgccguca

SEQ ID NO: 1080569 - RNA, 18 nt, Mycobacterium bovis subsp bovis AF2122/97
cggcggucagcggcuggg

SEQ ID NO: 1080570 - RNA, 18 nt, Mycobacterium bovis subsp bovis AF2122/97
cggcgguaugccacaggc

SEQ ID NO: 1080571 - RNA, 14 nt, Mycobacterium bovis subsp bovis AF2122/97
cggcggguagaucc

SEQ ID NO: 1080572 - RNA, 13 nt, Mycobacterium bovis subsp bovis AF2122/97
cggcggggugagg

SEQ ID NO: 1080573 - RNA, 21 nt, Mycobacterium bovis subsp bovis AF2122/97
cggcggggucgaacagcucga

SEQ ID NO: 1080574 - RNA, 20 nt, Mycobacterium bovis subsp bovis AF2122/97
cggcgggggaccccgccagc

SEQ ID NO: 1080575 - RNA, 21 nt, Mycobacterium bovis subsp bovis AF2122/97
cggcgggggaccccgccagcc

SEQ ID NO: 1080576 - RNA, 22 nt, Mycobacterium bovis subsp bovis AF2122/97
cggcgggggaccccgccagccg

SEQ ID NO: 1080577 - RNA, 23 nt, Mycobacterium bovis subsp bovis AF2122/97
cggcgggggaccccgccagccgg

SEQ ID NO: 1080578 - RNA, 21 nt, Mycobacterium bovis subsp bovis AF2122/97
cggcgggggcgucgccgccgg

SEQ ID NO: 1080579 - RNA, 19 nt, Mycobacterium bovis subsp bovis AF2122/97
cggcggggcggacucacga

SEQ ID NO: 1080580 - RNA, 20 nt, Mycobacterium bovis subsp bovis AF2122/97
cggcggggcggacucacgag

SEQ ID NO: 1080581 - RNA, 14 nt, Mycobacterium bovis subsp bovis AF2122/97
cggcggggcgccgg

SEQ ID NO: 1080582 - RNA, 18 nt, Mycobacterium bovis subsp bovis AF2122/97
cggcgggugccgagcugg

SEQ ID NO: 1080583 - RNA, 15 nt, Mycobacterium bovis subsp bovis AF2122/97
cggcgggucaggcca

SEQ ID NO: 1080584 - RNA, 16 nt, Mycobacterium bovis subsp bovis AF2122/97
cggcgggucccgccac

SEQ ID NO: 1080585 - RNA, 18 nt, Mycobacterium bovis subsp bovis AF2122/97
cggcgggucccgccacca

SEQ ID NO: 1080586 - RNA, 16 nt, Mycobacterium bovis subsp bovis AF2122/97
cggcggguccucgcgg

SEQ ID NO: 1080587 - RNA, 15 nt, Mycobacterium bovis subsp bovis AF2122/97
cggcguaggcgaugg

SEQ ID NO: 1080588 - RNA, 15 nt, Mycobacterium bovis subsp bovis AF2122/97
cggcguccagggcgc

SEQ ID NO: 1080589 - RNA, 20 nt, Mycobacterium bovis subsp bovis AF2122/97
cggcguauugcaccgccagg

SEQ ID NO: 1080590 - RNA, 22 nt, Mycobacterium bovis subsp bovis AF2122/97
cggcgucaaaggccuugacgua

SEQ ID NO: 1080591 - RNA, 19 nt, Mycobacterium bovis subsp bovis AF2122/97
cggcguauugcaccgccag

SEQ ID NO: 1080592 - RNA, 13 nt, Mycobacterium bovis subsp bovis AF2122/97
cggcguccaucac

SEQ ID NO: 1080593 - RNA, 14 nt, Mycobacterium bovis subsp bovis AF2122/97
cggcguccaucacc

SEQ ID NO: 1080594 - RNA, 16 nt, Mycobacterium bovis subsp bovis AF2122/97
cggcguccaucaccag

SEQ ID NO: 1080595 - RNA, 21 nt, Mycobacterium bovis subsp bovis AF2122/97
cggcguccaucaccagcagug

SEQ ID NO: 1080596 - RNA, 18 nt, Mycobacterium bovis subsp bovis AF2122/97
cggcguccaucgcgcgcc

SEQ ID NO: 1080597 - RNA, 23 nt, Mycobacterium bovis subsp bovis AF2122/97
cggcguccaucgcgcgccgaccg

SEQ ID NO: 1080598 - RNA, 19 nt, Mycobacterium bovis subsp bovis AF2122/97
cggcguauugcggccuguu

SEQ ID NO: 1080599 - RNA, 15 nt, Mycobacterium bovis subsp bovis AF2122/97
cggcgucccagggca

SEQ ID NO: 1080600 - RNA, 16 nt, Mycobacterium bovis subsp bovis AF2122/97
cggcguccagggcgcc

SEQ ID NO: 1080601 - RNA, 21 nt, Mycobacterium bovis subsp bovis AF2122/97
cggcguccagggcgccacuga

SEQ ID NO: 1080602 - RNA, 21 nt, Mycobacterium bovis subsp bovis AF2122/97
cggcgguugccccgaccgccg

SEQ ID NO: 1080603 - RNA, 18 nt, Mycobacterium bovis subsp bovis AF2122/97
cggcgguucgaucccguc

SEQ ID NO: 1080604 - RNA, 23 nt, Mycobacterium bovis subsp bovis AF2122/97
cggcgguuaucgucgggucaccc

SEQ ID NO: 1080605 - RNA, 22 nt, Mycobacterium bovis subsp bovis AF2122/97
cggcgguuccauacagccgccg

SEQ ID NO: 1080606 - RNA, 23 nt, Mycobacterium bovis subsp bovis AF2122/97
cggcgguuccauacagccgccga

SEQ ID NO: 1080607 - RNA, 16 nt, Mycobacterium bovis subsp bovis AF2122/97
cggcgguuaucgucgg

SEQ ID NO: 1080608 - RNA, 14 nt, Mycobacterium bovis subsp bovis AF2122/97
cggcggugguaccg

SEQ ID NO: 1080609 - RNA, 21 nt, Mycobacterium bovis subsp bovis AF2122/97
cggcgguggccagcgucgcga

SEQ ID NO: 1080610 - RNA, 19 nt, Mycobacterium bovis subsp bovis AF2122/97
cggcggugguaccggcgcc

SEQ ID NO: 1080611 - RNA, 14 nt, Mycobacterium bovis subsp bovis AF2122/97
cggcguccgcccag

SEQ ID NO: 1080612 - RNA, 22 nt, Mycobacterium bovis subsp bovis AF2122/97
cggcguccgcccagcacccuca

SEQ ID NO: 1080613 - RNA, 20 nt, Mycobacterium bovis subsp bovis AF2122/97
cggcgucgagggagcgccgc

SEQ ID NO: 1080614 - RNA, 17 nt, Mycobacterium bovis subsp bovis AF2122/97
cggcgucgacuggccgu

SEQ ID NO: 1080615 - RNA, 20 nt, Mycobacterium bovis subsp bovis AF2122/97
cggcgucgacuggccguuuc

SEQ ID NO: 1080616 - RNA, 21 nt, Mycobacterium bovis subsp bovis AF2122/97
cggcgucgagauagucggccg

SEQ ID NO: 1080617 - RNA, 23 nt, Mycobacterium bovis subsp bovis AF2122/97
cggcgucgagauagucggccggc

SEQ ID NO: 1080618 - RNA, 21 nt, Mycobacterium bovis subsp bovis AF2122/97
cggcgucgauaaccuggcggu

SEQ ID NO: 1080619 - RNA, 16 nt, Mycobacterium bovis subsp bovis AF2122/97
cggcgucgaugacgac

SEQ ID NO: 1080620 - RNA, 21 nt, Mycobacterium bovis subsp bovis AF2122/97
cggcgucgaguaguucgucga

SEQ ID NO: 1080621 - RNA, 20 nt, Mycobacterium bovis subsp bovis AF2122/97
cggcgucgaugacgacgccg

SEQ ID NO: 1080622 - RNA, 17 nt, Mycobacterium bovis subsp bovis AF2122/97
cggcgucgaugacgacg

SEQ ID NO: 1080623 - RNA, 18 nt, Mycobacterium bovis subsp bovis AF2122/97
cggcgucgaugacgacgc

SEQ ID NO: 1080624 - RNA, 23 nt, Mycobacterium bovis subsp bovis AF2122/97
cggcgucguugccgggucaaccg

SEQ ID NO: 1080625 - RNA, 14 nt, Mycobacterium bovis subsp bovis AF2122/97
cggcgucguggauc

SEQ ID NO: 1080626 - RNA, 16 nt, Mycobacterium bovis subsp bovis AF2122/97
cggcgucguggcuucc

SEQ ID NO: 1080627 - RNA, 15 nt, Mycobacterium bovis subsp bovis AF2122/97
cggcgucgugguggc

SEQ ID NO: 1080628 - RNA, 14 nt, Mycobacterium bovis subsp bovis AF2122/97
cggcgugacgucgu

SEQ ID NO: 1080629 - RNA, 23 nt, Mycobacterium bovis subsp bovis AF2122/97
cggcgugaugucuaccaacaccg

SEQ ID NO: 1080630 - RNA, 23 nt, Mycobacterium bovis subsp bovis AF2122/97
cggcgucgucgaugaugccggac

SEQ ID NO: 1080631 - RNA, 17 nt, Mycobacterium bovis subsp bovis AF2122/97
cggcgucguccgcgcca

SEQ ID NO: 1080632 - RNA, 16 nt, Mycobacterium bovis subsp bovis AF2122/97
cggcgucgucgacggc

SEQ ID NO: 1080633 - RNA, 17 nt, Mycobacterium bovis subsp bovis AF2122/97
cggcgucgucgacggcu

SEQ ID NO: 1080634 - RNA, 22 nt, Mycobacterium bovis subsp bovis AF2122/97
cggcgucguaggagccgucacg

SEQ ID NO: 1080635 - RNA, 21 nt, Mycobacterium bovis subsp bovis AF2122/97
cggcgucgaugucauccgaca

SEQ ID NO: 1080636 - RNA, 21 nt, Mycobacterium bovis subsp bovis AF2122/97
cggcgucgggaugcucgaucc

SEQ ID NO: 1080637 - RNA, 14 nt, Mycobacterium bovis subsp bovis AF2122/97
cgggcggcgucgaa

SEQ ID NO: 1080638 - RNA, 22 nt, Mycobacterium bovis subsp bovis AF2122/97
cgggcgucaugaugucgacauc

SEQ ID NO: 1080639 - RNA, 19 nt, Mycobacterium bovis subsp bovis AF2122/97
cgggcguccacgcugacca

SEQ ID NO: 1080640 - RNA, 15 nt, Mycobacterium bovis subsp bovis AF2122/97
cgggcgucccaaucg

SEQ ID NO: 1080641 - RNA, 12 nt, Mycobacterium bovis subsp bovis AF2122/97
cgggcgugccga

SEQ ID NO: 1080642 - RNA, 19 nt, Mycobacterium bovis subsp bovis AF2122/97
cgggcgucccaaucgggau

SEQ ID NO: 1080643 - RNA, 13 nt, Mycobacterium bovis subsp bovis AF2122/97
cgggcguccgccg

SEQ ID NO: 1080644 - RNA, 23 nt, Mycobacterium bovis subsp bovis AF2122/97
cgggcgucgggguggcgguccgg

SEQ ID NO: 1080645 - RNA, 16 nt, Mycobacterium bovis subsp bovis AF2122/97
cgggcgucgucgguga

SEQ ID NO: 1080646 - RNA, 21 nt, Mycobacterium bovis subsp bovis AF2122/97
cgggcggccucguugaccggg

SEQ ID NO: 1080647 - RNA, 20 nt, Mycobacterium bovis subsp bovis AF2122/97
cgggcggcgcgauagauacc

SEQ ID NO: 1080648 - RNA, 14 nt, Mycobacterium bovis subsp bovis AF2122/97
cgggcggccaggau

SEQ ID NO: 1080649 - RNA, 19 nt, Mycobacterium bovis subsp bovis AF2122/97
cgggcgcuguagucgcgcc

SEQ ID NO: 1080650 - RNA, 21 nt, Mycobacterium bovis subsp bovis AF2122/97
cgggcgcuguagucgcgccuc

SEQ ID NO: 1080651 - RNA, 19 nt, Mycobacterium bovis subsp bovis AF2122/97
cgggcuccaauugcggccg

SEQ ID NO: 1080652 - RNA, 20 nt, Mycobacterium bovis subsp bovis AF2122/97
cgggcuccaauugcggccgc

SEQ ID NO: 1080653 - RNA, 17 nt, Mycobacterium bovis subsp bovis AF2122/97
cgggcuauccgcgggaa

SEQ ID NO: 1080654 - RNA, 14 nt, Mycobacterium bovis subsp bovis AF2122/97
cgggcuccaacagg

SEQ ID NO: 1080655 - RNA, 19 nt, Mycobacterium bovis subsp bovis AF2122/97
cgggcuccgugguugccga

SEQ ID NO: 1080656 - RNA, 19 nt, Mycobacterium bovis subsp bovis AF2122/97
cgggcugacgaucuccacc

SEQ ID NO: 1080657 - RNA, 14 nt, Mycobacterium bovis subsp bovis AF2122/97
cgggcucagcggcg

SEQ ID NO: 1080658 - RNA, 18 nt, Mycobacterium bovis subsp bovis AF2122/97
cgggcucagcggcgaccg

SEQ ID NO: 1080659 - RNA, 20 nt, Mycobacterium bovis subsp bovis AF2122/97
cgggcucaacaccagccggu

SEQ ID NO: 1080660 - RNA, 22 nt, Mycobacterium bovis subsp bovis AF2122/97
cgggcucacaugugcgcgucgc

SEQ ID NO: 1080661 - RNA, 15 nt, Mycobacterium bovis subsp bovis AF2122/97
cgggcucaacaccag

SEQ ID NO: 1080662 - RNA, 17 nt, Mycobacterium bovis subsp bovis AF2122/97
cgggcucaacaccagcc

SEQ ID NO: 1080663 - RNA, 15 nt, Mycobacterium bovis subsp bovis AF2122/97
cgggcgugcucgccg

SEQ ID NO: 1080664 - RNA, 16 nt, Mycobacterium bovis subsp bovis AF2122/97
cgggcgugcucgccgg

SEQ ID NO: 1080665 - RNA, 17 nt, Mycobacterium bovis subsp bovis AF2122/97
cgggcgugcucgccggg

SEQ ID NO: 1080666 - RNA, 22 nt, Mycobacterium bovis subsp bovis AF2122/97
cgggcgugcucggaggcgauca

SEQ ID NO: 1080667 - RNA, 14 nt, Mycobacterium bovis subsp bovis AF2122/97
cgggcgugcugccg

SEQ ID NO: 1080668 - RNA, 14 nt, Mycobacterium bovis subsp bovis AF2122/97
cgggcgugcggcgg

SEQ ID NO: 1080669 - RNA, 17 nt, Mycobacterium bovis subsp bovis AF2122/97
cgggcgugccgaccagc

SEQ ID NO: 1080670 - RNA, 14 nt, Mycobacterium bovis subsp bovis AF2122/97
cgggcuuggccgcg

SEQ ID NO: 1080671 - RNA, 17 nt, Mycobacterium bovis subsp bovis AF2122/97
cgggcuuggccgcgccg

SEQ ID NO: 1080672 - RNA, 18 nt, Mycobacterium bovis subsp bovis AF2122/97
cgggcuuggccgcgccgg

SEQ ID NO: 1080673 - RNA, 15 nt, Mycobacterium bovis subsp bovis AF2122/97
cgggcuucggccaga

SEQ ID NO: 1080674 - RNA, 13 nt, Mycobacterium bovis subsp bovis AF2122/97
cgggcuucggcca

SEQ ID NO: 1080675 - RNA, 21 nt, Mycobacterium bovis subsp bovis AF2122/97
cgggcuugccgucuucgccgc

SEQ ID NO: 1080676 - RNA, 15 nt, Mycobacterium bovis subsp bovis AF2122/97
cgggcuguucggcca

SEQ ID NO: 1080677 - RNA, 22 nt, Mycobacterium bovis subsp bovis AF2122/97
cgggcuguucggccauggcggc

SEQ ID NO: 1080678 - RNA, 16 nt, Mycobacterium bovis subsp bovis AF2122/97
cgggcuuaggccgcgg

SEQ ID NO: 1080679 - RNA, 17 nt, Mycobacterium bovis subsp bovis AF2122/97
cgggcuuaugcacgacg

SEQ ID NO: 1080680 - RNA, 20 nt, Mycobacterium bovis subsp bovis AF2122/97
cgggcugugaacagcgcguc

SEQ ID NO: 1080681 - RNA, 22 nt, Mycobacterium bovis subsp bovis AF2122/97
cgggcugugaacagcgcgucgg

SEQ ID NO: 1080682 - RNA, 17 nt, Mycobacterium bovis subsp bovis AF2122/97
cgggcuguaggcgauca

SEQ ID NO: 1080683 - RNA, 21 nt, Mycobacterium bovis subsp bovis AF2122/97
cgggcuguaggcgaucacgau

SEQ ID NO: 1080684 - RNA, 20 nt, Mycobacterium bovis subsp bovis AF2122/97
cgggcugacgaucuccaccc

SEQ ID NO: 1080685 - RNA, 23 nt, Mycobacterium bovis subsp bovis AF2122/97
cgggcugcagugacucgaucacc

SEQ ID NO: 1080686 - RNA, 12 nt, Mycobacterium bovis subsp bovis AF2122/97
cgggcugcagcc

SEQ ID NO: 1080687 - RNA, 15 nt, Mycobacterium bovis subsp bovis AF2122/97
cgggcugcagccgac

SEQ ID NO: 1080688 - RNA, 22 nt, Mycobacterium bovis subsp bovis AF2122/97
cgggcugccgcccaugccggga

SEQ ID NO: 1080689 - RNA, 13 nt, Mycobacterium bovis subsp bovis AF2122/97
cgggcucgcaugu

SEQ ID NO: 1080690 - RNA, 17 nt, Mycobacterium bovis subsp bovis AF2122/97
cgggcuggcccggcuac

SEQ ID NO: 1080691 - RNA, 14 nt, Mycobacterium bovis subsp bovis AF2122/97
cgggcuggccgacu

SEQ ID NO: 1080692 - RNA, 19 nt, Mycobacterium bovis subsp bovis AF2122/97
cgggcugcuugcgcccggc

SEQ ID NO: 1080693 - RNA, 16 nt, Mycobacterium bovis subsp bovis AF2122/97
cgggcccaucgcccgg

SEQ ID NO: 1080694 - RNA, 21 nt, Mycobacterium bovis subsp bovis AF2122/97
cgggccauggguagccgccca

SEQ ID NO: 1080695 - RNA, 12 nt, Mycobacterium bovis subsp bovis AF2122/97
cgggcccaccgc

SEQ ID NO: 1080696 - RNA, 14 nt, Mycobacterium bovis subsp bovis AF2122/97
cgggccccacggcg

SEQ ID NO: 1080697 - RNA, 19 nt, Mycobacterium bovis subsp bovis AF2122/97
cgggcccccagguagugca

SEQ ID NO: 1080698 - RNA, 14 nt, Mycobacterium bovis subsp bovis AF2122/97
cgggcccgacgacg

SEQ ID NO: 1080699 - RNA, 19 nt, Mycobacterium bovis subsp bovis AF2122/97
cgggcccccuggaucgcgc

SEQ ID NO: 1080700 - RNA, 20 nt, Mycobacterium bovis subsp bovis AF2122/97
cgggccccggggugcccccg

SEQ ID NO: 1080701 - RNA, 21 nt, Mycobacterium bovis subsp bovis AF2122/97
cgggccccggggugcccccgg

SEQ ID NO: 1080702 - RNA, 24 nt, Mycobacterium bovis subsp bovis AF2122/97
cgggcccucgccauggcguucugc

SEQ ID NO: 1080703 - RNA, 18 nt, Mycobacterium bovis subsp bovis AF2122/97
cgggcccuuccuggccga

SEQ ID NO: 1080704 - RNA, 24 nt, Mycobacterium bovis subsp bovis AF2122/97
cgggcccgaugaggacauccggcg

SEQ ID NO: 1080705 - RNA, 17 nt, Mycobacterium bovis subsp bovis AF2122/97
cgggcccuccacugcga

SEQ ID NO: 1080706 - RNA, 16 nt, Mycobacterium bovis subsp bovis AF2122/97
cgggcccuccggcgca

SEQ ID NO: 1080707 - RNA, 20 nt, Mycobacterium bovis subsp bovis AF2122/97
cgggcccuccggcgcagcga

SEQ ID NO: 1080708 - RNA, 19 nt, Mycobacterium bovis subsp bovis AF2122/97
cgggccgaauaccacaccg

SEQ ID NO: 1080709 - RNA, 20 nt, Mycobacterium bovis subsp bovis AF2122/97
cgggccgaacacaccgggcg

SEQ ID NO: 1080710 - RNA, 19 nt, Mycobacterium bovis subsp bovis AF2122/97
cgggccgaggccgucgcga

SEQ ID NO: 1080711 - RNA, 13 nt, Mycobacterium bovis subsp bovis AF2122/97
cgggccgacgggc

SEQ ID NO: 1080712 - RNA, 21 nt, Mycobacterium bovis subsp bovis AF2122/97
cgggccgagaucacgccgggc

SEQ ID NO: 1080713 - RNA, 20 nt, Mycobacterium bovis subsp bovis AF2122/97
cgggccgagcgcaccacggc

SEQ ID NO: 1080714 - RNA, 20 nt, Mycobacterium bovis subsp bovis AF2122/97
cgggccgaucaccccggugg

SEQ ID NO: 1080715 - RNA, 23 nt, Mycobacterium bovis subsp bovis AF2122/97
cgggccuggcccacgccgcaucg

SEQ ID NO: 1080716 - RNA, 14 nt, Mycobacterium bovis subsp bovis AF2122/97
cgggccuggccugc

SEQ ID NO: 1080717 - RNA, 20 nt, Mycobacterium bovis subsp bovis AF2122/97
cgggccuggccugcccagca

SEQ ID NO: 1080718 - RNA, 16 nt, Mycobacterium bovis subsp bovis AF2122/97
cgggccugggacggcg

SEQ ID NO: 1080719 - RNA, 17 nt, Mycobacterium bovis subsp bovis AF2122/97
cgggccugggacggcgg

SEQ ID NO: 1080720 - RNA, 19 nt, Mycobacterium bovis subsp bovis AF2122/97
cgggccugggacggcggca

SEQ ID NO: 1080721 - RNA, 16 nt, Mycobacterium bovis subsp bovis AF2122/97
cgggccuucagcucac

SEQ ID NO: 1080722 - RNA, 15 nt, Mycobacterium bovis subsp bovis AF2122/97
cgggccuugcgcgcg

SEQ ID NO: 1080723 - RNA, 13 nt, Mycobacterium bovis subsp bovis AF2122/97
cgggccuucgcca

SEQ ID NO: 1080724 - RNA, 14 nt, Mycobacterium bovis subsp bovis AF2122/97
cgggcgaaccgcuc

SEQ ID NO: 1080725 - RNA, 18 nt, Mycobacterium bovis subsp bovis AF2122/97
cgggcgaaacgcccgggc

SEQ ID NO: 1080726 - RNA, 19 nt, Mycobacterium bovis subsp bovis AF2122/97
cgggcgagccgugccagca

SEQ ID NO: 1080727 - RNA, 21 nt, Mycobacterium bovis subsp bovis AF2122/97
cgggcgagccgugccagcagg

SEQ ID NO: 1080728 - RNA, 22 nt, Mycobacterium bovis subsp bovis AF2122/97
cgggcgagcgcaucgauggccg

SEQ ID NO: 1080729 - RNA, 23 nt, Mycobacterium bovis subsp bovis AF2122/97
cgggcgaacgcuucaccucgucg

SEQ ID NO: 1080730 - RNA, 15 nt, Mycobacterium bovis subsp bovis AF2122/97
cgggcgagcucgucg

SEQ ID NO: 1080731 - RNA, 14 nt, Mycobacterium bovis subsp bovis AF2122/97
cgggcgaucgccug

SEQ ID NO: 1080732 - RNA, 23 nt, Mycobacterium bovis subsp bovis AF2122/97
cgggcgaucgcggcgagcaccac

SEQ ID NO: 1080733 - RNA, 20 nt, Mycobacterium bovis subsp bovis AF2122/97
cgggcgagugucagcagaug

SEQ ID NO: 1080734 - RNA, 15 nt, Mycobacterium bovis subsp bovis AF2122/97
cgggcgagugucagc

SEQ ID NO: 1080735 - RNA, 15 nt, Mycobacterium bovis subsp bovis AF2122/97
cgggcgagucccggc

SEQ ID NO: 1080736 - RNA, 18 nt, Mycobacterium bovis subsp bovis AF2122/97
cgggcgagucccggcggu

SEQ ID NO: 1080737 - RNA, 20 nt, Mycobacterium bovis subsp bovis AF2122/97
cgggcgagucccggcgguug

SEQ ID NO: 1080738 - RNA, 12 nt, Mycobacterium bovis subsp bovis AF2122/97
cgggcgaugacc

SEQ ID NO: 1080739 - RNA, 20 nt, Mycobacterium bovis subsp bovis AF2122/97
cgggcgaucaaagccagcac

SEQ ID NO: 1080740 - RNA, 16 nt, Mycobacterium bovis subsp bovis AF2122/97
cgggcgaugacccgga

SEQ ID NO: 1080741 - RNA, 16 nt, Mycobacterium bovis subsp bovis AF2122/97
cgggcgaucuuggcga

SEQ ID NO: 1080742 - RNA, 15 nt, Mycobacterium bovis subsp bovis AF2122/97
cgggcgcgccggcca

SEQ ID NO: 1080743 - RNA, 14 nt, Mycobacterium bovis subsp bovis AF2122/97
cgggcgcgcugccc

SEQ ID NO: 1080744 - RNA, 15 nt, Mycobacterium bovis subsp bovis AF2122/97
cgggcgcgcugccca

SEQ ID NO: 1080745 - RNA, 15 nt, Mycobacterium bovis subsp bovis AF2122/97
cgggcgcgucggcgu

SEQ ID NO: 1080746 - RNA, 17 nt, Mycobacterium bovis subsp bovis AF2122/97
cgggcgcuggacggcgg

SEQ ID NO: 1080747 - RNA, 15 nt, Mycobacterium bovis subsp bovis AF2122/97
cgggcggccagcugc

SEQ ID NO: 1080748 - RNA, 13 nt, Mycobacterium bovis subsp bovis AF2122/97
cgggcggccagga

SEQ ID NO: 1080749 - RNA, 18 nt, Mycobacterium bovis subsp bovis AF2122/97
cgggcgcgggcgccggga

SEQ ID NO: 1080750 - RNA, 12 nt, Mycobacterium bovis subsp bovis AF2122/97
cgggcgcguccu

SEQ ID NO: 1080751 - RNA, 13 nt, Mycobacterium bovis subsp bovis AF2122/97
cgggcgcguccuc

SEQ ID NO: 1080752 - RNA, 18 nt, Mycobacterium bovis subsp bovis AF2122/97
cgggcgcguccucgccgc

SEQ ID NO: 1080753 - RNA, 21 nt, Mycobacterium bovis subsp bovis AF2122/97
cgggcgcguccucgccgcacg

SEQ ID NO: 1080754 - RNA, 22 nt, Mycobacterium bovis subsp bovis AF2122/97
cgggcgcguccucgccgcacgc

SEQ ID NO: 1080755 - RNA, 22 nt, Mycobacterium bovis subsp bovis AF2122/97
cgggcgcgggugaccaggcggc

SEQ ID NO: 1080756 - RNA, 14 nt, Mycobacterium bovis subsp bovis AF2122/97
cgggcgcgguaacc

SEQ ID NO: 1080757 - RNA, 22 nt, Mycobacterium bovis subsp bovis AF2122/97
cgggcgcgguaaccacgcggau

SEQ ID NO: 1080758 - RNA, 17 nt, Mycobacterium bovis subsp bovis AF2122/97
cgggguugaccgccacc

SEQ ID NO: 1080759 - RNA, 19 nt, Mycobacterium bovis subsp bovis AF2122/97
cgggguugaccguggucgg

SEQ ID NO: 1080760 - RNA, 20 nt, Mycobacterium bovis subsp bovis AF2122/97
cgggguugacuggccgcccg

SEQ ID NO: 1080761 - RNA, 22 nt, Mycobacterium bovis subsp bovis AF2122/97
cgggguugacuggccgcccggc

SEQ ID NO: 1080762 - RNA, 19 nt, Mycobacterium bovis subsp bovis AF2122/97
cggggugacaucgcgaggc

SEQ ID NO: 1080763 - RNA, 19 nt, Mycobacterium bovis subsp bovis AF2122/97
cgggguugaucaccgacac

SEQ ID NO: 1080764 - RNA, 18 nt, Mycobacterium bovis subsp bovis AF2122/97
cgggguuguccucggcga

SEQ ID NO: 1080765 - RNA, 14 nt, Mycobacterium bovis subsp bovis AF2122/97
cgggguugcucgcg

SEQ ID NO: 1080766 - RNA, 15 nt, Mycobacterium bovis subsp bovis AF2122/97
cgggguuucaggcgg

SEQ ID NO: 1080767 - RNA, 19 nt, Mycobacterium bovis subsp bovis AF2122/97
cgggguuucaggcggcagg

SEQ ID NO: 1080768 - RNA, 20 nt, Mycobacterium bovis subsp bovis AF2122/97
cgggguuucaggcggcaggu

SEQ ID NO: 1080769 - RNA, 18 nt, Mycobacterium bovis subsp bovis AF2122/97
cggguaacgcacccaccg

SEQ ID NO: 1080770 - RNA, 19 nt, Mycobacterium bovis subsp bovis AF2122/97
cggguaacgcacccaccga

SEQ ID NO: 1080771 - RNA, 23 nt, Mycobacterium bovis subsp bovis AF2122/97
cggggucggccugcggcaccggc

SEQ ID NO: 1080772 - RNA, 22 nt, Mycobacterium bovis subsp bovis AF2122/97
cgggguaggcccagcaaccgcu

SEQ ID NO: 1080773 - RNA, 13 nt, Mycobacterium bovis subsp bovis AF2122/97
cggggguugcggc

SEQ ID NO: 1080774 - RNA, 15 nt, Mycobacterium bovis subsp bovis AF2122/97
cgggguaaccggcgg

SEQ ID NO: 1080775 - RNA, 21 nt, Mycobacterium bovis subsp bovis AF2122/97
cgggguaaggcuugucagccg

SEQ ID NO: 1080776 - RNA, 18 nt, Mycobacterium bovis subsp bovis AF2122/97
cggggugaaaaucgccau

SEQ ID NO: 1080777 - RNA, 22 nt, Mycobacterium bovis subsp bovis AF2122/97
cggggugaacgcggacaccgcg

SEQ ID NO: 1080778 - RNA, 23 nt, Mycobacterium bovis subsp bovis AF2122/97
cggggugaaugcaacuccucgac

SEQ ID NO: 1080779 - RNA, 15 nt, Mycobacterium bovis subsp bovis AF2122/97
cggggugacaucgcg

SEQ ID NO: 1080780 - RNA, 16 nt, Mycobacterium bovis subsp bovis AF2122/97
cggggugacaucgcga

SEQ ID NO: 1080781 - RNA, 16 nt, Mycobacterium bovis subsp bovis AF2122/97
aaccacccaccggcca

SEQ ID NO: 1080782 - RNA, 15 nt, Mycobacterium bovis subsp bovis AF2122/97
cgggguucaccgucg

SEQ ID NO: 1080783 - RNA, 16 nt, Mycobacterium bovis subsp bovis AF2122/97
cgggguucaccgucga

SEQ ID NO: 1080784 - RNA, 16 nt, Mycobacterium bovis subsp bovis AF2122/97
cggggcggcggugggc

SEQ ID NO: 1080785 - RNA, 22 nt, Mycobacterium bovis subsp bovis AF2122/97
cggggcucucggaucuugacgu

SEQ ID NO: 1080786 - RNA, 19 nt, Mycobacterium bovis subsp bovis AF2122/97
cggggcggccugcccgccg

SEQ ID NO: 1080787 - RNA, 15 nt, Mycobacterium bovis subsp bovis AF2122/97
cggggcugaccgcca

SEQ ID NO: 1080788 - RNA, 20 nt, Mycobacterium bovis subsp bovis AF2122/97
cggggcugaccgccaccccg

SEQ ID NO: 1080789 - RNA, 12 nt, Mycobacterium bovis subsp bovis AF2122/97
cggggcugccgg

SEQ ID NO: 1080790 - RNA, 13 nt, Mycobacterium bovis subsp bovis AF2122/97
cggggcugccggu

SEQ ID NO: 1080791 - RNA, 17 nt, Mycobacterium bovis subsp bovis AF2122/97
cggggcugccggugagu

SEQ ID NO: 1080792 - RNA, 14 nt, Mycobacterium bovis subsp bovis AF2122/97
cggggcugccgaac

SEQ ID NO: 1080793 - RNA, 17 nt, Mycobacterium bovis subsp bovis AF2122/97
cggggcugccgccguug

SEQ ID NO: 1080794 - RNA, 20 nt, Mycobacterium bovis subsp bovis AF2122/97
cggggcucaagucucccggc

SEQ ID NO: 1080795 - RNA, 13 nt, Mycobacterium bovis subsp bovis AF2122/97
cggggcugaccgc

SEQ ID NO: 1080796 - RNA, 19 nt, Mycobacterium bovis subsp bovis AF2122/97
cgggggagcgaacggcgca

SEQ ID NO: 1080797 - RNA, 22 nt, Mycobacterium bovis subsp bovis AF2122/97
cgggggagcgaacggcgcaguu

SEQ ID NO: 1080798 - RNA, 17 nt, Mycobacterium bovis subsp bovis AF2122/97
cgggggaagcgccaaac

SEQ ID NO: 1080799 - RNA, 22 nt, Mycobacterium bovis subsp bovis AF2122/97
cggggcuguacucgcggcgcgg

SEQ ID NO: 1080800 - RNA, 21 nt, Mycobacterium bovis subsp bovis AF2122/97
cggggcuucaucuggcgccgu

SEQ ID NO: 1080801 - RNA, 20 nt, Mycobacterium bovis subsp bovis AF2122/97
cgggggauuucgcgucugcu

SEQ ID NO: 1080802 - RNA, 12 nt, Mycobacterium bovis subsp bovis AF2122/97
cgggggacgggu

SEQ ID NO: 1080803 - RNA, 18 nt, Mycobacterium bovis subsp bovis AF2122/97
cgggggaguagugguggg

SEQ ID NO: 1080804 - RNA, 19 nt, Mycobacterium bovis subsp bovis AF2122/97
cgggggaguaguggugggc

SEQ ID NO: 1080805 - RNA, 22 nt, Mycobacterium bovis subsp bovis AF2122/97
cgggggaguaguggugggcgug

SEQ ID NO: 1080806 - RNA, 15 nt, Mycobacterium bovis subsp bovis AF2122/97
cgggggcagcgccuc

SEQ ID NO: 1080807 - RNA, 22 nt, Mycobacterium bovis subsp bovis AF2122/97
cgggggccagcgucaccucacc

SEQ ID NO: 1080808 - RNA, 17 nt, Mycobacterium bovis subsp bovis AF2122/97
cgggggccgcgucucgg

SEQ ID NO: 1080809 - RNA, 20 nt, Mycobacterium bovis subsp bovis AF2122/97
cgggggcgccgccguugccg

SEQ ID NO: 1080810 - RNA, 22 nt, Mycobacterium bovis subsp bovis AF2122/97
cgggggcgccggagccaacggc

SEQ ID NO: 1080811 - RNA, 13 nt, Mycobacterium bovis subsp bovis AF2122/97
cgggggcgccggc

SEQ ID NO: 1080812 - RNA, 14 nt, Mycobacterium bovis subsp bovis AF2122/97
cgggggcgccggcg

SEQ ID NO: 1080813 - RNA, 17 nt, Mycobacterium bovis subsp bovis AF2122/97
cgggggccgaccagucg

SEQ ID NO: 1080814 - RNA, 21 nt, Mycobacterium bovis subsp bovis AF2122/97
cgggggccgaccagucgacgu

SEQ ID NO: 1080815 - RNA, 20 nt, Mycobacterium bovis subsp bovis AF2122/97
cgggggcuuaugcgucugcu

SEQ ID NO: 1080816 - RNA, 20 nt, Mycobacterium bovis subsp bovis AF2122/97
cgggggcuuuuacgucugcu

SEQ ID NO: 1080817 - RNA, 13 nt, Mycobacterium bovis subsp bovis AF2122/97
cgggggcgucgcc

SEQ ID NO: 1080818 - RNA, 13 nt, Mycobacterium bovis subsp bovis AF2122/97
cgggggcggcggc

SEQ ID NO: 1080819 - RNA, 15 nt, Mycobacterium bovis subsp bovis AF2122/97
cgggggcugcacgcu

SEQ ID NO: 1080820 - RNA, 19 nt, Mycobacterium bovis subsp bovis AF2122/97
cgggggcugcacgcucguu

SEQ ID NO: 1080821 - RNA, 16 nt, Mycobacterium bovis subsp bovis AF2122/97
cgggggcuguccaccg

SEQ ID NO: 1080822 - RNA, 20 nt, Mycobacterium bovis subsp bovis AF2122/97
cgggggugggcgugacgggc

SEQ ID NO: 1080823 - RNA, 17 nt, Mycobacterium bovis subsp bovis AF2122/97
cggggggucagacaaca

SEQ ID NO: 1080824 - RNA, 19 nt, Mycobacterium bovis subsp bovis AF2122/97
cgggggucgggcgugucgg

SEQ ID NO: 1080825 - RNA, 20 nt, Mycobacterium bovis subsp bovis AF2122/97
cgggggucgggcgugucggg

SEQ ID NO: 1080826 - RNA, 14 nt, Mycobacterium bovis subsp bovis AF2122/97
cggggggcagcucc

SEQ ID NO: 1080827 - RNA, 21 nt, Mycobacterium bovis subsp bovis AF2122/97
cggggggaucucggucgacgg

SEQ ID NO: 1080828 - RNA, 18 nt, Mycobacterium bovis subsp bovis AF2122/97
cggggccugcguccgacg

SEQ ID NO: 1080829 - RNA, 15 nt, Mycobacterium bovis subsp bovis AF2122/97
cggggccggccggca

SEQ ID NO: 1080830 - RNA, 21 nt, Mycobacterium bovis subsp bovis AF2122/97
cggggccgucgucggucaccg

SEQ ID NO: 1080831 - RNA, 23 nt, Mycobacterium bovis subsp bovis AF2122/97
cggggccgucgucggucaccgac

SEQ ID NO: 1080832 - RNA, 18 nt, Mycobacterium bovis subsp bovis AF2122/97
cggggccgucucgccgug

SEQ ID NO: 1080833 - RNA, 17 nt, Mycobacterium bovis subsp bovis AF2122/97
cggggccuucggcccgg

SEQ ID NO: 1080834 - RNA, 18 nt, Mycobacterium bovis subsp bovis AF2122/97
cggggccuucggcccggu

SEQ ID NO: 1080835 - RNA, 18 nt, Mycobacterium bovis subsp bovis AF2122/97
cggggcggcauuggcggu

SEQ ID NO: 1080836 - RNA, 22 nt, Mycobacterium bovis subsp bovis AF2122/97
cggggcggcauuggcggugccg

SEQ ID NO: 1080837 - RNA, 14 nt, Mycobacterium bovis subsp bovis AF2122/97
cggggcgcgguacc

SEQ ID NO: 1080838 - RNA, 16 nt, Mycobacterium bovis subsp bovis AF2122/97
cggggccgccagcugc

SEQ ID NO: 1080839 - RNA, 19 nt, Mycobacterium bovis subsp bovis AF2122/97
cggggcgcgguaccggugu

SEQ ID NO: 1080840 - RNA, 14 nt, Mycobacterium bovis subsp bovis AF2122/97
cggggccgccagcu

SEQ ID NO: 1080841 - RNA, 14 nt, Mycobacterium bovis subsp bovis AF2122/97
cggggccgccgcgg

SEQ ID NO: 1080842 - RNA, 15 nt, Mycobacterium bovis subsp bovis AF2122/97
cggggccgccgcggc

SEQ ID NO: 1080843 - RNA, 17 nt, Mycobacterium bovis subsp bovis AF2122/97
cggggccgccgcggccg

SEQ ID NO: 1080844 - RNA, 21 nt, Mycobacterium bovis subsp bovis AF2122/97
cggggccgccgcggccggcgc

SEQ ID NO: 1080845 - RNA, 12 nt, Mycobacterium bovis subsp bovis AF2122/97
cggggccgcgcu

SEQ ID NO: 1080846 - RNA, 12 nt, Mycobacterium bovis subsp bovis AF2122/97
cggggccgucgg

SEQ ID NO: 1080847 - RNA, 12 nt, Mycobacterium bovis subsp bovis AF2122/97
cggggccgucgu

SEQ ID NO: 1080848 - RNA, 15 nt, Mycobacterium bovis subsp bovis AF2122/97
cggggccgucgucgg

SEQ ID NO: 1080849 - RNA, 13 nt, Mycobacterium bovis subsp bovis AF2122/97
cggggcccacacg

SEQ ID NO: 1080850 - RNA, 15 nt, Mycobacterium bovis subsp bovis AF2122/97
cggggccgcaaccau

SEQ ID NO: 1080851 - RNA, 21 nt, Mycobacterium bovis subsp bovis AF2122/97
cggggccgccgaugccaccgc

SEQ ID NO: 1080852 - RNA, 18 nt, Mycobacterium bovis subsp bovis AF2122/97
cggggccccaugccgacc

SEQ ID NO: 1080853 - RNA, 19 nt, Mycobacterium bovis subsp bovis AF2122/97
cggggccccaugccgaccg

SEQ ID NO: 1080854 - RNA, 21 nt, Mycobacterium bovis subsp bovis AF2122/97
cggggccccaugccgaccggc

SEQ ID NO: 1080855 - RNA, 23 nt, Mycobacterium bovis subsp bovis AF2122/97
cggggccccaugccgaccggcac

SEQ ID NO: 1080856 - RNA, 19 nt, Mycobacterium bovis subsp bovis AF2122/97
cggggccccgcggcgccgc

SEQ ID NO: 1080857 - RNA, 20 nt, Mycobacterium bovis subsp bovis AF2122/97
cggggccccgcggcgccgcc

SEQ ID NO: 1080858 - RNA, 19 nt, Mycobacterium bovis subsp bovis AF2122/97
cggggaucgcuggccgcga

SEQ ID NO: 1080859 - RNA, 21 nt, Mycobacterium bovis subsp bovis AF2122/97
cggggaucgcaagccguugca

SEQ ID NO: 1080860 - RNA, 23 nt, Mycobacterium bovis subsp bovis AF2122/97
cggggaguggaaacccgccgaac

SEQ ID NO: 1080861 - RNA, 17 nt, Mycobacterium bovis subsp bovis AF2122/97
cggggauaucacgacgc

SEQ ID NO: 1080862 - RNA, 14 nt, Mycobacterium bovis subsp bovis AF2122/97
cggggacgggucgg

SEQ ID NO: 1080863 - RNA, 21 nt, Mycobacterium bovis subsp bovis AF2122/97
cggggaggucaaaaucagggu

SEQ ID NO: 1080864 - RNA, 15 nt, Mycobacterium bovis subsp bovis AF2122/97
cggggagcugcggcg

SEQ ID NO: 1080865 - RNA, 16 nt, Mycobacterium bovis subsp bovis AF2122/97
cggggagauccaggug

SEQ ID NO: 1080866 - RNA, 18 nt, Mycobacterium bovis subsp bovis AF2122/97
cggggaaucacccacucg

SEQ ID NO: 1080867 - RNA, 19 nt, Mycobacterium bovis subsp bovis AF2122/97
cggggaacguccgcgccga

SEQ ID NO: 1080868 - RNA, 22 nt, Mycobacterium bovis subsp bovis AF2122/97
cggggaacuuaccgaggccaug

SEQ ID NO: 1080869 - RNA, 20 nt, Mycobacterium bovis subsp bovis AF2122/97
cggggaagcccggcagaugc

SEQ ID NO: 1080870 - RNA, 20 nt, Mycobacterium bovis subsp bovis AF2122/97
cggggaagccugcgggccgg

SEQ ID NO: 1080871 - RNA, 22 nt, Mycobacterium bovis subsp bovis AF2122/97
cggggaagccugcgggccggca

SEQ ID NO: 1080872 - RNA, 14 nt, Mycobacterium bovis subsp bovis AF2122/97
cggggaagcccggc

SEQ ID NO: 1080873 - RNA, 18 nt, Mycobacterium bovis subsp bovis AF2122/97
cggggaagcccggcagau

SEQ ID NO: 1080874 - RNA, 18 nt, Mycobacterium bovis subsp bovis AF2122/97
cggggaacaccgcgguga

SEQ ID NO: 1080875 - RNA, 22 nt, Mycobacterium bovis subsp bovis AF2122/97
cggggaaaccggccagccgacg

SEQ ID NO: 1080876 - RNA, 17 nt, Mycobacterium bovis subsp bovis AF2122/97
cggggacaacucgcgug

SEQ ID NO: 1080877 - RNA, 21 nt, Mycobacterium bovis subsp bovis AF2122/97
cggggacagcccuucgcggga

SEQ ID NO: 1080878 - RNA, 20 nt, Mycobacterium bovis subsp bovis AF2122/97
cggggaccgcggucauggcg

SEQ ID NO: 1080879 - RNA, 14 nt, Mycobacterium bovis subsp bovis AF2122/97
cggggaccacgccg

SEQ ID NO: 1080880 - RNA, 17 nt, Mycobacterium bovis subsp bovis AF2122/97
cggggaccacgccgacg

SEQ ID NO: 1080881 - RNA, 23 nt, Mycobacterium bovis subsp bovis AF2122/97
cggggaccagauacgucgucgug

SEQ ID NO: 1080882 - RNA, 13 nt, Mycobacterium bovis subsp bovis AF2122/97
cggggaccgcggu

SEQ ID NO: 1080883 - RNA, 23 nt, Mycobacterium bovis subsp bovis AF2122/97
cggggcagcucaccuuccucgaa

SEQ ID NO: 1080884 - RNA, 13 nt, Mycobacterium bovis subsp bovis AF2122/97
cggggccacccgc

SEQ ID NO: 1080885 - RNA, 13 nt, Mycobacterium bovis subsp bovis AF2122/97
cggggcacaaggg

SEQ ID NO: 1080886 - RNA, 14 nt, Mycobacterium bovis subsp bovis AF2122/97
cggggcaacgauca

SEQ ID NO: 1080887 - RNA, 17 nt, Mycobacterium bovis subsp bovis AF2122/97
cggggcaaaggagccgu

SEQ ID NO: 1080888 - RNA, 18 nt, Mycobacterium bovis subsp bovis AF2122/97
cggggaugggggagccgg

SEQ ID NO: 1080889 - RNA, 14 nt, Mycobacterium bovis subsp bovis AF2122/97
cggggaugccgaac

SEQ ID NO: 1080890 - RNA, 18 nt, Mycobacterium bovis subsp bovis AF2122/97
cggggaugcgaccgccgg

SEQ ID NO: 1080891 - RNA, 15 nt, Mycobacterium bovis subsp bovis AF2122/97
cggggauggagccgg

SEQ ID NO: 1080892 - RNA, 16 nt, Mycobacterium bovis subsp bovis AF2122/97
cggggauggagccggu

SEQ ID NO: 1080893 - RNA, 21 nt, Mycobacterium bovis subsp bovis AF2122/97
cggggauggagccggugacgg

SEQ ID NO: 1080894 - RNA, 23 nt, Mycobacterium bovis subsp bovis AF2122/97
cggggauggagccggugacggug

SEQ ID NO: 1080895 - RNA, 14 nt, Mycobacterium bovis subsp bovis AF2122/97
cgggaagccgcgcc

SEQ ID NO: 1080896 - RNA, 22 nt, Mycobacterium bovis subsp bovis AF2122/97
cgggaacuucgccgaagcgccg

SEQ ID NO: 1080897 - RNA, 16 nt, Mycobacterium bovis subsp bovis AF2122/97
cgggaagaacaucacc

SEQ ID NO: 1080898 - RNA, 21 nt, Mycobacterium bovis subsp bovis AF2122/97
cgggaacggugccgaucgggg

SEQ ID NO: 1080899 - RNA, 23 nt, Mycobacterium bovis subsp bovis AF2122/97
cgggaacggugccgaucggggug

SEQ ID NO: 1080900 - RNA, 16 nt, Mycobacterium bovis subsp bovis AF2122/97
cgggaacgcucgucga

SEQ ID NO: 1080901 - RNA, 21 nt, Mycobacterium bovis subsp bovis AF2122/97
cgggaacgaguacgggcaggc

SEQ ID NO: 1080902 - RNA, 15 nt, Mycobacterium bovis subsp bovis AF2122/97
cgggaacgaugccgc

SEQ ID NO: 1080903 - RNA, 18 nt, Mycobacterium bovis subsp bovis AF2122/97
cgggaacgaugccgccgg

SEQ ID NO: 1080904 - RNA, 14 nt, Mycobacterium bovis subsp bovis AF2122/97
cgggaacgccucag

SEQ ID NO: 1080905 - RNA, 20 nt, Mycobacterium bovis subsp bovis AF2122/97
cgggaacgccucaggggcgc

SEQ ID NO: 1080906 - RNA, 17 nt, Mycobacterium bovis subsp bovis AF2122/97
cgggaagugcacccggu

SEQ ID NO: 1080907 - RNA, 12 nt, Mycobacterium bovis subsp bovis AF2122/97
cgggaagucggg

SEQ ID NO: 1080908 - RNA, 16 nt, Mycobacterium bovis subsp bovis AF2122/97
cgggaagucgggccgg

SEQ ID NO: 1080909 - RNA, 18 nt, Mycobacterium bovis subsp bovis AF2122/97
cgggaagucgggccggua

SEQ ID NO: 1080910 - RNA, 17 nt, Mycobacterium bovis subsp bovis AF2122/97
cgggaaguacggcaggc

SEQ ID NO: 1080911 - RNA, 15 nt, Mycobacterium bovis subsp bovis AF2122/97
cgggaaggaaccggg

SEQ ID NO: 1080912 - RNA, 19 nt, Mycobacterium bovis subsp bovis AF2122/97
cgggaaacuccgcggcgcg

SEQ ID NO: 1080913 - RNA, 19 nt, Mycobacterium bovis subsp bovis AF2122/97
cgggaaaguuguaucgcag

SEQ ID NO: 1080914 - RNA, 16 nt, Mycobacterium bovis subsp bovis AF2122/97
cgggaaccucgaccgu

SEQ ID NO: 1080915 - RNA, 18 nt, Mycobacterium bovis subsp bovis AF2122/97
cgggaaccaacaccaggu

SEQ ID NO: 1080916 - RNA, 20 nt, Mycobacterium bovis subsp bovis AF2122/97
cgggaacaacggcguaaucg

SEQ ID NO: 1080917 - RNA, 14 nt, Mycobacterium bovis subsp bovis AF2122/97
cggcuuuggccgcc

SEQ ID NO: 1080918 - RNA, 18 nt, Mycobacterium bovis subsp bovis AF2122/97
cggcuuugagccgcucga

SEQ ID NO: 1080919 - RNA, 14 nt, Mycobacterium bovis subsp bovis AF2122/97
cggcuuugcggcgc

SEQ ID NO: 1080920 - RNA, 15 nt, Mycobacterium bovis subsp bovis AF2122/97
cggcuuugcggcgcg

SEQ ID NO: 1080921 - RNA, 22 nt, Mycobacterium bovis subsp bovis AF2122/97
cggcuuuuccggcauugccgcc

SEQ ID NO: 1080922 - RNA, 16 nt, Mycobacterium bovis subsp bovis AF2122/97
cggcuuuucgacgcug

SEQ ID NO: 1080923 - RNA, 21 nt, Mycobacterium bovis subsp bovis AF2122/97
cggcuuuugucacaggcgaca

SEQ ID NO: 1080924 - RNA, 21 nt, Mycobacterium bovis subsp bovis AF2122/97
cggcuuggccgccccggccgc

SEQ ID NO: 1080925 - RNA, 22 nt, Mycobacterium bovis subsp bovis AF2122/97
cggcuugcgauuggcugggucg

SEQ ID NO: 1080926 - RNA, 16 nt, Mycobacterium bovis subsp bovis AF2122/97
cggcuuggcgucggcc

SEQ ID NO: 1080927 - RNA, 16 nt, Mycobacterium bovis subsp bovis AF2122/97
cggcuuggcgggaccg

SEQ ID NO: 1080928 - RNA, 20 nt, Mycobacterium bovis subsp bovis AF2122/97
cggcuuggccuagccgcggc

SEQ ID NO: 1080929 - RNA, 18 nt, Mycobacterium bovis subsp bovis AF2122/97
cggcuugggaaacccggc

SEQ ID NO: 1080930 - RNA, 23 nt, Mycobacterium bovis subsp bovis AF2122/97
cggcuugggaaacccggccagcu

SEQ ID NO: 1080931 - RNA, 18 nt, Mycobacterium bovis subsp bovis AF2122/97
cggcuuggugaaccgcgc

SEQ ID NO: 1080932 - RNA, 15 nt, Mycobacterium bovis subsp bovis AF2122/97
cggcuugggcuugcg

SEQ ID NO: 1080933 - RNA, 19 nt, Mycobacterium bovis subsp bovis AF2122/97
cggcuugggcuugcgccgg

SEQ ID NO: 1080934 - RNA, 20 nt, Mycobacterium bovis subsp bovis AF2122/97
cggcuugucgaccacgaccg

SEQ ID NO: 1080935 - RNA, 12 nt, Mycobacterium bovis subsp bovis AF2122/97
cggcuugucgcc

SEQ ID NO: 1080936 - RNA, 14 nt, Mycobacterium bovis subsp bovis AF2122/97
cggcuuucccaccg

SEQ ID NO: 1080937 - RNA, 17 nt, Mycobacterium bovis subsp bovis AF2122/97
cggcuuucccaccgcuu

SEQ ID NO: 1080938 - RNA, 18 nt, Mycobacterium bovis subsp bovis AF2122/97
cggcuuugacgcccggca

SEQ ID NO: 1080939 - RNA, 15 nt, Mycobacterium bovis subsp bovis AF2122/97
cggcuuugagccgcu

SEQ ID NO: 1080940 - RNA, 19 nt, Mycobacterium bovis subsp bovis AF2122/97
cggcuugcgauuggcuggg

SEQ ID NO: 1080941 - RNA, 13 nt, Mycobacterium bovis subsp bovis AF2122/97
cggcuugccgccg

SEQ ID NO: 1080942 - RNA, 21 nt, Mycobacterium bovis subsp bovis AF2122/97
cggcuuccaacucggcggcca

SEQ ID NO: 1080943 - RNA, 12 nt, Mycobacterium bovis subsp bovis AF2122/97
cggcugucgguc

SEQ ID NO: 1080944 - RNA, 18 nt, Mycobacterium bovis subsp bovis AF2122/97
cggcugggggauaccgcu

SEQ ID NO: 1080945 - RNA, 12 nt, Mycobacterium bovis subsp bovis AF2122/97
cggcugucggcc

SEQ ID NO: 1080946 - RNA, 23 nt, Mycobacterium bovis subsp bovis AF2122/97
cggcuguggucgcugcugccgca

SEQ ID NO: 1080947 - RNA, 21 nt, Mycobacterium bovis subsp bovis AF2122/97
cggcuguuaggcgauaucgca

SEQ ID NO: 1080948 - RNA, 14 nt, Mycobacterium bovis subsp bovis AF2122/97
cggcuguucucgcc

SEQ ID NO: 1080949 - RNA, 15 nt, Mycobacterium bovis subsp bovis AF2122/97
cggcuguucucgccg

SEQ ID NO: 1080950 - RNA, 17 nt, Mycobacterium bovis subsp bovis AF2122/97
cggcuguugcggcggcg

SEQ ID NO: 1080951 - RNA, 16 nt, Mycobacterium bovis subsp bovis AF2122/97
cggcuguugcguucgg

SEQ ID NO: 1080952 - RNA, 17 nt, Mycobacterium bovis subsp bovis AF2122/97
cggcuguugcguucggu

SEQ ID NO: 1080953 - RNA, 14 nt, Mycobacterium bovis subsp bovis AF2122/97
cggcugcaccggcu

SEQ ID NO: 1080954 - RNA, 19 nt, Mycobacterium bovis subsp bovis AF2122/97
cggcugcacgcugcggguc

SEQ ID NO: 1080955 - RNA, 15 nt, Mycobacterium bovis subsp bovis AF2122/97
cggcugauuggccca

SEQ ID NO: 1080956 - RNA, 19 nt, Mycobacterium bovis subsp bovis AF2122/97
cggcugauuggcccaccgc

SEQ ID NO: 1080957 - RNA, 20 nt, Mycobacterium bovis subsp bovis AF2122/97
cggcugcauccuccucgucg

SEQ ID NO: 1080958 - RNA, 20 nt, Mycobacterium bovis subsp bovis AF2122/97
cggcugagacgguguugcuc

SEQ ID NO: 1080959 - RNA, 19 nt, Mycobacterium bovis subsp bovis AF2122/97
cggcugccacacaggcguc

SEQ ID NO: 1080960 - RNA, 13 nt, Mycobacterium bovis subsp bovis AF2122/97
cggcugccaccgc

SEQ ID NO: 1080961 - RNA, 17 nt, Mycobacterium bovis subsp bovis AF2122/97
cggcugccacgcgucgg

SEQ ID NO: 1080962 - RNA, 15 nt, Mycobacterium bovis subsp bovis AF2122/97
cggcugccacacagg

SEQ ID NO: 1080963 - RNA, 18 nt, Mycobacterium bovis subsp bovis AF2122/97
cggcugccagcgccgccg

SEQ ID NO: 1080964 - RNA, 17 nt, Mycobacterium bovis subsp bovis AF2122/97
cggcugccagugccgcc

SEQ ID NO: 1080965 - RNA, 17 nt, Mycobacterium bovis subsp bovis AF2122/97
cggcugcggaggcgggu

SEQ ID NO: 1080966 - RNA, 14 nt, Mycobacterium bovis subsp bovis AF2122/97
cggcugcggcaacg

SEQ ID NO: 1080967 - RNA, 20 nt, Mycobacterium bovis subsp bovis AF2122/97
cggcugcgggaagacgucgg

SEQ ID NO: 1080968 - RNA, 13 nt, Mycobacterium bovis subsp bovis AF2122/97
cggcugcggggcg

SEQ ID NO: 1080969 - RNA, 14 nt, Mycobacterium bovis subsp bovis AF2122/97
cggcugcggggcga

SEQ ID NO: 1080970 - RNA, 22 nt, Mycobacterium bovis subsp bovis AF2122/97
cggcugcgucgucugcagaccu

SEQ ID NO: 1080971 - RNA, 17 nt, Mycobacterium bovis subsp bovis AF2122/97
cggcugcguuggcuggu

SEQ ID NO: 1080972 - RNA, 22 nt, Mycobacterium bovis subsp bovis AF2122/97
cggcugcgguaaucgccaccgc

SEQ ID NO: 1080973 - RNA, 16 nt, Mycobacterium bovis subsp bovis AF2122/97
cggcugcucgacggcu

SEQ ID NO: 1080974 - RNA, 23 nt, Mycobacterium bovis subsp bovis AF2122/97
cggcugcuaugggucguugucgg

SEQ ID NO: 1080975 - RNA, 20 nt, Mycobacterium bovis subsp bovis AF2122/97
cggcugcucgacggcuccga

SEQ ID NO: 1080976 - RNA, 16 nt, Mycobacterium bovis subsp bovis AF2122/97
cggcugggggauaccg

SEQ ID NO: 1080977 - RNA, 17 nt, Mycobacterium bovis subsp bovis AF2122/97
cggcugggcgaagccca

SEQ ID NO: 1080978 - RNA, 16 nt, Mycobacterium bovis subsp bovis AF2122/97
cggcugggcgccacca

SEQ ID NO: 1080979 - RNA, 15 nt, Mycobacterium bovis subsp bovis AF2122/97
cggcugcugcgcggu

SEQ ID NO: 1080980 - RNA, 12 nt, Mycobacterium bovis subsp bovis AF2122/97
cggcugagccgc

SEQ ID NO: 1080981 - RNA, 13 nt, Mycobacterium bovis subsp bovis AF2122/97
cggcugagccgca

SEQ ID NO: 1080982 - RNA, 23 nt, Mycobacterium bovis subsp bovis AF2122/97
cggcugagccgcaucuggccggc

SEQ ID NO: 1080983 - RNA, 16 nt, Mycobacterium bovis subsp bovis AF2122/97
cggcugagacgguguu

SEQ ID NO: 1080984 - RNA, 22 nt, Mycobacterium bovis subsp bovis AF2122/97
cggcugaccuucucacgcacca

SEQ ID NO: 1080985 - RNA, 18 nt, Mycobacterium bovis subsp bovis AF2122/97
cggcugacgaccaaccac

SEQ ID NO: 1080986 - RNA, 20 nt, Mycobacterium bovis subsp bovis AF2122/97
cggcugacgaccaaccaccg

SEQ ID NO: 1080987 - RNA, 19 nt, Mycobacterium bovis subsp bovis AF2122/97
cggcugagcgugcggugau

SEQ ID NO: 1080988 - RNA, 21 nt, Mycobacterium bovis subsp bovis AF2122/97
cggcugagcgugcggugaucg

SEQ ID NO: 1080989 - RNA, 13 nt, Mycobacterium bovis subsp bovis AF2122/97
cggcugaccgacc

SEQ ID NO: 1080990 - RNA, 20 nt, Mycobacterium bovis subsp bovis AF2122/97
cggcugaccucccacccccg

SEQ ID NO: 1080991 - RNA, 22 nt, Mycobacterium bovis subsp bovis AF2122/97
cggcugaccucccacccccggu

SEQ ID NO: 1080992 - RNA, 14 nt, Mycobacterium bovis subsp bovis AF2122/97
cggcugaccgaccc

SEQ ID NO: 1080993 - RNA, 21 nt, Mycobacterium bovis subsp bovis AF2122/97
cggcugaccuucucacgcacc

SEQ ID NO: 1080994 - RNA, 20 nt, Mycobacterium bovis subsp bovis AF2122/97
cggcugaccggggucggccu

SEQ ID NO: 1080995 - RNA, 21 nt, Mycobacterium bovis subsp bovis AF2122/97
cggcguggucgcgcggcaccg

SEQ ID NO: 1080996 - RNA, 14 nt, Mycobacterium bovis subsp bovis AF2122/97
cggcgugaucaccg

SEQ ID NO: 1080997 - RNA, 13 nt, Mycobacterium bovis subsp bovis AF2122/97
cggcguggcugcc

SEQ ID NO: 1080998 - RNA, 21 nt, Mycobacterium bovis subsp bovis AF2122/97
cggcguggcugccuucggcga

SEQ ID NO: 1080999 - RNA, 20 nt, Mycobacterium bovis subsp bovis AF2122/97
cggcguggcuuguucggacu

SEQ ID NO: 1081000 - RNA, 18 nt, Mycobacterium bovis subsp bovis AF2122/97
cggcgugggagguggcgc

SEQ ID NO: 1081001 - RNA, 20 nt, Mycobacterium bovis subsp bovis AF2122/97
cggcgugguauccgccguuc

SEQ ID NO: 1081002 - RNA, 17 nt, Mycobacterium bovis subsp bovis AF2122/97
cggcgugcaguacaccc

SEQ ID NO: 1081003 - RNA, 14 nt, Mycobacterium bovis subsp bovis AF2122/97
cggcgugcagcacu

SEQ ID NO: 1081004 - RNA, 18 nt, Mycobacterium bovis subsp bovis AF2122/97
cggcguggaugcccgguu

SEQ ID NO: 1081005 - RNA, 19 nt, Mycobacterium bovis subsp bovis AF2122/97
cggcguggcaguacaccgg

SEQ ID NO: 1081006 - RNA, 14 nt, Mycobacterium bovis subsp bovis AF2122/97
cggcguggcgccgg

SEQ ID NO: 1081007 - RNA, 17 nt, Mycobacterium bovis subsp bovis AF2122/97
cggcguggcgccggcca

SEQ ID NO: 1081008 - RNA, 18 nt, Mycobacterium bovis subsp bovis AF2122/97
cggcguggcgccggccac

SEQ ID NO: 1081009 - RNA, 20 nt, Mycobacterium bovis subsp bovis AF2122/97
cggcguggcaguacaccggc

SEQ ID NO: 1081010 - RNA, 18 nt, Mycobacterium bovis subsp bovis AF2122/97
cgggcagaggcuggcgca

SEQ ID NO: 1081011 - RNA, 23 nt, Mycobacterium bovis subsp bovis AF2122/97
cgggcagauacgccaaccgcuuc

SEQ ID NO: 1081012 - RNA, 15 nt, Mycobacterium bovis subsp bovis AF2122/97
cgggcagcacccgcg

SEQ ID NO: 1081013 - RNA, 16 nt, Mycobacterium bovis subsp bovis AF2122/97
cgggcagcacccgcgc

SEQ ID NO: 1081014 - RNA, 21 nt, Mycobacterium bovis subsp bovis AF2122/97
cgggcagaugaugccguucgg

SEQ ID NO: 1081015 - RNA, 21 nt, Mycobacterium bovis subsp bovis AF2122/97
cgggcagcaaaaaccagcguc

SEQ ID NO: 1081016 - RNA, 22 nt, Mycobacterium bovis subsp bovis AF2122/97
cgggcagcaaaaaccagcgucc

SEQ ID NO: 1081017 - RNA, 20 nt, Mycobacterium bovis subsp bovis AF2122/97
cgggcagcacuuggacccgg

SEQ ID NO: 1081018 - RNA, 15 nt, Mycobacterium bovis subsp bovis AF2122/97
cgggcagcacgccag

SEQ ID NO: 1081019 - RNA, 18 nt, Mycobacterium bovis subsp bovis AF2122/97
cgggcagcaucaacaccg

SEQ ID NO: 1081020 - RNA, 19 nt, Mycobacterium bovis subsp bovis AF2122/97
cgggcagcaucaacaccgg

SEQ ID NO: 1081021 - RNA, 20 nt, Mycobacterium bovis subsp bovis AF2122/97
cgggcagccgcacgguucgg

SEQ ID NO: 1081022 - RNA, 17 nt, Mycobacterium bovis subsp bovis AF2122/97
cgggcagccgcccgcca

SEQ ID NO: 1081023 - RNA, 15 nt, Mycobacterium bovis subsp bovis AF2122/97
cgggcagccgcgccg

SEQ ID NO: 1081024 - RNA, 21 nt, Mycobacterium bovis subsp bovis AF2122/97
cgggcagccgcgccgcggccc

SEQ ID NO: 1081025 - RNA, 21 nt, Mycobacterium bovis subsp bovis AF2122/97
cgggcagcgaucuugguggcc

SEQ ID NO: 1081026 - RNA, 17 nt, Mycobacterium bovis subsp bovis AF2122/97
cgggcagcgcggccagu

SEQ ID NO: 1081027 - RNA, 23 nt, Mycobacterium bovis subsp bovis AF2122/97
cgggcacguuuacauagaccacc

SEQ ID NO: 1081028 - RNA, 12 nt, Mycobacterium bovis subsp bovis AF2122/97
cgggcacaccga

SEQ ID NO: 1081029 - RNA, 21 nt, Mycobacterium bovis subsp bovis AF2122/97
cgggcacaccgacgccgccag

SEQ ID NO: 1081030 - RNA, 22 nt, Mycobacterium bovis subsp bovis AF2122/97
cgggcaaucgcucugugucgcc

SEQ ID NO: 1081031 - RNA, 13 nt, Mycobacterium bovis subsp bovis AF2122/97
cgggcaaugucga

SEQ ID NO: 1081032 - RNA, 19 nt, Mycobacterium bovis subsp bovis AF2122/97
cgggcaaugucgacaccgg

SEQ ID NO: 1081033 - RNA, 21 nt, Mycobacterium bovis subsp bovis AF2122/97
cgggcaaugucgacaccggcg

SEQ ID NO: 1081034 - RNA, 22 nt, Mycobacterium bovis subsp bovis AF2122/97
cgggcaaugucgacaccggcgc

SEQ ID NO: 1081035 - RNA, 19 nt, Mycobacterium bovis subsp bovis AF2122/97
cgggcaacggcggggccgg

SEQ ID NO: 1081036 - RNA, 15 nt, Mycobacterium bovis subsp bovis AF2122/97
cgggauugccgucgg

SEQ ID NO: 1081037 - RNA, 17 nt, Mycobacterium bovis subsp bovis AF2122/97
cgggauugccgucggug

SEQ ID NO: 1081038 - RNA, 21 nt, Mycobacterium bovis subsp bovis AF2122/97
cgggcaacugcagcauggccc

SEQ ID NO: 1081039 - RNA, 15 nt, Mycobacterium bovis subsp bovis AF2122/97
cgggauucgggcgcc

SEQ ID NO: 1081040 - RNA, 19 nt, Mycobacterium bovis subsp bovis AF2122/97
cgggcaagccggacagauc

SEQ ID NO: 1081041 - RNA, 16 nt, Mycobacterium bovis subsp bovis AF2122/97
cgggcaaggccaccgg

SEQ ID NO: 1081042 - RNA, 17 nt, Mycobacterium bovis subsp bovis AF2122/97
cgggcaaggccaccggc

SEQ ID NO: 1081043 - RNA, 19 nt, Mycobacterium bovis subsp bovis AF2122/97
cgggcaaggccaccggcgg

SEQ ID NO: 1081044 - RNA, 20 nt, Mycobacterium bovis subsp bovis AF2122/97
cgggcaaggccaccggcggu

SEQ ID NO: 1081045 - RNA, 21 nt, Mycobacterium bovis subsp bovis AF2122/97
cgggcaaggccaccgucgcgg

SEQ ID NO: 1081046 - RNA, 14 nt, Mycobacterium bovis subsp bovis AF2122/97
cgggcaaggcggcg

SEQ ID NO: 1081047 - RNA, 15 nt, Mycobacterium bovis subsp bovis AF2122/97
cgggcaaggcggcgg

SEQ ID NO: 1081048 - RNA, 18 nt, Mycobacterium bovis subsp bovis AF2122/97
cgggcaaggcggcggcca

SEQ ID NO: 1081049 - RNA, 22 nt, Mycobacterium bovis subsp bovis AF2122/97
cgggcaagccggacagaucaac

SEQ ID NO: 1081050 - RNA, 21 nt, Mycobacterium bovis subsp bovis AF2122/97
cgggcaauacguagucgccga

SEQ ID NO: 1081051 - RNA, 16 nt, Mycobacterium bovis subsp bovis AF2122/97
cgggcaaucaccgccg

SEQ ID NO: 1081052 - RNA, 18 nt, Mycobacterium bovis subsp bovis AF2122/97
cgggcaaucaccgccggc

SEQ ID NO: 1081053 - RNA, 16 nt, Mycobacterium bovis subsp bovis AF2122/97
cgggccaggauccgac

SEQ ID NO: 1081054 - RNA, 16 nt, Mycobacterium bovis subsp bovis AF2122/97
cgggccaucaagcgau

SEQ ID NO: 1081055 - RNA, 16 nt, Mycobacterium bovis subsp bovis AF2122/97
cgggcccaggacagca

SEQ ID NO: 1081056 - RNA, 22 nt, Mycobacterium bovis subsp bovis AF2122/97
cgggcccaggacagcagccgcc

SEQ ID NO: 1081057 - RNA, 13 nt, Mycobacterium bovis subsp bovis AF2122/97
cgggcccacguug

SEQ ID NO: 1081058 - RNA, 20 nt, Mycobacterium bovis subsp bovis AF2122/97
cgggcccagcaggucgucgg

SEQ ID NO: 1081059 - RNA, 19 nt, Mycobacterium bovis subsp bovis AF2122/97
cgggccauggguagccgcc

SEQ ID NO: 1081060 - RNA, 22 nt, Mycobacterium bovis subsp bovis AF2122/97
cgggccaggccgaugccgaccu

SEQ ID NO: 1081061 - RNA, 15 nt, Mycobacterium bovis subsp bovis AF2122/97
cgggcagugcgcggc

SEQ ID NO: 1081062 - RNA, 14 nt, Mycobacterium bovis subsp bovis AF2122/97
cgggcagcuacggg

SEQ ID NO: 1081063 - RNA, 16 nt, Mycobacterium bovis subsp bovis AF2122/97
cgggcagcgcgugcug

SEQ ID NO: 1081064 - RNA, 12 nt, Mycobacterium bovis subsp bovis AF2122/97
cgggcagcgcuc

SEQ ID NO: 1081065 - RNA, 18 nt, Mycobacterium bovis subsp bovis AF2122/97
cgggcagcacccgcgcca

SEQ ID NO: 1081066 - RNA, 20 nt, Mycobacterium bovis subsp bovis AF2122/97
cgggcagcgaaacgagccgg

SEQ ID NO: 1081067 - RNA, 15 nt, Mycobacterium bovis subsp bovis AF2122/97
cgggcagcgcucuca

SEQ ID NO: 1081068 - RNA, 17 nt, Mycobacterium bovis subsp bovis AF2122/97
cgggcaguggcagcccg

SEQ ID NO: 1081069 - RNA, 14 nt, Mycobacterium bovis subsp bovis AF2122/97
cgggcagugugguc

SEQ ID NO: 1081070 - RNA, 22 nt, Mycobacterium bovis subsp bovis AF2122/97
cgggcagucaggccuagcgcgg

SEQ ID NO: 1081071 - RNA, 22 nt, Mycobacterium bovis subsp bovis AF2122/97
cgggcaguucaacgaggccgac

SEQ ID NO: 1081072 - RNA, 15 nt, Mycobacterium bovis subsp bovis AF2122/97
cgggcaguucacggu

SEQ ID NO: 1081073 - RNA, 22 nt, Mycobacterium bovis subsp bovis AF2122/97
cgggcaguucacgguugaugau

SEQ ID NO: 1081074 - RNA, 14 nt, Mycobacterium bovis subsp bovis AF2122/97
cgggcaucggcggu

SEQ ID NO: 1081075 - RNA, 15 nt, Mycobacterium bovis subsp bovis AF2122/97
cgggcauccuucacc

SEQ ID NO: 1081076 - RNA, 21 nt, Mycobacterium bovis subsp bovis AF2122/97
cgggcauccuucaccagcugc

SEQ ID NO: 1081077 - RNA, 23 nt, Mycobacterium bovis subsp bovis AF2122/97
cgggcauccuucaccagcugcga

SEQ ID NO: 1081078 - RNA, 18 nt, Mycobacterium bovis subsp bovis AF2122/97
cgggcaguuuguucgcga

SEQ ID NO: 1081079 - RNA, 20 nt, Mycobacterium bovis subsp bovis AF2122/97
cgggcauaacccgcaccggg

SEQ ID NO: 1081080 - RNA, 15 nt, Mycobacterium bovis subsp bovis AF2122/97
cgggacgcugccggu

SEQ ID NO: 1081081 - RNA, 13 nt, Mycobacterium bovis subsp bovis AF2122/97
cgggacgccccgu

SEQ ID NO: 1081082 - RNA, 14 nt, Mycobacterium bovis subsp bovis AF2122/97
cgggacgccccguc

SEQ ID NO: 1081083 - RNA, 12 nt, Mycobacterium bovis subsp bovis AF2122/97
cgggacgccgug

SEQ ID NO: 1081084 - RNA, 18 nt, Mycobacterium bovis subsp bovis AF2122/97
cgggaccuucgagccgca

SEQ ID NO: 1081085 - RNA, 21 nt, Mycobacterium bovis subsp bovis AF2122/97
cgggacgaaaaaaucgugcgg

SEQ ID NO: 1081086 - RNA, 20 nt, Mycobacterium bovis subsp bovis AF2122/97
cgggacgaaccggccgacgc

SEQ ID NO: 1081087 - RNA, 21 nt, Mycobacterium bovis subsp bovis AF2122/97
cgggacgcaugcgugacccga

SEQ ID NO: 1081088 - RNA, 22 nt, Mycobacterium bovis subsp bovis AF2122/97
cgggacgcaugcgugacccgac

SEQ ID NO: 1081089 - RNA, 16 nt, Mycobacterium bovis subsp bovis AF2122/97
cgggacaaagccgaac

SEQ ID NO: 1081090 - RNA, 18 nt, Mycobacterium bovis subsp bovis AF2122/97
cgggacaaagccgaacga

SEQ ID NO: 1081091 - RNA, 13 nt, Mycobacterium bovis subsp bovis AF2122/97
cgggacaccaccg

SEQ ID NO: 1081092 - RNA, 19 nt, Mycobacterium bovis subsp bovis AF2122/97
cgggacaaguucgguagcg

SEQ ID NO: 1081093 - RNA, 15 nt, Mycobacterium bovis subsp bovis AF2122/97
cgggaauggcgacca

SEQ ID NO: 1081094 - RNA, 15 nt, Mycobacterium bovis subsp bovis AF2122/97
cgggaaguucgucgg

SEQ ID NO: 1081095 - RNA, 14 nt, Mycobacterium bovis subsp bovis AF2122/97
cgggaaucgcucgc

SEQ ID NO: 1081096 - RNA, 21 nt, Mycobacterium bovis subsp bovis AF2122/97
cgggaaucgcucgcgccaggu

SEQ ID NO: 1081097 - RNA, 13 nt, Mycobacterium bovis subsp bovis AF2122/97
cgggacgucaccg

SEQ ID NO: 1081098 - RNA, 23 nt, Mycobacterium bovis subsp bovis AF2122/97
cgggacggccaacagggcgccga

SEQ ID NO: 1081099 - RNA, 18 nt, Mycobacterium bovis subsp bovis AF2122/97
cgggacguuguccaccgc

SEQ ID NO: 1081100 - RNA, 17 nt, Mycobacterium bovis subsp bovis AF2122/97
cgggacgucgucguuga

SEQ ID NO: 1081101 - RNA, 19 nt, Mycobacterium bovis subsp bovis AF2122/97
cgggacguuguccaccgcc

SEQ ID NO: 1081102 - RNA, 21 nt, Mycobacterium bovis subsp bovis AF2122/97
cgggacguuguccaccgccac

SEQ ID NO: 1081103 - RNA, 16 nt, Mycobacterium bovis subsp bovis AF2122/97
cgggacucccgcgcgg

SEQ ID NO: 1081104 - RNA, 19 nt, Mycobacterium bovis subsp bovis AF2122/97
cgggacucccgcgcgggcg

SEQ ID NO: 1081105 - RNA, 20 nt, Mycobacterium bovis subsp bovis AF2122/97
cgggacucccgcgcgggcgg

SEQ ID NO: 1081106 - RNA, 16 nt, Mycobacterium bovis subsp bovis AF2122/97
cgggacugcagcgcgg

SEQ ID NO: 1081107 - RNA, 20 nt, Mycobacterium bovis subsp bovis AF2122/97
cgggagcccgagcucaccgc

SEQ ID NO: 1081108 - RNA, 17 nt, Mycobacterium bovis subsp bovis AF2122/97
cgggacuucgugccucg

SEQ ID NO: 1081109 - RNA, 22 nt, Mycobacterium bovis subsp bovis AF2122/97
cgggagaaaacggcggcgccgg

SEQ ID NO: 1081110 - RNA, 23 nt, Mycobacterium bovis subsp bovis AF2122/97
cgggagaaaacggcggcgccggu

SEQ ID NO: 1081111 - RNA, 16 nt, Mycobacterium bovis subsp bovis AF2122/97
cgggagaacgugccga

SEQ ID NO: 1081112 - RNA, 14 nt, Mycobacterium bovis subsp bovis AF2122/97
cgggagaucgucgc

SEQ ID NO: 1081113 - RNA, 23 nt, Mycobacterium bovis subsp bovis AF2122/97
cgggauaacccagcaccacaacg

SEQ ID NO: 1081114 - RNA, 20 nt, Mycobacterium bovis subsp bovis AF2122/97
cgggaucaugaccaucgagg

SEQ ID NO: 1081115 - RNA, 21 nt, Mycobacterium bovis subsp bovis AF2122/97
cgggauccacccagugccacg

SEQ ID NO: 1081116 - RNA, 17 nt, Mycobacterium bovis subsp bovis AF2122/97
aacaugauccgccggca

SEQ ID NO: 1081117 - RNA, 22 nt, Mycobacterium bovis subsp bovis AF2122/97
aacauguccagugccguuucga

SEQ ID NO: 1081118 - RNA, 15 nt, Mycobacterium bovis subsp bovis AF2122/97
cgggaucaccgauca

SEQ ID NO: 1081119 - RNA, 19 nt, Mycobacterium bovis subsp bovis AF2122/97
cgggauaggacaccgucau

SEQ ID NO: 1081120 - RNA, 20 nt, Mycobacterium bovis subsp bovis AF2122/97
cgggauaguuuucggccgcc

SEQ ID NO: 1081121 - RNA, 20 nt, Mycobacterium bovis subsp bovis AF2122/97
cgggagaugccguauagcgc

SEQ ID NO: 1081122 - RNA, 14 nt, Mycobacterium bovis subsp bovis AF2122/97
cgggaugccggcga

SEQ ID NO: 1081123 - RNA, 15 nt, Mycobacterium bovis subsp bovis AF2122/97
cgggauggacagcug

SEQ ID NO: 1081124 - RNA, 14 nt, Mycobacterium bovis subsp bovis AF2122/97
cgggauggccgccg

SEQ ID NO: 1081125 - RNA, 15 nt, Mycobacterium bovis subsp bovis AF2122/97
cgggauggccgccga

SEQ ID NO: 1081126 - RNA, 16 nt, Mycobacterium bovis subsp bovis AF2122/97
cgggauggccgccgac

SEQ ID NO: 1081127 - RNA, 21 nt, Mycobacterium bovis subsp bovis AF2122/97
cgggauuaugccggcaaccug

SEQ ID NO: 1081128 - RNA, 22 nt, Mycobacterium bovis subsp bovis AF2122/97
cgggauugccgccaccuuggcu

SEQ ID NO: 1081129 - RNA, 22 nt, Mycobacterium bovis subsp bovis AF2122/97
cgggaugugcggcugcaccggc

SEQ ID NO: 1081130 - RNA, 15 nt, Mycobacterium bovis subsp bovis AF2122/97
cgggaugcgcgcccg

SEQ ID NO: 1081131 - RNA, 21 nt, Mycobacterium bovis subsp bovis AF2122/97
cgggaugcgcguuacccaucg

SEQ ID NO: 1081132 - RNA, 19 nt, Mycobacterium bovis subsp bovis AF2122/97
cgggauggacaccaccucg

SEQ ID NO: 1081133 - RNA, 13 nt, Mycobacterium bovis subsp bovis AF2122/97
ggcggccagcucg

SEQ ID NO: 1081134 - RNA, 16 nt, Mycobacterium bovis subsp bovis AF2122/97
ggcggccagcugcagc

SEQ ID NO: 1081135 - RNA, 16 nt, Mycobacterium bovis subsp bovis AF2122/97
ggcggccgggcucccc

SEQ ID NO: 1081136 - RNA, 12 nt, Mycobacterium bovis subsp bovis AF2122/97
ggcggccggcgc

SEQ ID NO: 1081137 - RNA, 17 nt, Mycobacterium bovis subsp bovis AF2122/97
ggcggccggcgccggcg

SEQ ID NO: 1081138 - RNA, 14 nt, Mycobacterium bovis subsp bovis AF2122/97
ggcggccgucaccg

SEQ ID NO: 1081139 - RNA, 18 nt, Mycobacterium bovis subsp bovis AF2122/97
ggcggccgucaccggucg

SEQ ID NO: 1081140 - RNA, 19 nt, Mycobacterium bovis subsp bovis AF2122/97
ggcggccagcgcaccgccg

SEQ ID NO: 1081141 - RNA, 15 nt, Mycobacterium bovis subsp bovis AF2122/97
ggcggccucgccggc

SEQ ID NO: 1081142 - RNA, 18 nt, Mycobacterium bovis subsp bovis AF2122/97
ggcggccucgccggcgcg

SEQ ID NO: 1081143 - RNA, 17 nt, Mycobacterium bovis subsp bovis AF2122/97
ggcggcgaacucggcga

SEQ ID NO: 1081144 - RNA, 22 nt, Mycobacterium bovis subsp bovis AF2122/97
ggcggcgaagaagccggcaagc

SEQ ID NO: 1081145 - RNA, 20 nt, Mycobacterium bovis subsp bovis AF2122/97
ggcggcgacggcggagucgc

SEQ ID NO: 1081146 - RNA, 15 nt, Mycobacterium bovis subsp bovis AF2122/97
ggcggcgacggcggc

SEQ ID NO: 1081147 - RNA, 13 nt, Mycobacterium bovis subsp bovis AF2122/97
ggcggcgacggcg

SEQ ID NO: 1081148 - RNA, 21 nt, Mycobacterium bovis subsp bovis AF2122/97
ggcggcgccggccucgccggg

SEQ ID NO: 1081149 - RNA, 19 nt, Mycobacterium bovis subsp bovis AF2122/97
ggcggcgugcuccugcccg

SEQ ID NO: 1081150 - RNA, 12 nt, Mycobacterium bovis subsp bovis AF2122/97
ggcggcguggcg

SEQ ID NO: 1081151 - RNA, 18 nt, Mycobacterium bovis subsp bovis AF2122/97
ggcggcguuaccaccguc

SEQ ID NO: 1081152 - RNA, 18 nt, Mycobacterium bovis subsp bovis AF2122/97
ggcggcguugagcuggcg

SEQ ID NO: 1081153 - RNA, 16 nt, Mycobacterium bovis subsp bovis AF2122/97
ggcgggaacgggcaaa

SEQ ID NO: 1081154 - RNA, 18 nt, Mycobacterium bovis subsp bovis AF2122/97
ggcgggaacggugccgau

SEQ ID NO: 1081155 - RNA, 20 nt, Mycobacterium bovis subsp bovis AF2122/97
ggcggcucgggugcgcccgg

SEQ ID NO: 1081156 - RNA, 12 nt, Mycobacterium bovis subsp bovis AF2122/97
ggcggcucacga

SEQ ID NO: 1081157 - RNA, 12 nt, Mycobacterium bovis subsp bovis AF2122/97
ggcggcuccacc

SEQ ID NO: 1081158 - RNA, 17 nt, Mycobacterium bovis subsp bovis AF2122/97
ggcggcggcaacggcgg

SEQ ID NO: 1081159 - RNA, 20 nt, Mycobacterium bovis subsp bovis AF2122/97
ggcggcgcugcagcugcucg

SEQ ID NO: 1081160 - RNA, 14 nt, Mycobacterium bovis subsp bovis AF2122/97
ggcggcgcugcagc

SEQ ID NO: 1081161 - RNA, 15 nt, Mycobacterium bovis subsp bovis AF2122/97
ggcggcgcuggucgc

SEQ ID NO: 1081162 - RNA, 17 nt, Mycobacterium bovis subsp bovis AF2122/97
ggcggcgcuggcgucgu

SEQ ID NO: 1081163 - RNA, 16 nt, Mycobacterium bovis subsp bovis AF2122/97
ggcggcggccgcagcg

SEQ ID NO: 1081164 - RNA, 23 nt, Mycobacterium bovis subsp bovis AF2122/97
ggcggcggccgcagcggccagcc

SEQ ID NO: 1081165 - RNA, 14 nt, Mycobacterium bovis subsp bovis AF2122/97
ggcggcggcacgcu

SEQ ID NO: 1081166 - RNA, 14 nt, Mycobacterium bovis subsp bovis AF2122/97
ggcggcgcgcccgg

SEQ ID NO: 1081167 - RNA, 14 nt, Mycobacterium bovis subsp bovis AF2122/97
ggcggcgcgccgau

SEQ ID NO: 1081168 - RNA, 21 nt, Mycobacterium bovis subsp bovis AF2122/97
ggcggcgcgugcgguggcgcg

SEQ ID NO: 1081169 - RNA, 20 nt, Mycobacterium bovis subsp bovis AF2122/97
ggcggagcgggccagcaccc

SEQ ID NO: 1081170 - RNA, 15 nt, Mycobacterium bovis subsp bovis AF2122/97
ggcggagccggguga

SEQ ID NO: 1081171 - RNA, 16 nt, Mycobacterium bovis subsp bovis AF2122/97
ggcggacgcccggcgc

SEQ ID NO: 1081172 - RNA, 20 nt, Mycobacterium bovis subsp bovis AF2122/97
ggcggacgccgcgccggcgg

SEQ ID NO: 1081173 - RNA, 21 nt, Mycobacterium bovis subsp bovis AF2122/97
ggcggacgccgcgccggcggg

SEQ ID NO: 1081174 - RNA, 12 nt, Mycobacterium bovis subsp bovis AF2122/97
ggcggacgacgu

SEQ ID NO: 1081175 - RNA, 19 nt, Mycobacterium bovis subsp bovis AF2122/97
ggcggaccgguaggcaccg

SEQ ID NO: 1081176 - RNA, 21 nt, Mycobacterium bovis subsp bovis AF2122/97
ggcggaccguccgacggcgga

SEQ ID NO: 1081177 - RNA, 19 nt, Mycobacterium bovis subsp bovis AF2122/97
ggcggacccggugacccgc

SEQ ID NO: 1081178 - RNA, 23 nt, Mycobacterium bovis subsp bovis AF2122/97
ggcggacccggugacccgcuggg

SEQ ID NO: 1081179 - RNA, 14 nt, Mycobacterium bovis subsp bovis AF2122/97
ggcggaccgcagcg

SEQ ID NO: 1081180 - RNA, 23 nt, Mycobacterium bovis subsp bovis AF2122/97
ggcggacgugaccagaucgacgc

SEQ ID NO: 1081181 - RNA, 16 nt, Mycobacterium bovis subsp bovis AF2122/97
ggcggacggcgucgag

SEQ ID NO: 1081182 - RNA, 19 nt, Mycobacterium bovis subsp bovis AF2122/97
ggcggagaaaagcgcgcua

SEQ ID NO: 1081183 - RNA, 14 nt, Mycobacterium bovis subsp bovis AF2122/97
ggcggacaccucgg

SEQ ID NO: 1081184 - RNA, 16 nt, Mycobacterium bovis subsp bovis AF2122/97
ggcggacaccucgggc

SEQ ID NO: 1081185 - RNA, 20 nt, Mycobacterium bovis subsp bovis AF2122/97
ggcggaccccucgaccgaua

SEQ ID NO: 1081186 - RNA, 15 nt, Mycobacterium bovis subsp bovis AF2122/97
ggcggacagggcggc

SEQ ID NO: 1081187 - RNA, 16 nt, Mycobacterium bovis subsp bovis AF2122/97
ggcggacagggcggca

SEQ ID NO: 1081188 - RNA, 21 nt, Mycobacterium bovis subsp bovis AF2122/97
ggcggaaguucuccucgugca

SEQ ID NO: 1081189 - RNA, 18 nt, Mycobacterium bovis subsp bovis AF2122/97
ggcggaagaccggaucgc

SEQ ID NO: 1081190 - RNA, 20 nt, Mycobacterium bovis subsp bovis AF2122/97
ggcggaacuguaggucacag

SEQ ID NO: 1081191 - RNA, 14 nt, Mycobacterium bovis subsp bovis AF2122/97
ggcggaacuugccg

SEQ ID NO: 1081192 - RNA, 18 nt, Mycobacterium bovis subsp bovis AF2122/97
ggcggaacuugccggugc

SEQ ID NO: 1081193 - RNA, 13 nt, Mycobacterium bovis subsp bovis AF2122/97
ggcgcuuugggcu

SEQ ID NO: 1081194 - RNA, 16 nt, Mycobacterium bovis subsp bovis AF2122/97
ggcgcuuugggcugcc

SEQ ID NO: 1081195 - RNA, 19 nt, Mycobacterium bovis subsp bovis AF2122/97
ggcgcucauaggccggcgg

SEQ ID NO: 1081196 - RNA, 20 nt, Mycobacterium bovis subsp bovis AF2122/97
ggcgcucauaggccggcggu

SEQ ID NO: 1081197 - RNA, 21 nt, Mycobacterium bovis subsp bovis AF2122/97
ggcgcucauaggccggcgguc

SEQ ID NO: 1081198 - RNA, 13 nt, Mycobacterium bovis subsp bovis AF2122/97
ggcgcucaucacc

SEQ ID NO: 1081199 - RNA, 17 nt, Mycobacterium bovis subsp bovis AF2122/97
ggcgcucaucacccagc

SEQ ID NO: 1081200 - RNA, 18 nt, Mycobacterium bovis subsp bovis AF2122/97
ggcggaaccugucaacau

SEQ ID NO: 1081201 - RNA, 23 nt, Mycobacterium bovis subsp bovis AF2122/97
ggcggaacaagguauggccggag

SEQ ID NO: 1081202 - RNA, 13 nt, Mycobacterium bovis subsp bovis AF2122/97
ggcggccaacggc

SEQ ID NO: 1081203 - RNA, 22 nt, Mycobacterium bovis subsp bovis AF2122/97
ggcggcaucgggguuggugaac

SEQ ID NO: 1081204 - RNA, 23 nt, Mycobacterium bovis subsp bovis AF2122/97
ggcggcaugaagcaguuggccga

SEQ ID NO: 1081205 - RNA, 22 nt, Mycobacterium bovis subsp bovis AF2122/97
ggcggcaaggguggggccggcg

SEQ ID NO: 1081206 - RNA, 16 nt, Mycobacterium bovis subsp bovis AF2122/97
ggcggcauguucaucg

SEQ ID NO: 1081207 - RNA, 19 nt, Mycobacterium bovis subsp bovis AF2122/97
ggcggcauuggcggugccg

SEQ ID NO: 1081208 - RNA, 21 nt, Mycobacterium bovis subsp bovis AF2122/97
ggcggcauuggcggugccggu

SEQ ID NO: 1081209 - RNA, 13 nt, Mycobacterium bovis subsp bovis AF2122/97
ggcggccaccguc

SEQ ID NO: 1081210 - RNA, 16 nt, Mycobacterium bovis subsp bovis AF2122/97
ggcggccaccgucagc

SEQ ID NO: 1081211 - RNA, 12 nt, Mycobacterium bovis subsp bovis AF2122/97
ggcggccaccgc

SEQ ID NO: 1081212 - RNA, 22 nt, Mycobacterium bovis subsp bovis AF2122/97
ggcggccaccgcacgcuggcgg

SEQ ID NO: 1081213 - RNA, 13 nt, Mycobacterium bovis subsp bovis AF2122/97
ggcggccaccagc

SEQ ID NO: 1081214 - RNA, 13 nt, Mycobacterium bovis subsp bovis AF2122/97
ggcggccaacgac

SEQ ID NO: 1081215 - RNA, 12 nt, Mycobacterium bovis subsp bovis AF2122/97
ggcggccaccag

SEQ ID NO: 1081216 - RNA, 17 nt, Mycobacterium bovis subsp bovis AF2122/97
ggcggccagcacgucgu

SEQ ID NO: 1081217 - RNA, 16 nt, Mycobacterium bovis subsp bovis AF2122/97
ggcggccacguggucg

SEQ ID NO: 1081218 - RNA, 19 nt, Mycobacterium bovis subsp bovis AF2122/97
ggcggccacguggucggcg

SEQ ID NO: 1081219 - RNA, 19 nt, Mycobacterium bovis subsp bovis AF2122/97
ggcggccaccugcuggccg

SEQ ID NO: 1081220 - RNA, 17 nt, Mycobacterium bovis subsp bovis AF2122/97
ggcggccaccgucagcg

SEQ ID NO: 1081221 - RNA, 22 nt, Mycobacterium bovis subsp bovis AF2122/97
ggcggccaccgucagcgcgacc

SEQ ID NO: 1081222 - RNA, 18 nt, Mycobacterium bovis subsp bovis AF2122/97
ggcggccagccuaccggc

SEQ ID NO: 1081223 - RNA, 15 nt, Mycobacterium bovis subsp bovis AF2122/97
ggcggccagcgcacc

SEQ ID NO: 1081224 - RNA, 14 nt, Mycobacterium bovis subsp bovis AF2122/97
ggcggccagcgcgc

SEQ ID NO: 1081225 - RNA, 15 nt, Mycobacterium bovis subsp bovis AF2122/97
ggcggcaugcucacc

SEQ ID NO: 1081226 - RNA, 14 nt, Mycobacterium bovis subsp bovis AF2122/97
ggcggcaucggcgg

SEQ ID NO: 1081227 - RNA, 19 nt, Mycobacterium bovis subsp bovis AF2122/97
ggcggcaaccccgagcgga

SEQ ID NO: 1081228 - RNA, 18 nt, Mycobacterium bovis subsp bovis AF2122/97
ggcggauagucgcgggcc

SEQ ID NO: 1081229 - RNA, 13 nt, Mycobacterium bovis subsp bovis AF2122/97
ggcggcaacggcg

SEQ ID NO: 1081230 - RNA, 15 nt, Mycobacterium bovis subsp bovis AF2122/97
ggcggcaacggcggc

SEQ ID NO: 1081231 - RNA, 17 nt, Mycobacterium bovis subsp bovis AF2122/97
ggcggcaacggcggcaa

SEQ ID NO: 1081232 - RNA, 16 nt, Mycobacterium bovis subsp bovis AF2122/97
ggcggcaacgggggcg

SEQ ID NO: 1081233 - RNA, 22 nt, Mycobacterium bovis subsp bovis AF2122/97
ggcggauacaugguccggccgc

SEQ ID NO: 1081234 - RNA, 15 nt, Mycobacterium bovis subsp bovis AF2122/97
ggcggauaugaugau

SEQ ID NO: 1081235 - RNA, 18 nt, Mycobacterium bovis subsp bovis AF2122/97
ggcggcaaacacugcggc

SEQ ID NO: 1081236 - RNA, 19 nt, Mycobacterium bovis subsp bovis AF2122/97
ggcggcaaagaacagccgg

SEQ ID NO: 1081237 - RNA, 23 nt, Mycobacterium bovis subsp bovis AF2122/97
ggcggcaaagaacagccggccaa

SEQ ID NO: 1081238 - RNA, 18 nt, Mycobacterium bovis subsp bovis AF2122/97
ggcggguaagcgaccgac

SEQ ID NO: 1081239 - RNA, 17 nt, Mycobacterium bovis subsp bovis AF2122/97
ggcggguccucgcggag

SEQ ID NO: 1081240 - RNA, 23 nt, Mycobacterium bovis subsp bovis AF2122/97
ggcgggcucgcuucaggcaccgg

SEQ ID NO: 1081241 - RNA, 21 nt, Mycobacterium bovis subsp bovis AF2122/97
ggcgggcugauuucgugcgau

SEQ ID NO: 1081242 - RNA, 13 nt, Mycobacterium bovis subsp bovis AF2122/97
ggcggggccggcg

SEQ ID NO: 1081243 - RNA, 15 nt, Mycobacterium bovis subsp bovis AF2122/97
ggcggggccggcggc

SEQ ID NO: 1081244 - RNA, 12 nt, Mycobacterium bovis subsp bovis AF2122/97
ggcggggcgccg

SEQ ID NO: 1081245 - RNA, 17 nt, Mycobacterium bovis subsp bovis AF2122/97
ggcggggaucagcgagu

SEQ ID NO: 1081246 - RNA, 17 nt, Mycobacterium bovis subsp bovis AF2122/97
ggcgggcuuggcgucga

SEQ ID NO: 1081247 - RNA, 15 nt, Mycobacterium bovis subsp bovis AF2122/97
ggcggggacggcggc

SEQ ID NO: 1081248 - RNA, 22 nt, Mycobacterium bovis subsp bovis AF2122/97
ggcgggcaaucaccgccggcgg

SEQ ID NO: 1081249 - RNA, 14 nt, Mycobacterium bovis subsp bovis AF2122/97
ggcgggcggccgcu

SEQ ID NO: 1081250 - RNA, 13 nt, Mycobacterium bovis subsp bovis AF2122/97
ggcgggcggcagc

SEQ ID NO: 1081251 - RNA, 12 nt, Mycobacterium bovis subsp bovis AF2122/97
ggcgggcggugg

SEQ ID NO: 1081252 - RNA, 15 nt, Mycobacterium bovis subsp bovis AF2122/97
ggcgggaucgagagc

SEQ ID NO: 1081253 - RNA, 15 nt, Mycobacterium bovis subsp bovis AF2122/97
ggcgggcaccuccgc

SEQ ID NO: 1081254 - RNA, 23 nt, Mycobacterium bovis subsp bovis AF2122/97
ggcgggacccgugagcucgucga

SEQ ID NO: 1081255 - RNA, 17 nt, Mycobacterium bovis subsp bovis AF2122/97
ggcgggacaaccgggcg

SEQ ID NO: 1081256 - RNA, 14 nt, Mycobacterium bovis subsp bovis AF2122/97
ggcgggacucggcg

SEQ ID NO: 1081257 - RNA, 22 nt, Mycobacterium bovis subsp bovis AF2122/97
ggcgguccgaugcgcgcggcgc

SEQ ID NO: 1081258 - RNA, 12 nt, Mycobacterium bovis subsp bovis AF2122/97
ggcggucgauca

SEQ ID NO: 1081259 - RNA, 22 nt, Mycobacterium bovis subsp bovis AF2122/97
ggcggucgaucauggcggcagc

SEQ ID NO: 1081260 - RNA, 14 nt, Mycobacterium bovis subsp bovis AF2122/97
ggcgguccaccggc

SEQ ID NO: 1081261 - RNA, 15 nt, Mycobacterium bovis subsp bovis AF2122/97
ggcggucagcggcca

SEQ ID NO: 1081262 - RNA, 14 nt, Mycobacterium bovis subsp bovis AF2122/97
ggcggucagcggcu

SEQ ID NO: 1081263 - RNA, 19 nt, Mycobacterium bovis subsp bovis AF2122/97
ggcggucagcggcucggcg

SEQ ID NO: 1081264 - RNA, 19 nt, Mycobacterium bovis subsp bovis AF2122/97
ggcgguaugcucgcuggcg

SEQ ID NO: 1081265 - RNA, 17 nt, Mycobacterium bovis subsp bovis AF2122/97
ggcgguagccgaccagc

SEQ ID NO: 1081266 - RNA, 21 nt, Mycobacterium bovis subsp bovis AF2122/97
ggcgguaggcuugcaaggucg

SEQ ID NO: 1081267 - RNA, 14 nt, Mycobacterium bovis subsp bovis AF2122/97
ggcgguagcuuccg

SEQ ID NO: 1081268 - RNA, 23 nt, Mycobacterium bovis subsp bovis AF2122/97
ggcgguagucggccagcucgcgg

SEQ ID NO: 1081269 - RNA, 13 nt, Mycobacterium bovis subsp bovis AF2122/97
ggcggucaccacc

SEQ ID NO: 1081270 - RNA, 14 nt, Mycobacterium bovis subsp bovis AF2122/97
ggcggucaccaccg

SEQ ID NO: 1081271 - RNA, 19 nt, Mycobacterium bovis subsp bovis AF2122/97
ggcggucaccaccgacccg

SEQ ID NO: 1081272 - RNA, 15 nt, Mycobacterium bovis subsp bovis AF2122/97
ggcggucaccaccgu

SEQ ID NO: 1081273 - RNA, 19 nt, Mycobacterium bovis subsp bovis AF2122/97
ggcggucaccaccguggcg

SEQ ID NO: 1081274 - RNA, 15 nt, Mycobacterium bovis subsp bovis AF2122/97
ggcggucaccacgcg

SEQ ID NO: 1081275 - RNA, 14 nt, Mycobacterium bovis subsp bovis AF2122/97
ggcgguaccgccgc

SEQ ID NO: 1081276 - RNA, 19 nt, Mycobacterium bovis subsp bovis AF2122/97
ggcgguaccgccgcugccg

SEQ ID NO: 1081277 - RNA, 20 nt, Mycobacterium bovis subsp bovis AF2122/97
ggcgguaccgccgcugccgg

SEQ ID NO: 1081278 - RNA, 20 nt, Mycobacterium bovis subsp bovis AF2122/97
ggcgggguugaucaccgaca

SEQ ID NO: 1081279 - RNA, 22 nt, Mycobacterium bovis subsp bovis AF2122/97
ggcgguaccgggaucccacggc

SEQ ID NO: 1081280 - RNA, 22 nt, Mycobacterium bovis subsp bovis AF2122/97
ggcgguacaccgacacgccguu

SEQ ID NO: 1081281 - RNA, 20 nt, Mycobacterium bovis subsp bovis AF2122/97
ggcggguugcagacugcggc

SEQ ID NO: 1081282 - RNA, 15 nt, Mycobacterium bovis subsp bovis AF2122/97
ggcgguaacggcggu

SEQ ID NO: 1081283 - RNA, 23 nt, Mycobacterium bovis subsp bovis AF2122/97
ggcgguaaguacuagccggucgg

SEQ ID NO: 1081284 - RNA, 15 nt, Mycobacterium bovis subsp bovis AF2122/97
ggcgguaaucgcgag

SEQ ID NO: 1081285 - RNA, 22 nt, Mycobacterium bovis subsp bovis AF2122/97
ggcggucugcagugcagcgauc

SEQ ID NO: 1081286 - RNA, 20 nt, Mycobacterium bovis subsp bovis AF2122/97
ggcggucgcuauccggcggc

SEQ ID NO: 1081287 - RNA, 16 nt, Mycobacterium bovis subsp bovis AF2122/97
ggcggucgccacaccc

SEQ ID NO: 1081288 - RNA, 17 nt, Mycobacterium bovis subsp bovis AF2122/97
ggcggucuguaagacag

SEQ ID NO: 1081289 - RNA, 19 nt, Mycobacterium bovis subsp bovis AF2122/97
ggcggucuuggcgcgccca

SEQ ID NO: 1081290 - RNA, 17 nt, Mycobacterium bovis subsp bovis AF2122/97
ggcggugaacaccgccu

SEQ ID NO: 1081291 - RNA, 16 nt, Mycobacterium bovis subsp bovis AF2122/97
ggcggugaagugggcg

SEQ ID NO: 1081292 - RNA, 23 nt, Mycobacterium bovis subsp bovis AF2122/97
ggcggugaagugggcguuggcgg

SEQ ID NO: 1081293 - RNA, 15 nt, Mycobacterium bovis subsp bovis AF2122/97
ggcggugcagaucgg

SEQ ID NO: 1081294 - RNA, 15 nt, Mycobacterium bovis subsp bovis AF2122/97
ggcggugaugguggc

SEQ ID NO: 1081295 - RNA, 14 nt, Mycobacterium bovis subsp bovis AF2122/97
ggcggugcacaccg

SEQ ID NO: 1081296 - RNA, 19 nt, Mycobacterium bovis subsp bovis AF2122/97
ggcggugcacaccgucgca

SEQ ID NO: 1081297 - RNA, 18 nt, Mycobacterium bovis subsp bovis AF2122/97
ggcggugacggcggcaac

SEQ ID NO: 1081298 - RNA, 16 nt, Mycobacterium bovis subsp bovis AF2122/97
ggcggugccgucgccg

SEQ ID NO: 1081299 - RNA, 18 nt, Mycobacterium bovis subsp bovis AF2122/97
ggcggugccgugcucacg

SEQ ID NO: 1081300 - RNA, 13 nt, Mycobacterium bovis subsp bovis AF2122/97
ggcggugcgcacc

SEQ ID NO: 1081301 - RNA, 15 nt, Mycobacterium bovis subsp bovis AF2122/97
ggcggugcgcaccac

SEQ ID NO: 1081302 - RNA, 17 nt, Mycobacterium bovis subsp bovis AF2122/97
ggcggugcgcaccaccg

SEQ ID NO: 1081303 - RNA, 18 nt, Mycobacterium bovis subsp bovis AF2122/97
ggcggugcgcaccaccga

SEQ ID NO: 1081304 - RNA, 17 nt, Mycobacterium bovis subsp bovis AF2122/97
ggcggugccgguagcgg

SEQ ID NO: 1081305 - RNA, 18 nt, Mycobacterium bovis subsp bovis AF2122/97
ggcggugccgguggugac

SEQ ID NO: 1081306 - RNA, 15 nt, Mycobacterium bovis subsp bovis AF2122/97
ggcggugccgucagc

SEQ ID NO: 1081307 - RNA, 18 nt, Mycobacterium bovis subsp bovis AF2122/97
ggcggugccacgaucggc

SEQ ID NO: 1081308 - RNA, 12 nt, Mycobacterium bovis subsp bovis AF2122/97
ggcggugccacc

SEQ ID NO: 1081309 - RNA, 14 nt, Mycobacterium bovis subsp bovis AF2122/97
ggcggugccgacgg

SEQ ID NO: 1081310 - RNA, 20 nt, Mycobacterium bovis subsp bovis AF2122/97
ggcgguggccacccggccgc

SEQ ID NO: 1081311 - RNA, 16 nt, Mycobacterium bovis subsp bovis AF2122/97
ggcggugcgcagcuug

SEQ ID NO: 1081312 - RNA, 13 nt, Mycobacterium bovis subsp bovis AF2122/97
ggcgguggucccg

SEQ ID NO: 1081313 - RNA, 14 nt, Mycobacterium bovis subsp bovis AF2122/97
ggcgguggccgucg

SEQ ID NO: 1081314 - RNA, 14 nt, Mycobacterium bovis subsp bovis AF2122/97
ggcggugucggcgc

SEQ ID NO: 1081315 - RNA, 15 nt, Mycobacterium bovis subsp bovis AF2122/97
ggcggugucgucgag

SEQ ID NO: 1081316 - RNA, 23 nt, Mycobacterium bovis subsp bovis AF2122/97
ggcgguguugcucccggccgccg

SEQ ID NO: 1081317 - RNA, 13 nt, Mycobacterium bovis subsp bovis AF2122/97
ggcggugucggcg

SEQ ID NO: 1081318 - RNA, 21 nt, Mycobacterium bovis subsp bovis AF2122/97
ggcgguggugccgcggccacc

SEQ ID NO: 1081319 - RNA, 14 nt, Mycobacterium bovis subsp bovis AF2122/97
ggcggugguguagc

SEQ ID NO: 1081320 - RNA, 20 nt, Mycobacterium bovis subsp bovis AF2122/97
ggcgguggugucgcucgcga

SEQ ID NO: 1081321 - RNA, 14 nt, Mycobacterium bovis subsp bovis AF2122/97
ggcgguggucccga

SEQ ID NO: 1081322 - RNA, 16 nt, Mycobacterium bovis subsp bovis AF2122/97
ggcguaccuucgagcg

SEQ ID NO: 1081323 - RNA, 17 nt, Mycobacterium bovis subsp bovis AF2122/97
ggcguacucggcgcgca

SEQ ID NO: 1081324 - RNA, 19 nt, Mycobacterium bovis subsp bovis AF2122/97
ggcguacucggcgcgcagc

SEQ ID NO: 1081325 - RNA, 16 nt, Mycobacterium bovis subsp bovis AF2122/97
ggcguagacguccgcg

SEQ ID NO: 1081326 - RNA, 18 nt, Mycobacterium bovis subsp bovis AF2122/97
ggcguagacguccgcggu

SEQ ID NO: 1081327 - RNA, 21 nt, Mycobacterium bovis subsp bovis AF2122/97
ggcguagacguccgcggucgc

SEQ ID NO: 1081328 - RNA, 13 nt, Mycobacterium bovis subsp bovis AF2122/97
ggcguagaugcgc

SEQ ID NO: 1081329 - RNA, 17 nt, Mycobacterium bovis subsp bovis AF2122/97
ggcguagaugcgcccgg

SEQ ID NO: 1081330 - RNA, 17 nt, Mycobacterium bovis subsp bovis AF2122/97
ggcguagcagaaggccg

SEQ ID NO: 1081331 - RNA, 21 nt, Mycobacterium bovis subsp bovis AF2122/97
ggcguagcccaugccgaugcc

SEQ ID NO: 1081332 - RNA, 13 nt, Mycobacterium bovis subsp bovis AF2122/97
ggcguaggcgaug

SEQ ID NO: 1081333 - RNA, 22 nt, Mycobacterium bovis subsp bovis AF2122/97
ggcguaggcaggaucgccugag

SEQ ID NO: 1081334 - RNA, 14 nt, Mycobacterium bovis subsp bovis AF2122/97
ggcguagugcagcu

SEQ ID NO: 1081335 - RNA, 16 nt, Mycobacterium bovis subsp bovis AF2122/97
ggcgguugaucgccgg

SEQ ID NO: 1081336 - RNA, 17 nt, Mycobacterium bovis subsp bovis AF2122/97
ggcgguuccggccggcu

SEQ ID NO: 1081337 - RNA, 15 nt, Mycobacterium bovis subsp bovis AF2122/97
ggcgguugaucgccg

SEQ ID NO: 1081338 - RNA, 15 nt, Mycobacterium bovis subsp bovis AF2122/97
ggcgguuggugcagc

SEQ ID NO: 1081339 - RNA, 22 nt, Mycobacterium bovis subsp bovis AF2122/97
ggcgguugccccgaccgccgug

SEQ ID NO: 1081340 - RNA, 21 nt, Mycobacterium bovis subsp bovis AF2122/97
ggcguaaucgggaaguacggc

SEQ ID NO: 1081341 - RNA, 18 nt, Mycobacterium bovis subsp bovis AF2122/97
ggcgcgcgcaacgcugga

SEQ ID NO: 1081342 - RNA, 20 nt, Mycobacterium bovis subsp bovis AF2122/97
ggcgcgcgcaacgcuggagg

SEQ ID NO: 1081343 - RNA, 13 nt, Mycobacterium bovis subsp bovis AF2122/97
ggcgcgcgcccgg

SEQ ID NO: 1081344 - RNA, 14 nt, Mycobacterium bovis subsp bovis AF2122/97
ggcgcggcacccgg

SEQ ID NO: 1081345 - RNA, 19 nt, Mycobacterium bovis subsp bovis AF2122/97
ggcgcggcacccggucggc

SEQ ID NO: 1081346 - RNA, 21 nt, Mycobacterium bovis subsp bovis AF2122/97
ggcgcggcacccggucggcca

SEQ ID NO: 1081347 - RNA, 14 nt, Mycobacterium bovis subsp bovis AF2122/97
ggcgcggccgcagc

SEQ ID NO: 1081348 - RNA, 15 nt, Mycobacterium bovis subsp bovis AF2122/97
ggcgcggcgacaagc

SEQ ID NO: 1081349 - RNA, 16 nt, Mycobacterium bovis subsp bovis AF2122/97
ggcgcggcgagcacgc

SEQ ID NO: 1081350 - RNA, 22 nt, Mycobacterium bovis subsp bovis AF2122/97
ggcgcggcgagcacgcgggcac

SEQ ID NO: 1081351 - RNA, 17 nt, Mycobacterium bovis subsp bovis AF2122/97
ggcgcguccgggcucgc

SEQ ID NO: 1081352 - RNA, 23 nt, Mycobacterium bovis subsp bovis AF2122/97
ggcgcguccgggcucgcgcucga

SEQ ID NO: 1081353 - RNA, 17 nt, Mycobacterium bovis subsp bovis AF2122/97
ggcgcguccucgccgca

SEQ ID NO: 1081354 - RNA, 22 nt, Mycobacterium bovis subsp bovis AF2122/97
ggcgcguccucgccgcacgccg

SEQ ID NO: 1081355 - RNA, 16 nt, Mycobacterium bovis subsp bovis AF2122/97
ggcgcggcggcgucga

SEQ ID NO: 1081356 - RNA, 22 nt, Mycobacterium bovis subsp bovis AF2122/97
ggcgcggcggcgucgagggagc

SEQ ID NO: 1081357 - RNA, 20 nt, Mycobacterium bovis subsp bovis AF2122/97
ggcgcggcggaccguccgac

SEQ ID NO: 1081358 - RNA, 18 nt, Mycobacterium bovis subsp bovis AF2122/97
ggcgcguggaaaccggug

SEQ ID NO: 1081359 - RNA, 14 nt, Mycobacterium bovis subsp bovis AF2122/97
ggcgcgucggcacc

SEQ ID NO: 1081360 - RNA, 23 nt, Mycobacterium bovis subsp bovis AF2122/97
aagguccgugccgaugccggcga

SEQ ID NO: 1081361 - RNA, 22 nt, Mycobacterium bovis subsp bovis AF2122/97
aaggucgacggaaucgucggcg

SEQ ID NO: 1081362 - RNA, 24 nt, Mycobacterium bovis subsp bovis AF2122/97
ggcgcuagccagggaucagccgug

SEQ ID NO: 1081363 - RNA, 18 nt, Mycobacterium bovis subsp bovis AF2122/97
ggcgcuagcgccgcgcuu

SEQ ID NO: 1081364 - RNA, 21 nt, Mycobacterium bovis subsp bovis AF2122/97
aaggugacgacgagggcggga

SEQ ID NO: 1081365 - RNA, 19 nt, Mycobacterium bovis subsp bovis AF2122/97
aaggucuucaggccgcgca

SEQ ID NO: 1081366 - RNA, 14 nt, Mycobacterium bovis subsp bovis AF2122/97
aaggucgcggucga

SEQ ID NO: 1081367 - RNA, 23 nt, Mycobacterium bovis subsp bovis AF2122/97
aaggugcaccauuguuccguccc

SEQ ID NO: 1081368 - RNA, 22 nt, Mycobacterium bovis subsp bovis AF2122/97
aagguguggugacagagcgggu

SEQ ID NO: 1081369 - RNA, 12 nt, Mycobacterium bovis subsp bovis AF2122/97
ggcgcucagcgc

SEQ ID NO: 1081370 - RNA, 15 nt, Mycobacterium bovis subsp bovis AF2122/97
ggcgccgucguugug

SEQ ID NO: 1081371 - RNA, 24 nt, Mycobacterium bovis subsp bovis AF2122/97
ggcgccgucguugugccggucgau

SEQ ID NO: 1081372 - RNA, 16 nt, Mycobacterium bovis subsp bovis AF2122/97
ggcgccgucggccgag

SEQ ID NO: 1081373 - RNA, 15 nt, Mycobacterium bovis subsp bovis AF2122/97
ggcgccguugccacc

SEQ ID NO: 1081374 - RNA, 17 nt, Mycobacterium bovis subsp bovis AF2122/97
ggcgccguugccggcgu

SEQ ID NO: 1081375 - RNA, 20 nt, Mycobacterium bovis subsp bovis AF2122/97
ggcgccguugccggcguugc

SEQ ID NO: 1081376 - RNA, 17 nt, Mycobacterium bovis subsp bovis AF2122/97
ggcgccguugucggcgg

SEQ ID NO: 1081377 - RNA, 14 nt, Mycobacterium bovis subsp bovis AF2122/97
ggcgccuacaccgg

SEQ ID NO: 1081378 - RNA, 17 nt, Mycobacterium bovis subsp bovis AF2122/97
ggcgccuacaccggcgc

SEQ ID NO: 1081379 - RNA, 19 nt, Mycobacterium bovis subsp bovis AF2122/97
ggcgccuacaccggcgcuc

SEQ ID NO: 1081380 - RNA, 17 nt, Mycobacterium bovis subsp bovis AF2122/97
ggcgccguuagcgucgc

SEQ ID NO: 1081381 - RNA, 17 nt, Mycobacterium bovis subsp bovis AF2122/97
ggcgccgucucgaucgc

SEQ ID NO: 1081382 - RNA, 18 nt, Mycobacterium bovis subsp bovis AF2122/97
ggcgccgucucgaucgcg

SEQ ID NO: 1081383 - RNA, 18 nt, Mycobacterium bovis subsp bovis AF2122/97
ggcgccgucucgcggugc

SEQ ID NO: 1081384 - RNA, 17 nt, Mycobacterium bovis subsp bovis AF2122/97
ggcgccuccgcucggua

SEQ ID NO: 1081385 - RNA, 15 nt, Mycobacterium bovis subsp bovis AF2122/97
ggcgccuccggcacc

SEQ ID NO: 1081386 - RNA, 20 nt, Mycobacterium bovis subsp bovis AF2122/97
ggcgccucaucggacagcgc

SEQ ID NO: 1081387 - RNA, 20 nt, Mycobacterium bovis subsp bovis AF2122/97
ggcgcgacguagacgacguc

SEQ ID NO: 1081388 - RNA, 16 nt, Mycobacterium bovis subsp bovis AF2122/97
ggcgcgagcagacgca

SEQ ID NO: 1081389 - RNA, 19 nt, Mycobacterium bovis subsp bovis AF2122/97
ggcgccggccucgccgggg

SEQ ID NO: 1081390 - RNA, 21 nt, Mycobacterium bovis subsp bovis AF2122/97
ggcgcgagccggcucagacga

SEQ ID NO: 1081391 - RNA, 16 nt, Mycobacterium bovis subsp bovis AF2122/97
ggcgcgaggaacgccg

SEQ ID NO: 1081392 - RNA, 15 nt, Mycobacterium bovis subsp bovis AF2122/97
ggcgcgaggacgcug

SEQ ID NO: 1081393 - RNA, 20 nt, Mycobacterium bovis subsp bovis AF2122/97
ggcgcgaucggugccgaagc

SEQ ID NO: 1081394 - RNA, 14 nt, Mycobacterium bovis subsp bovis AF2122/97
ggcgcgaucgacgc

SEQ ID NO: 1081395 - RNA, 13 nt, Mycobacterium bovis subsp bovis AF2122/97
ggcgcgaucgcgc

SEQ ID NO: 1081396 - RNA, 21 nt, Mycobacterium bovis subsp bovis AF2122/97
ggcgcgaucagguaccggcgg

SEQ ID NO: 1081397 - RNA, 22 nt, Mycobacterium bovis subsp bovis AF2122/97
ggcgcgcaagugcuggccgaag

SEQ ID NO: 1081398 - RNA, 17 nt, Mycobacterium bovis subsp bovis AF2122/97
ggcgcgcaccaccgcgg

SEQ ID NO: 1081399 - RNA, 20 nt, Mycobacterium bovis subsp bovis AF2122/97
ggcgcgcaccaccgcggcgg

SEQ ID NO: 1081400 - RNA, 14 nt, Mycobacterium bovis subsp bovis AF2122/97
ggcgcgcagccggg

SEQ ID NO: 1081401 - RNA, 18 nt, Mycobacterium bovis subsp bovis AF2122/97
ggcgcgcagccgggccaa

SEQ ID NO: 1081402 - RNA, 17 nt, Mycobacterium bovis subsp bovis AF2122/97
ggcgcgcagcgauucgc

SEQ ID NO: 1081403 - RNA, 21 nt, Mycobacterium bovis subsp bovis AF2122/97
ggcgcgcagcgauucgccuag

SEQ ID NO: 1081404 - RNA, 14 nt, Mycobacterium bovis subsp bovis AF2122/97
ggcgcgcagcuugg

SEQ ID NO: 1081405 - RNA, 23 nt, Mycobacterium bovis subsp bovis AF2122/97
ggcgcgcagcuuggacaccagua

SEQ ID NO: 1081406 - RNA, 15 nt, Mycobacterium bovis subsp bovis AF2122/97
ggcgcgcaucugcuc

SEQ ID NO: 1081407 - RNA, 14 nt, Mycobacterium bovis subsp bovis AF2122/97
ggcgcgccggucgc

SEQ ID NO: 1081408 - RNA, 18 nt, Mycobacterium bovis subsp bovis AF2122/97
ggcgcgccggucgccgac

SEQ ID NO: 1081409 - RNA, 20 nt, Mycobacterium bovis subsp bovis AF2122/97
ggcgcgccggucgccgacgg

SEQ ID NO: 1081410 - RNA, 22 nt, Mycobacterium bovis subsp bovis AF2122/97
ggcgcgccggucgccgacggcg

SEQ ID NO: 1081411 - RNA, 22 nt, Mycobacterium bovis subsp bovis AF2122/97
ggcgcgccguacguucaccacc

SEQ ID NO: 1081412 - RNA, 22 nt, Mycobacterium bovis subsp bovis AF2122/97
ggcgcgccguucugaucugcgc

SEQ ID NO: 1081413 - RNA, 12 nt, Mycobacterium bovis subsp bovis AF2122/97
ggcgcgccgacc

SEQ ID NO: 1081414 - RNA, 17 nt, Mycobacterium bovis subsp bovis AF2122/97
ggcgcgccugugccacc

SEQ ID NO: 1081415 - RNA, 21 nt, Mycobacterium bovis subsp bovis AF2122/97
ggcgcgcccggaucucggcgu

SEQ ID NO: 1081416 - RNA, 13 nt, Mycobacterium bovis subsp bovis AF2122/97
ggcgcgccgcacc

SEQ ID NO: 1081417 - RNA, 18 nt, Mycobacterium bovis subsp bovis AF2122/97
ggcgcgccgaguugcccg

SEQ ID NO: 1081418 - RNA, 21 nt, Mycobacterium bovis subsp bovis AF2122/97
ggcgcgccgaugaacguggcg

SEQ ID NO: 1081419 - RNA, 17 nt, Mycobacterium bovis subsp bovis AF2122/97
ggcgcccuugccggcga

SEQ ID NO: 1081420 - RNA, 22 nt, Mycobacterium bovis subsp bovis AF2122/97
ggcgcccuuaagccggcgcggc

SEQ ID NO: 1081421 - RNA, 19 nt, Mycobacterium bovis subsp bovis AF2122/97
ggcgcccugcgccacaccc

SEQ ID NO: 1081422 - RNA, 13 nt, Mycobacterium bovis subsp bovis AF2122/97
ggcgccgaaguag

SEQ ID NO: 1081423 - RNA, 17 nt, Mycobacterium bovis subsp bovis AF2122/97
ggcgccgaacccggugu

SEQ ID NO: 1081424 - RNA, 14 nt, Mycobacterium bovis subsp bovis AF2122/97
ggcgccgcagcgcu

SEQ ID NO: 1081425 - RNA, 20 nt, Mycobacterium bovis subsp bovis AF2122/97
ggcgccgcaccaagcagcga

SEQ ID NO: 1081426 - RNA, 24 nt, Mycobacterium bovis subsp bovis AF2122/97
ggcgccgcaccaagcagcgaccag

SEQ ID NO: 1081427 - RNA, 15 nt, Mycobacterium bovis subsp bovis AF2122/97
ggcgccgacaccggc

SEQ ID NO: 1081428 - RNA, 16 nt, Mycobacterium bovis subsp bovis AF2122/97
ggcgccgacaccggcu

SEQ ID NO: 1081429 - RNA, 20 nt, Mycobacterium bovis subsp bovis AF2122/97
ggcgccgacaccggcugacc

SEQ ID NO: 1081430 - RNA, 21 nt, Mycobacterium bovis subsp bovis AF2122/97
ggcgccgcaaucagacggcga

SEQ ID NO: 1081431 - RNA, 19 nt, Mycobacterium bovis subsp bovis AF2122/97
ggcgccgaccacauuccgc

SEQ ID NO: 1081432 - RNA, 21 nt, Mycobacterium bovis subsp bovis AF2122/97
ggcgccgccacugccggcagc

SEQ ID NO: 1081433 - RNA, 13 nt, Mycobacterium bovis subsp bovis AF2122/97
ggcgccgcccgcg

SEQ ID NO: 1081434 - RNA, 14 nt, Mycobacterium bovis subsp bovis AF2122/97
ggcgccgcccgcgc

SEQ ID NO: 1081435 - RNA, 16 nt, Mycobacterium bovis subsp bovis AF2122/97
ggcgccgcccgcgcca

SEQ ID NO: 1081436 - RNA, 16 nt, Mycobacterium bovis subsp bovis AF2122/97
ggcgccgcccgcgccg

SEQ ID NO: 1081437 - RNA, 13 nt, Mycobacterium bovis subsp bovis AF2122/97
ggcgccgccagca

SEQ ID NO: 1081438 - RNA, 19 nt, Mycobacterium bovis subsp bovis AF2122/97
ggcgccgccagcaccaccg

SEQ ID NO: 1081439 - RNA, 11 nt, Mycobacterium bovis subsp bovis AF2122/97
ggcgccgccca

SEQ ID NO: 1081440 - RNA, 13 nt, Mycobacterium bovis subsp bovis AF2122/97
ggcgccgcccaac

SEQ ID NO: 1081441 - RNA, 16 nt, Mycobacterium bovis subsp bovis AF2122/97
ggcgccgccgaucccg

SEQ ID NO: 1081442 - RNA, 15 nt, Mycobacterium bovis subsp bovis AF2122/97
ggcgccgccggcacc

SEQ ID NO: 1081443 - RNA, 21 nt, Mycobacterium bovis subsp bovis AF2122/97
ggcgccgccggcacccgccgu

SEQ ID NO: 1081444 - RNA, 17 nt, Mycobacterium bovis subsp bovis AF2122/97
ggcgccgccggcaccgc

SEQ ID NO: 1081445 - RNA, 14 nt, Mycobacterium bovis subsp bovis AF2122/97
ggcgccgccggcgc

SEQ ID NO: 1081446 - RNA, 13 nt, Mycobacterium bovis subsp bovis AF2122/97
ggcgccggccggc

SEQ ID NO: 1081447 - RNA, 14 nt, Mycobacterium bovis subsp bovis AF2122/97
ggcgccggccggca

SEQ ID NO: 1081448 - RNA, 15 nt, Mycobacterium bovis subsp bovis AF2122/97
ggcgccggccggcag

SEQ ID NO: 1081449 - RNA, 14 nt, Mycobacterium bovis subsp bovis AF2122/97
ggcgccggccggcg

SEQ ID NO: 1081450 - RNA, 12 nt, Mycobacterium bovis subsp bovis AF2122/97
ggcgccggcgcc

SEQ ID NO: 1081451 - RNA, 15 nt, Mycobacterium bovis subsp bovis AF2122/97
ggcgccggcguccgg

SEQ ID NO: 1081452 - RNA, 14 nt, Mycobacterium bovis subsp bovis AF2122/97
ggcgccggcgucgg

SEQ ID NO: 1081453 - RNA, 12 nt, Mycobacterium bovis subsp bovis AF2122/97
ggcgccggcguc

SEQ ID NO: 1081454 - RNA, 16 nt, Mycobacterium bovis subsp bovis AF2122/97
ggcgccggcggccgcg

SEQ ID NO: 1081455 - RNA, 16 nt, Mycobacterium bovis subsp bovis AF2122/97
ggcgcccgccccgcgc

SEQ ID NO: 1081456 - RNA, 14 nt, Mycobacterium bovis subsp bovis AF2122/97
ggcgcccgcccgag

SEQ ID NO: 1081457 - RNA, 15 nt, Mycobacterium bovis subsp bovis AF2122/97
ggcgcccgcccgagc

SEQ ID NO: 1081458 - RNA, 13 nt, Mycobacterium bovis subsp bovis AF2122/97
ggcgcccgcguga

SEQ ID NO: 1081459 - RNA, 16 nt, Mycobacterium bovis subsp bovis AF2122/97
ggcgcccgccggcaac

SEQ ID NO: 1081460 - RNA, 22 nt, Mycobacterium bovis subsp bovis AF2122/97
ggcgcccgcucggccgcagcca

SEQ ID NO: 1081461 - RNA, 23 nt, Mycobacterium bovis subsp bovis AF2122/97
ggcgcccgcucggccgcagccag

SEQ ID NO: 1081462 - RNA, 21 nt, Mycobacterium bovis subsp bovis AF2122/97
ggcgcccgcguggccggucac

SEQ ID NO: 1081463 - RNA, 17 nt, Mycobacterium bovis subsp bovis AF2122/97
ggcgcccgucuccagca

SEQ ID NO: 1081464 - RNA, 13 nt, Mycobacterium bovis subsp bovis AF2122/97
ggcgcccgugccg

SEQ ID NO: 1081465 - RNA, 20 nt, Mycobacterium bovis subsp bovis AF2122/97
ggcgcccgugccgcccgcgc

SEQ ID NO: 1081466 - RNA, 13 nt, Mycobacterium bovis subsp bovis AF2122/97
ggcgcccggucga

SEQ ID NO: 1081467 - RNA, 16 nt, Mycobacterium bovis subsp bovis AF2122/97
ggcgcccggucgagcc

SEQ ID NO: 1081468 - RNA, 13 nt, Mycobacterium bovis subsp bovis AF2122/97
ggcgcccggcgga

SEQ ID NO: 1081469 - RNA, 14 nt, Mycobacterium bovis subsp bovis AF2122/97
ggcgcccggcggau

SEQ ID NO: 1081470 - RNA, 23 nt, Mycobacterium bovis subsp bovis AF2122/97
ggcgccacugaccgcgaucgccg

SEQ ID NO: 1081471 - RNA, 17 nt, Mycobacterium bovis subsp bovis AF2122/97
ggcgccagaucgacgcc

SEQ ID NO: 1081472 - RNA, 22 nt, Mycobacterium bovis subsp bovis AF2122/97
ggcgccagaugccucggagauc

SEQ ID NO: 1081473 - RNA, 14 nt, Mycobacterium bovis subsp bovis AF2122/97
ggcgccagccgacc

SEQ ID NO: 1081474 - RNA, 14 nt, Mycobacterium bovis subsp bovis AF2122/97
ggcgccagcgccgc

SEQ ID NO: 1081475 - RNA, 16 nt, Mycobacterium bovis subsp bovis AF2122/97
ggcgccagcgccgcca

SEQ ID NO: 1081476 - RNA, 19 nt, Mycobacterium bovis subsp bovis AF2122/97
ggcgccacggcagcgccca

SEQ ID NO: 1081477 - RNA, 15 nt, Mycobacterium bovis subsp bovis AF2122/97
ggcgccacugaccgc

SEQ ID NO: 1081478 - RNA, 19 nt, Mycobacterium bovis subsp bovis AF2122/97
ggcgccacugaccgcgauc

SEQ ID NO: 1081479 - RNA, 14 nt, Mycobacterium bovis subsp bovis AF2122/97
ggcgccacggguga

SEQ ID NO: 1081480 - RNA, 20 nt, Mycobacterium bovis subsp bovis AF2122/97
ggcgccacgggugacucggg

SEQ ID NO: 1081481 - RNA, 16 nt, Mycobacterium bovis subsp bovis AF2122/97
ggcgccaccagucacg

SEQ ID NO: 1081482 - RNA, 17 nt, Mycobacterium bovis subsp bovis AF2122/97
ggcgccaccaucgggga

SEQ ID NO: 1081483 - RNA, 15 nt, Mycobacterium bovis subsp bovis AF2122/97
ggcgccacccgcgcc

SEQ ID NO: 1081484 - RNA, 19 nt, Mycobacterium bovis subsp bovis AF2122/97
ggcgccacccccaccgucg

SEQ ID NO: 1081485 - RNA, 18 nt, Mycobacterium bovis subsp bovis AF2122/97
ggcgccaccgucgccgua

SEQ ID NO: 1081486 - RNA, 20 nt, Mycobacterium bovis subsp bovis AF2122/97
ggcgccaccgccgcugccgg

SEQ ID NO: 1081487 - RNA, 19 nt, Mycobacterium bovis subsp bovis AF2122/97
ggcgcagcgugagugcagc

SEQ ID NO: 1081488 - RNA, 21 nt, Mycobacterium bovis subsp bovis AF2122/97
ggcgcacaacccgucgagccg

SEQ ID NO: 1081489 - RNA, 14 nt, Mycobacterium bovis subsp bovis AF2122/97
ggcgcacagcgagc

SEQ ID NO: 1081490 - RNA, 20 nt, Mycobacterium bovis subsp bovis AF2122/97
ggcgcagcugguagcgcacc

SEQ ID NO: 1081491 - RNA, 20 nt, Mycobacterium bovis subsp bovis AF2122/97
ggcgcagcugguuugcggug

SEQ ID NO: 1081492 - RNA, 21 nt, Mycobacterium bovis subsp bovis AF2122/97
ggcgcagcgugagugcagcac

SEQ ID NO: 1081493 - RNA, 17 nt, Mycobacterium bovis subsp bovis AF2122/97
ggcgcagcuaacccgcc

SEQ ID NO: 1081494 - RNA, 23 nt, Mycobacterium bovis subsp bovis AF2122/97
ggcgcagcucaccgacggagauc

SEQ ID NO: 1081495 - RNA, 18 nt, Mycobacterium bovis subsp bovis AF2122/97
ggcgcauaccggcgucgu

SEQ ID NO: 1081496 - RNA, 12 nt, Mycobacterium bovis subsp bovis AF2122/97
ggcgccaccacc

SEQ ID NO: 1081497 - RNA, 17 nt, Mycobacterium bovis subsp bovis AF2122/97
ggcgccaccacccggcg

SEQ ID NO: 1081498 - RNA, 16 nt, Mycobacterium bovis subsp bovis AF2122/97
ggcgcaguagaugccg

SEQ ID NO: 1081499 - RNA, 18 nt, Mycobacterium bovis subsp bovis AF2122/97
ggcgcaguuggcaccagc

SEQ ID NO: 1081500 - RNA, 21 nt, Mycobacterium bovis subsp bovis AF2122/97
ggcgcaguuggcaccagccgg

SEQ ID NO: 1081501 - RNA, 20 nt, Mycobacterium bovis subsp bovis AF2122/97
ggcgcagguucucggugccg

SEQ ID NO: 1081502 - RNA, 21 nt, Mycobacterium bovis subsp bovis AF2122/97
ggcgagcgcaucggccaacac

SEQ ID NO: 1081503 - RNA, 21 nt, Mycobacterium bovis subsp bovis AF2122/97
ggcgagcggccuccagcaccc

SEQ ID NO: 1081504 - RNA, 24 nt, Mycobacterium bovis subsp bovis AF2122/97
ggcgagcggccuccagcacccggu

SEQ ID NO: 1081505 - RNA, 13 nt, Mycobacterium bovis subsp bovis AF2122/97
ggcgagccggcgc

SEQ ID NO: 1081506 - RNA, 14 nt, Mycobacterium bovis subsp bovis AF2122/97
ggcgagccgccacc

SEQ ID NO: 1081507 - RNA, 20 nt, Mycobacterium bovis subsp bovis AF2122/97
ggcgagcagacgcaaaagcc

SEQ ID NO: 1081508 - RNA, 20 nt, Mycobacterium bovis subsp bovis AF2122/97
ggcgagcucggccccgccgc

SEQ ID NO: 1081509 - RNA, 21 nt, Mycobacterium bovis subsp bovis AF2122/97
ggcgagcucggccccgccgcc

SEQ ID NO: 1081510 - RNA, 14 nt, Mycobacterium bovis subsp bovis AF2122/97
ggcgagcucgucga

SEQ ID NO: 1081511 - RNA, 20 nt, Mycobacterium bovis subsp bovis AF2122/97
ggcgagcgcggccugcacca

SEQ ID NO: 1081512 - RNA, 17 nt, Mycobacterium bovis subsp bovis AF2122/97
ggcgagcuggcguuccc

SEQ ID NO: 1081513 - RNA, 18 nt, Mycobacterium bovis subsp bovis AF2122/97
aagggcuugucgccggca

SEQ ID NO: 1081514 - RNA, 22 nt, Mycobacterium bovis subsp bovis AF2122/97
aagggauccgaagagccagcaa

SEQ ID NO: 1081515 - RNA, 14 nt, Mycobacterium bovis subsp bovis AF2122/97
aagggccgccucgc

SEQ ID NO: 1081516 - RNA, 17 nt, Mycobacterium bovis subsp bovis AF2122/97
ggcgcaacgagagcggc

SEQ ID NO: 1081517 - RNA, 21 nt, Mycobacterium bovis subsp bovis AF2122/97
ggcgcaacgagagcggcuccg

SEQ ID NO: 1081518 - RNA, 17 nt, Mycobacterium bovis subsp bovis AF2122/97
ggcgcaagaaugccgcc

SEQ ID NO: 1081519 - RNA, 22 nt, Mycobacterium bovis subsp bovis AF2122/97
ggcgcaagaaugccgccgacgg

SEQ ID NO: 1081520 - RNA, 15 nt, Mycobacterium bovis subsp bovis AF2122/97
ggcgcaagcagcccg

SEQ ID NO: 1081521 - RNA, 18 nt, Mycobacterium bovis subsp bovis AF2122/97
ggcgcaagcgccgcgcuu

SEQ ID NO: 1081522 - RNA, 14 nt, Mycobacterium bovis subsp bovis AF2122/97
ggccgccagccggc

SEQ ID NO: 1081523 - RNA, 15 nt, Mycobacterium bovis subsp bovis AF2122/97
ggccgccagccggcg

SEQ ID NO: 1081524 - RNA, 16 nt, Mycobacterium bovis subsp bovis AF2122/97
ggccgccagccggcgc

SEQ ID NO: 1081525 - RNA, 17 nt, Mycobacterium bovis subsp bovis AF2122/97
ggccgccagccggcgca

SEQ ID NO: 1081526 - RNA, 17 nt, Mycobacterium bovis subsp bovis AF2122/97
ggccgccagccccaccc

SEQ ID NO: 1081527 - RNA, 21 nt, Mycobacterium bovis subsp bovis AF2122/97
ggccgccagccccacccgcau

SEQ ID NO: 1081528 - RNA, 14 nt, Mycobacterium bovis subsp bovis AF2122/97
ggccgccagcgcgc

SEQ ID NO: 1081529 - RNA, 14 nt, Mycobacterium bovis subsp bovis AF2122/97
ggccgccagcggag

SEQ ID NO: 1081530 - RNA, 13 nt, Mycobacterium bovis subsp bovis AF2122/97
ggccgccagcggc

SEQ ID NO: 1081531 - RNA, 15 nt, Mycobacterium bovis subsp bovis AF2122/97
ggccgccagcugcgc

SEQ ID NO: 1081532 - RNA, 14 nt, Mycobacterium bovis subsp bovis AF2122/97
ggccgccagcggcg

SEQ ID NO: 1081533 - RNA, 14 nt, Mycobacterium bovis subsp bovis AF2122/97
ggccgccaggcggc

SEQ ID NO: 1081534 - RNA, 20 nt, Mycobacterium bovis subsp bovis AF2122/97
ggccgccaguccgaucgccg

SEQ ID NO: 1081535 - RNA, 18 nt, Mycobacterium bovis subsp bovis AF2122/97
ggccgccaguucggcguc

SEQ ID NO: 1081536 - RNA, 19 nt, Mycobacterium bovis subsp bovis AF2122/97
ggccgcccagaccgccgac

SEQ ID NO: 1081537 - RNA, 22 nt, Mycobacterium bovis subsp bovis AF2122/97
ggccgcccagaccgccgacgcc

SEQ ID NO: 1081538 - RNA, 21 nt, Mycobacterium bovis subsp bovis AF2122/97
ggccgccaugaaaucacccau

SEQ ID NO: 1081539 - RNA, 16 nt, Mycobacterium bovis subsp bovis AF2122/97
ggccgccccggccgcu

SEQ ID NO: 1081540 - RNA, 20 nt, Mycobacterium bovis subsp bovis AF2122/97
ggccgccccggccgcuggcg

SEQ ID NO: 1081541 - RNA, 14 nt, Mycobacterium bovis subsp bovis AF2122/97
ggccgcccgcucga

SEQ ID NO: 1081542 - RNA, 17 nt, Mycobacterium bovis subsp bovis AF2122/97
ggccgcccgcugcggcg

SEQ ID NO: 1081543 - RNA, 18 nt, Mycobacterium bovis subsp bovis AF2122/97
ggccgcccgcugcggcgg

SEQ ID NO: 1081544 - RNA, 20 nt, Mycobacterium bovis subsp bovis AF2122/97
ggccgcccgcuccaacaccc

SEQ ID NO: 1081545 - RNA, 13 nt, Mycobacterium bovis subsp bovis AF2122/97
ggccgcccggcga

SEQ ID NO: 1081546 - RNA, 15 nt, Mycobacterium bovis subsp bovis AF2122/97
ggccgcccggcgagc

SEQ ID NO: 1081547 - RNA, 19 nt, Mycobacterium bovis subsp bovis AF2122/97
ggccgcccuggccgcccag

SEQ ID NO: 1081548 - RNA, 23 nt, Mycobacterium bovis subsp bovis AF2122/97
ggccgccgaaacucaccagcacc

SEQ ID NO: 1081549 - RNA, 15 nt, Mycobacterium bovis subsp bovis AF2122/97
ggccccgucgccgau

SEQ ID NO: 1081550 - RNA, 14 nt, Mycobacterium bovis subsp bovis AF2122/97
ggccccggcucucu

SEQ ID NO: 1081551 - RNA, 20 nt, Mycobacterium bovis subsp bovis AF2122/97
ggccccgguggugcugccga

SEQ ID NO: 1081552 - RNA, 22 nt, Mycobacterium bovis subsp bovis AF2122/97
ggccccggggugcccccggugc

SEQ ID NO: 1081553 - RNA, 19 nt, Mycobacterium bovis subsp bovis AF2122/97
ggccccggugacgccgucg

SEQ ID NO: 1081554 - RNA, 17 nt, Mycobacterium bovis subsp bovis AF2122/97
ggccccuggccgccgca

SEQ ID NO: 1081555 - RNA, 17 nt, Mycobacterium bovis subsp bovis AF2122/97
ggccccugccacgacga

SEQ ID NO: 1081556 - RNA, 18 nt, Mycobacterium bovis subsp bovis AF2122/97
ggccccuugaccgcugcc

SEQ ID NO: 1081557 - RNA, 20 nt, Mycobacterium bovis subsp bovis AF2122/97
ggccccggcauugcccgagc

SEQ ID NO: 1081558 - RNA, 19 nt, Mycobacterium bovis subsp bovis AF2122/97
ggcccaucgaccgaggcac

SEQ ID NO: 1081559 - RNA, 17 nt, Mycobacterium bovis subsp bovis AF2122/97
ggcccauaccgauggug

SEQ ID NO: 1081560 - RNA, 13 nt, Mycobacterium bovis subsp bovis AF2122/97
ggccgccaccgca

SEQ ID NO: 1081561 - RNA, 14 nt, Mycobacterium bovis subsp bovis AF2122/97
ggccgccaccgcac

SEQ ID NO: 1081562 - RNA, 17 nt, Mycobacterium bovis subsp bovis AF2122/97
ggccgccacaccgccgc

SEQ ID NO: 1081563 - RNA, 19 nt, Mycobacterium bovis subsp bovis AF2122/97
ggccgccaccagcgcgagc

SEQ ID NO: 1081564 - RNA, 17 nt, Mycobacterium bovis subsp bovis AF2122/97
ggccgccaccgcgacga

SEQ ID NO: 1081565 - RNA, 22 nt, Mycobacterium bovis subsp bovis AF2122/97
ggccgccaccgcgacgagcggc

SEQ ID NO: 1081566 - RNA, 12 nt, Mycobacterium bovis subsp bovis AF2122/97
ggccgccaccgu

SEQ ID NO: 1081567 - RNA, 16 nt, Mycobacterium bovis subsp bovis AF2122/97
ggccgccaccgucacc

SEQ ID NO: 1081568 - RNA, 22 nt, Mycobacterium bovis subsp bovis AF2122/97
ggccgccaccgucaccgccguc

SEQ ID NO: 1081569 - RNA, 14 nt, Mycobacterium bovis subsp bovis AF2122/97
ggccgccaccuccc

SEQ ID NO: 1081570 - RNA, 15 nt, Mycobacterium bovis subsp bovis AF2122/97
ggccgccaccuccca

SEQ ID NO: 1081571 - RNA, 23 nt, Mycobacterium bovis subsp bovis AF2122/97
ggccgccacucgcccgcugccgu

SEQ ID NO: 1081572 - RNA, 13 nt, Mycobacterium bovis subsp bovis AF2122/97
ggccgccaccgcg

SEQ ID NO: 1081573 - RNA, 22 nt, Mycobacterium bovis subsp bovis AF2122/97
ggccgcauccccgguacgucga

SEQ ID NO: 1081574 - RNA, 12 nt, Mycobacterium bovis subsp bovis AF2122/97
ggcccgacacgg

SEQ ID NO: 1081575 - RNA, 14 nt, Mycobacterium bovis subsp bovis AF2122/97
ggcccgacacggcg

SEQ ID NO: 1081576 - RNA, 23 nt, Mycobacterium bovis subsp bovis AF2122/97
ggccgcauauugcggcgccguga

SEQ ID NO: 1081577 - RNA, 20 nt, Mycobacterium bovis subsp bovis AF2122/97
ggccgcaucgccucaccacg

SEQ ID NO: 1081578 - RNA, 23 nt, Mycobacterium bovis subsp bovis AF2122/97
ggccgcaucggucaaugccacua

SEQ ID NO: 1081579 - RNA, 18 nt, Mycobacterium bovis subsp bovis AF2122/97
ggccgcaucgucgccgcg

SEQ ID NO: 1081580 - RNA, 19 nt, Mycobacterium bovis subsp bovis AF2122/97
ggccgcaugccacggcaag

SEQ ID NO: 1081581 - RNA, 20 nt, Mycobacterium bovis subsp bovis AF2122/97
ggccgccaacuccagcaccc

SEQ ID NO: 1081582 - RNA, 19 nt, Mycobacterium bovis subsp bovis AF2122/97
ggccgccaacuucaccacc

SEQ ID NO: 1081583 - RNA, 18 nt, Mycobacterium bovis subsp bovis AF2122/97
ggccgcgcugcagcacgg

SEQ ID NO: 1081584 - RNA, 15 nt, Mycobacterium bovis subsp bovis AF2122/97
ggccgcgcucgucga

SEQ ID NO: 1081585 - RNA, 14 nt, Mycobacterium bovis subsp bovis AF2122/97
ggccgcgggcgcgc

SEQ ID NO: 1081586 - RNA, 15 nt, Mycobacterium bovis subsp bovis AF2122/97
ggccgcgggcguugc

SEQ ID NO: 1081587 - RNA, 15 nt, Mycobacterium bovis subsp bovis AF2122/97
ggccgcgggucccgg

SEQ ID NO: 1081588 - RNA, 16 nt, Mycobacterium bovis subsp bovis AF2122/97
ggccgcggucggccac

SEQ ID NO: 1081589 - RNA, 15 nt, Mycobacterium bovis subsp bovis AF2122/97
ggccgcggugcccgu

SEQ ID NO: 1081590 - RNA, 20 nt, Mycobacterium bovis subsp bovis AF2122/97
ggccgcgguacccaccuccc

SEQ ID NO: 1081591 - RNA, 23 nt, Mycobacterium bovis subsp bovis AF2122/97
ggccgcggcuggugucgggcguc

SEQ ID NO: 1081592 - RNA, 24 nt, Mycobacterium bovis subsp bovis AF2122/97
ggccgcgguguauccgacgucggu

SEQ ID NO: 1081593 - RNA, 17 nt, Mycobacterium bovis subsp bovis AF2122/97
ggccgcgguuuggcgac

SEQ ID NO: 1081594 - RNA, 21 nt, Mycobacterium bovis subsp bovis AF2122/97
ggccgcguaaaccggcugacc

SEQ ID NO: 1081595 - RNA, 16 nt, Mycobacterium bovis subsp bovis AF2122/97
ggccgcgucacggacc

SEQ ID NO: 1081596 - RNA, 19 nt, Mycobacterium bovis subsp bovis AF2122/97
ggccgcgucucggugcagc

SEQ ID NO: 1081597 - RNA, 14 nt, Mycobacterium bovis subsp bovis AF2122/97
ggccgcguccagac

SEQ ID NO: 1081598 - RNA, 16 nt, Mycobacterium bovis subsp bovis AF2122/97
ggccgcguccagaccg

SEQ ID NO: 1081599 - RNA, 22 nt, Mycobacterium bovis subsp bovis AF2122/97
ggccgcgucucggugcagcagc

SEQ ID NO: 1081600 - RNA, 20 nt, Mycobacterium bovis subsp bovis AF2122/97
ggccgcgucuuggugcgcgu

SEQ ID NO: 1081601 - RNA, 17 nt, Mycobacterium bovis subsp bovis AF2122/97
ggccgcucguuacgccg

SEQ ID NO: 1081602 - RNA, 19 nt, Mycobacterium bovis subsp bovis AF2122/97
ggccgcucguuacgccgag

SEQ ID NO: 1081603 - RNA, 15 nt, Mycobacterium bovis subsp bovis AF2122/97
ggccgcugacacccg

SEQ ID NO: 1081604 - RNA, 14 nt, Mycobacterium bovis subsp bovis AF2122/97
ggccgcugacgccg

SEQ ID NO: 1081605 - RNA, 14 nt, Mycobacterium bovis subsp bovis AF2122/97
ggccgcuccaccac

SEQ ID NO: 1081606 - RNA, 23 nt, Mycobacterium bovis subsp bovis AF2122/97
ggccgcucacaagccgugcagcu

SEQ ID NO: 1081607 - RNA, 15 nt, Mycobacterium bovis subsp bovis AF2122/97
ggccgcucaccccgc

SEQ ID NO: 1081608 - RNA, 16 nt, Mycobacterium bovis subsp bovis AF2122/97
ggccgcucaccccgcg

SEQ ID NO: 1081609 - RNA, 21 nt, Mycobacterium bovis subsp bovis AF2122/97
ggccgcguucguggaucucuu

SEQ ID NO: 1081610 - RNA, 15 nt, Mycobacterium bovis subsp bovis AF2122/97
ggccgccgagacgac

SEQ ID NO: 1081611 - RNA, 16 nt, Mycobacterium bovis subsp bovis AF2122/97
ggccgccgcgccggug

SEQ ID NO: 1081612 - RNA, 17 nt, Mycobacterium bovis subsp bovis AF2122/97
ggccgccgcgccggugu

SEQ ID NO: 1081613 - RNA, 14 nt, Mycobacterium bovis subsp bovis AF2122/97
ggccgccgcggccg

SEQ ID NO: 1081614 - RNA, 18 nt, Mycobacterium bovis subsp bovis AF2122/97
ggccgccgcggccggcgc

SEQ ID NO: 1081615 - RNA, 22 nt, Mycobacterium bovis subsp bovis AF2122/97
ggccgccgcggccggcgcucgc

SEQ ID NO: 1081616 - RNA, 13 nt, Mycobacterium bovis subsp bovis AF2122/97
ggccgccgcggcg

SEQ ID NO: 1081617 - RNA, 14 nt, Mycobacterium bovis subsp bovis AF2122/97
ggccgccggccagc

SEQ ID NO: 1081618 - RNA, 20 nt, Mycobacterium bovis subsp bovis AF2122/97
ggccgccgcgggacaccacc

SEQ ID NO: 1081619 - RNA, 16 nt, Mycobacterium bovis subsp bovis AF2122/97
ggccgccgagcucggu

SEQ ID NO: 1081620 - RNA, 13 nt, Mycobacterium bovis subsp bovis AF2122/97
ggccgccggccgc

SEQ ID NO: 1081621 - RNA, 14 nt, Mycobacterium bovis subsp bovis AF2122/97
ggccgccgcugccg

SEQ ID NO: 1081622 - RNA, 15 nt, Mycobacterium bovis subsp bovis AF2122/97
ggccgccgcuggugg

SEQ ID NO: 1081623 - RNA, 12 nt, Mycobacterium bovis subsp bovis AF2122/97
ggccgccgagga

SEQ ID NO: 1081624 - RNA, 15 nt, Mycobacterium bovis subsp bovis AF2122/97
ggccgccggcgccgc

SEQ ID NO: 1081625 - RNA, 13 nt, Mycobacterium bovis subsp bovis AF2122/97
ggccgcgagguga

SEQ ID NO: 1081626 - RNA, 21 nt, Mycobacterium bovis subsp bovis AF2122/97
ggccgcgcgacaacccggcgu

SEQ ID NO: 1081627 - RNA, 11 nt, Mycobacterium bovis subsp bovis AF2122/97
ggccgcgcaug

SEQ ID NO: 1081628 - RNA, 14 nt, Mycobacterium bovis subsp bovis AF2122/97
ggccgcgcaugguc

SEQ ID NO: 1081629 - RNA, 13 nt, Mycobacterium bovis subsp bovis AF2122/97
ggccgcgcggcgg

SEQ ID NO: 1081630 - RNA, 24 nt, Mycobacterium bovis subsp bovis AF2122/97
ggccgcgcgcucgagcaggcuggc

SEQ ID NO: 1081631 - RNA, 13 nt, Mycobacterium bovis subsp bovis AF2122/97
ggccgcgcggacc

SEQ ID NO: 1081632 - RNA, 19 nt, Mycobacterium bovis subsp bovis AF2122/97
ggccgcgcucaucgcggcg

SEQ ID NO: 1081633 - RNA, 24 nt, Mycobacterium bovis subsp bovis AF2122/97
ggccgcgcggucguacgcauggcg

SEQ ID NO: 1081634 - RNA, 21 nt, Mycobacterium bovis subsp bovis AF2122/97
ggccgcgaucccggccgucgc

SEQ ID NO: 1081635 - RNA, 19 nt, Mycobacterium bovis subsp bovis AF2122/97
ggccgcgaucgacgguguc

SEQ ID NO: 1081636 - RNA, 19 nt, Mycobacterium bovis subsp bovis AF2122/97
ggccgcgcacccguccgcc

SEQ ID NO: 1081637 - RNA, 21 nt, Mycobacterium bovis subsp bovis AF2122/97
ggccgcgcacccguccgccgc

SEQ ID NO: 1081638 - RNA, 17 nt, Mycobacterium bovis subsp bovis AF2122/97
ggccgcugccacuagca

SEQ ID NO: 1081639 - RNA, 12 nt, Mycobacterium bovis subsp bovis AF2122/97
ggccgcuggcgg

SEQ ID NO: 1081640 - RNA, 14 nt, Mycobacterium bovis subsp bovis AF2122/97
ggccgcugccacua

SEQ ID NO: 1081641 - RNA, 19 nt, Mycobacterium bovis subsp bovis AF2122/97
ggccggccaccaguccgau

SEQ ID NO: 1081642 - RNA, 12 nt, Mycobacterium bovis subsp bovis AF2122/97
ggccggccacca

SEQ ID NO: 1081643 - RNA, 15 nt, Mycobacterium bovis subsp bovis AF2122/97
ggccggccaccaccg

SEQ ID NO: 1081644 - RNA, 15 nt, Mycobacterium bovis subsp bovis AF2122/97
ggccggcauggcggc

SEQ ID NO: 1081645 - RNA, 20 nt, Mycobacterium bovis subsp bovis AF2122/97
ggccggcauggcggcauagc

SEQ ID NO: 1081646 - RNA, 18 nt, Mycobacterium bovis subsp bovis AF2122/97
ggccgcuggggcgcccga

SEQ ID NO: 1081647 - RNA, 19 nt, Mycobacterium bovis subsp bovis AF2122/97
ggccgcuggggcgcccgag

SEQ ID NO: 1081648 - RNA, 16 nt, Mycobacterium bovis subsp bovis AF2122/97
ggccggccccgcccgc

SEQ ID NO: 1081649 - RNA, 22 nt, Mycobacterium bovis subsp bovis AF2122/97
ggccggccccgcccgcgcggug

SEQ ID NO: 1081650 - RNA, 16 nt, Mycobacterium bovis subsp bovis AF2122/97
ggccggccgagcgcac

SEQ ID NO: 1081651 - RNA, 13 nt, Mycobacterium bovis subsp bovis AF2122/97
ggccggcgcucgc

SEQ ID NO: 1081652 - RNA, 16 nt, Mycobacterium bovis subsp bovis AF2122/97
ggccggcgggccugcc

SEQ ID NO: 1081653 - RNA, 16 nt, Mycobacterium bovis subsp bovis AF2122/97
ggccggcgggcucgcc

SEQ ID NO: 1081654 - RNA, 12 nt, Mycobacterium bovis subsp bovis AF2122/97
ggccggcggcgg

SEQ ID NO: 1081655 - RNA, 14 nt, Mycobacterium bovis subsp bovis AF2122/97
ggccggcggcggcg

SEQ ID NO: 1081656 - RNA, 17 nt, Mycobacterium bovis subsp bovis AF2122/97
ggccggcggcggcgcuc

SEQ ID NO: 1081657 - RNA, 20 nt, Mycobacterium bovis subsp bovis AF2122/97
ggccggcggucagcagcgcc

SEQ ID NO: 1081658 - RNA, 13 nt, Mycobacterium bovis subsp bovis AF2122/97
ggccggcggucgc

SEQ ID NO: 1081659 - RNA, 16 nt, Mycobacterium bovis subsp bovis AF2122/97
ggccggcguagcggcg

SEQ ID NO: 1081660 - RNA, 18 nt, Mycobacterium bovis subsp bovis AF2122/97
ggccggcguagcggcgau

SEQ ID NO: 1081661 - RNA, 19 nt, Mycobacterium bovis subsp bovis AF2122/97
ggccggcguagcggcgaua

SEQ ID NO: 1081662 - RNA, 22 nt, Mycobacterium bovis subsp bovis AF2122/97
ggccggcguagcggcgauaccg

SEQ ID NO: 1081663 - RNA, 16 nt, Mycobacterium bovis subsp bovis AF2122/97
ggccggcgucggcguc

SEQ ID NO: 1081664 - RNA, 20 nt, Mycobacterium bovis subsp bovis AF2122/97
ggccggcgucagccccgacu

SEQ ID NO: 1081665 - RNA, 17 nt, Mycobacterium bovis subsp bovis AF2122/97
ggccggcgucgaugacg

SEQ ID NO: 1081666 - RNA, 21 nt, Mycobacterium bovis subsp bovis AF2122/97
ggccggcgucgaugacgacgc

SEQ ID NO: 1081667 - RNA, 11 nt, Mycobacterium bovis subsp bovis AF2122/97
ggccggcguug

SEQ ID NO: 1081668 - RNA, 15 nt, Mycobacterium bovis subsp bovis AF2122/97
ggccggcggcggugg

SEQ ID NO: 1081669 - RNA, 16 nt, Mycobacterium bovis subsp bovis AF2122/97
ggccgggaaccucgcg

SEQ ID NO: 1081670 - RNA, 19 nt, Mycobacterium bovis subsp bovis AF2122/97
ggccgggacagcgccgggg

SEQ ID NO: 1081671 - RNA, 14 nt, Mycobacterium bovis subsp bovis AF2122/97
ggccgggaccacuc

SEQ ID NO: 1081672 - RNA, 14 nt, Mycobacterium bovis subsp bovis AF2122/97
ggccgggaccgccc

SEQ ID NO: 1081673 - RNA, 23 nt, Mycobacterium bovis subsp bovis AF2122/97
ggccggcucgccgacccgccgcg

SEQ ID NO: 1081674 - RNA, 12 nt, Mycobacterium bovis subsp bovis AF2122/97
ggccggcucgcu

SEQ ID NO: 1081675 - RNA, 11 nt, Mycobacterium bovis subsp bovis AF2122/97
ggccgggaucu

SEQ ID NO: 1081676 - RNA, 14 nt, Mycobacterium bovis subsp bovis AF2122/97
ggccgggacggcga

SEQ ID NO: 1081677 - RNA, 16 nt, Mycobacterium bovis subsp bovis AF2122/97
ggccgggacggcgaua

SEQ ID NO: 1081678 - RNA, 15 nt, Mycobacterium bovis subsp bovis AF2122/97
ggccgggcaccaaua

SEQ ID NO: 1081679 - RNA, 17 nt, Mycobacterium bovis subsp bovis AF2122/97
ggccgggcaccaauacc

SEQ ID NO: 1081680 - RNA, 13 nt, Mycobacterium bovis subsp bovis AF2122/97
ggccgggccugca

SEQ ID NO: 1081681 - RNA, 14 nt, Mycobacterium bovis subsp bovis AF2122/97
ggccggggccaccc

SEQ ID NO: 1081682 - RNA, 12 nt, Mycobacterium bovis subsp bovis AF2122/97
ggccgggccgcu

SEQ ID NO: 1081683 - RNA, 21 nt, Mycobacterium bovis subsp bovis AF2122/97
ggccgggcgcaagcagcccgg

SEQ ID NO: 1081684 - RNA, 19 nt, Mycobacterium bovis subsp bovis AF2122/97
ggccggggcgaacggcacc

SEQ ID NO: 1081685 - RNA, 17 nt, Mycobacterium bovis subsp bovis AF2122/97
ggccgguagcgcgggug

SEQ ID NO: 1081686 - RNA, 18 nt, Mycobacterium bovis subsp bovis AF2122/97
ggccgguagcgcgggugg

SEQ ID NO: 1081687 - RNA, 15 nt, Mycobacterium bovis subsp bovis AF2122/97
ggccggucggugagc

SEQ ID NO: 1081688 - RNA, 16 nt, Mycobacterium bovis subsp bovis AF2122/97
ggccgguccacggugu

SEQ ID NO: 1081689 - RNA, 20 nt, Mycobacterium bovis subsp bovis AF2122/97
ggccggugcgucacagccgg

SEQ ID NO: 1081690 - RNA, 17 nt, Mycobacterium bovis subsp bovis AF2122/97
ggccggucgugccgggg

SEQ ID NO: 1081691 - RNA, 17 nt, Mycobacterium bovis subsp bovis AF2122/97
ggccggugcgcaccaga

SEQ ID NO: 1081692 - RNA, 18 nt, Mycobacterium bovis subsp bovis AF2122/97
ggccggugcgcaccagag

SEQ ID NO: 1081693 - RNA, 19 nt, Mycobacterium bovis subsp bovis AF2122/97
ggccguaggcggcgacccg

SEQ ID NO: 1081694 - RNA, 20 nt, Mycobacterium bovis subsp bovis AF2122/97
ggccguaggcggcgacccgc

SEQ ID NO: 1081695 - RNA, 17 nt, Mycobacterium bovis subsp bovis AF2122/97
ggccguagucggcgaug

SEQ ID NO: 1081696 - RNA, 15 nt, Mycobacterium bovis subsp bovis AF2122/97
ggccguagugcacgu

SEQ ID NO: 1081697 - RNA, 20 nt, Mycobacterium bovis subsp bovis AF2122/97
ggccguagugcacgucggcg

SEQ ID NO: 1081698 - RNA, 21 nt, Mycobacterium bovis subsp bovis AF2122/97
ggccguagugcacgucggcgg

SEQ ID NO: 1081699 - RNA, 17 nt, Mycobacterium bovis subsp bovis AF2122/97
ggccgucaccggucggc

SEQ ID NO: 1081700 - RNA, 20 nt, Mycobacterium bovis subsp bovis AF2122/97
ggccgucaggcgugccgggg

SEQ ID NO: 1081701 - RNA, 14 nt, Mycobacterium bovis subsp bovis AF2122/97
ggccgucucgacac

SEQ ID NO: 1081702 - RNA, 14 nt, Mycobacterium bovis subsp bovis AF2122/97
ggccgucucgccgu

SEQ ID NO: 1081703 - RNA, 14 nt, Mycobacterium bovis subsp bovis AF2122/97
ggccgucagcgucg

SEQ ID NO: 1081704 - RNA, 20 nt, Mycobacterium bovis subsp bovis AF2122/97
ggccgucagcgucggcgcau

SEQ ID NO: 1081705 - RNA, 15 nt, Mycobacterium bovis subsp bovis AF2122/97
ggccgucucgccgug

SEQ ID NO: 1081706 - RNA, 17 nt, Mycobacterium bovis subsp bovis AF2122/97
ggccgucucgccgugga

SEQ ID NO: 1081707 - RNA, 18 nt, Mycobacterium bovis subsp bovis AF2122/97
ggccgugaauucgccgaa

SEQ ID NO: 1081708 - RNA, 12 nt, Mycobacterium bovis subsp bovis AF2122/97
ggccgugaccga

SEQ ID NO: 1081709 - RNA, 22 nt, Mycobacterium bovis subsp bovis AF2122/97
ggccgugaagggauccggaagc

SEQ ID NO: 1081710 - RNA, 16 nt, Mycobacterium bovis subsp bovis AF2122/97
ggccgucuucggugau

SEQ ID NO: 1081711 - RNA, 17 nt, Mycobacterium bovis subsp bovis AF2122/97
ggccgucuucggugauc

SEQ ID NO: 1081712 - RNA, 16 nt, Mycobacterium bovis subsp bovis AF2122/97
ggccgugaugccacgg

SEQ ID NO: 1081713 - RNA, 18 nt, Mycobacterium bovis subsp bovis AF2122/97
ggccgugaccgagccgcg

SEQ ID NO: 1081714 - RNA, 22 nt, Mycobacterium bovis subsp bovis AF2122/97
ggccgugaccgagccgcgaugc

SEQ ID NO: 1081715 - RNA, 16 nt, Mycobacterium bovis subsp bovis AF2122/97
ggccucgccggcgcgc

SEQ ID NO: 1081716 - RNA, 13 nt, Mycobacterium bovis subsp bovis AF2122/97
ggccucgccgggg

SEQ ID NO: 1081717 - RNA, 22 nt, Mycobacterium bovis subsp bovis AF2122/97
ggccucgccggggcaaacgggg

SEQ ID NO: 1081718 - RNA, 15 nt, Mycobacterium bovis subsp bovis AF2122/97
ggccucgaucagcgc

SEQ ID NO: 1081719 - RNA, 15 nt, Mycobacterium bovis subsp bovis AF2122/97
ggccucggcggccgu

SEQ ID NO: 1081720 - RNA, 22 nt, Mycobacterium bovis subsp bovis AF2122/97
ggccucggcggccguggccucg

SEQ ID NO: 1081721 - RNA, 14 nt, Mycobacterium bovis subsp bovis AF2122/97
ggccucggcgccgc

SEQ ID NO: 1081722 - RNA, 14 nt, Mycobacterium bovis subsp bovis AF2122/97
ggccucggcgccgu

SEQ ID NO: 1081723 - RNA, 13 nt, Mycobacterium bovis subsp bovis AF2122/97
ggccucgcugggc

SEQ ID NO: 1081724 - RNA, 19 nt, Mycobacterium bovis subsp bovis AF2122/97
ggccucgcugggcucaugg

SEQ ID NO: 1081725 - RNA, 18 nt, Mycobacterium bovis subsp bovis AF2122/97
ggccucggccagcgucag

SEQ ID NO: 1081726 - RNA, 15 nt, Mycobacterium bovis subsp bovis AF2122/97
ggccucggcgauacc

SEQ ID NO: 1081727 - RNA, 20 nt, Mycobacterium bovis subsp bovis AF2122/97
ggccucggcgauaccgagga

SEQ ID NO: 1081728 - RNA, 13 nt, Mycobacterium bovis subsp bovis AF2122/97
ggccucgcugcuc

SEQ ID NO: 1081729 - RNA, 22 nt, Mycobacterium bovis subsp bovis AF2122/97
ggccucaaguugguucaccgcg

SEQ ID NO: 1081730 - RNA, 16 nt, Mycobacterium bovis subsp bovis AF2122/97
ggccucacccggucaa

SEQ ID NO: 1081731 - RNA, 15 nt, Mycobacterium bovis subsp bovis AF2122/97
ggccucagacaacgg

SEQ ID NO: 1081732 - RNA, 18 nt, Mycobacterium bovis subsp bovis AF2122/97
ggccucagccaccgggcg

SEQ ID NO: 1081733 - RNA, 16 nt, Mycobacterium bovis subsp bovis AF2122/97
ggccucagcccggcca

SEQ ID NO: 1081734 - RNA, 22 nt, Mycobacterium bovis subsp bovis AF2122/97
ggccucagcccggccagccgca

SEQ ID NO: 1081735 - RNA, 13 nt, Mycobacterium bovis subsp bovis AF2122/97
ggccucgaccgcc

SEQ ID NO: 1081736 - RNA, 17 nt, Mycobacterium bovis subsp bovis AF2122/97
ggccucgaccgccagcc

SEQ ID NO: 1081737 - RNA, 20 nt, Mycobacterium bovis subsp bovis AF2122/97
ggccucaguacagcgcguug

SEQ ID NO: 1081738 - RNA, 13 nt, Mycobacterium bovis subsp bovis AF2122/97
ggccuagggcggc

SEQ ID NO: 1081739 - RNA, 19 nt, Mycobacterium bovis subsp bovis AF2122/97
ggccuaguccggcacugcg

SEQ ID NO: 1081740 - RNA, 17 nt, Mycobacterium bovis subsp bovis AF2122/97
ggccuagccgcggcacc

SEQ ID NO: 1081741 - RNA, 15 nt, Mycobacterium bovis subsp bovis AF2122/97
ggccuagcgcggcga

SEQ ID NO: 1081742 - RNA, 16 nt, Mycobacterium bovis subsp bovis AF2122/97
ggccuagccgauggcu

SEQ ID NO: 1081743 - RNA, 17 nt, Mycobacterium bovis subsp bovis AF2122/97
ggccgugaugccacggc

SEQ ID NO: 1081744 - RNA, 19 nt, Mycobacterium bovis subsp bovis AF2122/97
ggccuaccaggcgcggccc

SEQ ID NO: 1081745 - RNA, 15 nt, Mycobacterium bovis subsp bovis AF2122/97
ggccuaccgagcuac

SEQ ID NO: 1081746 - RNA, 18 nt, Mycobacterium bovis subsp bovis AF2122/97
ggcgaaaucgucgaaccg

SEQ ID NO: 1081747 - RNA, 16 nt, Mycobacterium bovis subsp bovis AF2122/97
ggcgaacccuccgcag

SEQ ID NO: 1081748 - RNA, 21 nt, Mycobacterium bovis subsp bovis AF2122/97
ggcgaacagugacgccacgac

SEQ ID NO: 1081749 - RNA, 17 nt, Mycobacterium bovis subsp bovis AF2122/97
ggcgaacaucaccgucg

SEQ ID NO: 1081750 - RNA, 14 nt, Mycobacterium bovis subsp bovis AF2122/97
ggccuuggcggcgg

SEQ ID NO: 1081751 - RNA, 15 nt, Mycobacterium bovis subsp bovis AF2122/97
ggccuuggcgggauc

SEQ ID NO: 1081752 - RNA, 16 nt, Mycobacterium bovis subsp bovis AF2122/97
ggccuuugagcgcggc

SEQ ID NO: 1081753 - RNA, 16 nt, Mycobacterium bovis subsp bovis AF2122/97
ggccuuuccagcaccc

SEQ ID NO: 1081754 - RNA, 14 nt, Mycobacterium bovis subsp bovis AF2122/97
ggcgaaaucgucga

SEQ ID NO: 1081755 - RNA, 18 nt, Mycobacterium bovis subsp bovis AF2122/97
ggcgaaaauugcuccacc

SEQ ID NO: 1081756 - RNA, 14 nt, Mycobacterium bovis subsp bovis AF2122/97
ggcgaaacgcccgg

SEQ ID NO: 1081757 - RNA, 15 nt, Mycobacterium bovis subsp bovis AF2122/97
ggcgaagcuugacgu

SEQ ID NO: 1081758 - RNA, 23 nt, Mycobacterium bovis subsp bovis AF2122/97
ggcgaagguccgugccgaugccg

SEQ ID NO: 1081759 - RNA, 22 nt, Mycobacterium bovis subsp bovis AF2122/97
ggcgaagucacgcacccggcgc

SEQ ID NO: 1081760 - RNA, 16 nt, Mycobacterium bovis subsp bovis AF2122/97
ggcgaagucgacucgc

SEQ ID NO: 1081761 - RNA, 14 nt, Mycobacterium bovis subsp bovis AF2122/97
ggcgaagucgucga

SEQ ID NO: 1081762 - RNA, 22 nt, Mycobacterium bovis subsp bovis AF2122/97
ggcgaagucgucgaggucacgc

SEQ ID NO: 1081763 - RNA, 22 nt, Mycobacterium bovis subsp bovis AF2122/97
ggcgaacggauucccgcccagc

SEQ ID NO: 1081764 - RNA, 16 nt, Mycobacterium bovis subsp bovis AF2122/97
ggcgaacggcaccgcg

SEQ ID NO: 1081765 - RNA, 18 nt, Mycobacterium bovis subsp bovis AF2122/97
ggcgaacggcaccgcgcc

SEQ ID NO: 1081766 - RNA, 21 nt, Mycobacterium bovis subsp bovis AF2122/97
ggcgaacggcaccgcgcccac

SEQ ID NO: 1081767 - RNA, 22 nt, Mycobacterium bovis subsp bovis AF2122/97
ggcgaacgcuucaccucgucga

SEQ ID NO: 1081768 - RNA, 16 nt, Mycobacterium bovis subsp bovis AF2122/97
ggcgaaccgucagcgc

SEQ ID NO: 1081769 - RNA, 14 nt, Mycobacterium bovis subsp bovis AF2122/97
ggcgaacugguagc

SEQ ID NO: 1081770 - RNA, 16 nt, Mycobacterium bovis subsp bovis AF2122/97
ggcgaacugguagccc

SEQ ID NO: 1081771 - RNA, 17 nt, Mycobacterium bovis subsp bovis AF2122/97
ggcgaacugggugcggu

SEQ ID NO: 1081772 - RNA, 19 nt, Mycobacterium bovis subsp bovis AF2122/97
ggcgaacucgcgcaggaag

SEQ ID NO: 1081773 - RNA, 17 nt, Mycobacterium bovis subsp bovis AF2122/97
ggcgaacucgcgccgag

SEQ ID NO: 1081774 - RNA, 23 nt, Mycobacterium bovis subsp bovis AF2122/97
ggcgaacuccaucaccacaccgg

SEQ ID NO: 1081775 - RNA, 15 nt, Mycobacterium bovis subsp bovis AF2122/97
aaggcgacgccgaaa

SEQ ID NO: 1081776 - RNA, 16 nt, Mycobacterium bovis subsp bovis AF2122/97
aaggcgcgggcgacgu

SEQ ID NO: 1081777 - RNA, 18 nt, Mycobacterium bovis subsp bovis AF2122/97
aaggcgacaucaccaccg

SEQ ID NO: 1081778 - RNA, 24 nt, Mycobacterium bovis subsp bovis AF2122/97
ggccuggggcagccgggcgucgcu

SEQ ID NO: 1081779 - RNA, 22 nt, Mycobacterium bovis subsp bovis AF2122/97
aaggcgucgaacagugccucgc

SEQ ID NO: 1081780 - RNA, 14 nt, Mycobacterium bovis subsp bovis AF2122/97
ggccucggucgcca

SEQ ID NO: 1081781 - RNA, 21 nt, Mycobacterium bovis subsp bovis AF2122/97
ggccucggugagcagcucggu

SEQ ID NO: 1081782 - RNA, 13 nt, Mycobacterium bovis subsp bovis AF2122/97
ggccucggggauc

SEQ ID NO: 1081783 - RNA, 23 nt, Mycobacterium bovis subsp bovis AF2122/97
ggccucgucccggacaauuccgc

SEQ ID NO: 1081784 - RNA, 14 nt, Mycobacterium bovis subsp bovis AF2122/97
ggccucgucgaugu

SEQ ID NO: 1081785 - RNA, 21 nt, Mycobacterium bovis subsp bovis AF2122/97
ggccucugaccagccggucuu

SEQ ID NO: 1081786 - RNA, 16 nt, Mycobacterium bovis subsp bovis AF2122/97
ggccugaccggcucgc

SEQ ID NO: 1081787 - RNA, 19 nt, Mycobacterium bovis subsp bovis AF2122/97
ggccuugaucgugcuggcg

SEQ ID NO: 1081788 - RNA, 13 nt, Mycobacterium bovis subsp bovis AF2122/97
ggccuugccaccg

SEQ ID NO: 1081789 - RNA, 15 nt, Mycobacterium bovis subsp bovis AF2122/97
ggccuugccgccggc

SEQ ID NO: 1081790 - RNA, 20 nt, Mycobacterium bovis subsp bovis AF2122/97
ggccuugccgccggcgccgc

SEQ ID NO: 1081791 - RNA, 23 nt, Mycobacterium bovis subsp bovis AF2122/97
ggccuugcucagccggcccugcg

SEQ ID NO: 1081792 - RNA, 18 nt, Mycobacterium bovis subsp bovis AF2122/97
ggccuuggcaguccagcc

SEQ ID NO: 1081793 - RNA, 22 nt, Mycobacterium bovis subsp bovis AF2122/97
ggccuugcgcacaggcgcgauc

SEQ ID NO: 1081794 - RNA, 18 nt, Mycobacterium bovis subsp bovis AF2122/97
ggccuugacgcacgacug

SEQ ID NO: 1081795 - RNA, 22 nt, Mycobacterium bovis subsp bovis AF2122/97
ggccuucgccgacuagcugggg

SEQ ID NO: 1081796 - RNA, 23 nt, Mycobacterium bovis subsp bovis AF2122/97
ggccuucuccccgaucagcaccg

SEQ ID NO: 1081797 - RNA, 14 nt, Mycobacterium bovis subsp bovis AF2122/97
ggccuucggccggc

SEQ ID NO: 1081798 - RNA, 12 nt, Mycobacterium bovis subsp bovis AF2122/97
ggccuugacagc

SEQ ID NO: 1081799 - RNA, 23 nt, Mycobacterium bovis subsp bovis AF2122/97
ggccugguacucccgcgaucgcg

SEQ ID NO: 1081800 - RNA, 20 nt, Mycobacterium bovis subsp bovis AF2122/97
aaggcguguagccugcggcg

SEQ ID NO: 1081801 - RNA, 16 nt, Mycobacterium bovis subsp bovis AF2122/97
ggccuggucccaccgc

SEQ ID NO: 1081802 - RNA, 17 nt, Mycobacterium bovis subsp bovis AF2122/97
ggccugucccgcacccg

SEQ ID NO: 1081803 - RNA, 21 nt, Mycobacterium bovis subsp bovis AF2122/97
ggccuggugcucaacggcgac

SEQ ID NO: 1081804 - RNA, 13 nt, Mycobacterium bovis subsp bovis AF2122/97
ggccuucagcuca

SEQ ID NO: 1081805 - RNA, 21 nt, Mycobacterium bovis subsp bovis AF2122/97
ggccuguugcugcccgacacc

SEQ ID NO: 1081806 - RNA, 17 nt, Mycobacterium bovis subsp bovis AF2122/97
ggccuuauucacccggu

SEQ ID NO: 1081807 - RNA, 15 nt, Mycobacterium bovis subsp bovis AF2122/97
ggccuguucgagauc

SEQ ID NO: 1081808 - RNA, 19 nt, Mycobacterium bovis subsp bovis AF2122/97
ggccuguucgagaucgccg

SEQ ID NO: 1081809 - RNA, 20 nt, Mycobacterium bovis subsp bovis AF2122/97
ggccuguucgagaucgccga

SEQ ID NO: 1081810 - RNA, 17 nt, Mycobacterium bovis subsp bovis AF2122/97
ggcgacgaucucgccgc

SEQ ID NO: 1081811 - RNA, 20 nt, Mycobacterium bovis subsp bovis AF2122/97
ggcgacgaucucgccgccag

SEQ ID NO: 1081812 - RNA, 17 nt, Mycobacterium bovis subsp bovis AF2122/97
ggcgacgaucucggcgg

SEQ ID NO: 1081813 - RNA, 21 nt, Mycobacterium bovis subsp bovis AF2122/97
ggcgacgagaucugcgauggg

SEQ ID NO: 1081814 - RNA, 18 nt, Mycobacterium bovis subsp bovis AF2122/97
ggcgacgaugucgagcgc

SEQ ID NO: 1081815 - RNA, 14 nt, Mycobacterium bovis subsp bovis AF2122/97
ggcgacgccgcugg

SEQ ID NO: 1081816 - RNA, 19 nt, Mycobacterium bovis subsp bovis AF2122/97
ggcgacgcuaccgccggag

SEQ ID NO: 1081817 - RNA, 20 nt, Mycobacterium bovis subsp bovis AF2122/97
ggcgacgcgccgguucagac

SEQ ID NO: 1081818 - RNA, 14 nt, Mycobacterium bovis subsp bovis AF2122/97
ggcgacggccagcg

SEQ ID NO: 1081819 - RNA, 16 nt, Mycobacterium bovis subsp bovis AF2122/97
ggcgacggcgcccaua

SEQ ID NO: 1081820 - RNA, 13 nt, Mycobacterium bovis subsp bovis AF2122/97
ggcgacggcgaug

SEQ ID NO: 1081821 - RNA, 14 nt, Mycobacterium bovis subsp bovis AF2122/97
ggcgacggcgucga

SEQ ID NO: 1081822 - RNA, 18 nt, Mycobacterium bovis subsp bovis AF2122/97
ggcgacggcgucgaugac

SEQ ID NO: 1081823 - RNA, 14 nt, Mycobacterium bovis subsp bovis AF2122/97
ggcgacggcggcac

SEQ ID NO: 1081824 - RNA, 13 nt, Mycobacterium bovis subsp bovis AF2122/97
ggcgacggcggcg

SEQ ID NO: 1081825 - RNA, 17 nt, Mycobacterium bovis subsp bovis AF2122/97
ggcgacggcggcgucga

SEQ ID NO: 1081826 - RNA, 20 nt, Mycobacterium bovis subsp bovis AF2122/97
ggcgacggcucuaccggucc

SEQ ID NO: 1081827 - RNA, 15 nt, Mycobacterium bovis subsp bovis AF2122/97
ggcgacggcucuacc

SEQ ID NO: 1081828 - RNA, 18 nt, Mycobacterium bovis subsp bovis AF2122/97
ggcgacgggucgggcaac

SEQ ID NO: 1081829 - RNA, 16 nt, Mycobacterium bovis subsp bovis AF2122/97
aaggcugugccggcca

SEQ ID NO: 1081830 - RNA, 15 nt, Mycobacterium bovis subsp bovis AF2122/97
ggcgagcaccgugcc

SEQ ID NO: 1081831 - RNA, 20 nt, Mycobacterium bovis subsp bovis AF2122/97
ggcgagcagucgcaaaagcc

SEQ ID NO: 1081832 - RNA, 22 nt, Mycobacterium bovis subsp bovis AF2122/97
ggcgagcagucgcaaaagcccc

SEQ ID NO: 1081833 - RNA, 16 nt, Mycobacterium bovis subsp bovis AF2122/97
ggcgagcaucucgaca

SEQ ID NO: 1081834 - RNA, 18 nt, Mycobacterium bovis subsp bovis AF2122/97
ggcgagcaucucgacauc

SEQ ID NO: 1081835 - RNA, 20 nt, Mycobacterium bovis subsp bovis AF2122/97
ggcgagcaucucgacaucgg

SEQ ID NO: 1081836 - RNA, 23 nt, Mycobacterium bovis subsp bovis AF2122/97
ggcgagcaucucgacaucggcca

SEQ ID NO: 1081837 - RNA, 13 nt, Mycobacterium bovis subsp bovis AF2122/97
ggcgagcaccacc

SEQ ID NO: 1081838 - RNA, 15 nt, Mycobacterium bovis subsp bovis AF2122/97
ggcgacugucugguc

SEQ ID NO: 1081839 - RNA, 22 nt, Mycobacterium bovis subsp bovis AF2122/97
ggcgacucgaggaccugcucgg

SEQ ID NO: 1081840 - RNA, 13 nt, Mycobacterium bovis subsp bovis AF2122/97
ggcgacucggugc

SEQ ID NO: 1081841 - RNA, 17 nt, Mycobacterium bovis subsp bovis AF2122/97
ggcgacugcgucggcgg

SEQ ID NO: 1081842 - RNA, 14 nt, Mycobacterium bovis subsp bovis AF2122/97
ggcgagacgcucca

SEQ ID NO: 1081843 - RNA, 21 nt, Mycobacterium bovis subsp bovis AF2122/97
ggcgagacggcguugauccgc

SEQ ID NO: 1081844 - RNA, 19 nt, Mycobacterium bovis subsp bovis AF2122/97
ggcgagaaacacgacagcc

SEQ ID NO: 1081845 - RNA, 21 nt, Mycobacterium bovis subsp bovis AF2122/97
ggcgacucgaggaccugcucg

SEQ ID NO: 1081846 - RNA, 16 nt, Mycobacterium bovis subsp bovis AF2122/97
ggcgacguggcgccga

SEQ ID NO: 1081847 - RNA, 15 nt, Mycobacterium bovis subsp bovis AF2122/97
ggcgacuacccagcc

SEQ ID NO: 1081848 - RNA, 14 nt, Mycobacterium bovis subsp bovis AF2122/97
ggcgacgucggcgg

SEQ ID NO: 1081849 - RNA, 17 nt, Mycobacterium bovis subsp bovis AF2122/97
ggcgacgucggcgguga

SEQ ID NO: 1081850 - RNA, 13 nt, Mycobacterium bovis subsp bovis AF2122/97
ggcgacguuccgc

SEQ ID NO: 1081851 - RNA, 13 nt, Mycobacterium bovis subsp bovis AF2122/97
ggcgacgucgaca

SEQ ID NO: 1081852 - RNA, 14 nt, Mycobacterium bovis subsp bovis AF2122/97
ggcgacgucgacaa

SEQ ID NO: 1081853 - RNA, 22 nt, Mycobacterium bovis subsp bovis AF2122/97
ggcgacgucaucgccgacccgc

SEQ ID NO: 1081854 - RNA, 23 nt, Mycobacterium bovis subsp bovis AF2122/97
ggcgacguagacgguccggucgc

SEQ ID NO: 1081855 - RNA, 17 nt, Mycobacterium bovis subsp bovis AF2122/97
ggcgacgucaucgccga

SEQ ID NO: 1081856 - RNA, 15 nt, Mycobacterium bovis subsp bovis AF2122/97
ggcgacggucgugau

SEQ ID NO: 1081857 - RNA, 18 nt, Mycobacterium bovis subsp bovis AF2122/97
ggcgaccgccagcgugga

SEQ ID NO: 1081858 - RNA, 22 nt, Mycobacterium bovis subsp bovis AF2122/97
ggcgacccggguagacaccgcg

SEQ ID NO: 1081859 - RNA, 19 nt, Mycobacterium bovis subsp bovis AF2122/97
ggcgacccguucucgguga

SEQ ID NO: 1081860 - RNA, 15 nt, Mycobacterium bovis subsp bovis AF2122/97
ggcgacccgcugggu

SEQ ID NO: 1081861 - RNA, 13 nt, Mycobacterium bovis subsp bovis AF2122/97
ggcgaccccggcc

SEQ ID NO: 1081862 - RNA, 21 nt, Mycobacterium bovis subsp bovis AF2122/97
ggcgaccccggccccgacggu

SEQ ID NO: 1081863 - RNA, 23 nt, Mycobacterium bovis subsp bovis AF2122/97
ggcgaccccgaacauccgccgcc

SEQ ID NO: 1081864 - RNA, 14 nt, Mycobacterium bovis subsp bovis AF2122/97
ggcgacccagcggu

SEQ ID NO: 1081865 - RNA, 17 nt, Mycobacterium bovis subsp bovis AF2122/97
ggcgaccgccugcgcgg

SEQ ID NO: 1081866 - RNA, 14 nt, Mycobacterium bovis subsp bovis AF2122/97
ggcgaccgacgccg

SEQ ID NO: 1081867 - RNA, 15 nt, Mycobacterium bovis subsp bovis AF2122/97
ggcgaccgcauccgg

SEQ ID NO: 1081868 - RNA, 22 nt, Mycobacterium bovis subsp bovis AF2122/97
ggcgaccgccauuucgcccgag

SEQ ID NO: 1081869 - RNA, 17 nt, Mycobacterium bovis subsp bovis AF2122/97
ggcgaccggccggccgc

SEQ ID NO: 1081870 - RNA, 12 nt, Mycobacterium bovis subsp bovis AF2122/97
ggcgaccggcga

SEQ ID NO: 1081871 - RNA, 13 nt, Mycobacterium bovis subsp bovis AF2122/97
ggcgaccggcgac

SEQ ID NO: 1081872 - RNA, 20 nt, Mycobacterium bovis subsp bovis AF2122/97
ggcgaccggcgaccggcgag

SEQ ID NO: 1081873 - RNA, 12 nt, Mycobacterium bovis subsp bovis AF2122/97
ggcgaccgcggu

SEQ ID NO: 1081874 - RNA, 20 nt, Mycobacterium bovis subsp bovis AF2122/97
ggcgaccgcgucgucccagu

SEQ ID NO: 1081875 - RNA, 18 nt, Mycobacterium bovis subsp bovis AF2122/97
ggcgacgaccgucggcuc

SEQ ID NO: 1081876 - RNA, 23 nt, Mycobacterium bovis subsp bovis AF2122/97
ggcgacgacaucugcccagcggu

SEQ ID NO: 1081877 - RNA, 11 nt, Mycobacterium bovis subsp bovis AF2122/97
ggcgacgaccc

SEQ ID NO: 1081878 - RNA, 12 nt, Mycobacterium bovis subsp bovis AF2122/97
ggcgacgacccg

SEQ ID NO: 1081879 - RNA, 13 nt, Mycobacterium bovis subsp bovis AF2122/97
ggcgacgacccgg

SEQ ID NO: 1081880 - RNA, 22 nt, Mycobacterium bovis subsp bovis AF2122/97
ggcgaccuggcucaucgaugcg

SEQ ID NO: 1081881 - RNA, 22 nt, Mycobacterium bovis subsp bovis AF2122/97
ggcgaccuccggaaucgcccgg

SEQ ID NO: 1081882 - RNA, 22 nt, Mycobacterium bovis subsp bovis AF2122/97
ggcgaccgggaucggcuccgcc

SEQ ID NO: 1081883 - RNA, 15 nt, Mycobacterium bovis subsp bovis AF2122/97
ggcgaccuugacccg

SEQ ID NO: 1081884 - RNA, 20 nt, Mycobacterium bovis subsp bovis AF2122/97
ggcgaccugcucgcugguga

SEQ ID NO: 1081885 - RNA, 21 nt, Mycobacterium bovis subsp bovis AF2122/97
ggcgaccgucgauuucgacga

SEQ ID NO: 1081886 - RNA, 19 nt, Mycobacterium bovis subsp bovis AF2122/97
ggcgaccacgccgccggcg

SEQ ID NO: 1081887 - RNA, 22 nt, Mycobacterium bovis subsp bovis AF2122/97
ggcgaccaccgcggcugcuccg

SEQ ID NO: 1081888 - RNA, 17 nt, Mycobacterium bovis subsp bovis AF2122/97
ggcgaccaccgcgucgg

SEQ ID NO: 1081889 - RNA, 22 nt, Mycobacterium bovis subsp bovis AF2122/97
ggcgaccaccgcgucgggccgc

SEQ ID NO: 1081890 - RNA, 12 nt, Mycobacterium bovis subsp bovis AF2122/97
ggcgaccaccgc

SEQ ID NO: 1081891 - RNA, 14 nt, Mycobacterium bovis subsp bovis AF2122/97
ggcgaccaccagcg

SEQ ID NO: 1081892 - RNA, 15 nt, Mycobacterium bovis subsp bovis AF2122/97
ggcgaccaccagcgc

SEQ ID NO: 1081893 - RNA, 16 nt, Mycobacterium bovis subsp bovis AF2122/97
ggcgaccacccccggc

SEQ ID NO: 1081894 - RNA, 18 nt, Mycobacterium bovis subsp bovis AF2122/97
ggcgaccagaggaugucg

SEQ ID NO: 1081895 - RNA, 12 nt, Mycobacterium bovis subsp bovis AF2122/97
ggcgaccagaua

SEQ ID NO: 1081896 - RNA, 14 nt, Mycobacterium bovis subsp bovis AF2122/97
ggcgaccaggagcc

SEQ ID NO: 1081897 - RNA, 22 nt, Mycobacterium bovis subsp bovis AF2122/97
ggcgaccaggagccuccagcgc

SEQ ID NO: 1081898 - RNA, 20 nt, Mycobacterium bovis subsp bovis AF2122/97
ggcgaccaaggccgaccugu

SEQ ID NO: 1081899 - RNA, 12 nt, Mycobacterium bovis subsp bovis AF2122/97
ggcgaccaccac

SEQ ID NO: 1081900 - RNA, 18 nt, Mycobacterium bovis subsp bovis AF2122/97
ggcgacaucaccaccgac

SEQ ID NO: 1081901 - RNA, 23 nt, Mycobacterium bovis subsp bovis AF2122/97
ggcgacauccacaccgcggcggc

SEQ ID NO: 1081902 - RNA, 17 nt, Mycobacterium bovis subsp bovis AF2122/97
ggcgaccaacacgucga

SEQ ID NO: 1081903 - RNA, 14 nt, Mycobacterium bovis subsp bovis AF2122/97
ggcgacaucggccc

SEQ ID NO: 1081904 - RNA, 21 nt, Mycobacterium bovis subsp bovis AF2122/97
ggcgacaugaucugccaccgc

SEQ ID NO: 1081905 - RNA, 22 nt, Mycobacterium bovis subsp bovis AF2122/97
ggcgacacgccaggugaugccg

SEQ ID NO: 1081906 - RNA, 22 nt, Mycobacterium bovis subsp bovis AF2122/97
ggcgacaggagacgguacgcca

SEQ ID NO: 1081907 - RNA, 23 nt, Mycobacterium bovis subsp bovis AF2122/97
ggcgacaguagggucguacgucg

SEQ ID NO: 1081908 - RNA, 17 nt, Mycobacterium bovis subsp bovis AF2122/97
ggcgaaugcgggccucc

SEQ ID NO: 1081909 - RNA, 23 nt, Mycobacterium bovis subsp bovis AF2122/97
ggcgaaugcgggccuccugcugg

SEQ ID NO: 1081910 - RNA, 15 nt, Mycobacterium bovis subsp bovis AF2122/97
ggcgacacgccagcc

SEQ ID NO: 1081911 - RNA, 14 nt, Mycobacterium bovis subsp bovis AF2122/97
ggccaccgcgccgu

SEQ ID NO: 1081912 - RNA, 13 nt, Mycobacterium bovis subsp bovis AF2122/97
ggccaccgccgaa

SEQ ID NO: 1081913 - RNA, 13 nt, Mycobacterium bovis subsp bovis AF2122/97
ggccaccgccgcc

SEQ ID NO: 1081914 - RNA, 15 nt, Mycobacterium bovis subsp bovis AF2122/97
ggccaccgccgccgc

SEQ ID NO: 1081915 - RNA, 17 nt, Mycobacterium bovis subsp bovis AF2122/97
ggccaccgccgccgcca

SEQ ID NO: 1081916 - RNA, 19 nt, Mycobacterium bovis subsp bovis AF2122/97
ggccaccgccgccgccgac

SEQ ID NO: 1081917 - RNA, 12 nt, Mycobacterium bovis subsp bovis AF2122/97
ggccaccgcgca

SEQ ID NO: 1081918 - RNA, 16 nt, Mycobacterium bovis subsp bovis AF2122/97
ggccaccgcgcaaccc

SEQ ID NO: 1081919 - RNA, 22 nt, Mycobacterium bovis subsp bovis AF2122/97
ggccaccgccgccugcccggcc

SEQ ID NO: 1081920 - RNA, 20 nt, Mycobacterium bovis subsp bovis AF2122/97
ggccaccgcugucagccgac

SEQ ID NO: 1081921 - RNA, 22 nt, Mycobacterium bovis subsp bovis AF2122/97
ggccaccggaauccuggccgcc

SEQ ID NO: 1081922 - RNA, 23 nt, Mycobacterium bovis subsp bovis AF2122/97
ggccaccggaauccuggccgccg

SEQ ID NO: 1081923 - RNA, 17 nt, Mycobacterium bovis subsp bovis AF2122/97
ggccacgauccgcggua

SEQ ID NO: 1081924 - RNA, 16 nt, Mycobacterium bovis subsp bovis AF2122/97
ggccacgcaccgggug

SEQ ID NO: 1081925 - RNA, 20 nt, Mycobacterium bovis subsp bovis AF2122/97
ggccacgccagcucgccggc

SEQ ID NO: 1081926 - RNA, 22 nt, Mycobacterium bovis subsp bovis AF2122/97
ggccacgccagcucgccggccg

SEQ ID NO: 1081927 - RNA, 13 nt, Mycobacterium bovis subsp bovis AF2122/97
ggccacgcccagg

SEQ ID NO: 1081928 - RNA, 15 nt, Mycobacterium bovis subsp bovis AF2122/97
ggccacgucgagcac

SEQ ID NO: 1081929 - RNA, 16 nt, Mycobacterium bovis subsp bovis AF2122/97
ggccacguccucagcc

SEQ ID NO: 1081930 - RNA, 22 nt, Mycobacterium bovis subsp bovis AF2122/97
ggccacguagcagcagacgacg

SEQ ID NO: 1081931 - RNA, 18 nt, Mycobacterium bovis subsp bovis AF2122/97
ggccacguagcagcgccg

SEQ ID NO: 1081932 - RNA, 22 nt, Mycobacterium bovis subsp bovis AF2122/97
ggccacugaaccguagcgccca

SEQ ID NO: 1081933 - RNA, 21 nt, Mycobacterium bovis subsp bovis AF2122/97
ggccacuccgguggccaacac

SEQ ID NO: 1081934 - RNA, 13 nt, Mycobacterium bovis subsp bovis AF2122/97
ggccacuggccgg

SEQ ID NO: 1081935 - RNA, 21 nt, Mycobacterium bovis subsp bovis AF2122/97
ggccacguugcgcauaggcga

SEQ ID NO: 1081936 - RNA, 21 nt, Mycobacterium bovis subsp bovis AF2122/97
ggccacguuguccgcgacgua

SEQ ID NO: 1081937 - RNA, 13 nt, Mycobacterium bovis subsp bovis AF2122/97
ggcaugccggcga

SEQ ID NO: 1081938 - RNA, 13 nt, Mycobacterium bovis subsp bovis AF2122/97
ggcaugccgcccg

SEQ ID NO: 1081939 - RNA, 14 nt, Mycobacterium bovis subsp bovis AF2122/97
ggcaugccggcgaa

SEQ ID NO: 1081940 - RNA, 19 nt, Mycobacterium bovis subsp bovis AF2122/97
ggcaugccagccacgaacu

SEQ ID NO: 1081941 - RNA, 14 nt, Mycobacterium bovis subsp bovis AF2122/97
ggcaugccggucuu

SEQ ID NO: 1081942 - RNA, 13 nt, Mycobacterium bovis subsp bovis AF2122/97
ggcaugccggcgu

SEQ ID NO: 1081943 - RNA, 17 nt, Mycobacterium bovis subsp bovis AF2122/97
ggcaugccggcgugcgg

SEQ ID NO: 1081944 - RNA, 16 nt, Mycobacterium bovis subsp bovis AF2122/97
ggcaugcggaucggcg

SEQ ID NO: 1081945 - RNA, 20 nt, Mycobacterium bovis subsp bovis AF2122/97
ggcaugcggaucggcggacc

SEQ ID NO: 1081946 - RNA, 15 nt, Mycobacterium bovis subsp bovis AF2122/97
ggcaugcggauucgc

SEQ ID NO: 1081947 - RNA, 16 nt, Mycobacterium bovis subsp bovis AF2122/97
ggcaucggucaccgcg

SEQ ID NO: 1081948 - RNA, 15 nt, Mycobacterium bovis subsp bovis AF2122/97
ggcaucggcggcaac

SEQ ID NO: 1081949 - RNA, 18 nt, Mycobacterium bovis subsp bovis AF2122/97
ggcaugcaaugcuggcgg

SEQ ID NO: 1081950 - RNA, 18 nt, Mycobacterium bovis subsp bovis AF2122/97
ggcaugcagaucucacgg

SEQ ID NO: 1081951 - RNA, 20 nt, Mycobacterium bovis subsp bovis AF2122/97
ggcaucgcggaagcgggcga

SEQ ID NO: 1081952 - RNA, 14 nt, Mycobacterium bovis subsp bovis AF2122/97
ggcaucgcgggcgg

SEQ ID NO: 1081953 - RNA, 17 nt, Mycobacterium bovis subsp bovis AF2122/97
ggcaucgcgggcggcgc

SEQ ID NO: 1081954 - RNA, 23 nt, Mycobacterium bovis subsp bovis AF2122/97
ggcaucggagauacgggccaccg

SEQ ID NO: 1081955 - RNA, 14 nt, Mycobacterium bovis subsp bovis AF2122/97
ggcaucggccaccu

SEQ ID NO: 1081956 - RNA, 16 nt, Mycobacterium bovis subsp bovis AF2122/97
ggcaucggccaccugu

SEQ ID NO: 1081957 - RNA, 15 nt, Mycobacterium bovis subsp bovis AF2122/97
ggccaccaccgccgc

SEQ ID NO: 1081958 - RNA, 11 nt, Mycobacterium bovis subsp bovis AF2122/97
ggccaccaccg

SEQ ID NO: 1081959 - RNA, 18 nt, Mycobacterium bovis subsp bovis AF2122/97
ggccaccaaacgcugcug

SEQ ID NO: 1081960 - RNA, 18 nt, Mycobacterium bovis subsp bovis AF2122/97
ggccaccaacucggcgac

SEQ ID NO: 1081961 - RNA, 17 nt, Mycobacterium bovis subsp bovis AF2122/97
ggcaugcuggcgaucgc

SEQ ID NO: 1081962 - RNA, 18 nt, Mycobacterium bovis subsp bovis AF2122/97
ggcaugcuggcgaucgcg

SEQ ID NO: 1081963 - RNA, 17 nt, Mycobacterium bovis subsp bovis AF2122/97
ggcaugcggaucggcgg

SEQ ID NO: 1081964 - RNA, 17 nt, Mycobacterium bovis subsp bovis AF2122/97
ggcaugcgugccggcag

SEQ ID NO: 1081965 - RNA, 20 nt, Mycobacterium bovis subsp bovis AF2122/97
ggccaccagcccgaugaucc

SEQ ID NO: 1081966 - RNA, 19 nt, Mycobacterium bovis subsp bovis AF2122/97
ggccaccagccuggcugcg

SEQ ID NO: 1081967 - RNA, 22 nt, Mycobacterium bovis subsp bovis AF2122/97
ggccaccacugcgcccgccacg

SEQ ID NO: 1081968 - RNA, 23 nt, Mycobacterium bovis subsp bovis AF2122/97
ggccaccagaucgcacaccaaca

SEQ ID NO: 1081969 - RNA, 16 nt, Mycobacterium bovis subsp bovis AF2122/97
ggccaccacgcgccgc

SEQ ID NO: 1081970 - RNA, 18 nt, Mycobacterium bovis subsp bovis AF2122/97
ggccaccaccgccgccgg

SEQ ID NO: 1081971 - RNA, 19 nt, Mycobacterium bovis subsp bovis AF2122/97
ggccaccaccgccgccggc

SEQ ID NO: 1081972 - RNA, 16 nt, Mycobacterium bovis subsp bovis AF2122/97
ggccaccaccgcgccg

SEQ ID NO: 1081973 - RNA, 21 nt, Mycobacterium bovis subsp bovis AF2122/97
ggccaccagcgcccggcccgc

SEQ ID NO: 1081974 - RNA, 14 nt, Mycobacterium bovis subsp bovis AF2122/97
ggccaccagcggca

SEQ ID NO: 1081975 - RNA, 22 nt, Mycobacterium bovis subsp bovis AF2122/97
ggccaccgcccagugccagaac

SEQ ID NO: 1081976 - RNA, 14 nt, Mycobacterium bovis subsp bovis AF2122/97
ggccagcccacucg

SEQ ID NO: 1081977 - RNA, 15 nt, Mycobacterium bovis subsp bovis AF2122/97
ggccagccuaccggc

SEQ ID NO: 1081978 - RNA, 19 nt, Mycobacterium bovis subsp bovis AF2122/97
ggccagcgcggcgagggcg

SEQ ID NO: 1081979 - RNA, 23 nt, Mycobacterium bovis subsp bovis AF2122/97
ggccagcgcgucgggaugcgcgu

SEQ ID NO: 1081980 - RNA, 11 nt, Mycobacterium bovis subsp bovis AF2122/97
ggccagcggca

SEQ ID NO: 1081981 - RNA, 23 nt, Mycobacterium bovis subsp bovis AF2122/97
ggccagcgcuucgucggccggca

SEQ ID NO: 1081982 - RNA, 24 nt, Mycobacterium bovis subsp bovis AF2122/97
ggccagcgcuucgucggccggcac

SEQ ID NO: 1081983 - RNA, 22 nt, Mycobacterium bovis subsp bovis AF2122/97
ggccagcggcagccuggccucg

SEQ ID NO: 1081984 - RNA, 18 nt, Mycobacterium bovis subsp bovis AF2122/97
ggccagcggcccgucacc

SEQ ID NO: 1081985 - RNA, 23 nt, Mycobacterium bovis subsp bovis AF2122/97
ggccagcgggaacacaccgcaua

SEQ ID NO: 1081986 - RNA, 22 nt, Mycobacterium bovis subsp bovis AF2122/97
ggccagcucuucggggaugacg

SEQ ID NO: 1081987 - RNA, 18 nt, Mycobacterium bovis subsp bovis AF2122/97
ggccagcugcguggcgaa

SEQ ID NO: 1081988 - RNA, 15 nt, Mycobacterium bovis subsp bovis AF2122/97
ggccagcuugcggag

SEQ ID NO: 1081989 - RNA, 21 nt, Mycobacterium bovis subsp bovis AF2122/97
ggccagcuugagguccgucgc

SEQ ID NO: 1081990 - RNA, 13 nt, Mycobacterium bovis subsp bovis AF2122/97
ggccagcacccgc

SEQ ID NO: 1081991 - RNA, 15 nt, Mycobacterium bovis subsp bovis AF2122/97
ggccagcacccgcuc

SEQ ID NO: 1081992 - RNA, 22 nt, Mycobacterium bovis subsp bovis AF2122/97
ggccagcacccgcuccagcucg

SEQ ID NO: 1081993 - RNA, 14 nt, Mycobacterium bovis subsp bovis AF2122/97
ggccagcacaccgu

SEQ ID NO: 1081994 - RNA, 17 nt, Mycobacterium bovis subsp bovis AF2122/97
ggccacuugaugcucga

SEQ ID NO: 1081995 - RNA, 21 nt, Mycobacterium bovis subsp bovis AF2122/97
ggccacuugaugcucgaugcg

SEQ ID NO: 1081996 - RNA, 21 nt, Mycobacterium bovis subsp bovis AF2122/97
ggccacugcguuccaucgccg

SEQ ID NO: 1081997 - RNA, 14 nt, Mycobacterium bovis subsp bovis AF2122/97
ggccagcaccucga

SEQ ID NO: 1081998 - RNA, 18 nt, Mycobacterium bovis subsp bovis AF2122/97
ggccagcaccucgaccgc

SEQ ID NO: 1081999 - RNA, 20 nt, Mycobacterium bovis subsp bovis AF2122/97
ggccagcacgcccucgacgc

SEQ ID NO: 1082000 - RNA, 14 nt, Mycobacterium bovis subsp bovis AF2122/97
ggccagcacgccgc

SEQ ID NO: 1082001 - RNA, 16 nt, Mycobacterium bovis subsp bovis AF2122/97
ggccagcacgccgccg

SEQ ID NO: 1082002 - RNA, 18 nt, Mycobacterium bovis subsp bovis AF2122/97
ggccagcacgccgccggc

SEQ ID NO: 1082003 - RNA, 21 nt, Mycobacterium bovis subsp bovis AF2122/97
ggccagcacuccgcgggguug

SEQ ID NO: 1082004 - RNA, 13 nt, Mycobacterium bovis subsp bovis AF2122/97
ggccagcagccgc

SEQ ID NO: 1082005 - RNA, 21 nt, Mycobacterium bovis subsp bovis AF2122/97
ggccagcagcagugccaccgg

SEQ ID NO: 1082006 - RNA, 22 nt, Mycobacterium bovis subsp bovis AF2122/97
ggccagcaccacggccagcggg

SEQ ID NO: 1082007 - RNA, 19 nt, Mycobacterium bovis subsp bovis AF2122/97
ggccagcagaaacaucgac

SEQ ID NO: 1082008 - RNA, 21 nt, Mycobacterium bovis subsp bovis AF2122/97
ggccagcagaaacaucgacag

SEQ ID NO: 1082009 - RNA, 17 nt, Mycobacterium bovis subsp bovis AF2122/97
ggccagcagagcggcac

SEQ ID NO: 1082010 - RNA, 15 nt, Mycobacterium bovis subsp bovis AF2122/97
ggccagcagugcggu

SEQ ID NO: 1082011 - RNA, 15 nt, Mycobacterium bovis subsp bovis AF2122/97
ggccagcaucagcgc

SEQ ID NO: 1082012 - RNA, 16 nt, Mycobacterium bovis subsp bovis AF2122/97
ggccagcaucagcgcc

SEQ ID NO: 1082013 - RNA, 17 nt, Mycobacterium bovis subsp bovis AF2122/97
ggccagcaucagcucga

SEQ ID NO: 1082014 - RNA, 16 nt, Mycobacterium bovis subsp bovis AF2122/97
ggccagcaucgcggug

SEQ ID NO: 1082015 - RNA, 16 nt, Mycobacterium bovis subsp bovis AF2122/97
ggccagcaucgggugg

SEQ ID NO: 1082016 - RNA, 14 nt, Mycobacterium bovis subsp bovis AF2122/97
ggccagccagcgau

SEQ ID NO: 1082017 - RNA, 15 nt, Mycobacterium bovis subsp bovis AF2122/97
ggccagccagcgauc

SEQ ID NO: 1082018 - RNA, 21 nt, Mycobacterium bovis subsp bovis AF2122/97
ggccagcagcaaugcgguacc

SEQ ID NO: 1082019 - RNA, 19 nt, Mycobacterium bovis subsp bovis AF2122/97
ggccaggucgagcaccggc

SEQ ID NO: 1082020 - RNA, 17 nt, Mycobacterium bovis subsp bovis AF2122/97
ggccaggucggccaccg

SEQ ID NO: 1082021 - RNA, 14 nt, Mycobacterium bovis subsp bovis AF2122/97
ggccagguugaucg

SEQ ID NO: 1082022 - RNA, 17 nt, Mycobacterium bovis subsp bovis AF2122/97
ggccagguggcgagcgc

SEQ ID NO: 1082023 - RNA, 20 nt, Mycobacterium bovis subsp bovis AF2122/97
ggccagguuguagacggcac

SEQ ID NO: 1082024 - RNA, 21 nt, Mycobacterium bovis subsp bovis AF2122/97
ggccagguuguagacggcacc

SEQ ID NO: 1082025 - RNA, 22 nt, Mycobacterium bovis subsp bovis AF2122/97
ggccagguuguagacggcaccc

SEQ ID NO: 1082026 - RNA, 16 nt, Mycobacterium bovis subsp bovis AF2122/97
ggccagugccaucgcc

SEQ ID NO: 1082027 - RNA, 22 nt, Mycobacterium bovis subsp bovis AF2122/97
ggccagugccgguucgauggca

SEQ ID NO: 1082028 - RNA, 17 nt, Mycobacterium bovis subsp bovis AF2122/97
ggccagugucagcacga

SEQ ID NO: 1082029 - RNA, 21 nt, Mycobacterium bovis subsp bovis AF2122/97
ggccagugucagcacgacgac

SEQ ID NO: 1082030 - RNA, 22 nt, Mycobacterium bovis subsp bovis AF2122/97
ggccagugucagcacgacgaca

SEQ ID NO: 1082031 - RNA, 14 nt, Mycobacterium bovis subsp bovis AF2122/97
ggccagugccaccu

SEQ ID NO: 1082032 - RNA, 23 nt, Mycobacterium bovis subsp bovis AF2122/97
ggccagucaggaaaccggcgcgg

SEQ ID NO: 1082033 - RNA, 18 nt, Mycobacterium bovis subsp bovis AF2122/97
ggccagucgugcuugccc

SEQ ID NO: 1082034 - RNA, 19 nt, Mycobacterium bovis subsp bovis AF2122/97
ggccagugaaaccaccggc

SEQ ID NO: 1082035 - RNA, 19 nt, Mycobacterium bovis subsp bovis AF2122/97
ggccaggggcgcagcgcgg

SEQ ID NO: 1082036 - RNA, 23 nt, Mycobacterium bovis subsp bovis AF2122/97
ggccagggucagcucggugaugu

SEQ ID NO: 1082037 - RNA, 17 nt, Mycobacterium bovis subsp bovis AF2122/97
ggccaggguguugaucu

SEQ ID NO: 1082038 - RNA, 17 nt, Mycobacterium bovis subsp bovis AF2122/97
ggccaggucgacaccgc

SEQ ID NO: 1082039 - RNA, 13 nt, Mycobacterium bovis subsp bovis AF2122/97
ggccaggucgacg

SEQ ID NO: 1082040 - RNA, 14 nt, Mycobacterium bovis subsp bovis AF2122/97
ggccagggcaccca

SEQ ID NO: 1082041 - RNA, 23 nt, Mycobacterium bovis subsp bovis AF2122/97
ggccauccgaucacgacguugcc

SEQ ID NO: 1082042 - RNA, 14 nt, Mycobacterium bovis subsp bovis AF2122/97
ggccauccaccgca

SEQ ID NO: 1082043 - RNA, 15 nt, Mycobacterium bovis subsp bovis AF2122/97
ggccauccaccgcag

SEQ ID NO: 1082044 - RNA, 20 nt, Mycobacterium bovis subsp bovis AF2122/97
ggccauauugggaguccggc

SEQ ID NO: 1082045 - RNA, 20 nt, Mycobacterium bovis subsp bovis AF2122/97
ggccaucaucgacggugauc

SEQ ID NO: 1082046 - RNA, 18 nt, Mycobacterium bovis subsp bovis AF2122/97
ggccaucccgcguucgag

SEQ ID NO: 1082047 - RNA, 23 nt, Mycobacterium bovis subsp bovis AF2122/97
ggccaucgaccguccgggucacc

SEQ ID NO: 1082048 - RNA, 19 nt, Mycobacterium bovis subsp bovis AF2122/97
ggccaucgcauccccagca

SEQ ID NO: 1082049 - RNA, 17 nt, Mycobacterium bovis subsp bovis AF2122/97
ggccaucgcccgaugcg

SEQ ID NO: 1082050 - RNA, 13 nt, Mycobacterium bovis subsp bovis AF2122/97
ggccaucgagggc

SEQ ID NO: 1082051 - RNA, 17 nt, Mycobacterium bovis subsp bovis AF2122/97
ggccaucgaguccacca

SEQ ID NO: 1082052 - RNA, 17 nt, Mycobacterium bovis subsp bovis AF2122/97
ggccaucgcauccccag

SEQ ID NO: 1082053 - RNA, 20 nt, Mycobacterium bovis subsp bovis AF2122/97
ggccaucgcccggaugaucc

SEQ ID NO: 1082054 - RNA, 13 nt, Mycobacterium bovis subsp bovis AF2122/97
ggccaucgugcgg

SEQ ID NO: 1082055 - RNA, 16 nt, Mycobacterium bovis subsp bovis AF2122/97
ggccaucugcucgugg

SEQ ID NO: 1082056 - RNA, 22 nt, Mycobacterium bovis subsp bovis AF2122/97
ggccaguugcacaucggugguu

SEQ ID NO: 1082057 - RNA, 18 nt, Mycobacterium bovis subsp bovis AF2122/97
ggccaguuggccggccag

SEQ ID NO: 1082058 - RNA, 20 nt, Mycobacterium bovis subsp bovis AF2122/97
ggccaguucggugagccggg

SEQ ID NO: 1082059 - RNA, 18 nt, Mycobacterium bovis subsp bovis AF2122/97
ggccaguucggugagccg

SEQ ID NO: 1082060 - RNA, 13 nt, Mycobacterium bovis subsp bovis AF2122/97
ggccauagcgccg

SEQ ID NO: 1082061 - RNA, 23 nt, Mycobacterium bovis subsp bovis AF2122/97
ggccauagucagacgacgaugau

SEQ ID NO: 1082062 - RNA, 22 nt, Mycobacterium bovis subsp bovis AF2122/97
ggccauagugaggccgaccagc

SEQ ID NO: 1082063 - RNA, 14 nt, Mycobacterium bovis subsp bovis AF2122/97
ggccauacgcgcgc

SEQ ID NO: 1082064 - RNA, 18 nt, Mycobacterium bovis subsp bovis AF2122/97
ggcccacggcagcgccgg

SEQ ID NO: 1082065 - RNA, 15 nt, Mycobacterium bovis subsp bovis AF2122/97
ggcccacggcgacca

SEQ ID NO: 1082066 - RNA, 21 nt, Mycobacterium bovis subsp bovis AF2122/97
ggcccaccgccguugggccgc

SEQ ID NO: 1082067 - RNA, 19 nt, Mycobacterium bovis subsp bovis AF2122/97
ggcccagaucgguugaucg

SEQ ID NO: 1082068 - RNA, 18 nt, Mycobacterium bovis subsp bovis AF2122/97
ggcccagcaaccgcucgg

SEQ ID NO: 1082069 - RNA, 23 nt, Mycobacterium bovis subsp bovis AF2122/97
ggcccagcaaccgcucggcgaug

SEQ ID NO: 1082070 - RNA, 14 nt, Mycobacterium bovis subsp bovis AF2122/97
ggcccagcagcgca

SEQ ID NO: 1082071 - RNA, 13 nt, Mycobacterium bovis subsp bovis AF2122/97
ggcccagcacggu

SEQ ID NO: 1082072 - RNA, 21 nt, Mycobacterium bovis subsp bovis AF2122/97
ggcccagcgcccccagcagcu

SEQ ID NO: 1082073 - RNA, 21 nt, Mycobacterium bovis subsp bovis AF2122/97
ggcccaggagauccaccgguc

SEQ ID NO: 1082074 - RNA, 22 nt, Mycobacterium bovis subsp bovis AF2122/97
ggcccaggagauccaccggucc

SEQ ID NO: 1082075 - RNA, 15 nt, Mycobacterium bovis subsp bovis AF2122/97
ggcccaaccggucgu

SEQ ID NO: 1082076 - RNA, 20 nt, Mycobacterium bovis subsp bovis AF2122/97
ggccauugcgggcucaacac

SEQ ID NO: 1082077 - RNA, 16 nt, Mycobacterium bovis subsp bovis AF2122/97
ggcccacacggucguc

SEQ ID NO: 1082078 - RNA, 21 nt, Mycobacterium bovis subsp bovis AF2122/97
ggcccacacggugcgauuccg

SEQ ID NO: 1082079 - RNA, 17 nt, Mycobacterium bovis subsp bovis AF2122/97
ggcccaacgacggcaac

SEQ ID NO: 1082080 - RNA, 21 nt, Mycobacterium bovis subsp bovis AF2122/97
ggcccaacucccagaacgccg

SEQ ID NO: 1082081 - RNA, 18 nt, Mycobacterium bovis subsp bovis AF2122/97
ggcccaagccguggccgg

SEQ ID NO: 1082082 - RNA, 18 nt, Mycobacterium bovis subsp bovis AF2122/97
ggcccaaggaacggcguc

SEQ ID NO: 1082083 - RNA, 15 nt, Mycobacterium bovis subsp bovis AF2122/97
ggcccaccaggccca

SEQ ID NO: 1082084 - RNA, 15 nt, Mycobacterium bovis subsp bovis AF2122/97
ggcccaccgccguug

SEQ ID NO: 1082085 - RNA, 17 nt, Mycobacterium bovis subsp bovis AF2122/97
ggccauguggacggcau

SEQ ID NO: 1082086 - RNA, 15 nt, Mycobacterium bovis subsp bovis AF2122/97
ggccauguggggacc

SEQ ID NO: 1082087 - RNA, 15 nt, Mycobacterium bovis subsp bovis AF2122/97
ggccauguugccgug

SEQ ID NO: 1082088 - RNA, 18 nt, Mycobacterium bovis subsp bovis AF2122/97
ggccauucuuggugaucg

SEQ ID NO: 1082089 - RNA, 23 nt, Mycobacterium bovis subsp bovis AF2122/97
ggcccaaccgcauucggacgcca

SEQ ID NO: 1082090 - RNA, 20 nt, Mycobacterium bovis subsp bovis AF2122/97
ggccaugcuggucagcggcg

SEQ ID NO: 1082091 - RNA, 20 nt, Mycobacterium bovis subsp bovis AF2122/97
ggccaugguggcgccgacgu

SEQ ID NO: 1082092 - RNA, 17 nt, Mycobacterium bovis subsp bovis AF2122/97
ggccauggcggcgccgg

SEQ ID NO: 1082093 - RNA, 20 nt, Mycobacterium bovis subsp bovis AF2122/97
ggccauggcggcgccggugg

SEQ ID NO: 1082094 - RNA, 17 nt, Mycobacterium bovis subsp bovis AF2122/97
ggccaugaaaaucggca

SEQ ID NO: 1082095 - RNA, 13 nt, Mycobacterium bovis subsp bovis AF2122/97
ggccaucugcucg

SEQ ID NO: 1082096 - RNA, 23 nt, Mycobacterium bovis subsp bovis AF2122/97
ggccaugaucacaccgcugcuag

SEQ ID NO: 1082097 - RNA, 13 nt, Mycobacterium bovis subsp bovis AF2122/97
ggccaugaugaug

SEQ ID NO: 1082098 - RNA, 22 nt, Mycobacterium bovis subsp bovis AF2122/97
ggccaugcuaggaccaccagcg

SEQ ID NO: 1082099 - RNA, 17 nt, Mycobacterium bovis subsp bovis AF2122/97
ggcagccuggccucgcc

SEQ ID NO: 1082100 - RNA, 15 nt, Mycobacterium bovis subsp bovis AF2122/97
ggcagccgcgccgcg

SEQ ID NO: 1082101 - RNA, 23 nt, Mycobacterium bovis subsp bovis AF2122/97
ggcagcgacgccggcccgacggg

SEQ ID NO: 1082102 - RNA, 14 nt, Mycobacterium bovis subsp bovis AF2122/97
ggcagccggcuugg

SEQ ID NO: 1082103 - RNA, 15 nt, Mycobacterium bovis subsp bovis AF2122/97
ggcagccgggcggca

SEQ ID NO: 1082104 - RNA, 17 nt, Mycobacterium bovis subsp bovis AF2122/97
ggcagccgggcggcagc

SEQ ID NO: 1082105 - RNA, 20 nt, Mycobacterium bovis subsp bovis AF2122/97
ggcagccgggcggcagcggc

SEQ ID NO: 1082106 - RNA, 20 nt, Mycobacterium bovis subsp bovis AF2122/97
ggcagcgagacuucgacgcg

SEQ ID NO: 1082107 - RNA, 16 nt, Mycobacterium bovis subsp bovis AF2122/97
ggcagcgagucgacgu

SEQ ID NO: 1082108 - RNA, 16 nt, Mycobacterium bovis subsp bovis AF2122/97
ggcagcgccaggccgu

SEQ ID NO: 1082109 - RNA, 14 nt, Mycobacterium bovis subsp bovis AF2122/97
ggcagcgcacccgg

SEQ ID NO: 1082110 - RNA, 15 nt, Mycobacterium bovis subsp bovis AF2122/97
ggcagcgccggucgg

SEQ ID NO: 1082111 - RNA, 23 nt, Mycobacterium bovis subsp bovis AF2122/97
ggcagcgccggucggaucgguga

SEQ ID NO: 1082112 - RNA, 16 nt, Mycobacterium bovis subsp bovis AF2122/97
ggcagcgccgcagcga

SEQ ID NO: 1082113 - RNA, 19 nt, Mycobacterium bovis subsp bovis AF2122/97
ggcagccgcauaggccccg

SEQ ID NO: 1082114 - RNA, 16 nt, Mycobacterium bovis subsp bovis AF2122/97
ggcagccgcccgccca

SEQ ID NO: 1082115 - RNA, 13 nt, Mycobacterium bovis subsp bovis AF2122/97
ggcagcccggcgg

SEQ ID NO: 1082116 - RNA, 14 nt, Mycobacterium bovis subsp bovis AF2122/97
ggcagcccggcggc

SEQ ID NO: 1082117 - RNA, 13 nt, Mycobacterium bovis subsp bovis AF2122/97
ggcagcccguucg

SEQ ID NO: 1082118 - RNA, 18 nt, Mycobacterium bovis subsp bovis AF2122/97
ggcagcccguucgugccg

SEQ ID NO: 1082119 - RNA, 23 nt, Mycobacterium bovis subsp bovis AF2122/97
ggcagcccucugguggcgcugaa

SEQ ID NO: 1082120 - RNA, 17 nt, Mycobacterium bovis subsp bovis AF2122/97
ggcagccgaagcgcccg

SEQ ID NO: 1082121 - RNA, 19 nt, Mycobacterium bovis subsp bovis AF2122/97
ggcagccgaagcgcccguu

SEQ ID NO: 1082122 - RNA, 16 nt, Mycobacterium bovis subsp bovis AF2122/97
ggcagccccuccgcgc

SEQ ID NO: 1082123 - RNA, 22 nt, Mycobacterium bovis subsp bovis AF2122/97
ggcagcccccggauccgucgcg

SEQ ID NO: 1082124 - RNA, 14 nt, Mycobacterium bovis subsp bovis AF2122/97
ggcagcccggcgau

SEQ ID NO: 1082125 - RNA, 22 nt, Mycobacterium bovis subsp bovis AF2122/97
ggcagccacggguagcugccgc

SEQ ID NO: 1082126 - RNA, 20 nt, Mycobacterium bovis subsp bovis AF2122/97
ggcagccaaaaacgcugccg

SEQ ID NO: 1082127 - RNA, 16 nt, Mycobacterium bovis subsp bovis AF2122/97
ggcagccaccagcgac

SEQ ID NO: 1082128 - RNA, 18 nt, Mycobacterium bovis subsp bovis AF2122/97
ggcagccaccagcgacga

SEQ ID NO: 1082129 - RNA, 16 nt, Mycobacterium bovis subsp bovis AF2122/97
ggcagccaaccggcgc

SEQ ID NO: 1082130 - RNA, 16 nt, Mycobacterium bovis subsp bovis AF2122/97
ggcagccagccaccgg

SEQ ID NO: 1082131 - RNA, 17 nt, Mycobacterium bovis subsp bovis AF2122/97
ggcagccagccaccggg

SEQ ID NO: 1082132 - RNA, 14 nt, Mycobacterium bovis subsp bovis AF2122/97
ggcagccagcggcg

SEQ ID NO: 1082133 - RNA, 14 nt, Mycobacterium bovis subsp bovis AF2122/97
ggcagccaugcggc

SEQ ID NO: 1082134 - RNA, 22 nt, Mycobacterium bovis subsp bovis AF2122/97
ggcagcccaaagcgccagcagc

SEQ ID NO: 1082135 - RNA, 23 nt, Mycobacterium bovis subsp bovis AF2122/97
ggcagcccaaagcgccagcagcc

SEQ ID NO: 1082136 - RNA, 24 nt, Mycobacterium bovis subsp bovis AF2122/97
ggcagcccaaagcgccagcagcca

SEQ ID NO: 1082137 - RNA, 22 nt, Mycobacterium bovis subsp bovis AF2122/97
ggcagcacgucacgcaaccggc

SEQ ID NO: 1082138 - RNA, 19 nt, Mycobacterium bovis subsp bovis AF2122/97
ggcagcacucuucgaugaa

SEQ ID NO: 1082139 - RNA, 15 nt, Mycobacterium bovis subsp bovis AF2122/97
ggcagcacuuggacc

SEQ ID NO: 1082140 - RNA, 21 nt, Mycobacterium bovis subsp bovis AF2122/97
ggcagcacuuggacccggccg

SEQ ID NO: 1082141 - RNA, 15 nt, Mycobacterium bovis subsp bovis AF2122/97
ggcagcagccggcgg

SEQ ID NO: 1082142 - RNA, 14 nt, Mycobacterium bovis subsp bovis AF2122/97
ggcagcagcccggg

SEQ ID NO: 1082143 - RNA, 13 nt, Mycobacterium bovis subsp bovis AF2122/97
ggcagcagcgcgc

SEQ ID NO: 1082144 - RNA, 16 nt, Mycobacterium bovis subsp bovis AF2122/97
ggcagcauccucgacu

SEQ ID NO: 1082145 - RNA, 16 nt, Mycobacterium bovis subsp bovis AF2122/97
ggcagcaucggucaca

SEQ ID NO: 1082146 - RNA, 20 nt, Mycobacterium bovis subsp bovis AF2122/97
ggcagcauauccgccggcga

SEQ ID NO: 1082147 - RNA, 21 nt, Mycobacterium bovis subsp bovis AF2122/97
ggcagcauauccgccggcgac

SEQ ID NO: 1082148 - RNA, 15 nt, Mycobacterium bovis subsp bovis AF2122/97
ggcagcaucaacacc

SEQ ID NO: 1082149 - RNA, 19 nt, Mycobacterium bovis subsp bovis AF2122/97
ggcagcaucaacaccggcu

SEQ ID NO: 1082150 - RNA, 12 nt, Mycobacterium bovis subsp bovis AF2122/97
ggcagcagcugg

SEQ ID NO: 1082151 - RNA, 16 nt, Mycobacterium bovis subsp bovis AF2122/97
ggcagcaggcccaccc

SEQ ID NO: 1082152 - RNA, 16 nt, Mycobacterium bovis subsp bovis AF2122/97
ggcagcaggcgaugcg

SEQ ID NO: 1082153 - RNA, 13 nt, Mycobacterium bovis subsp bovis AF2122/97
ggcagcaccagcg

SEQ ID NO: 1082154 - RNA, 17 nt, Mycobacterium bovis subsp bovis AF2122/97
ggcagcacaggcuggcg

SEQ ID NO: 1082155 - RNA, 16 nt, Mycobacterium bovis subsp bovis AF2122/97
ggcagcaccagcgccu

SEQ ID NO: 1082156 - RNA, 19 nt, Mycobacterium bovis subsp bovis AF2122/97
ggcagcacccgcacggugu

SEQ ID NO: 1082157 - RNA, 21 nt, Mycobacterium bovis subsp bovis AF2122/97
ggcagcacccgcacgguguau

SEQ ID NO: 1082158 - RNA, 15 nt, Mycobacterium bovis subsp bovis AF2122/97
ggcagcacccgcgcc

SEQ ID NO: 1082159 - RNA, 17 nt, Mycobacterium bovis subsp bovis AF2122/97
ggcagcacgccagcccc

SEQ ID NO: 1082160 - RNA, 14 nt, Mycobacterium bovis subsp bovis AF2122/97
ggcagaccggcauc

SEQ ID NO: 1082161 - RNA, 13 nt, Mycobacterium bovis subsp bovis AF2122/97
ggcagaccggugc

SEQ ID NO: 1082162 - RNA, 22 nt, Mycobacterium bovis subsp bovis AF2122/97
ggcagcaacgacgucgucgccg

SEQ ID NO: 1082163 - RNA, 22 nt, Mycobacterium bovis subsp bovis AF2122/97
ggcagaagucguugcgcggucu

SEQ ID NO: 1082164 - RNA, 19 nt, Mycobacterium bovis subsp bovis AF2122/97
ggcagaaucggugggcggg

SEQ ID NO: 1082165 - RNA, 13 nt, Mycobacterium bovis subsp bovis AF2122/97
ggcagacacgcug

SEQ ID NO: 1082166 - RNA, 23 nt, Mycobacterium bovis subsp bovis AF2122/97
ggcagacacgcugcaggcggccg

SEQ ID NO: 1082167 - RNA, 20 nt, Mycobacterium bovis subsp bovis AF2122/97
ggcagaccaagcccgucguc

SEQ ID NO: 1082168 - RNA, 22 nt, Mycobacterium bovis subsp bovis AF2122/97
ggcagaccaagcccgucgucgu

SEQ ID NO: 1082169 - RNA, 23 nt, Mycobacterium bovis subsp bovis AF2122/97
ggcagugaaauugccgccgccgg

SEQ ID NO: 1082170 - RNA, 16 nt, Mycobacterium bovis subsp bovis AF2122/97
ggcagucccagcgccg

SEQ ID NO: 1082171 - RNA, 22 nt, Mycobacterium bovis subsp bovis AF2122/97
ggcagugagggucccacggcgg

SEQ ID NO: 1082172 - RNA, 23 nt, Mycobacterium bovis subsp bovis AF2122/97
ggcagugagggucccacggcggu

SEQ ID NO: 1082173 - RNA, 17 nt, Mycobacterium bovis subsp bovis AF2122/97
ggcagugcaggcggccg

SEQ ID NO: 1082174 - RNA, 16 nt, Mycobacterium bovis subsp bovis AF2122/97
ggcaguggcgcggcga

SEQ ID NO: 1082175 - RNA, 20 nt, Mycobacterium bovis subsp bovis AF2122/97
ggcaggguguuuauggcccu

SEQ ID NO: 1082176 - RNA, 19 nt, Mycobacterium bovis subsp bovis AF2122/97
ggcagguccaucuggcgcg

SEQ ID NO: 1082177 - RNA, 22 nt, Mycobacterium bovis subsp bovis AF2122/97
ggcagguaccaccgcggugugg

SEQ ID NO: 1082178 - RNA, 19 nt, Mycobacterium bovis subsp bovis AF2122/97
ggcaguccaccgcgcggcg

SEQ ID NO: 1082179 - RNA, 23 nt, Mycobacterium bovis subsp bovis AF2122/97
ggcaguccaccgcgcggcgcagc

SEQ ID NO: 1082180 - RNA, 15 nt, Mycobacterium bovis subsp bovis AF2122/97
ggcaguccagccggg

SEQ ID NO: 1082181 - RNA, 14 nt, Mycobacterium bovis subsp bovis AF2122/97
ggcagcggugcugg

SEQ ID NO: 1082182 - RNA, 23 nt, Mycobacterium bovis subsp bovis AF2122/97
ggcagcggguuugccgggcgcug

SEQ ID NO: 1082183 - RNA, 12 nt, Mycobacterium bovis subsp bovis AF2122/97
ggcagcgggccg

SEQ ID NO: 1082184 - RNA, 19 nt, Mycobacterium bovis subsp bovis AF2122/97
ggcagcgguguagccggcg

SEQ ID NO: 1082185 - RNA, 20 nt, Mycobacterium bovis subsp bovis AF2122/97
ggcagcgguguagccggcgc

SEQ ID NO: 1082186 - RNA, 18 nt, Mycobacterium bovis subsp bovis AF2122/97
ggcagcguagugcugcgc

SEQ ID NO: 1082187 - RNA, 17 nt, Mycobacterium bovis subsp bovis AF2122/97
ggcagcgucgucgacga

SEQ ID NO: 1082188 - RNA, 19 nt, Mycobacterium bovis subsp bovis AF2122/97
ggcagcgucacccugucgc

SEQ ID NO: 1082189 - RNA, 18 nt, Mycobacterium bovis subsp bovis AF2122/97
ggcagcuccaccaggacg

SEQ ID NO: 1082190 - RNA, 15 nt, Mycobacterium bovis subsp bovis AF2122/97
ggcagcuccagcaaa

SEQ ID NO: 1082191 - RNA, 14 nt, Mycobacterium bovis subsp bovis AF2122/97
ggcagggccagcgg

SEQ ID NO: 1082192 - RNA, 16 nt, Mycobacterium bovis subsp bovis AF2122/97
ggcagggcagcccggc

SEQ ID NO: 1082193 - RNA, 21 nt, Mycobacterium bovis subsp bovis AF2122/97
ggcauccgccccgcccgcacc

SEQ ID NO: 1082194 - RNA, 20 nt, Mycobacterium bovis subsp bovis AF2122/97
ggcauccccaguugugcggc

SEQ ID NO: 1082195 - RNA, 15 nt, Mycobacterium bovis subsp bovis AF2122/97
ggcauccagcuucgc

SEQ ID NO: 1082196 - RNA, 17 nt, Mycobacterium bovis subsp bovis AF2122/97
ggcauccaggcugucgc

SEQ ID NO: 1082197 - RNA, 12 nt, Mycobacterium bovis subsp bovis AF2122/97
ggcaucgacgcg

SEQ ID NO: 1082198 - RNA, 13 nt, Mycobacterium bovis subsp bovis AF2122/97
ggcaucgacgcgg

SEQ ID NO: 1082199 - RNA, 17 nt, Mycobacterium bovis subsp bovis AF2122/97
ggcaucgacugccagcg

SEQ ID NO: 1082200 - RNA, 20 nt, Mycobacterium bovis subsp bovis AF2122/97
ggcaucgcgcgcggcuccgu

SEQ ID NO: 1082201 - RNA, 21 nt, Mycobacterium bovis subsp bovis AF2122/97
ggcaucgcgcgcggcuccguu

SEQ ID NO: 1082202 - RNA, 18 nt, Mycobacterium bovis subsp bovis AF2122/97
ggcaucaucgcugugcgc

SEQ ID NO: 1082203 - RNA, 21 nt, Mycobacterium bovis subsp bovis AF2122/97
ggcaucaucgcugugcgcugg

SEQ ID NO: 1082204 - RNA, 16 nt, Mycobacterium bovis subsp bovis AF2122/97
ggcaucaucagcggcg

SEQ ID NO: 1082205 - RNA, 17 nt, Mycobacterium bovis subsp bovis AF2122/97
ggcaucaggccgcgcgg

SEQ ID NO: 1082206 - RNA, 13 nt, Mycobacterium bovis subsp bovis AF2122/97
ggcaucaccuggc

SEQ ID NO: 1082207 - RNA, 23 nt, Mycobacterium bovis subsp bovis AF2122/97
ggcaucaccuggcgugucgccgc

SEQ ID NO: 1082208 - RNA, 23 nt, Mycobacterium bovis subsp bovis AF2122/97
ggcagugggggugguaccggcgg

SEQ ID NO: 1082209 - RNA, 22 nt, Mycobacterium bovis subsp bovis AF2122/97
ggcaguucaacgaggccgacga

SEQ ID NO: 1082210 - RNA, 21 nt, Mycobacterium bovis subsp bovis AF2122/97
ggcaucaagaaacguggugac

SEQ ID NO: 1082211 - RNA, 15 nt, Mycobacterium bovis subsp bovis AF2122/97
ggcaucaccgacgcg

SEQ ID NO: 1082212 - RNA, 15 nt, Mycobacterium bovis subsp bovis AF2122/97
ggcaucaccgccgcg

SEQ ID NO: 1082213 - RNA, 16 nt, Mycobacterium bovis subsp bovis AF2122/97
ggcaucaccgccgcgg

SEQ ID NO: 1082214 - RNA, 23 nt, Mycobacterium bovis subsp bovis AF2122/97
ggcaucaccgccgcggccgccgu

SEQ ID NO: 1082215 - RNA, 19 nt, Mycobacterium bovis subsp bovis AF2122/97
ggcaucaacgcgggcgcuu

SEQ ID NO: 1082216 - RNA, 22 nt, Mycobacterium bovis subsp bovis AF2122/97
ggcaccgaaaaacaccagcgag

SEQ ID NO: 1082217 - RNA, 16 nt, Mycobacterium bovis subsp bovis AF2122/97
ggcaccgaaaaacacc

SEQ ID NO: 1082218 - RNA, 20 nt, Mycobacterium bovis subsp bovis AF2122/97
ggcaccgaaaaacaccagcg

SEQ ID NO: 1082219 - RNA, 21 nt, Mycobacterium bovis subsp bovis AF2122/97
ggcacccgucgggugcugaug

SEQ ID NO: 1082220 - RNA, 17 nt, Mycobacterium bovis subsp bovis AF2122/97
ggcaccagcggcaccgc

SEQ ID NO: 1082221 - RNA, 20 nt, Mycobacterium bovis subsp bovis AF2122/97
ggcacccuugccgauuccgg

SEQ ID NO: 1082222 - RNA, 13 nt, Mycobacterium bovis subsp bovis AF2122/97
ggcacccuugccg

SEQ ID NO: 1082223 - RNA, 15 nt, Mycobacterium bovis subsp bovis AF2122/97
ggcacccuccgccgg

SEQ ID NO: 1082224 - RNA, 14 nt, Mycobacterium bovis subsp bovis AF2122/97
ggcacccucggcgu

SEQ ID NO: 1082225 - RNA, 18 nt, Mycobacterium bovis subsp bovis AF2122/97
ggcaccgguuuucgccgg

SEQ ID NO: 1082226 - RNA, 19 nt, Mycobacterium bovis subsp bovis AF2122/97
ggcaccgguuuucgccggc

SEQ ID NO: 1082227 - RNA, 23 nt, Mycobacterium bovis subsp bovis AF2122/97
ggcaccgguuuucgccggcuccg

SEQ ID NO: 1082228 - RNA, 19 nt, Mycobacterium bovis subsp bovis AF2122/97
ggcaccguagagcaugccg

SEQ ID NO: 1082229 - RNA, 21 nt, Mycobacterium bovis subsp bovis AF2122/97
ggcaccguagagcaugccgcc

SEQ ID NO: 1082230 - RNA, 15 nt, Mycobacterium bovis subsp bovis AF2122/97
ggcaccggccggugg

SEQ ID NO: 1082231 - RNA, 12 nt, Mycobacterium bovis subsp bovis AF2122/97
ggcaccggcgau

SEQ ID NO: 1082232 - RNA, 13 nt, Mycobacterium bovis subsp bovis AF2122/97
ggcaccggcgauc

SEQ ID NO: 1082233 - RNA, 23 nt, Mycobacterium bovis subsp bovis AF2122/97
ggcaccggcgaucguguccaccg

SEQ ID NO: 1082234 - RNA, 11 nt, Mycobacterium bovis subsp bovis AF2122/97
ggcaccggcgg

SEQ ID NO: 1082235 - RNA, 12 nt, Mycobacterium bovis subsp bovis AF2122/97
ggcaccggcggc

SEQ ID NO: 1082236 - RNA, 19 nt, Mycobacterium bovis subsp bovis AF2122/97
ggcaccggccuugcccuca

SEQ ID NO: 1082237 - RNA, 17 nt, Mycobacterium bovis subsp bovis AF2122/97
ggcaccgacgucggcuu

SEQ ID NO: 1082238 - RNA, 19 nt, Mycobacterium bovis subsp bovis AF2122/97
ggcaccagcgggucggcgg

SEQ ID NO: 1082239 - RNA, 13 nt, Mycobacterium bovis subsp bovis AF2122/97
ggcaccagcggca

SEQ ID NO: 1082240 - RNA, 22 nt, Mycobacterium bovis subsp bovis AF2122/97
ggcaccagcacacucucgucgu

SEQ ID NO: 1082241 - RNA, 14 nt, Mycobacterium bovis subsp bovis AF2122/97
ggcaccagcgcgcg

SEQ ID NO: 1082242 - RNA, 21 nt, Mycobacterium bovis subsp bovis AF2122/97
ggcaccagcgcgcgccgagcc

SEQ ID NO: 1082243 - RNA, 22 nt, Mycobacterium bovis subsp bovis AF2122/97
ggcaccagcgcgcgccgagccc

SEQ ID NO: 1082244 - RNA, 23 nt, Mycobacterium bovis subsp bovis AF2122/97
ggcacccggggugcccggccgcc

SEQ ID NO: 1082245 - RNA, 14 nt, Mycobacterium bovis subsp bovis AF2122/97
ggcacccggucggc

SEQ ID NO: 1082246 - RNA, 15 nt, Mycobacterium bovis subsp bovis AF2122/97
ggcacccgcuggcgg

SEQ ID NO: 1082247 - RNA, 15 nt, Mycobacterium bovis subsp bovis AF2122/97
ggcacccggcagagc

SEQ ID NO: 1082248 - RNA, 15 nt, Mycobacterium bovis subsp bovis AF2122/97
ggcaccagccgguga

SEQ ID NO: 1082249 - RNA, 23 nt, Mycobacterium bovis subsp bovis AF2122/97
ggcaccagccggugagcgagcgc

SEQ ID NO: 1082250 - RNA, 13 nt, Mycobacterium bovis subsp bovis AF2122/97
ggcaccagcgaau

SEQ ID NO: 1082251 - RNA, 16 nt, Mycobacterium bovis subsp bovis AF2122/97
ggcaccacccuugccg

SEQ ID NO: 1082252 - RNA, 18 nt, Mycobacterium bovis subsp bovis AF2122/97
ggcacacuccugcaccau

SEQ ID NO: 1082253 - RNA, 23 nt, Mycobacterium bovis subsp bovis AF2122/97
ggcaccacgaucaacucgugcgg

SEQ ID NO: 1082254 - RNA, 15 nt, Mycobacterium bovis subsp bovis AF2122/97
ggcaccacgcugugc

SEQ ID NO: 1082255 - RNA, 20 nt, Mycobacterium bovis subsp bovis AF2122/97
ggcaccggggcugcccgcgg

SEQ ID NO: 1082256 - RNA, 16 nt, Mycobacterium bovis subsp bovis AF2122/97
ggcaccgucagaccau

SEQ ID NO: 1082257 - RNA, 17 nt, Mycobacterium bovis subsp bovis AF2122/97
ggcacgaucaaccgggu

SEQ ID NO: 1082258 - RNA, 19 nt, Mycobacterium bovis subsp bovis AF2122/97
ggcacgaucaucggggugg

SEQ ID NO: 1082259 - RNA, 21 nt, Mycobacterium bovis subsp bovis AF2122/97
ggcacgccgggcaucggcggu

SEQ ID NO: 1082260 - RNA, 15 nt, Mycobacterium bovis subsp bovis AF2122/97
ggcacgccgaccggu

SEQ ID NO: 1082261 - RNA, 16 nt, Mycobacterium bovis subsp bovis AF2122/97
ggcacgccgaccggug

SEQ ID NO: 1082262 - RNA, 23 nt, Mycobacterium bovis subsp bovis AF2122/97
ggcacgccgaccgguggcaccgg

SEQ ID NO: 1082263 - RNA, 14 nt, Mycobacterium bovis subsp bovis AF2122/97
ggcacgccgccgac

SEQ ID NO: 1082264 - RNA, 16 nt, Mycobacterium bovis subsp bovis AF2122/97
ggcacgccgccgacgu

SEQ ID NO: 1082265 - RNA, 16 nt, Mycobacterium bovis subsp bovis AF2122/97
ggcacgggcgucgucg

SEQ ID NO: 1082266 - RNA, 22 nt, Mycobacterium bovis subsp bovis AF2122/97
ggcacgggucgucaugccaguc

SEQ ID NO: 1082267 - RNA, 20 nt, Mycobacterium bovis subsp bovis AF2122/97
ggcacguccgaucggcgcgc

SEQ ID NO: 1082268 - RNA, 20 nt, Mycobacterium bovis subsp bovis AF2122/97
ggcacgucgagcgugaaccu

SEQ ID NO: 1082269 - RNA, 16 nt, Mycobacterium bovis subsp bovis AF2122/97
ggcacgucgucguccc

SEQ ID NO: 1082270 - RNA, 20 nt, Mycobacterium bovis subsp bovis AF2122/97
ggcacguucagccaggcgug

SEQ ID NO: 1082271 - RNA, 15 nt, Mycobacterium bovis subsp bovis AF2122/97
ggcacguucggcgca

SEQ ID NO: 1082272 - RNA, 19 nt, Mycobacterium bovis subsp bovis AF2122/97
ggcacguggcgaccggcga

SEQ ID NO: 1082273 - RNA, 18 nt, Mycobacterium bovis subsp bovis AF2122/97
ggcacguggcgaccggcg

SEQ ID NO: 1082274 - RNA, 20 nt, Mycobacterium bovis subsp bovis AF2122/97
ggcacuuuguagcccgcgau

SEQ ID NO: 1082275 - RNA, 20 nt, Mycobacterium bovis subsp bovis AF2122/97
ggcacuuccagcccggcaau

SEQ ID NO: 1082276 - RNA, 16 nt, Mycobacterium bovis subsp bovis AF2122/97
ggaucgacaccgacgc

SEQ ID NO: 1082277 - RNA, 17 nt, Mycobacterium bovis subsp bovis AF2122/97
ggaucgacaccgacgcg

SEQ ID NO: 1082278 - RNA, 17 nt, Mycobacterium bovis subsp bovis AF2122/97
ggcaaaguuggccgccc

SEQ ID NO: 1082279 - RNA, 12 nt, Mycobacterium bovis subsp bovis AF2122/97
ggaucgaccgcc

SEQ ID NO: 1082280 - RNA, 17 nt, Mycobacterium bovis subsp bovis AF2122/97
ggaucgagagccgaccg

SEQ ID NO: 1082281 - RNA, 23 nt, Mycobacterium bovis subsp bovis AF2122/97
ggaucccugugccagcagcagcg

SEQ ID NO: 1082282 - RNA, 24 nt, Mycobacterium bovis subsp bovis AF2122/97
ggaucgaccaauucgaccgcgcgg

SEQ ID NO: 1082283 - RNA, 17 nt, Mycobacterium bovis subsp bovis AF2122/97
ggcaaaucaagcacagc

SEQ ID NO: 1082284 - RNA, 18 nt, Mycobacterium bovis subsp bovis AF2122/97
ggcaaaucggugcgaucc

SEQ ID NO: 1082285 - RNA, 21 nt, Mycobacterium bovis subsp bovis AF2122/97
ggcaacagcggggugugcggu

SEQ ID NO: 1082286 - RNA, 13 nt, Mycobacterium bovis subsp bovis AF2122/97
ggcaacagcgcca

SEQ ID NO: 1082287 - RNA, 22 nt, Mycobacterium bovis subsp bovis AF2122/97
ggcaacaucagcaggaccaacg

SEQ ID NO: 1082288 - RNA, 16 nt, Mycobacterium bovis subsp bovis AF2122/97
ggcaacaucggguucu

SEQ ID NO: 1082289 - RNA, 15 nt, Mycobacterium bovis subsp bovis AF2122/97
ggcaaccaccggccg

SEQ ID NO: 1082290 - RNA, 19 nt, Mycobacterium bovis subsp bovis AF2122/97
ggcaaccaccggccgcgca

SEQ ID NO: 1082291 - RNA, 21 nt, Mycobacterium bovis subsp bovis AF2122/97
ggcaaccaccggccgcgcaga

SEQ ID NO: 1082292 - RNA, 15 nt, Mycobacterium bovis subsp bovis AF2122/97
ggcaacgcgaaccgg

SEQ ID NO: 1082293 - RNA, 19 nt, Mycobacterium bovis subsp bovis AF2122/97
ggcaacaccaccucgacga

SEQ ID NO: 1082294 - RNA, 22 nt, Mycobacterium bovis subsp bovis AF2122/97
ggcaacggcggaucggcggccg

SEQ ID NO: 1082295 - RNA, 20 nt, Mycobacterium bovis subsp bovis AF2122/97
ggcaacggcggcaacggcgg

SEQ ID NO: 1082296 - RNA, 20 nt, Mycobacterium bovis subsp bovis AF2122/97
ggcaacggcggcgacggcgg

SEQ ID NO: 1082297 - RNA, 12 nt, Mycobacterium bovis subsp bovis AF2122/97
ggcaacggcggg

SEQ ID NO: 1082298 - RNA, 16 nt, Mycobacterium bovis subsp bovis AF2122/97
ggcaacggcggggccg

SEQ ID NO: 1082299 - RNA, 21 nt, Mycobacterium bovis subsp bovis AF2122/97
ggcaacggcgguaacggcggu

SEQ ID NO: 1082300 - RNA, 21 nt, Mycobacterium bovis subsp bovis AF2122/97
ggcaacggacgggaucgccca

SEQ ID NO: 1082301 - RNA, 20 nt, Mycobacterium bovis subsp bovis AF2122/97
ggcaacggguccgacggugu

SEQ ID NO: 1082302 - RNA, 18 nt, Mycobacterium bovis subsp bovis AF2122/97
ggcaacgguacgcgcuga

SEQ ID NO: 1082303 - RNA, 19 nt, Mycobacterium bovis subsp bovis AF2122/97
ggcaacgguggcaacggag

SEQ ID NO: 1082304 - RNA, 17 nt, Mycobacterium bovis subsp bovis AF2122/97
ggcaacgcgaaccggcc

SEQ ID NO: 1082305 - RNA, 19 nt, Mycobacterium bovis subsp bovis AF2122/97
ggcaacggaggugccggcg

SEQ ID NO: 1082306 - RNA, 20 nt, Mycobacterium bovis subsp bovis AF2122/97
ggcaacggaggugccggcgc

SEQ ID NO: 1082307 - RNA, 22 nt, Mycobacterium bovis subsp bovis AF2122/97
ggcaacggaggugccggcgcca

SEQ ID NO: 1082308 - RNA, 22 nt, Mycobacterium bovis subsp bovis AF2122/97
ggcaacgugccucucuccgcgc

SEQ ID NO: 1082309 - RNA, 22 nt, Mycobacterium bovis subsp bovis AF2122/97
ggcaacuccggucaacacccgc

SEQ ID NO: 1082310 - RNA, 23 nt, Mycobacterium bovis subsp bovis AF2122/97
ggcaacuccggucaacacccgcc

SEQ ID NO: 1082311 - RNA, 20 nt, Mycobacterium bovis subsp bovis AF2122/97
ggcaagcugaccgccagcgg

SEQ ID NO: 1082312 - RNA, 18 nt, Mycobacterium bovis subsp bovis AF2122/97
ggcaagcugucgucgccc

SEQ ID NO: 1082313 - RNA, 21 nt, Mycobacterium bovis subsp bovis AF2122/97
ggcaaggcauccaacgcggcg

SEQ ID NO: 1082314 - RNA, 15 nt, Mycobacterium bovis subsp bovis AF2122/97
ggcaagcggccgcgg

SEQ ID NO: 1082315 - RNA, 21 nt, Mycobacterium bovis subsp bovis AF2122/97
ggcaauugcgguucgaacgcg

SEQ ID NO: 1082316 - RNA, 18 nt, Mycobacterium bovis subsp bovis AF2122/97
ggcaauucgggcaugguc

SEQ ID NO: 1082317 - RNA, 22 nt, Mycobacterium bovis subsp bovis AF2122/97
ggcaaucgaggaaggugugcgu

SEQ ID NO: 1082318 - RNA, 16 nt, Mycobacterium bovis subsp bovis AF2122/97
ggcacacccgcaccgg

SEQ ID NO: 1082319 - RNA, 17 nt, Mycobacterium bovis subsp bovis AF2122/97
ggcacacccgcaccgga

SEQ ID NO: 1082320 - RNA, 14 nt, Mycobacterium bovis subsp bovis AF2122/97
ggcacaccgacgcc

SEQ ID NO: 1082321 - RNA, 18 nt, Mycobacterium bovis subsp bovis AF2122/97
ggcacacggucaccggca

SEQ ID NO: 1082322 - RNA, 22 nt, Mycobacterium bovis subsp bovis AF2122/97
ggcacaauaggcuccagcgcgc

SEQ ID NO: 1082323 - RNA, 17 nt, Mycobacterium bovis subsp bovis AF2122/97
ggcacaaucaccgccgc

SEQ ID NO: 1082324 - RNA, 20 nt, Mycobacterium bovis subsp bovis AF2122/97
ggcacaaucggauagccgug

SEQ ID NO: 1082325 - RNA, 23 nt, Mycobacterium bovis subsp bovis AF2122/97
ggcacaaucggauagccgugcug

SEQ ID NO: 1082326 - RNA, 13 nt, Mycobacterium bovis subsp bovis AF2122/97
ggcacaaucggcg

SEQ ID NO: 1082327 - RNA, 15 nt, Mycobacterium bovis subsp bovis AF2122/97
ggcacaacaucgccg

SEQ ID NO: 1082328 - RNA, 21 nt, Mycobacterium bovis subsp bovis AF2122/97
ggcaaucaucucccgaccgcc

SEQ ID NO: 1082329 - RNA, 23 nt, Mycobacterium bovis subsp bovis AF2122/97
ggcaaucacaucaaagucggcgu

SEQ ID NO: 1082330 - RNA, 23 nt, Mycobacterium bovis subsp bovis AF2122/97
ggcaauagccggguugccugcgc

SEQ ID NO: 1082331 - RNA, 20 nt, Mycobacterium bovis subsp bovis AF2122/97
ggcaauaccgccagcgccac

SEQ ID NO: 1082332 - RNA, 14 nt, Mycobacterium bovis subsp bovis AF2122/97
ggcaaggccaccgg

SEQ ID NO: 1082333 - RNA, 18 nt, Mycobacterium bovis subsp bovis AF2122/97
ggcaaggccaccggcggu

SEQ ID NO: 1082334 - RNA, 13 nt, Mycobacterium bovis subsp bovis AF2122/97
ggcaaggcggcgg

SEQ ID NO: 1082335 - RNA, 14 nt, Mycobacterium bovis subsp bovis AF2122/97
ggcaaggcggcggc

SEQ ID NO: 1082336 - RNA, 21 nt, Mycobacterium bovis subsp bovis AF2122/97
ggcaagucaacaccgcggccg

SEQ ID NO: 1082337 - RNA, 18 nt, Mycobacterium bovis subsp bovis AF2122/97
ggcaagucgacgccgcag

SEQ ID NO: 1082338 - RNA, 24 nt, Mycobacterium bovis subsp bovis AF2122/97
ggcaagucgcccagccgagcgugg

SEQ ID NO: 1082339 - RNA, 16 nt, Mycobacterium bovis subsp bovis AF2122/97
ggcaauacccgccgcg

SEQ ID NO: 1082340 - RNA, 19 nt, Mycobacterium bovis subsp bovis AF2122/97
ggcaauaccgccagcgcca

SEQ ID NO: 1082341 - RNA, 14 nt, Mycobacterium bovis subsp bovis AF2122/97
ggaucccgaggcgc

SEQ ID NO: 1082342 - RNA, 16 nt, Mycobacterium bovis subsp bovis AF2122/97
ggaucccgccgcugcc

SEQ ID NO: 1082343 - RNA, 18 nt, Mycobacterium bovis subsp bovis AF2122/97
ggaucccgccgcugccgc

SEQ ID NO: 1082344 - RNA, 20 nt, Mycobacterium bovis subsp bovis AF2122/97
ggaucccgccgcugccgccg

SEQ ID NO: 1082345 - RNA, 23 nt, Mycobacterium bovis subsp bovis AF2122/97
ggaucccagugccagugccagcg

SEQ ID NO: 1082346 - RNA, 15 nt, Mycobacterium bovis subsp bovis AF2122/97
ggaucccccgcgcga

SEQ ID NO: 1082347 - RNA, 20 nt, Mycobacterium bovis subsp bovis AF2122/97
ggauccaggcccagccgagc

SEQ ID NO: 1082348 - RNA, 16 nt, Mycobacterium bovis subsp bovis AF2122/97
ggaucaugaccaucga

SEQ ID NO: 1082349 - RNA, 19 nt, Mycobacterium bovis subsp bovis AF2122/97
ggauccagaaacugcucgg

SEQ ID NO: 1082350 - RNA, 15 nt, Mycobacterium bovis subsp bovis AF2122/97
ggauccagcaggccg

SEQ ID NO: 1082351 - RNA, 13 nt, Mycobacterium bovis subsp bovis AF2122/97
ggaucccagcgca

SEQ ID NO: 1082352 - RNA, 19 nt, Mycobacterium bovis subsp bovis AF2122/97
ggaucauguucggccacca

SEQ ID NO: 1082353 - RNA, 13 nt, Mycobacterium bovis subsp bovis AF2122/97
ggaucccacggcg

SEQ ID NO: 1082354 - RNA, 21 nt, Mycobacterium bovis subsp bovis AF2122/97
ggaucccacgaguuggccaag

SEQ ID NO: 1082355 - RNA, 22 nt, Mycobacterium bovis subsp bovis AF2122/97
ggauccuccggguuggcgacga

SEQ ID NO: 1082356 - RNA, 13 nt, Mycobacterium bovis subsp bovis AF2122/97
ggauccggcagca

SEQ ID NO: 1082357 - RNA, 20 nt, Mycobacterium bovis subsp bovis AF2122/97
ggauccggcagcagccggcg

SEQ ID NO: 1082358 - RNA, 16 nt, Mycobacterium bovis subsp bovis AF2122/97
ggaucgaagaccagca

SEQ ID NO: 1082359 - RNA, 15 nt, Mycobacterium bovis subsp bovis AF2122/97
ggauccgauccgcac

SEQ ID NO: 1082360 - RNA, 21 nt, Mycobacterium bovis subsp bovis AF2122/97
ggauccgaugacauaugacgg

SEQ ID NO: 1082361 - RNA, 22 nt, Mycobacterium bovis subsp bovis AF2122/97
ggauccgcaccacgcccgacga

SEQ ID NO: 1082362 - RNA, 18 nt, Mycobacterium bovis subsp bovis AF2122/97
ggaucccgguggcagcac

SEQ ID NO: 1082363 - RNA, 11 nt, Mycobacterium bovis subsp bovis AF2122/97
ggaucccggug

SEQ ID NO: 1082364 - RNA, 12 nt, Mycobacterium bovis subsp bovis AF2122/97
ggauccgcgcgc

SEQ ID NO: 1082365 - RNA, 17 nt, Mycobacterium bovis subsp bovis AF2122/97
ggauccgaccccgcgcc

SEQ ID NO: 1082366 - RNA, 22 nt, Mycobacterium bovis subsp bovis AF2122/97
ggauccgaccccgcgccgacac

SEQ ID NO: 1082367 - RNA, 16 nt, Mycobacterium bovis subsp bovis AF2122/97
ggaucagggcuuucgc

SEQ ID NO: 1082368 - RNA, 20 nt, Mycobacterium bovis subsp bovis AF2122/97
ggaucaguuugccaucggga

SEQ ID NO: 1082369 - RNA, 13 nt, Mycobacterium bovis subsp bovis AF2122/97
ggaucauguucgg

SEQ ID NO: 1082370 - RNA, 13 nt, Mycobacterium bovis subsp bovis AF2122/97
ggauccaccacgc

SEQ ID NO: 1082371 - RNA, 21 nt, Mycobacterium bovis subsp bovis AF2122/97
ggaucaucaagggugcgucgc

SEQ ID NO: 1082372 - RNA, 17 nt, Mycobacterium bovis subsp bovis AF2122/97
ggaucauccuucgccgg

SEQ ID NO: 1082373 - RNA, 20 nt, Mycobacterium bovis subsp bovis AF2122/97
ggaucauccuucgccggcgc

SEQ ID NO: 1082374 - RNA, 21 nt, Mycobacterium bovis subsp bovis AF2122/97
ggaucauccuucgccggcgcc

SEQ ID NO: 1082375 - RNA, 14 nt, Mycobacterium bovis subsp bovis AF2122/97
ggaucaucgccgcg

SEQ ID NO: 1082376 - RNA, 17 nt, Mycobacterium bovis subsp bovis AF2122/97
ggaucaucgccgcggcc

SEQ ID NO: 1082377 - RNA, 15 nt, Mycobacterium bovis subsp bovis AF2122/97
ggaucagcgugucgc

SEQ ID NO: 1082378 - RNA, 22 nt, Mycobacterium bovis subsp bovis AF2122/97
ggaucagcccgcgcagcagugc

SEQ ID NO: 1082379 - RNA, 19 nt, Mycobacterium bovis subsp bovis AF2122/97
ggaucagccgugcgggccg

SEQ ID NO: 1082380 - RNA, 20 nt, Mycobacterium bovis subsp bovis AF2122/97
ggaucaggcccgggcggaug

SEQ ID NO: 1082381 - RNA, 15 nt, Mycobacterium bovis subsp bovis AF2122/97
ggaucacgccgccgg

SEQ ID NO: 1082382 - RNA, 14 nt, Mycobacterium bovis subsp bovis AF2122/97
ggaucagaacgcgg

SEQ ID NO: 1082383 - RNA, 18 nt, Mycobacterium bovis subsp bovis AF2122/97
ggauagccucggcggcgc

SEQ ID NO: 1082384 - RNA, 18 nt, Mycobacterium bovis subsp bovis AF2122/97
ggauaggccgcgcggcgg

SEQ ID NO: 1082385 - RNA, 23 nt, Mycobacterium bovis subsp bovis AF2122/97
ggauaggccgcgcggcggcgccg

SEQ ID NO: 1082386 - RNA, 14 nt, Mycobacterium bovis subsp bovis AF2122/97
ggauagacggcgac

SEQ ID NO: 1082387 - RNA, 12 nt, Mycobacterium bovis subsp bovis AF2122/97
ggauaccggggu

SEQ ID NO: 1082388 - RNA, 18 nt, Mycobacterium bovis subsp bovis AF2122/97
ggauaccggucagcaccu

SEQ ID NO: 1082389 - RNA, 23 nt, Mycobacterium bovis subsp bovis AF2122/97
ggauaccgcucagggugcgccgc

SEQ ID NO: 1082390 - RNA, 19 nt, Mycobacterium bovis subsp bovis AF2122/97
ggauaccgcugggucgccg

SEQ ID NO: 1082391 - RNA, 15 nt, Mycobacterium bovis subsp bovis AF2122/97
ggauacccagcgccc

SEQ ID NO: 1082392 - RNA, 13 nt, Mycobacterium bovis subsp bovis AF2122/97
ggauacagccgcc

SEQ ID NO: 1082393 - RNA, 12 nt, Mycobacterium bovis subsp bovis AF2122/97
ggaucaccgauc

SEQ ID NO: 1082394 - RNA, 19 nt, Mycobacterium bovis subsp bovis AF2122/97
ggaucaccaucgccgccgc

SEQ ID NO: 1082395 - RNA, 21 nt, Mycobacterium bovis subsp bovis AF2122/97
ggaucaccaucgccgccgcgc

SEQ ID NO: 1082396 - RNA, 15 nt, Mycobacterium bovis subsp bovis AF2122/97
ggaucaccccggccg

SEQ ID NO: 1082397 - RNA, 16 nt, Mycobacterium bovis subsp bovis AF2122/97
ggaucacccgccgcgu

SEQ ID NO: 1082398 - RNA, 18 nt, Mycobacterium bovis subsp bovis AF2122/97
ggaucacaccccaggcac

SEQ ID NO: 1082399 - RNA, 14 nt, Mycobacterium bovis subsp bovis AF2122/97
ggaucacgaccgcg

SEQ ID NO: 1082400 - RNA, 21 nt, Mycobacterium bovis subsp bovis AF2122/97
ggaucaaaaaccacgcgucgc

SEQ ID NO: 1082401 - RNA, 14 nt, Mycobacterium bovis subsp bovis AF2122/97
ggaucaacaggccg

SEQ ID NO: 1082402 - RNA, 13 nt, Mycobacterium bovis subsp bovis AF2122/97
ggauaucacgacg

SEQ ID NO: 1082403 - RNA, 19 nt, Mycobacterium bovis subsp bovis AF2122/97
ggaguacgggagccggcug

SEQ ID NO: 1082404 - RNA, 15 nt, Mycobacterium bovis subsp bovis AF2122/97
ggaguagccgcagcu

SEQ ID NO: 1082405 - RNA, 18 nt, Mycobacterium bovis subsp bovis AF2122/97
ggagucacgcagccgcgc

SEQ ID NO: 1082406 - RNA, 19 nt, Mycobacterium bovis subsp bovis AF2122/97
ggaguccgucgacaccgcg

SEQ ID NO: 1082407 - RNA, 22 nt, Mycobacterium bovis subsp bovis AF2122/97
ggagucgucgagcugaccacgg

SEQ ID NO: 1082408 - RNA, 14 nt, Mycobacterium bovis subsp bovis AF2122/97
ggaggugccggcgc

SEQ ID NO: 1082409 - RNA, 21 nt, Mycobacterium bovis subsp bovis AF2122/97
ggaggugguucacggggacca

SEQ ID NO: 1082410 - RNA, 15 nt, Mycobacterium bovis subsp bovis AF2122/97
ggaggguugccgccg

SEQ ID NO: 1082411 - RNA, 18 nt, Mycobacterium bovis subsp bovis AF2122/97
ggaggcuccuggucgccg

SEQ ID NO: 1082412 - RNA, 13 nt, Mycobacterium bovis subsp bovis AF2122/97
ggaguggccgggc

SEQ ID NO: 1082413 - RNA, 18 nt, Mycobacterium bovis subsp bovis AF2122/97
ggaguggccgggcgguag

SEQ ID NO: 1082414 - RNA, 16 nt, Mycobacterium bovis subsp bovis AF2122/97
ggaguugagcugucgc

SEQ ID NO: 1082415 - RNA, 20 nt, Mycobacterium bovis subsp bovis AF2122/97
ggaguugagcugucgcaacg

SEQ ID NO: 1082416 - RNA, 17 nt, Mycobacterium bovis subsp bovis AF2122/97
ggaguccggccgacccg

SEQ ID NO: 1082417 - RNA, 16 nt, Mycobacterium bovis subsp bovis AF2122/97
ggauaacccagcggcg

SEQ ID NO: 1082418 - RNA, 17 nt, Mycobacterium bovis subsp bovis AF2122/97
ggauaacccagcggcgc

SEQ ID NO: 1082419 - RNA, 23 nt, Mycobacterium bovis subsp bovis AF2122/97
ggaguugaucuccacggcggugc

SEQ ID NO: 1082420 - RNA, 20 nt, Mycobacterium bovis subsp bovis AF2122/97
ggaguugucgacggccaccc

SEQ ID NO: 1082421 - RNA, 15 nt, Mycobacterium bovis subsp bovis AF2122/97
ggagugcgccggcug

SEQ ID NO: 1082422 - RNA, 12 nt, Mycobacterium bovis subsp bovis AF2122/97
ggauaacccagc

SEQ ID NO: 1082423 - RNA, 19 nt, Mycobacterium bovis subsp bovis AF2122/97
ggaggaaucguucggggug

SEQ ID NO: 1082424 - RNA, 13 nt, Mycobacterium bovis subsp bovis AF2122/97
ggaggcagcgcga

SEQ ID NO: 1082425 - RNA, 16 nt, Mycobacterium bovis subsp bovis AF2122/97
ggaggccaacccugcg

SEQ ID NO: 1082426 - RNA, 14 nt, Mycobacterium bovis subsp bovis AF2122/97
ggaggacaccagcu

SEQ ID NO: 1082427 - RNA, 15 nt, Mycobacterium bovis subsp bovis AF2122/97
ggagcucaucgacga

SEQ ID NO: 1082428 - RNA, 18 nt, Mycobacterium bovis subsp bovis AF2122/97
ggagcucacgugcugccg

SEQ ID NO: 1082429 - RNA, 14 nt, Mycobacterium bovis subsp bovis AF2122/97
ggagcggcugcacg

SEQ ID NO: 1082430 - RNA, 13 nt, Mycobacterium bovis subsp bovis AF2122/97
ggagcggcugcgg

SEQ ID NO: 1082431 - RNA, 18 nt, Mycobacterium bovis subsp bovis AF2122/97
ggagcgggauucuggcgc

SEQ ID NO: 1082432 - RNA, 13 nt, Mycobacterium bovis subsp bovis AF2122/97
ggagcggccgccg

SEQ ID NO: 1082433 - RNA, 18 nt, Mycobacterium bovis subsp bovis AF2122/97
ggagcggcgcgggggugg

SEQ ID NO: 1082434 - RNA, 15 nt, Mycobacterium bovis subsp bovis AF2122/97
ggagcggaauggcgc

SEQ ID NO: 1082435 - RNA, 14 nt, Mycobacterium bovis subsp bovis AF2122/97
ggagcggauagcgg

SEQ ID NO: 1082436 - RNA, 20 nt, Mycobacterium bovis subsp bovis AF2122/97
ggagcggauagcggcaaagc

SEQ ID NO: 1082437 - RNA, 12 nt, Mycobacterium bovis subsp bovis AF2122/97
ggagcgccgagc

SEQ ID NO: 1082438 - RNA, 23 nt, Mycobacterium bovis subsp bovis AF2122/97
ggagcgcaccugaaggcggcgau

SEQ ID NO: 1082439 - RNA, 24 nt, Mycobacterium bovis subsp bovis AF2122/97
ggagcgcauuuguugcugcugccg

SEQ ID NO: 1082440 - RNA, 19 nt, Mycobacterium bovis subsp bovis AF2122/97
ggagcgccgagcucggcgc

SEQ ID NO: 1082441 - RNA, 23 nt, Mycobacterium bovis subsp bovis AF2122/97
aaggccgugaugccacggcgucg

SEQ ID NO: 1082442 - RNA, 17 nt, Mycobacterium bovis subsp bovis AF2122/97
ggacuggcaccgccagc

SEQ ID NO: 1082443 - RNA, 22 nt, Mycobacterium bovis subsp bovis AF2122/97
ggacugcggcccgacccggccg

SEQ ID NO: 1082444 - RNA, 18 nt, Mycobacterium bovis subsp bovis AF2122/97
ggacugcggacacguugc

SEQ ID NO: 1082445 - RNA, 12 nt, Mycobacterium bovis subsp bovis AF2122/97
ggacugcgccac

SEQ ID NO: 1082446 - RNA, 14 nt, Mycobacterium bovis subsp bovis AF2122/97
ggacugcgccaccg

SEQ ID NO: 1082447 - RNA, 15 nt, Mycobacterium bovis subsp bovis AF2122/97
ggacugcgccaccgg

SEQ ID NO: 1082448 - RNA, 18 nt, Mycobacterium bovis subsp bovis AF2122/97
ggacugcagcgccucgac

SEQ ID NO: 1082449 - RNA, 19 nt, Mycobacterium bovis subsp bovis AF2122/97
ggacucggaauucggcguc

SEQ ID NO: 1082450 - RNA, 21 nt, Mycobacterium bovis subsp bovis AF2122/97
ggacucggaauucggcgucgu

SEQ ID NO: 1082451 - RNA, 18 nt, Mycobacterium bovis subsp bovis AF2122/97
ggacuccaaagccgugcc

SEQ ID NO: 1082452 - RNA, 18 nt, Mycobacterium bovis subsp bovis AF2122/97
ggacuccggccgcacgcc

SEQ ID NO: 1082453 - RNA, 12 nt, Mycobacterium bovis subsp bovis AF2122/97
ggacucgccgac

SEQ ID NO: 1082454 - RNA, 17 nt, Mycobacterium bovis subsp bovis AF2122/97
ggacuuuggugucgcuc

SEQ ID NO: 1082455 - RNA, 20 nt, Mycobacterium bovis subsp bovis AF2122/97
ggagaaaacggcggcgccgg

SEQ ID NO: 1082456 - RNA, 20 nt, Mycobacterium bovis subsp bovis AF2122/97
ggacuucggugagcagggcg

SEQ ID NO: 1082457 - RNA, 13 nt, Mycobacterium bovis subsp bovis AF2122/97
ggacugcagcgcg

SEQ ID NO: 1082458 - RNA, 18 nt, Mycobacterium bovis subsp bovis AF2122/97
ggacugugggggcgcacc

SEQ ID NO: 1082459 - RNA, 16 nt, Mycobacterium bovis subsp bovis AF2122/97
ggacggugcggucaga

SEQ ID NO: 1082460 - RNA, 21 nt, Mycobacterium bovis subsp bovis AF2122/97
ggacgguugguccgccgucga

SEQ ID NO: 1082461 - RNA, 14 nt, Mycobacterium bovis subsp bovis AF2122/97
ggacgucggcgaua

SEQ ID NO: 1082462 - RNA, 23 nt, Mycobacterium bovis subsp bovis AF2122/97
ggacgucaccgucaguucggugu

SEQ ID NO: 1082463 - RNA, 21 nt, Mycobacterium bovis subsp bovis AF2122/97
ggacgugcagccgcagguggg

SEQ ID NO: 1082464 - RNA, 16 nt, Mycobacterium bovis subsp bovis AF2122/97
ggacgucgugaccggc

SEQ ID NO: 1082465 - RNA, 19 nt, Mycobacterium bovis subsp bovis AF2122/97
ggacgucgugaccggcggg

SEQ ID NO: 1082466 - RNA, 21 nt, Mycobacterium bovis subsp bovis AF2122/97
ggacguggacuuuggugucgc

SEQ ID NO: 1082467 - RNA, 12 nt, Mycobacterium bovis subsp bovis AF2122/97
ggacgugacgau

SEQ ID NO: 1082468 - RNA, 14 nt, Mycobacterium bovis subsp bovis AF2122/97
ggacuaccgccggc

SEQ ID NO: 1082469 - RNA, 18 nt, Mycobacterium bovis subsp bovis AF2122/97
ggacuaccgccggcggcg

SEQ ID NO: 1082470 - RNA, 17 nt, Mycobacterium bovis subsp bovis AF2122/97
ggacgugcccugacgcc

SEQ ID NO: 1082471 - RNA, 21 nt, Mycobacterium bovis subsp bovis AF2122/97
ggacuacuaggccccuggccg

SEQ ID NO: 1082472 - RNA, 15 nt, Mycobacterium bovis subsp bovis AF2122/97
ggacggcaccggccc

SEQ ID NO: 1082473 - RNA, 19 nt, Mycobacterium bovis subsp bovis AF2122/97
ggacggauaguucaccaca

SEQ ID NO: 1082474 - RNA, 21 nt, Mycobacterium bovis subsp bovis AF2122/97
ggacggcagccaccagcgacg

SEQ ID NO: 1082475 - RNA, 17 nt, Mycobacterium bovis subsp bovis AF2122/97
ggacggcaggcuggcga

SEQ ID NO: 1082476 - RNA, 18 nt, Mycobacterium bovis subsp bovis AF2122/97
ggacggcaggcuggcgag

SEQ ID NO: 1082477 - RNA, 16 nt, Mycobacterium bovis subsp bovis AF2122/97
ggacggcauagcagcc

SEQ ID NO: 1082478 - RNA, 18 nt, Mycobacterium bovis subsp bovis AF2122/97
ggacggcgcgagccgcac

SEQ ID NO: 1082479 - RNA, 21 nt, Mycobacterium bovis subsp bovis AF2122/97
ggacggccaacagggcgccga

SEQ ID NO: 1082480 - RNA, 21 nt, Mycobacterium bovis subsp bovis AF2122/97
ggacggucauccggccgucgg

SEQ ID NO: 1082481 - RNA, 15 nt, Mycobacterium bovis subsp bovis AF2122/97
ggacgggugcagcgc

SEQ ID NO: 1082482 - RNA, 17 nt, Mycobacterium bovis subsp bovis AF2122/97
ggacgggguacugcggc

SEQ ID NO: 1082483 - RNA, 14 nt, Mycobacterium bovis subsp bovis AF2122/97
ggacgggucgccgc

SEQ ID NO: 1082484 - RNA, 16 nt, Mycobacterium bovis subsp bovis AF2122/97
ggacgggucucgcgag

SEQ ID NO: 1082485 - RNA, 18 nt, Mycobacterium bovis subsp bovis AF2122/97
ggacgggucucgcgagcg

SEQ ID NO: 1082486 - RNA, 21 nt, Mycobacterium bovis subsp bovis AF2122/97
ggacggcguuuccuucgacga

SEQ ID NO: 1082487 - RNA, 18 nt, Mycobacterium bovis subsp bovis AF2122/97
ggacggcgggccgcgcgg

SEQ ID NO: 1082488 - RNA, 21 nt, Mycobacterium bovis subsp bovis AF2122/97
ggacggcgggccgcgcggcga

SEQ ID NO: 1082489 - RNA, 12 nt, Mycobacterium bovis subsp bovis AF2122/97
ggacggggaggu

SEQ ID NO: 1082490 - RNA, 16 nt, Mycobacterium bovis subsp bovis AF2122/97
ggacggcuugagccgc

SEQ ID NO: 1082491 - RNA, 13 nt, Mycobacterium bovis subsp bovis AF2122/97
ggacgccggcgcc

SEQ ID NO: 1082492 - RNA, 15 nt, Mycobacterium bovis subsp bovis AF2122/97
ggacgccuugcacaa

SEQ ID NO: 1082493 - RNA, 20 nt, Mycobacterium bovis subsp bovis AF2122/97
ggacgcgaaauccccugcgc

SEQ ID NO: 1082494 - RNA, 12 nt, Mycobacterium bovis subsp bovis AF2122/97
ggacgcgcagca

SEQ ID NO: 1082495 - RNA, 21 nt, Mycobacterium bovis subsp bovis AF2122/97
ggacgcgcagcaucggcgaca

SEQ ID NO: 1082496 - RNA, 16 nt, Mycobacterium bovis subsp bovis AF2122/97
ggacgcgacucggcgg

SEQ ID NO: 1082497 - RNA, 14 nt, Mycobacterium bovis subsp bovis AF2122/97
ggacgcgaucggcg

SEQ ID NO: 1082498 - RNA, 17 nt, Mycobacterium bovis subsp bovis AF2122/97
ggacgcgaugaucauga

SEQ ID NO: 1082499 - RNA, 17 nt, Mycobacterium bovis subsp bovis AF2122/97
ggacgcgcaugccccga

SEQ ID NO: 1082500 - RNA, 18 nt, Mycobacterium bovis subsp bovis AF2122/97
ggacgcgcauuucaccgg

SEQ ID NO: 1082501 - RNA, 19 nt, Mycobacterium bovis subsp bovis AF2122/97
ggacgcgcggauggccucg

SEQ ID NO: 1082502 - RNA, 21 nt, Mycobacterium bovis subsp bovis AF2122/97
ggacgcgcggauuucgccgug

SEQ ID NO: 1082503 - RNA, 14 nt, Mycobacterium bovis subsp bovis AF2122/97
ggacgcugaucgaa

SEQ ID NO: 1082504 - RNA, 22 nt, Mycobacterium bovis subsp bovis AF2122/97
ggacgcggccaauggccgcggc

SEQ ID NO: 1082505 - RNA, 20 nt, Mycobacterium bovis subsp bovis AF2122/97
aaggccgcguugccggucgc

SEQ ID NO: 1082506 - RNA, 12 nt, Mycobacterium bovis subsp bovis AF2122/97
aaggccgccaac

SEQ ID NO: 1082507 - RNA, 19 nt, Mycobacterium bovis subsp bovis AF2122/97
aaggccgccgccgucggcg

SEQ ID NO: 1082508 - RNA, 15 nt, Mycobacterium bovis subsp bovis AF2122/97
aaggcccuggccgcg

SEQ ID NO: 1082509 - RNA, 13 nt, Mycobacterium bovis subsp bovis AF2122/97
aaggccagcacgg

SEQ ID NO: 1082510 - RNA, 13 nt, Mycobacterium bovis subsp bovis AF2122/97
aaggcccggcgcg

SEQ ID NO: 1082511 - RNA, 13 nt, Mycobacterium bovis subsp bovis AF2122/97
aaggcaaacacca

SEQ ID NO: 1082512 - RNA, 18 nt, Mycobacterium bovis subsp bovis AF2122/97
aaggcauccaacgcggcg

SEQ ID NO: 1082513 - RNA, 12 nt, Mycobacterium bovis subsp bovis AF2122/97
ggagccggcgca

SEQ ID NO: 1082514 - RNA, 13 nt, Mycobacterium bovis subsp bovis AF2122/97
ggagccgucacgc

SEQ ID NO: 1082515 - RNA, 15 nt, Mycobacterium bovis subsp bovis AF2122/97
ggagccgucacgccg

SEQ ID NO: 1082516 - RNA, 13 nt, Mycobacterium bovis subsp bovis AF2122/97
ggagccgggccgu

SEQ ID NO: 1082517 - RNA, 22 nt, Mycobacterium bovis subsp bovis AF2122/97
ggagccgggugaggcgggucgc

SEQ ID NO: 1082518 - RNA, 13 nt, Mycobacterium bovis subsp bovis AF2122/97
ggagccgugcggu

SEQ ID NO: 1082519 - RNA, 17 nt, Mycobacterium bovis subsp bovis AF2122/97
ggagccgucgagcagcc

SEQ ID NO: 1082520 - RNA, 16 nt, Mycobacterium bovis subsp bovis AF2122/97
ggagccuugguagccg

SEQ ID NO: 1082521 - RNA, 16 nt, Mycobacterium bovis subsp bovis AF2122/97
ggagcgacgucgguga

SEQ ID NO: 1082522 - RNA, 10 nt, Mycobacterium bovis subsp bovis AF2122/97
aaggaucaac

SEQ ID NO: 1082523 - RNA, 22 nt, Mycobacterium bovis subsp bovis AF2122/97
ggagcgcaccugaaggcggcga

SEQ ID NO: 1082524 - RNA, 15 nt, Mycobacterium bovis subsp bovis AF2122/97
ggagaccugucggua

SEQ ID NO: 1082525 - RNA, 13 nt, Mycobacterium bovis subsp bovis AF2122/97
ggagaccagcucg

SEQ ID NO: 1082526 - RNA, 16 nt, Mycobacterium bovis subsp bovis AF2122/97
ggagaccccgcgcgcu

SEQ ID NO: 1082527 - RNA, 14 nt, Mycobacterium bovis subsp bovis AF2122/97
ggagaccgcggccg

SEQ ID NO: 1082528 - RNA, 16 nt, Mycobacterium bovis subsp bovis AF2122/97
ggagaaggcgcgggcg

SEQ ID NO: 1082529 - RNA, 16 nt, Mycobacterium bovis subsp bovis AF2122/97
ggagacaccgcaacgc

SEQ ID NO: 1082530 - RNA, 20 nt, Mycobacterium bovis subsp bovis AF2122/97
ggagaagauuuucucggugc

SEQ ID NO: 1082531 - RNA, 23 nt, Mycobacterium bovis subsp bovis AF2122/97
ggagaacgucaaacccagcgacg

SEQ ID NO: 1082532 - RNA, 21 nt, Mycobacterium bovis subsp bovis AF2122/97
ggagaacaucccccggcuggu

SEQ ID NO: 1082533 - RNA, 18 nt, Mycobacterium bovis subsp bovis AF2122/97
ggagacguuuugcggccc

SEQ ID NO: 1082534 - RNA, 20 nt, Mycobacterium bovis subsp bovis AF2122/97
ggagacgguacgccagucgc

SEQ ID NO: 1082535 - RNA, 23 nt, Mycobacterium bovis subsp bovis AF2122/97
ggagagccgguagaucagcgccu

SEQ ID NO: 1082536 - RNA, 17 nt, Mycobacterium bovis subsp bovis AF2122/97
ggagauaccgaccaucg

SEQ ID NO: 1082537 - RNA, 14 nt, Mycobacterium bovis subsp bovis AF2122/97
ggagaucgccgccg

SEQ ID NO: 1082538 - RNA, 17 nt, Mycobacterium bovis subsp bovis AF2122/97
ggagaucgccgccggcg

SEQ ID NO: 1082539 - RNA, 20 nt, Mycobacterium bovis subsp bovis AF2122/97
ggagaucaccucggugccgg

SEQ ID NO: 1082540 - RNA, 16 nt, Mycobacterium bovis subsp bovis AF2122/97
ggagaucacgccgacg

SEQ ID NO: 1082541 - RNA, 21 nt, Mycobacterium bovis subsp bovis AF2122/97
ggagagccugcucgcagcggg

SEQ ID NO: 1082542 - RNA, 15 nt, Mycobacterium bovis subsp bovis AF2122/97
ggagccgcacccgaa

SEQ ID NO: 1082543 - RNA, 18 nt, Mycobacterium bovis subsp bovis AF2122/97
ggagccaggacgacgccg

SEQ ID NO: 1082544 - RNA, 17 nt, Mycobacterium bovis subsp bovis AF2122/97
ggagccccugucaacgc

SEQ ID NO: 1082545 - RNA, 16 nt, Mycobacterium bovis subsp bovis AF2122/97
ggagcccgagcucacc

SEQ ID NO: 1082546 - RNA, 19 nt, Mycobacterium bovis subsp bovis AF2122/97
ggagcccgagcucaccgca

SEQ ID NO: 1082547 - RNA, 12 nt, Mycobacterium bovis subsp bovis AF2122/97
ggagccgccgac

SEQ ID NO: 1082548 - RNA, 11 nt, Mycobacterium bovis subsp bovis AF2122/97
ggagccgccgg

SEQ ID NO: 1082549 - RNA, 19 nt, Mycobacterium bovis subsp bovis AF2122/97
ggagccgccggccccgcca

SEQ ID NO: 1082550 - RNA, 15 nt, Mycobacterium bovis subsp bovis AF2122/97
ggagcagcacgucga

SEQ ID NO: 1082551 - RNA, 12 nt, Mycobacterium bovis subsp bovis AF2122/97
ggagccaacggc

SEQ ID NO: 1082552 - RNA, 16 nt, Mycobacterium bovis subsp bovis AF2122/97
ggagcccacacgcuca

SEQ ID NO: 1082553 - RNA, 14 nt, Mycobacterium bovis subsp bovis AF2122/97
ggaagcccgaugcg

SEQ ID NO: 1082554 - RNA, 21 nt, Mycobacterium bovis subsp bovis AF2122/97
ggaagcccggcagaugcagcg

SEQ ID NO: 1082555 - RNA, 21 nt, Mycobacterium bovis subsp bovis AF2122/97
ggaagcagaaguccucggcgg

SEQ ID NO: 1082556 - RNA, 15 nt, Mycobacterium bovis subsp bovis AF2122/97
ggaagcccgucgcgg

SEQ ID NO: 1082557 - RNA, 21 nt, Mycobacterium bovis subsp bovis AF2122/97
ggaagccgcgccuugaugguc

SEQ ID NO: 1082558 - RNA, 20 nt, Mycobacterium bovis subsp bovis AF2122/97
ggaagccugcgggccggcau

SEQ ID NO: 1082559 - RNA, 14 nt, Mycobacterium bovis subsp bovis AF2122/97
ggaagcgccggccg

SEQ ID NO: 1082560 - RNA, 17 nt, Mycobacterium bovis subsp bovis AF2122/97
ggaagcgccggccgauc

SEQ ID NO: 1082561 - RNA, 15 nt, Mycobacterium bovis subsp bovis AF2122/97
ggaagcgagcagcuc

SEQ ID NO: 1082562 - RNA, 13 nt, Mycobacterium bovis subsp bovis AF2122/97
ggaagcgugcggu

SEQ ID NO: 1082563 - RNA, 20 nt, Mycobacterium bovis subsp bovis AF2122/97
ggaagagccgggcucgucga

SEQ ID NO: 1082564 - RNA, 19 nt, Mycobacterium bovis subsp bovis AF2122/97
ggaacuggacaccguggau

SEQ ID NO: 1082565 - RNA, 17 nt, Mycobacterium bovis subsp bovis AF2122/97
ggaacuggaccacagcc

SEQ ID NO: 1082566 - RNA, 19 nt, Mycobacterium bovis subsp bovis AF2122/97
ggaacugaugaaccacggc

SEQ ID NO: 1082567 - RNA, 18 nt, Mycobacterium bovis subsp bovis AF2122/97
ggaacugaaacgcuuggc

SEQ ID NO: 1082568 - RNA, 22 nt, Mycobacterium bovis subsp bovis AF2122/97
ggaacuguaggucacagcugcg

SEQ ID NO: 1082569 - RNA, 19 nt, Mycobacterium bovis subsp bovis AF2122/97
ggaacuguggugccugcgg

SEQ ID NO: 1082570 - RNA, 18 nt, Mycobacterium bovis subsp bovis AF2122/97
ggaagaaaccgcagucgc

SEQ ID NO: 1082571 - RNA, 23 nt, Mycobacterium bovis subsp bovis AF2122/97
ggaagaaaccgcagucgcggcag

SEQ ID NO: 1082572 - RNA, 15 nt, Mycobacterium bovis subsp bovis AF2122/97
ggaacuugugccggg

SEQ ID NO: 1082573 - RNA, 18 nt, Mycobacterium bovis subsp bovis AF2122/97
ggaaguacacggcggccc

SEQ ID NO: 1082574 - RNA, 19 nt, Mycobacterium bovis subsp bovis AF2122/97
ggaaguacgcgacgggccg

SEQ ID NO: 1082575 - RNA, 14 nt, Mycobacterium bovis subsp bovis AF2122/97
ggaagguugaacgc

SEQ ID NO: 1082576 - RNA, 12 nt, Mycobacterium bovis subsp bovis AF2122/97
ggaaggcgggca

SEQ ID NO: 1082577 - RNA, 18 nt, Mycobacterium bovis subsp bovis AF2122/97
ggaagggcuaucguggcg

SEQ ID NO: 1082578 - RNA, 13 nt, Mycobacterium bovis subsp bovis AF2122/97
ggaagucccgagu

SEQ ID NO: 1082579 - RNA, 22 nt, Mycobacterium bovis subsp bovis AF2122/97
ggaagucccgaguggccggugg

SEQ ID NO: 1082580 - RNA, 14 nt, Mycobacterium bovis subsp bovis AF2122/97
ggaagucccgccgu

SEQ ID NO: 1082581 - RNA, 14 nt, Mycobacterium bovis subsp bovis AF2122/97
ggaaguucgucggu

SEQ ID NO: 1082582 - RNA, 13 nt, Mycobacterium bovis subsp bovis AF2122/97
ggaauacaacagc

SEQ ID NO: 1082583 - RNA, 18 nt, Mycobacterium bovis subsp bovis AF2122/97
ggaauccuggccgccgcc

SEQ ID NO: 1082584 - RNA, 17 nt, Mycobacterium bovis subsp bovis AF2122/97
ggaauccggccagaccc

SEQ ID NO: 1082585 - RNA, 17 nt, Mycobacterium bovis subsp bovis AF2122/97
ggaauccccccugucgc

SEQ ID NO: 1082586 - RNA, 14 nt, Mycobacterium bovis subsp bovis AF2122/97
ggaaucgaugaucg

SEQ ID NO: 1082587 - RNA, 21 nt, Mycobacterium bovis subsp bovis AF2122/97
ggaaggugaucacgucggcgu

SEQ ID NO: 1082588 - RNA, 13 nt, Mycobacterium bovis subsp bovis AF2122/97
ggaauagcggcgc

SEQ ID NO: 1082589 - RNA, 15 nt, Mycobacterium bovis subsp bovis AF2122/97
ggaauacgcugcugg

SEQ ID NO: 1082590 - RNA, 16 nt, Mycobacterium bovis subsp bovis AF2122/97
ggaauauggcggccgg

SEQ ID NO: 1082591 - RNA, 20 nt, Mycobacterium bovis subsp bovis AF2122/97
ggaaucgucgcggccgucgc

SEQ ID NO: 1082592 - RNA, 13 nt, Mycobacterium bovis subsp bovis AF2122/97
ggaaucguucggg

SEQ ID NO: 1082593 - RNA, 13 nt, Mycobacterium bovis subsp bovis AF2122/97
ggaauggcgccgg

SEQ ID NO: 1082594 - RNA, 16 nt, Mycobacterium bovis subsp bovis AF2122/97
ggaauggcgccggccg

SEQ ID NO: 1082595 - RNA, 22 nt, Mycobacterium bovis subsp bovis AF2122/97
ggaauggcucacgcuccgccgg

SEQ ID NO: 1082596 - RNA, 14 nt, Mycobacterium bovis subsp bovis AF2122/97
ggaauggaccagcg

SEQ ID NO: 1082597 - RNA, 14 nt, Mycobacterium bovis subsp bovis AF2122/97
gcuggcgcccccgc

SEQ ID NO: 1082598 - RNA, 16 nt, Mycobacterium bovis subsp bovis AF2122/97
gcuggcgcccccgcca

SEQ ID NO: 1082599 - RNA, 13 nt, Mycobacterium bovis subsp bovis AF2122/97
gcuggcgccgccg

SEQ ID NO: 1082600 - RNA, 14 nt, Mycobacterium bovis subsp bovis AF2122/97
gcuggcgccgccgg

SEQ ID NO: 1082601 - RNA, 22 nt, Mycobacterium bovis subsp bovis AF2122/97
gcuggcgccgccggugccaccg

SEQ ID NO: 1082602 - RNA, 18 nt, Mycobacterium bovis subsp bovis AF2122/97
gcuggcgcagccugccga

SEQ ID NO: 1082603 - RNA, 16 nt, Mycobacterium bovis subsp bovis AF2122/97
gcuggcgcagcgccau

SEQ ID NO: 1082604 - RNA, 19 nt, Mycobacterium bovis subsp bovis AF2122/97
gcuggcgcagcgccaucga

SEQ ID NO: 1082605 - RNA, 13 nt, Mycobacterium bovis subsp bovis AF2122/97
gcuggcgccggcc

SEQ ID NO: 1082606 - RNA, 16 nt, Mycobacterium bovis subsp bovis AF2122/97
gcuggcgccggccagc

SEQ ID NO: 1082607 - RNA, 23 nt, Mycobacterium bovis subsp bovis AF2122/97
gcuggcgccggccagccagcgau

SEQ ID NO: 1082608 - RNA, 22 nt, Mycobacterium bovis subsp bovis AF2122/97
gcuggcgcucauaggccggcgg

SEQ ID NO: 1082609 - RNA, 21 nt, Mycobacterium bovis subsp bovis AF2122/97
gcuggcgcgcgggguggcggc

SEQ ID NO: 1082610 - RNA, 13 nt, Mycobacterium bovis subsp bovis AF2122/97
ggaacacgaugcg

SEQ ID NO: 1082611 - RNA, 22 nt, Mycobacterium bovis subsp bovis AF2122/97
ggaacacccauaccuucggcga

SEQ ID NO: 1082612 - RNA, 19 nt, Mycobacterium bovis subsp bovis AF2122/97
ggaacacgaagucgaacgg

SEQ ID NO: 1082613 - RNA, 13 nt, Mycobacterium bovis subsp bovis AF2122/97
ggaacagcagcgc

SEQ ID NO: 1082614 - RNA, 12 nt, Mycobacterium bovis subsp bovis AF2122/97
ggaacaccagca

SEQ ID NO: 1082615 - RNA, 18 nt, Mycobacterium bovis subsp bovis AF2122/97
ggaacaaugagaucggga

SEQ ID NO: 1082616 - RNA, 14 nt, Mycobacterium bovis subsp bovis AF2122/97
ggaacaccgaggcg

SEQ ID NO: 1082617 - RNA, 18 nt, Mycobacterium bovis subsp bovis AF2122/97
ggaacaccagcaggcggc

SEQ ID NO: 1082618 - RNA, 17 nt, Mycobacterium bovis subsp bovis AF2122/97
ggaaccacccaccggcc

SEQ ID NO: 1082619 - RNA, 21 nt, Mycobacterium bovis subsp bovis AF2122/97
ggaaccacccaccggccacca

SEQ ID NO: 1082620 - RNA, 18 nt, Mycobacterium bovis subsp bovis AF2122/97
ggaaccucgaccgucacc

SEQ ID NO: 1082621 - RNA, 23 nt, Mycobacterium bovis subsp bovis AF2122/97
ggaacgauagaacguagcgccca

SEQ ID NO: 1082622 - RNA, 15 nt, Mycobacterium bovis subsp bovis AF2122/97
ggaacgaucgaugac

SEQ ID NO: 1082623 - RNA, 16 nt, Mycobacterium bovis subsp bovis AF2122/97
ggaacgaugccgccgg

SEQ ID NO: 1082624 - RNA, 15 nt, Mycobacterium bovis subsp bovis AF2122/97
ggaacgaugccggca

SEQ ID NO: 1082625 - RNA, 14 nt, Mycobacterium bovis subsp bovis AF2122/97
ggaacgagccacgc

SEQ ID NO: 1082626 - RNA, 21 nt, Mycobacterium bovis subsp bovis AF2122/97
ggaacgccgagcacgccgagc

SEQ ID NO: 1082627 - RNA, 22 nt, Mycobacterium bovis subsp bovis AF2122/97
ggaacgccgagcacgccgagcc

SEQ ID NO: 1082628 - RNA, 10 nt, Mycobacterium bovis subsp bovis AF2122/97
ggaaccccga

SEQ ID NO: 1082629 - RNA, 21 nt, Mycobacterium bovis subsp bovis AF2122/97
ggaaccccgagcugccaacgc

SEQ ID NO: 1082630 - RNA, 22 nt, Mycobacterium bovis subsp bovis AF2122/97
ggaaccccucgauucccggcgc

SEQ ID NO: 1082631 - RNA, 14 nt, Mycobacterium bovis subsp bovis AF2122/97
ggaacccgagccgg

SEQ ID NO: 1082632 - RNA, 20 nt, Mycobacterium bovis subsp bovis AF2122/97
ggaacccgagcuugggccgg

SEQ ID NO: 1082633 - RNA, 13 nt, Mycobacterium bovis subsp bovis AF2122/97
ggaaccacggcgc

SEQ ID NO: 1082634 - RNA, 19 nt, Mycobacterium bovis subsp bovis AF2122/97
ggaaccacggucagcacgc

SEQ ID NO: 1082635 - RNA, 16 nt, Mycobacterium bovis subsp bovis AF2122/97
ggaaccagcggucggc

SEQ ID NO: 1082636 - RNA, 18 nt, Mycobacterium bovis subsp bovis AF2122/97
ggaaccagcggucggcga

SEQ ID NO: 1082637 - RNA, 22 nt, Mycobacterium bovis subsp bovis AF2122/97
ggaaccagcguaucggccggca

SEQ ID NO: 1082638 - RNA, 17 nt, Mycobacterium bovis subsp bovis AF2122/97
ggaaccaguugacgaag

SEQ ID NO: 1082639 - RNA, 22 nt, Mycobacterium bovis subsp bovis AF2122/97
ggaacccuccggacccacccgc

SEQ ID NO: 1082640 - RNA, 17 nt, Mycobacterium bovis subsp bovis AF2122/97
ggaaccgauaccucgcc

SEQ ID NO: 1082641 - RNA, 19 nt, Mycobacterium bovis subsp bovis AF2122/97
ggaaccgauaccucgccau

SEQ ID NO: 1082642 - RNA, 17 nt, Mycobacterium bovis subsp bovis AF2122/97
ggaaccgaucggucgau

SEQ ID NO: 1082643 - RNA, 13 nt, Mycobacterium bovis subsp bovis AF2122/97
ggaaccggcgugc

SEQ ID NO: 1082644 - RNA, 14 nt, Mycobacterium bovis subsp bovis AF2122/97
ggaaccgggcaaau

SEQ ID NO: 1082645 - RNA, 13 nt, Mycobacterium bovis subsp bovis AF2122/97
ggaacgccggcau

SEQ ID NO: 1082646 - RNA, 17 nt, Mycobacterium bovis subsp bovis AF2122/97
ggaacgccucaggggcg

SEQ ID NO: 1082647 - RNA, 18 nt, Mycobacterium bovis subsp bovis AF2122/97
ggaacgcgucgccgacgc

SEQ ID NO: 1082648 - RNA, 12 nt, Mycobacterium bovis subsp bovis AF2122/97
ggaacgccgggg

SEQ ID NO: 1082649 - RNA, 22 nt, Mycobacterium bovis subsp bovis AF2122/97
ggaacgccgugccguacgccca

SEQ ID NO: 1082650 - RNA, 18 nt, Mycobacterium bovis subsp bovis AF2122/97
ggaacgcuaaacccgugu

SEQ ID NO: 1082651 - RNA, 21 nt, Mycobacterium bovis subsp bovis AF2122/97
ggaacgcuaggcgauccagac

SEQ ID NO: 1082652 - RNA, 14 nt, Mycobacterium bovis subsp bovis AF2122/97
ggaacggcucggcc

SEQ ID NO: 1082653 - RNA, 18 nt, Mycobacterium bovis subsp bovis AF2122/97
ggaacguccgcgccgagc

SEQ ID NO: 1082654 - RNA, 16 nt, Mycobacterium bovis subsp bovis AF2122/97
ggaacgugaccgacgc

SEQ ID NO: 1082655 - RNA, 15 nt, Mycobacterium bovis subsp bovis AF2122/97
ggaacguccgcgccg

SEQ ID NO: 1082656 - RNA, 17 nt, Mycobacterium bovis subsp bovis AF2122/97
ggaacguuucgcugucc

SEQ ID NO: 1082657 - RNA, 21 nt, Mycobacterium bovis subsp bovis AF2122/97
ggaacuacccgccagcaaacc

SEQ ID NO: 1082658 - RNA, 18 nt, Mycobacterium bovis subsp bovis AF2122/97
ggacccacccgcaccgcc

SEQ ID NO: 1082659 - RNA, 21 nt, Mycobacterium bovis subsp bovis AF2122/97
ggacccacccgcaccgccggc

SEQ ID NO: 1082660 - RNA, 16 nt, Mycobacterium bovis subsp bovis AF2122/97
ggacccgcgcgucgcc

SEQ ID NO: 1082661 - RNA, 19 nt, Mycobacterium bovis subsp bovis AF2122/97
ggacccgcgcgucgcccag

SEQ ID NO: 1082662 - RNA, 16 nt, Mycobacterium bovis subsp bovis AF2122/97
ggacccgaccgucguc

SEQ ID NO: 1082663 - RNA, 19 nt, Mycobacterium bovis subsp bovis AF2122/97
ggacccgcagcugcggauc

SEQ ID NO: 1082664 - RNA, 22 nt, Mycobacterium bovis subsp bovis AF2122/97
ggaccaucuccggugugaucgg

SEQ ID NO: 1082665 - RNA, 19 nt, Mycobacterium bovis subsp bovis AF2122/97
ggacccgugagcucgucga

SEQ ID NO: 1082666 - RNA, 23 nt, Mycobacterium bovis subsp bovis AF2122/97
ggaccgagccgaucugcugucgg

SEQ ID NO: 1082667 - RNA, 13 nt, Mycobacterium bovis subsp bovis AF2122/97
ggaccgaccaccg

SEQ ID NO: 1082668 - RNA, 17 nt, Mycobacterium bovis subsp bovis AF2122/97
ggacccggcgccgucga

SEQ ID NO: 1082669 - RNA, 16 nt, Mycobacterium bovis subsp bovis AF2122/97
ggacccugcgccgcca

SEQ ID NO: 1082670 - RNA, 16 nt, Mycobacterium bovis subsp bovis AF2122/97
ggacccuuccgccgcc

SEQ ID NO: 1082671 - RNA, 20 nt, Mycobacterium bovis subsp bovis AF2122/97
ggaccgcgacggcgccggca

SEQ ID NO: 1082672 - RNA, 21 nt, Mycobacterium bovis subsp bovis AF2122/97
ggaccgcgacggcgccggcau

SEQ ID NO: 1082673 - RNA, 22 nt, Mycobacterium bovis subsp bovis AF2122/97
ggaccgcaacgacggccgucgc

SEQ ID NO: 1082674 - RNA, 18 nt, Mycobacterium bovis subsp bovis AF2122/97
ggaccgaucuuggccacc

SEQ ID NO: 1082675 - RNA, 22 nt, Mycobacterium bovis subsp bovis AF2122/97
ggaccgauggcucacaugcccg

SEQ ID NO: 1082676 - RNA, 23 nt, Mycobacterium bovis subsp bovis AF2122/97
ggaccgcagcgugaucuggccac

SEQ ID NO: 1082677 - RNA, 20 nt, Mycobacterium bovis subsp bovis AF2122/97
ggaccgccccggccaggaca

SEQ ID NO: 1082678 - RNA, 21 nt, Mycobacterium bovis subsp bovis AF2122/97
ggaccgcccgagucucgucgg

SEQ ID NO: 1082679 - RNA, 17 nt, Mycobacterium bovis subsp bovis AF2122/97
ggaccgccgaucggcca

SEQ ID NO: 1082680 - RNA, 20 nt, Mycobacterium bovis subsp bovis AF2122/97
ggaccgcggauuccagcgcg

SEQ ID NO: 1082681 - RNA, 21 nt, Mycobacterium bovis subsp bovis AF2122/97
ggaccgcggauuccagcgcgu

SEQ ID NO: 1082682 - RNA, 22 nt, Mycobacterium bovis subsp bovis AF2122/97
ggaccgcggcgcguccgggcuc

SEQ ID NO: 1082683 - RNA, 15 nt, Mycobacterium bovis subsp bovis AF2122/97
ggaccggccuggcuc

SEQ ID NO: 1082684 - RNA, 17 nt, Mycobacterium bovis subsp bovis AF2122/97
ggaccgcucgucgccgg

SEQ ID NO: 1082685 - RNA, 20 nt, Mycobacterium bovis subsp bovis AF2122/97
ggaccgggaucgucaggccc

SEQ ID NO: 1082686 - RNA, 12 nt, Mycobacterium bovis subsp bovis AF2122/97
ggaccgcgguga

SEQ ID NO: 1082687 - RNA, 24 nt, Mycobacterium bovis subsp bovis AF2122/97
ggaccgcgguggccagaucgaacg

SEQ ID NO: 1082688 - RNA, 19 nt, Mycobacterium bovis subsp bovis AF2122/97
ggaccgcucugcggccacg

SEQ ID NO: 1082689 - RNA, 20 nt, Mycobacterium bovis subsp bovis AF2122/97
ggaccgggucgggcaccgcg

SEQ ID NO: 1082690 - RNA, 15 nt, Mycobacterium bovis subsp bovis AF2122/97
ggaccggucgacagc

SEQ ID NO: 1082691 - RNA, 21 nt, Mycobacterium bovis subsp bovis AF2122/97
ggaccuauuggucgcucgcgg

SEQ ID NO: 1082692 - RNA, 15 nt, Mycobacterium bovis subsp bovis AF2122/97
ggaccguccgacggc

SEQ ID NO: 1082693 - RNA, 20 nt, Mycobacterium bovis subsp bovis AF2122/97
ggaccgucuuuggugccgag

SEQ ID NO: 1082694 - RNA, 12 nt, Mycobacterium bovis subsp bovis AF2122/97
ggaccgucgugg

SEQ ID NO: 1082695 - RNA, 19 nt, Mycobacterium bovis subsp bovis AF2122/97
ggaccugcgagaucggaug

SEQ ID NO: 1082696 - RNA, 21 nt, Mycobacterium bovis subsp bovis AF2122/97
ggaccuccggauaacccagcg

SEQ ID NO: 1082697 - RNA, 12 nt, Mycobacterium bovis subsp bovis AF2122/97
ggaccugaccgg

SEQ ID NO: 1082698 - RNA, 13 nt, Mycobacterium bovis subsp bovis AF2122/97
ggaccucgcccau

SEQ ID NO: 1082699 - RNA, 23 nt, Mycobacterium bovis subsp bovis AF2122/97
ggaccuauuggucgcucgcgguc

SEQ ID NO: 1082700 - RNA, 19 nt, Mycobacterium bovis subsp bovis AF2122/97
ggacgaacaacgcgacgaa

SEQ ID NO: 1082701 - RNA, 20 nt, Mycobacterium bovis subsp bovis AF2122/97
ggacgaacaacgcgacgaag

SEQ ID NO: 1082702 - RNA, 14 nt, Mycobacterium bovis subsp bovis AF2122/97
ggacgaacgcgccg

SEQ ID NO: 1082703 - RNA, 21 nt, Mycobacterium bovis subsp bovis AF2122/97
ggacgaacgcuggcggcgugc

SEQ ID NO: 1082704 - RNA, 19 nt, Mycobacterium bovis subsp bovis AF2122/97
ggacgaagcaccucccgau

SEQ ID NO: 1082705 - RNA, 23 nt, Mycobacterium bovis subsp bovis AF2122/97
ggacgaaucccgcgcccggccgg

SEQ ID NO: 1082706 - RNA, 20 nt, Mycobacterium bovis subsp bovis AF2122/97
ggacgacaacaggccgucga

SEQ ID NO: 1082707 - RNA, 19 nt, Mycobacterium bovis subsp bovis AF2122/97
ggaccugugcggccgacgg

SEQ ID NO: 1082708 - RNA, 19 nt, Mycobacterium bovis subsp bovis AF2122/97
ggacgacgccgacgaugac

SEQ ID NO: 1082709 - RNA, 14 nt, Mycobacterium bovis subsp bovis AF2122/97
ggacgacccgggcc

SEQ ID NO: 1082710 - RNA, 16 nt, Mycobacterium bovis subsp bovis AF2122/97
ggacgacccgggccgg

SEQ ID NO: 1082711 - RNA, 13 nt, Mycobacterium bovis subsp bovis AF2122/97
ggacgaccgcgcg

SEQ ID NO: 1082712 - RNA, 21 nt, Mycobacterium bovis subsp bovis AF2122/97
ggacgauacgcgcaccguggc

SEQ ID NO: 1082713 - RNA, 22 nt, Mycobacterium bovis subsp bovis AF2122/97
ggacgccagcaaugcccgcacc

SEQ ID NO: 1082714 - RNA, 21 nt, Mycobacterium bovis subsp bovis AF2122/97
ggacgaugcccuccucgaccg

SEQ ID NO: 1082715 - RNA, 17 nt, Mycobacterium bovis subsp bovis AF2122/97
ggacgccauggugaacg

SEQ ID NO: 1082716 - RNA, 22 nt, Mycobacterium bovis subsp bovis AF2122/97
ggacgcccacaugcucagggca

SEQ ID NO: 1082717 - RNA, 15 nt, Mycobacterium bovis subsp bovis AF2122/97
ggacgcccucggggu

SEQ ID NO: 1082718 - RNA, 15 nt, Mycobacterium bovis subsp bovis AF2122/97
ggacgcccgaguuga

SEQ ID NO: 1082719 - RNA, 15 nt, Mycobacterium bovis subsp bovis AF2122/97
ggacgccgccggaga

SEQ ID NO: 1082720 - RNA, 22 nt, Mycobacterium bovis subsp bovis AF2122/97
ggacgcccgcccgcacgacgaa

SEQ ID NO: 1082721 - RNA, 12 nt, Mycobacterium bovis subsp bovis AF2122/97
ggacgccgcgcc

SEQ ID NO: 1082722 - RNA, 15 nt, Mycobacterium bovis subsp bovis AF2122/97
ggacgccgcggcgcc

SEQ ID NO: 1082723 - RNA, 17 nt, Mycobacterium bovis subsp bovis AF2122/97
ggacgccgcggcgccgg

SEQ ID NO: 1082724 - RNA, 21 nt, Mycobacterium bovis subsp bovis AF2122/97
ggacgccgcggcgccgguggg

SEQ ID NO: 1082725 - RNA, 17 nt, Mycobacterium bovis subsp bovis AF2122/97
ggacgauuccgcccaca

SEQ ID NO: 1082726 - RNA, 19 nt, Mycobacterium bovis subsp bovis AF2122/97
ggacgcagagucaacgaac

SEQ ID NO: 1082727 - RNA, 19 nt, Mycobacterium bovis subsp bovis AF2122/97
ggacagggcggcaacggcg

SEQ ID NO: 1082728 - RNA, 20 nt, Mycobacterium bovis subsp bovis AF2122/97
ggacaguucgcgccguggcg

SEQ ID NO: 1082729 - RNA, 15 nt, Mycobacterium bovis subsp bovis AF2122/97
ggacaggucgggcag

SEQ ID NO: 1082730 - RNA, 14 nt, Mycobacterium bovis subsp bovis AF2122/97
ggacaucaccggca

SEQ ID NO: 1082731 - RNA, 13 nt, Mycobacterium bovis subsp bovis AF2122/97
ggaccaucgccug

SEQ ID NO: 1082732 - RNA, 21 nt, Mycobacterium bovis subsp bovis AF2122/97
ggaccagcguggggccgccac

SEQ ID NO: 1082733 - RNA, 15 nt, Mycobacterium bovis subsp bovis AF2122/97
ggaccagcugccggc

SEQ ID NO: 1082734 - RNA, 18 nt, Mycobacterium bovis subsp bovis AF2122/97
ggaccagcugccggcgac

SEQ ID NO: 1082735 - RNA, 13 nt, Mycobacterium bovis subsp bovis AF2122/97
ggaccagcgcccc

SEQ ID NO: 1082736 - RNA, 16 nt, Mycobacterium bovis subsp bovis AF2122/97
ggaccagcgccccggc

SEQ ID NO: 1082737 - RNA, 12 nt, Mycobacterium bovis subsp bovis AF2122/97
ggaccagcaccg

SEQ ID NO: 1082738 - RNA, 15 nt, Mycobacterium bovis subsp bovis AF2122/97
ggaccagcaccgccg

SEQ ID NO: 1082739 - RNA, 17 nt, Mycobacterium bovis subsp bovis AF2122/97
ggaccagcaccgccgcg

SEQ ID NO: 1082740 - RNA, 18 nt, Mycobacterium bovis subsp bovis AF2122/97
ggaccagcaccgccgcgc

SEQ ID NO: 1082741 - RNA, 22 nt, Mycobacterium bovis subsp bovis AF2122/97
ggaccagcaccgccgcgccggc

SEQ ID NO: 1082742 - RNA, 16 nt, Mycobacterium bovis subsp bovis AF2122/97
ggaccaccgccgaagc

SEQ ID NO: 1082743 - RNA, 21 nt, Mycobacterium bovis subsp bovis AF2122/97
ggaccagaggcgcuucgccac

SEQ ID NO: 1082744 - RNA, 17 nt, Mycobacterium bovis subsp bovis AF2122/97
ggaccacgugaucgacg

SEQ ID NO: 1082745 - RNA, 14 nt, Mycobacterium bovis subsp bovis AF2122/97
ggaccacucgccgg

SEQ ID NO: 1082746 - RNA, 15 nt, Mycobacterium bovis subsp bovis AF2122/97
ggaccacucgccggc

SEQ ID NO: 1082747 - RNA, 16 nt, Mycobacterium bovis subsp bovis AF2122/97
ggaccacucgccggcg

SEQ ID NO: 1082748 - RNA, 13 nt, Mycobacterium bovis subsp bovis AF2122/97
ggacaucggccgg

SEQ ID NO: 1082749 - RNA, 21 nt, Mycobacterium bovis subsp bovis AF2122/97
ggacauccgcuuacggguguc

SEQ ID NO: 1082750 - RNA, 15 nt, Mycobacterium bovis subsp bovis AF2122/97
ggacauccggcgccg

SEQ ID NO: 1082751 - RNA, 21 nt, Mycobacterium bovis subsp bovis AF2122/97
ggaccaccacuaggucgccgg

SEQ ID NO: 1082752 - RNA, 17 nt, Mycobacterium bovis subsp bovis AF2122/97
ggaccaacgccaacgcc

SEQ ID NO: 1082753 - RNA, 15 nt, Mycobacterium bovis subsp bovis AF2122/97
ggaccacagccgcgc

SEQ ID NO: 1082754 - RNA, 14 nt, Mycobacterium bovis subsp bovis AF2122/97
ggaccaccgcucgc

SEQ ID NO: 1082755 - RNA, 17 nt, Mycobacterium bovis subsp bovis AF2122/97
ggaccaccgcucgccac

SEQ ID NO: 1082756 - RNA, 15 nt, Mycobacterium bovis subsp bovis AF2122/97
ggaccacgccgacgu

SEQ ID NO: 1082757 - RNA, 12 nt, Mycobacterium bovis subsp bovis AF2122/97
ggacaccgugga

SEQ ID NO: 1082758 - RNA, 14 nt, Mycobacterium bovis subsp bovis AF2122/97
ggacaccgcggcga

SEQ ID NO: 1082759 - RNA, 15 nt, Mycobacterium bovis subsp bovis AF2122/97
ggacaccgcggcgau

SEQ ID NO: 1082760 - RNA, 15 nt, Mycobacterium bovis subsp bovis AF2122/97
ggacacgucgugagg

SEQ ID NO: 1082761 - RNA, 17 nt, Mycobacterium bovis subsp bovis AF2122/97
ggacacguugcgacguc

SEQ ID NO: 1082762 - RNA, 20 nt, Mycobacterium bovis subsp bovis AF2122/97
ggacacguuguucaccgacg

SEQ ID NO: 1082763 - RNA, 24 nt, Mycobacterium bovis subsp bovis AF2122/97
ggacacguuguucaccgacgcgaa

SEQ ID NO: 1082764 - RNA, 21 nt, Mycobacterium bovis subsp bovis AF2122/97
ggacacucccgggugcgacgc

SEQ ID NO: 1082765 - RNA, 15 nt, Mycobacterium bovis subsp bovis AF2122/97
ggacaccucgggcgc

SEQ ID NO: 1082766 - RNA, 21 nt, Mycobacterium bovis subsp bovis AF2122/97
ggacaccuguaguucgaugac

SEQ ID NO: 1082767 - RNA, 14 nt, Mycobacterium bovis subsp bovis AF2122/97
ggacagcagccgcc

SEQ ID NO: 1082768 - RNA, 19 nt, Mycobacterium bovis subsp bovis AF2122/97
ggacagcagccgccggccg

SEQ ID NO: 1082769 - RNA, 20 nt, Mycobacterium bovis subsp bovis AF2122/97
ggacagcagccgccggccgg

SEQ ID NO: 1082770 - RNA, 22 nt, Mycobacterium bovis subsp bovis AF2122/97
ggacagcagccgccggccggca

SEQ ID NO: 1082771 - RNA, 16 nt, Mycobacterium bovis subsp bovis AF2122/97
ggacaccuuucuccac

SEQ ID NO: 1082772 - RNA, 11 nt, Mycobacterium bovis subsp bovis AF2122/97
ggacagcgccg

SEQ ID NO: 1082773 - RNA, 17 nt, Mycobacterium bovis subsp bovis AF2122/97
ggacagcgccuggccgg

SEQ ID NO: 1082774 - RNA, 15 nt, Mycobacterium bovis subsp bovis AF2122/97
ggacaaccucgucga

SEQ ID NO: 1082775 - RNA, 17 nt, Mycobacterium bovis subsp bovis AF2122/97
ggacaagcuccucgcga

SEQ ID NO: 1082776 - RNA, 22 nt, Mycobacterium bovis subsp bovis AF2122/97
ggacaaggucaucggcauccgc

SEQ ID NO: 1082777 - RNA, 16 nt, Mycobacterium bovis subsp bovis AF2122/97
ggacaccaccguggcc

SEQ ID NO: 1082778 - RNA, 14 nt, Mycobacterium bovis subsp bovis AF2122/97
ggacaccacgagcg

SEQ ID NO: 1082779 - RNA, 15 nt, Mycobacterium bovis subsp bovis AF2122/97
ggacaaucucggccg

SEQ ID NO: 1082780 - RNA, 15 nt, Mycobacterium bovis subsp bovis AF2122/97
ggacaauucgacgaa

SEQ ID NO: 1082781 - RNA, 15 nt, Mycobacterium bovis subsp bovis AF2122/97
ggacacauugaccag

SEQ ID NO: 1082782 - RNA, 16 nt, Mycobacterium bovis subsp bovis AF2122/97
ggacaagugccggcgc

SEQ ID NO: 1082783 - RNA, 14 nt, Mycobacterium bovis subsp bovis AF2122/97
ggacacagcguccg

SEQ ID NO: 1082784 - RNA, 19 nt, Mycobacterium bovis subsp bovis AF2122/97
ggacaaacaucgcacccac

SEQ ID NO: 1082785 - RNA, 20 nt, Mycobacterium bovis subsp bovis AF2122/97
ggacaaagccgaacgacagc

SEQ ID NO: 1082786 - RNA, 15 nt, Mycobacterium bovis subsp bovis AF2122/97
ggacaaagccgucgc

SEQ ID NO: 1082787 - RNA, 18 nt, Mycobacterium bovis subsp bovis AF2122/97
ggacaaagccgucgcgac

SEQ ID NO: 1082788 - RNA, 14 nt, Mycobacterium bovis subsp bovis AF2122/97
ggacaacacggcga

SEQ ID NO: 1082789 - RNA, 13 nt, Mycobacterium bovis subsp bovis AF2122/97
ggacaacagcaug

SEQ ID NO: 1082790 - RNA, 21 nt, Mycobacterium bovis subsp bovis AF2122/97
ggacaacagcuuggagaucgc

SEQ ID NO: 1082791 - RNA, 17 nt, Mycobacterium bovis subsp bovis AF2122/97
ggacaacccguagggug

SEQ ID NO: 1082792 - RNA, 18 nt, Mycobacterium bovis subsp bovis AF2122/97
ggacaaccgggcgggacu

SEQ ID NO: 1082793 - RNA, 23 nt, Mycobacterium bovis subsp bovis AF2122/97
ggacaaccgggcgggacucggcg

SEQ ID NO: 1082794 - RNA, 13 nt, Mycobacterium bovis subsp bovis AF2122/97
gggccccacggcg

SEQ ID NO: 1082795 - RNA, 19 nt, Mycobacterium bovis subsp bovis AF2122/97
gggccccaugccgaccggc

SEQ ID NO: 1082796 - RNA, 18 nt, Mycobacterium bovis subsp bovis AF2122/97
gggccaucaagcgauccg

SEQ ID NO: 1082797 - RNA, 18 nt, Mycobacterium bovis subsp bovis AF2122/97
gggccccacaucgccccc

SEQ ID NO: 1082798 - RNA, 14 nt, Mycobacterium bovis subsp bovis AF2122/97
gggcccagccggac

SEQ ID NO: 1082799 - RNA, 22 nt, Mycobacterium bovis subsp bovis AF2122/97
gggcccaccgcugcggcaccac

SEQ ID NO: 1082800 - RNA, 16 nt, Mycobacterium bovis subsp bovis AF2122/97
gggccauggguagccg

SEQ ID NO: 1082801 - RNA, 18 nt, Mycobacterium bovis subsp bovis AF2122/97
gggccauggguagccgcc

SEQ ID NO: 1082802 - RNA, 19 nt, Mycobacterium bovis subsp bovis AF2122/97
gggccauggguagccgccc

SEQ ID NO: 1082803 - RNA, 20 nt, Mycobacterium bovis subsp bovis AF2122/97
gggccauggguagccgccca

SEQ ID NO: 1082804 - RNA, 21 nt, Mycobacterium bovis subsp bovis AF2122/97
gggccauguggacggcauagc

SEQ ID NO: 1082805 - RNA, 19 nt, Mycobacterium bovis subsp bovis AF2122/97
gggccaugcuaggaccacc

SEQ ID NO: 1082806 - RNA, 18 nt, Mycobacterium bovis subsp bovis AF2122/97
gggcccgccgucaccgcc

SEQ ID NO: 1082807 - RNA, 16 nt, Mycobacterium bovis subsp bovis AF2122/97
gggcccgccggccccg

SEQ ID NO: 1082808 - RNA, 17 nt, Mycobacterium bovis subsp bovis AF2122/97
gggcccgaugucgucga

SEQ ID NO: 1082809 - RNA, 14 nt, Mycobacterium bovis subsp bovis AF2122/97
gggcccgccagccc

SEQ ID NO: 1082810 - RNA, 17 nt, Mycobacterium bovis subsp bovis AF2122/97
gggcccgacgacgacgu

SEQ ID NO: 1082811 - RNA, 11 nt, Mycobacterium bovis subsp bovis AF2122/97
gggcccgacgu

SEQ ID NO: 1082812 - RNA, 19 nt, Mycobacterium bovis subsp bovis AF2122/97
gggcccgagcuggccguca

SEQ ID NO: 1082813 - RNA, 23 nt, Mycobacterium bovis subsp bovis AF2122/97
gggcccgaugaggacauccggcg

SEQ ID NO: 1082814 - RNA, 20 nt, Mycobacterium bovis subsp bovis AF2122/97
gggcccgaccuguccaccca

SEQ ID NO: 1082815 - RNA, 13 nt, Mycobacterium bovis subsp bovis AF2122/97
gggcccgcugggc

SEQ ID NO: 1082816 - RNA, 12 nt, Mycobacterium bovis subsp bovis AF2122/97
gggcccguccug

SEQ ID NO: 1082817 - RNA, 16 nt, Mycobacterium bovis subsp bovis AF2122/97
gggcccuagccggcgc

SEQ ID NO: 1082818 - RNA, 17 nt, Mycobacterium bovis subsp bovis AF2122/97
gggcccuagccggcgcg

SEQ ID NO: 1082819 - RNA, 20 nt, Mycobacterium bovis subsp bovis AF2122/97
gggcccuagccggcgcgccc

SEQ ID NO: 1082820 - RNA, 17 nt, Mycobacterium bovis subsp bovis AF2122/97
gggcccggccggacggg

SEQ ID NO: 1082821 - RNA, 13 nt, Mycobacterium bovis subsp bovis AF2122/97
gggcccggcgagc

SEQ ID NO: 1082822 - RNA, 19 nt, Mycobacterium bovis subsp bovis AF2122/97
gggcccgccgucaccgccg

SEQ ID NO: 1082823 - RNA, 14 nt, Mycobacterium bovis subsp bovis AF2122/97
gggcccugcuggcc

SEQ ID NO: 1082824 - RNA, 14 nt, Mycobacterium bovis subsp bovis AF2122/97
gggcccuggcggcc

SEQ ID NO: 1082825 - RNA, 12 nt, Mycobacterium bovis subsp bovis AF2122/97
gggccgaagcgc

SEQ ID NO: 1082826 - RNA, 13 nt, Mycobacterium bovis subsp bovis AF2122/97
gggccgagccgac

SEQ ID NO: 1082827 - RNA, 13 nt, Mycobacterium bovis subsp bovis AF2122/97
gggccgagcgcac

SEQ ID NO: 1082828 - RNA, 16 nt, Mycobacterium bovis subsp bovis AF2122/97
gggccgagcgcaccac

SEQ ID NO: 1082829 - RNA, 20 nt, Mycobacterium bovis subsp bovis AF2122/97
gggccgaucucuccggcggc

SEQ ID NO: 1082830 - RNA, 22 nt, Mycobacterium bovis subsp bovis AF2122/97
gggccgaucucuccggcggcga

SEQ ID NO: 1082831 - RNA, 16 nt, Mycobacterium bovis subsp bovis AF2122/97
gggccgaggccgucgc

SEQ ID NO: 1082832 - RNA, 21 nt, Mycobacterium bovis subsp bovis AF2122/97
gggccgagcgcgccguugccg

SEQ ID NO: 1082833 - RNA, 20 nt, Mycobacterium bovis subsp bovis AF2122/97
gggccgcaucgucgccgcgc

SEQ ID NO: 1082834 - RNA, 15 nt, Mycobacterium bovis subsp bovis AF2122/97
gggccgccaccagcg

SEQ ID NO: 1082835 - RNA, 16 nt, Mycobacterium bovis subsp bovis AF2122/97
gggccgccaccagcgc

SEQ ID NO: 1082836 - RNA, 23 nt, Mycobacterium bovis subsp bovis AF2122/97
gggccgcacguauccacggucga

SEQ ID NO: 1082837 - RNA, 22 nt, Mycobacterium bovis subsp bovis AF2122/97
gggccgccagcugcgcagcgca

SEQ ID NO: 1082838 - RNA, 15 nt, Mycobacterium bovis subsp bovis AF2122/97
gggccgccaucucgu

SEQ ID NO: 1082839 - RNA, 23 nt, Mycobacterium bovis subsp bovis AF2122/97
gggccgccgaagcucaucgccgc

SEQ ID NO: 1082840 - RNA, 16 nt, Mycobacterium bovis subsp bovis AF2122/97
gggccgccgagcggac

SEQ ID NO: 1082841 - RNA, 21 nt, Mycobacterium bovis subsp bovis AF2122/97
gggccgccgagcggaccaccg

SEQ ID NO: 1082842 - RNA, 22 nt, Mycobacterium bovis subsp bovis AF2122/97
gggccgccgagcggaccaccgc

SEQ ID NO: 1082843 - RNA, 13 nt, Mycobacterium bovis subsp bovis AF2122/97
gggccgccgcggc

SEQ ID NO: 1082844 - RNA, 20 nt, Mycobacterium bovis subsp bovis AF2122/97
gggccgccgcugccgccugc

SEQ ID NO: 1082845 - RNA, 19 nt, Mycobacterium bovis subsp bovis AF2122/97
gggccgccucgaucgacuc

SEQ ID NO: 1082846 - RNA, 21 nt, Mycobacterium bovis subsp bovis AF2122/97
gggccgcuccaccacgaccgc

SEQ ID NO: 1082847 - RNA, 23 nt, Mycobacterium bovis subsp bovis AF2122/97
gggccgcgcgcacuugcguggcg

SEQ ID NO: 1082848 - RNA, 23 nt, Mycobacterium bovis subsp bovis AF2122/97
gggccgcgcgcagagcguacagg

SEQ ID NO: 1082849 - RNA, 18 nt, Mycobacterium bovis subsp bovis AF2122/97
gggccgcgcgggccgccg

SEQ ID NO: 1082850 - RNA, 15 nt, Mycobacterium bovis subsp bovis AF2122/97
gggccgcggcggcca

SEQ ID NO: 1082851 - RNA, 17 nt, Mycobacterium bovis subsp bovis AF2122/97
gggccgcggcggccagc

SEQ ID NO: 1082852 - RNA, 16 nt, Mycobacterium bovis subsp bovis AF2122/97
gggccggagccggugc

SEQ ID NO: 1082853 - RNA, 18 nt, Mycobacterium bovis subsp bovis AF2122/97
gggccggaugggcgucga

SEQ ID NO: 1082854 - RNA, 18 nt, Mycobacterium bovis subsp bovis AF2122/97
gggccggcacugccgagc

SEQ ID NO: 1082855 - RNA, 13 nt, Mycobacterium bovis subsp bovis AF2122/97
gggccggccgagc

SEQ ID NO: 1082856 - RNA, 14 nt, Mycobacterium bovis subsp bovis AF2122/97
gggccggccgagcg

SEQ ID NO: 1082857 - RNA, 13 nt, Mycobacterium bovis subsp bovis AF2122/97
gggccggccgccg

SEQ ID NO: 1082858 - RNA, 14 nt, Mycobacterium bovis subsp bovis AF2122/97
gggccggccgccgc

SEQ ID NO: 1082859 - RNA, 13 nt, Mycobacterium bovis subsp bovis AF2122/97
gggccggcgucga

SEQ ID NO: 1082860 - RNA, 15 nt, Mycobacterium bovis subsp bovis AF2122/97
gggccgggcgaucgc

SEQ ID NO: 1082861 - RNA, 17 nt, Mycobacterium bovis subsp bovis AF2122/97
gggccggugcagcacgu

SEQ ID NO: 1082862 - RNA, 13 nt, Mycobacterium bovis subsp bovis AF2122/97
gggcagccgcgcc

SEQ ID NO: 1082863 - RNA, 14 nt, Mycobacterium bovis subsp bovis AF2122/97
gggcagccgcgccg

SEQ ID NO: 1082864 - RNA, 14 nt, Mycobacterium bovis subsp bovis AF2122/97
gggcagccgcacgg

SEQ ID NO: 1082865 - RNA, 13 nt, Mycobacterium bovis subsp bovis AF2122/97
gggcagccgcccg

SEQ ID NO: 1082866 - RNA, 22 nt, Mycobacterium bovis subsp bovis AF2122/97
gggcagccgcccgcccaccucg

SEQ ID NO: 1082867 - RNA, 14 nt, Mycobacterium bovis subsp bovis AF2122/97
gggcagcgggccgc

SEQ ID NO: 1082868 - RNA, 16 nt, Mycobacterium bovis subsp bovis AF2122/97
gggcagcgggccgccc

SEQ ID NO: 1082869 - RNA, 16 nt, Mycobacterium bovis subsp bovis AF2122/97
gggcagcgcgaucacc

SEQ ID NO: 1082870 - RNA, 22 nt, Mycobacterium bovis subsp bovis AF2122/97
gggcagcuccaccaggacgugg

SEQ ID NO: 1082871 - RNA, 23 nt, Mycobacterium bovis subsp bovis AF2122/97
gggcaggaucuccgggucgaugu

SEQ ID NO: 1082872 - RNA, 15 nt, Mycobacterium bovis subsp bovis AF2122/97
gggcaucaccgccgc

SEQ ID NO: 1082873 - RNA, 18 nt, Mycobacterium bovis subsp bovis AF2122/97
gggcaucaucagcggcgc

SEQ ID NO: 1082874 - RNA, 15 nt, Mycobacterium bovis subsp bovis AF2122/97
gggcauaacccgcac

SEQ ID NO: 1082875 - RNA, 21 nt, Mycobacterium bovis subsp bovis AF2122/97
gggcaguaucaucggcgcugg

SEQ ID NO: 1082876 - RNA, 24 nt, Mycobacterium bovis subsp bovis AF2122/97
gggcaggccgcugggccgaccgcc

SEQ ID NO: 1082877 - RNA, 13 nt, Mycobacterium bovis subsp bovis AF2122/97
gggcagugaacau

SEQ ID NO: 1082878 - RNA, 21 nt, Mycobacterium bovis subsp bovis AF2122/97
gggcaugccggcgaagccggc

SEQ ID NO: 1082879 - RNA, 12 nt, Mycobacterium bovis subsp bovis AF2122/97
gggcaucgucgc

SEQ ID NO: 1082880 - RNA, 15 nt, Mycobacterium bovis subsp bovis AF2122/97
gggcauucucgagcc

SEQ ID NO: 1082881 - RNA, 13 nt, Mycobacterium bovis subsp bovis AF2122/97
gggcaugucgccg

SEQ ID NO: 1082882 - RNA, 18 nt, Mycobacterium bovis subsp bovis AF2122/97
gggcauucccgcucgcag

SEQ ID NO: 1082883 - RNA, 12 nt, Mycobacterium bovis subsp bovis AF2122/97
gggccaggcgaa

SEQ ID NO: 1082884 - RNA, 15 nt, Mycobacterium bovis subsp bovis AF2122/97
gggccaggccgaugc

SEQ ID NO: 1082885 - RNA, 17 nt, Mycobacterium bovis subsp bovis AF2122/97
gggccaggccgaugccg

SEQ ID NO: 1082886 - RNA, 19 nt, Mycobacterium bovis subsp bovis AF2122/97
gggccagugaaaccaccgg

SEQ ID NO: 1082887 - RNA, 20 nt, Mycobacterium bovis subsp bovis AF2122/97
gggccagugaaaccaccggc

SEQ ID NO: 1082888 - RNA, 19 nt, Mycobacterium bovis subsp bovis AF2122/97
gggccaucgcauccccagc

SEQ ID NO: 1082889 - RNA, 17 nt, Mycobacterium bovis subsp bovis AF2122/97
gggccagccgcucaccc

SEQ ID NO: 1082890 - RNA, 13 nt, Mycobacterium bovis subsp bovis AF2122/97
gggccagcgccuc

SEQ ID NO: 1082891 - RNA, 14 nt, Mycobacterium bovis subsp bovis AF2122/97
gggccaaagccguc

SEQ ID NO: 1082892 - RNA, 17 nt, Mycobacterium bovis subsp bovis AF2122/97
gggccagcagccgcgac

SEQ ID NO: 1082893 - RNA, 16 nt, Mycobacterium bovis subsp bovis AF2122/97
gggccagaucgccggg

SEQ ID NO: 1082894 - RNA, 20 nt, Mycobacterium bovis subsp bovis AF2122/97
gggccaccaguuguccggcu

SEQ ID NO: 1082895 - RNA, 21 nt, Mycobacterium bovis subsp bovis AF2122/97
gggccaccaguuguccggcua

SEQ ID NO: 1082896 - RNA, 13 nt, Mycobacterium bovis subsp bovis AF2122/97
gggccacguccug

SEQ ID NO: 1082897 - RNA, 16 nt, Mycobacterium bovis subsp bovis AF2122/97
gggccacuggccgguu

SEQ ID NO: 1082898 - RNA, 12 nt, Mycobacterium bovis subsp bovis AF2122/97
gggccaccaccu

SEQ ID NO: 1082899 - RNA, 12 nt, Mycobacterium bovis subsp bovis AF2122/97
gggccaccacgc

SEQ ID NO: 1082900 - RNA, 16 nt, Mycobacterium bovis subsp bovis AF2122/97
gggccaccacgcgccg

SEQ ID NO: 1082901 - RNA, 16 nt, Mycobacterium bovis subsp bovis AF2122/97
gggccaccaccacggc

SEQ ID NO: 1082902 - RNA, 19 nt, Mycobacterium bovis subsp bovis AF2122/97
gggccacaccugcgccacc

SEQ ID NO: 1082903 - RNA, 15 nt, Mycobacterium bovis subsp bovis AF2122/97
gggccacagcaacgu

SEQ ID NO: 1082904 - RNA, 15 nt, Mycobacterium bovis subsp bovis AF2122/97
gggccaaccggucgu

SEQ ID NO: 1082905 - RNA, 20 nt, Mycobacterium bovis subsp bovis AF2122/97
gggccaaccggucgucuguc

SEQ ID NO: 1082906 - RNA, 17 nt, Mycobacterium bovis subsp bovis AF2122/97
gggacgcgagugcguga

SEQ ID NO: 1082907 - RNA, 20 nt, Mycobacterium bovis subsp bovis AF2122/97
gggacgcccgugcggcucgc

SEQ ID NO: 1082908 - RNA, 12 nt, Mycobacterium bovis subsp bovis AF2122/97
gggacgccgccc

SEQ ID NO: 1082909 - RNA, 13 nt, Mycobacterium bovis subsp bovis AF2122/97
gggacgccgcggc

SEQ ID NO: 1082910 - RNA, 17 nt, Mycobacterium bovis subsp bovis AF2122/97
gggacguuguccaccgc

SEQ ID NO: 1082911 - RNA, 22 nt, Mycobacterium bovis subsp bovis AF2122/97
gggacucauggccggucugcug

SEQ ID NO: 1082912 - RNA, 15 nt, Mycobacterium bovis subsp bovis AF2122/97
gggacgugcccggug

SEQ ID NO: 1082913 - RNA, 17 nt, Mycobacterium bovis subsp bovis AF2122/97
gggacggcggcgaggcg

SEQ ID NO: 1082914 - RNA, 14 nt, Mycobacterium bovis subsp bovis AF2122/97
gggacgcggccgag

SEQ ID NO: 1082915 - RNA, 13 nt, Mycobacterium bovis subsp bovis AF2122/97
gggacggcggcaa

SEQ ID NO: 1082916 - RNA, 17 nt, Mycobacterium bovis subsp bovis AF2122/97
gggacgggcgcgucggc

SEQ ID NO: 1082917 - RNA, 13 nt, Mycobacterium bovis subsp bovis AF2122/97
gggacgggucgcc

SEQ ID NO: 1082918 - RNA, 17 nt, Mycobacterium bovis subsp bovis AF2122/97
gggacgggucgccgcca

SEQ ID NO: 1082919 - RNA, 18 nt, Mycobacterium bovis subsp bovis AF2122/97
ggcgucaugaacgaucgg

SEQ ID NO: 1082920 - RNA, 18 nt, Mycobacterium bovis subsp bovis AF2122/97
gggacccggcgccgucga

SEQ ID NO: 1082921 - RNA, 23 nt, Mycobacterium bovis subsp bovis AF2122/97
gggacccggcgccgucgaugacc

SEQ ID NO: 1082922 - RNA, 18 nt, Mycobacterium bovis subsp bovis AF2122/97
gggaccgagaacugcucg

SEQ ID NO: 1082923 - RNA, 20 nt, Mycobacterium bovis subsp bovis AF2122/97
gggacgaaaaaaucgugcgg

SEQ ID NO: 1082924 - RNA, 12 nt, Mycobacterium bovis subsp bovis AF2122/97
ggcgucaccccg

SEQ ID NO: 1082925 - RNA, 14 nt, Mycobacterium bovis subsp bovis AF2122/97
ggcgucaccccggu

SEQ ID NO: 1082926 - RNA, 19 nt, Mycobacterium bovis subsp bovis AF2122/97
ggcgucaagcaaguccacc

SEQ ID NO: 1082927 - RNA, 21 nt, Mycobacterium bovis subsp bovis AF2122/97
ggcguagaucaucuggcuggu

SEQ ID NO: 1082928 - RNA, 22 nt, Mycobacterium bovis subsp bovis AF2122/97
ggcgucacgguggacgauacgc

SEQ ID NO: 1082929 - RNA, 21 nt, Mycobacterium bovis subsp bovis AF2122/97
ggcgucagcaguucggcgaug

SEQ ID NO: 1082930 - RNA, 14 nt, Mycobacterium bovis subsp bovis AF2122/97
ggcgucagcagcaa

SEQ ID NO: 1082931 - RNA, 12 nt, Mycobacterium bovis subsp bovis AF2122/97
ggcgucaccgcc

SEQ ID NO: 1082932 - RNA, 13 nt, Mycobacterium bovis subsp bovis AF2122/97
ggcgucaccgccg

SEQ ID NO: 1082933 - RNA, 22 nt, Mycobacterium bovis subsp bovis AF2122/97
ggcgucaggccagagucgcccg

SEQ ID NO: 1082934 - RNA, 20 nt, Mycobacterium bovis subsp bovis AF2122/97
gggagcccgagcucaccgca

SEQ ID NO: 1082935 - RNA, 14 nt, Mycobacterium bovis subsp bovis AF2122/97
gggagcagccgaac

SEQ ID NO: 1082936 - RNA, 16 nt, Mycobacterium bovis subsp bovis AF2122/97
gggagaucucguccag

SEQ ID NO: 1082937 - RNA, 22 nt, Mycobacterium bovis subsp bovis AF2122/97
gggacugugggggcgcaccgag

SEQ ID NO: 1082938 - RNA, 12 nt, Mycobacterium bovis subsp bovis AF2122/97
gggacuucccgc

SEQ ID NO: 1082939 - RNA, 21 nt, Mycobacterium bovis subsp bovis AF2122/97
gggacucugccacccagcacg

SEQ ID NO: 1082940 - RNA, 17 nt, Mycobacterium bovis subsp bovis AF2122/97
gggagaccgcggccggc

SEQ ID NO: 1082941 - RNA, 14 nt, Mycobacterium bovis subsp bovis AF2122/97
gggagggaccaccc

SEQ ID NO: 1082942 - RNA, 15 nt, Mycobacterium bovis subsp bovis AF2122/97
gggaggcagcgcgag

SEQ ID NO: 1082943 - RNA, 17 nt, Mycobacterium bovis subsp bovis AF2122/97
gggagcccggcggcccg

SEQ ID NO: 1082944 - RNA, 17 nt, Mycobacterium bovis subsp bovis AF2122/97
gggagcugaccacuucg

SEQ ID NO: 1082945 - RNA, 16 nt, Mycobacterium bovis subsp bovis AF2122/97
gggagcugaucacgca

SEQ ID NO: 1082946 - RNA, 14 nt, Mycobacterium bovis subsp bovis AF2122/97
gggagcggcugcgg

SEQ ID NO: 1082947 - RNA, 18 nt, Mycobacterium bovis subsp bovis AF2122/97
gggagcggcugcggcaac

SEQ ID NO: 1082948 - RNA, 16 nt, Mycobacterium bovis subsp bovis AF2122/97
gggaucgagagccgac

SEQ ID NO: 1082949 - RNA, 17 nt, Mycobacterium bovis subsp bovis AF2122/97
gggauccgaagagccag

SEQ ID NO: 1082950 - RNA, 17 nt, Mycobacterium bovis subsp bovis AF2122/97
gggaucaugaccaucga

SEQ ID NO: 1082951 - RNA, 22 nt, Mycobacterium bovis subsp bovis AF2122/97
gggaucaugaccaucgaggcga

SEQ ID NO: 1082952 - RNA, 13 nt, Mycobacterium bovis subsp bovis AF2122/97
gggaucacgaccg

SEQ ID NO: 1082953 - RNA, 15 nt, Mycobacterium bovis subsp bovis AF2122/97
gggaucacgaucaca

SEQ ID NO: 1082954 - RNA, 19 nt, Mycobacterium bovis subsp bovis AF2122/97
gggaguucaucgcacgaaa

SEQ ID NO: 1082955 - RNA, 16 nt, Mycobacterium bovis subsp bovis AF2122/97
gggauaucgucgacgc

SEQ ID NO: 1082956 - RNA, 20 nt, Mycobacterium bovis subsp bovis AF2122/97
gggauaguuuucggccgcca

SEQ ID NO: 1082957 - RNA, 13 nt, Mycobacterium bovis subsp bovis AF2122/97
gggauaggccgug

SEQ ID NO: 1082958 - RNA, 17 nt, Mycobacterium bovis subsp bovis AF2122/97
gggauacucgucgucgg

SEQ ID NO: 1082959 - RNA, 22 nt, Mycobacterium bovis subsp bovis AF2122/97
gggauagacgaccccggugagc

SEQ ID NO: 1082960 - RNA, 22 nt, Mycobacterium bovis subsp bovis AF2122/97
gggagguggcgcggggccgccg

SEQ ID NO: 1082961 - RNA, 17 nt, Mycobacterium bovis subsp bovis AF2122/97
gggaguacgggagccgg

SEQ ID NO: 1082962 - RNA, 19 nt, Mycobacterium bovis subsp bovis AF2122/97
gggcaccguuaccgccguc

SEQ ID NO: 1082963 - RNA, 11 nt, Mycobacterium bovis subsp bovis AF2122/97
gggcaccggcg

SEQ ID NO: 1082964 - RNA, 13 nt, Mycobacterium bovis subsp bovis AF2122/97
gggcaccggcggu

SEQ ID NO: 1082965 - RNA, 16 nt, Mycobacterium bovis subsp bovis AF2122/97
gggcaccgguuugacg

SEQ ID NO: 1082966 - RNA, 18 nt, Mycobacterium bovis subsp bovis AF2122/97
gggcaccuuggccggccc

SEQ ID NO: 1082967 - RNA, 13 nt, Mycobacterium bovis subsp bovis AF2122/97
gggcacgcccucg

SEQ ID NO: 1082968 - RNA, 17 nt, Mycobacterium bovis subsp bovis AF2122/97
gggcacgccgccgacgu

SEQ ID NO: 1082969 - RNA, 14 nt, Mycobacterium bovis subsp bovis AF2122/97
gggcacguggcggu

SEQ ID NO: 1082970 - RNA, 20 nt, Mycobacterium bovis subsp bovis AF2122/97
gggcacuccgggcucggcgu

SEQ ID NO: 1082971 - RNA, 20 nt, Mycobacterium bovis subsp bovis AF2122/97
gggcacguugugaucgucag

SEQ ID NO: 1082972 - RNA, 15 nt, Mycobacterium bovis subsp bovis AF2122/97
gggcagcaccagcgc

SEQ ID NO: 1082973 - RNA, 18 nt, Mycobacterium bovis subsp bovis AF2122/97
gggcagccccuccgcgcc

SEQ ID NO: 1082974 - RNA, 13 nt, Mycobacterium bovis subsp bovis AF2122/97
gggcaccauaucg

SEQ ID NO: 1082975 - RNA, 18 nt, Mycobacterium bovis subsp bovis AF2122/97
gggcaagaaaguuccacg

SEQ ID NO: 1082976 - RNA, 17 nt, Mycobacterium bovis subsp bovis AF2122/97
gggcacaccgcaccugg

SEQ ID NO: 1082977 - RNA, 12 nt, Mycobacterium bovis subsp bovis AF2122/97
gggcaccaccac

SEQ ID NO: 1082978 - RNA, 13 nt, Mycobacterium bovis subsp bovis AF2122/97
gggcaccaccaca

SEQ ID NO: 1082979 - RNA, 20 nt, Mycobacterium bovis subsp bovis AF2122/97
gggcaccacccuugccgaug

SEQ ID NO: 1082980 - RNA, 15 nt, Mycobacterium bovis subsp bovis AF2122/97
gggcaaccugccggg

SEQ ID NO: 1082981 - RNA, 17 nt, Mycobacterium bovis subsp bovis AF2122/97
gggcaacucggugacgu

SEQ ID NO: 1082982 - RNA, 14 nt, Mycobacterium bovis subsp bovis AF2122/97
gggcaaggccaccg

SEQ ID NO: 1082983 - RNA, 21 nt, Mycobacterium bovis subsp bovis AF2122/97
gggcaaggccaccggcggugc

SEQ ID NO: 1082984 - RNA, 21 nt, Mycobacterium bovis subsp bovis AF2122/97
gggcaaggacaagccgcugau

SEQ ID NO: 1082985 - RNA, 14 nt, Mycobacterium bovis subsp bovis AF2122/97
gggcacaccgacgc

SEQ ID NO: 1082986 - RNA, 15 nt, Mycobacterium bovis subsp bovis AF2122/97
gggcacaccgacgcc

SEQ ID NO: 1082987 - RNA, 19 nt, Mycobacterium bovis subsp bovis AF2122/97
gggcacaccgacgccgcca

SEQ ID NO: 1082988 - RNA, 16 nt, Mycobacterium bovis subsp bovis AF2122/97
gggcaauuccgccgag

SEQ ID NO: 1082989 - RNA, 19 nt, Mycobacterium bovis subsp bovis AF2122/97
gggcaauuccgccgagcgc

SEQ ID NO: 1082990 - RNA, 20 nt, Mycobacterium bovis subsp bovis AF2122/97
gggcacaaccagaucuguac

SEQ ID NO: 1082991 - RNA, 19 nt, Mycobacterium bovis subsp bovis AF2122/97
gggcaaucaccgccggcgg

SEQ ID NO: 1082992 - RNA, 20 nt, Mycobacterium bovis subsp bovis AF2122/97
gggcaaugucgacaccggcg

SEQ ID NO: 1082993 - RNA, 17 nt, Mycobacterium bovis subsp bovis AF2122/97
gggaucgcgcagcgccg

SEQ ID NO: 1082994 - RNA, 20 nt, Mycobacterium bovis subsp bovis AF2122/97
gggaucgcgcagcgccgcca

SEQ ID NO: 1082995 - RNA, 17 nt, Mycobacterium bovis subsp bovis AF2122/97
gggaucgccguccagca

SEQ ID NO: 1082996 - RNA, 15 nt, Mycobacterium bovis subsp bovis AF2122/97
gggaucggggcaccg

SEQ ID NO: 1082997 - RNA, 13 nt, Mycobacterium bovis subsp bovis AF2122/97
gggaucgugccgg

SEQ ID NO: 1082998 - RNA, 21 nt, Mycobacterium bovis subsp bovis AF2122/97
gggaucuagaggcggcccccg

SEQ ID NO: 1082999 - RNA, 19 nt, Mycobacterium bovis subsp bovis AF2122/97
gggaucuuaggcacucccg

SEQ ID NO: 1083000 - RNA, 19 nt, Mycobacterium bovis subsp bovis AF2122/97
gggaucucgaaggccgcca

SEQ ID NO: 1083001 - RNA, 21 nt, Mycobacterium bovis subsp bovis AF2122/97
gggaucugcgccgcgcgcggc

SEQ ID NO: 1083002 - RNA, 16 nt, Mycobacterium bovis subsp bovis AF2122/97
gggaugcgcgcccgac

SEQ ID NO: 1083003 - RNA, 15 nt, Mycobacterium bovis subsp bovis AF2122/97
gggaugccggcgaag

SEQ ID NO: 1083004 - RNA, 18 nt, Mycobacterium bovis subsp bovis AF2122/97
gggaugggggagccggug

SEQ ID NO: 1083005 - RNA, 15 nt, Mycobacterium bovis subsp bovis AF2122/97
gggauggacaccacc

SEQ ID NO: 1083006 - RNA, 23 nt, Mycobacterium bovis subsp bovis AF2122/97
gggauggcucacccaggcgccga

SEQ ID NO: 1083007 - RNA, 23 nt, Mycobacterium bovis subsp bovis AF2122/97
gggauggacggcagccagccacc

SEQ ID NO: 1083008 - RNA, 18 nt, Mycobacterium bovis subsp bovis AF2122/97
gggaugcgaccgccggac

SEQ ID NO: 1083009 - RNA, 15 nt, Mycobacterium bovis subsp bovis AF2122/97
gggcaaaggagccgu

SEQ ID NO: 1083010 - RNA, 19 nt, Mycobacterium bovis subsp bovis AF2122/97
gggauuuugcgucugcucg

SEQ ID NO: 1083011 - RNA, 12 nt, Mycobacterium bovis subsp bovis AF2122/97
gggcaaacccgg

SEQ ID NO: 1083012 - RNA, 14 nt, Mycobacterium bovis subsp bovis AF2122/97
gggauucggguucc

SEQ ID NO: 1083013 - RNA, 20 nt, Mycobacterium bovis subsp bovis AF2122/97
gggcaaacugggcaccggcg

SEQ ID NO: 1083014 - RNA, 19 nt, Mycobacterium bovis subsp bovis AF2122/97
gggcaacggacgggaucgc

SEQ ID NO: 1083015 - RNA, 15 nt, Mycobacterium bovis subsp bovis AF2122/97
gggcaacggccgcua

SEQ ID NO: 1083016 - RNA, 15 nt, Mycobacterium bovis subsp bovis AF2122/97
gggcaaccagcagca

SEQ ID NO: 1083017 - RNA, 17 nt, Mycobacterium bovis subsp bovis AF2122/97
gggcaaccagcagcagg

SEQ ID NO: 1083018 - RNA, 20 nt, Mycobacterium bovis subsp bovis AF2122/97
gggcaaccagcagcagguug

SEQ ID NO: 1083019 - RNA, 13 nt, Mycobacterium bovis subsp bovis AF2122/97
gggauggucccgc

SEQ ID NO: 1083020 - RNA, 18 nt, Mycobacterium bovis subsp bovis AF2122/97
gggauguagugcugcucg

SEQ ID NO: 1083021 - RNA, 17 nt, Mycobacterium bovis subsp bovis AF2122/97
gggauguagugcugcuc

SEQ ID NO: 1083022 - RNA, 21 nt, Mycobacterium bovis subsp bovis AF2122/97
gggauguagugcugcucgaca

SEQ ID NO: 1083023 - RNA, 19 nt, Mycobacterium bovis subsp bovis AF2122/97
gggauuucgcgucugcucg

SEQ ID NO: 1083024 - RNA, 16 nt, Mycobacterium bovis subsp bovis AF2122/97
gggauuugggcugcgg

SEQ ID NO: 1083025 - RNA, 23 nt, Mycobacterium bovis subsp bovis AF2122/97
gggauuuugcgucugcucggcgg

SEQ ID NO: 1083026 - RNA, 21 nt, Mycobacterium bovis subsp bovis AF2122/97
gggcuccaauugcggccgcgc

SEQ ID NO: 1083027 - RNA, 21 nt, Mycobacterium bovis subsp bovis AF2122/97
gggcuccgugguugccgaagc

SEQ ID NO: 1083028 - RNA, 18 nt, Mycobacterium bovis subsp bovis AF2122/97
gggcuccucgugcacgca

SEQ ID NO: 1083029 - RNA, 14 nt, Mycobacterium bovis subsp bovis AF2122/97
gggcucagcggugg

SEQ ID NO: 1083030 - RNA, 21 nt, Mycobacterium bovis subsp bovis AF2122/97
gggcuaucguggcggcgucga

SEQ ID NO: 1083031 - RNA, 16 nt, Mycobacterium bovis subsp bovis AF2122/97
gggcuaugaccugcga

SEQ ID NO: 1083032 - RNA, 21 nt, Mycobacterium bovis subsp bovis AF2122/97
gggcuaccggcgccgcgcggc

SEQ ID NO: 1083033 - RNA, 23 nt, Mycobacterium bovis subsp bovis AF2122/97
gggcucaacaccagccggucguc

SEQ ID NO: 1083034 - RNA, 12 nt, Mycobacterium bovis subsp bovis AF2122/97
gggcucgcucgc

SEQ ID NO: 1083035 - RNA, 12 nt, Mycobacterium bovis subsp bovis AF2122/97
gggcucggcagg

SEQ ID NO: 1083036 - RNA, 11 nt, Mycobacterium bovis subsp bovis AF2122/97
gggcucggcgg

SEQ ID NO: 1083037 - RNA, 14 nt, Mycobacterium bovis subsp bovis AF2122/97
gggcucggcgucgc

SEQ ID NO: 1083038 - RNA, 22 nt, Mycobacterium bovis subsp bovis AF2122/97
gggcucugcugccagccgaagc

SEQ ID NO: 1083039 - RNA, 14 nt, Mycobacterium bovis subsp bovis AF2122/97
gggcucguccagca

SEQ ID NO: 1083040 - RNA, 18 nt, Mycobacterium bovis subsp bovis AF2122/97
gggcucgcccgcuacggc

SEQ ID NO: 1083041 - RNA, 21 nt, Mycobacterium bovis subsp bovis AF2122/97
gggcucgucgaguggaucaca

SEQ ID NO: 1083042 - RNA, 22 nt, Mycobacterium bovis subsp bovis AF2122/97
gggcugaggguggaccggucga

SEQ ID NO: 1083043 - RNA, 13 nt, Mycobacterium bovis subsp bovis AF2122/97
gggcugccgccca

SEQ ID NO: 1083044 - RNA, 22 nt, Mycobacterium bovis subsp bovis AF2122/97
gggcugccccuccgggcgcacc

SEQ ID NO: 1083045 - RNA, 12 nt, Mycobacterium bovis subsp bovis AF2122/97
gggcuggccagc

SEQ ID NO: 1083046 - RNA, 13 nt, Mycobacterium bovis subsp bovis AF2122/97
gggcuggccagca

SEQ ID NO: 1083047 - RNA, 13 nt, Mycobacterium bovis subsp bovis AF2122/97
gggcugcggccgc

SEQ ID NO: 1083048 - RNA, 15 nt, Mycobacterium bovis subsp bovis AF2122/97
gggcgguccgcgucu

SEQ ID NO: 1083049 - RNA, 10 nt, Mycobacterium bovis subsp bovis AF2122/97
gggcgguggg

SEQ ID NO: 1083050 - RNA, 17 nt, Mycobacterium bovis subsp bovis AF2122/97
gggcggugaaggccccg

SEQ ID NO: 1083051 - RNA, 15 nt, Mycobacterium bovis subsp bovis AF2122/97
gggcggucggccggc

SEQ ID NO: 1083052 - RNA, 17 nt, Mycobacterium bovis subsp bovis AF2122/97
gggcguacucggcgcgc

SEQ ID NO: 1083053 - RNA, 14 nt, Mycobacterium bovis subsp bovis AF2122/97
gggcgucgccgccg

SEQ ID NO: 1083054 - RNA, 16 nt, Mycobacterium bovis subsp bovis AF2122/97
gggcgucgccgccggg

SEQ ID NO: 1083055 - RNA, 18 nt, Mycobacterium bovis subsp bovis AF2122/97
gggcgucgcaacgcgauc

SEQ ID NO: 1083056 - RNA, 15 nt, Mycobacterium bovis subsp bovis AF2122/97
gggcguucccccggc

SEQ ID NO: 1083057 - RNA, 13 nt, Mycobacterium bovis subsp bovis AF2122/97
gggcgugggcacc

SEQ ID NO: 1083058 - RNA, 17 nt, Mycobacterium bovis subsp bovis AF2122/97
gggcgugggccgcuggg

SEQ ID NO: 1083059 - RNA, 21 nt, Mycobacterium bovis subsp bovis AF2122/97
gggcguuucagacacuggucg

SEQ ID NO: 1083060 - RNA, 22 nt, Mycobacterium bovis subsp bovis AF2122/97
gggcguuucagacacuggucgc

SEQ ID NO: 1083061 - RNA, 20 nt, Mycobacterium bovis subsp bovis AF2122/97
gggcguuuggacgggcgugc

SEQ ID NO: 1083062 - RNA, 21 nt, Mycobacterium bovis subsp bovis AF2122/97
gggcgucaagcaaguccaccg

SEQ ID NO: 1083063 - RNA, 13 nt, Mycobacterium bovis subsp bovis AF2122/97
gggcgugccgacc

SEQ ID NO: 1083064 - RNA, 16 nt, Mycobacterium bovis subsp bovis AF2122/97
gggcgugcuacacccg

SEQ ID NO: 1083065 - RNA, 17 nt, Mycobacterium bovis subsp bovis AF2122/97
gggcgugcuacacccgu

SEQ ID NO: 1083066 - RNA, 16 nt, Mycobacterium bovis subsp bovis AF2122/97
gggcgugcucgccggg

SEQ ID NO: 1083067 - RNA, 18 nt, Mycobacterium bovis subsp bovis AF2122/97
gggcgugaucccgcccaa

SEQ ID NO: 1083068 - RNA, 13 nt, Mycobacterium bovis subsp bovis AF2122/97
gggcgucguucgc

SEQ ID NO: 1083069 - RNA, 22 nt, Mycobacterium bovis subsp bovis AF2122/97
gggcgucgucggugaucaccgc

SEQ ID NO: 1083070 - RNA, 18 nt, Mycobacterium bovis subsp bovis AF2122/97
gggcgucgucgaguuggc

SEQ ID NO: 1083071 - RNA, 16 nt, Mycobacterium bovis subsp bovis AF2122/97
gggcuuucugcacccg

SEQ ID NO: 1083072 - RNA, 23 nt, Mycobacterium bovis subsp bovis AF2122/97
gggcuuucugcacccgccagggc

SEQ ID NO: 1083073 - RNA, 19 nt, Mycobacterium bovis subsp bovis AF2122/97
gggcuuuugcgucugcucg

SEQ ID NO: 1083074 - RNA, 17 nt, Mycobacterium bovis subsp bovis AF2122/97
gggcuuugucaccggcu

SEQ ID NO: 1083075 - RNA, 19 nt, Mycobacterium bovis subsp bovis AF2122/97
gggcuuuuacgucugcucg

SEQ ID NO: 1083076 - RNA, 19 nt, Mycobacterium bovis subsp bovis AF2122/97
gggcuuugcagcguugacg

SEQ ID NO: 1083077 - RNA, 15 nt, Mycobacterium bovis subsp bovis AF2122/97
gggcuuugccgucga

SEQ ID NO: 1083078 - RNA, 20 nt, Mycobacterium bovis subsp bovis AF2122/97
gggcuuuugcgucugcugac

SEQ ID NO: 1083079 - RNA, 15 nt, Mycobacterium bovis subsp bovis AF2122/97
gggcuugucgccggc

SEQ ID NO: 1083080 - RNA, 20 nt, Mycobacterium bovis subsp bovis AF2122/97
ggggaaccguccaagccggc

SEQ ID NO: 1083081 - RNA, 23 nt, Mycobacterium bovis subsp bovis AF2122/97
ggggacccggaccuucggcggug

SEQ ID NO: 1083082 - RNA, 18 nt, Mycobacterium bovis subsp bovis AF2122/97
ggggacccggggccguug

SEQ ID NO: 1083083 - RNA, 21 nt, Mycobacterium bovis subsp bovis AF2122/97
ggggaccuauuggucgcucgc

SEQ ID NO: 1083084 - RNA, 14 nt, Mycobacterium bovis subsp bovis AF2122/97
ggggaccucggcga

SEQ ID NO: 1083085 - RNA, 21 nt, Mycobacterium bovis subsp bovis AF2122/97
ggggaccucggcgaucaagcc

SEQ ID NO: 1083086 - RNA, 17 nt, Mycobacterium bovis subsp bovis AF2122/97
ggggacgugcccggugu

SEQ ID NO: 1083087 - RNA, 14 nt, Mycobacterium bovis subsp bovis AF2122/97
ggggacgggcggcc

SEQ ID NO: 1083088 - RNA, 15 nt, Mycobacterium bovis subsp bovis AF2122/97
ggggacgggucgccg

SEQ ID NO: 1083089 - RNA, 18 nt, Mycobacterium bovis subsp bovis AF2122/97
ggggagccggugacggug

SEQ ID NO: 1083090 - RNA, 23 nt, Mycobacterium bovis subsp bovis AF2122/97
ggggacucauggccggucugcug

SEQ ID NO: 1083091 - RNA, 20 nt, Mycobacterium bovis subsp bovis AF2122/97
gggcuuggcgacgaugcagg

SEQ ID NO: 1083092 - RNA, 14 nt, Mycobacterium bovis subsp bovis AF2122/97
gggcuuggcugugg

SEQ ID NO: 1083093 - RNA, 19 nt, Mycobacterium bovis subsp bovis AF2122/97
gggcuuggccgcgccgguc

SEQ ID NO: 1083094 - RNA, 22 nt, Mycobacterium bovis subsp bovis AF2122/97
gggcuucugcgucugcucgcgg

SEQ ID NO: 1083095 - RNA, 15 nt, Mycobacterium bovis subsp bovis AF2122/97
gggcuugcaccugca

SEQ ID NO: 1083096 - RNA, 19 nt, Mycobacterium bovis subsp bovis AF2122/97
gggcuucugcgucugcucg

SEQ ID NO: 1083097 - RNA, 19 nt, Mycobacterium bovis subsp bovis AF2122/97
gggcuuaugcgucugcucg

SEQ ID NO: 1083098 - RNA, 21 nt, Mycobacterium bovis subsp bovis AF2122/97
gggcuuacuuaaccaggcgag

SEQ ID NO: 1083099 - RNA, 22 nt, Mycobacterium bovis subsp bovis AF2122/97
gggcuuccgacaugaaccgguc

SEQ ID NO: 1083100 - RNA, 16 nt, Mycobacterium bovis subsp bovis AF2122/97
gggcuguccgaccucg

SEQ ID NO: 1083101 - RNA, 21 nt, Mycobacterium bovis subsp bovis AF2122/97
gggcugguaucgagcaccccg

SEQ ID NO: 1083102 - RNA, 21 nt, Mycobacterium bovis subsp bovis AF2122/97
gggcuguugacgccacgacgc

SEQ ID NO: 1083103 - RNA, 15 nt, Mycobacterium bovis subsp bovis AF2122/97
gggcugggauagcgc

SEQ ID NO: 1083104 - RNA, 17 nt, Mycobacterium bovis subsp bovis AF2122/97
gggcugggauagcgcgg

SEQ ID NO: 1083105 - RNA, 16 nt, Mycobacterium bovis subsp bovis AF2122/97
gggcuggccgacucga

SEQ ID NO: 1083106 - RNA, 15 nt, Mycobacterium bovis subsp bovis AF2122/97
ggggauccagcaggc

SEQ ID NO: 1083107 - RNA, 17 nt, Mycobacterium bovis subsp bovis AF2122/97
ggggauuucgcgucugc

SEQ ID NO: 1083108 - RNA, 19 nt, Mycobacterium bovis subsp bovis AF2122/97
ggggauuucgcgucugcuc

SEQ ID NO: 1083109 - RNA, 21 nt, Mycobacterium bovis subsp bovis AF2122/97
ggggauaccgcugggucgccg

SEQ ID NO: 1083110 - RNA, 19 nt, Mycobacterium bovis subsp bovis AF2122/97
ggggaguucgcgcagcacc

SEQ ID NO: 1083111 - RNA, 20 nt, Mycobacterium bovis subsp bovis AF2122/97
ggggaguucgcgcagcaccg

SEQ ID NO: 1083112 - RNA, 19 nt, Mycobacterium bovis subsp bovis AF2122/97
ggggauuuugcgucugcuc

SEQ ID NO: 1083113 - RNA, 14 nt, Mycobacterium bovis subsp bovis AF2122/97
ggggccgcaaccau

SEQ ID NO: 1083114 - RNA, 20 nt, Mycobacterium bovis subsp bovis AF2122/97
ggggauuucgcgucugcucg

SEQ ID NO: 1083115 - RNA, 17 nt, Mycobacterium bovis subsp bovis AF2122/97
ggggauuuugcgucugc

SEQ ID NO: 1083116 - RNA, 15 nt, Mycobacterium bovis subsp bovis AF2122/97
ggggccgccaccagc

SEQ ID NO: 1083117 - RNA, 11 nt, Mycobacterium bovis subsp bovis AF2122/97
ggggccugcgu

SEQ ID NO: 1083118 - RNA, 14 nt, Mycobacterium bovis subsp bovis AF2122/97
ggggccugcguccg

SEQ ID NO: 1083119 - RNA, 18 nt, Mycobacterium bovis subsp bovis AF2122/97
ggggccuggucccaccgc

SEQ ID NO: 1083120 - RNA, 23 nt, Mycobacterium bovis subsp bovis AF2122/97
ggggccuugggcguacucggcgc

SEQ ID NO: 1083121 - RNA, 21 nt, Mycobacterium bovis subsp bovis AF2122/97
ggggcgaaguggaucuggcgc

SEQ ID NO: 1083122 - RNA, 19 nt, Mycobacterium bovis subsp bovis AF2122/97
gggggauuucgcgucugcu

SEQ ID NO: 1083123 - RNA, 22 nt, Mycobacterium bovis subsp bovis AF2122/97
ggggcuucugcgucugcucgcg

SEQ ID NO: 1083124 - RNA, 21 nt, Mycobacterium bovis subsp bovis AF2122/97
gggggauuucgcgucugcucg

SEQ ID NO: 1083125 - RNA, 13 nt, Mycobacterium bovis subsp bovis AF2122/97
gggggcagcuccg

SEQ ID NO: 1083126 - RNA, 11 nt, Mycobacterium bovis subsp bovis AF2122/97
gggggccggca

SEQ ID NO: 1083127 - RNA, 13 nt, Mycobacterium bovis subsp bovis AF2122/97
gggggcgcaccga

SEQ ID NO: 1083128 - RNA, 12 nt, Mycobacterium bovis subsp bovis AF2122/97
gggggacccgga

SEQ ID NO: 1083129 - RNA, 23 nt, Mycobacterium bovis subsp bovis AF2122/97
gggggauccagcaggccgggaca

SEQ ID NO: 1083130 - RNA, 20 nt, Mycobacterium bovis subsp bovis AF2122/97
ggggcuuuuacgucugcucg

SEQ ID NO: 1083131 - RNA, 20 nt, Mycobacterium bovis subsp bovis AF2122/97
ggggcuucugcgucugcucg

SEQ ID NO: 1083132 - RNA, 23 nt, Mycobacterium bovis subsp bovis AF2122/97
ggggcgaugagccugcaggccgc

SEQ ID NO: 1083133 - RNA, 20 nt, Mycobacterium bovis subsp bovis AF2122/97
ggggcuuuugcgucugcucg

SEQ ID NO: 1083134 - RNA, 19 nt, Mycobacterium bovis subsp bovis AF2122/97
ggggcuuuugcgucugcuc

SEQ ID NO: 1083135 - RNA, 13 nt, Mycobacterium bovis subsp bovis AF2122/97
gggggaucucggu

SEQ ID NO: 1083136 - RNA, 21 nt, Mycobacterium bovis subsp bovis AF2122/97
gggggcuuaugcgucugcucg

SEQ ID NO: 1083137 - RNA, 15 nt, Mycobacterium bovis subsp bovis AF2122/97
gggggcugcugcucg

SEQ ID NO: 1083138 - RNA, 21 nt, Mycobacterium bovis subsp bovis AF2122/97
gggggcuuuuacgucugcucg

SEQ ID NO: 1083139 - RNA, 22 nt, Mycobacterium bovis subsp bovis AF2122/97
gggcgauuuugcgucugcucgc

SEQ ID NO: 1083140 - RNA, 14 nt, Mycobacterium bovis subsp bovis AF2122/97
gggcgcagcgcggc

SEQ ID NO: 1083141 - RNA, 14 nt, Mycobacterium bovis subsp bovis AF2122/97
gggcgccaccaccc

SEQ ID NO: 1083142 - RNA, 18 nt, Mycobacterium bovis subsp bovis AF2122/97
gggcgccacugaccgcga

SEQ ID NO: 1083143 - RNA, 15 nt, Mycobacterium bovis subsp bovis AF2122/97
gggcgcaacgccaua

SEQ ID NO: 1083144 - RNA, 12 nt, Mycobacterium bovis subsp bovis AF2122/97
gggcgcccgccc

SEQ ID NO: 1083145 - RNA, 17 nt, Mycobacterium bovis subsp bovis AF2122/97
gggcgcccgcgugacgc

SEQ ID NO: 1083146 - RNA, 12 nt, Mycobacterium bovis subsp bovis AF2122/97
gggcgccgacga

SEQ ID NO: 1083147 - RNA, 16 nt, Mycobacterium bovis subsp bovis AF2122/97
gggcgcccggccaggu

SEQ ID NO: 1083148 - RNA, 21 nt, Mycobacterium bovis subsp bovis AF2122/97
gggcgccgaauuggcccgggu

SEQ ID NO: 1083149 - RNA, 17 nt, Mycobacterium bovis subsp bovis AF2122/97
gggcgccgcuaggugac

SEQ ID NO: 1083150 - RNA, 19 nt, Mycobacterium bovis subsp bovis AF2122/97
gggcgccuucaccuggugu

SEQ ID NO: 1083151 - RNA, 16 nt, Mycobacterium bovis subsp bovis AF2122/97
gggcgcgcaucugcuc

SEQ ID NO: 1083152 - RNA, 23 nt, Mycobacterium bovis subsp bovis AF2122/97
gggcgcgccggccaugccuucgg

SEQ ID NO: 1083153 - RNA, 22 nt, Mycobacterium bovis subsp bovis AF2122/97
gggcgccugaugcggccggcgc

SEQ ID NO: 1083154 - RNA, 17 nt, Mycobacterium bovis subsp bovis AF2122/97
gggcgcgcucaucgacc

SEQ ID NO: 1083155 - RNA, 16 nt, Mycobacterium bovis subsp bovis AF2122/97
gggcgcgggcgccggg

SEQ ID NO: 1083156 - RNA, 17 nt, Mycobacterium bovis subsp bovis AF2122/97
gggcgcgguaaccacgc

SEQ ID NO: 1083157 - RNA, 18 nt, Mycobacterium bovis subsp bovis AF2122/97
gggcgcgggugcgccggc

SEQ ID NO: 1083158 - RNA, 13 nt, Mycobacterium bovis subsp bovis AF2122/97
gggcgcucggucu

SEQ ID NO: 1083159 - RNA, 13 nt, Mycobacterium bovis subsp bovis AF2122/97
gggcgcucgcauc

SEQ ID NO: 1083160 - RNA, 19 nt, Mycobacterium bovis subsp bovis AF2122/97
gggcgcgugggcgugcagg

SEQ ID NO: 1083161 - RNA, 19 nt, Mycobacterium bovis subsp bovis AF2122/97
gggcgcucgcgcgcugggc

SEQ ID NO: 1083162 - RNA, 15 nt, Mycobacterium bovis subsp bovis AF2122/97
gggcgcuggacggcg

SEQ ID NO: 1083163 - RNA, 18 nt, Mycobacterium bovis subsp bovis AF2122/97
gggcgcuggaggccacca

SEQ ID NO: 1083164 - RNA, 18 nt, Mycobacterium bovis subsp bovis AF2122/97
gggcgcugccaauccgau

SEQ ID NO: 1083165 - RNA, 12 nt, Mycobacterium bovis subsp bovis AF2122/97
gggcggagccga

SEQ ID NO: 1083166 - RNA, 19 nt, Mycobacterium bovis subsp bovis AF2122/97
gggcggauacaugguccgg

SEQ ID NO: 1083167 - RNA, 22 nt, Mycobacterium bovis subsp bovis AF2122/97
gggcggaaaaucggcuggcccg

SEQ ID NO: 1083168 - RNA, 15 nt, Mycobacterium bovis subsp bovis AF2122/97
gggcggaucgccggg

SEQ ID NO: 1083169 - RNA, 22 nt, Mycobacterium bovis subsp bovis AF2122/97
gggcggcaccgcuucaggcgcc

SEQ ID NO: 1083170 - RNA, 19 nt, Mycobacterium bovis subsp bovis AF2122/97
gggcggcagcgagucgacg

SEQ ID NO: 1083171 - RNA, 14 nt, Mycobacterium bovis subsp bovis AF2122/97
gggcggcaucccca

SEQ ID NO: 1083172 - RNA, 21 nt, Mycobacterium bovis subsp bovis AF2122/97
gggcggcaucgccgaggugga

SEQ ID NO: 1083173 - RNA, 22 nt, Mycobacterium bovis subsp bovis AF2122/97
gggcggcgucggugagcgcguc

SEQ ID NO: 1083174 - RNA, 16 nt, Mycobacterium bovis subsp bovis AF2122/97
gggcgggaaccccggc

SEQ ID NO: 1083175 - RNA, 18 nt, Mycobacterium bovis subsp bovis AF2122/97
gggcgggaaccccggcca

SEQ ID NO: 1083176 - RNA, 22 nt, Mycobacterium bovis subsp bovis AF2122/97
gggcggccucccgggccgccgc

SEQ ID NO: 1083177 - RNA, 14 nt, Mycobacterium bovis subsp bovis AF2122/97
gggcggcgaacucu

SEQ ID NO: 1083178 - RNA, 17 nt, Mycobacterium bovis subsp bovis AF2122/97
gggcggcccaccggcca

SEQ ID NO: 1083179 - RNA, 14 nt, Mycobacterium bovis subsp bovis AF2122/97
gggccugcccggcg

SEQ ID NO: 1083180 - RNA, 14 nt, Mycobacterium bovis subsp bovis AF2122/97
gggccugggccgca

SEQ ID NO: 1083181 - RNA, 15 nt, Mycobacterium bovis subsp bovis AF2122/97
gggccugggccgcac

SEQ ID NO: 1083182 - RNA, 15 nt, Mycobacterium bovis subsp bovis AF2122/97
gggccuuggcaggug

SEQ ID NO: 1083183 - RNA, 21 nt, Mycobacterium bovis subsp bovis AF2122/97
gggccuuguugccgcgccacu

SEQ ID NO: 1083184 - RNA, 19 nt, Mycobacterium bovis subsp bovis AF2122/97
gggccuucagcucaccacc

SEQ ID NO: 1083185 - RNA, 17 nt, Mycobacterium bovis subsp bovis AF2122/97
gggccuggucccaccgc

SEQ ID NO: 1083186 - RNA, 17 nt, Mycobacterium bovis subsp bovis AF2122/97
gggcgaacggcaccgcg

SEQ ID NO: 1083187 - RNA, 13 nt, Mycobacterium bovis subsp bovis AF2122/97
gggccgucgggga

SEQ ID NO: 1083188 - RNA, 17 nt, Mycobacterium bovis subsp bovis AF2122/97
gggccucagacaacggg

SEQ ID NO: 1083189 - RNA, 17 nt, Mycobacterium bovis subsp bovis AF2122/97
gggccguguccgccgga

SEQ ID NO: 1083190 - RNA, 15 nt, Mycobacterium bovis subsp bovis AF2122/97
gggccucgaccgcca

SEQ ID NO: 1083191 - RNA, 17 nt, Mycobacterium bovis subsp bovis AF2122/97
gggccucgaccgccagc

SEQ ID NO: 1083192 - RNA, 20 nt, Mycobacterium bovis subsp bovis AF2122/97
gggccucagcuaccccggcg

SEQ ID NO: 1083193 - RNA, 18 nt, Mycobacterium bovis subsp bovis AF2122/97
gggccucaugcuaggcca

SEQ ID NO: 1083194 - RNA, 18 nt, Mycobacterium bovis subsp bovis AF2122/97
gggccucggcgccgucgg

SEQ ID NO: 1083195 - RNA, 16 nt, Mycobacterium bovis subsp bovis AF2122/97
gggccugcguccgacg

SEQ ID NO: 1083196 - RNA, 19 nt, Mycobacterium bovis subsp bovis AF2122/97
gggccucguugaccagaac

SEQ ID NO: 1083197 - RNA, 14 nt, Mycobacterium bovis subsp bovis AF2122/97
gggccguucaaccg

SEQ ID NO: 1083198 - RNA, 16 nt, Mycobacterium bovis subsp bovis AF2122/97
gggccugaguguuguc

SEQ ID NO: 1083199 - RNA, 17 nt, Mycobacterium bovis subsp bovis AF2122/97
gggccugcaccacggcg

SEQ ID NO: 1083200 - RNA, 17 nt, Mycobacterium bovis subsp bovis AF2122/97
gggccugcacgccggcg

SEQ ID NO: 1083201 - RNA, 18 nt, Mycobacterium bovis subsp bovis AF2122/97
gggccugcacgccggcgc

SEQ ID NO: 1083202 - RNA, 19 nt, Mycobacterium bovis subsp bovis AF2122/97
gggcgagguaauccgcggg

SEQ ID NO: 1083203 - RNA, 16 nt, Mycobacterium bovis subsp bovis AF2122/97
gggcgagucgaucucg

SEQ ID NO: 1083204 - RNA, 20 nt, Mycobacterium bovis subsp bovis AF2122/97
gggcgaugcgggccgccagg

SEQ ID NO: 1083205 - RNA, 21 nt, Mycobacterium bovis subsp bovis AF2122/97
gggcgaugcgggccgccaggc

SEQ ID NO: 1083206 - RNA, 19 nt, Mycobacterium bovis subsp bovis AF2122/97
gggcgauaaggaccgcgcc

SEQ ID NO: 1083207 - RNA, 19 nt, Mycobacterium bovis subsp bovis AF2122/97
gggcgauauuggacgcgca

SEQ ID NO: 1083208 - RNA, 15 nt, Mycobacterium bovis subsp bovis AF2122/97
gggcgauuucggcgc

SEQ ID NO: 1083209 - RNA, 19 nt, Mycobacterium bovis subsp bovis AF2122/97
gggcgauuuugcgucugcu

SEQ ID NO: 1083210 - RNA, 21 nt, Mycobacterium bovis subsp bovis AF2122/97
gggcgauuuugcgucugcucg

SEQ ID NO: 1083211 - RNA, 21 nt, Mycobacterium bovis subsp bovis AF2122/97
gggcgauucugcgucugcucg

SEQ ID NO: 1083212 - RNA, 12 nt, Mycobacterium bovis subsp bovis AF2122/97
gggcgacgacgu

SEQ ID NO: 1083213 - RNA, 20 nt, Mycobacterium bovis subsp bovis AF2122/97
gggcgacgucaucgccgacc

SEQ ID NO: 1083214 - RNA, 13 nt, Mycobacterium bovis subsp bovis AF2122/97
gggcgacguccgc

SEQ ID NO: 1083215 - RNA, 16 nt, Mycobacterium bovis subsp bovis AF2122/97
gggcgagaacccacgc

SEQ ID NO: 1083216 - RNA, 18 nt, Mycobacterium bovis subsp bovis AF2122/97
gggcgagccgugccagca

SEQ ID NO: 1083217 - RNA, 15 nt, Mycobacterium bovis subsp bovis AF2122/97
gggcgagaccgcgag

SEQ ID NO: 1083218 - RNA, 17 nt, Mycobacterium bovis subsp bovis AF2122/97
gggcgagaccgcgagca

SEQ ID NO: 1083219 - RNA, 18 nt, Mycobacterium bovis subsp bovis AF2122/97
gggcgacaucgagaucgc

SEQ ID NO: 1083220 - RNA, 13 nt, Mycobacterium bovis subsp bovis AF2122/97
gggcgaccaccac

SEQ ID NO: 1083221 - RNA, 19 nt, Mycobacterium bovis subsp bovis AF2122/97
gggcgaccaccaccgccgc

SEQ ID NO: 1083222 - RNA, 22 nt, Mycobacterium bovis subsp bovis AF2122/97
gggcgaccaccaccgccgccga

SEQ ID NO: 1083223 - RNA, 13 nt, Mycobacterium bovis subsp bovis AF2122/97
gggcgaccaccgc

SEQ ID NO: 1083224 - RNA, 16 nt, Mycobacterium bovis subsp bovis AF2122/97
gggcgaccaccgcggc

SEQ ID NO: 1083225 - RNA, 14 nt, Mycobacterium bovis subsp bovis AF2122/97
gggcgaagcccaga

SEQ ID NO: 1083226 - RNA, 16 nt, Mycobacterium bovis subsp bovis AF2122/97
gggcgaauccggcggg

SEQ ID NO: 1083227 - RNA, 15 nt, Mycobacterium bovis subsp bovis AF2122/97
ggucacccaucaacg

SEQ ID NO: 1083228 - RNA, 21 nt, Mycobacterium bovis subsp bovis AF2122/97
ggucacccaucaacgccggcg

SEQ ID NO: 1083229 - RNA, 21 nt, Mycobacterium bovis subsp bovis AF2122/97
ggucaccauggcgccgcgccg

SEQ ID NO: 1083230 - RNA, 22 nt, Mycobacterium bovis subsp bovis AF2122/97
ggucaccagcgcaucggccagc

SEQ ID NO: 1083231 - RNA, 18 nt, Mycobacterium bovis subsp bovis AF2122/97
ggucaccgaacgacccug

SEQ ID NO: 1083232 - RNA, 17 nt, Mycobacterium bovis subsp bovis AF2122/97
ggucaccaucaccggug

SEQ ID NO: 1083233 - RNA, 14 nt, Mycobacterium bovis subsp bovis AF2122/97
ggucaccgacacgg

SEQ ID NO: 1083234 - RNA, 17 nt, Mycobacterium bovis subsp bovis AF2122/97
ggucacccgcaggucga

SEQ ID NO: 1083235 - RNA, 17 nt, Mycobacterium bovis subsp bovis AF2122/97
ggucacccgguagacgu

SEQ ID NO: 1083236 - RNA, 12 nt, Mycobacterium bovis subsp bovis AF2122/97
ggucaccugcgg

SEQ ID NO: 1083237 - RNA, 16 nt, Mycobacterium bovis subsp bovis AF2122/97
ggucaccucgccggcg

SEQ ID NO: 1083238 - RNA, 20 nt, Mycobacterium bovis subsp bovis AF2122/97
ggucaccgucugcaccggca

SEQ ID NO: 1083239 - RNA, 21 nt, Mycobacterium bovis subsp bovis AF2122/97
ggucaccggcacgucgccccc

SEQ ID NO: 1083240 - RNA, 11 nt, Mycobacterium bovis subsp bovis AF2122/97
ggucaccggcg

SEQ ID NO: 1083241 - RNA, 15 nt, Mycobacterium bovis subsp bovis AF2122/97
ggucaccggcgaccg

SEQ ID NO: 1083242 - RNA, 16 nt, Mycobacterium bovis subsp bovis AF2122/97
ggucaccggccgccga

SEQ ID NO: 1083243 - RNA, 19 nt, Mycobacterium bovis subsp bovis AF2122/97
ggucaccggacugcgccgg

SEQ ID NO: 1083244 - RNA, 17 nt, Mycobacterium bovis subsp bovis AF2122/97
ggucaccggagagccgg

SEQ ID NO: 1083245 - RNA, 12 nt, Mycobacterium bovis subsp bovis AF2122/97
ggucaccgcgca

SEQ ID NO: 1083246 - RNA, 15 nt, Mycobacterium bovis subsp bovis AF2122/97
ggucacgcgaggcga

SEQ ID NO: 1083247 - RNA, 20 nt, Mycobacterium bovis subsp bovis AF2122/97
ggucacgcguuccauggccc

SEQ ID NO: 1083248 - RNA, 19 nt, Mycobacterium bovis subsp bovis AF2122/97
ggucacugguccaacgauc

SEQ ID NO: 1083249 - RNA, 15 nt, Mycobacterium bovis subsp bovis AF2122/97
ggucacgucgaugag

SEQ ID NO: 1083250 - RNA, 15 nt, Mycobacterium bovis subsp bovis AF2122/97
ggucacuccggcggc

SEQ ID NO: 1083251 - RNA, 16 nt, Mycobacterium bovis subsp bovis AF2122/97
ggucacuccggcggcu

SEQ ID NO: 1083252 - RNA, 21 nt, Mycobacterium bovis subsp bovis AF2122/97
ggucacgguucgcccgucgcc

SEQ ID NO: 1083253 - RNA, 17 nt, Mycobacterium bovis subsp bovis AF2122/97
ggucacugugacgccgg

SEQ ID NO: 1083254 - RNA, 17 nt, Mycobacterium bovis subsp bovis AF2122/97
ggucagcaccaccagca

SEQ ID NO: 1083255 - RNA, 18 nt, Mycobacterium bovis subsp bovis AF2122/97
ggucagcacccaacccgg

SEQ ID NO: 1083256 - RNA, 22 nt, Mycobacterium bovis subsp bovis AF2122/97
ggucagcacccaacccggcggc

SEQ ID NO: 1083257 - RNA, 18 nt, Mycobacterium bovis subsp bovis AF2122/97
ggucagcagauccgcgau

SEQ ID NO: 1083258 - RNA, 14 nt, Mycobacterium bovis subsp bovis AF2122/97
ggucagcagcgccg

SEQ ID NO: 1083259 - RNA, 12 nt, Mycobacterium bovis subsp bovis AF2122/97
ggucagcagcuc

SEQ ID NO: 1083260 - RNA, 20 nt, Mycobacterium bovis subsp bovis AF2122/97
ggucagcagcuccacuggcg

SEQ ID NO: 1083261 - RNA, 15 nt, Mycobacterium bovis subsp bovis AF2122/97
ggucauauugcggug

SEQ ID NO: 1083262 - RNA, 16 nt, Mycobacterium bovis subsp bovis AF2122/97
ggucauauugcggugc

SEQ ID NO: 1083263 - RNA, 22 nt, Mycobacterium bovis subsp bovis AF2122/97
ggucauaagggcaugcgcucag

SEQ ID NO: 1083264 - RNA, 17 nt, Mycobacterium bovis subsp bovis AF2122/97
ggucauaccaagcgcgg

SEQ ID NO: 1083265 - RNA, 14 nt, Mycobacterium bovis subsp bovis AF2122/97
ggucaguccgucgg

SEQ ID NO: 1083266 - RNA, 13 nt, Mycobacterium bovis subsp bovis AF2122/97
ggucagugcgaug

SEQ ID NO: 1083267 - RNA, 15 nt, Mycobacterium bovis subsp bovis AF2122/97
ggucagugcgaugcg

SEQ ID NO: 1083268 - RNA, 18 nt, Mycobacterium bovis subsp bovis AF2122/97
ggucagugggacgggcgc

SEQ ID NO: 1083269 - RNA, 14 nt, Mycobacterium bovis subsp bovis AF2122/97
ggucagugggcggu

SEQ ID NO: 1083270 - RNA, 15 nt, Mycobacterium bovis subsp bovis AF2122/97
gguccaaccgggccg

SEQ ID NO: 1083271 - RNA, 19 nt, Mycobacterium bovis subsp bovis AF2122/97
gguccaaccgggccggcua

SEQ ID NO: 1083272 - RNA, 20 nt, Mycobacterium bovis subsp bovis AF2122/97
ggucaucccuuucgcgccgc

SEQ ID NO: 1083273 - RNA, 23 nt, Mycobacterium bovis subsp bovis AF2122/97
ggucaucaacgccacgaugaccg

SEQ ID NO: 1083274 - RNA, 21 nt, Mycobacterium bovis subsp bovis AF2122/97
gguccaccgaccuaccgucga

SEQ ID NO: 1083275 - RNA, 23 nt, Mycobacterium bovis subsp bovis AF2122/97
gguccagacaucagugcgccggc

SEQ ID NO: 1083276 - RNA, 16 nt, Mycobacterium bovis subsp bovis AF2122/97
gguccagacccagcuc

SEQ ID NO: 1083277 - RNA, 20 nt, Mycobacterium bovis subsp bovis AF2122/97
gguccaagugggccggcggu

SEQ ID NO: 1083278 - RNA, 13 nt, Mycobacterium bovis subsp bovis AF2122/97
gguccacagccgg

SEQ ID NO: 1083279 - RNA, 15 nt, Mycobacterium bovis subsp bovis AF2122/97
gguccaccccgccga

SEQ ID NO: 1083280 - RNA, 15 nt, Mycobacterium bovis subsp bovis AF2122/97
gguccaccgcugccg

SEQ ID NO: 1083281 - RNA, 11 nt, Mycobacterium bovis subsp bovis AF2122/97
ggucagcgccu

SEQ ID NO: 1083282 - RNA, 23 nt, Mycobacterium bovis subsp bovis AF2122/97
ggucagcgccgacuccaguucgg

SEQ ID NO: 1083283 - RNA, 19 nt, Mycobacterium bovis subsp bovis AF2122/97
ggucagcgccgcgccccag

SEQ ID NO: 1083284 - RNA, 13 nt, Mycobacterium bovis subsp bovis AF2122/97
ggucagucccgug

SEQ ID NO: 1083285 - RNA, 17 nt, Mycobacterium bovis subsp bovis AF2122/97
ggucaguccgacaccgg

SEQ ID NO: 1083286 - RNA, 23 nt, Mycobacterium bovis subsp bovis AF2122/97
ggucaguccgacaccggcggcau

SEQ ID NO: 1083287 - RNA, 15 nt, Mycobacterium bovis subsp bovis AF2122/97
ggucaguaggcggau

SEQ ID NO: 1083288 - RNA, 14 nt, Mycobacterium bovis subsp bovis AF2122/97
ggucagguugucgg

SEQ ID NO: 1083289 - RNA, 17 nt, Mycobacterium bovis subsp bovis AF2122/97
ggucagguugucggcga

SEQ ID NO: 1083290 - RNA, 18 nt, Mycobacterium bovis subsp bovis AF2122/97
ggucagguugucggcgau

SEQ ID NO: 1083291 - RNA, 21 nt, Mycobacterium bovis subsp bovis AF2122/97
ggucagccgcgcgggucacga

SEQ ID NO: 1083292 - RNA, 14 nt, Mycobacterium bovis subsp bovis AF2122/97
ggucagccgauggg

SEQ ID NO: 1083293 - RNA, 21 nt, Mycobacterium bovis subsp bovis AF2122/97
ggucagcgaguuucugcucga

SEQ ID NO: 1083294 - RNA, 16 nt, Mycobacterium bovis subsp bovis AF2122/97
gguccggcguacgccg

SEQ ID NO: 1083295 - RNA, 14 nt, Mycobacterium bovis subsp bovis AF2122/97
gguccggcggccgg

SEQ ID NO: 1083296 - RNA, 18 nt, Mycobacterium bovis subsp bovis AF2122/97
gguccggcggccgguaga

SEQ ID NO: 1083297 - RNA, 18 nt, Mycobacterium bovis subsp bovis AF2122/97
gguccggcgaacugcgau

SEQ ID NO: 1083298 - RNA, 18 nt, Mycobacterium bovis subsp bovis AF2122/97
gguccggcccaccagcgc

SEQ ID NO: 1083299 - RNA, 18 nt, Mycobacterium bovis subsp bovis AF2122/97
gguccgacgguguagccg

SEQ ID NO: 1083300 - RNA, 17 nt, Mycobacterium bovis subsp bovis AF2122/97
gguccgaccagcggccg

SEQ ID NO: 1083301 - RNA, 21 nt, Mycobacterium bovis subsp bovis AF2122/97
gguccgaccagcggccgaccg

SEQ ID NO: 1083302 - RNA, 16 nt, Mycobacterium bovis subsp bovis AF2122/97
gguccgaccagcggcc

SEQ ID NO: 1083303 - RNA, 18 nt, Mycobacterium bovis subsp bovis AF2122/97
ggucccggugaugaccgg

SEQ ID NO: 1083304 - RNA, 12 nt, Mycobacterium bovis subsp bovis AF2122/97
ggucccgugcgc

SEQ ID NO: 1083305 - RNA, 14 nt, Mycobacterium bovis subsp bovis AF2122/97
ggucccgugcgcgc

SEQ ID NO: 1083306 - RNA, 13 nt, Mycobacterium bovis subsp bovis AF2122/97
ggucccguugccg

SEQ ID NO: 1083307 - RNA, 17 nt, Mycobacterium bovis subsp bovis AF2122/97
ggucccuccgacuaacg

SEQ ID NO: 1083308 - RNA, 15 nt, Mycobacterium bovis subsp bovis AF2122/97
ggucccccgcccaca

SEQ ID NO: 1083309 - RNA, 15 nt, Mycobacterium bovis subsp bovis AF2122/97
ggucccgcucugguc

SEQ ID NO: 1083310 - RNA, 15 nt, Mycobacterium bovis subsp bovis AF2122/97
ggucccgccgccugg

SEQ ID NO: 1083311 - RNA, 21 nt, Mycobacterium bovis subsp bovis AF2122/97
ggucccgccgggugucggugg

SEQ ID NO: 1083312 - RNA, 19 nt, Mycobacterium bovis subsp bovis AF2122/97
ggucccgccgugccgcggc

SEQ ID NO: 1083313 - RNA, 20 nt, Mycobacterium bovis subsp bovis AF2122/97
ggucccgccgugccgcggcg

SEQ ID NO: 1083314 - RNA, 17 nt, Mycobacterium bovis subsp bovis AF2122/97
gguccccgacaacggcg

SEQ ID NO: 1083315 - RNA, 22 nt, Mycobacterium bovis subsp bovis AF2122/97
gguccccgcagcucgaccagga

SEQ ID NO: 1083316 - RNA, 15 nt, Mycobacterium bovis subsp bovis AF2122/97
gguccccgccggcgg

SEQ ID NO: 1083317 - RNA, 14 nt, Mycobacterium bovis subsp bovis AF2122/97
gguccagcacaucg

SEQ ID NO: 1083318 - RNA, 17 nt, Mycobacterium bovis subsp bovis AF2122/97
gguccagcacaucggcg

SEQ ID NO: 1083319 - RNA, 13 nt, Mycobacterium bovis subsp bovis AF2122/97
gguccagcagcuc

SEQ ID NO: 1083320 - RNA, 22 nt, Mycobacterium bovis subsp bovis AF2122/97
ggucccagguuggagcccgagc

SEQ ID NO: 1083321 - RNA, 16 nt, Mycobacterium bovis subsp bovis AF2122/97
ggucgaaucgcugccg

SEQ ID NO: 1083322 - RNA, 20 nt, Mycobacterium bovis subsp bovis AF2122/97
ggucgaaucgcugccgccga

SEQ ID NO: 1083323 - RNA, 22 nt, Mycobacterium bovis subsp bovis AF2122/97
ggucgaaucgcugccgccgauc

SEQ ID NO: 1083324 - RNA, 14 nt, Mycobacterium bovis subsp bovis AF2122/97
ggucgacaccgcgg

SEQ ID NO: 1083325 - RNA, 19 nt, Mycobacterium bovis subsp bovis AF2122/97
ggucgacagcgaaggcgcc

SEQ ID NO: 1083326 - RNA, 21 nt, Mycobacterium bovis subsp bovis AF2122/97
ggucgacagcgaaggcgccga

SEQ ID NO: 1083327 - RNA, 12 nt, Mycobacterium bovis subsp bovis AF2122/97
gguccugcgguc

SEQ ID NO: 1083328 - RNA, 12 nt, Mycobacterium bovis subsp bovis AF2122/97
gguccugcucgc

SEQ ID NO: 1083329 - RNA, 23 nt, Mycobacterium bovis subsp bovis AF2122/97
ggucgaagagguggggcaggauc

SEQ ID NO: 1083330 - RNA, 20 nt, Mycobacterium bovis subsp bovis AF2122/97
ggucgacaugggucggcugu

SEQ ID NO: 1083331 - RNA, 16 nt, Mycobacterium bovis subsp bovis AF2122/97
ggucgaccggcguugc

SEQ ID NO: 1083332 - RNA, 22 nt, Mycobacterium bovis subsp bovis AF2122/97
ggucgaccgugcgucgauggcg

SEQ ID NO: 1083333 - RNA, 22 nt, Mycobacterium bovis subsp bovis AF2122/97
gguccucgaucagacgcucgac

SEQ ID NO: 1083334 - RNA, 22 nt, Mycobacterium bovis subsp bovis AF2122/97
gguccuccagcgcacuacucga

SEQ ID NO: 1083335 - RNA, 19 nt, Mycobacterium bovis subsp bovis AF2122/97
gguccuccuucgguggugg

SEQ ID NO: 1083336 - RNA, 23 nt, Mycobacterium bovis subsp bovis AF2122/97
gguccguuuuaccucggccgcca

SEQ ID NO: 1083337 - RNA, 15 nt, Mycobacterium bovis subsp bovis AF2122/97
gguccguucgcgccg

SEQ ID NO: 1083338 - RNA, 13 nt, Mycobacterium bovis subsp bovis AF2122/97
gguccgugccgau

SEQ ID NO: 1083339 - RNA, 17 nt, Mycobacterium bovis subsp bovis AF2122/97
gguccgggugccggugc

SEQ ID NO: 1083340 - RNA, 22 nt, Mycobacterium bovis subsp bovis AF2122/97
gguccggucuuuguccgucgcg

SEQ ID NO: 1083341 - RNA, 21 nt, Mycobacterium bovis subsp bovis AF2122/97
gguccgugccgaugccggcga

SEQ ID NO: 1083342 - RNA, 18 nt, Mycobacterium bovis subsp bovis AF2122/97
gguccgucaccaccgccg

SEQ ID NO: 1083343 - RNA, 19 nt, Mycobacterium bovis subsp bovis AF2122/97
gguccgucaccaccgccgc

SEQ ID NO: 1083344 - RNA, 14 nt, Mycobacterium bovis subsp bovis AF2122/97
gguccgggcggccg

SEQ ID NO: 1083345 - RNA, 17 nt, Mycobacterium bovis subsp bovis AF2122/97
gguccggggaaagccgc

SEQ ID NO: 1083346 - RNA, 23 nt, Mycobacterium bovis subsp bovis AF2122/97
ggucgagcgaacccuucgcggug

SEQ ID NO: 1083347 - RNA, 11 nt, Mycobacterium bovis subsp bovis AF2122/97
ggucgacgacg

SEQ ID NO: 1083348 - RNA, 12 nt, Mycobacterium bovis subsp bovis AF2122/97
ggucgacgagau

SEQ ID NO: 1083349 - RNA, 20 nt, Mycobacterium bovis subsp bovis AF2122/97
ggucgacgagauccagcgcc

SEQ ID NO: 1083350 - RNA, 16 nt, Mycobacterium bovis subsp bovis AF2122/97
ggucgagcggucgcgg

SEQ ID NO: 1083351 - RNA, 18 nt, Mycobacterium bovis subsp bovis AF2122/97
ggucgagcggucgcggua

SEQ ID NO: 1083352 - RNA, 22 nt, Mycobacterium bovis subsp bovis AF2122/97
ggucgagcgcuucgucgccgaa

SEQ ID NO: 1083353 - RNA, 20 nt, Mycobacterium bovis subsp bovis AF2122/97
ggucgagcgcuucgucgccg

SEQ ID NO: 1083354 - RNA, 18 nt, Mycobacterium bovis subsp bovis AF2122/97
ggucgagguggcgggcga

SEQ ID NO: 1083355 - RNA, 19 nt, Mycobacterium bovis subsp bovis AF2122/97
ggucgagguggcgggcgau

SEQ ID NO: 1083356 - RNA, 21 nt, Mycobacterium bovis subsp bovis AF2122/97
ggucgaggcaggccucggcgc

SEQ ID NO: 1083357 - RNA, 12 nt, Mycobacterium bovis subsp bovis AF2122/97
ggucgagggcgg

SEQ ID NO: 1083358 - RNA, 12 nt, Mycobacterium bovis subsp bovis AF2122/97
ggucgaguugaa

SEQ ID NO: 1083359 - RNA, 15 nt, Mycobacterium bovis subsp bovis AF2122/97
ggucgcagugcaccc

SEQ ID NO: 1083360 - RNA, 21 nt, Mycobacterium bovis subsp bovis AF2122/97
ggucgcagugcacccgggccg

SEQ ID NO: 1083361 - RNA, 14 nt, Mycobacterium bovis subsp bovis AF2122/97
ggucgcauggucga

SEQ ID NO: 1083362 - RNA, 16 nt, Mycobacterium bovis subsp bovis AF2122/97
ggucgccgcaucggcg

SEQ ID NO: 1083363 - RNA, 15 nt, Mycobacterium bovis subsp bovis AF2122/97
ggucgccgccgccac

SEQ ID NO: 1083364 - RNA, 17 nt, Mycobacterium bovis subsp bovis AF2122/97
ggucgccgccgccacgg

SEQ ID NO: 1083365 - RNA, 22 nt, Mycobacterium bovis subsp bovis AF2122/97
ggucgccgcuuucuuggcgggc

SEQ ID NO: 1083366 - RNA, 16 nt, Mycobacterium bovis subsp bovis AF2122/97
ggucgccggacugcgg

SEQ ID NO: 1083367 - RNA, 12 nt, Mycobacterium bovis subsp bovis AF2122/97
ggucgccggcgu

SEQ ID NO: 1083368 - RNA, 19 nt, Mycobacterium bovis subsp bovis AF2122/97
ggucgccggcgucgagccg

SEQ ID NO: 1083369 - RNA, 19 nt, Mycobacterium bovis subsp bovis AF2122/97
ggucgccgggacgauaccg

SEQ ID NO: 1083370 - RNA, 19 nt, Mycobacterium bovis subsp bovis AF2122/97
ggucgaugucagccaccau

SEQ ID NO: 1083371 - RNA, 23 nt, Mycobacterium bovis subsp bovis AF2122/97
ggucgaugucggcgaaccacggc

SEQ ID NO: 1083372 - RNA, 23 nt, Mycobacterium bovis subsp bovis AF2122/97
ggucgaugccuucguagcggccg

SEQ ID NO: 1083373 - RNA, 14 nt, Mycobacterium bovis subsp bovis AF2122/97
ggucgaugcgcaac

SEQ ID NO: 1083374 - RNA, 16 nt, Mycobacterium bovis subsp bovis AF2122/97
ggucgaugcugccagc

SEQ ID NO: 1083375 - RNA, 15 nt, Mycobacterium bovis subsp bovis AF2122/97
ggucgcagaccagac

SEQ ID NO: 1083376 - RNA, 21 nt, Mycobacterium bovis subsp bovis AF2122/97
ggucgcaauauccggccgagc

SEQ ID NO: 1083377 - RNA, 20 nt, Mycobacterium bovis subsp bovis AF2122/97
ggucgcaccacagugccaau

SEQ ID NO: 1083378 - RNA, 22 nt, Mycobacterium bovis subsp bovis AF2122/97
ggucgcagcagaccacaacgcc

SEQ ID NO: 1083379 - RNA, 13 nt, Mycobacterium bovis subsp bovis AF2122/97
gguagcguucggc

SEQ ID NO: 1083380 - RNA, 16 nt, Mycobacterium bovis subsp bovis AF2122/97
gguagccauucggugu

SEQ ID NO: 1083381 - RNA, 15 nt, Mycobacterium bovis subsp bovis AF2122/97
gguagccaucggcua

SEQ ID NO: 1083382 - RNA, 19 nt, Mycobacterium bovis subsp bovis AF2122/97
gguagcacagcagcaacgc

SEQ ID NO: 1083383 - RNA, 15 nt, Mycobacterium bovis subsp bovis AF2122/97
gguagcacccacggc

SEQ ID NO: 1083384 - RNA, 18 nt, Mycobacterium bovis subsp bovis AF2122/97
gguagcacccacggcgag

SEQ ID NO: 1083385 - RNA, 17 nt, Mycobacterium bovis subsp bovis AF2122/97
gguagcacugucgaggu

SEQ ID NO: 1083386 - RNA, 22 nt, Mycobacterium bovis subsp bovis AF2122/97
gguaccgccgcugccgguggcg

SEQ ID NO: 1083387 - RNA, 12 nt, Mycobacterium bovis subsp bovis AF2122/97
gguaccgccggc

SEQ ID NO: 1083388 - RNA, 11 nt, Mycobacterium bovis subsp bovis AF2122/97
gguaccggcgg

SEQ ID NO: 1083389 - RNA, 12 nt, Mycobacterium bovis subsp bovis AF2122/97
gguaccggcggc

SEQ ID NO: 1083390 - RNA, 14 nt, Mycobacterium bovis subsp bovis AF2122/97
gguaccggcggcgc

SEQ ID NO: 1083391 - RNA, 19 nt, Mycobacterium bovis subsp bovis AF2122/97
gguaccggcggcgccgggg

SEQ ID NO: 1083392 - RNA, 13 nt, Mycobacterium bovis subsp bovis AF2122/97
gguaccgggacga

SEQ ID NO: 1083393 - RNA, 17 nt, Mycobacterium bovis subsp bovis AF2122/97
gguaccgccggcuccgc

SEQ ID NO: 1083394 - RNA, 16 nt, Mycobacterium bovis subsp bovis AF2122/97
gguaccgcuuguccac

SEQ ID NO: 1083395 - RNA, 17 nt, Mycobacterium bovis subsp bovis AF2122/97
gguaccggaaucggcgg

SEQ ID NO: 1083396 - RNA, 20 nt, Mycobacterium bovis subsp bovis AF2122/97
gguagauguucacgccgccg

SEQ ID NO: 1083397 - RNA, 12 nt, Mycobacterium bovis subsp bovis AF2122/97
gguagauggcga

SEQ ID NO: 1083398 - RNA, 18 nt, Mycobacterium bovis subsp bovis AF2122/97
gguacccccagcacccgg

SEQ ID NO: 1083399 - RNA, 21 nt, Mycobacterium bovis subsp bovis AF2122/97
gguagaucagcaugccuucgg

SEQ ID NO: 1083400 - RNA, 13 nt, Mycobacterium bovis subsp bovis AF2122/97
gguaggccgccgg

SEQ ID NO: 1083401 - RNA, 21 nt, Mycobacterium bovis subsp bovis AF2122/97
gguaggcaggccggcucgccg

SEQ ID NO: 1083402 - RNA, 12 nt, Mycobacterium bovis subsp bovis AF2122/97
gguaggccggga

SEQ ID NO: 1083403 - RNA, 13 nt, Mycobacterium bovis subsp bovis AF2122/97
gguaggccggcaa

SEQ ID NO: 1083404 - RNA, 17 nt, Mycobacterium bovis subsp bovis AF2122/97
gguagcugacgugucgg

SEQ ID NO: 1083405 - RNA, 20 nt, Mycobacterium bovis subsp bovis AF2122/97
gguagcucccugggcgucga

SEQ ID NO: 1083406 - RNA, 21 nt, Mycobacterium bovis subsp bovis AF2122/97
gguagcuuccgcgacgcucgc

SEQ ID NO: 1083407 - RNA, 23 nt, Mycobacterium bovis subsp bovis AF2122/97
gguagcuuccgcgacgcucgcug

SEQ ID NO: 1083408 - RNA, 14 nt, Mycobacterium bovis subsp bovis AF2122/97
gguagcugccgcgg

SEQ ID NO: 1083409 - RNA, 19 nt, Mycobacterium bovis subsp bovis AF2122/97
gguagcugccgcggccggc

SEQ ID NO: 1083410 - RNA, 21 nt, Mycobacterium bovis subsp bovis AF2122/97
gguagcugccgcggccggcgu

SEQ ID NO: 1083411 - RNA, 18 nt, Mycobacterium bovis subsp bovis AF2122/97
gguaguugucccgccgcg

SEQ ID NO: 1083412 - RNA, 14 nt, Mycobacterium bovis subsp bovis AF2122/97
gguauagccggcgc

SEQ ID NO: 1083413 - RNA, 15 nt, Mycobacterium bovis subsp bovis AF2122/97
gguauccaccgcgag

SEQ ID NO: 1083414 - RNA, 20 nt, Mycobacterium bovis subsp bovis AF2122/97
gguauccaccgcgagaccuu

SEQ ID NO: 1083415 - RNA, 17 nt, Mycobacterium bovis subsp bovis AF2122/97
gguaugccgaacggugu

SEQ ID NO: 1083416 - RNA, 13 nt, Mycobacterium bovis subsp bovis AF2122/97
gguaugcucgcug

SEQ ID NO: 1083417 - RNA, 15 nt, Mycobacterium bovis subsp bovis AF2122/97
gguauguccgccauu

SEQ ID NO: 1083418 - RNA, 14 nt, Mycobacterium bovis subsp bovis AF2122/97
gguaucggcgugcu

SEQ ID NO: 1083419 - RNA, 20 nt, Mycobacterium bovis subsp bovis AF2122/97
gguaucgucccggcgaccgg

SEQ ID NO: 1083420 - RNA, 15 nt, Mycobacterium bovis subsp bovis AF2122/97
gguaucgucccggcg

SEQ ID NO: 1083421 - RNA, 16 nt, Mycobacterium bovis subsp bovis AF2122/97
gguaucgucccggcga

SEQ ID NO: 1083422 - RNA, 17 nt, Mycobacterium bovis subsp bovis AF2122/97
gguaucgucccggcgac

SEQ ID NO: 1083423 - RNA, 22 nt, Mycobacterium bovis subsp bovis AF2122/97
gguauccguguguuaggcccgc

SEQ ID NO: 1083424 - RNA, 19 nt, Mycobacterium bovis subsp bovis AF2122/97
gguaucgagaugccaucgg

SEQ ID NO: 1083425 - RNA, 17 nt, Mycobacterium bovis subsp bovis AF2122/97
gguaucgccaguggugc

SEQ ID NO: 1083426 - RNA, 21 nt, Mycobacterium bovis subsp bovis AF2122/97
gguaucgccaguggugcaccg

SEQ ID NO: 1083427 - RNA, 17 nt, Mycobacterium bovis subsp bovis AF2122/97
gguaucggcagaugguc

SEQ ID NO: 1083428 - RNA, 17 nt, Mycobacterium bovis subsp bovis AF2122/97
ggucacacccagcgcgc

SEQ ID NO: 1083429 - RNA, 23 nt, Mycobacterium bovis subsp bovis AF2122/97
ggucaaugcgcuggcgccgccgg

SEQ ID NO: 1083430 - RNA, 16 nt, Mycobacterium bovis subsp bovis AF2122/97
ggucaccaagacaccg

SEQ ID NO: 1083431 - RNA, 14 nt, Mycobacterium bovis subsp bovis AF2122/97
ggucacagcugcgc

SEQ ID NO: 1083432 - RNA, 14 nt, Mycobacterium bovis subsp bovis AF2122/97
ggucaagccggcgc

SEQ ID NO: 1083433 - RNA, 19 nt, Mycobacterium bovis subsp bovis AF2122/97
ggucaaucccacgcccggc

SEQ ID NO: 1083434 - RNA, 14 nt, Mycobacterium bovis subsp bovis AF2122/97
ggucaaugcuggca

SEQ ID NO: 1083435 - RNA, 20 nt, Mycobacterium bovis subsp bovis AF2122/97
ggucaaugcuggcagcggcc

SEQ ID NO: 1083436 - RNA, 20 nt, Mycobacterium bovis subsp bovis AF2122/97
ggucaacgggaugccggcga

SEQ ID NO: 1083437 - RNA, 21 nt, Mycobacterium bovis subsp bovis AF2122/97
ggucaacgggaugccggcgaa

SEQ ID NO: 1083438 - RNA, 16 nt, Mycobacterium bovis subsp bovis AF2122/97
ggucaacccucgccac

SEQ ID NO: 1083439 - RNA, 20 nt, Mycobacterium bovis subsp bovis AF2122/97
ggucaaccgcgucgaagccg

SEQ ID NO: 1083440 - RNA, 13 nt, Mycobacterium bovis subsp bovis AF2122/97
ggucaaccggugu

SEQ ID NO: 1083441 - RNA, 15 nt, Mycobacterium bovis subsp bovis AF2122/97
ggucaacgccaucac

SEQ ID NO: 1083442 - RNA, 17 nt, Mycobacterium bovis subsp bovis AF2122/97
ggucaacgccaucaccc

SEQ ID NO: 1083443 - RNA, 20 nt, Mycobacterium bovis subsp bovis AF2122/97
ggucaacgugaugcguucgg

SEQ ID NO: 1083444 - RNA, 21 nt, Mycobacterium bovis subsp bovis AF2122/97
ggucaacgugaugcguucggc

SEQ ID NO: 1083445 - RNA, 12 nt, Mycobacterium bovis subsp bovis AF2122/97
ggucaacgacau

SEQ ID NO: 1083446 - RNA, 13 nt, Mycobacterium bovis subsp bovis AF2122/97
ggucaacgacauu

SEQ ID NO: 1083447 - RNA, 19 nt, Mycobacterium bovis subsp bovis AF2122/97
ggucaacgaguugcggaua

SEQ ID NO: 1083448 - RNA, 14 nt, Mycobacterium bovis subsp bovis AF2122/97
ggucaaacgcgcgc

SEQ ID NO: 1083449 - RNA, 19 nt, Mycobacterium bovis subsp bovis AF2122/97
ggucaaaugaauggugacc

SEQ ID NO: 1083450 - RNA, 14 nt, Mycobacterium bovis subsp bovis AF2122/97
ggucaacaagacga

SEQ ID NO: 1083451 - RNA, 14 nt, Mycobacterium bovis subsp bovis AF2122/97
gguaccaucaccgc

SEQ ID NO: 1083452 - RNA, 17 nt, Mycobacterium bovis subsp bovis AF2122/97
gguacccaccucccgca

SEQ ID NO: 1083453 - RNA, 19 nt, Mycobacterium bovis subsp bovis AF2122/97
gguacccaucgucgagccg

SEQ ID NO: 1083454 - RNA, 21 nt, Mycobacterium bovis subsp bovis AF2122/97
gguacccgcacccguugcgac

SEQ ID NO: 1083455 - RNA, 16 nt, Mycobacterium bovis subsp bovis AF2122/97
gguaccaccggcacgg

SEQ ID NO: 1083456 - RNA, 17 nt, Mycobacterium bovis subsp bovis AF2122/97
gguacccguagcaccac

SEQ ID NO: 1083457 - RNA, 12 nt, Mycobacterium bovis subsp bovis AF2122/97
gguaccgacggg

SEQ ID NO: 1083458 - RNA, 23 nt, Mycobacterium bovis subsp bovis AF2122/97
gguaccgacggggauggagccgg

SEQ ID NO: 1083459 - RNA, 13 nt, Mycobacterium bovis subsp bovis AF2122/97
gguaagccggcgu

SEQ ID NO: 1083460 - RNA, 20 nt, Mycobacterium bovis subsp bovis AF2122/97
gguaaguacuagccggucgg

SEQ ID NO: 1083461 - RNA, 17 nt, Mycobacterium bovis subsp bovis AF2122/97
gguaauacgcggggccg

SEQ ID NO: 1083462 - RNA, 14 nt, Mycobacterium bovis subsp bovis AF2122/97
gguaaucaccuggc

SEQ ID NO: 1083463 - RNA, 13 nt, Mycobacterium bovis subsp bovis AF2122/97
gguaaucgcgaga

SEQ ID NO: 1083464 - RNA, 19 nt, Mycobacterium bovis subsp bovis AF2122/97
gguaaccagggcagccggg

SEQ ID NO: 1083465 - RNA, 14 nt, Mycobacterium bovis subsp bovis AF2122/97
gguaacaccggcga

SEQ ID NO: 1083466 - RNA, 21 nt, Mycobacterium bovis subsp bovis AF2122/97
gguaacacucgaagucgccca

SEQ ID NO: 1083467 - RNA, 13 nt, Mycobacterium bovis subsp bovis AF2122/97
ggguuccacaccc

SEQ ID NO: 1083468 - RNA, 12 nt, Mycobacterium bovis subsp bovis AF2122/97
gguaaagccccg

SEQ ID NO: 1083469 - RNA, 13 nt, Mycobacterium bovis subsp bovis AF2122/97
gguaaccggcgga

SEQ ID NO: 1083470 - RNA, 15 nt, Mycobacterium bovis subsp bovis AF2122/97
gguaaccggcggauu

SEQ ID NO: 1083471 - RNA, 20 nt, Mycobacterium bovis subsp bovis AF2122/97
gguaacgguccucgaaacgc

SEQ ID NO: 1083472 - RNA, 14 nt, Mycobacterium bovis subsp bovis AF2122/97
gguaacgccaacac

SEQ ID NO: 1083473 - RNA, 19 nt, Mycobacterium bovis subsp bovis AF2122/97
gguaacgccaacaccggca

SEQ ID NO: 1083474 - RNA, 21 nt, Mycobacterium bovis subsp bovis AF2122/97
ggguguagccagcggcugccc

SEQ ID NO: 1083475 - RNA, 20 nt, Mycobacterium bovis subsp bovis AF2122/97
ggguguauggccaccacgca

SEQ ID NO: 1083476 - RNA, 20 nt, Mycobacterium bovis subsp bovis AF2122/97
ggguguagcaagucgccgag

SEQ ID NO: 1083477 - RNA, 14 nt, Mycobacterium bovis subsp bovis AF2122/97
ggguucgcgucuga

SEQ ID NO: 1083478 - RNA, 13 nt, Mycobacterium bovis subsp bovis AF2122/97
ggguucgcucugg

SEQ ID NO: 1083479 - RNA, 19 nt, Mycobacterium bovis subsp bovis AF2122/97
ggguucgccgaagccggac

SEQ ID NO: 1083480 - RNA, 14 nt, Mycobacterium bovis subsp bovis AF2122/97
ggguugaccgccac

SEQ ID NO: 1083481 - RNA, 18 nt, Mycobacterium bovis subsp bovis AF2122/97
ggguugaccgccaccccg

SEQ ID NO: 1083482 - RNA, 16 nt, Mycobacterium bovis subsp bovis AF2122/97
ggguugaggaucccgg

SEQ ID NO: 1083483 - RNA, 19 nt, Mycobacterium bovis subsp bovis AF2122/97
ggguucuuccacagcgcgu

SEQ ID NO: 1083484 - RNA, 16 nt, Mycobacterium bovis subsp bovis AF2122/97
ggguugaucgcgcuga

SEQ ID NO: 1083485 - RNA, 23 nt, Mycobacterium bovis subsp bovis AF2122/97
gggugggcaagcugaccgccagc

SEQ ID NO: 1083486 - RNA, 17 nt, Mycobacterium bovis subsp bovis AF2122/97
gggugggccagugaaac

SEQ ID NO: 1083487 - RNA, 19 nt, Mycobacterium bovis subsp bovis AF2122/97
ggguggcgucaccgccggu

SEQ ID NO: 1083488 - RNA, 12 nt, Mycobacterium bovis subsp bovis AF2122/97
ggguggcgucgc

SEQ ID NO: 1083489 - RNA, 14 nt, Mycobacterium bovis subsp bovis AF2122/97
ggguggcugcuggc

SEQ ID NO: 1083490 - RNA, 20 nt, Mycobacterium bovis subsp bovis AF2122/97
gggugggucggcuuccggug

SEQ ID NO: 1083491 - RNA, 14 nt, Mycobacterium bovis subsp bovis AF2122/97
gggugguaccggcg

SEQ ID NO: 1083492 - RNA, 16 nt, Mycobacterium bovis subsp bovis AF2122/97
gggugguagcugacgc

SEQ ID NO: 1083493 - RNA, 22 nt, Mycobacterium bovis subsp bovis AF2122/97
gggugguguggccucgucccgg

SEQ ID NO: 1083494 - RNA, 19 nt, Mycobacterium bovis subsp bovis AF2122/97
gggugguuguucggccauc

SEQ ID NO: 1083495 - RNA, 18 nt, Mycobacterium bovis subsp bovis AF2122/97
ggguggugucgcggccgc

SEQ ID NO: 1083496 - RNA, 17 nt, Mycobacterium bovis subsp bovis AF2122/97
ggguggcggcgcugcgc

SEQ ID NO: 1083497 - RNA, 12 nt, Mycobacterium bovis subsp bovis AF2122/97
ggguggcggcgu

SEQ ID NO: 1083498 - RNA, 14 nt, Mycobacterium bovis subsp bovis AF2122/97
ggguggcggcguca

SEQ ID NO: 1083499 - RNA, 14 nt, Mycobacterium bovis subsp bovis AF2122/97
aaguacuggccgcc

SEQ ID NO: 1083500 - RNA, 22 nt, Mycobacterium bovis subsp bovis AF2122/97
aaguacuggcguugccaccgga

SEQ ID NO: 1083501 - RNA, 15 nt, Mycobacterium bovis subsp bovis AF2122/97
aaguacacggcggcc

SEQ ID NO: 1083502 - RNA, 22 nt, Mycobacterium bovis subsp bovis AF2122/97
ggugcaucgccacagucgucga

SEQ ID NO: 1083503 - RNA, 16 nt, Mycobacterium bovis subsp bovis AF2122/97
ggugcagucgauuucg

SEQ ID NO: 1083504 - RNA, 19 nt, Mycobacterium bovis subsp bovis AF2122/97
ggugcagcgacuccguacc

SEQ ID NO: 1083505 - RNA, 18 nt, Mycobacterium bovis subsp bovis AF2122/97
ggugcaggugagugcggc

SEQ ID NO: 1083506 - RNA, 19 nt, Mycobacterium bovis subsp bovis AF2122/97
ggugcaggugaugcaugcu

SEQ ID NO: 1083507 - RNA, 15 nt, Mycobacterium bovis subsp bovis AF2122/97
ggugccacguucgcg

SEQ ID NO: 1083508 - RNA, 19 nt, Mycobacterium bovis subsp bovis AF2122/97
ggugccacugccguugccg

SEQ ID NO: 1083509 - RNA, 23 nt, Mycobacterium bovis subsp bovis AF2122/97
ggugccacugccguugccgccgg

SEQ ID NO: 1083510 - RNA, 22 nt, Mycobacterium bovis subsp bovis AF2122/97
ggugccagaccagggcagcggc

SEQ ID NO: 1083511 - RNA, 17 nt, Mycobacterium bovis subsp bovis AF2122/97
ggugccaaccgcggcga

SEQ ID NO: 1083512 - RNA, 21 nt, Mycobacterium bovis subsp bovis AF2122/97
ggugccaacugcgccguucgc

SEQ ID NO: 1083513 - RNA, 20 nt, Mycobacterium bovis subsp bovis AF2122/97
ggugcaggauucggcggucg

SEQ ID NO: 1083514 - RNA, 21 nt, Mycobacterium bovis subsp bovis AF2122/97
ggugcaggauucggcggucgc

SEQ ID NO: 1083515 - RNA, 19 nt, Mycobacterium bovis subsp bovis AF2122/97
ggugcagcgugcagcggcg

SEQ ID NO: 1083516 - RNA, 13 nt, Mycobacterium bovis subsp bovis AF2122/97
ggugcagcagggc

SEQ ID NO: 1083517 - RNA, 19 nt, Mycobacterium bovis subsp bovis AF2122/97
ggugcagaucggcucaccg

SEQ ID NO: 1083518 - RNA, 14 nt, Mycobacterium bovis subsp bovis AF2122/97
ggugcagcacggcg

SEQ ID NO: 1083519 - RNA, 18 nt, Mycobacterium bovis subsp bovis AF2122/97
ggugcagcacggcgccgc

SEQ ID NO: 1083520 - RNA, 15 nt, Mycobacterium bovis subsp bovis AF2122/97
ggugcagcgccgaca

SEQ ID NO: 1083521 - RNA, 13 nt, Mycobacterium bovis subsp bovis AF2122/97
ggugcagccgcgg

SEQ ID NO: 1083522 - RNA, 20 nt, Mycobacterium bovis subsp bovis AF2122/97
ggugcagccgcggucguugg

SEQ ID NO: 1083523 - RNA, 16 nt, Mycobacterium bovis subsp bovis AF2122/97
ggugcccgcaccacac

SEQ ID NO: 1083524 - RNA, 21 nt, Mycobacterium bovis subsp bovis AF2122/97
ggugcccgacuugacggcggg

SEQ ID NO: 1083525 - RNA, 21 nt, Mycobacterium bovis subsp bovis AF2122/97
ggugcccggccaaaauggcgc

SEQ ID NO: 1083526 - RNA, 12 nt, Mycobacterium bovis subsp bovis AF2122/97
ggugcccggccg

SEQ ID NO: 1083527 - RNA, 13 nt, Mycobacterium bovis subsp bovis AF2122/97
ggugcccggccgc

SEQ ID NO: 1083528 - RNA, 20 nt, Mycobacterium bovis subsp bovis AF2122/97
ggugcccaggaaggcgacgc

SEQ ID NO: 1083529 - RNA, 16 nt, Mycobacterium bovis subsp bovis AF2122/97
ggugcccccggugccg

SEQ ID NO: 1083530 - RNA, 22 nt, Mycobacterium bovis subsp bovis AF2122/97
ggugcccaagcaguccacgagc

SEQ ID NO: 1083531 - RNA, 22 nt, Mycobacterium bovis subsp bovis AF2122/97
ggugcccagcgcuuugaugccg

SEQ ID NO: 1083532 - RNA, 16 nt, Mycobacterium bovis subsp bovis AF2122/97
ggugccaguccaaaac

SEQ ID NO: 1083533 - RNA, 17 nt, Mycobacterium bovis subsp bovis AF2122/97
ggugccaucgguggugg

SEQ ID NO: 1083534 - RNA, 23 nt, Mycobacterium bovis subsp bovis AF2122/97
ggugcccaaggcagacccccagc

SEQ ID NO: 1083535 - RNA, 14 nt, Mycobacterium bovis subsp bovis AF2122/97
ggugcccaccaccg

SEQ ID NO: 1083536 - RNA, 14 nt, Mycobacterium bovis subsp bovis AF2122/97
ggugccaccgacgc

SEQ ID NO: 1083537 - RNA, 12 nt, Mycobacterium bovis subsp bovis AF2122/97
ggugccaccgcg

SEQ ID NO: 1083538 - RNA, 16 nt, Mycobacterium bovis subsp bovis AF2122/97
ggugccaccgcgacgg

SEQ ID NO: 1083539 - RNA, 18 nt, Mycobacterium bovis subsp bovis AF2122/97
ggugccacgaucggcggg

SEQ ID NO: 1083540 - RNA, 19 nt, Mycobacterium bovis subsp bovis AF2122/97
ggugccagcaccacgucga

SEQ ID NO: 1083541 - RNA, 13 nt, Mycobacterium bovis subsp bovis AF2122/97
ggugccagcaggc

SEQ ID NO: 1083542 - RNA, 16 nt, Mycobacterium bovis subsp bovis AF2122/97
ggugccagcaggccga

SEQ ID NO: 1083543 - RNA, 21 nt, Mycobacterium bovis subsp bovis AF2122/97
ggugccagccggucgaugccg

SEQ ID NO: 1083544 - RNA, 15 nt, Mycobacterium bovis subsp bovis AF2122/97
ggugcauucgcaugu

SEQ ID NO: 1083545 - RNA, 11 nt, Mycobacterium bovis subsp bovis AF2122/97
ggugccagccg

SEQ ID NO: 1083546 - RNA, 17 nt, Mycobacterium bovis subsp bovis AF2122/97
ggugccagccggucgau

SEQ ID NO: 1083547 - RNA, 20 nt, Mycobacterium bovis subsp bovis AF2122/97
ggugccgacggcgccgaacc

SEQ ID NO: 1083548 - RNA, 13 nt, Mycobacterium bovis subsp bovis AF2122/97
ggugccgacccgc

SEQ ID NO: 1083549 - RNA, 17 nt, Mycobacterium bovis subsp bovis AF2122/97
ggugccgacccgccgcg

SEQ ID NO: 1083550 - RNA, 21 nt, Mycobacterium bovis subsp bovis AF2122/97
ggugccgacccgccgcgcccg

SEQ ID NO: 1083551 - RNA, 16 nt, Mycobacterium bovis subsp bovis AF2122/97
ggugccgaacagcggg

SEQ ID NO: 1083552 - RNA, 16 nt, Mycobacterium bovis subsp bovis AF2122/97
ggugccgaaccggcgc

SEQ ID NO: 1083553 - RNA, 14 nt, Mycobacterium bovis subsp bovis AF2122/97
ggugccgaacgagg

SEQ ID NO: 1083554 - RNA, 18 nt, Mycobacterium bovis subsp bovis AF2122/97
ggugcccucggccgccug

SEQ ID NO: 1083555 - RNA, 20 nt, Mycobacterium bovis subsp bovis AF2122/97
ggugccgaagaugaccgcuc

SEQ ID NO: 1083556 - RNA, 15 nt, Mycobacterium bovis subsp bovis AF2122/97
ggugccgccaccacc

SEQ ID NO: 1083557 - RNA, 21 nt, Mycobacterium bovis subsp bovis AF2122/97
ggugccgccaccaccggcgcc

SEQ ID NO: 1083558 - RNA, 17 nt, Mycobacterium bovis subsp bovis AF2122/97
ggugccgccaccggcgu

SEQ ID NO: 1083559 - RNA, 19 nt, Mycobacterium bovis subsp bovis AF2122/97
ggugccgagcacucggcca

SEQ ID NO: 1083560 - RNA, 15 nt, Mycobacterium bovis subsp bovis AF2122/97
ggugccgagcuggcg

SEQ ID NO: 1083561 - RNA, 19 nt, Mycobacterium bovis subsp bovis AF2122/97
ggugccgccaccggcgucc

SEQ ID NO: 1083562 - RNA, 17 nt, Mycobacterium bovis subsp bovis AF2122/97
ggugccgaucgaugcca

SEQ ID NO: 1083563 - RNA, 19 nt, Mycobacterium bovis subsp bovis AF2122/97
ggugccgccauugacgccg

SEQ ID NO: 1083564 - RNA, 13 nt, Mycobacterium bovis subsp bovis AF2122/97
ggugccgcccgag

SEQ ID NO: 1083565 - RNA, 13 nt, Mycobacterium bovis subsp bovis AF2122/97
ggugccgcccgcg

SEQ ID NO: 1083566 - RNA, 16 nt, Mycobacterium bovis subsp bovis AF2122/97
ggugccgcccgcgccg

SEQ ID NO: 1083567 - RNA, 22 nt, Mycobacterium bovis subsp bovis AF2122/97
ggugccgccgggugcaacggcg

SEQ ID NO: 1083568 - RNA, 16 nt, Mycobacterium bovis subsp bovis AF2122/97
ggugccgccggugccg

SEQ ID NO: 1083569 - RNA, 21 nt, Mycobacterium bovis subsp bovis AF2122/97
ggugccgccggugccgccauu

SEQ ID NO: 1083570 - RNA, 14 nt, Mycobacterium bovis subsp bovis AF2122/97
ggugccgccgucga

SEQ ID NO: 1083571 - RNA, 15 nt, Mycobacterium bovis subsp bovis AF2122/97
ggugccgccgucgau

SEQ ID NO: 1083572 - RNA, 18 nt, Mycobacterium bovis subsp bovis AF2122/97
ggugccgcagcaggggac

SEQ ID NO: 1083573 - RNA, 12 nt, Mycobacterium bovis subsp bovis AF2122/97
ggugccgccggg

SEQ ID NO: 1083574 - RNA, 13 nt, Mycobacterium bovis subsp bovis AF2122/97
ggugccgccgccg

SEQ ID NO: 1083575 - RNA, 16 nt, Mycobacterium bovis subsp bovis AF2122/97
ggugccgccgccggcg

SEQ ID NO: 1083576 - RNA, 13 nt, Mycobacterium bovis subsp bovis AF2122/97
ggugccgccgcgg

SEQ ID NO: 1083577 - RNA, 14 nt, Mycobacterium bovis subsp bovis AF2122/97
ggugccgcgcagcu

SEQ ID NO: 1083578 - RNA, 13 nt, Mycobacterium bovis subsp bovis AF2122/97
ggugccgcggcca

SEQ ID NO: 1083579 - RNA, 20 nt, Mycobacterium bovis subsp bovis AF2122/97
ggugccggacuuggccugcg

SEQ ID NO: 1083580 - RNA, 21 nt, Mycobacterium bovis subsp bovis AF2122/97
ggugccggacuuggccugcgg

SEQ ID NO: 1083581 - RNA, 17 nt, Mycobacterium bovis subsp bovis AF2122/97
ggugccggcacccgagu

SEQ ID NO: 1083582 - RNA, 16 nt, Mycobacterium bovis subsp bovis AF2122/97
ggugccggcagcggcg

SEQ ID NO: 1083583 - RNA, 17 nt, Mycobacterium bovis subsp bovis AF2122/97
ggugccggcagcggcgc

SEQ ID NO: 1083584 - RNA, 18 nt, Mycobacterium bovis subsp bovis AF2122/97
ggugccggcagcggcgcg

SEQ ID NO: 1083585 - RNA, 17 nt, Mycobacterium bovis subsp bovis AF2122/97
ggugccggcauagaucg

SEQ ID NO: 1083586 - RNA, 12 nt, Mycobacterium bovis subsp bovis AF2122/97
ggugccggcgac

SEQ ID NO: 1083587 - RNA, 16 nt, Mycobacterium bovis subsp bovis AF2122/97
ggugccggcccugcuc

SEQ ID NO: 1083588 - RNA, 14 nt, Mycobacterium bovis subsp bovis AF2122/97
ggugccggcgacgc

SEQ ID NO: 1083589 - RNA, 22 nt, Mycobacterium bovis subsp bovis AF2122/97
ggugccggcgacgcuaccgccg

SEQ ID NO: 1083590 - RNA, 12 nt, Mycobacterium bovis subsp bovis AF2122/97
ggugccggcgcc

SEQ ID NO: 1083591 - RNA, 13 nt, Mycobacterium bovis subsp bovis AF2122/97
ggugccggcgcca

SEQ ID NO: 1083592 - RNA, 14 nt, Mycobacterium bovis subsp bovis AF2122/97
ggugccggcgccac

SEQ ID NO: 1083593 - RNA, 15 nt, Mycobacterium bovis subsp bovis AF2122/97
ggugccggcgccacc

SEQ ID NO: 1083594 - RNA, 16 nt, Mycobacterium bovis subsp bovis AF2122/97
ggugccggcgccgcca

SEQ ID NO: 1083595 - RNA, 18 nt, Mycobacterium bovis subsp bovis AF2122/97
ggugccggcgccgccagc

SEQ ID NO: 1083596 - RNA, 14 nt, Mycobacterium bovis subsp bovis AF2122/97
ggugccggcggaaa

SEQ ID NO: 1083597 - RNA, 14 nt, Mycobacterium bovis subsp bovis AF2122/97
ggugccggcggcgc

SEQ ID NO: 1083598 - RNA, 14 nt, Mycobacterium bovis subsp bovis AF2122/97
ggugccgucgggua

SEQ ID NO: 1083599 - RNA, 15 nt, Mycobacterium bovis subsp bovis AF2122/97
ggugccgucagcggc

SEQ ID NO: 1083600 - RNA, 11 nt, Mycobacterium bovis subsp bovis AF2122/97
ggugccgucgc

SEQ ID NO: 1083601 - RNA, 17 nt, Mycobacterium bovis subsp bovis AF2122/97
ggugccgucggugccgc

SEQ ID NO: 1083602 - RNA, 15 nt, Mycobacterium bovis subsp bovis AF2122/97
ggugccgugcucacg

SEQ ID NO: 1083603 - RNA, 17 nt, Mycobacterium bovis subsp bovis AF2122/97
ggugccguggauugcgc

SEQ ID NO: 1083604 - RNA, 17 nt, Mycobacterium bovis subsp bovis AF2122/97
ggugccguuggagccgc

SEQ ID NO: 1083605 - RNA, 18 nt, Mycobacterium bovis subsp bovis AF2122/97
ggugccguuggagccgcc

SEQ ID NO: 1083606 - RNA, 20 nt, Mycobacterium bovis subsp bovis AF2122/97
ggugccguuggagccgccac

SEQ ID NO: 1083607 - RNA, 16 nt, Mycobacterium bovis subsp bovis AF2122/97
ggugccuacaccggca

SEQ ID NO: 1083608 - RNA, 19 nt, Mycobacterium bovis subsp bovis AF2122/97
ggugccuacaccggcaagc

SEQ ID NO: 1083609 - RNA, 13 nt, Mycobacterium bovis subsp bovis AF2122/97
ggugccgucgagu

SEQ ID NO: 1083610 - RNA, 20 nt, Mycobacterium bovis subsp bovis AF2122/97
ggugccgguguugccgccgg

SEQ ID NO: 1083611 - RNA, 23 nt, Mycobacterium bovis subsp bovis AF2122/97
ggugccggugcuccucggcaggc

SEQ ID NO: 1083612 - RNA, 22 nt, Mycobacterium bovis subsp bovis AF2122/97
ggugccggcggugacggcggca

SEQ ID NO: 1083613 - RNA, 14 nt, Mycobacterium bovis subsp bovis AF2122/97
ggugccggcgucgc

SEQ ID NO: 1083614 - RNA, 14 nt, Mycobacterium bovis subsp bovis AF2122/97
ggugccggcguugc

SEQ ID NO: 1083615 - RNA, 19 nt, Mycobacterium bovis subsp bovis AF2122/97
ggugccggugauggccgac

SEQ ID NO: 1083616 - RNA, 19 nt, Mycobacterium bovis subsp bovis AF2122/97
ggugccgggaugccgccgc

SEQ ID NO: 1083617 - RNA, 23 nt, Mycobacterium bovis subsp bovis AF2122/97
ggugccggucaccucgccggcgg

SEQ ID NO: 1083618 - RNA, 20 nt, Mycobacterium bovis subsp bovis AF2122/97
ggugcgccgguccucgucgg

SEQ ID NO: 1083619 - RNA, 18 nt, Mycobacterium bovis subsp bovis AF2122/97
ggugcgccguggcaucgc

SEQ ID NO: 1083620 - RNA, 22 nt, Mycobacterium bovis subsp bovis AF2122/97
ggugcgccguugccgccgucgc

SEQ ID NO: 1083621 - RNA, 23 nt, Mycobacterium bovis subsp bovis AF2122/97
ggugcgccguugccgccgucgcc

SEQ ID NO: 1083622 - RNA, 14 nt, Mycobacterium bovis subsp bovis AF2122/97
ggugcgccgccauc

SEQ ID NO: 1083623 - RNA, 13 nt, Mycobacterium bovis subsp bovis AF2122/97
ggugcgccggcgu

SEQ ID NO: 1083624 - RNA, 18 nt, Mycobacterium bovis subsp bovis AF2122/97
ggugcgcgcgaccauacc

SEQ ID NO: 1083625 - RNA, 17 nt, Mycobacterium bovis subsp bovis AF2122/97
ggugcgcagguacgccu

SEQ ID NO: 1083626 - RNA, 23 nt, Mycobacterium bovis subsp bovis AF2122/97
ggugcgccgggcguccgccggcg

SEQ ID NO: 1083627 - RNA, 15 nt, Mycobacterium bovis subsp bovis AF2122/97
ggugcgcgaggucgg

SEQ ID NO: 1083628 - RNA, 15 nt, Mycobacterium bovis subsp bovis AF2122/97
ggugcgcgcggucga

SEQ ID NO: 1083629 - RNA, 17 nt, Mycobacterium bovis subsp bovis AF2122/97
ggugcggaccugcgccg

SEQ ID NO: 1083630 - RNA, 23 nt, Mycobacterium bovis subsp bovis AF2122/97
ggugcgcuugcggccgcgcgccg

SEQ ID NO: 1083631 - RNA, 18 nt, Mycobacterium bovis subsp bovis AF2122/97
ggugcggaacacgaugcg

SEQ ID NO: 1083632 - RNA, 13 nt, Mycobacterium bovis subsp bovis AF2122/97
ggugcgcuggcgg

SEQ ID NO: 1083633 - RNA, 16 nt, Mycobacterium bovis subsp bovis AF2122/97
ggugcgcuggcggcgc

SEQ ID NO: 1083634 - RNA, 24 nt, Mycobacterium bovis subsp bovis AF2122/97
ggugcgcuggaugugggcgcucgc

SEQ ID NO: 1083635 - RNA, 12 nt, Mycobacterium bovis subsp bovis AF2122/97
ggugcgcuggcg

SEQ ID NO: 1083636 - RNA, 14 nt, Mycobacterium bovis subsp bovis AF2122/97
ggugcggacuucga

SEQ ID NO: 1083637 - RNA, 16 nt, Mycobacterium bovis subsp bovis AF2122/97
ggugcggcaacagcgc

SEQ ID NO: 1083638 - RNA, 21 nt, Mycobacterium bovis subsp bovis AF2122/97
ggugcggauguccuugcgguc

SEQ ID NO: 1083639 - RNA, 23 nt, Mycobacterium bovis subsp bovis AF2122/97
ggugcggcccugcuugcaggcga

SEQ ID NO: 1083640 - RNA, 13 nt, Mycobacterium bovis subsp bovis AF2122/97
ggugcgcacggcg

SEQ ID NO: 1083641 - RNA, 18 nt, Mycobacterium bovis subsp bovis AF2122/97
ggugcgccauucccggug

SEQ ID NO: 1083642 - RNA, 19 nt, Mycobacterium bovis subsp bovis AF2122/97
ggugcgccauugcgggaac

SEQ ID NO: 1083643 - RNA, 13 nt, Mycobacterium bovis subsp bovis AF2122/97
ggugcgccgcagc

SEQ ID NO: 1083644 - RNA, 16 nt, Mycobacterium bovis subsp bovis AF2122/97
ggugcgccgcagcagg

SEQ ID NO: 1083645 - RNA, 17 nt, Mycobacterium bovis subsp bovis AF2122/97
ggugcgcccgccggcgc

SEQ ID NO: 1083646 - RNA, 23 nt, Mycobacterium bovis subsp bovis AF2122/97
ggugcgcccggccaagccggcga

SEQ ID NO: 1083647 - RNA, 15 nt, Mycobacterium bovis subsp bovis AF2122/97
ggugcgcagcugcgg

SEQ ID NO: 1083648 - RNA, 19 nt, Mycobacterium bovis subsp bovis AF2122/97
ggugcgaucccacccucgg

SEQ ID NO: 1083649 - RNA, 21 nt, Mycobacterium bovis subsp bovis AF2122/97
ggugcgaucgcaacaccggug

SEQ ID NO: 1083650 - RNA, 17 nt, Mycobacterium bovis subsp bovis AF2122/97
ggugcgauuccgcgucu

SEQ ID NO: 1083651 - RNA, 21 nt, Mycobacterium bovis subsp bovis AF2122/97
ggugcgcaaucgacaccagcg

SEQ ID NO: 1083652 - RNA, 19 nt, Mycobacterium bovis subsp bovis AF2122/97
ggugcgacgcgaccgcgau

SEQ ID NO: 1083653 - RNA, 14 nt, Mycobacterium bovis subsp bovis AF2122/97
ggugccugcaacgc

SEQ ID NO: 1083654 - RNA, 15 nt, Mycobacterium bovis subsp bovis AF2122/97
ggugccugcagcuug

SEQ ID NO: 1083655 - RNA, 20 nt, Mycobacterium bovis subsp bovis AF2122/97
ggugccuacaccggcaagcc

SEQ ID NO: 1083656 - RNA, 15 nt, Mycobacterium bovis subsp bovis AF2122/97
ggugcguccaggcca

SEQ ID NO: 1083657 - RNA, 18 nt, Mycobacterium bovis subsp bovis AF2122/97
ggugcgguuucaccgacg

SEQ ID NO: 1083658 - RNA, 22 nt, Mycobacterium bovis subsp bovis AF2122/97
ggugcgguuucaccgacgacgc

SEQ ID NO: 1083659 - RNA, 16 nt, Mycobacterium bovis subsp bovis AF2122/97
ggugcggucuccgccc

SEQ ID NO: 1083660 - RNA, 17 nt, Mycobacterium bovis subsp bovis AF2122/97
ggugcggugauuccagc

SEQ ID NO: 1083661 - RNA, 18 nt, Mycobacterium bovis subsp bovis AF2122/97
ggugcggcaacagcgcca

SEQ ID NO: 1083662 - RNA, 16 nt, Mycobacterium bovis subsp bovis AF2122/97
ggugcggccgggucgc

SEQ ID NO: 1083663 - RNA, 19 nt, Mycobacterium bovis subsp bovis AF2122/97
ggugcggccguggcguggc

SEQ ID NO: 1083664 - RNA, 15 nt, Mycobacterium bovis subsp bovis AF2122/97
ggugcgggccggugg

SEQ ID NO: 1083665 - RNA, 14 nt, Mycobacterium bovis subsp bovis AF2122/97
ggugcgggcgccgc

SEQ ID NO: 1083666 - RNA, 16 nt, Mycobacterium bovis subsp bovis AF2122/97
ggugcgggcuaggcgg

SEQ ID NO: 1083667 - RNA, 19 nt, Mycobacterium bovis subsp bovis AF2122/97
ggugcggguggugccggcg

SEQ ID NO: 1083668 - RNA, 20 nt, Mycobacterium bovis subsp bovis AF2122/97
ggugcggguggugccggcgg

SEQ ID NO: 1083669 - RNA, 19 nt, Mycobacterium bovis subsp bovis AF2122/97
ggugcgggugggacaccau

SEQ ID NO: 1083670 - RNA, 20 nt, Mycobacterium bovis subsp bovis AF2122/97
ggugcgucacagccggguuu

SEQ ID NO: 1083671 - RNA, 13 nt, Mycobacterium bovis subsp bovis AF2122/97
gguggagcggcgc

SEQ ID NO: 1083672 - RNA, 16 nt, Mycobacterium bovis subsp bovis AF2122/97
gguggcagagccgccg

SEQ ID NO: 1083673 - RNA, 22 nt, Mycobacterium bovis subsp bovis AF2122/97
gguggcagagccgccguugccg

SEQ ID NO: 1083674 - RNA, 14 nt, Mycobacterium bovis subsp bovis AF2122/97
gguggcacccgcgu

SEQ ID NO: 1083675 - RNA, 14 nt, Mycobacterium bovis subsp bovis AF2122/97
gguggccaccagcg

SEQ ID NO: 1083676 - RNA, 15 nt, Mycobacterium bovis subsp bovis AF2122/97
gguggccaccagcgg

SEQ ID NO: 1083677 - RNA, 13 nt, Mycobacterium bovis subsp bovis AF2122/97
gguggcaugcgac

SEQ ID NO: 1083678 - RNA, 21 nt, Mycobacterium bovis subsp bovis AF2122/97
gguggaucagggucaucagcc

SEQ ID NO: 1083679 - RNA, 21 nt, Mycobacterium bovis subsp bovis AF2122/97
gguggagagccgacgugcggc

SEQ ID NO: 1083680 - RNA, 17 nt, Mycobacterium bovis subsp bovis AF2122/97
ggugcuaaccgacgcug

SEQ ID NO: 1083681 - RNA, 16 nt, Mycobacterium bovis subsp bovis AF2122/97
ggugcgugcgcgucgg

SEQ ID NO: 1083682 - RNA, 17 nt, Mycobacterium bovis subsp bovis AF2122/97
ggugcguggaauggcgc

SEQ ID NO: 1083683 - RNA, 21 nt, Mycobacterium bovis subsp bovis AF2122/97
ggugcguggaauggcgccggc

SEQ ID NO: 1083684 - RNA, 17 nt, Mycobacterium bovis subsp bovis AF2122/97
ggugcucaaggcuucgg

SEQ ID NO: 1083685 - RNA, 17 nt, Mycobacterium bovis subsp bovis AF2122/97
ggugcucagcggcucgc

SEQ ID NO: 1083686 - RNA, 19 nt, Mycobacterium bovis subsp bovis AF2122/97
ggugcgguucgcugcggcg

SEQ ID NO: 1083687 - RNA, 21 nt, Mycobacterium bovis subsp bovis AF2122/97
ggucuuggaaagcccgcucgg

SEQ ID NO: 1083688 - RNA, 17 nt, Mycobacterium bovis subsp bovis AF2122/97
ggucuuggauccggccg

SEQ ID NO: 1083689 - RNA, 21 nt, Mycobacterium bovis subsp bovis AF2122/97
ggucuuggauccggccgccaa

SEQ ID NO: 1083690 - RNA, 14 nt, Mycobacterium bovis subsp bovis AF2122/97
ggucuugccgagca

SEQ ID NO: 1083691 - RNA, 13 nt, Mycobacterium bovis subsp bovis AF2122/97
ggucuuggcggug

SEQ ID NO: 1083692 - RNA, 20 nt, Mycobacterium bovis subsp bovis AF2122/97
ggugaaggcaaacaccagcc

SEQ ID NO: 1083693 - RNA, 17 nt, Mycobacterium bovis subsp bovis AF2122/97
ggugaagccgagcgccc

SEQ ID NO: 1083694 - RNA, 14 nt, Mycobacterium bovis subsp bovis AF2122/97
ggucuucaggccgc

SEQ ID NO: 1083695 - RNA, 20 nt, Mycobacterium bovis subsp bovis AF2122/97
ggucuucaggccgcgcaugg

SEQ ID NO: 1083696 - RNA, 20 nt, Mycobacterium bovis subsp bovis AF2122/97
ggucuuccggugcgccgauc

SEQ ID NO: 1083697 - RNA, 15 nt, Mycobacterium bovis subsp bovis AF2122/97
ggucuucgaccacgg

SEQ ID NO: 1083698 - RNA, 13 nt, Mycobacterium bovis subsp bovis AF2122/97
ggucuucgccguc

SEQ ID NO: 1083699 - RNA, 22 nt, Mycobacterium bovis subsp bovis AF2122/97
ggucugcuauugguugaggagg

SEQ ID NO: 1083700 - RNA, 10 nt, Mycobacterium bovis subsp bovis AF2122/97
ggucugcuca

SEQ ID NO: 1083701 - RNA, 16 nt, Mycobacterium bovis subsp bovis AF2122/97
ggucugcuccaggcgc

SEQ ID NO: 1083702 - RNA, 17 nt, Mycobacterium bovis subsp bovis AF2122/97
ggucugcuccaggcgcg

SEQ ID NO: 1083703 - RNA, 15 nt, Mycobacterium bovis subsp bovis AF2122/97
ggucugcgcgucgcg

SEQ ID NO: 1083704 - RNA, 21 nt, Mycobacterium bovis subsp bovis AF2122/97
ggucucccagaggucgagcgc

SEQ ID NO: 1083705 - RNA, 18 nt, Mycobacterium bovis subsp bovis AF2122/97
ggucugcgccgccggcgg

SEQ ID NO: 1083706 - RNA, 21 nt, Mycobacterium bovis subsp bovis AF2122/97
ggucugcgccgccggcggcgg

SEQ ID NO: 1083707 - RNA, 16 nt, Mycobacterium bovis subsp bovis AF2122/97
ggucugcggccgauac

SEQ ID NO: 1083708 - RNA, 17 nt, Mycobacterium bovis subsp bovis AF2122/97
ggucguuggcggcgguc

SEQ ID NO: 1083709 - RNA, 15 nt, Mycobacterium bovis subsp bovis AF2122/97
ggucuacuucggcgc

SEQ ID NO: 1083710 - RNA, 22 nt, Mycobacterium bovis subsp bovis AF2122/97
ggucguuucccuggccgccgcc

SEQ ID NO: 1083711 - RNA, 16 nt, Mycobacterium bovis subsp bovis AF2122/97
ggucgccggggccgcu

SEQ ID NO: 1083712 - RNA, 16 nt, Mycobacterium bovis subsp bovis AF2122/97
ggucgccucaccggcg

SEQ ID NO: 1083713 - RNA, 17 nt, Mycobacterium bovis subsp bovis AF2122/97
ggucgccggacugcggc

SEQ ID NO: 1083714 - RNA, 23 nt, Mycobacterium bovis subsp bovis AF2122/97
ggucggccacgcgcacucgacgc

SEQ ID NO: 1083715 - RNA, 18 nt, Mycobacterium bovis subsp bovis AF2122/97
ggucggccaggccgucgg

SEQ ID NO: 1083716 - RNA, 15 nt, Mycobacterium bovis subsp bovis AF2122/97
ggucggccggcucgu

SEQ ID NO: 1083717 - RNA, 14 nt, Mycobacterium bovis subsp bovis AF2122/97
ggucggccucgaga

SEQ ID NO: 1083718 - RNA, 21 nt, Mycobacterium bovis subsp bovis AF2122/97
ggucggccucgagacggucga

SEQ ID NO: 1083719 - RNA, 13 nt, Mycobacterium bovis subsp bovis AF2122/97
ggucggccugcga

SEQ ID NO: 1083720 - RNA, 13 nt, Mycobacterium bovis subsp bovis AF2122/97
ggucggccugcgg

SEQ ID NO: 1083721 - RNA, 13 nt, Mycobacterium bovis subsp bovis AF2122/97
ggucggcgacguc

SEQ ID NO: 1083722 - RNA, 12 nt, Mycobacterium bovis subsp bovis AF2122/97
ggucggcgacca

SEQ ID NO: 1083723 - RNA, 13 nt, Mycobacterium bovis subsp bovis AF2122/97
ggucggcgaccac

SEQ ID NO: 1083724 - RNA, 14 nt, Mycobacterium bovis subsp bovis AF2122/97
ggucggcgaccacc

SEQ ID NO: 1083725 - RNA, 15 nt, Mycobacterium bovis subsp bovis AF2122/97
ggucggcgaccaccc

SEQ ID NO: 1083726 - RNA, 16 nt, Mycobacterium bovis subsp bovis AF2122/97
ggucggcccacggugu

SEQ ID NO: 1083727 - RNA, 17 nt, Mycobacterium bovis subsp bovis AF2122/97
ggucgggcauuccggug

SEQ ID NO: 1083728 - RNA, 15 nt, Mycobacterium bovis subsp bovis AF2122/97
ggucgggcccccggc

SEQ ID NO: 1083729 - RNA, 15 nt, Mycobacterium bovis subsp bovis AF2122/97
ggucgggcccggcga

SEQ ID NO: 1083730 - RNA, 16 nt, Mycobacterium bovis subsp bovis AF2122/97
ggucggggagcugcgg

SEQ ID NO: 1083731 - RNA, 18 nt, Mycobacterium bovis subsp bovis AF2122/97
ggucggggagcugcggcg

SEQ ID NO: 1083732 - RNA, 20 nt, Mycobacterium bovis subsp bovis AF2122/97
ggucggggagcugcggcggc

SEQ ID NO: 1083733 - RNA, 16 nt, Mycobacterium bovis subsp bovis AF2122/97
ggucgggucgaucacc

SEQ ID NO: 1083734 - RNA, 22 nt, Mycobacterium bovis subsp bovis AF2122/97
ggucgggucgaucaccgacacc

SEQ ID NO: 1083735 - RNA, 16 nt, Mycobacterium bovis subsp bovis AF2122/97
ggucgggacgcugccg

SEQ ID NO: 1083736 - RNA, 15 nt, Mycobacterium bovis subsp bovis AF2122/97
ggucggcuuccggug

SEQ ID NO: 1083737 - RNA, 22 nt, Mycobacterium bovis subsp bovis AF2122/97
ggucggcuuccggugccgggau

SEQ ID NO: 1083738 - RNA, 16 nt, Mycobacterium bovis subsp bovis AF2122/97
ggucguucaccgaucc

SEQ ID NO: 1083739 - RNA, 22 nt, Mycobacterium bovis subsp bovis AF2122/97
ggucguggugcaacacgccggc

SEQ ID NO: 1083740 - RNA, 15 nt, Mycobacterium bovis subsp bovis AF2122/97
ggucgugggccacca

SEQ ID NO: 1083741 - RNA, 18 nt, Mycobacterium bovis subsp bovis AF2122/97
ggucguugaggccgguga

SEQ ID NO: 1083742 - RNA, 16 nt, Mycobacterium bovis subsp bovis AF2122/97
ggucguucccgccggc

SEQ ID NO: 1083743 - RNA, 13 nt, Mycobacterium bovis subsp bovis AF2122/97
ggucguucgccga

SEQ ID NO: 1083744 - RNA, 17 nt, Mycobacterium bovis subsp bovis AF2122/97
ggucggggaacgcggcg

SEQ ID NO: 1083745 - RNA, 18 nt, Mycobacterium bovis subsp bovis AF2122/97
ggucgguaacggcggugc

SEQ ID NO: 1083746 - RNA, 23 nt, Mycobacterium bovis subsp bovis AF2122/97
ggucgguacccgcacccguugcg

SEQ ID NO: 1083747 - RNA, 15 nt, Mycobacterium bovis subsp bovis AF2122/97
ggugaucagcagcag

SEQ ID NO: 1083748 - RNA, 14 nt, Mycobacterium bovis subsp bovis AF2122/97
ggugaucagcagca

SEQ ID NO: 1083749 - RNA, 12 nt, Mycobacterium bovis subsp bovis AF2122/97
ggugaucgcaca

SEQ ID NO: 1083750 - RNA, 13 nt, Mycobacterium bovis subsp bovis AF2122/97
ggugaucgccacc

SEQ ID NO: 1083751 - RNA, 14 nt, Mycobacterium bovis subsp bovis AF2122/97
ggugaucgccaccg

SEQ ID NO: 1083752 - RNA, 17 nt, Mycobacterium bovis subsp bovis AF2122/97
ggugaucuccaccggcg

SEQ ID NO: 1083753 - RNA, 12 nt, Mycobacterium bovis subsp bovis AF2122/97
ggugaucggcgg

SEQ ID NO: 1083754 - RNA, 22 nt, Mycobacterium bovis subsp bovis AF2122/97
ggugaucagcucagugaugcgc

SEQ ID NO: 1083755 - RNA, 18 nt, Mycobacterium bovis subsp bovis AF2122/97
ggugauccagccgucggc

SEQ ID NO: 1083756 - RNA, 20 nt, Mycobacterium bovis subsp bovis AF2122/97
ggugaucgcgguggcggugu

SEQ ID NO: 1083757 - RNA, 19 nt, Mycobacterium bovis subsp bovis AF2122/97
ggugauguuggccgccaca

SEQ ID NO: 1083758 - RNA, 22 nt, Mycobacterium bovis subsp bovis AF2122/97
ggugauguuggccgccacaccg

SEQ ID NO: 1083759 - RNA, 22 nt, Mycobacterium bovis subsp bovis AF2122/97
ggugaugucggugcguccggug

SEQ ID NO: 1083760 - RNA, 22 nt, Mycobacterium bovis subsp bovis AF2122/97
ggugauguagggcugcuccugg

SEQ ID NO: 1083761 - RNA, 13 nt, Mycobacterium bovis subsp bovis AF2122/97
ggugcacggcgcu

SEQ ID NO: 1083762 - RNA, 20 nt, Mycobacterium bovis subsp bovis AF2122/97
ggugcacggcuuuucgacgc

SEQ ID NO: 1083763 - RNA, 18 nt, Mycobacterium bovis subsp bovis AF2122/97
ggugcacgccuugagccg

SEQ ID NO: 1083764 - RNA, 20 nt, Mycobacterium bovis subsp bovis AF2122/97
ggugcaccgaagauggccag

SEQ ID NO: 1083765 - RNA, 14 nt, Mycobacterium bovis subsp bovis AF2122/97
ggugcaccgauucc

SEQ ID NO: 1083766 - RNA, 15 nt, Mycobacterium bovis subsp bovis AF2122/97
ggugcaccgauucca

SEQ ID NO: 1083767 - RNA, 17 nt, Mycobacterium bovis subsp bovis AF2122/97
ggugcagaauucggcgc

SEQ ID NO: 1083768 - RNA, 18 nt, Mycobacterium bovis subsp bovis AF2122/97
ggugcagaauucggcgcg

SEQ ID NO: 1083769 - RNA, 14 nt, Mycobacterium bovis subsp bovis AF2122/97
ggugcagaccaccg

SEQ ID NO: 1083770 - RNA, 18 nt, Mycobacterium bovis subsp bovis AF2122/97
ggugcaacacgccggccc

SEQ ID NO: 1083771 - RNA, 18 nt, Mycobacterium bovis subsp bovis AF2122/97
ggugcacgguaucggugc

SEQ ID NO: 1083772 - RNA, 15 nt, Mycobacterium bovis subsp bovis AF2122/97
ggugcagaucggcuc

SEQ ID NO: 1083773 - RNA, 18 nt, Mycobacterium bovis subsp bovis AF2122/97
ggugcagaucggcucacc

SEQ ID NO: 1083774 - RNA, 22 nt, Mycobacterium bovis subsp bovis AF2122/97
ggugcagcaccagccacgccag

SEQ ID NO: 1083775 - RNA, 17 nt, Mycobacterium bovis subsp bovis AF2122/97
ggugauugcggccgccg

SEQ ID NO: 1083776 - RNA, 18 nt, Mycobacterium bovis subsp bovis AF2122/97
ggugauugcggccgccga

SEQ ID NO: 1083777 - RNA, 17 nt, Mycobacterium bovis subsp bovis AF2122/97
ggugauuggucacaccc

SEQ ID NO: 1083778 - RNA, 20 nt, Mycobacterium bovis subsp bovis AF2122/97
ggugcacaacgcccaccacg

SEQ ID NO: 1083779 - RNA, 13 nt, Mycobacterium bovis subsp bovis AF2122/97
ggugcacaccguc

SEQ ID NO: 1083780 - RNA, 23 nt, Mycobacterium bovis subsp bovis AF2122/97
ggugcaccauuguuccguccccg

SEQ ID NO: 1083781 - RNA, 21 nt, Mycobacterium bovis subsp bovis AF2122/97
ggugcaacaggcgcgucggug

SEQ ID NO: 1083782 - RNA, 13 nt, Mycobacterium bovis subsp bovis AF2122/97
ggugcaacgcgcc

SEQ ID NO: 1083783 - RNA, 16 nt, Mycobacterium bovis subsp bovis AF2122/97
ggugaccgcgggcgcc

SEQ ID NO: 1083784 - RNA, 15 nt, Mycobacterium bovis subsp bovis AF2122/97
ggugacccguucagc

SEQ ID NO: 1083785 - RNA, 17 nt, Mycobacterium bovis subsp bovis AF2122/97
ggugaccggcucggcgg

SEQ ID NO: 1083786 - RNA, 12 nt, Mycobacterium bovis subsp bovis AF2122/97
ggugagcaacgc

SEQ ID NO: 1083787 - RNA, 22 nt, Mycobacterium bovis subsp bovis AF2122/97
ggugagcaacgcgaccaucucg

SEQ ID NO: 1083788 - RNA, 13 nt, Mycobacterium bovis subsp bovis AF2122/97
ggugacccccaau

SEQ ID NO: 1083789 - RNA, 14 nt, Mycobacterium bovis subsp bovis AF2122/97
ggugaccgggucga

SEQ ID NO: 1083790 - RNA, 16 nt, Mycobacterium bovis subsp bovis AF2122/97
ggugacuucgcugcgg

SEQ ID NO: 1083791 - RNA, 19 nt, Mycobacterium bovis subsp bovis AF2122/97
ggugacuucgcugcggugg

SEQ ID NO: 1083792 - RNA, 20 nt, Mycobacterium bovis subsp bovis AF2122/97
ggugacuucgguggcgggcu

SEQ ID NO: 1083793 - RNA, 12 nt, Mycobacterium bovis subsp bovis AF2122/97
ggugagcgcgcu

SEQ ID NO: 1083794 - RNA, 17 nt, Mycobacterium bovis subsp bovis AF2122/97
ggugagcgagcgcgcgu

SEQ ID NO: 1083795 - RNA, 19 nt, Mycobacterium bovis subsp bovis AF2122/97
ggugagccucuuggucaac

SEQ ID NO: 1083796 - RNA, 21 nt, Mycobacterium bovis subsp bovis AF2122/97
ggugagccucuuggucaacgg

SEQ ID NO: 1083797 - RNA, 12 nt, Mycobacterium bovis subsp bovis AF2122/97
ggugagccgugc

SEQ ID NO: 1083798 - RNA, 19 nt, Mycobacterium bovis subsp bovis AF2122/97
ggugagccgugccgccagc

SEQ ID NO: 1083799 - RNA, 23 nt, Mycobacterium bovis subsp bovis AF2122/97
ggugagccgugccgccagcaacc

SEQ ID NO: 1083800 - RNA, 19 nt, Mycobacterium bovis subsp bovis AF2122/97
ggugagcccgggauaccgc

SEQ ID NO: 1083801 - RNA, 23 nt, Mycobacterium bovis subsp bovis AF2122/97
ggugagccgagccagcuccggcg

SEQ ID NO: 1083802 - RNA, 15 nt, Mycobacterium bovis subsp bovis AF2122/97
ggugagcaccggaua

SEQ ID NO: 1083803 - RNA, 13 nt, Mycobacterium bovis subsp bovis AF2122/97
ggugacaucgcga

SEQ ID NO: 1083804 - RNA, 17 nt, Mycobacterium bovis subsp bovis AF2122/97
ggugaccaacgucgacu

SEQ ID NO: 1083805 - RNA, 16 nt, Mycobacterium bovis subsp bovis AF2122/97
ggugaccaccccggcc

SEQ ID NO: 1083806 - RNA, 22 nt, Mycobacterium bovis subsp bovis AF2122/97
ggugacaagcgauuuggcgucg

SEQ ID NO: 1083807 - RNA, 19 nt, Mycobacterium bovis subsp bovis AF2122/97
ggugacaccaacaccggug

SEQ ID NO: 1083808 - RNA, 22 nt, Mycobacterium bovis subsp bovis AF2122/97
ggugacagagcggguucgacgu

SEQ ID NO: 1083809 - RNA, 16 nt, Mycobacterium bovis subsp bovis AF2122/97
ggugacagauccgccc

SEQ ID NO: 1083810 - RNA, 19 nt, Mycobacterium bovis subsp bovis AF2122/97
ggugacauagacguugccg

SEQ ID NO: 1083811 - RNA, 20 nt, Mycobacterium bovis subsp bovis AF2122/97
ggugaccacgccguggcccg

SEQ ID NO: 1083812 - RNA, 16 nt, Mycobacterium bovis subsp bovis AF2122/97
ggugaccagcaggccg

SEQ ID NO: 1083813 - RNA, 16 nt, Mycobacterium bovis subsp bovis AF2122/97
ggugaccaggccggcc

SEQ ID NO: 1083814 - RNA, 22 nt, Mycobacterium bovis subsp bovis AF2122/97
ggugaccaggccggcccgcaac

SEQ ID NO: 1083815 - RNA, 11 nt, Mycobacterium bovis subsp bovis AF2122/97
ggugaccacgc

SEQ ID NO: 1083816 - RNA, 14 nt, Mycobacterium bovis subsp bovis AF2122/97
ggugaccaggccgg

SEQ ID NO: 1083817 - RNA, 18 nt, Mycobacterium bovis subsp bovis AF2122/97
ggugaaguggcgcaccac

SEQ ID NO: 1083818 - RNA, 19 nt, Mycobacterium bovis subsp bovis AF2122/97
ggugaaguggcgcaccacc

SEQ ID NO: 1083819 - RNA, 20 nt, Mycobacterium bovis subsp bovis AF2122/97
ggucuuucacguagcgaccg

SEQ ID NO: 1083820 - RNA, 18 nt, Mycobacterium bovis subsp bovis AF2122/97
ggugaaggccccgccggu

SEQ ID NO: 1083821 - RNA, 19 nt, Mycobacterium bovis subsp bovis AF2122/97
ggugaaguagucggcgccg

SEQ ID NO: 1083822 - RNA, 22 nt, Mycobacterium bovis subsp bovis AF2122/97
ggugaaguagucggcgccgaga

SEQ ID NO: 1083823 - RNA, 19 nt, Mycobacterium bovis subsp bovis AF2122/97
ggugaaguagugcucgcag

SEQ ID NO: 1083824 - RNA, 21 nt, Mycobacterium bovis subsp bovis AF2122/97
ggugaaguccuccacgcuggc

SEQ ID NO: 1083825 - RNA, 16 nt, Mycobacterium bovis subsp bovis AF2122/97
ggugaaucgaagcccg

SEQ ID NO: 1083826 - RNA, 16 nt, Mycobacterium bovis subsp bovis AF2122/97
ggugaaucgacaccgc

SEQ ID NO: 1083827 - RNA, 17 nt, Mycobacterium bovis subsp bovis AF2122/97
ggugaaugccgucgccg

SEQ ID NO: 1083828 - RNA, 17 nt, Mycobacterium bovis subsp bovis AF2122/97
ggugaauguugccgccg

SEQ ID NO: 1083829 - RNA, 22 nt, Mycobacterium bovis subsp bovis AF2122/97
ggugaauucacgaugcucgccg

SEQ ID NO: 1083830 - RNA, 19 nt, Mycobacterium bovis subsp bovis AF2122/97
ggugaaucgucugacgaaa

SEQ ID NO: 1083831 - RNA, 13 nt, Mycobacterium bovis subsp bovis AF2122/97
gucgcguucggcc

SEQ ID NO: 1083832 - RNA, 16 nt, Mycobacterium bovis subsp bovis AF2122/97
gucgcguucuccggca

SEQ ID NO: 1083833 - RNA, 17 nt, Mycobacterium bovis subsp bovis AF2122/97
gucgcguucuccggcac

SEQ ID NO: 1083834 - RNA, 21 nt, Mycobacterium bovis subsp bovis AF2122/97
gucgcguuucgcagccgcacc

SEQ ID NO: 1083835 - RNA, 21 nt, Mycobacterium bovis subsp bovis AF2122/97
gucgcuacgcaacgggucggg

SEQ ID NO: 1083836 - RNA, 23 nt, Mycobacterium bovis subsp bovis AF2122/97
gucgcguccgcgaucugcagcgc

SEQ ID NO: 1083837 - RNA, 17 nt, Mycobacterium bovis subsp bovis AF2122/97
gucgcguccacccacga

SEQ ID NO: 1083838 - RNA, 13 nt, Mycobacterium bovis subsp bovis AF2122/97
gucgcgucgcagg

SEQ ID NO: 1083839 - RNA, 16 nt, Mycobacterium bovis subsp bovis AF2122/97
gucgcggucgcccgcu

SEQ ID NO: 1083840 - RNA, 21 nt, Mycobacterium bovis subsp bovis AF2122/97
gucgcguaccaacaggauggu

SEQ ID NO: 1083841 - RNA, 16 nt, Mycobacterium bovis subsp bovis AF2122/97
gucgcggugcggcaga

SEQ ID NO: 1083842 - RNA, 17 nt, Mycobacterium bovis subsp bovis AF2122/97
gucgcgguggcggcggu

SEQ ID NO: 1083843 - RNA, 16 nt, Mycobacterium bovis subsp bovis AF2122/97
gucgcgguaggcggga

SEQ ID NO: 1083844 - RNA, 20 nt, Mycobacterium bovis subsp bovis AF2122/97
gucgcgguaccaucaccgcg

SEQ ID NO: 1083845 - RNA, 21 nt, Mycobacterium bovis subsp bovis AF2122/97
gucgcgguaccaucaccgcgc

SEQ ID NO: 1083846 - RNA, 23 nt, Mycobacterium bovis subsp bovis AF2122/97
gucgcgguagccuggcuguccgc

SEQ ID NO: 1083847 - RNA, 16 nt, Mycobacterium bovis subsp bovis AF2122/97
gucgcggggccggaug

SEQ ID NO: 1083848 - RNA, 15 nt, Mycobacterium bovis subsp bovis AF2122/97
gucgcggguccaggc

SEQ ID NO: 1083849 - RNA, 22 nt, Mycobacterium bovis subsp bovis AF2122/97
gucgcggguguuccacaccagg

SEQ ID NO: 1083850 - RNA, 15 nt, Mycobacterium bovis subsp bovis AF2122/97
gucgcggcccgcgaa

SEQ ID NO: 1083851 - RNA, 12 nt, Mycobacterium bovis subsp bovis AF2122/97
gucgcggccgug

SEQ ID NO: 1083852 - RNA, 12 nt, Mycobacterium bovis subsp bovis AF2122/97
gucgcggccgag

SEQ ID NO: 1083853 - RNA, 12 nt, Mycobacterium bovis subsp bovis AF2122/97
gucgcggccgcc

SEQ ID NO: 1083854 - RNA, 21 nt, Mycobacterium bovis subsp bovis AF2122/97
gucgcggccgccccaggcugg

SEQ ID NO: 1083855 - RNA, 13 nt, Mycobacterium bovis subsp bovis AF2122/97
gucgcggccggcg

SEQ ID NO: 1083856 - RNA, 16 nt, Mycobacterium bovis subsp bovis AF2122/97
gucgcggccggcggcc

SEQ ID NO: 1083857 - RNA, 16 nt, Mycobacterium bovis subsp bovis AF2122/97
gucgcggccgucgcgg

SEQ ID NO: 1083858 - RNA, 22 nt, Mycobacterium bovis subsp bovis AF2122/97
gucgcggccgucgcgggacaac

SEQ ID NO: 1083859 - RNA, 23 nt, Mycobacterium bovis subsp bovis AF2122/97
gucgcgaugcuucccggaugccg

SEQ ID NO: 1083860 - RNA, 15 nt, Mycobacterium bovis subsp bovis AF2122/97
gucgcggcacgccca

SEQ ID NO: 1083861 - RNA, 15 nt, Mycobacterium bovis subsp bovis AF2122/97
gucgcggauugccgc

SEQ ID NO: 1083862 - RNA, 23 nt, Mycobacterium bovis subsp bovis AF2122/97
gucgcgaaacaccagacacuggc

SEQ ID NO: 1083863 - RNA, 18 nt, Mycobacterium bovis subsp bovis AF2122/97
gucgcgaaauagcugcgg

SEQ ID NO: 1083864 - RNA, 19 nt, Mycobacterium bovis subsp bovis AF2122/97
gucgcgaaauagcugcgga

SEQ ID NO: 1083865 - RNA, 21 nt, Mycobacterium bovis subsp bovis AF2122/97
gucgcgaaauagcugcggagg

SEQ ID NO: 1083866 - RNA, 19 nt, Mycobacterium bovis subsp bovis AF2122/97
gucgccggacugcggcccg

SEQ ID NO: 1083867 - RNA, 14 nt, Mycobacterium bovis subsp bovis AF2122/97
gucgccgcuuggcc

SEQ ID NO: 1083868 - RNA, 23 nt, Mycobacterium bovis subsp bovis AF2122/97
gucgccgcggcggcagcggcgau

SEQ ID NO: 1083869 - RNA, 17 nt, Mycobacterium bovis subsp bovis AF2122/97
gucgccgcggcggcagc

SEQ ID NO: 1083870 - RNA, 21 nt, Mycobacterium bovis subsp bovis AF2122/97
gucgccgcggcggcagcggcg

SEQ ID NO: 1083871 - RNA, 21 nt, Mycobacterium bovis subsp bovis AF2122/97
gucgccgcgcguuccagcaca

SEQ ID NO: 1083872 - RNA, 14 nt, Mycobacterium bovis subsp bovis AF2122/97
gucgccgcggcagc

SEQ ID NO: 1083873 - RNA, 15 nt, Mycobacterium bovis subsp bovis AF2122/97
gucgcgaguagcuga

SEQ ID NO: 1083874 - RNA, 19 nt, Mycobacterium bovis subsp bovis AF2122/97
gucgcgaggcucggucggc

SEQ ID NO: 1083875 - RNA, 16 nt, Mycobacterium bovis subsp bovis AF2122/97
gucgcgagguccagca

SEQ ID NO: 1083876 - RNA, 21 nt, Mycobacterium bovis subsp bovis AF2122/97
gucgcgaguagcugacccgcg

SEQ ID NO: 1083877 - RNA, 22 nt, Mycobacterium bovis subsp bovis AF2122/97
gucgcgaguagcugacccgcgg

SEQ ID NO: 1083878 - RNA, 13 nt, Mycobacterium bovis subsp bovis AF2122/97
gucgcgacgucgg

SEQ ID NO: 1083879 - RNA, 15 nt, Mycobacterium bovis subsp bovis AF2122/97
gucgcgacgucggcc

SEQ ID NO: 1083880 - RNA, 20 nt, Mycobacterium bovis subsp bovis AF2122/97
gucgcgacgacguagauggu

SEQ ID NO: 1083881 - RNA, 14 nt, Mycobacterium bovis subsp bovis AF2122/97
gucgcgauugccgc

SEQ ID NO: 1083882 - RNA, 17 nt, Mycobacterium bovis subsp bovis AF2122/97
gucgcggaucagcccgc

SEQ ID NO: 1083883 - RNA, 23 nt, Mycobacterium bovis subsp bovis AF2122/97
gucgcggaucauuccgacgaacc

SEQ ID NO: 1083884 - RNA, 14 nt, Mycobacterium bovis subsp bovis AF2122/97
gucgcggacggugc

SEQ ID NO: 1083885 - RNA, 23 nt, Mycobacterium bovis subsp bovis AF2122/97
gucgcgcaccggaucgccgucgc

SEQ ID NO: 1083886 - RNA, 14 nt, Mycobacterium bovis subsp bovis AF2122/97
gucgaucauggcgg

SEQ ID NO: 1083887 - RNA, 22 nt, Mycobacterium bovis subsp bovis AF2122/97
gucgcagcugccguuggggugg

SEQ ID NO: 1083888 - RNA, 13 nt, Mycobacterium bovis subsp bovis AF2122/97
gucgcaggaucgg

SEQ ID NO: 1083889 - RNA, 16 nt, Mycobacterium bovis subsp bovis AF2122/97
gucgcaggaucggcgg

SEQ ID NO: 1083890 - RNA, 13 nt, Mycobacterium bovis subsp bovis AF2122/97
gucgaucaccgac

SEQ ID NO: 1083891 - RNA, 21 nt, Mycobacterium bovis subsp bovis AF2122/97
gucgaucaugacgagccgagc

SEQ ID NO: 1083892 - RNA, 18 nt, Mycobacterium bovis subsp bovis AF2122/97
gucgaucacggccgucga

SEQ ID NO: 1083893 - RNA, 12 nt, Mycobacterium bovis subsp bovis AF2122/97
gucgaucaccga

SEQ ID NO: 1083894 - RNA, 23 nt, Mycobacterium bovis subsp bovis AF2122/97
gucgaucaacaccaacgacagcg

SEQ ID NO: 1083895 - RNA, 21 nt, Mycobacterium bovis subsp bovis AF2122/97
gucgaucaacaccaacgacag

SEQ ID NO: 1083896 - RNA, 20 nt, Mycobacterium bovis subsp bovis AF2122/97
gucgaucagcgcgacggucc

SEQ ID NO: 1083897 - RNA, 11 nt, Mycobacterium bovis subsp bovis AF2122/97
gucgaucagcg

SEQ ID NO: 1083898 - RNA, 20 nt, Mycobacterium bovis subsp bovis AF2122/97
gucgaucacguacgccgccg

SEQ ID NO: 1083899 - RNA, 22 nt, Mycobacterium bovis subsp bovis AF2122/97
gucgaucacguggugcggccgg

SEQ ID NO: 1083900 - RNA, 22 nt, Mycobacterium bovis subsp bovis AF2122/97
gucgauaagggcuugugguguc

SEQ ID NO: 1083901 - RNA, 14 nt, Mycobacterium bovis subsp bovis AF2122/97
gucgaguuggccau

SEQ ID NO: 1083902 - RNA, 19 nt, Mycobacterium bovis subsp bovis AF2122/97
gucgcaguauucacagucg

SEQ ID NO: 1083903 - RNA, 18 nt, Mycobacterium bovis subsp bovis AF2122/97
gucgaucauggcggcagc

SEQ ID NO: 1083904 - RNA, 14 nt, Mycobacterium bovis subsp bovis AF2122/97
gucgcagcucgucg

SEQ ID NO: 1083905 - RNA, 15 nt, Mycobacterium bovis subsp bovis AF2122/97
gucgcaucaggucgg

SEQ ID NO: 1083906 - RNA, 14 nt, Mycobacterium bovis subsp bovis AF2122/97
gucgcaucaccagg

SEQ ID NO: 1083907 - RNA, 16 nt, Mycobacterium bovis subsp bovis AF2122/97
gucgcaucaccagggu

SEQ ID NO: 1083908 - RNA, 22 nt, Mycobacterium bovis subsp bovis AF2122/97
gucgccaacgccagcaccagcg

SEQ ID NO: 1083909 - RNA, 22 nt, Mycobacterium bovis subsp bovis AF2122/97
gucgccagcucggcacccgccg

SEQ ID NO: 1083910 - RNA, 15 nt, Mycobacterium bovis subsp bovis AF2122/97
gucgccaggucaucg

SEQ ID NO: 1083911 - RNA, 22 nt, Mycobacterium bovis subsp bovis AF2122/97
gucgccaggcccccucggcgug

SEQ ID NO: 1083912 - RNA, 19 nt, Mycobacterium bovis subsp bovis AF2122/97
gucgccaagcccaggcgau

SEQ ID NO: 1083913 - RNA, 22 nt, Mycobacterium bovis subsp bovis AF2122/97
gucgccgcauugcagaaccgcc

SEQ ID NO: 1083914 - RNA, 13 nt, Mycobacterium bovis subsp bovis AF2122/97
gucgccgccacca

SEQ ID NO: 1083915 - RNA, 14 nt, Mycobacterium bovis subsp bovis AF2122/97
gucgccgccaccag

SEQ ID NO: 1083916 - RNA, 16 nt, Mycobacterium bovis subsp bovis AF2122/97
gucgccgccguugccg

SEQ ID NO: 1083917 - RNA, 21 nt, Mycobacterium bovis subsp bovis AF2122/97
gucgccgccuuacgcaccgau

SEQ ID NO: 1083918 - RNA, 18 nt, Mycobacterium bovis subsp bovis AF2122/97
gucgccgccgcuaccgcc

SEQ ID NO: 1083919 - RNA, 16 nt, Mycobacterium bovis subsp bovis AF2122/97
gucgccgccggcuccg

SEQ ID NO: 1083920 - RNA, 13 nt, Mycobacterium bovis subsp bovis AF2122/97
gucgccgccgggc

SEQ ID NO: 1083921 - RNA, 12 nt, Mycobacterium bovis subsp bovis AF2122/97
gucgccgccggu

SEQ ID NO: 1083922 - RNA, 13 nt, Mycobacterium bovis subsp bovis AF2122/97
gucgccgccguug

SEQ ID NO: 1083923 - RNA, 13 nt, Mycobacterium bovis subsp bovis AF2122/97
gucgccgcgcguu

SEQ ID NO: 1083924 - RNA, 15 nt, Mycobacterium bovis subsp bovis AF2122/97
gucgccgaucaccgc

SEQ ID NO: 1083925 - RNA, 17 nt, Mycobacterium bovis subsp bovis AF2122/97
gucgcccucgaucgcca

SEQ ID NO: 1083926 - RNA, 18 nt, Mycobacterium bovis subsp bovis AF2122/97
gucgcccggguggcgucg

SEQ ID NO: 1083927 - RNA, 16 nt, Mycobacterium bovis subsp bovis AF2122/97
gucgccagggccgccg

SEQ ID NO: 1083928 - RNA, 19 nt, Mycobacterium bovis subsp bovis AF2122/97
gucgccauccucgagcugc

SEQ ID NO: 1083929 - RNA, 20 nt, Mycobacterium bovis subsp bovis AF2122/97
gucgccccguuucggucgac

SEQ ID NO: 1083930 - RNA, 13 nt, Mycobacterium bovis subsp bovis AF2122/97
gucgcccgagucg

SEQ ID NO: 1083931 - RNA, 14 nt, Mycobacterium bovis subsp bovis AF2122/97
gucgcccgagucga

SEQ ID NO: 1083932 - RNA, 15 nt, Mycobacterium bovis subsp bovis AF2122/97
gucgcccgcacacag

SEQ ID NO: 1083933 - RNA, 12 nt, Mycobacterium bovis subsp bovis AF2122/97
gucggccggcgg

SEQ ID NO: 1083934 - RNA, 15 nt, Mycobacterium bovis subsp bovis AF2122/97
gucggccggcggucg

SEQ ID NO: 1083935 - RNA, 16 nt, Mycobacterium bovis subsp bovis AF2122/97
gucggccggcggucgc

SEQ ID NO: 1083936 - RNA, 14 nt, Mycobacterium bovis subsp bovis AF2122/97
gucggccggcucgu

SEQ ID NO: 1083937 - RNA, 21 nt, Mycobacterium bovis subsp bovis AF2122/97
gucggccggcaacgugcggug

SEQ ID NO: 1083938 - RNA, 21 nt, Mycobacterium bovis subsp bovis AF2122/97
gucggccggaugagcgaacgc

SEQ ID NO: 1083939 - RNA, 17 nt, Mycobacterium bovis subsp bovis AF2122/97
gucggccucggcggucg

SEQ ID NO: 1083940 - RNA, 17 nt, Mycobacterium bovis subsp bovis AF2122/97
gucggccugcggcaacg

SEQ ID NO: 1083941 - RNA, 19 nt, Mycobacterium bovis subsp bovis AF2122/97
gucggccugcgaacacgcg

SEQ ID NO: 1083942 - RNA, 13 nt, Mycobacterium bovis subsp bovis AF2122/97
gucggccggcucg

SEQ ID NO: 1083943 - RNA, 16 nt, Mycobacterium bovis subsp bovis AF2122/97
gucggcgagggcgcgc

SEQ ID NO: 1083944 - RNA, 17 nt, Mycobacterium bovis subsp bovis AF2122/97
gucggcgagggcgcgcc

SEQ ID NO: 1083945 - RNA, 13 nt, Mycobacterium bovis subsp bovis AF2122/97
gucggcgagcucg

SEQ ID NO: 1083946 - RNA, 16 nt, Mycobacterium bovis subsp bovis AF2122/97
gucggcgacggccagc

SEQ ID NO: 1083947 - RNA, 20 nt, Mycobacterium bovis subsp bovis AF2122/97
gucggcgacguagacggucc

SEQ ID NO: 1083948 - RNA, 22 nt, Mycobacterium bovis subsp bovis AF2122/97
gucggcgaucaacgcgcacgcg

SEQ ID NO: 1083949 - RNA, 17 nt, Mycobacterium bovis subsp bovis AF2122/97
gucggcgaugcgcacca

SEQ ID NO: 1083950 - RNA, 20 nt, Mycobacterium bovis subsp bovis AF2122/97
gucggcgaugaugcucgaca

SEQ ID NO: 1083951 - RNA, 12 nt, Mycobacterium bovis subsp bovis AF2122/97
gucggcgcaggc

SEQ ID NO: 1083952 - RNA, 16 nt, Mycobacterium bovis subsp bovis AF2122/97
gucggcgcaggcgugc

SEQ ID NO: 1083953 - RNA, 23 nt, Mycobacterium bovis subsp bovis AF2122/97
gucggcgaugaacagcgacgcca

SEQ ID NO: 1083954 - RNA, 12 nt, Mycobacterium bovis subsp bovis AF2122/97
gucggcgcccag

SEQ ID NO: 1083955 - RNA, 15 nt, Mycobacterium bovis subsp bovis AF2122/97
gucggcgcgccgcac

SEQ ID NO: 1083956 - RNA, 15 nt, Mycobacterium bovis subsp bovis AF2122/97
gucggcgcggccgug

SEQ ID NO: 1083957 - RNA, 16 nt, Mycobacterium bovis subsp bovis AF2122/97
gucggcgcucgucgcg

SEQ ID NO: 1083958 - RNA, 12 nt, Mycobacterium bovis subsp bovis AF2122/97
gucggcgcggcu

SEQ ID NO: 1083959 - RNA, 16 nt, Mycobacterium bovis subsp bovis AF2122/97
gucggcgcggcugucg

SEQ ID NO: 1083960 - RNA, 21 nt, Mycobacterium bovis subsp bovis AF2122/97
gucggccauccaccgcagauc

SEQ ID NO: 1083961 - RNA, 15 nt, Mycobacterium bovis subsp bovis AF2122/97
gucggccccggccgc

SEQ ID NO: 1083962 - RNA, 22 nt, Mycobacterium bovis subsp bovis AF2122/97
gucggccaugguguucggcagc

SEQ ID NO: 1083963 - RNA, 23 nt, Mycobacterium bovis subsp bovis AF2122/97
gucggccaugguguucggcagcg

SEQ ID NO: 1083964 - RNA, 17 nt, Mycobacterium bovis subsp bovis AF2122/97
gucggccauugcccggg

SEQ ID NO: 1083965 - RNA, 17 nt, Mycobacterium bovis subsp bovis AF2122/97
gucggcccacggugucc

SEQ ID NO: 1083966 - RNA, 23 nt, Mycobacterium bovis subsp bovis AF2122/97
gucggccaggucgagcaccggcu

SEQ ID NO: 1083967 - RNA, 17 nt, Mycobacterium bovis subsp bovis AF2122/97
gucggccaggucggcgu

SEQ ID NO: 1083968 - RNA, 19 nt, Mycobacterium bovis subsp bovis AF2122/97
gucggccaggcugccuccg

SEQ ID NO: 1083969 - RNA, 21 nt, Mycobacterium bovis subsp bovis AF2122/97
gucggcccggugcucaagcgc

SEQ ID NO: 1083970 - RNA, 14 nt, Mycobacterium bovis subsp bovis AF2122/97
gucggcccuccacc

SEQ ID NO: 1083971 - RNA, 23 nt, Mycobacterium bovis subsp bovis AF2122/97
gucggcccuccaccgguguuggu

SEQ ID NO: 1083972 - RNA, 16 nt, Mycobacterium bovis subsp bovis AF2122/97
gucggccgcaucgccc

SEQ ID NO: 1083973 - RNA, 19 nt, Mycobacterium bovis subsp bovis AF2122/97
gucggccagcucgcgggcc

SEQ ID NO: 1083974 - RNA, 13 nt, Mycobacterium bovis subsp bovis AF2122/97
gucggccacgcgc

SEQ ID NO: 1083975 - RNA, 12 nt, Mycobacterium bovis subsp bovis AF2122/97
gucggccaccgu

SEQ ID NO: 1083976 - RNA, 17 nt, Mycobacterium bovis subsp bovis AF2122/97
gucggccaccugcucgu

SEQ ID NO: 1083977 - RNA, 14 nt, Mycobacterium bovis subsp bovis AF2122/97
gucggccaccggcg

SEQ ID NO: 1083978 - RNA, 15 nt, Mycobacterium bovis subsp bovis AF2122/97
gucggccaccggcgu

SEQ ID NO: 1083979 - RNA, 13 nt, Mycobacterium bovis subsp bovis AF2122/97
gucggccaccgcg

SEQ ID NO: 1083980 - RNA, 22 nt, Mycobacterium bovis subsp bovis AF2122/97
gucggccaaagacccggcaccc

SEQ ID NO: 1083981 - RNA, 18 nt, Mycobacterium bovis subsp bovis AF2122/97
gucggccacauccagcgc

SEQ ID NO: 1083982 - RNA, 18 nt, Mycobacterium bovis subsp bovis AF2122/97
gucggcaugggccggcgc

SEQ ID NO: 1083983 - RNA, 23 nt, Mycobacterium bovis subsp bovis AF2122/97
gucggccaccaacucggcgaccu

SEQ ID NO: 1083984 - RNA, 13 nt, Mycobacterium bovis subsp bovis AF2122/97
gucggcaccgguu

SEQ ID NO: 1083985 - RNA, 16 nt, Mycobacterium bovis subsp bovis AF2122/97
gucggcaucgcgagcu

SEQ ID NO: 1083986 - RNA, 15 nt, Mycobacterium bovis subsp bovis AF2122/97
gucggcauugaucgg

SEQ ID NO: 1083987 - RNA, 19 nt, Mycobacterium bovis subsp bovis AF2122/97
gucggcauugaucggugcc

SEQ ID NO: 1083988 - RNA, 17 nt, Mycobacterium bovis subsp bovis AF2122/97
gucggccaaagacccgg

SEQ ID NO: 1083989 - RNA, 19 nt, Mycobacterium bovis subsp bovis AF2122/97
gucgcugugcagcggguug

SEQ ID NO: 1083990 - RNA, 14 nt, Mycobacterium bovis subsp bovis AF2122/97
gucgcugguggcgg

SEQ ID NO: 1083991 - RNA, 17 nt, Mycobacterium bovis subsp bovis AF2122/97
gucgcugggaggcgcgg

SEQ ID NO: 1083992 - RNA, 22 nt, Mycobacterium bovis subsp bovis AF2122/97
gucgcugggaggcgcggucgac

SEQ ID NO: 1083993 - RNA, 23 nt, Mycobacterium bovis subsp bovis AF2122/97
gucgcugggaggcgcggucgacc

SEQ ID NO: 1083994 - RNA, 16 nt, Mycobacterium bovis subsp bovis AF2122/97
gucgcuggccggcacc

SEQ ID NO: 1083995 - RNA, 14 nt, Mycobacterium bovis subsp bovis AF2122/97
gucgcuggccguag

SEQ ID NO: 1083996 - RNA, 20 nt, Mycobacterium bovis subsp bovis AF2122/97
gucgcugcuugcgggcucgu

SEQ ID NO: 1083997 - RNA, 13 nt, Mycobacterium bovis subsp bovis AF2122/97
gucgcuggccagg

SEQ ID NO: 1083998 - RNA, 19 nt, Mycobacterium bovis subsp bovis AF2122/97
gucgcuggccaggccggca

SEQ ID NO: 1083999 - RNA, 14 nt, Mycobacterium bovis subsp bovis AF2122/97
gucgcugccgccgu

SEQ ID NO: 1084000 - RNA, 11 nt, Mycobacterium bovis subsp bovis AF2122/97
gucgcugcccg

SEQ ID NO: 1084001 - RNA, 23 nt, Mycobacterium bovis subsp bovis AF2122/97
gucgcugccgccgccggcggucg

SEQ ID NO: 1084002 - RNA, 21 nt, Mycobacterium bovis subsp bovis AF2122/97
gucgcugccgccgccggcggu

SEQ ID NO: 1084003 - RNA, 15 nt, Mycobacterium bovis subsp bovis AF2122/97
gucgcugcgcuggua

SEQ ID NO: 1084004 - RNA, 17 nt, Mycobacterium bovis subsp bovis AF2122/97
gucgcugcugccgcacc

SEQ ID NO: 1084005 - RNA, 22 nt, Mycobacterium bovis subsp bovis AF2122/97
gucgcugaacagacggcucagc

SEQ ID NO: 1084006 - RNA, 16 nt, Mycobacterium bovis subsp bovis AF2122/97
gucgcugaagccgucg

SEQ ID NO: 1084007 - RNA, 22 nt, Mycobacterium bovis subsp bovis AF2122/97
gucgcugagcacggcgcggcgg

SEQ ID NO: 1084008 - RNA, 15 nt, Mycobacterium bovis subsp bovis AF2122/97
gucgcugagcagcgc

SEQ ID NO: 1084009 - RNA, 17 nt, Mycobacterium bovis subsp bovis AF2122/97
gucgcugcaaccgccgg

SEQ ID NO: 1084010 - RNA, 20 nt, Mycobacterium bovis subsp bovis AF2122/97
gucgcugauccgggcgccga

SEQ ID NO: 1084011 - RNA, 20 nt, Mycobacterium bovis subsp bovis AF2122/97
gucgcugacgcccuccuggc

SEQ ID NO: 1084012 - RNA, 22 nt, Mycobacterium bovis subsp bovis AF2122/97
gucgcugacgcccuccuggcgg

SEQ ID NO: 1084013 - RNA, 14 nt, Mycobacterium bovis subsp bovis AF2122/97
gucgcucgcgguca

SEQ ID NO: 1084014 - RNA, 23 nt, Mycobacterium bovis subsp bovis AF2122/97
gucgcucccgguugggguggcgg

SEQ ID NO: 1084015 - RNA, 20 nt, Mycobacterium bovis subsp bovis AF2122/97
gucgcuauccggcggccagu

SEQ ID NO: 1084016 - RNA, 16 nt, Mycobacterium bovis subsp bovis AF2122/97
gucgcucaguuuggcg

SEQ ID NO: 1084017 - RNA, 22 nt, Mycobacterium bovis subsp bovis AF2122/97
gucggagucgacggucacggug

SEQ ID NO: 1084018 - RNA, 12 nt, Mycobacterium bovis subsp bovis AF2122/97
gucggagccggc

SEQ ID NO: 1084019 - RNA, 21 nt, Mycobacterium bovis subsp bovis AF2122/97
gucggaucgauuccgccgcac

SEQ ID NO: 1084020 - RNA, 21 nt, Mycobacterium bovis subsp bovis AF2122/97
gucggauagccucggcggcgc

SEQ ID NO: 1084021 - RNA, 15 nt, Mycobacterium bovis subsp bovis AF2122/97
gucggcaacgacccg

SEQ ID NO: 1084022 - RNA, 17 nt, Mycobacterium bovis subsp bovis AF2122/97
gucggcaaagcgcucgu

SEQ ID NO: 1084023 - RNA, 23 nt, Mycobacterium bovis subsp bovis AF2122/97
gucggcaaccaaccgcgcgagcc

SEQ ID NO: 1084024 - RNA, 18 nt, Mycobacterium bovis subsp bovis AF2122/97
gucggauggaaggcggcc

SEQ ID NO: 1084025 - RNA, 15 nt, Mycobacterium bovis subsp bovis AF2122/97
gucggcaaacaacga

SEQ ID NO: 1084026 - RNA, 20 nt, Mycobacterium bovis subsp bovis AF2122/97
gucggcaaagaaggcgaccc

SEQ ID NO: 1084027 - RNA, 22 nt, Mycobacterium bovis subsp bovis AF2122/97
gucggcaauacuccgcugacga

SEQ ID NO: 1084028 - RNA, 23 nt, Mycobacterium bovis subsp bovis AF2122/97
gucggcaaugucuucgauaccga

SEQ ID NO: 1084029 - RNA, 17 nt, Mycobacterium bovis subsp bovis AF2122/97
gucggcaccaccacgcc

SEQ ID NO: 1084030 - RNA, 20 nt, Mycobacterium bovis subsp bovis AF2122/97
gucggcaccaccacgccgac

SEQ ID NO: 1084031 - RNA, 14 nt, Mycobacterium bovis subsp bovis AF2122/97
gucggcaccagcag

SEQ ID NO: 1084032 - RNA, 15 nt, Mycobacterium bovis subsp bovis AF2122/97
gucggcagaccgacc

SEQ ID NO: 1084033 - RNA, 14 nt, Mycobacterium bovis subsp bovis AF2122/97
gucggcacgacccg

SEQ ID NO: 1084034 - RNA, 15 nt, Mycobacterium bovis subsp bovis AF2122/97
gucggcacgacccgg

SEQ ID NO: 1084035 - RNA, 13 nt, Mycobacterium bovis subsp bovis AF2122/97
gucggcagcagcg

SEQ ID NO: 1084036 - RNA, 14 nt, Mycobacterium bovis subsp bovis AF2122/97
gucggcagcgacgc

SEQ ID NO: 1084037 - RNA, 17 nt, Mycobacterium bovis subsp bovis AF2122/97
gucggcagcuccagcaa

SEQ ID NO: 1084038 - RNA, 20 nt, Mycobacterium bovis subsp bovis AF2122/97
gucggcagcuucucgccgac

SEQ ID NO: 1084039 - RNA, 21 nt, Mycobacterium bovis subsp bovis AF2122/97
gucggcagcuucucgccgacg

SEQ ID NO: 1084040 - RNA, 22 nt, Mycobacterium bovis subsp bovis AF2122/97
gucggcagcuucucgccgacga

SEQ ID NO: 1084041 - RNA, 13 nt, Mycobacterium bovis subsp bovis AF2122/97
gucggagcgggga

SEQ ID NO: 1084042 - RNA, 17 nt, Mycobacterium bovis subsp bovis AF2122/97
gucggagcgggugcggg

SEQ ID NO: 1084043 - RNA, 14 nt, Mycobacterium bovis subsp bovis AF2122/97
gucggagaccagcg

SEQ ID NO: 1084044 - RNA, 14 nt, Mycobacterium bovis subsp bovis AF2122/97
gucggacagcgagu

SEQ ID NO: 1084045 - RNA, 17 nt, Mycobacterium bovis subsp bovis AF2122/97
gucggacauaccgcgaa

SEQ ID NO: 1084046 - RNA, 22 nt, Mycobacterium bovis subsp bovis AF2122/97
gucggacaugccgagguaacgc

SEQ ID NO: 1084047 - RNA, 18 nt, Mycobacterium bovis subsp bovis AF2122/97
gucggaccacccggcgcg

SEQ ID NO: 1084048 - RNA, 17 nt, Mycobacterium bovis subsp bovis AF2122/97
gucggaccagcugccgg

SEQ ID NO: 1084049 - RNA, 20 nt, Mycobacterium bovis subsp bovis AF2122/97
gucggaccagcugccggcga

SEQ ID NO: 1084050 - RNA, 15 nt, Mycobacterium bovis subsp bovis AF2122/97
gucggacggccaucg

SEQ ID NO: 1084051 - RNA, 11 nt, Mycobacterium bovis subsp bovis AF2122/97
gucggacgggu

SEQ ID NO: 1084052 - RNA, 15 nt, Mycobacterium bovis subsp bovis AF2122/97
gucgcuucagcgcca

SEQ ID NO: 1084053 - RNA, 18 nt, Mycobacterium bovis subsp bovis AF2122/97
gucggacacguggcguug

SEQ ID NO: 1084054 - RNA, 19 nt, Mycobacterium bovis subsp bovis AF2122/97
gucggaaugccgucgccgg

SEQ ID NO: 1084055 - RNA, 18 nt, Mycobacterium bovis subsp bovis AF2122/97
gucggaaugggcgccaca

SEQ ID NO: 1084056 - RNA, 22 nt, Mycobacterium bovis subsp bovis AF2122/97
gucggaaugggcgccacagccg

SEQ ID NO: 1084057 - RNA, 19 nt, Mycobacterium bovis subsp bovis AF2122/97
guccuccgacgggggucgg

SEQ ID NO: 1084058 - RNA, 19 nt, Mycobacterium bovis subsp bovis AF2122/97
guccuccacgcuggcgccc

SEQ ID NO: 1084059 - RNA, 20 nt, Mycobacterium bovis subsp bovis AF2122/97
guccuccacuuuuccgccgg

SEQ ID NO: 1084060 - RNA, 18 nt, Mycobacterium bovis subsp bovis AF2122/97
guccuccagcugcgcggg

SEQ ID NO: 1084061 - RNA, 18 nt, Mycobacterium bovis subsp bovis AF2122/97
guccuaucagugagccgc

SEQ ID NO: 1084062 - RNA, 18 nt, Mycobacterium bovis subsp bovis AF2122/97
guccuauuugcagccuuc

SEQ ID NO: 1084063 - RNA, 19 nt, Mycobacterium bovis subsp bovis AF2122/97
guccuaauucggggccgcg

SEQ ID NO: 1084064 - RNA, 22 nt, Mycobacterium bovis subsp bovis AF2122/97
guccuccaaggcggucaccacc

SEQ ID NO: 1084065 - RNA, 18 nt, Mycobacterium bovis subsp bovis AF2122/97
guccucacgggucagcau

SEQ ID NO: 1084066 - RNA, 15 nt, Mycobacterium bovis subsp bovis AF2122/97
guccucaucgagcgc

SEQ ID NO: 1084067 - RNA, 17 nt, Mycobacterium bovis subsp bovis AF2122/97
guccucaucguuccacg

SEQ ID NO: 1084068 - RNA, 13 nt, Mycobacterium bovis subsp bovis AF2122/97
guccucgaucgcg

SEQ ID NO: 1084069 - RNA, 17 nt, Mycobacterium bovis subsp bovis AF2122/97
guccucgaucgcgcaga

SEQ ID NO: 1084070 - RNA, 20 nt, Mycobacterium bovis subsp bovis AF2122/97
guccucgacgaucagcacgu

SEQ ID NO: 1084071 - RNA, 17 nt, Mycobacterium bovis subsp bovis AF2122/97
guccucgagugccgccg

SEQ ID NO: 1084072 - RNA, 18 nt, Mycobacterium bovis subsp bovis AF2122/97
guccucgagugccgccgu

SEQ ID NO: 1084073 - RNA, 21 nt, Mycobacterium bovis subsp bovis AF2122/97
guccucgagugccgccgucgc

SEQ ID NO: 1084074 - RNA, 19 nt, Mycobacterium bovis subsp bovis AF2122/97
guccucgcggagccgucgc

SEQ ID NO: 1084075 - RNA, 21 nt, Mycobacterium bovis subsp bovis AF2122/97
guccucgaucagacgcucgac

SEQ ID NO: 1084076 - RNA, 20 nt, Mycobacterium bovis subsp bovis AF2122/97
guccucgcggagccgucgca

SEQ ID NO: 1084077 - RNA, 11 nt, Mycobacterium bovis subsp bovis AF2122/97
guccucggcga

SEQ ID NO: 1084078 - RNA, 20 nt, Mycobacterium bovis subsp bovis AF2122/97
guccugcuuguagcgcaucg

SEQ ID NO: 1084079 - RNA, 21 nt, Mycobacterium bovis subsp bovis AF2122/97
guccugcgagaggugcugcac

SEQ ID NO: 1084080 - RNA, 16 nt, Mycobacterium bovis subsp bovis AF2122/97
guccugcagcuggcga

SEQ ID NO: 1084081 - RNA, 14 nt, Mycobacterium bovis subsp bovis AF2122/97
guccucgucggugu

SEQ ID NO: 1084082 - RNA, 13 nt, Mycobacterium bovis subsp bovis AF2122/97
guccucgucggcg

SEQ ID NO: 1084083 - RNA, 22 nt, Mycobacterium bovis subsp bovis AF2122/97
guccucgggcaggcggccagcg

SEQ ID NO: 1084084 - RNA, 20 nt, Mycobacterium bovis subsp bovis AF2122/97
gucgaagaaccggccgacga

SEQ ID NO: 1084085 - RNA, 15 nt, Mycobacterium bovis subsp bovis AF2122/97
gucgaagaucgagcc

SEQ ID NO: 1084086 - RNA, 13 nt, Mycobacterium bovis subsp bovis AF2122/97
gucgaagccgggg

SEQ ID NO: 1084087 - RNA, 23 nt, Mycobacterium bovis subsp bovis AF2122/97
guccuggauaugcuccggccgca

SEQ ID NO: 1084088 - RNA, 15 nt, Mycobacterium bovis subsp bovis AF2122/97
guccuggaucagcca

SEQ ID NO: 1084089 - RNA, 15 nt, Mycobacterium bovis subsp bovis AF2122/97
guccugggccgccgc

SEQ ID NO: 1084090 - RNA, 17 nt, Mycobacterium bovis subsp bovis AF2122/97
guccugggccgccgccc

SEQ ID NO: 1084091 - RNA, 14 nt, Mycobacterium bovis subsp bovis AF2122/97
guccuggcucggca

SEQ ID NO: 1084092 - RNA, 19 nt, Mycobacterium bovis subsp bovis AF2122/97
gucgaacuugaucaccgcg

SEQ ID NO: 1084093 - RNA, 21 nt, Mycobacterium bovis subsp bovis AF2122/97
gucgaacuuugucgcgcugcu

SEQ ID NO: 1084094 - RNA, 23 nt, Mycobacterium bovis subsp bovis AF2122/97
gucgaauccucgcgaaaccgccg

SEQ ID NO: 1084095 - RNA, 19 nt, Mycobacterium bovis subsp bovis AF2122/97
gucgaauccugccgcacgg

SEQ ID NO: 1084096 - RNA, 18 nt, Mycobacterium bovis subsp bovis AF2122/97
gucgaaucgcugccgccg

SEQ ID NO: 1084097 - RNA, 21 nt, Mycobacterium bovis subsp bovis AF2122/97
gucgaaucgcugccgccgauc

SEQ ID NO: 1084098 - RNA, 19 nt, Mycobacterium bovis subsp bovis AF2122/97
gucgaauaguugaccaggc

SEQ ID NO: 1084099 - RNA, 22 nt, Mycobacterium bovis subsp bovis AF2122/97
gucgaauaguugaccaggccga

SEQ ID NO: 1084100 - RNA, 23 nt, Mycobacterium bovis subsp bovis AF2122/97
gucgaagugggugaaccggaccu

SEQ ID NO: 1084101 - RNA, 22 nt, Mycobacterium bovis subsp bovis AF2122/97
gucgaaguuggcgaagcccgac

SEQ ID NO: 1084102 - RNA, 16 nt, Mycobacterium bovis subsp bovis AF2122/97
gucgaaggugaccagg

SEQ ID NO: 1084103 - RNA, 14 nt, Mycobacterium bovis subsp bovis AF2122/97
gucgacacggugau

SEQ ID NO: 1084104 - RNA, 17 nt, Mycobacterium bovis subsp bovis AF2122/97
gucgacaccgcggugcc

SEQ ID NO: 1084105 - RNA, 21 nt, Mycobacterium bovis subsp bovis AF2122/97
gucgacaccgcggugccccgg

SEQ ID NO: 1084106 - RNA, 17 nt, Mycobacterium bovis subsp bovis AF2122/97
gucgacacgccgaacgu

SEQ ID NO: 1084107 - RNA, 15 nt, Mycobacterium bovis subsp bovis AF2122/97
gucgacacccgcacg

SEQ ID NO: 1084108 - RNA, 19 nt, Mycobacterium bovis subsp bovis AF2122/97
gucgacaccgaggaccucg

SEQ ID NO: 1084109 - RNA, 23 nt, Mycobacterium bovis subsp bovis AF2122/97
gucgaaugggggcuggucgccgu

SEQ ID NO: 1084110 - RNA, 22 nt, Mycobacterium bovis subsp bovis AF2122/97
gucgaaugucccgguguccagc

SEQ ID NO: 1084111 - RNA, 13 nt, Mycobacterium bovis subsp bovis AF2122/97
gucgaaucguguc

SEQ ID NO: 1084112 - RNA, 11 nt, Mycobacterium bovis subsp bovis AF2122/97
gucgacaaacc

SEQ ID NO: 1084113 - RNA, 21 nt, Mycobacterium bovis subsp bovis AF2122/97
gucgacaaccgcugccgcauc

SEQ ID NO: 1084114 - RNA, 20 nt, Mycobacterium bovis subsp bovis AF2122/97
gucgacaacgaucgcgcgag

SEQ ID NO: 1084115 - RNA, 22 nt, Mycobacterium bovis subsp bovis AF2122/97
gucgacaacgaucgcgcgagcg

SEQ ID NO: 1084116 - RNA, 23 nt, Mycobacterium bovis subsp bovis AF2122/97
gucgaaguagccgacgucgccgg

SEQ ID NO: 1084117 - RNA, 22 nt, Mycobacterium bovis subsp bovis AF2122/97
gucgacgugaucgcgguccaac

SEQ ID NO: 1084118 - RNA, 14 nt, Mycobacterium bovis subsp bovis AF2122/97
gucgacgucggugu

SEQ ID NO: 1084119 - RNA, 16 nt, Mycobacterium bovis subsp bovis AF2122/97
gucgacgucgauggug

SEQ ID NO: 1084120 - RNA, 13 nt, Mycobacterium bovis subsp bovis AF2122/97
gucgacgucggca

SEQ ID NO: 1084121 - RNA, 14 nt, Mycobacterium bovis subsp bovis AF2122/97
gucgacgucggcga

SEQ ID NO: 1084122 - RNA, 16 nt, Mycobacterium bovis subsp bovis AF2122/97
gucgacgucggcgagc

SEQ ID NO: 1084123 - RNA, 22 nt, Mycobacterium bovis subsp bovis AF2122/97
gucgacguugaugaccuguccg

SEQ ID NO: 1084124 - RNA, 18 nt, Mycobacterium bovis subsp bovis AF2122/97
gucgacugcgugccgcac

SEQ ID NO: 1084125 - RNA, 21 nt, Mycobacterium bovis subsp bovis AF2122/97
gucgacugcgugccgcaccgc

SEQ ID NO: 1084126 - RNA, 20 nt, Mycobacterium bovis subsp bovis AF2122/97
gucgacucguggcgccacgg

SEQ ID NO: 1084127 - RNA, 16 nt, Mycobacterium bovis subsp bovis AF2122/97
gucgacucggcggcgc

SEQ ID NO: 1084128 - RNA, 17 nt, Mycobacterium bovis subsp bovis AF2122/97
gucgacucggcggcgcg

SEQ ID NO: 1084129 - RNA, 23 nt, Mycobacterium bovis subsp bovis AF2122/97
gucgacgugaucgcgguccaaca

SEQ ID NO: 1084130 - RNA, 21 nt, Mycobacterium bovis subsp bovis AF2122/97
gucgacuccagcaccagcacg

SEQ ID NO: 1084131 - RNA, 13 nt, Mycobacterium bovis subsp bovis AF2122/97
gucgacuccgauc

SEQ ID NO: 1084132 - RNA, 18 nt, Mycobacterium bovis subsp bovis AF2122/97
gucgacuccgaucgggcc

SEQ ID NO: 1084133 - RNA, 18 nt, Mycobacterium bovis subsp bovis AF2122/97
gucgacugggacgacgcc

SEQ ID NO: 1084134 - RNA, 16 nt, Mycobacterium bovis subsp bovis AF2122/97
gucgacuucagcggcc

SEQ ID NO: 1084135 - RNA, 16 nt, Mycobacterium bovis subsp bovis AF2122/97
gucgacuugcaggcgu

SEQ ID NO: 1084136 - RNA, 18 nt, Mycobacterium bovis subsp bovis AF2122/97
gucgagccggugccgcgg

SEQ ID NO: 1084137 - RNA, 14 nt, Mycobacterium bovis subsp bovis AF2122/97
gucgagccggugcc

SEQ ID NO: 1084138 - RNA, 14 nt, Mycobacterium bovis subsp bovis AF2122/97
gucgagcgccgcgg

SEQ ID NO: 1084139 - RNA, 17 nt, Mycobacterium bovis subsp bovis AF2122/97
gucgagcgccggccgcg

SEQ ID NO: 1084140 - RNA, 19 nt, Mycobacterium bovis subsp bovis AF2122/97
gucgagcgaccccacacgc

SEQ ID NO: 1084141 - RNA, 22 nt, Mycobacterium bovis subsp bovis AF2122/97
gucgagucgccgaggacgccgg

SEQ ID NO: 1084142 - RNA, 19 nt, Mycobacterium bovis subsp bovis AF2122/97
gucgaguucgcagucgaug

SEQ ID NO: 1084143 - RNA, 18 nt, Mycobacterium bovis subsp bovis AF2122/97
gucgagucgguccugcca

SEQ ID NO: 1084144 - RNA, 15 nt, Mycobacterium bovis subsp bovis AF2122/97
gucgagugccgccac

SEQ ID NO: 1084145 - RNA, 21 nt, Mycobacterium bovis subsp bovis AF2122/97
gucgagugccgccaccgccac

SEQ ID NO: 1084146 - RNA, 15 nt, Mycobacterium bovis subsp bovis AF2122/97
gucgagucgaugacc

SEQ ID NO: 1084147 - RNA, 13 nt, Mycobacterium bovis subsp bovis AF2122/97
gucgagucgccga

SEQ ID NO: 1084148 - RNA, 14 nt, Mycobacterium bovis subsp bovis AF2122/97
gucgagucgccgag

SEQ ID NO: 1084149 - RNA, 17 nt, Mycobacterium bovis subsp bovis AF2122/97
gucgaguauugcaggaa

SEQ ID NO: 1084150 - RNA, 15 nt, Mycobacterium bovis subsp bovis AF2122/97
gucgaguccacagcg

SEQ ID NO: 1084151 - RNA, 13 nt, Mycobacterium bovis subsp bovis AF2122/97
gucgagcgcggug

SEQ ID NO: 1084152 - RNA, 20 nt, Mycobacterium bovis subsp bovis AF2122/97
gucgagcgucugcgaucccg

SEQ ID NO: 1084153 - RNA, 19 nt, Mycobacterium bovis subsp bovis AF2122/97
gucgagcgcgucggucacc

SEQ ID NO: 1084154 - RNA, 18 nt, Mycobacterium bovis subsp bovis AF2122/97
gucgagcguggcgacggg

SEQ ID NO: 1084155 - RNA, 19 nt, Mycobacterium bovis subsp bovis AF2122/97
gucgagcguggcgacggga

SEQ ID NO: 1084156 - RNA, 19 nt, Mycobacterium bovis subsp bovis AF2122/97
gucgacaguuuucaccgcg

SEQ ID NO: 1084157 - RNA, 19 nt, Mycobacterium bovis subsp bovis AF2122/97
gucgaccgugucaccgccg

SEQ ID NO: 1084158 - RNA, 20 nt, Mycobacterium bovis subsp bovis AF2122/97
gucgaccgugucaccgccgg

SEQ ID NO: 1084159 - RNA, 21 nt, Mycobacterium bovis subsp bovis AF2122/97
gucgaccggacaaagcugcuc

SEQ ID NO: 1084160 - RNA, 22 nt, Mycobacterium bovis subsp bovis AF2122/97
gucgaccggacaaagcugcucg

SEQ ID NO: 1084161 - RNA, 14 nt, Mycobacterium bovis subsp bovis AF2122/97
gucgacggccaccc

SEQ ID NO: 1084162 - RNA, 22 nt, Mycobacterium bovis subsp bovis AF2122/97
gucgacggccuggggcagccgg

SEQ ID NO: 1084163 - RNA, 12 nt, Mycobacterium bovis subsp bovis AF2122/97
gucgacggcggc

SEQ ID NO: 1084164 - RNA, 15 nt, Mycobacterium bovis subsp bovis AF2122/97
gucgacgcugugggc

SEQ ID NO: 1084165 - RNA, 14 nt, Mycobacterium bovis subsp bovis AF2122/97
gucgacggucaccg

SEQ ID NO: 1084166 - RNA, 21 nt, Mycobacterium bovis subsp bovis AF2122/97
gucgacggucaccggcgcacc

SEQ ID NO: 1084167 - RNA, 16 nt, Mycobacterium bovis subsp bovis AF2122/97
gucgacggugccgucg

SEQ ID NO: 1084168 - RNA, 14 nt, Mycobacterium bovis subsp bovis AF2122/97
gucgacgguggcgc

SEQ ID NO: 1084169 - RNA, 22 nt, Mycobacterium bovis subsp bovis AF2122/97
gucgacggggaacguccgcgcc

SEQ ID NO: 1084170 - RNA, 18 nt, Mycobacterium bovis subsp bovis AF2122/97
gucgacggggcggucggc

SEQ ID NO: 1084171 - RNA, 21 nt, Mycobacterium bovis subsp bovis AF2122/97
gucgacggggcggucggccgg

SEQ ID NO: 1084172 - RNA, 16 nt, Mycobacterium bovis subsp bovis AF2122/97
gucgacgggucggcgc

SEQ ID NO: 1084173 - RNA, 18 nt, Mycobacterium bovis subsp bovis AF2122/97
gucgacgggcacgcggcg

SEQ ID NO: 1084174 - RNA, 19 nt, Mycobacterium bovis subsp bovis AF2122/97
gucgacgggcacgcggcga

SEQ ID NO: 1084175 - RNA, 13 nt, Mycobacterium bovis subsp bovis AF2122/97
gucgacgucgauc

SEQ ID NO: 1084176 - RNA, 16 nt, Mycobacterium bovis subsp bovis AF2122/97
gucgacccugcccagc

SEQ ID NO: 1084177 - RNA, 21 nt, Mycobacterium bovis subsp bovis AF2122/97
gucgaccgaaacggggcgacg

SEQ ID NO: 1084178 - RNA, 15 nt, Mycobacterium bovis subsp bovis AF2122/97
gucgaccacccgcag

SEQ ID NO: 1084179 - RNA, 16 nt, Mycobacterium bovis subsp bovis AF2122/97
gucgaccacccgcagg

SEQ ID NO: 1084180 - RNA, 21 nt, Mycobacterium bovis subsp bovis AF2122/97
gucgaccgcggcccggacguc

SEQ ID NO: 1084181 - RNA, 16 nt, Mycobacterium bovis subsp bovis AF2122/97
gucgaccacgaauggg

SEQ ID NO: 1084182 - RNA, 12 nt, Mycobacterium bovis subsp bovis AF2122/97
gucgaccacgac

SEQ ID NO: 1084183 - RNA, 15 nt, Mycobacterium bovis subsp bovis AF2122/97
gucgaccacgaccgu

SEQ ID NO: 1084184 - RNA, 21 nt, Mycobacterium bovis subsp bovis AF2122/97
gucgaccaagguguccagcac

SEQ ID NO: 1084185 - RNA, 21 nt, Mycobacterium bovis subsp bovis AF2122/97
gucgaccaauuggucgagucg

SEQ ID NO: 1084186 - RNA, 20 nt, Mycobacterium bovis subsp bovis AF2122/97
gucgacaguucaacgggccu

SEQ ID NO: 1084187 - RNA, 22 nt, Mycobacterium bovis subsp bovis AF2122/97
gucgacagcgaaggcgccgaac

SEQ ID NO: 1084188 - RNA, 23 nt, Mycobacterium bovis subsp bovis AF2122/97
gucgacaggugccagaccagggc

SEQ ID NO: 1084189 - RNA, 19 nt, Mycobacterium bovis subsp bovis AF2122/97
guccgucgcguccgcgauc

SEQ ID NO: 1084190 - RNA, 14 nt, Mycobacterium bovis subsp bovis AF2122/97
guccguggacaagc

SEQ ID NO: 1084191 - RNA, 17 nt, Mycobacterium bovis subsp bovis AF2122/97
guccgugaguacggugu

SEQ ID NO: 1084192 - RNA, 15 nt, Mycobacterium bovis subsp bovis AF2122/97
guccguggacaagca

SEQ ID NO: 1084193 - RNA, 22 nt, Mycobacterium bovis subsp bovis AF2122/97
guccguucgaugccagugcauc

SEQ ID NO: 1084194 - RNA, 18 nt, Mycobacterium bovis subsp bovis AF2122/97
guccggugcugguccagc

SEQ ID NO: 1084195 - RNA, 20 nt, Mycobacterium bovis subsp bovis AF2122/97
guccgguggaauccaccagc

SEQ ID NO: 1084196 - RNA, 23 nt, Mycobacterium bovis subsp bovis AF2122/97
guccgguggaccgccgaucggcc

SEQ ID NO: 1084197 - RNA, 14 nt, Mycobacterium bovis subsp bovis AF2122/97
guccgguauugauc

SEQ ID NO: 1084198 - RNA, 15 nt, Mycobacterium bovis subsp bovis AF2122/97
guccgguccgccagc

SEQ ID NO: 1084199 - RNA, 16 nt, Mycobacterium bovis subsp bovis AF2122/97
guccgguccgccagcg

SEQ ID NO: 1084200 - RNA, 19 nt, Mycobacterium bovis subsp bovis AF2122/97
guccggucgccucaccggc

SEQ ID NO: 1084201 - RNA, 22 nt, Mycobacterium bovis subsp bovis AF2122/97
guccggucggcgguagccgacc

SEQ ID NO: 1084202 - RNA, 19 nt, Mycobacterium bovis subsp bovis AF2122/97
guccggcaucgagacgcac

SEQ ID NO: 1084203 - RNA, 23 nt, Mycobacterium bovis subsp bovis AF2122/97
guccgguguggcgcugaucggca

SEQ ID NO: 1084204 - RNA, 14 nt, Mycobacterium bovis subsp bovis AF2122/97
guccguagcgcggc

SEQ ID NO: 1084205 - RNA, 18 nt, Mycobacterium bovis subsp bovis AF2122/97
guccguagcgcggccgau

SEQ ID NO: 1084206 - RNA, 16 nt, Mycobacterium bovis subsp bovis AF2122/97
guccggcccaccagcg

SEQ ID NO: 1084207 - RNA, 19 nt, Mycobacterium bovis subsp bovis AF2122/97
guccggcccaccagcgcag

SEQ ID NO: 1084208 - RNA, 15 nt, Mycobacterium bovis subsp bovis AF2122/97
guccgguagcagcgc

SEQ ID NO: 1084209 - RNA, 17 nt, Mycobacterium bovis subsp bovis AF2122/97
guccggcaucggugauc

SEQ ID NO: 1084210 - RNA, 15 nt, Mycobacterium bovis subsp bovis AF2122/97
guccggacggcagcc

SEQ ID NO: 1084211 - RNA, 20 nt, Mycobacterium bovis subsp bovis AF2122/97
guccggaaauuccggcgcgg

SEQ ID NO: 1084212 - RNA, 17 nt, Mycobacterium bovis subsp bovis AF2122/97
guccggaagcggcguuc

SEQ ID NO: 1084213 - RNA, 18 nt, Mycobacterium bovis subsp bovis AF2122/97
guccgcugcagcaccgca

SEQ ID NO: 1084214 - RNA, 16 nt, Mycobacterium bovis subsp bovis AF2122/97
guccggaucggucggc

SEQ ID NO: 1084215 - RNA, 18 nt, Mycobacterium bovis subsp bovis AF2122/97
guccggcacugcggccag

SEQ ID NO: 1084216 - RNA, 21 nt, Mycobacterium bovis subsp bovis AF2122/97
guccggauugaagucgucggc

SEQ ID NO: 1084217 - RNA, 11 nt, Mycobacterium bovis subsp bovis AF2122/97
guccgccgccu

SEQ ID NO: 1084218 - RNA, 19 nt, Mycobacterium bovis subsp bovis AF2122/97
guccgccggauagcaccgg

SEQ ID NO: 1084219 - RNA, 21 nt, Mycobacterium bovis subsp bovis AF2122/97
guccgccggauagcaccggca

SEQ ID NO: 1084220 - RNA, 17 nt, Mycobacterium bovis subsp bovis AF2122/97
guccgccgggccccggg

SEQ ID NO: 1084221 - RNA, 14 nt, Mycobacterium bovis subsp bovis AF2122/97
guccgcggccacca

SEQ ID NO: 1084222 - RNA, 20 nt, Mycobacterium bovis subsp bovis AF2122/97
guccgccugcaccgccgccg

SEQ ID NO: 1084223 - RNA, 21 nt, Mycobacterium bovis subsp bovis AF2122/97
guccgccugcaccgccgccgc

SEQ ID NO: 1084224 - RNA, 20 nt, Mycobacterium bovis subsp bovis AF2122/97
guccgcggacuuggcggucg

SEQ ID NO: 1084225 - RNA, 18 nt, Mycobacterium bovis subsp bovis AF2122/97
guccgccgucgaccacga

SEQ ID NO: 1084226 - RNA, 16 nt, Mycobacterium bovis subsp bovis AF2122/97
guccgccguugccgau

SEQ ID NO: 1084227 - RNA, 21 nt, Mycobacterium bovis subsp bovis AF2122/97
guccgccguaugccgccaacc

SEQ ID NO: 1084228 - RNA, 11 nt, Mycobacterium bovis subsp bovis AF2122/97
guccgccggug

SEQ ID NO: 1084229 - RNA, 14 nt, Mycobacterium bovis subsp bovis AF2122/97
guccgccggugccg

SEQ ID NO: 1084230 - RNA, 14 nt, Mycobacterium bovis subsp bovis AF2122/97
guccgcgggccgcg

SEQ ID NO: 1084231 - RNA, 12 nt, Mycobacterium bovis subsp bovis AF2122/97
guccgcggucgc

SEQ ID NO: 1084232 - RNA, 15 nt, Mycobacterium bovis subsp bovis AF2122/97
guccgcuacggcguc

SEQ ID NO: 1084233 - RNA, 15 nt, Mycobacterium bovis subsp bovis AF2122/97
guccgacgccaccgc

SEQ ID NO: 1084234 - RNA, 21 nt, Mycobacterium bovis subsp bovis AF2122/97
guccgacgcaccaacgcgauc

SEQ ID NO: 1084235 - RNA, 12 nt, Mycobacterium bovis subsp bovis AF2122/97
guccgccgcaga

SEQ ID NO: 1084236 - RNA, 15 nt, Mycobacterium bovis subsp bovis AF2122/97
guccgaccagcggcc

SEQ ID NO: 1084237 - RNA, 14 nt, Mycobacterium bovis subsp bovis AF2122/97
guccgaccagcggc

SEQ ID NO: 1084238 - RNA, 17 nt, Mycobacterium bovis subsp bovis AF2122/97
guccgacaguccgcgcc

SEQ ID NO: 1084239 - RNA, 20 nt, Mycobacterium bovis subsp bovis AF2122/97
guccgacaguccgcgccggc

SEQ ID NO: 1084240 - RNA, 20 nt, Mycobacterium bovis subsp bovis AF2122/97
guccgaaggcuugucgguag

SEQ ID NO: 1084241 - RNA, 16 nt, Mycobacterium bovis subsp bovis AF2122/97
guccgaaguacuggcc

SEQ ID NO: 1084242 - RNA, 19 nt, Mycobacterium bovis subsp bovis AF2122/97
guccgacaccggcggcauc

SEQ ID NO: 1084243 - RNA, 17 nt, Mycobacterium bovis subsp bovis AF2122/97
gucccgcacccggccca

SEQ ID NO: 1084244 - RNA, 12 nt, Mycobacterium bovis subsp bovis AF2122/97
gucccggcgacc

SEQ ID NO: 1084245 - RNA, 16 nt, Mycobacterium bovis subsp bovis AF2122/97
gucauccaaccguggu

SEQ ID NO: 1084246 - RNA, 13 nt, Mycobacterium bovis subsp bovis AF2122/97
gucauccaccgca

SEQ ID NO: 1084247 - RNA, 21 nt, Mycobacterium bovis subsp bovis AF2122/97
gucaucccuuucgcgccgcga

SEQ ID NO: 1084248 - RNA, 20 nt, Mycobacterium bovis subsp bovis AF2122/97
gucauccgacaagcugucgg

SEQ ID NO: 1084249 - RNA, 23 nt, Mycobacterium bovis subsp bovis AF2122/97
gucauccauccgggccgcggcca

SEQ ID NO: 1084250 - RNA, 14 nt, Mycobacterium bovis subsp bovis AF2122/97
gucauccggccguc

SEQ ID NO: 1084251 - RNA, 15 nt, Mycobacterium bovis subsp bovis AF2122/97
gucauccggccgucg

SEQ ID NO: 1084252 - RNA, 13 nt, Mycobacterium bovis subsp bovis AF2122/97
gucaucgccagcg

SEQ ID NO: 1084253 - RNA, 16 nt, Mycobacterium bovis subsp bovis AF2122/97
gucaucgccagcggca

SEQ ID NO: 1084254 - RNA, 22 nt, Mycobacterium bovis subsp bovis AF2122/97
gucaucgagcgggaucgggccc

SEQ ID NO: 1084255 - RNA, 16 nt, Mycobacterium bovis subsp bovis AF2122/97
guccaucgcgcgccga

SEQ ID NO: 1084256 - RNA, 16 nt, Mycobacterium bovis subsp bovis AF2122/97
guccaucgcgcugcgg

SEQ ID NO: 1084257 - RNA, 18 nt, Mycobacterium bovis subsp bovis AF2122/97
guccaucgccaccgcguc

SEQ ID NO: 1084258 - RNA, 14 nt, Mycobacterium bovis subsp bovis AF2122/97
guccaucccggcgc

SEQ ID NO: 1084259 - RNA, 15 nt, Mycobacterium bovis subsp bovis AF2122/97
guccaucccggcgcc

SEQ ID NO: 1084260 - RNA, 16 nt, Mycobacterium bovis subsp bovis AF2122/97
guccaucccggcgccg

SEQ ID NO: 1084261 - RNA, 19 nt, Mycobacterium bovis subsp bovis AF2122/97
guccaucccggcgccgcgg

SEQ ID NO: 1084262 - RNA, 21 nt, Mycobacterium bovis subsp bovis AF2122/97
guccagugcauucccgccuuc

SEQ ID NO: 1084263 - RNA, 18 nt, Mycobacterium bovis subsp bovis AF2122/97
gucaucgcggugugccgg

SEQ ID NO: 1084264 - RNA, 17 nt, Mycobacterium bovis subsp bovis AF2122/97
gucaucgccgacccgcc

SEQ ID NO: 1084265 - RNA, 19 nt, Mycobacterium bovis subsp bovis AF2122/97
gucaucggcuggccgcgcc

SEQ ID NO: 1084266 - RNA, 18 nt, Mycobacterium bovis subsp bovis AF2122/97
guccaucaagagcgcgcc

SEQ ID NO: 1084267 - RNA, 17 nt, Mycobacterium bovis subsp bovis AF2122/97
guccaucaccggcggcc

SEQ ID NO: 1084268 - RNA, 19 nt, Mycobacterium bovis subsp bovis AF2122/97
gucccgccgaccgacacca

SEQ ID NO: 1084269 - RNA, 22 nt, Mycobacterium bovis subsp bovis AF2122/97
gucccgcaaaaucgucagcgcc

SEQ ID NO: 1084270 - RNA, 19 nt, Mycobacterium bovis subsp bovis AF2122/97
gucccgaugguggccgcgc

SEQ ID NO: 1084271 - RNA, 18 nt, Mycobacterium bovis subsp bovis AF2122/97
gucccgcgagcagcccgg

SEQ ID NO: 1084272 - RNA, 22 nt, Mycobacterium bovis subsp bovis AF2122/97
gucccgcgaggcaagaacccga

SEQ ID NO: 1084273 - RNA, 12 nt, Mycobacterium bovis subsp bovis AF2122/97
gucccgccgcgc

SEQ ID NO: 1084274 - RNA, 12 nt, Mycobacterium bovis subsp bovis AF2122/97
gucccgccgggu

SEQ ID NO: 1084275 - RNA, 17 nt, Mycobacterium bovis subsp bovis AF2122/97
gucccgccggucacgac

SEQ ID NO: 1084276 - RNA, 17 nt, Mycobacterium bovis subsp bovis AF2122/97
gucccgccgugccgcgg

SEQ ID NO: 1084277 - RNA, 15 nt, Mycobacterium bovis subsp bovis AF2122/97
gucccgccguugccg

SEQ ID NO: 1084278 - RNA, 19 nt, Mycobacterium bovis subsp bovis AF2122/97
gucccgccguugccgccgu

SEQ ID NO: 1084279 - RNA, 18 nt, Mycobacterium bovis subsp bovis AF2122/97
gucccgcucuggucgucg

SEQ ID NO: 1084280 - RNA, 21 nt, Mycobacterium bovis subsp bovis AF2122/97
gucccgcucuggucgucgaac

SEQ ID NO: 1084281 - RNA, 14 nt, Mycobacterium bovis subsp bovis AF2122/97
gucccgcucgagca

SEQ ID NO: 1084282 - RNA, 15 nt, Mycobacterium bovis subsp bovis AF2122/97
gucccgcucgagcag

SEQ ID NO: 1084283 - RNA, 23 nt, Mycobacterium bovis subsp bovis AF2122/97
gucccggcagcuggucggugggc

SEQ ID NO: 1084284 - RNA, 14 nt, Mycobacterium bovis subsp bovis AF2122/97
gucccggcucgagc

SEQ ID NO: 1084285 - RNA, 21 nt, Mycobacterium bovis subsp bovis AF2122/97
guccccagaccggcggcuacg

SEQ ID NO: 1084286 - RNA, 18 nt, Mycobacterium bovis subsp bovis AF2122/97
gucccgaaacgccggguu

SEQ ID NO: 1084287 - RNA, 17 nt, Mycobacterium bovis subsp bovis AF2122/97
gucccgauacggccggc

SEQ ID NO: 1084288 - RNA, 22 nt, Mycobacterium bovis subsp bovis AF2122/97
gucccgauacggccggccguug

SEQ ID NO: 1084289 - RNA, 14 nt, Mycobacterium bovis subsp bovis AF2122/97
gucccgaucacccc

SEQ ID NO: 1084290 - RNA, 16 nt, Mycobacterium bovis subsp bovis AF2122/97
gucccgaucaccccgg

SEQ ID NO: 1084291 - RNA, 21 nt, Mycobacterium bovis subsp bovis AF2122/97
gucccgaucaccccggucggc

SEQ ID NO: 1084292 - RNA, 16 nt, Mycobacterium bovis subsp bovis AF2122/97
gucccaggugcuggua

SEQ ID NO: 1084293 - RNA, 15 nt, Mycobacterium bovis subsp bovis AF2122/97
gucccagcacacccc

SEQ ID NO: 1084294 - RNA, 22 nt, Mycobacterium bovis subsp bovis AF2122/97
gucccaggacuccggccgcacg

SEQ ID NO: 1084295 - RNA, 22 nt, Mycobacterium bovis subsp bovis AF2122/97
gucccaguucguugguguugga

SEQ ID NO: 1084296 - RNA, 16 nt, Mycobacterium bovis subsp bovis AF2122/97
gucccaucgcgucggc

SEQ ID NO: 1084297 - RNA, 20 nt, Mycobacterium bovis subsp bovis AF2122/97
gucccauggaauuccgccug

SEQ ID NO: 1084298 - RNA, 18 nt, Mycobacterium bovis subsp bovis AF2122/97
guagucgggcaaggcggc

SEQ ID NO: 1084299 - RNA, 16 nt, Mycobacterium bovis subsp bovis AF2122/97
guagucggcgccgaga

SEQ ID NO: 1084300 - RNA, 18 nt, Mycobacterium bovis subsp bovis AF2122/97
guaguccagcucgcugcg

SEQ ID NO: 1084301 - RNA, 16 nt, Mycobacterium bovis subsp bovis AF2122/97
guagugaacggaucgu

SEQ ID NO: 1084302 - RNA, 20 nt, Mycobacterium bovis subsp bovis AF2122/97
guaguggaagccgaccaccg

SEQ ID NO: 1084303 - RNA, 17 nt, Mycobacterium bovis subsp bovis AF2122/97
guagugcacgucggcgg

SEQ ID NO: 1084304 - RNA, 23 nt, Mycobacterium bovis subsp bovis AF2122/97
guagugcguaaggcugugccggc

SEQ ID NO: 1084305 - RNA, 16 nt, Mycobacterium bovis subsp bovis AF2122/97
guagugaucgaucgcg

SEQ ID NO: 1084306 - RNA, 19 nt, Mycobacterium bovis subsp bovis AF2122/97
guagugaucgaucgcggcg

SEQ ID NO: 1084307 - RNA, 16 nt, Mycobacterium bovis subsp bovis AF2122/97
guagugucguaggcga

SEQ ID NO: 1084308 - RNA, 15 nt, Mycobacterium bovis subsp bovis AF2122/97
guaguggccggcuuc

SEQ ID NO: 1084309 - RNA, 21 nt, Mycobacterium bovis subsp bovis AF2122/97
guaucacgguugccgcgaucg

SEQ ID NO: 1084310 - RNA, 17 nt, Mycobacterium bovis subsp bovis AF2122/97
guaguccugcgggccgu

SEQ ID NO: 1084311 - RNA, 19 nt, Mycobacterium bovis subsp bovis AF2122/97
guaguccgcauccgcgacg

SEQ ID NO: 1084312 - RNA, 17 nt, Mycobacterium bovis subsp bovis AF2122/97
guaguccgcgccgacgg

SEQ ID NO: 1084313 - RNA, 14 nt, Mycobacterium bovis subsp bovis AF2122/97
guaguccgcgcuca

SEQ ID NO: 1084314 - RNA, 12 nt, Mycobacterium bovis subsp bovis AF2122/97
guaguccgcugc

SEQ ID NO: 1084315 - RNA, 14 nt, Mycobacterium bovis subsp bovis AF2122/97
guaguccugcgggc

SEQ ID NO: 1084316 - RNA, 13 nt, Mycobacterium bovis subsp bovis AF2122/97
guaguccgcaucc

SEQ ID NO: 1084317 - RNA, 21 nt, Mycobacterium bovis subsp bovis AF2122/97
guagucgauuggcugcgccga

SEQ ID NO: 1084318 - RNA, 13 nt, Mycobacterium bovis subsp bovis AF2122/97
guagucggccagc

SEQ ID NO: 1084319 - RNA, 16 nt, Mycobacterium bovis subsp bovis AF2122/97
guagucggccagcucg

SEQ ID NO: 1084320 - RNA, 18 nt, Mycobacterium bovis subsp bovis AF2122/97
guagucggccagcucgcg

SEQ ID NO: 1084321 - RNA, 21 nt, Mycobacterium bovis subsp bovis AF2122/97
guagucggccagcucgcgggc

SEQ ID NO: 1084322 - RNA, 15 nt, Mycobacterium bovis subsp bovis AF2122/97
guagucagaaccgac

SEQ ID NO: 1084323 - RNA, 22 nt, Mycobacterium bovis subsp bovis AF2122/97
guagucagaaccgacggccagc

SEQ ID NO: 1084324 - RNA, 13 nt, Mycobacterium bovis subsp bovis AF2122/97
aagucgucgaggu

SEQ ID NO: 1084325 - RNA, 15 nt, Mycobacterium bovis subsp bovis AF2122/97
guagcucauugccga

SEQ ID NO: 1084326 - RNA, 18 nt, Mycobacterium bovis subsp bovis AF2122/97
guagcucccugggcgucg

SEQ ID NO: 1084327 - RNA, 20 nt, Mycobacterium bovis subsp bovis AF2122/97
guagcuccuugagcaaugac

SEQ ID NO: 1084328 - RNA, 12 nt, Mycobacterium bovis subsp bovis AF2122/97
guagcugcgcag

SEQ ID NO: 1084329 - RNA, 13 nt, Mycobacterium bovis subsp bovis AF2122/97
guagcugcgcggg

SEQ ID NO: 1084330 - RNA, 18 nt, Mycobacterium bovis subsp bovis AF2122/97
guagcuggugcguagccc

SEQ ID NO: 1084331 - RNA, 19 nt, Mycobacterium bovis subsp bovis AF2122/97
guagcuguggcccgcggug

SEQ ID NO: 1084332 - RNA, 19 nt, Mycobacterium bovis subsp bovis AF2122/97
guagcuucgaugggcauca

SEQ ID NO: 1084333 - RNA, 19 nt, Mycobacterium bovis subsp bovis AF2122/97
aaguagguuuucggcggcu

SEQ ID NO: 1084334 - RNA, 15 nt, Mycobacterium bovis subsp bovis AF2122/97
guaggccgccguggu

SEQ ID NO: 1084335 - RNA, 13 nt, Mycobacterium bovis subsp bovis AF2122/97
guagcuggccagg

SEQ ID NO: 1084336 - RNA, 13 nt, Mycobacterium bovis subsp bovis AF2122/97
aaguaucgcagca

SEQ ID NO: 1084337 - RNA, 16 nt, Mycobacterium bovis subsp bovis AF2122/97
aagucggcaccggugc

SEQ ID NO: 1084338 - RNA, 19 nt, Mycobacterium bovis subsp bovis AF2122/97
aagucgaacggcuuggcgu

SEQ ID NO: 1084339 - RNA, 21 nt, Mycobacterium bovis subsp bovis AF2122/97
aaguccucggcggacccggug

SEQ ID NO: 1084340 - RNA, 14 nt, Mycobacterium bovis subsp bovis AF2122/97
aagucgacgccgca

SEQ ID NO: 1084341 - RNA, 13 nt, Mycobacterium bovis subsp bovis AF2122/97
aagucgaugaugc

SEQ ID NO: 1084342 - RNA, 13 nt, Mycobacterium bovis subsp bovis AF2122/97
aagucacgcaccc

SEQ ID NO: 1084343 - RNA, 17 nt, Mycobacterium bovis subsp bovis AF2122/97
guagcgcggccgauacg

SEQ ID NO: 1084344 - RNA, 21 nt, Mycobacterium bovis subsp bovis AF2122/97
guagcggacagcucgcgguag

SEQ ID NO: 1084345 - RNA, 17 nt, Mycobacterium bovis subsp bovis AF2122/97
guagcggaucgcgguca

SEQ ID NO: 1084346 - RNA, 22 nt, Mycobacterium bovis subsp bovis AF2122/97
guagcggaucgcggucagcggg

SEQ ID NO: 1084347 - RNA, 12 nt, Mycobacterium bovis subsp bovis AF2122/97
guagcgaugccg

SEQ ID NO: 1084348 - RNA, 13 nt, Mycobacterium bovis subsp bovis AF2122/97
guagcgccccgau

SEQ ID NO: 1084349 - RNA, 16 nt, Mycobacterium bovis subsp bovis AF2122/97
guagcaggucgacggc

SEQ ID NO: 1084350 - RNA, 20 nt, Mycobacterium bovis subsp bovis AF2122/97
guagccaaccugaagccagc

SEQ ID NO: 1084351 - RNA, 22 nt, Mycobacterium bovis subsp bovis AF2122/97
guagccaagcgagcggucgacg

SEQ ID NO: 1084352 - RNA, 19 nt, Mycobacterium bovis subsp bovis AF2122/97
guagauguucacgccgccg

SEQ ID NO: 1084353 - RNA, 19 nt, Mycobacterium bovis subsp bovis AF2122/97
guagcaccacaucggugcc

SEQ ID NO: 1084354 - RNA, 17 nt, Mycobacterium bovis subsp bovis AF2122/97
guagcagaaggccgcgg

SEQ ID NO: 1084355 - RNA, 14 nt, Mycobacterium bovis subsp bovis AF2122/97
guagccggugaccg

SEQ ID NO: 1084356 - RNA, 14 nt, Mycobacterium bovis subsp bovis AF2122/97
guagccgucgucgu

SEQ ID NO: 1084357 - RNA, 16 nt, Mycobacterium bovis subsp bovis AF2122/97
guagccgucgucgucg

SEQ ID NO: 1084358 - RNA, 22 nt, Mycobacterium bovis subsp bovis AF2122/97
guagcgaccucgccgcggcgga

SEQ ID NO: 1084359 - RNA, 18 nt, Mycobacterium bovis subsp bovis AF2122/97
guacuggaauggcucacg

SEQ ID NO: 1084360 - RNA, 19 nt, Mycobacterium bovis subsp bovis AF2122/97
guacugugggcgaucggcg

SEQ ID NO: 1084361 - RNA, 21 nt, Mycobacterium bovis subsp bovis AF2122/97
guacuucauauaccgcucgua

SEQ ID NO: 1084362 - RNA, 17 nt, Mycobacterium bovis subsp bovis AF2122/97
guacuucgcggcgguga

SEQ ID NO: 1084363 - RNA, 18 nt, Mycobacterium bovis subsp bovis AF2122/97
guacuucgcuggaaaccu

SEQ ID NO: 1084364 - RNA, 18 nt, Mycobacterium bovis subsp bovis AF2122/97
guacuugaccguccaccg

SEQ ID NO: 1084365 - RNA, 13 nt, Mycobacterium bovis subsp bovis AF2122/97
guacuugccaccc

SEQ ID NO: 1084366 - RNA, 15 nt, Mycobacterium bovis subsp bovis AF2122/97
guacugcggcucgcu

SEQ ID NO: 1084367 - RNA, 16 nt, Mycobacterium bovis subsp bovis AF2122/97
guacgggcaggccgcu

SEQ ID NO: 1084368 - RNA, 23 nt, Mycobacterium bovis subsp bovis AF2122/97
guacggugggugguuguccacgg

SEQ ID NO: 1084369 - RNA, 19 nt, Mycobacterium bovis subsp bovis AF2122/97
guacugguagcacucggga

SEQ ID NO: 1084370 - RNA, 19 nt, Mycobacterium bovis subsp bovis AF2122/97
guagacccacaucaggucg

SEQ ID NO: 1084371 - RNA, 23 nt, Mycobacterium bovis subsp bovis AF2122/97
guagacccacaucaggucggcga

SEQ ID NO: 1084372 - RNA, 21 nt, Mycobacterium bovis subsp bovis AF2122/97
guagaccgagcccgauggugg

SEQ ID NO: 1084373 - RNA, 22 nt, Mycobacterium bovis subsp bovis AF2122/97
guagaccuccagugcggccuug

SEQ ID NO: 1084374 - RNA, 17 nt, Mycobacterium bovis subsp bovis AF2122/97
guagaccuggccgucgc

SEQ ID NO: 1084375 - RNA, 19 nt, Mycobacterium bovis subsp bovis AF2122/97
guagaccugguugaccucg

SEQ ID NO: 1084376 - RNA, 22 nt, Mycobacterium bovis subsp bovis AF2122/97
guagaccugguugaccucggug

SEQ ID NO: 1084377 - RNA, 20 nt, Mycobacterium bovis subsp bovis AF2122/97
guagaccuucucgccgccgc

SEQ ID NO: 1084378 - RNA, 17 nt, Mycobacterium bovis subsp bovis AF2122/97
guagacgguuaccgcga

SEQ ID NO: 1084379 - RNA, 14 nt, Mycobacterium bovis subsp bovis AF2122/97
guagacguccgcgg

SEQ ID NO: 1084380 - RNA, 16 nt, Mycobacterium bovis subsp bovis AF2122/97
guagacggcacccccg

SEQ ID NO: 1084381 - RNA, 17 nt, Mycobacterium bovis subsp bovis AF2122/97
guagacggcacccccga

SEQ ID NO: 1084382 - RNA, 16 nt, Mycobacterium bovis subsp bovis AF2122/97
guagaccucgagcuug

SEQ ID NO: 1084383 - RNA, 23 nt, Mycobacterium bovis subsp bovis AF2122/97
guagacgacgucggccgcaucgc

SEQ ID NO: 1084384 - RNA, 14 nt, Mycobacterium bovis subsp bovis AF2122/97
guagacgccgccgu

SEQ ID NO: 1084385 - RNA, 22 nt, Mycobacterium bovis subsp bovis AF2122/97
guagacggcacccccgacgaga

SEQ ID NO: 1084386 - RNA, 14 nt, Mycobacterium bovis subsp bovis AF2122/97
guagcacagcagca

SEQ ID NO: 1084387 - RNA, 15 nt, Mycobacterium bovis subsp bovis AF2122/97
guagcaccacaucgg

SEQ ID NO: 1084388 - RNA, 20 nt, Mycobacterium bovis subsp bovis AF2122/97
guaccgaaaagccguucgcg

SEQ ID NO: 1084389 - RNA, 22 nt, Mycobacterium bovis subsp bovis AF2122/97
guaccgauagccugcggcggcg

SEQ ID NO: 1084390 - RNA, 22 nt, Mycobacterium bovis subsp bovis AF2122/97
guaccgucaucgcggugugccg

SEQ ID NO: 1084391 - RNA, 15 nt, Mycobacterium bovis subsp bovis AF2122/97
guaccucaucgcaga

SEQ ID NO: 1084392 - RNA, 21 nt, Mycobacterium bovis subsp bovis AF2122/97
guacccgccucgggccggcgu

SEQ ID NO: 1084393 - RNA, 15 nt, Mycobacterium bovis subsp bovis AF2122/97
guacccggcgacguu

SEQ ID NO: 1084394 - RNA, 20 nt, Mycobacterium bovis subsp bovis AF2122/97
guacccggcgacguuccgcu

SEQ ID NO: 1084395 - RNA, 17 nt, Mycobacterium bovis subsp bovis AF2122/97
guacccgaucagcgacg

SEQ ID NO: 1084396 - RNA, 17 nt, Mycobacterium bovis subsp bovis AF2122/97
guacccgaccagcacca

SEQ ID NO: 1084397 - RNA, 16 nt, Mycobacterium bovis subsp bovis AF2122/97
guacccgaucacucgg

SEQ ID NO: 1084398 - RNA, 16 nt, Mycobacterium bovis subsp bovis AF2122/97
guaccuccaggaucgc

SEQ ID NO: 1084399 - RNA, 12 nt, Mycobacterium bovis subsp bovis AF2122/97
guaccucgucga

SEQ ID NO: 1084400 - RNA, 22 nt, Mycobacterium bovis subsp bovis AF2122/97
guaccucaacaccaggccgucc

SEQ ID NO: 1084401 - RNA, 19 nt, Mycobacterium bovis subsp bovis AF2122/97
guacgacagucgcagucgc

SEQ ID NO: 1084402 - RNA, 13 nt, Mycobacterium bovis subsp bovis AF2122/97
guacggcucggcg

SEQ ID NO: 1084403 - RNA, 14 nt, Mycobacterium bovis subsp bovis AF2122/97
guacggcucggcgc

SEQ ID NO: 1084404 - RNA, 23 nt, Mycobacterium bovis subsp bovis AF2122/97
guacggggucgccggcaccggau

SEQ ID NO: 1084405 - RNA, 13 nt, Mycobacterium bovis subsp bovis AF2122/97
guacggguaacgc

SEQ ID NO: 1084406 - RNA, 21 nt, Mycobacterium bovis subsp bovis AF2122/97
guacggguaacgcacccaccg

SEQ ID NO: 1084407 - RNA, 16 nt, Mycobacterium bovis subsp bovis AF2122/97
guacgggucgccggac

SEQ ID NO: 1084408 - RNA, 12 nt, Mycobacterium bovis subsp bovis AF2122/97
guacgggugauc

SEQ ID NO: 1084409 - RNA, 20 nt, Mycobacterium bovis subsp bovis AF2122/97
guacggcgcguacggaacca

SEQ ID NO: 1084410 - RNA, 16 nt, Mycobacterium bovis subsp bovis AF2122/97
guacggcgguccggau

SEQ ID NO: 1084411 - RNA, 18 nt, Mycobacterium bovis subsp bovis AF2122/97
guacaccgcgcccgccga

SEQ ID NO: 1084412 - RNA, 18 nt, Mycobacterium bovis subsp bovis AF2122/97
guacaccucgagcgcggc

SEQ ID NO: 1084413 - RNA, 23 nt, Mycobacterium bovis subsp bovis AF2122/97
guacaccucgagcgcggcgaucg

SEQ ID NO: 1084414 - RNA, 16 nt, Mycobacterium bovis subsp bovis AF2122/97
guacaggguggugauc

SEQ ID NO: 1084415 - RNA, 22 nt, Mycobacterium bovis subsp bovis AF2122/97
guacaggguggugaucggcgau

SEQ ID NO: 1084416 - RNA, 14 nt, Mycobacterium bovis subsp bovis AF2122/97
guacaguccacgcg

SEQ ID NO: 1084417 - RNA, 21 nt, Mycobacterium bovis subsp bovis AF2122/97
guacaucgaggccacgccagc

SEQ ID NO: 1084418 - RNA, 22 nt, Mycobacterium bovis subsp bovis AF2122/97
guacauacucugcgacaccacg

SEQ ID NO: 1084419 - RNA, 17 nt, Mycobacterium bovis subsp bovis AF2122/97
guacaucagcgcgaacg

SEQ ID NO: 1084420 - RNA, 13 nt, Mycobacterium bovis subsp bovis AF2122/97
guacaucccggug

SEQ ID NO: 1084421 - RNA, 22 nt, Mycobacterium bovis subsp bovis AF2122/97
guacacccgcucgcccgccgcc

SEQ ID NO: 1084422 - RNA, 16 nt, Mycobacterium bovis subsp bovis AF2122/97
guacacaucgucacug

SEQ ID NO: 1084423 - RNA, 16 nt, Mycobacterium bovis subsp bovis AF2122/97
guaaucgguggugugc

SEQ ID NO: 1084424 - RNA, 15 nt, Mycobacterium bovis subsp bovis AF2122/97
guaaucgccaccgca

SEQ ID NO: 1084425 - RNA, 20 nt, Mycobacterium bovis subsp bovis AF2122/97
guaaucaagcagcguggcga

SEQ ID NO: 1084426 - RNA, 23 nt, Mycobacterium bovis subsp bovis AF2122/97
guaaucaccgaauaccgccgcgc

SEQ ID NO: 1084427 - RNA, 12 nt, Mycobacterium bovis subsp bovis AF2122/97
gguggccaccaa

SEQ ID NO: 1084428 - RNA, 18 nt, Mycobacterium bovis subsp bovis AF2122/97
gguggccacccggccgcg

SEQ ID NO: 1084429 - RNA, 19 nt, Mycobacterium bovis subsp bovis AF2122/97
gguggccacccggccgcgc

SEQ ID NO: 1084430 - RNA, 20 nt, Mycobacterium bovis subsp bovis AF2122/97
gguggccacccggccgcgcg

SEQ ID NO: 1084431 - RNA, 22 nt, Mycobacterium bovis subsp bovis AF2122/97
gguggccacccggccgcgcggg

SEQ ID NO: 1084432 - RNA, 15 nt, Mycobacterium bovis subsp bovis AF2122/97
gguggcccgaccggg

SEQ ID NO: 1084433 - RNA, 24 nt, Mycobacterium bovis subsp bovis AF2122/97
gguggcccgaccgggaaccacggu

SEQ ID NO: 1084434 - RNA, 13 nt, Mycobacterium bovis subsp bovis AF2122/97
gguggccaucgcg

SEQ ID NO: 1084435 - RNA, 14 nt, Mycobacterium bovis subsp bovis AF2122/97
gguggccaucgcgc

SEQ ID NO: 1084436 - RNA, 12 nt, Mycobacterium bovis subsp bovis AF2122/97
gguggccgacga

SEQ ID NO: 1084437 - RNA, 20 nt, Mycobacterium bovis subsp bovis AF2122/97
gguggcccggaacaccgacg

SEQ ID NO: 1084438 - RNA, 13 nt, Mycobacterium bovis subsp bovis AF2122/97
gguggcccgggga

SEQ ID NO: 1084439 - RNA, 15 nt, Mycobacterium bovis subsp bovis AF2122/97
gguggccaucgcgcg

SEQ ID NO: 1084440 - RNA, 21 nt, Mycobacterium bovis subsp bovis AF2122/97
gguggcccgccggcagugagu

SEQ ID NO: 1084441 - RNA, 15 nt, Mycobacterium bovis subsp bovis AF2122/97
gguuuucccgucgcc

SEQ ID NO: 1084442 - RNA, 21 nt, Mycobacterium bovis subsp bovis AF2122/97
gguuuugauagacgacccggu

SEQ ID NO: 1084443 - RNA, 21 nt, Mycobacterium bovis subsp bovis AF2122/97
guaaaagccgaugacgguccc

SEQ ID NO: 1084444 - RNA, 22 nt, Mycobacterium bovis subsp bovis AF2122/97
guaaagcucaccacaucggugu

SEQ ID NO: 1084445 - RNA, 20 nt, Mycobacterium bovis subsp bovis AF2122/97
guaacugcguuggcgaccau

SEQ ID NO: 1084446 - RNA, 14 nt, Mycobacterium bovis subsp bovis AF2122/97
guaacuucaccggc

SEQ ID NO: 1084447 - RNA, 15 nt, Mycobacterium bovis subsp bovis AF2122/97
guaacuucaccggcu

SEQ ID NO: 1084448 - RNA, 18 nt, Mycobacterium bovis subsp bovis AF2122/97
guaagaguucgcgcgccg

SEQ ID NO: 1084449 - RNA, 20 nt, Mycobacterium bovis subsp bovis AF2122/97
guaagugccucgcgggaagu

SEQ ID NO: 1084450 - RNA, 16 nt, Mycobacterium bovis subsp bovis AF2122/97
guaagggacaccagcu

SEQ ID NO: 1084451 - RNA, 21 nt, Mycobacterium bovis subsp bovis AF2122/97
guaauacgcggggccggccgg

SEQ ID NO: 1084452 - RNA, 17 nt, Mycobacterium bovis subsp bovis AF2122/97
guaagcgaacagcggca

SEQ ID NO: 1084453 - RNA, 18 nt, Mycobacterium bovis subsp bovis AF2122/97
guaagcgguuguccgguc

SEQ ID NO: 1084454 - RNA, 16 nt, Mycobacterium bovis subsp bovis AF2122/97
guaaggagccgggccg

SEQ ID NO: 1084455 - RNA, 13 nt, Mycobacterium bovis subsp bovis AF2122/97
guaagcggauguc

SEQ ID NO: 1084456 - RNA, 13 nt, Mycobacterium bovis subsp bovis AF2122/97
gucagcagcgccg

SEQ ID NO: 1084457 - RNA, 16 nt, Mycobacterium bovis subsp bovis AF2122/97
gucagcagauccgcga

SEQ ID NO: 1084458 - RNA, 15 nt, Mycobacterium bovis subsp bovis AF2122/97
gucagcagcgccguc

SEQ ID NO: 1084459 - RNA, 23 nt, Mycobacterium bovis subsp bovis AF2122/97
gucagcauaucgauucgggcguc

SEQ ID NO: 1084460 - RNA, 17 nt, Mycobacterium bovis subsp bovis AF2122/97
gucagcaguucggcgau

SEQ ID NO: 1084461 - RNA, 13 nt, Mycobacterium bovis subsp bovis AF2122/97
gucagcagcccau

SEQ ID NO: 1084462 - RNA, 23 nt, Mycobacterium bovis subsp bovis AF2122/97
gucagcagcccauuucgagcucg

SEQ ID NO: 1084463 - RNA, 17 nt, Mycobacterium bovis subsp bovis AF2122/97
gucagcacccaacccgg

SEQ ID NO: 1084464 - RNA, 23 nt, Mycobacterium bovis subsp bovis AF2122/97
gucagcaccuccaccgcgccggc

SEQ ID NO: 1084465 - RNA, 24 nt, Mycobacterium bovis subsp bovis AF2122/97
gucagcaccuccaccgcgccggcg

SEQ ID NO: 1084466 - RNA, 16 nt, Mycobacterium bovis subsp bovis AF2122/97
gucagcaccggcgcgg

SEQ ID NO: 1084467 - RNA, 17 nt, Mycobacterium bovis subsp bovis AF2122/97
gucagcaccggcgcggg

SEQ ID NO: 1084468 - RNA, 13 nt, Mycobacterium bovis subsp bovis AF2122/97
gucagcgccgccg

SEQ ID NO: 1084469 - RNA, 12 nt, Mycobacterium bovis subsp bovis AF2122/97
gucagcgccgag

SEQ ID NO: 1084470 - RNA, 19 nt, Mycobacterium bovis subsp bovis AF2122/97
gucagcgaguuucugcucg

SEQ ID NO: 1084471 - RNA, 20 nt, Mycobacterium bovis subsp bovis AF2122/97
gucagcgacuugcggugcuc

SEQ ID NO: 1084472 - RNA, 12 nt, Mycobacterium bovis subsp bovis AF2122/97
gucagccgguga

SEQ ID NO: 1084473 - RNA, 13 nt, Mycobacterium bovis subsp bovis AF2122/97
gucagccggugac

SEQ ID NO: 1084474 - RNA, 14 nt, Mycobacterium bovis subsp bovis AF2122/97
gucagcgaccacgu

SEQ ID NO: 1084475 - RNA, 17 nt, Mycobacterium bovis subsp bovis AF2122/97
gucagcgaccucacugc

SEQ ID NO: 1084476 - RNA, 23 nt, Mycobacterium bovis subsp bovis AF2122/97
gucagcgaccucacugcggcgcc

SEQ ID NO: 1084477 - RNA, 14 nt, Mycobacterium bovis subsp bovis AF2122/97
gucagccgcgcggg

SEQ ID NO: 1084478 - RNA, 17 nt, Mycobacterium bovis subsp bovis AF2122/97
gucagccgcaccccgcc

SEQ ID NO: 1084479 - RNA, 21 nt, Mycobacterium bovis subsp bovis AF2122/97
gucagccgcaccccgcccgac

SEQ ID NO: 1084480 - RNA, 14 nt, Mycobacterium bovis subsp bovis AF2122/97
gucagcccggcgcg

SEQ ID NO: 1084481 - RNA, 18 nt, Mycobacterium bovis subsp bovis AF2122/97
gucagccccgacugcgcc

SEQ ID NO: 1084482 - RNA, 20 nt, Mycobacterium bovis subsp bovis AF2122/97
gucagccccgacugcgccca

SEQ ID NO: 1084483 - RNA, 16 nt, Mycobacterium bovis subsp bovis AF2122/97
gucaggcgaaccuggu

SEQ ID NO: 1084484 - RNA, 12 nt, Mycobacterium bovis subsp bovis AF2122/97
gucaggcggccg

SEQ ID NO: 1084485 - RNA, 16 nt, Mycobacterium bovis subsp bovis AF2122/97
gucaggcggccgucgu

SEQ ID NO: 1084486 - RNA, 21 nt, Mycobacterium bovis subsp bovis AF2122/97
gucaggcggcggacccgcucg

SEQ ID NO: 1084487 - RNA, 14 nt, Mycobacterium bovis subsp bovis AF2122/97
gucauagccguugc

SEQ ID NO: 1084488 - RNA, 24 nt, Mycobacterium bovis subsp bovis AF2122/97
gucauauaggagcgggugcauucg

SEQ ID NO: 1084489 - RNA, 15 nt, Mycobacterium bovis subsp bovis AF2122/97
gucauaucucgagcc

SEQ ID NO: 1084490 - RNA, 22 nt, Mycobacterium bovis subsp bovis AF2122/97
gucaggccagggugaccaggcc

SEQ ID NO: 1084491 - RNA, 17 nt, Mycobacterium bovis subsp bovis AF2122/97
gucaggccagggugacc

SEQ ID NO: 1084492 - RNA, 13 nt, Mycobacterium bovis subsp bovis AF2122/97
gucaggccgccgc

SEQ ID NO: 1084493 - RNA, 17 nt, Mycobacterium bovis subsp bovis AF2122/97
gucaggccgccgcggcg

SEQ ID NO: 1084494 - RNA, 12 nt, Mycobacterium bovis subsp bovis AF2122/97
gucagcgcggcg

SEQ ID NO: 1084495 - RNA, 15 nt, Mycobacterium bovis subsp bovis AF2122/97
gucagcgcggcgacc

SEQ ID NO: 1084496 - RNA, 12 nt, Mycobacterium bovis subsp bovis AF2122/97
gucagcgcggca

SEQ ID NO: 1084497 - RNA, 14 nt, Mycobacterium bovis subsp bovis AF2122/97
gucagcgcggcaag

SEQ ID NO: 1084498 - RNA, 13 nt, Mycobacterium bovis subsp bovis AF2122/97
gucagcgccgcgc

SEQ ID NO: 1084499 - RNA, 16 nt, Mycobacterium bovis subsp bovis AF2122/97
gucagcgcggcgcaca

SEQ ID NO: 1084500 - RNA, 13 nt, Mycobacterium bovis subsp bovis AF2122/97
gucagcggccgcg

SEQ ID NO: 1084501 - RNA, 16 nt, Mycobacterium bovis subsp bovis AF2122/97
gucagcggccgcgacg

SEQ ID NO: 1084502 - RNA, 22 nt, Mycobacterium bovis subsp bovis AF2122/97
gucagcuagguauugccgcaga

SEQ ID NO: 1084503 - RNA, 22 nt, Mycobacterium bovis subsp bovis AF2122/97
gucagcgucggcgcaucaccac

SEQ ID NO: 1084504 - RNA, 16 nt, Mycobacterium bovis subsp bovis AF2122/97
gucagcucccggcuuc

SEQ ID NO: 1084505 - RNA, 16 nt, Mycobacterium bovis subsp bovis AF2122/97
gucagcuccgcgcagc

SEQ ID NO: 1084506 - RNA, 12 nt, Mycobacterium bovis subsp bovis AF2122/97
gucagcggcgcg

SEQ ID NO: 1084507 - RNA, 16 nt, Mycobacterium bovis subsp bovis AF2122/97
gucagcggcggccacg

SEQ ID NO: 1084508 - RNA, 19 nt, Mycobacterium bovis subsp bovis AF2122/97
gucagcgggcacgccgccg

SEQ ID NO: 1084509 - RNA, 20 nt, Mycobacterium bovis subsp bovis AF2122/97
gucagcgggcuugccguugg

SEQ ID NO: 1084510 - RNA, 14 nt, Mycobacterium bovis subsp bovis AF2122/97
gucagcggcugggc

SEQ ID NO: 1084511 - RNA, 15 nt, Mycobacterium bovis subsp bovis AF2122/97
gucagcgguugggcg

SEQ ID NO: 1084512 - RNA, 23 nt, Mycobacterium bovis subsp bovis AF2122/97
gucagcgucugagcgccggcauc

SEQ ID NO: 1084513 - RNA, 17 nt, Mycobacterium bovis subsp bovis AF2122/97
gucacgcgaccaccgcc

SEQ ID NO: 1084514 - RNA, 19 nt, Mycobacterium bovis subsp bovis AF2122/97
gucacgcgaccaccgccga

SEQ ID NO: 1084515 - RNA, 20 nt, Mycobacterium bovis subsp bovis AF2122/97
gucacgcgaccaccgccgag

SEQ ID NO: 1084516 - RNA, 22 nt, Mycobacterium bovis subsp bovis AF2122/97
gucacgcgaccaccgccgagcc

SEQ ID NO: 1084517 - RNA, 13 nt, Mycobacterium bovis subsp bovis AF2122/97
gucacgcgaggcg

SEQ ID NO: 1084518 - RNA, 16 nt, Mycobacterium bovis subsp bovis AF2122/97
gucacgccggaugguc

SEQ ID NO: 1084519 - RNA, 20 nt, Mycobacterium bovis subsp bovis AF2122/97
gucacgccggauggucggcc

SEQ ID NO: 1084520 - RNA, 17 nt, Mycobacterium bovis subsp bovis AF2122/97
gucacgcaaccggcgga

SEQ ID NO: 1084521 - RNA, 13 nt, Mycobacterium bovis subsp bovis AF2122/97
gucacgcaccgcg

SEQ ID NO: 1084522 - RNA, 20 nt, Mycobacterium bovis subsp bovis AF2122/97
gucacgcacgccgcgugccg

SEQ ID NO: 1084523 - RNA, 15 nt, Mycobacterium bovis subsp bovis AF2122/97
gucacgcagccgcgc

SEQ ID NO: 1084524 - RNA, 12 nt, Mycobacterium bovis subsp bovis AF2122/97
gucacgccaccg

SEQ ID NO: 1084525 - RNA, 13 nt, Mycobacterium bovis subsp bovis AF2122/97
gucaccugcgggc

SEQ ID NO: 1084526 - RNA, 13 nt, Mycobacterium bovis subsp bovis AF2122/97
gucacgaucacga

SEQ ID NO: 1084527 - RNA, 16 nt, Mycobacterium bovis subsp bovis AF2122/97
gucacgaucagggcga

SEQ ID NO: 1084528 - RNA, 19 nt, Mycobacterium bovis subsp bovis AF2122/97
gucacgaagaccaggccgg

SEQ ID NO: 1084529 - RNA, 21 nt, Mycobacterium bovis subsp bovis AF2122/97
gucacgacccaagucgccgag

SEQ ID NO: 1084530 - RNA, 22 nt, Mycobacterium bovis subsp bovis AF2122/97
gucacgacccaagucgccgagg

SEQ ID NO: 1084531 - RNA, 14 nt, Mycobacterium bovis subsp bovis AF2122/97
gucacgacggcacg

SEQ ID NO: 1084532 - RNA, 16 nt, Mycobacterium bovis subsp bovis AF2122/97
gucaccuugaccgggu

SEQ ID NO: 1084533 - RNA, 13 nt, Mycobacterium bovis subsp bovis AF2122/97
gucaccucgaugc

SEQ ID NO: 1084534 - RNA, 16 nt, Mycobacterium bovis subsp bovis AF2122/97
gucaccucgccggcgg

SEQ ID NO: 1084535 - RNA, 17 nt, Mycobacterium bovis subsp bovis AF2122/97
gucaccucgccggcggg

SEQ ID NO: 1084536 - RNA, 20 nt, Mycobacterium bovis subsp bovis AF2122/97
gucaccucgccggcgggacg

SEQ ID NO: 1084537 - RNA, 23 nt, Mycobacterium bovis subsp bovis AF2122/97
gucaccgugggccugcccggcgc

SEQ ID NO: 1084538 - RNA, 21 nt, Mycobacterium bovis subsp bovis AF2122/97
gucaccguucuugucgaagua

SEQ ID NO: 1084539 - RNA, 15 nt, Mycobacterium bovis subsp bovis AF2122/97
gucaccguuggccgc

SEQ ID NO: 1084540 - RNA, 16 nt, Mycobacterium bovis subsp bovis AF2122/97
gucaccgucuugcacg

SEQ ID NO: 1084541 - RNA, 16 nt, Mycobacterium bovis subsp bovis AF2122/97
gucaccggguccaccg

SEQ ID NO: 1084542 - RNA, 14 nt, Mycobacterium bovis subsp bovis AF2122/97
gucaccggcuucgg

SEQ ID NO: 1084543 - RNA, 19 nt, Mycobacterium bovis subsp bovis AF2122/97
gucaccggcuucggccagc

SEQ ID NO: 1084544 - RNA, 15 nt, Mycobacterium bovis subsp bovis AF2122/97
gucaccggucaccgc

SEQ ID NO: 1084545 - RNA, 14 nt, Mycobacterium bovis subsp bovis AF2122/97
gucaccggucggcc

SEQ ID NO: 1084546 - RNA, 16 nt, Mycobacterium bovis subsp bovis AF2122/97
gucaccgucugcaccg

SEQ ID NO: 1084547 - RNA, 19 nt, Mycobacterium bovis subsp bovis AF2122/97
gucacggucguggugcaac

SEQ ID NO: 1084548 - RNA, 13 nt, Mycobacterium bovis subsp bovis AF2122/97
gucacggacccuu

SEQ ID NO: 1084549 - RNA, 23 nt, Mycobacterium bovis subsp bovis AF2122/97
gucacggacccuuccgccgccgc

SEQ ID NO: 1084550 - RNA, 18 nt, Mycobacterium bovis subsp bovis AF2122/97
gucacggugcguucgugc

SEQ ID NO: 1084551 - RNA, 17 nt, Mycobacterium bovis subsp bovis AF2122/97
gucacgguggugucagc

SEQ ID NO: 1084552 - RNA, 14 nt, Mycobacterium bovis subsp bovis AF2122/97
gucacgucgacggc

SEQ ID NO: 1084553 - RNA, 13 nt, Mycobacterium bovis subsp bovis AF2122/97
gucacgucgaucu

SEQ ID NO: 1084554 - RNA, 14 nt, Mycobacterium bovis subsp bovis AF2122/97
gucacgucgaugag

SEQ ID NO: 1084555 - RNA, 14 nt, Mycobacterium bovis subsp bovis AF2122/97
gucacgucgcagua

SEQ ID NO: 1084556 - RNA, 19 nt, Mycobacterium bovis subsp bovis AF2122/97
gucacguggucggccaccc

SEQ ID NO: 1084557 - RNA, 13 nt, Mycobacterium bovis subsp bovis AF2122/97
gucacguucggcg

SEQ ID NO: 1084558 - RNA, 20 nt, Mycobacterium bovis subsp bovis AF2122/97
gucacgguucgcccgucgcc

SEQ ID NO: 1084559 - RNA, 15 nt, Mycobacterium bovis subsp bovis AF2122/97
gucacguggucggcc

SEQ ID NO: 1084560 - RNA, 17 nt, Mycobacterium bovis subsp bovis AF2122/97
gucacguggucggccac

SEQ ID NO: 1084561 - RNA, 20 nt, Mycobacterium bovis subsp bovis AF2122/97
gucacucccuggccgcuucg

SEQ ID NO: 1084562 - RNA, 14 nt, Mycobacterium bovis subsp bovis AF2122/97
gucacuccggcggc

SEQ ID NO: 1084563 - RNA, 22 nt, Mycobacterium bovis subsp bovis AF2122/97
gucacucaccccaacagggcgg

SEQ ID NO: 1084564 - RNA, 19 nt, Mycobacterium bovis subsp bovis AF2122/97
gucagcaagaucggcagcg

SEQ ID NO: 1084565 - RNA, 19 nt, Mycobacterium bovis subsp bovis AF2122/97
gucagcaauacggcggcgc

SEQ ID NO: 1084566 - RNA, 17 nt, Mycobacterium bovis subsp bovis AF2122/97
gucagaacggcggcagc

SEQ ID NO: 1084567 - RNA, 15 nt, Mycobacterium bovis subsp bovis AF2122/97
gucagaacaccggcc

SEQ ID NO: 1084568 - RNA, 13 nt, Mycobacterium bovis subsp bovis AF2122/97
gucacugccaccu

SEQ ID NO: 1084569 - RNA, 19 nt, Mycobacterium bovis subsp bovis AF2122/97
gucaaagaugucgcugggu

SEQ ID NO: 1084570 - RNA, 14 nt, Mycobacterium bovis subsp bovis AF2122/97
gucaaagcccgacg

SEQ ID NO: 1084571 - RNA, 23 nt, Mycobacterium bovis subsp bovis AF2122/97
gucaaagaauucguucagcgcca

SEQ ID NO: 1084572 - RNA, 13 nt, Mycobacterium bovis subsp bovis AF2122/97
gucaaacccagcg

SEQ ID NO: 1084573 - RNA, 12 nt, Mycobacterium bovis subsp bovis AF2122/97
gucaaacgacag

SEQ ID NO: 1084574 - RNA, 14 nt, Mycobacterium bovis subsp bovis AF2122/97
gucaaacgcaaaga

SEQ ID NO: 1084575 - RNA, 18 nt, Mycobacterium bovis subsp bovis AF2122/97
gucaaacgccgucacggc

SEQ ID NO: 1084576 - RNA, 19 nt, Mycobacterium bovis subsp bovis AF2122/97
gucaaacgccgucacggca

SEQ ID NO: 1084577 - RNA, 14 nt, Mycobacterium bovis subsp bovis AF2122/97
gucaaacgcgcgcg

SEQ ID NO: 1084578 - RNA, 22 nt, Mycobacterium bovis subsp bovis AF2122/97
gucaacaagacgaugcuggcgg

SEQ ID NO: 1084579 - RNA, 12 nt, Mycobacterium bovis subsp bovis AF2122/97
gucaacaccgcg

SEQ ID NO: 1084580 - RNA, 17 nt, Mycobacterium bovis subsp bovis AF2122/97
gucaacaggccguggcg

SEQ ID NO: 1084581 - RNA, 15 nt, Mycobacterium bovis subsp bovis AF2122/97
gucaaauccagcagc

SEQ ID NO: 1084582 - RNA, 22 nt, Mycobacterium bovis subsp bovis AF2122/97
gucaaaaucagggugccgucgg

SEQ ID NO: 1084583 - RNA, 13 nt, Mycobacterium bovis subsp bovis AF2122/97
gucaaaauccgcg

SEQ ID NO: 1084584 - RNA, 16 nt, Mycobacterium bovis subsp bovis AF2122/97
guauucggccgcgaga

SEQ ID NO: 1084585 - RNA, 22 nt, Mycobacterium bovis subsp bovis AF2122/97
guauugccaaagcccgacauga

SEQ ID NO: 1084586 - RNA, 22 nt, Mycobacterium bovis subsp bovis AF2122/97
guauugggcgcggcaggccugg

SEQ ID NO: 1084587 - RNA, 16 nt, Mycobacterium bovis subsp bovis AF2122/97
guauugggguggcagc

SEQ ID NO: 1084588 - RNA, 14 nt, Mycobacterium bovis subsp bovis AF2122/97
guauucggcaucgc

SEQ ID NO: 1084589 - RNA, 16 nt, Mycobacterium bovis subsp bovis AF2122/97
guauuaccgccguggc

SEQ ID NO: 1084590 - RNA, 20 nt, Mycobacterium bovis subsp bovis AF2122/97
guaugcccgccguagaccag

SEQ ID NO: 1084591 - RNA, 17 nt, Mycobacterium bovis subsp bovis AF2122/97
guaugcccggauuggcg

SEQ ID NO: 1084592 - RNA, 19 nt, Mycobacterium bovis subsp bovis AF2122/97
guaugcgccaucucgacgg

SEQ ID NO: 1084593 - RNA, 23 nt, Mycobacterium bovis subsp bovis AF2122/97
guaugaggucuacuucggcgccg

SEQ ID NO: 1084594 - RNA, 23 nt, Mycobacterium bovis subsp bovis AF2122/97
guaucuguuccuugugaccccgg

SEQ ID NO: 1084595 - RNA, 13 nt, Mycobacterium bovis subsp bovis AF2122/97
guaugcggugacg

SEQ ID NO: 1084596 - RNA, 13 nt, Mycobacterium bovis subsp bovis AF2122/97
guaucugcugccg

SEQ ID NO: 1084597 - RNA, 17 nt, Mycobacterium bovis subsp bovis AF2122/97
guaugcgggacugaccc

SEQ ID NO: 1084598 - RNA, 14 nt, Mycobacterium bovis subsp bovis AF2122/97
guaugcugcgcgcc

SEQ ID NO: 1084599 - RNA, 21 nt, Mycobacterium bovis subsp bovis AF2122/97
guauguaaguuguagacgucg

SEQ ID NO: 1084600 - RNA, 15 nt, Mycobacterium bovis subsp bovis AF2122/97
guaucggucgacugg

SEQ ID NO: 1084601 - RNA, 20 nt, Mycobacterium bovis subsp bovis AF2122/97
guaucggugcuggucgccgc

SEQ ID NO: 1084602 - RNA, 20 nt, Mycobacterium bovis subsp bovis AF2122/97
guaucggcgugucucgucgc

SEQ ID NO: 1084603 - RNA, 24 nt, Mycobacterium bovis subsp bovis AF2122/97
guaucggggggucuugccgagcaa

SEQ ID NO: 1084604 - RNA, 19 nt, Mycobacterium bovis subsp bovis AF2122/97
guaucggcgugucucgucg

SEQ ID NO: 1084605 - RNA, 13 nt, Mycobacterium bovis subsp bovis AF2122/97
guaucgucccggc

SEQ ID NO: 1084606 - RNA, 22 nt, Mycobacterium bovis subsp bovis AF2122/97
guauccaccgcgagaccuucgg

SEQ ID NO: 1084607 - RNA, 22 nt, Mycobacterium bovis subsp bovis AF2122/97
guauccaggcccauacgugccg

SEQ ID NO: 1084608 - RNA, 15 nt, Mycobacterium bovis subsp bovis AF2122/97
guauccccgaccacu

SEQ ID NO: 1084609 - RNA, 19 nt, Mycobacterium bovis subsp bovis AF2122/97
guauccacggucgaccagg

SEQ ID NO: 1084610 - RNA, 18 nt, Mycobacterium bovis subsp bovis AF2122/97
gucaccaggccgaaaucc

SEQ ID NO: 1084611 - RNA, 18 nt, Mycobacterium bovis subsp bovis AF2122/97
gucaccagcgcaucggcc

SEQ ID NO: 1084612 - RNA, 16 nt, Mycobacterium bovis subsp bovis AF2122/97
gucaccauggcgccgc

SEQ ID NO: 1084613 - RNA, 19 nt, Mycobacterium bovis subsp bovis AF2122/97
gucaccauggcgccgcgcc

SEQ ID NO: 1084614 - RNA, 15 nt, Mycobacterium bovis subsp bovis AF2122/97
gucacccccgauacu

SEQ ID NO: 1084615 - RNA, 14 nt, Mycobacterium bovis subsp bovis AF2122/97
gucacccccggcca

SEQ ID NO: 1084616 - RNA, 16 nt, Mycobacterium bovis subsp bovis AF2122/97
gucaccccgcccagcg

SEQ ID NO: 1084617 - RNA, 13 nt, Mycobacterium bovis subsp bovis AF2122/97
gucacccguaucg

SEQ ID NO: 1084618 - RNA, 16 nt, Mycobacterium bovis subsp bovis AF2122/97
gucacacgccagccgg

SEQ ID NO: 1084619 - RNA, 16 nt, Mycobacterium bovis subsp bovis AF2122/97
gucaccaccgccgcca

SEQ ID NO: 1084620 - RNA, 19 nt, Mycobacterium bovis subsp bovis AF2122/97
gucaccaccguggcgcccg

SEQ ID NO: 1084621 - RNA, 18 nt, Mycobacterium bovis subsp bovis AF2122/97
gucaccaccuggugcaac

SEQ ID NO: 1084622 - RNA, 19 nt, Mycobacterium bovis subsp bovis AF2122/97
gucacacccacacccagcg

SEQ ID NO: 1084623 - RNA, 14 nt, Mycobacterium bovis subsp bovis AF2122/97
gucacaggcgacac

SEQ ID NO: 1084624 - RNA, 24 nt, Mycobacterium bovis subsp bovis AF2122/97
gucaccacgagggccacguagcag

SEQ ID NO: 1084625 - RNA, 18 nt, Mycobacterium bovis subsp bovis AF2122/97
gucaccacgaucgcagug

SEQ ID NO: 1084626 - RNA, 15 nt, Mycobacterium bovis subsp bovis AF2122/97
gucaccacggcggcg

SEQ ID NO: 1084627 - RNA, 19 nt, Mycobacterium bovis subsp bovis AF2122/97
gucacauccgacagcagcc

SEQ ID NO: 1084628 - RNA, 16 nt, Mycobacterium bovis subsp bovis AF2122/97
gucaccgcccuugccg

SEQ ID NO: 1084629 - RNA, 22 nt, Mycobacterium bovis subsp bovis AF2122/97
gucaccgcagccaacgucacca

SEQ ID NO: 1084630 - RNA, 16 nt, Mycobacterium bovis subsp bovis AF2122/97
gucaccgccggcaccg

SEQ ID NO: 1084631 - RNA, 12 nt, Mycobacterium bovis subsp bovis AF2122/97
gucaccgccggg

SEQ ID NO: 1084632 - RNA, 23 nt, Mycobacterium bovis subsp bovis AF2122/97
gucaccgccgggaagccgcaucu

SEQ ID NO: 1084633 - RNA, 15 nt, Mycobacterium bovis subsp bovis AF2122/97
gucacccugucgcgc

SEQ ID NO: 1084634 - RNA, 18 nt, Mycobacterium bovis subsp bovis AF2122/97
gucaccgcgucaccggag

SEQ ID NO: 1084635 - RNA, 14 nt, Mycobacterium bovis subsp bovis AF2122/97
gucaccgccggcac

SEQ ID NO: 1084636 - RNA, 14 nt, Mycobacterium bovis subsp bovis AF2122/97
gucaccgccggugc

SEQ ID NO: 1084637 - RNA, 16 nt, Mycobacterium bovis subsp bovis AF2122/97
gucaccgccguugccg

SEQ ID NO: 1084638 - RNA, 20 nt, Mycobacterium bovis subsp bovis AF2122/97
gucaccgccguugccgccgg

SEQ ID NO: 1084639 - RNA, 12 nt, Mycobacterium bovis subsp bovis AF2122/97
gucaccggccgc

SEQ ID NO: 1084640 - RNA, 16 nt, Mycobacterium bovis subsp bovis AF2122/97
gucaccggccgccgac

SEQ ID NO: 1084641 - RNA, 17 nt, Mycobacterium bovis subsp bovis AF2122/97
gucaccggccgccgaca

SEQ ID NO: 1084642 - RNA, 13 nt, Mycobacterium bovis subsp bovis AF2122/97
gucaccggcgacc

SEQ ID NO: 1084643 - RNA, 19 nt, Mycobacterium bovis subsp bovis AF2122/97
gucaccggcgcaccggagu

SEQ ID NO: 1084644 - RNA, 13 nt, Mycobacterium bovis subsp bovis AF2122/97
gucaccgcgaccc

SEQ ID NO: 1084645 - RNA, 17 nt, Mycobacterium bovis subsp bovis AF2122/97
gucaccgcgacggaacc

SEQ ID NO: 1084646 - RNA, 17 nt, Mycobacterium bovis subsp bovis AF2122/97
gucaccggaggccgccg

SEQ ID NO: 1084647 - RNA, 21 nt, Mycobacterium bovis subsp bovis AF2122/97
gucaccggaggccgccgcgcc

SEQ ID NO: 1084648 - RNA, 22 nt, Mycobacterium bovis subsp bovis AF2122/97
gucaacguggaugucucgauca

SEQ ID NO: 1084649 - RNA, 14 nt, Mycobacterium bovis subsp bovis AF2122/97
gucaacuccacgcg

SEQ ID NO: 1084650 - RNA, 14 nt, Mycobacterium bovis subsp bovis AF2122/97
gucaacucgaacgu

SEQ ID NO: 1084651 - RNA, 20 nt, Mycobacterium bovis subsp bovis AF2122/97
gucaagaucggugccagcac

SEQ ID NO: 1084652 - RNA, 23 nt, Mycobacterium bovis subsp bovis AF2122/97
gucaagauugaacgaguagccgg

SEQ ID NO: 1084653 - RNA, 24 nt, Mycobacterium bovis subsp bovis AF2122/97
gucaagagugcucagcgcgcgccg

SEQ ID NO: 1084654 - RNA, 13 nt, Mycobacterium bovis subsp bovis AF2122/97
gucaagccggcgc

SEQ ID NO: 1084655 - RNA, 16 nt, Mycobacterium bovis subsp bovis AF2122/97
gucaagccggcgcccg

SEQ ID NO: 1084656 - RNA, 12 nt, Mycobacterium bovis subsp bovis AF2122/97
gucaaccgaucg

SEQ ID NO: 1084657 - RNA, 23 nt, Mycobacterium bovis subsp bovis AF2122/97
gucaacccgcaccccggccgcgc

SEQ ID NO: 1084658 - RNA, 19 nt, Mycobacterium bovis subsp bovis AF2122/97
gucaaccagggugccggcg

SEQ ID NO: 1084659 - RNA, 20 nt, Mycobacterium bovis subsp bovis AF2122/97
gucaaccagggugccggcgg

SEQ ID NO: 1084660 - RNA, 21 nt, Mycobacterium bovis subsp bovis AF2122/97
gucaaccagggugccggcggu

SEQ ID NO: 1084661 - RNA, 20 nt, Mycobacterium bovis subsp bovis AF2122/97
gucaaccaagcgugccugca

SEQ ID NO: 1084662 - RNA, 19 nt, Mycobacterium bovis subsp bovis AF2122/97
gucaaccacggccgccgcg

SEQ ID NO: 1084663 - RNA, 13 nt, Mycobacterium bovis subsp bovis AF2122/97
gucaacgcuucgg

SEQ ID NO: 1084664 - RNA, 14 nt, Mycobacterium bovis subsp bovis AF2122/97
gucaacgcugacgu

SEQ ID NO: 1084665 - RNA, 16 nt, Mycobacterium bovis subsp bovis AF2122/97
gucaacgacgacgaca

SEQ ID NO: 1084666 - RNA, 17 nt, Mycobacterium bovis subsp bovis AF2122/97
gucaacgccacgccgau

SEQ ID NO: 1084667 - RNA, 20 nt, Mycobacterium bovis subsp bovis AF2122/97
gucaacgacauugccacggc

SEQ ID NO: 1084668 - RNA, 23 nt, Mycobacterium bovis subsp bovis AF2122/97
gucaacgacauugccacggcgcc

SEQ ID NO: 1084669 - RNA, 12 nt, Mycobacterium bovis subsp bovis AF2122/97
gucaacgauggu

SEQ ID NO: 1084670 - RNA, 18 nt, Mycobacterium bovis subsp bovis AF2122/97
gucaaucccacgcccggc

SEQ ID NO: 1084671 - RNA, 15 nt, Mycobacterium bovis subsp bovis AF2122/97
gucaaugacaccggg

SEQ ID NO: 1084672 - RNA, 17 nt, Mycobacterium bovis subsp bovis AF2122/97
gucaaugacaccggggc

SEQ ID NO: 1084673 - RNA, 16 nt, Mycobacterium bovis subsp bovis AF2122/97
gucaaugccggccgcg

SEQ ID NO: 1084674 - RNA, 17 nt, Mycobacterium bovis subsp bovis AF2122/97
gucaaugccggccgcgg

SEQ ID NO: 1084675 - RNA, 15 nt, Mycobacterium bovis subsp bovis AF2122/97
gucaaugcgcuggcg

SEQ ID NO: 1084676 - RNA, 21 nt, Mycobacterium bovis subsp bovis AF2122/97
gucaaugcgcuggcgccgccg

SEQ ID NO: 1084677 - RNA, 22 nt, Mycobacterium bovis subsp bovis AF2122/97
gucaaugcgcuggcgccgccgg

SEQ ID NO: 1084678 - RNA, 20 nt, Mycobacterium bovis subsp bovis AF2122/97
gucaagucugucuggcccca

SEQ ID NO: 1084679 - RNA, 20 nt, Mycobacterium bovis subsp bovis AF2122/97
gucaaguggcaaccgcaccg

SEQ ID NO: 1084680 - RNA, 18 nt, Mycobacterium bovis subsp bovis AF2122/97
gucacaccagcgggcauc

SEQ ID NO: 1084681 - RNA, 19 nt, Mycobacterium bovis subsp bovis AF2122/97
gucacaccagcgggcaucg

SEQ ID NO: 1084682 - RNA, 16 nt, Mycobacterium bovis subsp bovis AF2122/97
gucacaacgcgugacc

SEQ ID NO: 1084683 - RNA, 17 nt, Mycobacterium bovis subsp bovis AF2122/97
gucacaagccugccggc

SEQ ID NO: 1084684 - RNA, 17 nt, Mycobacterium bovis subsp bovis AF2122/97
gucacaagcugacacga

SEQ ID NO: 1084685 - RNA, 21 nt, Mycobacterium bovis subsp bovis AF2122/97
gucaauggucuuuguccacga

SEQ ID NO: 1084686 - RNA, 12 nt, Mycobacterium bovis subsp bovis AF2122/97
gcgcccagaccg

SEQ ID NO: 1084687 - RNA, 15 nt, Mycobacterium bovis subsp bovis AF2122/97
gcgcccagaucgccg

SEQ ID NO: 1084688 - RNA, 22 nt, Mycobacterium bovis subsp bovis AF2122/97
gcgccccaguucgacggcguca

SEQ ID NO: 1084689 - RNA, 22 nt, Mycobacterium bovis subsp bovis AF2122/97
gcgccccaugcaacacaccgcg

SEQ ID NO: 1084690 - RNA, 13 nt, Mycobacterium bovis subsp bovis AF2122/97
gcgccccaccgcg

SEQ ID NO: 1084691 - RNA, 17 nt, Mycobacterium bovis subsp bovis AF2122/97
gcgcccauggccaccag

SEQ ID NO: 1084692 - RNA, 17 nt, Mycobacterium bovis subsp bovis AF2122/97
gcgccccaccggcccgg

SEQ ID NO: 1084693 - RNA, 12 nt, Mycobacterium bovis subsp bovis AF2122/97
gcgcccgccggc

SEQ ID NO: 1084694 - RNA, 13 nt, Mycobacterium bovis subsp bovis AF2122/97
gcgcccgcggccg

SEQ ID NO: 1084695 - RNA, 19 nt, Mycobacterium bovis subsp bovis AF2122/97
gcgcccgcggccgccagcg

SEQ ID NO: 1084696 - RNA, 17 nt, Mycobacterium bovis subsp bovis AF2122/97
gcgccaggccacguagc

SEQ ID NO: 1084697 - RNA, 12 nt, Mycobacterium bovis subsp bovis AF2122/97
gcgccaggccgc

SEQ ID NO: 1084698 - RNA, 17 nt, Mycobacterium bovis subsp bovis AF2122/97
gcgccaggggugugccg

SEQ ID NO: 1084699 - RNA, 18 nt, Mycobacterium bovis subsp bovis AF2122/97
gcgccaggcgcgaucgcg

SEQ ID NO: 1084700 - RNA, 23 nt, Mycobacterium bovis subsp bovis AF2122/97
gcgccaugcccucggcgccgaac

SEQ ID NO: 1084701 - RNA, 16 nt, Mycobacterium bovis subsp bovis AF2122/97
gcgccauggucgcugc

SEQ ID NO: 1084702 - RNA, 20 nt, Mycobacterium bovis subsp bovis AF2122/97
gcgccaugcugucguagcgc

SEQ ID NO: 1084703 - RNA, 21 nt, Mycobacterium bovis subsp bovis AF2122/97
gcgccauggaucccacgaguu

SEQ ID NO: 1084704 - RNA, 15 nt, Mycobacterium bovis subsp bovis AF2122/97
gcgccaggucgguga

SEQ ID NO: 1084705 - RNA, 18 nt, Mycobacterium bovis subsp bovis AF2122/97
gcgccaggucagcucgag

SEQ ID NO: 1084706 - RNA, 17 nt, Mycobacterium bovis subsp bovis AF2122/97
gcgccaguaacgcccac

SEQ ID NO: 1084707 - RNA, 16 nt, Mycobacterium bovis subsp bovis AF2122/97
gcgccaugaagccggg

SEQ ID NO: 1084708 - RNA, 16 nt, Mycobacterium bovis subsp bovis AF2122/97
gcgccgaugccggcca

SEQ ID NO: 1084709 - RNA, 14 nt, Mycobacterium bovis subsp bovis AF2122/97
gcgccgauggccgc

SEQ ID NO: 1084710 - RNA, 23 nt, Mycobacterium bovis subsp bovis AF2122/97
gcgccgauguggccggcgauggc

SEQ ID NO: 1084711 - RNA, 16 nt, Mycobacterium bovis subsp bovis AF2122/97
gcgccgauuccaccgc

SEQ ID NO: 1084712 - RNA, 22 nt, Mycobacterium bovis subsp bovis AF2122/97
gcgccgauuccaccgccgacgc

SEQ ID NO: 1084713 - RNA, 18 nt, Mycobacterium bovis subsp bovis AF2122/97
gcgccgcaaugacgucgu

SEQ ID NO: 1084714 - RNA, 14 nt, Mycobacterium bovis subsp bovis AF2122/97
gcgccgcacacguc

SEQ ID NO: 1084715 - RNA, 20 nt, Mycobacterium bovis subsp bovis AF2122/97
gcgccgcacacucucgguga

SEQ ID NO: 1084716 - RNA, 20 nt, Mycobacterium bovis subsp bovis AF2122/97
gcgccgcaaucagacggcga

SEQ ID NO: 1084717 - RNA, 17 nt, Mycobacterium bovis subsp bovis AF2122/97
gcgccgcaaugacgucg

SEQ ID NO: 1084718 - RNA, 15 nt, Mycobacterium bovis subsp bovis AF2122/97
gcgccgcaaccgccg

SEQ ID NO: 1084719 - RNA, 20 nt, Mycobacterium bovis subsp bovis AF2122/97
gcgccgagagcaccgcucgg

SEQ ID NO: 1084720 - RNA, 15 nt, Mycobacterium bovis subsp bovis AF2122/97
gcgccgaccaccgcu

SEQ ID NO: 1084721 - RNA, 15 nt, Mycobacterium bovis subsp bovis AF2122/97
gcgccgagauccacg

SEQ ID NO: 1084722 - RNA, 18 nt, Mycobacterium bovis subsp bovis AF2122/97
gcgccgagauccacgcca

SEQ ID NO: 1084723 - RNA, 14 nt, Mycobacterium bovis subsp bovis AF2122/97
gcgccgagaucgac

SEQ ID NO: 1084724 - RNA, 14 nt, Mycobacterium bovis subsp bovis AF2122/97
gcgccgagccagca

SEQ ID NO: 1084725 - RNA, 17 nt, Mycobacterium bovis subsp bovis AF2122/97
gcgccgagccagcaccc

SEQ ID NO: 1084726 - RNA, 12 nt, Mycobacterium bovis subsp bovis AF2122/97
gcgccgagcucg

SEQ ID NO: 1084727 - RNA, 16 nt, Mycobacterium bovis subsp bovis AF2122/97
gcgccgaauucauccg

SEQ ID NO: 1084728 - RNA, 19 nt, Mycobacterium bovis subsp bovis AF2122/97
gcgccgaaugccaccucga

SEQ ID NO: 1084729 - RNA, 21 nt, Mycobacterium bovis subsp bovis AF2122/97
gcgccgaaugccaccucgacg

SEQ ID NO: 1084730 - RNA, 22 nt, Mycobacterium bovis subsp bovis AF2122/97
gcgccgaaugccaccucgacgc

SEQ ID NO: 1084731 - RNA, 13 nt, Mycobacterium bovis subsp bovis AF2122/97
gcgccgaccaccg

SEQ ID NO: 1084732 - RNA, 18 nt, Mycobacterium bovis subsp bovis AF2122/97
gcgccgaaguagccgacc

SEQ ID NO: 1084733 - RNA, 17 nt, Mycobacterium bovis subsp bovis AF2122/97
gcgcccgggguguucgu

SEQ ID NO: 1084734 - RNA, 13 nt, Mycobacterium bovis subsp bovis AF2122/97
gcgcccugcgcca

SEQ ID NO: 1084735 - RNA, 14 nt, Mycobacterium bovis subsp bovis AF2122/97
gcgcccucagccgc

SEQ ID NO: 1084736 - RNA, 18 nt, Mycobacterium bovis subsp bovis AF2122/97
gcgcccugagccaccccg

SEQ ID NO: 1084737 - RNA, 15 nt, Mycobacterium bovis subsp bovis AF2122/97
gcgcccuggccgccc

SEQ ID NO: 1084738 - RNA, 21 nt, Mycobacterium bovis subsp bovis AF2122/97
gcgccgaagccuugcagcgcc

SEQ ID NO: 1084739 - RNA, 20 nt, Mycobacterium bovis subsp bovis AF2122/97
gcgccgaacgcuccaggccu

SEQ ID NO: 1084740 - RNA, 17 nt, Mycobacterium bovis subsp bovis AF2122/97
gcgcccggcggaucccg

SEQ ID NO: 1084741 - RNA, 17 nt, Mycobacterium bovis subsp bovis AF2122/97
gcgcccggucgagccag

SEQ ID NO: 1084742 - RNA, 17 nt, Mycobacterium bovis subsp bovis AF2122/97
gcgcccgugccgcccgc

SEQ ID NO: 1084743 - RNA, 19 nt, Mycobacterium bovis subsp bovis AF2122/97
gcgcccgugccgcccgcgc

SEQ ID NO: 1084744 - RNA, 13 nt, Mycobacterium bovis subsp bovis AF2122/97
gcgcccgcucggc

SEQ ID NO: 1084745 - RNA, 17 nt, Mycobacterium bovis subsp bovis AF2122/97
gcgcccgcucggccgca

SEQ ID NO: 1084746 - RNA, 19 nt, Mycobacterium bovis subsp bovis AF2122/97
gcgcccgcgguccggcgaa

SEQ ID NO: 1084747 - RNA, 19 nt, Mycobacterium bovis subsp bovis AF2122/97
gcgcccgcuaacuggcccg

SEQ ID NO: 1084748 - RNA, 13 nt, Mycobacterium bovis subsp bovis AF2122/97
gcgcccggcgugg

SEQ ID NO: 1084749 - RNA, 21 nt, Mycobacterium bovis subsp bovis AF2122/97
gcgcauccaauccacgguugc

SEQ ID NO: 1084750 - RNA, 22 nt, Mycobacterium bovis subsp bovis AF2122/97
gcgcaguacuugaccguccacc

SEQ ID NO: 1084751 - RNA, 23 nt, Mycobacterium bovis subsp bovis AF2122/97
gcgcaguacuugaccguccaccg

SEQ ID NO: 1084752 - RNA, 19 nt, Mycobacterium bovis subsp bovis AF2122/97
gcgcagaaagucgcgcgcg

SEQ ID NO: 1084753 - RNA, 15 nt, Mycobacterium bovis subsp bovis AF2122/97
gcgcagaacaccacc

SEQ ID NO: 1084754 - RNA, 19 nt, Mycobacterium bovis subsp bovis AF2122/97
gcgcagaaacgccgagcgc

SEQ ID NO: 1084755 - RNA, 22 nt, Mycobacterium bovis subsp bovis AF2122/97
gcgcagaaacgccgagcgccag

SEQ ID NO: 1084756 - RNA, 17 nt, Mycobacterium bovis subsp bovis AF2122/97
gcgcacuugcguggcgu

SEQ ID NO: 1084757 - RNA, 22 nt, Mycobacterium bovis subsp bovis AF2122/97
gcgcacucccggauauugccau

SEQ ID NO: 1084758 - RNA, 21 nt, Mycobacterium bovis subsp bovis AF2122/97
gcgcacucccggcucggccag

SEQ ID NO: 1084759 - RNA, 18 nt, Mycobacterium bovis subsp bovis AF2122/97
gcgcacucgaccaggacc

SEQ ID NO: 1084760 - RNA, 13 nt, Mycobacterium bovis subsp bovis AF2122/97
gcgcacucgacgc

SEQ ID NO: 1084761 - RNA, 16 nt, Mycobacterium bovis subsp bovis AF2122/97
gcgcacucuagccggg

SEQ ID NO: 1084762 - RNA, 16 nt, Mycobacterium bovis subsp bovis AF2122/97
gcgcagaacaccaccg

SEQ ID NO: 1084763 - RNA, 18 nt, Mycobacterium bovis subsp bovis AF2122/97
gcgcaggugccuuucggc

SEQ ID NO: 1084764 - RNA, 23 nt, Mycobacterium bovis subsp bovis AF2122/97
gcgcaggugccuuucggcagacc

SEQ ID NO: 1084765 - RNA, 18 nt, Mycobacterium bovis subsp bovis AF2122/97
gcgcagguucucggugcc

SEQ ID NO: 1084766 - RNA, 22 nt, Mycobacterium bovis subsp bovis AF2122/97
gcgcagguuggcaagcacggcg

SEQ ID NO: 1084767 - RNA, 21 nt, Mycobacterium bovis subsp bovis AF2122/97
gcgcaguaacgucgucgcguc

SEQ ID NO: 1084768 - RNA, 22 nt, Mycobacterium bovis subsp bovis AF2122/97
gcgcauccgguuuggucgccgc

SEQ ID NO: 1084769 - RNA, 14 nt, Mycobacterium bovis subsp bovis AF2122/97
gcgcaucccgaagu

SEQ ID NO: 1084770 - RNA, 12 nt, Mycobacterium bovis subsp bovis AF2122/97
gcgcaucgcacg

SEQ ID NO: 1084771 - RNA, 20 nt, Mycobacterium bovis subsp bovis AF2122/97
gcgcaucgcacgggccacca

SEQ ID NO: 1084772 - RNA, 23 nt, Mycobacterium bovis subsp bovis AF2122/97
gcgcaucgcacgggccaccagcg

SEQ ID NO: 1084773 - RNA, 12 nt, Mycobacterium bovis subsp bovis AF2122/97
gcgcaucgccaa

SEQ ID NO: 1084774 - RNA, 13 nt, Mycobacterium bovis subsp bovis AF2122/97
gcgcaucccgaag

SEQ ID NO: 1084775 - RNA, 18 nt, Mycobacterium bovis subsp bovis AF2122/97
gcgcaugccccgaccgcg

SEQ ID NO: 1084776 - RNA, 18 nt, Mycobacterium bovis subsp bovis AF2122/97
gcgcaugcaagucaaacg

SEQ ID NO: 1084777 - RNA, 18 nt, Mycobacterium bovis subsp bovis AF2122/97
gcgcaucgccgacagcgc

SEQ ID NO: 1084778 - RNA, 14 nt, Mycobacterium bovis subsp bovis AF2122/97
gcgcaucgagcacc

SEQ ID NO: 1084779 - RNA, 15 nt, Mycobacterium bovis subsp bovis AF2122/97
gcgcaucgccgcugg

SEQ ID NO: 1084780 - RNA, 17 nt, Mycobacterium bovis subsp bovis AF2122/97
gcgcaucgccgcuggcc

SEQ ID NO: 1084781 - RNA, 22 nt, Mycobacterium bovis subsp bovis AF2122/97
gcgcauggucagguaggcgucg

SEQ ID NO: 1084782 - RNA, 19 nt, Mycobacterium bovis subsp bovis AF2122/97
gcgccaaaauccgcccacc

SEQ ID NO: 1084783 - RNA, 16 nt, Mycobacterium bovis subsp bovis AF2122/97
gcgcauggccaaaaac

SEQ ID NO: 1084784 - RNA, 15 nt, Mycobacterium bovis subsp bovis AF2122/97
gcgccaacccggcca

SEQ ID NO: 1084785 - RNA, 19 nt, Mycobacterium bovis subsp bovis AF2122/97
gcgccaagacgucggcgug

SEQ ID NO: 1084786 - RNA, 15 nt, Mycobacterium bovis subsp bovis AF2122/97
gcgccaacgggcugc

SEQ ID NO: 1084787 - RNA, 15 nt, Mycobacterium bovis subsp bovis AF2122/97
gcgccaaggcgaugg

SEQ ID NO: 1084788 - RNA, 18 nt, Mycobacterium bovis subsp bovis AF2122/97
gcgccaaguggcgcucgc

SEQ ID NO: 1084789 - RNA, 19 nt, Mycobacterium bovis subsp bovis AF2122/97
gcgccagcgccugcgcgca

SEQ ID NO: 1084790 - RNA, 21 nt, Mycobacterium bovis subsp bovis AF2122/97
gcgccagcguuaggucgccgg

SEQ ID NO: 1084791 - RNA, 18 nt, Mycobacterium bovis subsp bovis AF2122/97
gcgccagcuccgugucgg

SEQ ID NO: 1084792 - RNA, 19 nt, Mycobacterium bovis subsp bovis AF2122/97
gcgccagcucggcggcagc

SEQ ID NO: 1084793 - RNA, 14 nt, Mycobacterium bovis subsp bovis AF2122/97
gcgccagcucggcg

SEQ ID NO: 1084794 - RNA, 17 nt, Mycobacterium bovis subsp bovis AF2122/97
gcgccaggagcgcggcc

SEQ ID NO: 1084795 - RNA, 18 nt, Mycobacterium bovis subsp bovis AF2122/97
gcgccaggagcgcggccc

SEQ ID NO: 1084796 - RNA, 17 nt, Mycobacterium bovis subsp bovis AF2122/97
gcgccaggaguggccac

SEQ ID NO: 1084797 - RNA, 18 nt, Mycobacterium bovis subsp bovis AF2122/97
gcgccaggaguggccacg

SEQ ID NO: 1084798 - RNA, 20 nt, Mycobacterium bovis subsp bovis AF2122/97
gcgccaggaguggccacguu

SEQ ID NO: 1084799 - RNA, 24 nt, Mycobacterium bovis subsp bovis AF2122/97
gcgccaggaguggccacguugcgc

SEQ ID NO: 1084800 - RNA, 14 nt, Mycobacterium bovis subsp bovis AF2122/97
gcgccagccgaccg

SEQ ID NO: 1084801 - RNA, 15 nt, Mycobacterium bovis subsp bovis AF2122/97
gcgccagccgaccga

SEQ ID NO: 1084802 - RNA, 14 nt, Mycobacterium bovis subsp bovis AF2122/97
gcgccagcgccgcc

SEQ ID NO: 1084803 - RNA, 16 nt, Mycobacterium bovis subsp bovis AF2122/97
gcgccagcgccugcgc

SEQ ID NO: 1084804 - RNA, 18 nt, Mycobacterium bovis subsp bovis AF2122/97
gcgccagcgagcauaccg

SEQ ID NO: 1084805 - RNA, 18 nt, Mycobacterium bovis subsp bovis AF2122/97
gcgccagcgauaucggcg

SEQ ID NO: 1084806 - RNA, 14 nt, Mycobacterium bovis subsp bovis AF2122/97
gcgccacgccgagg

SEQ ID NO: 1084807 - RNA, 16 nt, Mycobacterium bovis subsp bovis AF2122/97
gcgccacggcagcgcc

SEQ ID NO: 1084808 - RNA, 14 nt, Mycobacterium bovis subsp bovis AF2122/97
gcgccacgcacccg

SEQ ID NO: 1084809 - RNA, 20 nt, Mycobacterium bovis subsp bovis AF2122/97
gcgccacgcacccggcaauc

SEQ ID NO: 1084810 - RNA, 14 nt, Mycobacterium bovis subsp bovis AF2122/97
gcgccacgccaccg

SEQ ID NO: 1084811 - RNA, 23 nt, Mycobacterium bovis subsp bovis AF2122/97
gcgccacgccaccgcggucaccg

SEQ ID NO: 1084812 - RNA, 22 nt, Mycobacterium bovis subsp bovis AF2122/97
gcgccacaacguugcaccgaga

SEQ ID NO: 1084813 - RNA, 17 nt, Mycobacterium bovis subsp bovis AF2122/97
gcgccaccucccacgcc

SEQ ID NO: 1084814 - RNA, 21 nt, Mycobacterium bovis subsp bovis AF2122/97
gcgccaccucccacgccgccg

SEQ ID NO: 1084815 - RNA, 16 nt, Mycobacterium bovis subsp bovis AF2122/97
gcgccaccuccgacgg

SEQ ID NO: 1084816 - RNA, 14 nt, Mycobacterium bovis subsp bovis AF2122/97
gcgccaccucgacg

SEQ ID NO: 1084817 - RNA, 18 nt, Mycobacterium bovis subsp bovis AF2122/97
gcgccaauucagcggcaa

SEQ ID NO: 1084818 - RNA, 23 nt, Mycobacterium bovis subsp bovis AF2122/97
gcgccgccaacuccucagccgcc

SEQ ID NO: 1084819 - RNA, 20 nt, Mycobacterium bovis subsp bovis AF2122/97
gcgccgccaccccgcgcgcc

SEQ ID NO: 1084820 - RNA, 19 nt, Mycobacterium bovis subsp bovis AF2122/97
gcgccgccaccgaagccgc

SEQ ID NO: 1084821 - RNA, 13 nt, Mycobacterium bovis subsp bovis AF2122/97
gcgccgccagcac

SEQ ID NO: 1084822 - RNA, 17 nt, Mycobacterium bovis subsp bovis AF2122/97
gcgccgccagcaccacc

SEQ ID NO: 1084823 - RNA, 14 nt, Mycobacterium bovis subsp bovis AF2122/97
gcgccgccagcgcc

SEQ ID NO: 1084824 - RNA, 20 nt, Mycobacterium bovis subsp bovis AF2122/97
gcgccgccagcgccgccggc

SEQ ID NO: 1084825 - RNA, 17 nt, Mycobacterium bovis subsp bovis AF2122/97
gcgccgcuaaccggacc

SEQ ID NO: 1084826 - RNA, 23 nt, Mycobacterium bovis subsp bovis AF2122/97
gcgccgcguggcuggcggcgacc

SEQ ID NO: 1084827 - RNA, 21 nt, Mycobacterium bovis subsp bovis AF2122/97
gcgccgcuaggugacgccgcc

SEQ ID NO: 1084828 - RNA, 19 nt, Mycobacterium bovis subsp bovis AF2122/97
gcgccgcugggugaccagg

SEQ ID NO: 1084829 - RNA, 18 nt, Mycobacterium bovis subsp bovis AF2122/97
gcgccgcuuggcgauccg

SEQ ID NO: 1084830 - RNA, 13 nt, Mycobacterium bovis subsp bovis AF2122/97
gcgccggacagcg

SEQ ID NO: 1084831 - RNA, 22 nt, Mycobacterium bovis subsp bovis AF2122/97
gcgccggaaccccucgauuccc

SEQ ID NO: 1084832 - RNA, 22 nt, Mycobacterium bovis subsp bovis AF2122/97
gcgccggaacgagcggccgcgc

SEQ ID NO: 1084833 - RNA, 17 nt, Mycobacterium bovis subsp bovis AF2122/97
gcgccggcaucgacgua

SEQ ID NO: 1084834 - RNA, 14 nt, Mycobacterium bovis subsp bovis AF2122/97
gcgccggcaucgcg

SEQ ID NO: 1084835 - RNA, 15 nt, Mycobacterium bovis subsp bovis AF2122/97
gcgccggcaucgcgc

SEQ ID NO: 1084836 - RNA, 20 nt, Mycobacterium bovis subsp bovis AF2122/97
gcgccggcaucggucagcgc

SEQ ID NO: 1084837 - RNA, 14 nt, Mycobacterium bovis subsp bovis AF2122/97
gcgccggacagcgc

SEQ ID NO: 1084838 - RNA, 15 nt, Mycobacterium bovis subsp bovis AF2122/97
gcgccggccaggcua

SEQ ID NO: 1084839 - RNA, 16 nt, Mycobacterium bovis subsp bovis AF2122/97
gcgccggccgcggcgg

SEQ ID NO: 1084840 - RNA, 21 nt, Mycobacterium bovis subsp bovis AF2122/97
gcgccggccgcggcggccccg

SEQ ID NO: 1084841 - RNA, 15 nt, Mycobacterium bovis subsp bovis AF2122/97
gcgccggccgaucgg

SEQ ID NO: 1084842 - RNA, 18 nt, Mycobacterium bovis subsp bovis AF2122/97
gcgccggccgcgggucgc

SEQ ID NO: 1084843 - RNA, 13 nt, Mycobacterium bovis subsp bovis AF2122/97
gcgccggccggcg

SEQ ID NO: 1084844 - RNA, 16 nt, Mycobacterium bovis subsp bovis AF2122/97
gcgccggccucgccgg

SEQ ID NO: 1084845 - RNA, 15 nt, Mycobacterium bovis subsp bovis AF2122/97
gcgccggcguugccg

SEQ ID NO: 1084846 - RNA, 23 nt, Mycobacterium bovis subsp bovis AF2122/97
gcgccggcugccacacaggcguc

SEQ ID NO: 1084847 - RNA, 17 nt, Mycobacterium bovis subsp bovis AF2122/97
gcgccggucagggacga

SEQ ID NO: 1084848 - RNA, 21 nt, Mycobacterium bovis subsp bovis AF2122/97
gcgccgguccucgucggcgaa

SEQ ID NO: 1084849 - RNA, 18 nt, Mycobacterium bovis subsp bovis AF2122/97
gcgccggucggaucggug

SEQ ID NO: 1084850 - RNA, 14 nt, Mycobacterium bovis subsp bovis AF2122/97
gcgccggucgccga

SEQ ID NO: 1084851 - RNA, 17 nt, Mycobacterium bovis subsp bovis AF2122/97
gcgccggucgccgacgg

SEQ ID NO: 1084852 - RNA, 19 nt, Mycobacterium bovis subsp bovis AF2122/97
gcgccggucgccgacggcg

SEQ ID NO: 1084853 - RNA, 21 nt, Mycobacterium bovis subsp bovis AF2122/97
gcgccggucgccgacggcgac

SEQ ID NO: 1084854 - RNA, 18 nt, Mycobacterium bovis subsp bovis AF2122/97
gcgccgucgaaauacccg

SEQ ID NO: 1084855 - RNA, 15 nt, Mycobacterium bovis subsp bovis AF2122/97
gcgccgucgcccagc

SEQ ID NO: 1084856 - RNA, 14 nt, Mycobacterium bovis subsp bovis AF2122/97
gcgccgucgaugac

SEQ ID NO: 1084857 - RNA, 22 nt, Mycobacterium bovis subsp bovis AF2122/97
gcgccgucggagccggccaccu

SEQ ID NO: 1084858 - RNA, 19 nt, Mycobacterium bovis subsp bovis AF2122/97
gcgccgucggagccggcca

SEQ ID NO: 1084859 - RNA, 18 nt, Mycobacterium bovis subsp bovis AF2122/97
gcgccguggcgucggugg

SEQ ID NO: 1084860 - RNA, 15 nt, Mycobacterium bovis subsp bovis AF2122/97
gcgccguuaccgccg

SEQ ID NO: 1084861 - RNA, 20 nt, Mycobacterium bovis subsp bovis AF2122/97
gcgccguggaucaucccgac

SEQ ID NO: 1084862 - RNA, 21 nt, Mycobacterium bovis subsp bovis AF2122/97
gcgccggucagcaauacggcg

SEQ ID NO: 1084863 - RNA, 19 nt, Mycobacterium bovis subsp bovis AF2122/97
gcgccgugaucagcucgcg

SEQ ID NO: 1084864 - RNA, 20 nt, Mycobacterium bovis subsp bovis AF2122/97
gcgccguucgcucccccgcu

SEQ ID NO: 1084865 - RNA, 20 nt, Mycobacterium bovis subsp bovis AF2122/97
gcgccguucgccuggucacc

SEQ ID NO: 1084866 - RNA, 16 nt, Mycobacterium bovis subsp bovis AF2122/97
gcgccguucgcucccc

SEQ ID NO: 1084867 - RNA, 16 nt, Mycobacterium bovis subsp bovis AF2122/97
gcgccguuagcgucgc

SEQ ID NO: 1084868 - RNA, 18 nt, Mycobacterium bovis subsp bovis AF2122/97
gcgccguucacccuggug

SEQ ID NO: 1084869 - RNA, 16 nt, Mycobacterium bovis subsp bovis AF2122/97
gcgccguugucggcgg

SEQ ID NO: 1084870 - RNA, 18 nt, Mycobacterium bovis subsp bovis AF2122/97
gcgccguugucggcggug

SEQ ID NO: 1084871 - RNA, 19 nt, Mycobacterium bovis subsp bovis AF2122/97
gcgccguugccgccgucgc

SEQ ID NO: 1084872 - RNA, 20 nt, Mycobacterium bovis subsp bovis AF2122/97
gcgccguugccgccgucgcc

SEQ ID NO: 1084873 - RNA, 18 nt, Mycobacterium bovis subsp bovis AF2122/97
gcgccguugccggccacc

SEQ ID NO: 1084874 - RNA, 20 nt, Mycobacterium bovis subsp bovis AF2122/97
gcgccuaaagacucgaccaa

SEQ ID NO: 1084875 - RNA, 21 nt, Mycobacterium bovis subsp bovis AF2122/97
gcgccuaaccccggcucgacg

SEQ ID NO: 1084876 - RNA, 22 nt, Mycobacterium bovis subsp bovis AF2122/97
gcgccuaaccccggcucgacgc

SEQ ID NO: 1084877 - RNA, 13 nt, Mycobacterium bovis subsp bovis AF2122/97
gcgccucgauccg

SEQ ID NO: 1084878 - RNA, 14 nt, Mycobacterium bovis subsp bovis AF2122/97
gcgccuccacucuu

SEQ ID NO: 1084879 - RNA, 15 nt, Mycobacterium bovis subsp bovis AF2122/97
gcgccuccacucuuc

SEQ ID NO: 1084880 - RNA, 18 nt, Mycobacterium bovis subsp bovis AF2122/97
gcgccucaucggacagcg

SEQ ID NO: 1084881 - RNA, 15 nt, Mycobacterium bovis subsp bovis AF2122/97
gcgccuaugggccug

SEQ ID NO: 1084882 - RNA, 19 nt, Mycobacterium bovis subsp bovis AF2122/97
gcgccucaucggacagcgc

SEQ ID NO: 1084883 - RNA, 17 nt, Mycobacterium bovis subsp bovis AF2122/97
gcgccucgccggccacc

SEQ ID NO: 1084884 - RNA, 18 nt, Mycobacterium bovis subsp bovis AF2122/97
gcgccucgccggccaccc

SEQ ID NO: 1084885 - RNA, 22 nt, Mycobacterium bovis subsp bovis AF2122/97
gcgccucggaccagacccacga

SEQ ID NO: 1084886 - RNA, 14 nt, Mycobacterium bovis subsp bovis AF2122/97
gcgccucggcaucg

SEQ ID NO: 1084887 - RNA, 23 nt, Mycobacterium bovis subsp bovis AF2122/97
gcgccucgugcgugggcgcggcg

SEQ ID NO: 1084888 - RNA, 14 nt, Mycobacterium bovis subsp bovis AF2122/97
gcgccucggcggcc

SEQ ID NO: 1084889 - RNA, 15 nt, Mycobacterium bovis subsp bovis AF2122/97
gcgccucgugcgugg

SEQ ID NO: 1084890 - RNA, 16 nt, Mycobacterium bovis subsp bovis AF2122/97
gcgccugaauaggucg

SEQ ID NO: 1084891 - RNA, 19 nt, Mycobacterium bovis subsp bovis AF2122/97
gcgccugacucaucaccga

SEQ ID NO: 1084892 - RNA, 13 nt, Mycobacterium bovis subsp bovis AF2122/97
gcgccugcguucc

SEQ ID NO: 1084893 - RNA, 13 nt, Mycobacterium bovis subsp bovis AF2122/97
gcgccuggagcga

SEQ ID NO: 1084894 - RNA, 17 nt, Mycobacterium bovis subsp bovis AF2122/97
gcgccuggagcgaucuc

SEQ ID NO: 1084895 - RNA, 17 nt, Mycobacterium bovis subsp bovis AF2122/97
gcgccugaugcggccgg

SEQ ID NO: 1084896 - RNA, 17 nt, Mycobacterium bovis subsp bovis AF2122/97
gcgccuugaagcggugg

SEQ ID NO: 1084897 - RNA, 13 nt, Mycobacterium bovis subsp bovis AF2122/97
gcgccuugaccac

SEQ ID NO: 1084898 - RNA, 21 nt, Mycobacterium bovis subsp bovis AF2122/97
gcgccuugauggucuccacca

SEQ ID NO: 1084899 - RNA, 14 nt, Mycobacterium bovis subsp bovis AF2122/97
gcgccuugaccaca

SEQ ID NO: 1084900 - RNA, 17 nt, Mycobacterium bovis subsp bovis AF2122/97
gcgccuugaccagcagc

SEQ ID NO: 1084901 - RNA, 16 nt, Mycobacterium bovis subsp bovis AF2122/97
gcgccuucaccuggug

SEQ ID NO: 1084902 - RNA, 21 nt, Mycobacterium bovis subsp bovis AF2122/97
gcgccuucgccagcggcgcga

SEQ ID NO: 1084903 - RNA, 21 nt, Mycobacterium bovis subsp bovis AF2122/97
gcgccugguccucacggguca

SEQ ID NO: 1084904 - RNA, 20 nt, Mycobacterium bovis subsp bovis AF2122/97
gcgccugugccaccgcugga

SEQ ID NO: 1084905 - RNA, 23 nt, Mycobacterium bovis subsp bovis AF2122/97
gcgccuugcuuccgggacuacca

SEQ ID NO: 1084906 - RNA, 18 nt, Mycobacterium bovis subsp bovis AF2122/97
gcgccuuggucgccgccu

SEQ ID NO: 1084907 - RNA, 18 nt, Mycobacterium bovis subsp bovis AF2122/97
gcgccuuggucgccggcg

SEQ ID NO: 1084908 - RNA, 14 nt, Mycobacterium bovis subsp bovis AF2122/97
gcgccuugucgauc

SEQ ID NO: 1084909 - RNA, 18 nt, Mycobacterium bovis subsp bovis AF2122/97
gcgccuuguggcacaccc

SEQ ID NO: 1084910 - RNA, 15 nt, Mycobacterium bovis subsp bovis AF2122/97
gcgccuuguuggcga

SEQ ID NO: 1084911 - RNA, 20 nt, Mycobacterium bovis subsp bovis AF2122/97
gcgcgaaaccaguccaucga

SEQ ID NO: 1084912 - RNA, 14 nt, Mycobacterium bovis subsp bovis AF2122/97
gcgcgaaacgccgc

SEQ ID NO: 1084913 - RNA, 16 nt, Mycobacterium bovis subsp bovis AF2122/97
gcgccuuucgucgaag

SEQ ID NO: 1084914 - RNA, 16 nt, Mycobacterium bovis subsp bovis AF2122/97
gcgccuuggucgccgg

SEQ ID NO: 1084915 - RNA, 15 nt, Mycobacterium bovis subsp bovis AF2122/97
gcgcgaaccugcucg

SEQ ID NO: 1084916 - RNA, 16 nt, Mycobacterium bovis subsp bovis AF2122/97
gcgcgaaccugcucgg

SEQ ID NO: 1084917 - RNA, 18 nt, Mycobacterium bovis subsp bovis AF2122/97
gcgcgaaccugcucggcg

SEQ ID NO: 1084918 - RNA, 22 nt, Mycobacterium bovis subsp bovis AF2122/97
gcgcgaaggauuugauaggcgc

SEQ ID NO: 1084919 - RNA, 23 nt, Mycobacterium bovis subsp bovis AF2122/97
gcgcgaacgucaaccgggcggcg

SEQ ID NO: 1084920 - RNA, 14 nt, Mycobacterium bovis subsp bovis AF2122/97
gcgcgaagccacca

SEQ ID NO: 1084921 - RNA, 15 nt, Mycobacterium bovis subsp bovis AF2122/97
gcgcgaagccaccag

SEQ ID NO: 1084922 - RNA, 22 nt, Mycobacterium bovis subsp bovis AF2122/97
gcgcgacagccguggcgcgacg

SEQ ID NO: 1084923 - RNA, 13 nt, Mycobacterium bovis subsp bovis AF2122/97
gcgcgacaggccc

SEQ ID NO: 1084924 - RNA, 15 nt, Mycobacterium bovis subsp bovis AF2122/97
gcgcgaaagcgccga

SEQ ID NO: 1084925 - RNA, 13 nt, Mycobacterium bovis subsp bovis AF2122/97
gcgcgaaccccag

SEQ ID NO: 1084926 - RNA, 15 nt, Mycobacterium bovis subsp bovis AF2122/97
gcgcgaacccggccc

SEQ ID NO: 1084927 - RNA, 14 nt, Mycobacterium bovis subsp bovis AF2122/97
gcgcgaaccgcucc

SEQ ID NO: 1084928 - RNA, 18 nt, Mycobacterium bovis subsp bovis AF2122/97
gcgcgaaacgccgcaaug

SEQ ID NO: 1084929 - RNA, 14 nt, Mycobacterium bovis subsp bovis AF2122/97
gcgcgaaagcgccg

SEQ ID NO: 1084930 - RNA, 22 nt, Mycobacterium bovis subsp bovis AF2122/97
gcgcgaacacccgaagccggcg

SEQ ID NO: 1084931 - RNA, 18 nt, Mycobacterium bovis subsp bovis AF2122/97
gcgcgaccaaugcguuga

SEQ ID NO: 1084932 - RNA, 14 nt, Mycobacterium bovis subsp bovis AF2122/97
gcgcgaccauaccc

SEQ ID NO: 1084933 - RNA, 23 nt, Mycobacterium bovis subsp bovis AF2122/97
gcgcgaccauacccgcgcgcacc

SEQ ID NO: 1084934 - RNA, 22 nt, Mycobacterium bovis subsp bovis AF2122/97
gcgcgaccgaaaauucaggcgc

SEQ ID NO: 1084935 - RNA, 16 nt, Mycobacterium bovis subsp bovis AF2122/97
gcgcgaccccaggcgc

SEQ ID NO: 1084936 - RNA, 17 nt, Mycobacterium bovis subsp bovis AF2122/97
gcgcgaccucgcuggcc

SEQ ID NO: 1084937 - RNA, 14 nt, Mycobacterium bovis subsp bovis AF2122/97
gcgcgaccgcggcg

SEQ ID NO: 1084938 - RNA, 15 nt, Mycobacterium bovis subsp bovis AF2122/97
gcgcgaccgcggcga

SEQ ID NO: 1084939 - RNA, 14 nt, Mycobacterium bovis subsp bovis AF2122/97
gcgcgaggucggcg

SEQ ID NO: 1084940 - RNA, 17 nt, Mycobacterium bovis subsp bovis AF2122/97
gcgcgaggucggcggcg

SEQ ID NO: 1084941 - RNA, 18 nt, Mycobacterium bovis subsp bovis AF2122/97
gcgcgaggucggcggcgc

SEQ ID NO: 1084942 - RNA, 19 nt, Mycobacterium bovis subsp bovis AF2122/97
gcgcgaggucggcggcgca

SEQ ID NO: 1084943 - RNA, 16 nt, Mycobacterium bovis subsp bovis AF2122/97
gcgcgauggacccaag

SEQ ID NO: 1084944 - RNA, 16 nt, Mycobacterium bovis subsp bovis AF2122/97
gcgcgaugcuggcgaa

SEQ ID NO: 1084945 - RNA, 20 nt, Mycobacterium bovis subsp bovis AF2122/97
gcgcgauggcagcgccgaug

SEQ ID NO: 1084946 - RNA, 18 nt, Mycobacterium bovis subsp bovis AF2122/97
gcgcgauggcagcgccga

SEQ ID NO: 1084947 - RNA, 15 nt, Mycobacterium bovis subsp bovis AF2122/97
gcgcgauggccguug

SEQ ID NO: 1084948 - RNA, 17 nt, Mycobacterium bovis subsp bovis AF2122/97
gcgcgauggccguugcc

SEQ ID NO: 1084949 - RNA, 12 nt, Mycobacterium bovis subsp bovis AF2122/97
gcgcgauggcgc

SEQ ID NO: 1084950 - RNA, 17 nt, Mycobacterium bovis subsp bovis AF2122/97
gcgcgaugucgccggcg

SEQ ID NO: 1084951 - RNA, 21 nt, Mycobacterium bovis subsp bovis AF2122/97
gcgcgaugucgccggcgacca

SEQ ID NO: 1084952 - RNA, 17 nt, Mycobacterium bovis subsp bovis AF2122/97
gcgcgaugucguucgcg

SEQ ID NO: 1084953 - RNA, 20 nt, Mycobacterium bovis subsp bovis AF2122/97
gcgcgaugaccucggcgaug

SEQ ID NO: 1084954 - RNA, 18 nt, Mycobacterium bovis subsp bovis AF2122/97
gcgcgaugaccucggcga

SEQ ID NO: 1084955 - RNA, 14 nt, Mycobacterium bovis subsp bovis AF2122/97
gcgcgaucgucgac

SEQ ID NO: 1084956 - RNA, 14 nt, Mycobacterium bovis subsp bovis AF2122/97
gcgcgauaggugcu

SEQ ID NO: 1084957 - RNA, 13 nt, Mycobacterium bovis subsp bovis AF2122/97
gcgcgaucaacgc

SEQ ID NO: 1084958 - RNA, 15 nt, Mycobacterium bovis subsp bovis AF2122/97
gcgaccagccgagcg

SEQ ID NO: 1084959 - RNA, 18 nt, Mycobacterium bovis subsp bovis AF2122/97
gcgaccagaggaugucga

SEQ ID NO: 1084960 - RNA, 19 nt, Mycobacterium bovis subsp bovis AF2122/97
gcgaccagaggaugucgau

SEQ ID NO: 1084961 - RNA, 21 nt, Mycobacterium bovis subsp bovis AF2122/97
gcgaccagauagaacaacguc

SEQ ID NO: 1084962 - RNA, 19 nt, Mycobacterium bovis subsp bovis AF2122/97
gcgaccauggugguaucca

SEQ ID NO: 1084963 - RNA, 20 nt, Mycobacterium bovis subsp bovis AF2122/97
aagccgaccguaccgaucca

SEQ ID NO: 1084964 - RNA, 15 nt, Mycobacterium bovis subsp bovis AF2122/97
gcgaccacgccgccg

SEQ ID NO: 1084965 - RNA, 23 nt, Mycobacterium bovis subsp bovis AF2122/97
gcgaccacggcaccgaucaacgg

SEQ ID NO: 1084966 - RNA, 14 nt, Mycobacterium bovis subsp bovis AF2122/97
gcgaccacgucggc

SEQ ID NO: 1084967 - RNA, 16 nt, Mycobacterium bovis subsp bovis AF2122/97
gcgaccacgucggcga

SEQ ID NO: 1084968 - RNA, 17 nt, Mycobacterium bovis subsp bovis AF2122/97
gcgaccacgucggcgaa

SEQ ID NO: 1084969 - RNA, 15 nt, Mycobacterium bovis subsp bovis AF2122/97
gcgaccaccagcgcc

SEQ ID NO: 1084970 - RNA, 17 nt, Mycobacterium bovis subsp bovis AF2122/97
gcgaccaccgcggcugc

SEQ ID NO: 1084971 - RNA, 16 nt, Mycobacterium bovis subsp bovis AF2122/97
gcgaccaccgcgucgg

SEQ ID NO: 1084972 - RNA, 15 nt, Mycobacterium bovis subsp bovis AF2122/97
gcgaccaccaccgcc

SEQ ID NO: 1084973 - RNA, 22 nt, Mycobacterium bovis subsp bovis AF2122/97
gcgaccaaugcagugcgaucgg

SEQ ID NO: 1084974 - RNA, 22 nt, Mycobacterium bovis subsp bovis AF2122/97
gcgaccaaugcguugacgucga

SEQ ID NO: 1084975 - RNA, 13 nt, Mycobacterium bovis subsp bovis AF2122/97
gcgaccaccaccg

SEQ ID NO: 1084976 - RNA, 21 nt, Mycobacterium bovis subsp bovis AF2122/97
gcgacaucaccaccgaccugg

SEQ ID NO: 1084977 - RNA, 20 nt, Mycobacterium bovis subsp bovis AF2122/97
gcgaccaccaccgccgccga

SEQ ID NO: 1084978 - RNA, 14 nt, Mycobacterium bovis subsp bovis AF2122/97
gcgaccacccgccg

SEQ ID NO: 1084979 - RNA, 15 nt, Mycobacterium bovis subsp bovis AF2122/97
gcgaccacccgccgc

SEQ ID NO: 1084980 - RNA, 16 nt, Mycobacterium bovis subsp bovis AF2122/97
gcgacauacccgauca

SEQ ID NO: 1084981 - RNA, 14 nt, Mycobacterium bovis subsp bovis AF2122/97
gcgacaggccgagc

SEQ ID NO: 1084982 - RNA, 14 nt, Mycobacterium bovis subsp bovis AF2122/97
gccuucggcgagcg

SEQ ID NO: 1084983 - RNA, 18 nt, Mycobacterium bovis subsp bovis AF2122/97
gcgacaaggucgucgacu

SEQ ID NO: 1084984 - RNA, 15 nt, Mycobacterium bovis subsp bovis AF2122/97
gccuucgaucaucga

SEQ ID NO: 1084985 - RNA, 15 nt, Mycobacterium bovis subsp bovis AF2122/97
gccuucggccggcgu

SEQ ID NO: 1084986 - RNA, 23 nt, Mycobacterium bovis subsp bovis AF2122/97
gcgacacccugggugccggcagc

SEQ ID NO: 1084987 - RNA, 16 nt, Mycobacterium bovis subsp bovis AF2122/97
gcgacacacgccgccg

SEQ ID NO: 1084988 - RNA, 21 nt, Mycobacterium bovis subsp bovis AF2122/97
gcgacacacgccgccgguguc

SEQ ID NO: 1084989 - RNA, 16 nt, Mycobacterium bovis subsp bovis AF2122/97
gcgacaauggugccca

SEQ ID NO: 1084990 - RNA, 20 nt, Mycobacterium bovis subsp bovis AF2122/97
gcgacacaacgggugucggc

SEQ ID NO: 1084991 - RNA, 22 nt, Mycobacterium bovis subsp bovis AF2122/97
gcgacaccuccgucagcgccgc

SEQ ID NO: 1084992 - RNA, 16 nt, Mycobacterium bovis subsp bovis AF2122/97
gcgacacgccagccgu

SEQ ID NO: 1084993 - RNA, 18 nt, Mycobacterium bovis subsp bovis AF2122/97
gcgacaggacgucggcga

SEQ ID NO: 1084994 - RNA, 12 nt, Mycobacterium bovis subsp bovis AF2122/97
gcgacaggccga

SEQ ID NO: 1084995 - RNA, 14 nt, Mycobacterium bovis subsp bovis AF2122/97
gcgaccugcgcgag

SEQ ID NO: 1084996 - RNA, 17 nt, Mycobacterium bovis subsp bovis AF2122/97
gcgaccugcgcgagguu

SEQ ID NO: 1084997 - RNA, 21 nt, Mycobacterium bovis subsp bovis AF2122/97
gcgacgaagaagaacucggcg

SEQ ID NO: 1084998 - RNA, 21 nt, Mycobacterium bovis subsp bovis AF2122/97
gcgacgacacgccugggcgac

SEQ ID NO: 1084999 - RNA, 20 nt, Mycobacterium bovis subsp bovis AF2122/97
gcgacgacccgggucggcac

SEQ ID NO: 1085000 - RNA, 13 nt, Mycobacterium bovis subsp bovis AF2122/97
gcgacgaccgucg

SEQ ID NO: 1085001 - RNA, 14 nt, Mycobacterium bovis subsp bovis AF2122/97
gcgacgaccgucgg

SEQ ID NO: 1085002 - RNA, 11 nt, Mycobacterium bovis subsp bovis AF2122/97
gcgacgaucgu

SEQ ID NO: 1085003 - RNA, 21 nt, Mycobacterium bovis subsp bovis AF2122/97
gcgacgaucucgccgccagcg

SEQ ID NO: 1085004 - RNA, 22 nt, Mycobacterium bovis subsp bovis AF2122/97
gcgacgaugucgagcgcgaucg

SEQ ID NO: 1085005 - RNA, 23 nt, Mycobacterium bovis subsp bovis AF2122/97
gcgacgaugucgagcgcgaucgg

SEQ ID NO: 1085006 - RNA, 23 nt, Mycobacterium bovis subsp bovis AF2122/97
gcgacgaugugguccaucgcgcu

SEQ ID NO: 1085007 - RNA, 24 nt, Mycobacterium bovis subsp bovis AF2122/97
gcgacgacccgggucggcacgacc

SEQ ID NO: 1085008 - RNA, 16 nt, Mycobacterium bovis subsp bovis AF2122/97
gcgacgaugccccggu

SEQ ID NO: 1085009 - RNA, 12 nt, Mycobacterium bovis subsp bovis AF2122/97
gcgacgcagacc

SEQ ID NO: 1085010 - RNA, 14 nt, Mycobacterium bovis subsp bovis AF2122/97
gcgacgcagaccgu

SEQ ID NO: 1085011 - RNA, 20 nt, Mycobacterium bovis subsp bovis AF2122/97
gcgacgcagaccguccagca

SEQ ID NO: 1085012 - RNA, 15 nt, Mycobacterium bovis subsp bovis AF2122/97
gcgacgcauaaccgg

SEQ ID NO: 1085013 - RNA, 16 nt, Mycobacterium bovis subsp bovis AF2122/97
gcgacgccaugucgau

SEQ ID NO: 1085014 - RNA, 13 nt, Mycobacterium bovis subsp bovis AF2122/97
gcgacggcaagca

SEQ ID NO: 1085015 - RNA, 23 nt, Mycobacterium bovis subsp bovis AF2122/97
gcgacggaaccaguugacgaaga

SEQ ID NO: 1085016 - RNA, 18 nt, Mycobacterium bovis subsp bovis AF2122/97
gcgacggaccaucuccgg

SEQ ID NO: 1085017 - RNA, 15 nt, Mycobacterium bovis subsp bovis AF2122/97
gcgacggacucccuc

SEQ ID NO: 1085018 - RNA, 17 nt, Mycobacterium bovis subsp bovis AF2122/97
gcgacggacucccucga

SEQ ID NO: 1085019 - RNA, 23 nt, Mycobacterium bovis subsp bovis AF2122/97
gcgacggacucccucgaucacgg

SEQ ID NO: 1085020 - RNA, 13 nt, Mycobacterium bovis subsp bovis AF2122/97
gcgacggccagcg

SEQ ID NO: 1085021 - RNA, 14 nt, Mycobacterium bovis subsp bovis AF2122/97
gcgaccucgccgcg

SEQ ID NO: 1085022 - RNA, 20 nt, Mycobacterium bovis subsp bovis AF2122/97
gcgaccucgccgcggcggaa

SEQ ID NO: 1085023 - RNA, 13 nt, Mycobacterium bovis subsp bovis AF2122/97
gcgaccucgccgg

SEQ ID NO: 1085024 - RNA, 17 nt, Mycobacterium bovis subsp bovis AF2122/97
gcgaccucgccggacgg

SEQ ID NO: 1085025 - RNA, 12 nt, Mycobacterium bovis subsp bovis AF2122/97
gcgaccucgcgg

SEQ ID NO: 1085026 - RNA, 15 nt, Mycobacterium bovis subsp bovis AF2122/97
gcgaccucgcggcgc

SEQ ID NO: 1085027 - RNA, 17 nt, Mycobacterium bovis subsp bovis AF2122/97
gcgaccucgcggcgcug

SEQ ID NO: 1085028 - RNA, 22 nt, Mycobacterium bovis subsp bovis AF2122/97
gcgacgaaccggaucaucgccg

SEQ ID NO: 1085029 - RNA, 23 nt, Mycobacterium bovis subsp bovis AF2122/97
gcgacgaaccggaucaucgccgc

SEQ ID NO: 1085030 - RNA, 14 nt, Mycobacterium bovis subsp bovis AF2122/97
gcgacgaaccucgg

SEQ ID NO: 1085031 - RNA, 17 nt, Mycobacterium bovis subsp bovis AF2122/97
gcgacgaaccucggcgg

SEQ ID NO: 1085032 - RNA, 20 nt, Mycobacterium bovis subsp bovis AF2122/97
gcgaccucggcggcggcacg

SEQ ID NO: 1085033 - RNA, 17 nt, Mycobacterium bovis subsp bovis AF2122/97
gcgaccuccggaaucgc

SEQ ID NO: 1085034 - RNA, 18 nt, Mycobacterium bovis subsp bovis AF2122/97
gcgaccugccggaccgcg

SEQ ID NO: 1085035 - RNA, 13 nt, Mycobacterium bovis subsp bovis AF2122/97
gcgaccugcgcga

SEQ ID NO: 1085036 - RNA, 16 nt, Mycobacterium bovis subsp bovis AF2122/97
gcgaccgucgucaccg

SEQ ID NO: 1085037 - RNA, 12 nt, Mycobacterium bovis subsp bovis AF2122/97
gcgaccgucugg

SEQ ID NO: 1085038 - RNA, 15 nt, Mycobacterium bovis subsp bovis AF2122/97
gcgaccgccggaccg

SEQ ID NO: 1085039 - RNA, 20 nt, Mycobacterium bovis subsp bovis AF2122/97
gcgaccgccggaccgccgca

SEQ ID NO: 1085040 - RNA, 16 nt, Mycobacterium bovis subsp bovis AF2122/97
gcgaccgccucgccgu

SEQ ID NO: 1085041 - RNA, 17 nt, Mycobacterium bovis subsp bovis AF2122/97
gcgaccgccaucacgac

SEQ ID NO: 1085042 - RNA, 15 nt, Mycobacterium bovis subsp bovis AF2122/97
gcgaccgcgaccgca

SEQ ID NO: 1085043 - RNA, 20 nt, Mycobacterium bovis subsp bovis AF2122/97
gcgaccuccggaaucgcccg

SEQ ID NO: 1085044 - RNA, 18 nt, Mycobacterium bovis subsp bovis AF2122/97
gcgaccgaugaucucacc

SEQ ID NO: 1085045 - RNA, 18 nt, Mycobacterium bovis subsp bovis AF2122/97
gcgaccgagacggcgucg

SEQ ID NO: 1085046 - RNA, 19 nt, Mycobacterium bovis subsp bovis AF2122/97
gcgaccgagacggcgucgg

SEQ ID NO: 1085047 - RNA, 17 nt, Mycobacterium bovis subsp bovis AF2122/97
gcgacccgaucgcgcca

SEQ ID NO: 1085048 - RNA, 17 nt, Mycobacterium bovis subsp bovis AF2122/97
gcgaccagcgccgcacc

SEQ ID NO: 1085049 - RNA, 14 nt, Mycobacterium bovis subsp bovis AF2122/97
gcgaccgacgccgg

SEQ ID NO: 1085050 - RNA, 12 nt, Mycobacterium bovis subsp bovis AF2122/97
gcgaccgccauu

SEQ ID NO: 1085051 - RNA, 20 nt, Mycobacterium bovis subsp bovis AF2122/97
gcgaccccugguagcaccca

SEQ ID NO: 1085052 - RNA, 22 nt, Mycobacterium bovis subsp bovis AF2122/97
gcgaccccgaacauccgccgcc

SEQ ID NO: 1085053 - RNA, 23 nt, Mycobacterium bovis subsp bovis AF2122/97
gcgaccccgccgagcgguugccu

SEQ ID NO: 1085054 - RNA, 23 nt, Mycobacterium bovis subsp bovis AF2122/97
gcgaccccgcuuuuucccggcgg

SEQ ID NO: 1085055 - RNA, 15 nt, Mycobacterium bovis subsp bovis AF2122/97
gcgaccccggccccg

SEQ ID NO: 1085056 - RNA, 16 nt, Mycobacterium bovis subsp bovis AF2122/97
gcgaccccggccccga

SEQ ID NO: 1085057 - RNA, 23 nt, Mycobacterium bovis subsp bovis AF2122/97
gcgacccagcgguaucccccagc

SEQ ID NO: 1085058 - RNA, 13 nt, Mycobacterium bovis subsp bovis AF2122/97
gcgacccccagcg

SEQ ID NO: 1085059 - RNA, 15 nt, Mycobacterium bovis subsp bovis AF2122/97
gcgacccccagcgcc

SEQ ID NO: 1085060 - RNA, 22 nt, Mycobacterium bovis subsp bovis AF2122/97
gcgacccccagcgcccgccggc

SEQ ID NO: 1085061 - RNA, 23 nt, Mycobacterium bovis subsp bovis AF2122/97
gcgacccccagcgcccgccggca

SEQ ID NO: 1085062 - RNA, 18 nt, Mycobacterium bovis subsp bovis AF2122/97
gcgaggucggcggcgcag

SEQ ID NO: 1085063 - RNA, 21 nt, Mycobacterium bovis subsp bovis AF2122/97
gcgaggucggugaggucgaug

SEQ ID NO: 1085064 - RNA, 23 nt, Mycobacterium bovis subsp bovis AF2122/97
gcgagggugaagacaccggcguc

SEQ ID NO: 1085065 - RNA, 21 nt, Mycobacterium bovis subsp bovis AF2122/97
gcgagguaagcgagucgacga

SEQ ID NO: 1085066 - RNA, 19 nt, Mycobacterium bovis subsp bovis AF2122/97
gcgagguacccaucgucga

SEQ ID NO: 1085067 - RNA, 20 nt, Mycobacterium bovis subsp bovis AF2122/97
gcgaggugcucggaucggcu

SEQ ID NO: 1085068 - RNA, 16 nt, Mycobacterium bovis subsp bovis AF2122/97
gcgagguugaccacca

SEQ ID NO: 1085069 - RNA, 23 nt, Mycobacterium bovis subsp bovis AF2122/97
gcgauaacccgcaucggaaucgc

SEQ ID NO: 1085070 - RNA, 18 nt, Mycobacterium bovis subsp bovis AF2122/97
gcgauaacuccgcggcga

SEQ ID NO: 1085071 - RNA, 15 nt, Mycobacterium bovis subsp bovis AF2122/97
gcgauaaggaccgcg

SEQ ID NO: 1085072 - RNA, 15 nt, Mycobacterium bovis subsp bovis AF2122/97
gcgagguugcgccga

SEQ ID NO: 1085073 - RNA, 18 nt, Mycobacterium bovis subsp bovis AF2122/97
gcgagguugcgccgaccg

SEQ ID NO: 1085074 - RNA, 23 nt, Mycobacterium bovis subsp bovis AF2122/97
gcgagguuggcguugguggucgg

SEQ ID NO: 1085075 - RNA, 18 nt, Mycobacterium bovis subsp bovis AF2122/97
gcgaguaagcgaacagcg

SEQ ID NO: 1085076 - RNA, 15 nt, Mycobacterium bovis subsp bovis AF2122/97
gcgauaaaucgccga

SEQ ID NO: 1085077 - RNA, 14 nt, Mycobacterium bovis subsp bovis AF2122/97
gcgauacccaccgu

SEQ ID NO: 1085078 - RNA, 23 nt, Mycobacterium bovis subsp bovis AF2122/97
gcgaucaacucgggcagcgcggc

SEQ ID NO: 1085079 - RNA, 18 nt, Mycobacterium bovis subsp bovis AF2122/97
gcgaucaaugcgaugcgg

SEQ ID NO: 1085080 - RNA, 20 nt, Mycobacterium bovis subsp bovis AF2122/97
gcgaucaaugcgaugcgguc

SEQ ID NO: 1085081 - RNA, 16 nt, Mycobacterium bovis subsp bovis AF2122/97
gcgaucaacgcgcacg

SEQ ID NO: 1085082 - RNA, 13 nt, Mycobacterium bovis subsp bovis AF2122/97
gcgaucaacgcgu

SEQ ID NO: 1085083 - RNA, 21 nt, Mycobacterium bovis subsp bovis AF2122/97
gcgaucaaugcgaugcggucg

SEQ ID NO: 1085084 - RNA, 22 nt, Mycobacterium bovis subsp bovis AF2122/97
gcgaucaacccuacccgcauga

SEQ ID NO: 1085085 - RNA, 13 nt, Mycobacterium bovis subsp bovis AF2122/97
gcgauaucggcgg

SEQ ID NO: 1085086 - RNA, 14 nt, Mycobacterium bovis subsp bovis AF2122/97
gcgauaucgaucgg

SEQ ID NO: 1085087 - RNA, 17 nt, Mycobacterium bovis subsp bovis AF2122/97
gcgauaucgcacaugga

SEQ ID NO: 1085088 - RNA, 22 nt, Mycobacterium bovis subsp bovis AF2122/97
gcgagcccaccuggggccgcac

SEQ ID NO: 1085089 - RNA, 16 nt, Mycobacterium bovis subsp bovis AF2122/97
gcgagcuuggccggca

SEQ ID NO: 1085090 - RNA, 17 nt, Mycobacterium bovis subsp bovis AF2122/97
gcgaggaacgccggggc

SEQ ID NO: 1085091 - RNA, 18 nt, Mycobacterium bovis subsp bovis AF2122/97
gcgaggaacgccggggcg

SEQ ID NO: 1085092 - RNA, 21 nt, Mycobacterium bovis subsp bovis AF2122/97
gcgaggaacuggaccggugcc

SEQ ID NO: 1085093 - RNA, 21 nt, Mycobacterium bovis subsp bovis AF2122/97
gcgaggacagcugguugugcu

SEQ ID NO: 1085094 - RNA, 14 nt, Mycobacterium bovis subsp bovis AF2122/97
gcgaggggccggcu

SEQ ID NO: 1085095 - RNA, 15 nt, Mycobacterium bovis subsp bovis AF2122/97
gcgaggacgcgcccg

SEQ ID NO: 1085096 - RNA, 19 nt, Mycobacterium bovis subsp bovis AF2122/97
gcgagcccagcugcgccga

SEQ ID NO: 1085097 - RNA, 17 nt, Mycobacterium bovis subsp bovis AF2122/97
gcgagcccgaaccaccg

SEQ ID NO: 1085098 - RNA, 20 nt, Mycobacterium bovis subsp bovis AF2122/97
gcgagcccggccucggcgag

SEQ ID NO: 1085099 - RNA, 14 nt, Mycobacterium bovis subsp bovis AF2122/97
gcgagccgcacgau

SEQ ID NO: 1085100 - RNA, 14 nt, Mycobacterium bovis subsp bovis AF2122/97
gcgagccgccaccg

SEQ ID NO: 1085101 - RNA, 12 nt, Mycobacterium bovis subsp bovis AF2122/97
gcgagccggcgc

SEQ ID NO: 1085102 - RNA, 13 nt, Mycobacterium bovis subsp bovis AF2122/97
gcgagccggcgcc

SEQ ID NO: 1085103 - RNA, 16 nt, Mycobacterium bovis subsp bovis AF2122/97
gcgagccguaucggac

SEQ ID NO: 1085104 - RNA, 14 nt, Mycobacterium bovis subsp bovis AF2122/97
gcgagccggugauc

SEQ ID NO: 1085105 - RNA, 15 nt, Mycobacterium bovis subsp bovis AF2122/97
gcgagccucgcgcgu

SEQ ID NO: 1085106 - RNA, 23 nt, Mycobacterium bovis subsp bovis AF2122/97
gcgacugugaaucucacgacgcc

SEQ ID NO: 1085107 - RNA, 16 nt, Mycobacterium bovis subsp bovis AF2122/97
gcgacuucaucuucga

SEQ ID NO: 1085108 - RNA, 15 nt, Mycobacterium bovis subsp bovis AF2122/97
gcgacuugcaccccg

SEQ ID NO: 1085109 - RNA, 22 nt, Mycobacterium bovis subsp bovis AF2122/97
gcgagaggugcugcaccuggcg

SEQ ID NO: 1085110 - RNA, 23 nt, Mycobacterium bovis subsp bovis AF2122/97
gcgagacuucgacgcggcgaccg

SEQ ID NO: 1085111 - RNA, 19 nt, Mycobacterium bovis subsp bovis AF2122/97
gcgagacuucgacgcggcg

SEQ ID NO: 1085112 - RNA, 22 nt, Mycobacterium bovis subsp bovis AF2122/97
gcgagacuucgacgcggcgacc

SEQ ID NO: 1085113 - RNA, 14 nt, Mycobacterium bovis subsp bovis AF2122/97
gcgagaucagccgg

SEQ ID NO: 1085114 - RNA, 22 nt, Mycobacterium bovis subsp bovis AF2122/97
gcgagaucggauggugugucgg

SEQ ID NO: 1085115 - RNA, 17 nt, Mycobacterium bovis subsp bovis AF2122/97
gcgagaucgggccggcc

SEQ ID NO: 1085116 - RNA, 21 nt, Mycobacterium bovis subsp bovis AF2122/97
gcgagcagacgcagaaucgcc

SEQ ID NO: 1085117 - RNA, 14 nt, Mycobacterium bovis subsp bovis AF2122/97
gcgagaucgcggcg

SEQ ID NO: 1085118 - RNA, 16 nt, Mycobacterium bovis subsp bovis AF2122/97
gcgagaucgcggcgac

SEQ ID NO: 1085119 - RNA, 20 nt, Mycobacterium bovis subsp bovis AF2122/97
gcgagcagacgcagagucgc

SEQ ID NO: 1085120 - RNA, 22 nt, Mycobacterium bovis subsp bovis AF2122/97
gcgagcagacgcagagucgcac

SEQ ID NO: 1085121 - RNA, 23 nt, Mycobacterium bovis subsp bovis AF2122/97
gcgagcagacgcagagucgcacu

SEQ ID NO: 1085122 - RNA, 20 nt, Mycobacterium bovis subsp bovis AF2122/97
gcgagcagacgcauaagccc

SEQ ID NO: 1085123 - RNA, 16 nt, Mycobacterium bovis subsp bovis AF2122/97
gcgagcagacgccgcg

SEQ ID NO: 1085124 - RNA, 16 nt, Mycobacterium bovis subsp bovis AF2122/97
gcgagcagcgcacgau

SEQ ID NO: 1085125 - RNA, 13 nt, Mycobacterium bovis subsp bovis AF2122/97
gcgagcagcccgg

SEQ ID NO: 1085126 - RNA, 19 nt, Mycobacterium bovis subsp bovis AF2122/97
gcgagcagacguaaaagcc

SEQ ID NO: 1085127 - RNA, 12 nt, Mycobacterium bovis subsp bovis AF2122/97
gcgagcagcagg

SEQ ID NO: 1085128 - RNA, 15 nt, Mycobacterium bovis subsp bovis AF2122/97
gcgagcagcccggcg

SEQ ID NO: 1085129 - RNA, 15 nt, Mycobacterium bovis subsp bovis AF2122/97
gcgagcaggccguug

SEQ ID NO: 1085130 - RNA, 16 nt, Mycobacterium bovis subsp bovis AF2122/97
gcgagcaggccguuga

SEQ ID NO: 1085131 - RNA, 16 nt, Mycobacterium bovis subsp bovis AF2122/97
gcgagcagggcgucga

SEQ ID NO: 1085132 - RNA, 17 nt, Mycobacterium bovis subsp bovis AF2122/97
gcgagcagggcgucgac

SEQ ID NO: 1085133 - RNA, 15 nt, Mycobacterium bovis subsp bovis AF2122/97
gcgagcaucgacgaa

SEQ ID NO: 1085134 - RNA, 19 nt, Mycobacterium bovis subsp bovis AF2122/97
gcgagcagucgcaaaagcc

SEQ ID NO: 1085135 - RNA, 17 nt, Mycobacterium bovis subsp bovis AF2122/97
gcgagcaugauguccuc

SEQ ID NO: 1085136 - RNA, 16 nt, Mycobacterium bovis subsp bovis AF2122/97
gcgagcaugccguuga

SEQ ID NO: 1085137 - RNA, 22 nt, Mycobacterium bovis subsp bovis AF2122/97
gcgacggccgcucgggccagcg

SEQ ID NO: 1085138 - RNA, 12 nt, Mycobacterium bovis subsp bovis AF2122/97
gcgacggccggc

SEQ ID NO: 1085139 - RNA, 16 nt, Mycobacterium bovis subsp bovis AF2122/97
gcgacggccggcaagc

SEQ ID NO: 1085140 - RNA, 20 nt, Mycobacterium bovis subsp bovis AF2122/97
gcgacggcauguaccgaccg

SEQ ID NO: 1085141 - RNA, 22 nt, Mycobacterium bovis subsp bovis AF2122/97
gcgacggcccgaucccgaucga

SEQ ID NO: 1085142 - RNA, 18 nt, Mycobacterium bovis subsp bovis AF2122/97
gcgacggccagcgcgucg

SEQ ID NO: 1085143 - RNA, 19 nt, Mycobacterium bovis subsp bovis AF2122/97
gcgacggccagcgcgucgg

SEQ ID NO: 1085144 - RNA, 20 nt, Mycobacterium bovis subsp bovis AF2122/97
gcgacggccagcgcgucggg

SEQ ID NO: 1085145 - RNA, 20 nt, Mycobacterium bovis subsp bovis AF2122/97
gcgacggcgcccauagcacc

SEQ ID NO: 1085146 - RNA, 16 nt, Mycobacterium bovis subsp bovis AF2122/97
gcgacggcgcucggcg

SEQ ID NO: 1085147 - RNA, 20 nt, Mycobacterium bovis subsp bovis AF2122/97
gcgacggcggcucccggggg

SEQ ID NO: 1085148 - RNA, 16 nt, Mycobacterium bovis subsp bovis AF2122/97
gcgacgucucgcaugc

SEQ ID NO: 1085149 - RNA, 21 nt, Mycobacterium bovis subsp bovis AF2122/97
gcgacgucugccaggcgcagc

SEQ ID NO: 1085150 - RNA, 16 nt, Mycobacterium bovis subsp bovis AF2122/97
gcgacggcguugccgg

SEQ ID NO: 1085151 - RNA, 16 nt, Mycobacterium bovis subsp bovis AF2122/97
gcgacguggcgccgac

SEQ ID NO: 1085152 - RNA, 22 nt, Mycobacterium bovis subsp bovis AF2122/97
gcgacgucugccaggcgcagcu

SEQ ID NO: 1085153 - RNA, 20 nt, Mycobacterium bovis subsp bovis AF2122/97
gcgacguguugcacguacgg

SEQ ID NO: 1085154 - RNA, 18 nt, Mycobacterium bovis subsp bovis AF2122/97
gcgacguuaacugcgccu

SEQ ID NO: 1085155 - RNA, 14 nt, Mycobacterium bovis subsp bovis AF2122/97
gcgacggcggcacg

SEQ ID NO: 1085156 - RNA, 20 nt, Mycobacterium bovis subsp bovis AF2122/97
gcgacguuguuuuugcacug

SEQ ID NO: 1085157 - RNA, 15 nt, Mycobacterium bovis subsp bovis AF2122/97
gcgacguuccgcucg

SEQ ID NO: 1085158 - RNA, 18 nt, Mycobacterium bovis subsp bovis AF2122/97
gcgacguuccgcucgagg

SEQ ID NO: 1085159 - RNA, 15 nt, Mycobacterium bovis subsp bovis AF2122/97
gcgacuaagggcacu

SEQ ID NO: 1085160 - RNA, 14 nt, Mycobacterium bovis subsp bovis AF2122/97
gcgacuaccaucgc

SEQ ID NO: 1085161 - RNA, 15 nt, Mycobacterium bovis subsp bovis AF2122/97
gcgacuacggccucg

SEQ ID NO: 1085162 - RNA, 15 nt, Mycobacterium bovis subsp bovis AF2122/97
gcgacugucuggucg

SEQ ID NO: 1085163 - RNA, 16 nt, Mycobacterium bovis subsp bovis AF2122/97
gcgacugcgucggcgg

SEQ ID NO: 1085164 - RNA, 19 nt, Mycobacterium bovis subsp bovis AF2122/97
gcgacuagacgccgccgcu

SEQ ID NO: 1085165 - RNA, 13 nt, Mycobacterium bovis subsp bovis AF2122/97
gcgacugcgcacc

SEQ ID NO: 1085166 - RNA, 19 nt, Mycobacterium bovis subsp bovis AF2122/97
gcgcaaccgcggccccgac

SEQ ID NO: 1085167 - RNA, 22 nt, Mycobacterium bovis subsp bovis AF2122/97
gcgcaaccgcggccccgacugc

SEQ ID NO: 1085168 - RNA, 23 nt, Mycobacterium bovis subsp bovis AF2122/97
gcgcaaccagccuuuccggccgc

SEQ ID NO: 1085169 - RNA, 22 nt, Mycobacterium bovis subsp bovis AF2122/97
gcgcaaccuaaauugccgggcc

SEQ ID NO: 1085170 - RNA, 12 nt, Mycobacterium bovis subsp bovis AF2122/97
gcgcaaccggug

SEQ ID NO: 1085171 - RNA, 19 nt, Mycobacterium bovis subsp bovis AF2122/97
gcgcaacggaucaagagcg

SEQ ID NO: 1085172 - RNA, 16 nt, Mycobacterium bovis subsp bovis AF2122/97
gcgcaacggccagcgc

SEQ ID NO: 1085173 - RNA, 18 nt, Mycobacterium bovis subsp bovis AF2122/97
gcgcaacguagccagcag

SEQ ID NO: 1085174 - RNA, 13 nt, Mycobacterium bovis subsp bovis AF2122/97
gcgcaacucccag

SEQ ID NO: 1085175 - RNA, 16 nt, Mycobacterium bovis subsp bovis AF2122/97
gcgcaacucccagcac

SEQ ID NO: 1085176 - RNA, 18 nt, Mycobacterium bovis subsp bovis AF2122/97
gcgcaacucccagcacgg

SEQ ID NO: 1085177 - RNA, 12 nt, Mycobacterium bovis subsp bovis AF2122/97
gcgcaagcgccg

SEQ ID NO: 1085178 - RNA, 14 nt, Mycobacterium bovis subsp bovis AF2122/97
gcgcaagcgccgcg

SEQ ID NO: 1085179 - RNA, 13 nt, Mycobacterium bovis subsp bovis AF2122/97
gcgcaaggucgac

SEQ ID NO: 1085180 - RNA, 22 nt, Mycobacterium bovis subsp bovis AF2122/97
gcgcaaggcaaaucggugcgau

SEQ ID NO: 1085181 - RNA, 20 nt, Mycobacterium bovis subsp bovis AF2122/97
gcgcaagugauuucggugac

SEQ ID NO: 1085182 - RNA, 16 nt, Mycobacterium bovis subsp bovis AF2122/97
gcgcaagugcuggccg

SEQ ID NO: 1085183 - RNA, 13 nt, Mycobacterium bovis subsp bovis AF2122/97
gcgcaccaccgcc

SEQ ID NO: 1085184 - RNA, 18 nt, Mycobacterium bovis subsp bovis AF2122/97
gcgcaccaccgcggcggc

SEQ ID NO: 1085185 - RNA, 20 nt, Mycobacterium bovis subsp bovis AF2122/97
gcgcaccaccgucucgccgc

SEQ ID NO: 1085186 - RNA, 11 nt, Mycobacterium bovis subsp bovis AF2122/97
gcgcaccaccu

SEQ ID NO: 1085187 - RNA, 14 nt, Mycobacterium bovis subsp bovis AF2122/97
gcgcaccaaggccg

SEQ ID NO: 1085188 - RNA, 18 nt, Mycobacterium bovis subsp bovis AF2122/97
gcgcaccaacaccagcgc

SEQ ID NO: 1085189 - RNA, 15 nt, Mycobacterium bovis subsp bovis AF2122/97
gcgcaaucgaccacg

SEQ ID NO: 1085190 - RNA, 18 nt, Mycobacterium bovis subsp bovis AF2122/97
gcgcaaucgugguucggc

SEQ ID NO: 1085191 - RNA, 16 nt, Mycobacterium bovis subsp bovis AF2122/97
gcgcaaucgaccacga

SEQ ID NO: 1085192 - RNA, 17 nt, Mycobacterium bovis subsp bovis AF2122/97
gcgcaaucgaccacgac

SEQ ID NO: 1085193 - RNA, 21 nt, Mycobacterium bovis subsp bovis AF2122/97
gcgcaaugcaucgcggcggcg

SEQ ID NO: 1085194 - RNA, 23 nt, Mycobacterium bovis subsp bovis AF2122/97
gcgcaaugcaucgcggcggcgcu

SEQ ID NO: 1085195 - RNA, 21 nt, Mycobacterium bovis subsp bovis AF2122/97
gcgcacgcccugaagggccgc

SEQ ID NO: 1085196 - RNA, 22 nt, Mycobacterium bovis subsp bovis AF2122/97
gcgcacgcccugaagggccgcc

SEQ ID NO: 1085197 - RNA, 23 nt, Mycobacterium bovis subsp bovis AF2122/97
gcgcacgcccugaagggccgccu

SEQ ID NO: 1085198 - RNA, 18 nt, Mycobacterium bovis subsp bovis AF2122/97
gcgcacgcccuggugucg

SEQ ID NO: 1085199 - RNA, 14 nt, Mycobacterium bovis subsp bovis AF2122/97
gcgcacgcccgcac

SEQ ID NO: 1085200 - RNA, 15 nt, Mycobacterium bovis subsp bovis AF2122/97
gcgcaccgcugaccg

SEQ ID NO: 1085201 - RNA, 13 nt, Mycobacterium bovis subsp bovis AF2122/97
gcgcacgaaaccg

SEQ ID NO: 1085202 - RNA, 13 nt, Mycobacterium bovis subsp bovis AF2122/97
gcgcaccagcggc

SEQ ID NO: 1085203 - RNA, 12 nt, Mycobacterium bovis subsp bovis AF2122/97
gcgcaccacacc

SEQ ID NO: 1085204 - RNA, 17 nt, Mycobacterium bovis subsp bovis AF2122/97
gcgcaccaggcggccgu

SEQ ID NO: 1085205 - RNA, 12 nt, Mycobacterium bovis subsp bovis AF2122/97
gcgcaccgccgc

SEQ ID NO: 1085206 - RNA, 14 nt, Mycobacterium bovis subsp bovis AF2122/97
gcgcaccgccgcgc

SEQ ID NO: 1085207 - RNA, 19 nt, Mycobacterium bovis subsp bovis AF2122/97
gcgcaccgcauaacgcgaa

SEQ ID NO: 1085208 - RNA, 14 nt, Mycobacterium bovis subsp bovis AF2122/97
gcgcaccgccgaug

SEQ ID NO: 1085209 - RNA, 18 nt, Mycobacterium bovis subsp bovis AF2122/97
gcgauucccgcgaagcgg

SEQ ID NO: 1085210 - RNA, 17 nt, Mycobacterium bovis subsp bovis AF2122/97
gcgauucgcaaucagcu

SEQ ID NO: 1085211 - RNA, 20 nt, Mycobacterium bovis subsp bovis AF2122/97
gcgauuccgcgucugcucgc

SEQ ID NO: 1085212 - RNA, 23 nt, Mycobacterium bovis subsp bovis AF2122/97
gcgauuccgcgucugcucggcgg

SEQ ID NO: 1085213 - RNA, 19 nt, Mycobacterium bovis subsp bovis AF2122/97
gcgauuccgcgucugcucg

SEQ ID NO: 1085214 - RNA, 22 nt, Mycobacterium bovis subsp bovis AF2122/97
gcgauucugcgucugcucgccg

SEQ ID NO: 1085215 - RNA, 13 nt, Mycobacterium bovis subsp bovis AF2122/97
gcgauuucggcgc

SEQ ID NO: 1085216 - RNA, 14 nt, Mycobacterium bovis subsp bovis AF2122/97
gcgauuucggcgcc

SEQ ID NO: 1085217 - RNA, 22 nt, Mycobacterium bovis subsp bovis AF2122/97
gcgauuucggcgccggcgucgg

SEQ ID NO: 1085218 - RNA, 15 nt, Mycobacterium bovis subsp bovis AF2122/97
gcgauuucgucgucg

SEQ ID NO: 1085219 - RNA, 18 nt, Mycobacterium bovis subsp bovis AF2122/97
gcgauuuggcgucgccga

SEQ ID NO: 1085220 - RNA, 20 nt, Mycobacterium bovis subsp bovis AF2122/97
gcgauuuugcgucugcucgc

SEQ ID NO: 1085221 - RNA, 20 nt, Mycobacterium bovis subsp bovis AF2122/97
gcgauuuugugucugcucgc

SEQ ID NO: 1085222 - RNA, 17 nt, Mycobacterium bovis subsp bovis AF2122/97
gcgauugcccgcgcucg

SEQ ID NO: 1085223 - RNA, 13 nt, Mycobacterium bovis subsp bovis AF2122/97
gcgauugccgcgg

SEQ ID NO: 1085224 - RNA, 14 nt, Mycobacterium bovis subsp bovis AF2122/97
gcgauugccgucgu

SEQ ID NO: 1085225 - RNA, 20 nt, Mycobacterium bovis subsp bovis AF2122/97
gcgauugucggggccgcagg

SEQ ID NO: 1085226 - RNA, 21 nt, Mycobacterium bovis subsp bovis AF2122/97
gcgauuuccaucgcgaccucg

SEQ ID NO: 1085227 - RNA, 21 nt, Mycobacterium bovis subsp bovis AF2122/97
gcgcaacaccgugcaccagcu

SEQ ID NO: 1085228 - RNA, 13 nt, Mycobacterium bovis subsp bovis AF2122/97
gcgcaacaccucg

SEQ ID NO: 1085229 - RNA, 13 nt, Mycobacterium bovis subsp bovis AF2122/97
gcgcaaccgcuga

SEQ ID NO: 1085230 - RNA, 14 nt, Mycobacterium bovis subsp bovis AF2122/97
gcgcaacccccgaa

SEQ ID NO: 1085231 - RNA, 18 nt, Mycobacterium bovis subsp bovis AF2122/97
gcgcaacccagccgcgcc

SEQ ID NO: 1085232 - RNA, 18 nt, Mycobacterium bovis subsp bovis AF2122/97
gcgcaaauaggacugcgc

SEQ ID NO: 1085233 - RNA, 22 nt, Mycobacterium bovis subsp bovis AF2122/97
gcgcaaauaggacugcgccacc

SEQ ID NO: 1085234 - RNA, 13 nt, Mycobacterium bovis subsp bovis AF2122/97
gcgauggcggcgc

SEQ ID NO: 1085235 - RNA, 22 nt, Mycobacterium bovis subsp bovis AF2122/97
gcgauggcguagcccaugccga

SEQ ID NO: 1085236 - RNA, 19 nt, Mycobacterium bovis subsp bovis AF2122/97
gcgaugggagcccggcggc

SEQ ID NO: 1085237 - RNA, 14 nt, Mycobacterium bovis subsp bovis AF2122/97
gcgauggcaccggc

SEQ ID NO: 1085238 - RNA, 15 nt, Mycobacterium bovis subsp bovis AF2122/97
gcgauggcaccggcg

SEQ ID NO: 1085239 - RNA, 16 nt, Mycobacterium bovis subsp bovis AF2122/97
gcgauggcaccgugga

SEQ ID NO: 1085240 - RNA, 13 nt, Mycobacterium bovis subsp bovis AF2122/97
gcgauggccgacg

SEQ ID NO: 1085241 - RNA, 15 nt, Mycobacterium bovis subsp bovis AF2122/97
gcgauggcagcgccg

SEQ ID NO: 1085242 - RNA, 23 nt, Mycobacterium bovis subsp bovis AF2122/97
gcgauggugguuccgcccggugc

SEQ ID NO: 1085243 - RNA, 19 nt, Mycobacterium bovis subsp bovis AF2122/97
gcgauguccuuguuggcca

SEQ ID NO: 1085244 - RNA, 21 nt, Mycobacterium bovis subsp bovis AF2122/97
gcgauguccuuguuggccagu

SEQ ID NO: 1085245 - RNA, 18 nt, Mycobacterium bovis subsp bovis AF2122/97
gcgauggugcgccgggcg

SEQ ID NO: 1085246 - RNA, 17 nt, Mycobacterium bovis subsp bovis AF2122/97
gcgaugguagucgcgac

SEQ ID NO: 1085247 - RNA, 15 nt, Mycobacterium bovis subsp bovis AF2122/97
gcgaugguaucgccg

SEQ ID NO: 1085248 - RNA, 16 nt, Mycobacterium bovis subsp bovis AF2122/97
gcgaugguaucgccgc

SEQ ID NO: 1085249 - RNA, 17 nt, Mycobacterium bovis subsp bovis AF2122/97
gcgaugguaucgccgcu

SEQ ID NO: 1085250 - RNA, 13 nt, Mycobacterium bovis subsp bovis AF2122/97
gcgaugucguucg

SEQ ID NO: 1085251 - RNA, 13 nt, Mycobacterium bovis subsp bovis AF2122/97
gcgaugucgccgg

SEQ ID NO: 1085252 - RNA, 17 nt, Mycobacterium bovis subsp bovis AF2122/97
gcgaugucgccggcgac

SEQ ID NO: 1085253 - RNA, 20 nt, Mycobacterium bovis subsp bovis AF2122/97
gcgaugucgcgcauugccga

SEQ ID NO: 1085254 - RNA, 16 nt, Mycobacterium bovis subsp bovis AF2122/97
gcgauguggguuaccu

SEQ ID NO: 1085255 - RNA, 19 nt, Mycobacterium bovis subsp bovis AF2122/97
gcgauuagcaaaccgaccg

SEQ ID NO: 1085256 - RNA, 19 nt, Mycobacterium bovis subsp bovis AF2122/97
gcgauuaccggcacgccgg

SEQ ID NO: 1085257 - RNA, 13 nt, Mycobacterium bovis subsp bovis AF2122/97
gcgaugaacagcg

SEQ ID NO: 1085258 - RNA, 16 nt, Mycobacterium bovis subsp bovis AF2122/97
gcgaugaacgggaucg

SEQ ID NO: 1085259 - RNA, 18 nt, Mycobacterium bovis subsp bovis AF2122/97
gcgaucuugguggccuca

SEQ ID NO: 1085260 - RNA, 14 nt, Mycobacterium bovis subsp bovis AF2122/97
gcgaucuuggaucg

SEQ ID NO: 1085261 - RNA, 15 nt, Mycobacterium bovis subsp bovis AF2122/97
gcgaucuuggcgaca

SEQ ID NO: 1085262 - RNA, 22 nt, Mycobacterium bovis subsp bovis AF2122/97
gcgaucuuggcgacaugcagcg

SEQ ID NO: 1085263 - RNA, 12 nt, Mycobacterium bovis subsp bovis AF2122/97
gcgaucugcucg

SEQ ID NO: 1085264 - RNA, 15 nt, Mycobacterium bovis subsp bovis AF2122/97
gcgaucugcucgccc

SEQ ID NO: 1085265 - RNA, 13 nt, Mycobacterium bovis subsp bovis AF2122/97
gcgaucugcucgu

SEQ ID NO: 1085266 - RNA, 14 nt, Mycobacterium bovis subsp bovis AF2122/97
gcgaucugcggcgc

SEQ ID NO: 1085267 - RNA, 15 nt, Mycobacterium bovis subsp bovis AF2122/97
gcgaucugcggcgcc

SEQ ID NO: 1085268 - RNA, 17 nt, Mycobacterium bovis subsp bovis AF2122/97
gcgaucugcggcgcccg

SEQ ID NO: 1085269 - RNA, 18 nt, Mycobacterium bovis subsp bovis AF2122/97
gcgaucugcggcgcccgg

SEQ ID NO: 1085270 - RNA, 15 nt, Mycobacterium bovis subsp bovis AF2122/97
gcgaucugcuaccag

SEQ ID NO: 1085271 - RNA, 22 nt, Mycobacterium bovis subsp bovis AF2122/97
gcgaucuugcgacgcccgccuu

SEQ ID NO: 1085272 - RNA, 23 nt, Mycobacterium bovis subsp bovis AF2122/97
gcgaucuugcgacgcccgccuuc

SEQ ID NO: 1085273 - RNA, 17 nt, Mycobacterium bovis subsp bovis AF2122/97
gcgaugaucaccagucg

SEQ ID NO: 1085274 - RNA, 21 nt, Mycobacterium bovis subsp bovis AF2122/97
gcgaugaucaccagucgcuga

SEQ ID NO: 1085275 - RNA, 22 nt, Mycobacterium bovis subsp bovis AF2122/97
gcgaugaccucggcgaugucgc

SEQ ID NO: 1085276 - RNA, 21 nt, Mycobacterium bovis subsp bovis AF2122/97
gcgaugagccugcaggccgcc

SEQ ID NO: 1085277 - RNA, 15 nt, Mycobacterium bovis subsp bovis AF2122/97
gcgaugaccgggcga

SEQ ID NO: 1085278 - RNA, 18 nt, Mycobacterium bovis subsp bovis AF2122/97
gcgaugacgaccgaucgg

SEQ ID NO: 1085279 - RNA, 16 nt, Mycobacterium bovis subsp bovis AF2122/97
gcgaugacgaucgcgu

SEQ ID NO: 1085280 - RNA, 16 nt, Mycobacterium bovis subsp bovis AF2122/97
gcgaugacaucaccga

SEQ ID NO: 1085281 - RNA, 14 nt, Mycobacterium bovis subsp bovis AF2122/97
gcgaugaccucggc

SEQ ID NO: 1085282 - RNA, 20 nt, Mycobacterium bovis subsp bovis AF2122/97
gcgaucuccgugagccggac

SEQ ID NO: 1085283 - RNA, 15 nt, Mycobacterium bovis subsp bovis AF2122/97
gcgaucuccggcgga

SEQ ID NO: 1085284 - RNA, 22 nt, Mycobacterium bovis subsp bovis AF2122/97
gcgaucuccuuggccguucggc

SEQ ID NO: 1085285 - RNA, 13 nt, Mycobacterium bovis subsp bovis AF2122/97
gcgaucucgacgg

SEQ ID NO: 1085286 - RNA, 13 nt, Mycobacterium bovis subsp bovis AF2122/97
gcgaucucgaugu

SEQ ID NO: 1085287 - RNA, 21 nt, Mycobacterium bovis subsp bovis AF2122/97
gcgaucucaccuggagcuaug

SEQ ID NO: 1085288 - RNA, 18 nt, Mycobacterium bovis subsp bovis AF2122/97
gcgaucugcgacaagacc

SEQ ID NO: 1085289 - RNA, 18 nt, Mycobacterium bovis subsp bovis AF2122/97
gcgaucgugcugcccgca

SEQ ID NO: 1085290 - RNA, 18 nt, Mycobacterium bovis subsp bovis AF2122/97
gcgaucguguccaccgga

SEQ ID NO: 1085291 - RNA, 16 nt, Mycobacterium bovis subsp bovis AF2122/97
gcgaucgggccggcgc

SEQ ID NO: 1085292 - RNA, 17 nt, Mycobacterium bovis subsp bovis AF2122/97
gcgaucgggccggcgcg

SEQ ID NO: 1085293 - RNA, 17 nt, Mycobacterium bovis subsp bovis AF2122/97
gcgaucggugccgaagc

SEQ ID NO: 1085294 - RNA, 17 nt, Mycobacterium bovis subsp bovis AF2122/97
gcgaucggugcgggcgc

SEQ ID NO: 1085295 - RNA, 20 nt, Mycobacterium bovis subsp bovis AF2122/97
gcgaucggugcgggcgccgc

SEQ ID NO: 1085296 - RNA, 12 nt, Mycobacterium bovis subsp bovis AF2122/97
gcgaucggcaug

SEQ ID NO: 1085297 - RNA, 14 nt, Mycobacterium bovis subsp bovis AF2122/97
gcgaugcccgucga

SEQ ID NO: 1085298 - RNA, 15 nt, Mycobacterium bovis subsp bovis AF2122/97
gcgaugaugugcgac

SEQ ID NO: 1085299 - RNA, 17 nt, Mycobacterium bovis subsp bovis AF2122/97
gcgaugaugcucgacaa

SEQ ID NO: 1085300 - RNA, 19 nt, Mycobacterium bovis subsp bovis AF2122/97
gcgaugauggcgcgaucgg

SEQ ID NO: 1085301 - RNA, 15 nt, Mycobacterium bovis subsp bovis AF2122/97
gcgaugaucgcaucg

SEQ ID NO: 1085302 - RNA, 19 nt, Mycobacterium bovis subsp bovis AF2122/97
gcgaugaucgcaucgacgu

SEQ ID NO: 1085303 - RNA, 15 nt, Mycobacterium bovis subsp bovis AF2122/97
gcgaugcagccggga

SEQ ID NO: 1085304 - RNA, 16 nt, Mycobacterium bovis subsp bovis AF2122/97
gcgaugcagccgggaa

SEQ ID NO: 1085305 - RNA, 18 nt, Mycobacterium bovis subsp bovis AF2122/97
gcgaugcagugcgacccg

SEQ ID NO: 1085306 - RNA, 15 nt, Mycobacterium bovis subsp bovis AF2122/97
gcgaugccacccaac

SEQ ID NO: 1085307 - RNA, 22 nt, Mycobacterium bovis subsp bovis AF2122/97
gcgaugauuucgucgaucggcu

SEQ ID NO: 1085308 - RNA, 16 nt, Mycobacterium bovis subsp bovis AF2122/97
gcgaugcaccccauga

SEQ ID NO: 1085309 - RNA, 15 nt, Mycobacterium bovis subsp bovis AF2122/97
gcgaugccgugcugg

SEQ ID NO: 1085310 - RNA, 19 nt, Mycobacterium bovis subsp bovis AF2122/97
gcgaugccgugcugggccg

SEQ ID NO: 1085311 - RNA, 21 nt, Mycobacterium bovis subsp bovis AF2122/97
gcgaugccgugcugggccgac

SEQ ID NO: 1085312 - RNA, 15 nt, Mycobacterium bovis subsp bovis AF2122/97
gcgaugcgcaccagc

SEQ ID NO: 1085313 - RNA, 16 nt, Mycobacterium bovis subsp bovis AF2122/97
gcgaugcgcaccagcg

SEQ ID NO: 1085314 - RNA, 15 nt, Mycobacterium bovis subsp bovis AF2122/97
gcgaugcggcccucg

SEQ ID NO: 1085315 - RNA, 16 nt, Mycobacterium bovis subsp bovis AF2122/97
gcgaugcggcccucga

SEQ ID NO: 1085316 - RNA, 14 nt, Mycobacterium bovis subsp bovis AF2122/97
gcgaugcggcgucg

SEQ ID NO: 1085317 - RNA, 17 nt, Mycobacterium bovis subsp bovis AF2122/97
gcgaugcgggccgccag

SEQ ID NO: 1085318 - RNA, 15 nt, Mycobacterium bovis subsp bovis AF2122/97
gcgaugcgcgccccg

SEQ ID NO: 1085319 - RNA, 15 nt, Mycobacterium bovis subsp bovis AF2122/97
gcgaugcgcgccgau

SEQ ID NO: 1085320 - RNA, 13 nt, Mycobacterium bovis subsp bovis AF2122/97
gcgaugcggugua

SEQ ID NO: 1085321 - RNA, 22 nt, Mycobacterium bovis subsp bovis AF2122/97
gcgaugcgguuccgauagccga

SEQ ID NO: 1085322 - RNA, 13 nt, Mycobacterium bovis subsp bovis AF2122/97
gcgaugcggucgg

SEQ ID NO: 1085323 - RNA, 18 nt, Mycobacterium bovis subsp bovis AF2122/97
gcgaugcugaucaccguc

SEQ ID NO: 1085324 - RNA, 18 nt, Mycobacterium bovis subsp bovis AF2122/97
gcgauccaaugcgagguu

SEQ ID NO: 1085325 - RNA, 19 nt, Mycobacterium bovis subsp bovis AF2122/97
gcgaucaugagcagcacgu

SEQ ID NO: 1085326 - RNA, 21 nt, Mycobacterium bovis subsp bovis AF2122/97
gcgaucaugguggggaccgcg

SEQ ID NO: 1085327 - RNA, 20 nt, Mycobacterium bovis subsp bovis AF2122/97
gcgaucaggcggacgggacg

SEQ ID NO: 1085328 - RNA, 19 nt, Mycobacterium bovis subsp bovis AF2122/97
gcgaucaucaggugcgccu

SEQ ID NO: 1085329 - RNA, 21 nt, Mycobacterium bovis subsp bovis AF2122/97
gcgaucaucaggugcgccugg

SEQ ID NO: 1085330 - RNA, 20 nt, Mycobacterium bovis subsp bovis AF2122/97
gcgaucaguucgugacgugc

SEQ ID NO: 1085331 - RNA, 16 nt, Mycobacterium bovis subsp bovis AF2122/97
gcgaucaucaggugcg

SEQ ID NO: 1085332 - RNA, 18 nt, Mycobacterium bovis subsp bovis AF2122/97
gcgauccccagcaccacg

SEQ ID NO: 1085333 - RNA, 18 nt, Mycobacterium bovis subsp bovis AF2122/97
gcgauccagggccgacgc

SEQ ID NO: 1085334 - RNA, 15 nt, Mycobacterium bovis subsp bovis AF2122/97
gcgauccacuccggc

SEQ ID NO: 1085335 - RNA, 19 nt, Mycobacterium bovis subsp bovis AF2122/97
gcgauccacuccggcgauc

SEQ ID NO: 1085336 - RNA, 16 nt, Mycobacterium bovis subsp bovis AF2122/97
gcgaucaggcgcucga

SEQ ID NO: 1085337 - RNA, 20 nt, Mycobacterium bovis subsp bovis AF2122/97
gcgaucaauugcccggcacg

SEQ ID NO: 1085338 - RNA, 21 nt, Mycobacterium bovis subsp bovis AF2122/97
gcgaucaauugcccggcacgg

SEQ ID NO: 1085339 - RNA, 16 nt, Mycobacterium bovis subsp bovis AF2122/97
gcgaucaaagccagca

SEQ ID NO: 1085340 - RNA, 19 nt, Mycobacterium bovis subsp bovis AF2122/97
gcgaucaccgagauggcga

SEQ ID NO: 1085341 - RNA, 18 nt, Mycobacterium bovis subsp bovis AF2122/97
gcgaucaccgagucgacg

SEQ ID NO: 1085342 - RNA, 17 nt, Mycobacterium bovis subsp bovis AF2122/97
gcgaucaccuccgcgac

SEQ ID NO: 1085343 - RNA, 19 nt, Mycobacterium bovis subsp bovis AF2122/97
gcgaucaccuccgcgacgg

SEQ ID NO: 1085344 - RNA, 14 nt, Mycobacterium bovis subsp bovis AF2122/97
gcgaucaccgcgcc

SEQ ID NO: 1085345 - RNA, 22 nt, Mycobacterium bovis subsp bovis AF2122/97
gcgaucaccgcgccggagaucg

SEQ ID NO: 1085346 - RNA, 14 nt, Mycobacterium bovis subsp bovis AF2122/97
gcgaucgccgacgc

SEQ ID NO: 1085347 - RNA, 15 nt, Mycobacterium bovis subsp bovis AF2122/97
gcgaucgcccggccc

SEQ ID NO: 1085348 - RNA, 17 nt, Mycobacterium bovis subsp bovis AF2122/97
gcgaucgcccggccccg

SEQ ID NO: 1085349 - RNA, 20 nt, Mycobacterium bovis subsp bovis AF2122/97
gcgaucgcccggccccgcaa

SEQ ID NO: 1085350 - RNA, 16 nt, Mycobacterium bovis subsp bovis AF2122/97
gcgaucgcauccgcgg

SEQ ID NO: 1085351 - RNA, 23 nt, Mycobacterium bovis subsp bovis AF2122/97
gcgaucgccugggcuuggcgacg

SEQ ID NO: 1085352 - RNA, 21 nt, Mycobacterium bovis subsp bovis AF2122/97
gcgaucgcgacgaugccccgg

SEQ ID NO: 1085353 - RNA, 13 nt, Mycobacterium bovis subsp bovis AF2122/97
gcgaucggcguca

SEQ ID NO: 1085354 - RNA, 18 nt, Mycobacterium bovis subsp bovis AF2122/97
gcgaucggcggcggcgcc

SEQ ID NO: 1085355 - RNA, 14 nt, Mycobacterium bovis subsp bovis AF2122/97
gcgaucgcgugcgg

SEQ ID NO: 1085356 - RNA, 19 nt, Mycobacterium bovis subsp bovis AF2122/97
gcgaucgcggcgagcacca

SEQ ID NO: 1085357 - RNA, 13 nt, Mycobacterium bovis subsp bovis AF2122/97
gcgaucgcgcccg

SEQ ID NO: 1085358 - RNA, 17 nt, Mycobacterium bovis subsp bovis AF2122/97
gcgaucgcgcccgcuga

SEQ ID NO: 1085359 - RNA, 16 nt, Mycobacterium bovis subsp bovis AF2122/97
gcgaucggcacuagcg

SEQ ID NO: 1085360 - RNA, 21 nt, Mycobacterium bovis subsp bovis AF2122/97
gcgaucgcuccgcggcgcagc

SEQ ID NO: 1085361 - RNA, 17 nt, Mycobacterium bovis subsp bovis AF2122/97
gcgaucgcuucgcaagu

SEQ ID NO: 1085362 - RNA, 22 nt, Mycobacterium bovis subsp bovis AF2122/97
gcgaucggcacuuagcccgaug

SEQ ID NO: 1085363 - RNA, 19 nt, Mycobacterium bovis subsp bovis AF2122/97
gcgauccgcugcgccgagg

SEQ ID NO: 1085364 - RNA, 14 nt, Mycobacterium bovis subsp bovis AF2122/97
gcgauccgcggcgu

SEQ ID NO: 1085365 - RNA, 15 nt, Mycobacterium bovis subsp bovis AF2122/97
gcgauccgcggcguu

SEQ ID NO: 1085366 - RNA, 16 nt, Mycobacterium bovis subsp bovis AF2122/97
gcgauccgcggcguuc

SEQ ID NO: 1085367 - RNA, 22 nt, Mycobacterium bovis subsp bovis AF2122/97
gcgauccgcgcgcauauccgca

SEQ ID NO: 1085368 - RNA, 13 nt, Mycobacterium bovis subsp bovis AF2122/97
gcgauccgagacc

SEQ ID NO: 1085369 - RNA, 16 nt, Mycobacterium bovis subsp bovis AF2122/97
gcgauccgagaccgcg

SEQ ID NO: 1085370 - RNA, 22 nt, Mycobacterium bovis subsp bovis AF2122/97
gcgauccgagaccgcgugcucg

SEQ ID NO: 1085371 - RNA, 23 nt, Mycobacterium bovis subsp bovis AF2122/97
gcgauccgagaccgcgugcucga

SEQ ID NO: 1085372 - RNA, 18 nt, Mycobacterium bovis subsp bovis AF2122/97
gcgaucccgaucgcgcug

SEQ ID NO: 1085373 - RNA, 13 nt, Mycobacterium bovis subsp bovis AF2122/97
gcgaucccgccgg

SEQ ID NO: 1085374 - RNA, 15 nt, Mycobacterium bovis subsp bovis AF2122/97
gcgaucccgccgggg

SEQ ID NO: 1085375 - RNA, 17 nt, Mycobacterium bovis subsp bovis AF2122/97
gcgaucccgccggggcc

SEQ ID NO: 1085376 - RNA, 15 nt, Mycobacterium bovis subsp bovis AF2122/97
gcgaucccggcaaca

SEQ ID NO: 1085377 - RNA, 15 nt, Mycobacterium bovis subsp bovis AF2122/97
gcgauccccgcgcug

SEQ ID NO: 1085378 - RNA, 13 nt, Mycobacterium bovis subsp bovis AF2122/97
gcgaucccgaucg

SEQ ID NO: 1085379 - RNA, 17 nt, Mycobacterium bovis subsp bovis AF2122/97
gcgaucccggccgucgc

SEQ ID NO: 1085380 - RNA, 13 nt, Mycobacterium bovis subsp bovis AF2122/97
gcgaucgcaacac

SEQ ID NO: 1085381 - RNA, 14 nt, Mycobacterium bovis subsp bovis AF2122/97
gcgaucgcaacacc

SEQ ID NO: 1085382 - RNA, 15 nt, Mycobacterium bovis subsp bovis AF2122/97
gcgaucgcaacaccg

SEQ ID NO: 1085383 - RNA, 19 nt, Mycobacterium bovis subsp bovis AF2122/97
gcgaucgcaagcgcggcga

SEQ ID NO: 1085384 - RNA, 20 nt, Mycobacterium bovis subsp bovis AF2122/97
gcgaucgaggagaugccgac

SEQ ID NO: 1085385 - RNA, 14 nt, Mycobacterium bovis subsp bovis AF2122/97
gcgaucgacgcucg

SEQ ID NO: 1085386 - RNA, 17 nt, Mycobacterium bovis subsp bovis AF2122/97
gccggucacguccgcgg

SEQ ID NO: 1085387 - RNA, 14 nt, Mycobacterium bovis subsp bovis AF2122/97
gccggucacgucga

SEQ ID NO: 1085388 - RNA, 14 nt, Mycobacterium bovis subsp bovis AF2122/97
gccgguccucgucg

SEQ ID NO: 1085389 - RNA, 15 nt, Mycobacterium bovis subsp bovis AF2122/97
gccgguaugcgccau

SEQ ID NO: 1085390 - RNA, 16 nt, Mycobacterium bovis subsp bovis AF2122/97
gccgguaugcgccauc

SEQ ID NO: 1085391 - RNA, 14 nt, Mycobacterium bovis subsp bovis AF2122/97
gccgguaugccgaa

SEQ ID NO: 1085392 - RNA, 20 nt, Mycobacterium bovis subsp bovis AF2122/97
gccggucaccucgccggcgg

SEQ ID NO: 1085393 - RNA, 16 nt, Mycobacterium bovis subsp bovis AF2122/97
gccggguucgcgucug

SEQ ID NO: 1085394 - RNA, 14 nt, Mycobacterium bovis subsp bovis AF2122/97
gccggguuggccgg

SEQ ID NO: 1085395 - RNA, 19 nt, Mycobacterium bovis subsp bovis AF2122/97
gccggguuggucuucgauc

SEQ ID NO: 1085396 - RNA, 17 nt, Mycobacterium bovis subsp bovis AF2122/97
gccggguuuauccaguc

SEQ ID NO: 1085397 - RNA, 22 nt, Mycobacterium bovis subsp bovis AF2122/97
gccggguguggcuugacgcccg

SEQ ID NO: 1085398 - RNA, 17 nt, Mycobacterium bovis subsp bovis AF2122/97
gccggguuuggugcagc

SEQ ID NO: 1085399 - RNA, 22 nt, Mycobacterium bovis subsp bovis AF2122/97
gccgguaaccgcgucgaccgga

SEQ ID NO: 1085400 - RNA, 17 nt, Mycobacterium bovis subsp bovis AF2122/97
gccgguaacuguccgcc

SEQ ID NO: 1085401 - RNA, 16 nt, Mycobacterium bovis subsp bovis AF2122/97
gccgggugggagcagc

SEQ ID NO: 1085402 - RNA, 19 nt, Mycobacterium bovis subsp bovis AF2122/97
gccgggugggagcagccga

SEQ ID NO: 1085403 - RNA, 13 nt, Mycobacterium bovis subsp bovis AF2122/97
gccgggcaaggcc

SEQ ID NO: 1085404 - RNA, 21 nt, Mycobacterium bovis subsp bovis AF2122/97
gccgggcaaggccaccgucgc

SEQ ID NO: 1085405 - RNA, 16 nt, Mycobacterium bovis subsp bovis AF2122/97
gccgggcaacgcgaac

SEQ ID NO: 1085406 - RNA, 20 nt, Mycobacterium bovis subsp bovis AF2122/97
gccggguggugauugcggaa

SEQ ID NO: 1085407 - RNA, 17 nt, Mycobacterium bovis subsp bovis AF2122/97
gccgggcaaccagcagc

SEQ ID NO: 1085408 - RNA, 18 nt, Mycobacterium bovis subsp bovis AF2122/97
gccgggauugccgccacc

SEQ ID NO: 1085409 - RNA, 17 nt, Mycobacterium bovis subsp bovis AF2122/97
gccgggauugccgucgg

SEQ ID NO: 1085410 - RNA, 18 nt, Mycobacterium bovis subsp bovis AF2122/97
gccggugaggcgaccgga

SEQ ID NO: 1085411 - RNA, 15 nt, Mycobacterium bovis subsp bovis AF2122/97
gccggugaucggcgg

SEQ ID NO: 1085412 - RNA, 16 nt, Mycobacterium bovis subsp bovis AF2122/97
gccggugaucggcggc

SEQ ID NO: 1085413 - RNA, 20 nt, Mycobacterium bovis subsp bovis AF2122/97
gccggugauggccgaccagc

SEQ ID NO: 1085414 - RNA, 14 nt, Mycobacterium bovis subsp bovis AF2122/97
gccggugcagcacg

SEQ ID NO: 1085415 - RNA, 22 nt, Mycobacterium bovis subsp bovis AF2122/97
gccggugauguccgcacaacga

SEQ ID NO: 1085416 - RNA, 21 nt, Mycobacterium bovis subsp bovis AF2122/97
gccggugcugacgacgagggc

SEQ ID NO: 1085417 - RNA, 23 nt, Mycobacterium bovis subsp bovis AF2122/97
gccggugcugacgacgagggcca

SEQ ID NO: 1085418 - RNA, 15 nt, Mycobacterium bovis subsp bovis AF2122/97
gccggugcugcggga

SEQ ID NO: 1085419 - RNA, 20 nt, Mycobacterium bovis subsp bovis AF2122/97
gccgguggaaaagccacggc

SEQ ID NO: 1085420 - RNA, 17 nt, Mycobacterium bovis subsp bovis AF2122/97
gccggugccacugccgu

SEQ ID NO: 1085421 - RNA, 14 nt, Mycobacterium bovis subsp bovis AF2122/97
gccggugccaccga

SEQ ID NO: 1085422 - RNA, 17 nt, Mycobacterium bovis subsp bovis AF2122/97
gccggugccaccggcug

SEQ ID NO: 1085423 - RNA, 13 nt, Mycobacterium bovis subsp bovis AF2122/97
gccggugccaccg

SEQ ID NO: 1085424 - RNA, 14 nt, Mycobacterium bovis subsp bovis AF2122/97
gccggugcggcggg

SEQ ID NO: 1085425 - RNA, 15 nt, Mycobacterium bovis subsp bovis AF2122/97
gccggugcgcugguu

SEQ ID NO: 1085426 - RNA, 18 nt, Mycobacterium bovis subsp bovis AF2122/97
gccggucgaugucggcga

SEQ ID NO: 1085427 - RNA, 20 nt, Mycobacterium bovis subsp bovis AF2122/97
gccggucgcauggucgacga

SEQ ID NO: 1085428 - RNA, 21 nt, Mycobacterium bovis subsp bovis AF2122/97
gccggucgcauggucgacgaa

SEQ ID NO: 1085429 - RNA, 23 nt, Mycobacterium bovis subsp bovis AF2122/97
gccggucgcauggucgacgaaca

SEQ ID NO: 1085430 - RNA, 17 nt, Mycobacterium bovis subsp bovis AF2122/97
gccgguccucgucggcg

SEQ ID NO: 1085431 - RNA, 18 nt, Mycobacterium bovis subsp bovis AF2122/97
gccgguccucgucggcga

SEQ ID NO: 1085432 - RNA, 19 nt, Mycobacterium bovis subsp bovis AF2122/97
gccgguccucgucggcgaa

SEQ ID NO: 1085433 - RNA, 15 nt, Mycobacterium bovis subsp bovis AF2122/97
gccggucgagacgcu

SEQ ID NO: 1085434 - RNA, 22 nt, Mycobacterium bovis subsp bovis AF2122/97
gccggucuucgcgggacgcgac

SEQ ID NO: 1085435 - RNA, 16 nt, Mycobacterium bovis subsp bovis AF2122/97
gccggucuugcaucgc

SEQ ID NO: 1085436 - RNA, 14 nt, Mycobacterium bovis subsp bovis AF2122/97
gccggugacaagug

SEQ ID NO: 1085437 - RNA, 20 nt, Mycobacterium bovis subsp bovis AF2122/97
gccggugacaaguggugccc

SEQ ID NO: 1085438 - RNA, 21 nt, Mycobacterium bovis subsp bovis AF2122/97
gccggugacaaguggugcccu

SEQ ID NO: 1085439 - RNA, 18 nt, Mycobacterium bovis subsp bovis AF2122/97
gccggugacgacgucgcc

SEQ ID NO: 1085440 - RNA, 23 nt, Mycobacterium bovis subsp bovis AF2122/97
gccggugacgacgucgccgccgc

SEQ ID NO: 1085441 - RNA, 17 nt, Mycobacterium bovis subsp bovis AF2122/97
gccggugacggggcuga

SEQ ID NO: 1085442 - RNA, 22 nt, Mycobacterium bovis subsp bovis AF2122/97
gccggugagcgagcgcgcguag

SEQ ID NO: 1085443 - RNA, 15 nt, Mycobacterium bovis subsp bovis AF2122/97
gccggugagcgagcg

SEQ ID NO: 1085444 - RNA, 17 nt, Mycobacterium bovis subsp bovis AF2122/97
gccggugagcgagcgcg

SEQ ID NO: 1085445 - RNA, 22 nt, Mycobacterium bovis subsp bovis AF2122/97
gccggugacgggguugaccgcc

SEQ ID NO: 1085446 - RNA, 13 nt, Mycobacterium bovis subsp bovis AF2122/97
gccggugacggug

SEQ ID NO: 1085447 - RNA, 18 nt, Mycobacterium bovis subsp bovis AF2122/97
gccggugacgguguuggu

SEQ ID NO: 1085448 - RNA, 23 nt, Mycobacterium bovis subsp bovis AF2122/97
gccggugacgguguuggugaccg

SEQ ID NO: 1085449 - RNA, 18 nt, Mycobacterium bovis subsp bovis AF2122/97
gccggugacguggugggc

SEQ ID NO: 1085450 - RNA, 18 nt, Mycobacterium bovis subsp bovis AF2122/97
gccgguggucgcgcccau

SEQ ID NO: 1085451 - RNA, 15 nt, Mycobacterium bovis subsp bovis AF2122/97
gccgguggcacggcc

SEQ ID NO: 1085452 - RNA, 16 nt, Mycobacterium bovis subsp bovis AF2122/97
gccggugggccgccca

SEQ ID NO: 1085453 - RNA, 17 nt, Mycobacterium bovis subsp bovis AF2122/97
gccgguggguagccagc

SEQ ID NO: 1085454 - RNA, 14 nt, Mycobacterium bovis subsp bovis AF2122/97
gccggugguaacgg

SEQ ID NO: 1085455 - RNA, 17 nt, Mycobacterium bovis subsp bovis AF2122/97
gccggugggcgguccgc

SEQ ID NO: 1085456 - RNA, 13 nt, Mycobacterium bovis subsp bovis AF2122/97
gccgguggcggcg

SEQ ID NO: 1085457 - RNA, 15 nt, Mycobacterium bovis subsp bovis AF2122/97
gccgguggcggcggc

SEQ ID NO: 1085458 - RNA, 23 nt, Mycobacterium bovis subsp bovis AF2122/97
gccgguggcggcggcggcaacgg

SEQ ID NO: 1085459 - RNA, 13 nt, Mycobacterium bovis subsp bovis AF2122/97
gccgguggccagc

SEQ ID NO: 1085460 - RNA, 17 nt, Mycobacterium bovis subsp bovis AF2122/97
gccgguguaacccucga

SEQ ID NO: 1085461 - RNA, 17 nt, Mycobacterium bovis subsp bovis AF2122/97
gccgguggugccggcgc

SEQ ID NO: 1085462 - RNA, 22 nt, Mycobacterium bovis subsp bovis AF2122/97
gccgguggugccggcgccgcca

SEQ ID NO: 1085463 - RNA, 14 nt, Mycobacterium bovis subsp bovis AF2122/97
gccggugguaccgg

SEQ ID NO: 1085464 - RNA, 21 nt, Mycobacterium bovis subsp bovis AF2122/97
gccggugguaccggcggcgcc

SEQ ID NO: 1085465 - RNA, 16 nt, Mycobacterium bovis subsp bovis AF2122/97
gccgguggugacggcg

SEQ ID NO: 1085466 - RNA, 20 nt, Mycobacterium bovis subsp bovis AF2122/97
gccgguggugacggcgguac

SEQ ID NO: 1085467 - RNA, 21 nt, Mycobacterium bovis subsp bovis AF2122/97
gccgguggugacggcgguacc

SEQ ID NO: 1085468 - RNA, 22 nt, Mycobacterium bovis subsp bovis AF2122/97
gccgguggugacggcgguaccg

SEQ ID NO: 1085469 - RNA, 19 nt, Mycobacterium bovis subsp bovis AF2122/97
gccgguguaacccucgaac

SEQ ID NO: 1085470 - RNA, 18 nt, Mycobacterium bovis subsp bovis AF2122/97
gccgguguccuuggccgc

SEQ ID NO: 1085471 - RNA, 19 nt, Mycobacterium bovis subsp bovis AF2122/97
gccggugucgacggggaac

SEQ ID NO: 1085472 - RNA, 16 nt, Mycobacterium bovis subsp bovis AF2122/97
gccggugucggcuggu

SEQ ID NO: 1085473 - RNA, 20 nt, Mycobacterium bovis subsp bovis AF2122/97
gccggugucgggcugucagg

SEQ ID NO: 1085474 - RNA, 22 nt, Mycobacterium bovis subsp bovis AF2122/97
gccggugucucccuugccgcca

SEQ ID NO: 1085475 - RNA, 15 nt, Mycobacterium bovis subsp bovis AF2122/97
gccguacgcccaggc

SEQ ID NO: 1085476 - RNA, 14 nt, Mycobacterium bovis subsp bovis AF2122/97
gccguacucgucgu

SEQ ID NO: 1085477 - RNA, 22 nt, Mycobacterium bovis subsp bovis AF2122/97
gccguagaccacuucgauggcg

SEQ ID NO: 1085478 - RNA, 14 nt, Mycobacterium bovis subsp bovis AF2122/97
gccguagaccagca

SEQ ID NO: 1085479 - RNA, 14 nt, Mycobacterium bovis subsp bovis AF2122/97
gccguagaccagcc

SEQ ID NO: 1085480 - RNA, 23 nt, Mycobacterium bovis subsp bovis AF2122/97
gccguagaccagccgucguccgc

SEQ ID NO: 1085481 - RNA, 21 nt, Mycobacterium bovis subsp bovis AF2122/97
gccguaguaguggccgccacc

SEQ ID NO: 1085482 - RNA, 16 nt, Mycobacterium bovis subsp bovis AF2122/97
gccguagugcgcaucg

SEQ ID NO: 1085483 - RNA, 20 nt, Mycobacterium bovis subsp bovis AF2122/97
gccguagugcgcaucgccgg

SEQ ID NO: 1085484 - RNA, 13 nt, Mycobacterium bovis subsp bovis AF2122/97
gccguagaucccg

SEQ ID NO: 1085485 - RNA, 14 nt, Mycobacterium bovis subsp bovis AF2122/97
gccguagugucggc

SEQ ID NO: 1085486 - RNA, 17 nt, Mycobacterium bovis subsp bovis AF2122/97
gccguagugucggcguc

SEQ ID NO: 1085487 - RNA, 13 nt, Mycobacterium bovis subsp bovis AF2122/97
gccguaucggugu

SEQ ID NO: 1085488 - RNA, 20 nt, Mycobacterium bovis subsp bovis AF2122/97
gccguauaggcccgggcggc

SEQ ID NO: 1085489 - RNA, 22 nt, Mycobacterium bovis subsp bovis AF2122/97
gccguauaggcccgggcggcca

SEQ ID NO: 1085490 - RNA, 17 nt, Mycobacterium bovis subsp bovis AF2122/97
gccguauccaggcgugc

SEQ ID NO: 1085491 - RNA, 17 nt, Mycobacterium bovis subsp bovis AF2122/97
gccguccaccgauaccc

SEQ ID NO: 1085492 - RNA, 23 nt, Mycobacterium bovis subsp bovis AF2122/97
gccguccaagaugucguguucgc

SEQ ID NO: 1085493 - RNA, 14 nt, Mycobacterium bovis subsp bovis AF2122/97
gccgucauggcccg

SEQ ID NO: 1085494 - RNA, 11 nt, Mycobacterium bovis subsp bovis AF2122/97
gccguccagcg

SEQ ID NO: 1085495 - RNA, 19 nt, Mycobacterium bovis subsp bovis AF2122/97
gccguccaauuccgcagag

SEQ ID NO: 1085496 - RNA, 17 nt, Mycobacterium bovis subsp bovis AF2122/97
gccguccagcgccgcgg

SEQ ID NO: 1085497 - RNA, 14 nt, Mycobacterium bovis subsp bovis AF2122/97
gccguccaggacgg

SEQ ID NO: 1085498 - RNA, 21 nt, Mycobacterium bovis subsp bovis AF2122/97
gccgucccgauacggccggcc

SEQ ID NO: 1085499 - RNA, 21 nt, Mycobacterium bovis subsp bovis AF2122/97
gccgucagggucagcugggac

SEQ ID NO: 1085500 - RNA, 14 nt, Mycobacterium bovis subsp bovis AF2122/97
gccgucaucgccgg

SEQ ID NO: 1085501 - RNA, 14 nt, Mycobacterium bovis subsp bovis AF2122/97
gccgucaucuccga

SEQ ID NO: 1085502 - RNA, 14 nt, Mycobacterium bovis subsp bovis AF2122/97
gccgucaucgcagc

SEQ ID NO: 1085503 - RNA, 15 nt, Mycobacterium bovis subsp bovis AF2122/97
gccgucagcggcggc

SEQ ID NO: 1085504 - RNA, 16 nt, Mycobacterium bovis subsp bovis AF2122/97
gccgucagcggcggcc

SEQ ID NO: 1085505 - RNA, 17 nt, Mycobacterium bovis subsp bovis AF2122/97
gccgucaggcgugccgg

SEQ ID NO: 1085506 - RNA, 14 nt, Mycobacterium bovis subsp bovis AF2122/97
gccgucagcggcgg

SEQ ID NO: 1085507 - RNA, 17 nt, Mycobacterium bovis subsp bovis AF2122/97
gccgucagccguucggc

SEQ ID NO: 1085508 - RNA, 20 nt, Mycobacterium bovis subsp bovis AF2122/97
gccgucaacgaugguggcga

SEQ ID NO: 1085509 - RNA, 21 nt, Mycobacterium bovis subsp bovis AF2122/97
gccgucaacgaugguggcgau

SEQ ID NO: 1085510 - RNA, 18 nt, Mycobacterium bovis subsp bovis AF2122/97
gccgucaacgccucugcu

SEQ ID NO: 1085511 - RNA, 21 nt, Mycobacterium bovis subsp bovis AF2122/97
gccgucagaacaccggccagg

SEQ ID NO: 1085512 - RNA, 20 nt, Mycobacterium bovis subsp bovis AF2122/97
gccgucaaccagggugccgg

SEQ ID NO: 1085513 - RNA, 22 nt, Mycobacterium bovis subsp bovis AF2122/97
gccgucaaccagggugccggcg

SEQ ID NO: 1085514 - RNA, 14 nt, Mycobacterium bovis subsp bovis AF2122/97
gccguaugccgcca

SEQ ID NO: 1085515 - RNA, 15 nt, Mycobacterium bovis subsp bovis AF2122/97
gccgucgacgcggcc

SEQ ID NO: 1085516 - RNA, 19 nt, Mycobacterium bovis subsp bovis AF2122/97
gccgucgacgcggccggcc

SEQ ID NO: 1085517 - RNA, 22 nt, Mycobacterium bovis subsp bovis AF2122/97
gccgucgcccuuagggucgccg

SEQ ID NO: 1085518 - RNA, 11 nt, Mycobacterium bovis subsp bovis AF2122/97
gccgucgccga

SEQ ID NO: 1085519 - RNA, 19 nt, Mycobacterium bovis subsp bovis AF2122/97
gccgucgcccagcgugaac

SEQ ID NO: 1085520 - RNA, 20 nt, Mycobacterium bovis subsp bovis AF2122/97
gccgucgcccagcgugaacu

SEQ ID NO: 1085521 - RNA, 13 nt, Mycobacterium bovis subsp bovis AF2122/97
gccgucgccgccg

SEQ ID NO: 1085522 - RNA, 14 nt, Mycobacterium bovis subsp bovis AF2122/97
gccgucgccgccgg

SEQ ID NO: 1085523 - RNA, 16 nt, Mycobacterium bovis subsp bovis AF2122/97
gccgucgccgccggcg

SEQ ID NO: 1085524 - RNA, 17 nt, Mycobacterium bovis subsp bovis AF2122/97
gccgucgccgccggcgc

SEQ ID NO: 1085525 - RNA, 13 nt, Mycobacterium bovis subsp bovis AF2122/97
gccgucgccgauc

SEQ ID NO: 1085526 - RNA, 14 nt, Mycobacterium bovis subsp bovis AF2122/97
gccgucgccgccgu

SEQ ID NO: 1085527 - RNA, 22 nt, Mycobacterium bovis subsp bovis AF2122/97
gccgucggcgugacgucgucga

SEQ ID NO: 1085528 - RNA, 16 nt, Mycobacterium bovis subsp bovis AF2122/97
gccgucggcgugcagc

SEQ ID NO: 1085529 - RNA, 16 nt, Mycobacterium bovis subsp bovis AF2122/97
gccgucggcgucgaag

SEQ ID NO: 1085530 - RNA, 16 nt, Mycobacterium bovis subsp bovis AF2122/97
gccgucgccgccguua

SEQ ID NO: 1085531 - RNA, 21 nt, Mycobacterium bovis subsp bovis AF2122/97
gccgucggugauggagccggu

SEQ ID NO: 1085532 - RNA, 23 nt, Mycobacterium bovis subsp bovis AF2122/97
gccgucggugauggagccgguga

SEQ ID NO: 1085533 - RNA, 14 nt, Mycobacterium bovis subsp bovis AF2122/97
gccgucggugccgc

SEQ ID NO: 1085534 - RNA, 18 nt, Mycobacterium bovis subsp bovis AF2122/97
gccgucgggacggccaac

SEQ ID NO: 1085535 - RNA, 20 nt, Mycobacterium bovis subsp bovis AF2122/97
gccgucggguaggccgccgu

SEQ ID NO: 1085536 - RNA, 21 nt, Mycobacterium bovis subsp bovis AF2122/97
gccgucggggaguucgcgcag

SEQ ID NO: 1085537 - RNA, 22 nt, Mycobacterium bovis subsp bovis AF2122/97
gccgucggggaguucgcgcagc

SEQ ID NO: 1085538 - RNA, 20 nt, Mycobacterium bovis subsp bovis AF2122/97
gccgucggugaugacguagu

SEQ ID NO: 1085539 - RNA, 15 nt, Mycobacterium bovis subsp bovis AF2122/97
gccgucgucgaccac

SEQ ID NO: 1085540 - RNA, 16 nt, Mycobacterium bovis subsp bovis AF2122/97
gccgucgucgaccacg

SEQ ID NO: 1085541 - RNA, 13 nt, Mycobacterium bovis subsp bovis AF2122/97
gccgucgucgauc

SEQ ID NO: 1085542 - RNA, 13 nt, Mycobacterium bovis subsp bovis AF2122/97
gccgucgucgccg

SEQ ID NO: 1085543 - RNA, 21 nt, Mycobacterium bovis subsp bovis AF2122/97
gccgucgucgccgucggugcc

SEQ ID NO: 1085544 - RNA, 19 nt, Mycobacterium bovis subsp bovis AF2122/97
gccgucggugggugccagc

SEQ ID NO: 1085545 - RNA, 17 nt, Mycobacterium bovis subsp bovis AF2122/97
gccgucggugccgccgc

SEQ ID NO: 1085546 - RNA, 21 nt, Mycobacterium bovis subsp bovis AF2122/97
gccgucggugccgccgccggc

SEQ ID NO: 1085547 - RNA, 22 nt, Mycobacterium bovis subsp bovis AF2122/97
gccgucggugccgccgccggcg

SEQ ID NO: 1085548 - RNA, 17 nt, Mycobacterium bovis subsp bovis AF2122/97
gccgucggugccgcgga

SEQ ID NO: 1085549 - RNA, 17 nt, Mycobacterium bovis subsp bovis AF2122/97
gccgucguacaccucga

SEQ ID NO: 1085550 - RNA, 23 nt, Mycobacterium bovis subsp bovis AF2122/97
gccgucguacucgaccgcgagca

SEQ ID NO: 1085551 - RNA, 12 nt, Mycobacterium bovis subsp bovis AF2122/97
gccgucgucggc

SEQ ID NO: 1085552 - RNA, 22 nt, Mycobacterium bovis subsp bovis AF2122/97
gccgucgguaaagggcucgaug

SEQ ID NO: 1085553 - RNA, 15 nt, Mycobacterium bovis subsp bovis AF2122/97
gccgucgucgcgcag

SEQ ID NO: 1085554 - RNA, 16 nt, Mycobacterium bovis subsp bovis AF2122/97
gccgucgucggccaga

SEQ ID NO: 1085555 - RNA, 14 nt, Mycobacterium bovis subsp bovis AF2122/97
gccgucgucggcgu

SEQ ID NO: 1085556 - RNA, 16 nt, Mycobacterium bovis subsp bovis AF2122/97
gccgucgucggcguac

SEQ ID NO: 1085557 - RNA, 13 nt, Mycobacterium bovis subsp bovis AF2122/97
gccgucgugaucg

SEQ ID NO: 1085558 - RNA, 23 nt, Mycobacterium bovis subsp bovis AF2122/97
gccgucgucgucgagauagccga

SEQ ID NO: 1085559 - RNA, 15 nt, Mycobacterium bovis subsp bovis AF2122/97
gccgucgucgucgcu

SEQ ID NO: 1085560 - RNA, 19 nt, Mycobacterium bovis subsp bovis AF2122/97
gccgucgugaucggcgaac

SEQ ID NO: 1085561 - RNA, 23 nt, Mycobacterium bovis subsp bovis AF2122/97
gccgucgucgucgcuguaggcga

SEQ ID NO: 1085562 - RNA, 17 nt, Mycobacterium bovis subsp bovis AF2122/97
gccgucgugaucggcga

SEQ ID NO: 1085563 - RNA, 18 nt, Mycobacterium bovis subsp bovis AF2122/97
gccgucgugaucggcgaa

SEQ ID NO: 1085564 - RNA, 19 nt, Mycobacterium bovis subsp bovis AF2122/97
gccgucugaucacucaccc

SEQ ID NO: 1085565 - RNA, 19 nt, Mycobacterium bovis subsp bovis AF2122/97
gccgucucugacgaauggg

SEQ ID NO: 1085566 - RNA, 13 nt, Mycobacterium bovis subsp bovis AF2122/97
gccguccggugug

SEQ ID NO: 1085567 - RNA, 20 nt, Mycobacterium bovis subsp bovis AF2122/97
gccguccggcuuggcggcga

SEQ ID NO: 1085568 - RNA, 16 nt, Mycobacterium bovis subsp bovis AF2122/97
gccguccgggcggccu

SEQ ID NO: 1085569 - RNA, 14 nt, Mycobacterium bovis subsp bovis AF2122/97
gccguccucgguca

SEQ ID NO: 1085570 - RNA, 16 nt, Mycobacterium bovis subsp bovis AF2122/97
gccguccucggucagc

SEQ ID NO: 1085571 - RNA, 20 nt, Mycobacterium bovis subsp bovis AF2122/97
gccguccgggcggccucccg

SEQ ID NO: 1085572 - RNA, 14 nt, Mycobacterium bovis subsp bovis AF2122/97
gccguccggcgccc

SEQ ID NO: 1085573 - RNA, 14 nt, Mycobacterium bovis subsp bovis AF2122/97
gccguccggcgcug

SEQ ID NO: 1085574 - RNA, 18 nt, Mycobacterium bovis subsp bovis AF2122/97
gccguccggcgcuggcgu

SEQ ID NO: 1085575 - RNA, 21 nt, Mycobacterium bovis subsp bovis AF2122/97
gccgucccgcgagcagcccgg

SEQ ID NO: 1085576 - RNA, 20 nt, Mycobacterium bovis subsp bovis AF2122/97
gccguccagucggucgguac

SEQ ID NO: 1085577 - RNA, 16 nt, Mycobacterium bovis subsp bovis AF2122/97
gccgucccaccagccg

SEQ ID NO: 1085578 - RNA, 15 nt, Mycobacterium bovis subsp bovis AF2122/97
gccgucccggcucga

SEQ ID NO: 1085579 - RNA, 22 nt, Mycobacterium bovis subsp bovis AF2122/97
gccgucgaaagagaaggcggcg

SEQ ID NO: 1085580 - RNA, 17 nt, Mycobacterium bovis subsp bovis AF2122/97
gccgucgaaauacccgg

SEQ ID NO: 1085581 - RNA, 13 nt, Mycobacterium bovis subsp bovis AF2122/97
gccgucgaccacg

SEQ ID NO: 1085582 - RNA, 20 nt, Mycobacterium bovis subsp bovis AF2122/97
gccgucgaagcggaccagcg

SEQ ID NO: 1085583 - RNA, 20 nt, Mycobacterium bovis subsp bovis AF2122/97
gccgucgacaacaaacccgg

SEQ ID NO: 1085584 - RNA, 14 nt, Mycobacterium bovis subsp bovis AF2122/97
gccgucgcaucagg

SEQ ID NO: 1085585 - RNA, 11 nt, Mycobacterium bovis subsp bovis AF2122/97
gccgucgccac

SEQ ID NO: 1085586 - RNA, 21 nt, Mycobacterium bovis subsp bovis AF2122/97
gccgucgccaccgguaccgau

SEQ ID NO: 1085587 - RNA, 14 nt, Mycobacterium bovis subsp bovis AF2122/97
gccgucgccaccau

SEQ ID NO: 1085588 - RNA, 16 nt, Mycobacterium bovis subsp bovis AF2122/97
gccgucgccaccaucg

SEQ ID NO: 1085589 - RNA, 13 nt, Mycobacterium bovis subsp bovis AF2122/97
gccgucgaccggc

SEQ ID NO: 1085590 - RNA, 14 nt, Mycobacterium bovis subsp bovis AF2122/97
gccgucgaccggcg

SEQ ID NO: 1085591 - RNA, 13 nt, Mycobacterium bovis subsp bovis AF2122/97
gccgugcggcggc

SEQ ID NO: 1085592 - RNA, 14 nt, Mycobacterium bovis subsp bovis AF2122/97
gccgugcggcggcu

SEQ ID NO: 1085593 - RNA, 22 nt, Mycobacterium bovis subsp bovis AF2122/97
gccgugcugaacuccgccgcga

SEQ ID NO: 1085594 - RNA, 22 nt, Mycobacterium bovis subsp bovis AF2122/97
gccgugcugaauugccaagcgc

SEQ ID NO: 1085595 - RNA, 17 nt, Mycobacterium bovis subsp bovis AF2122/97
gccgugcucaccggcgc

SEQ ID NO: 1085596 - RNA, 22 nt, Mycobacterium bovis subsp bovis AF2122/97
gccgugcucaccggcgcccagc

SEQ ID NO: 1085597 - RNA, 23 nt, Mycobacterium bovis subsp bovis AF2122/97
gccgugcucaccggcgcccagcg

SEQ ID NO: 1085598 - RNA, 14 nt, Mycobacterium bovis subsp bovis AF2122/97
gccgugcucacggc

SEQ ID NO: 1085599 - RNA, 17 nt, Mycobacterium bovis subsp bovis AF2122/97
gccgugcgggccggucg

SEQ ID NO: 1085600 - RNA, 18 nt, Mycobacterium bovis subsp bovis AF2122/97
gccgugcggucgcgcccu

SEQ ID NO: 1085601 - RNA, 13 nt, Mycobacterium bovis subsp bovis AF2122/97
gccgugcgugcgg

SEQ ID NO: 1085602 - RNA, 19 nt, Mycobacterium bovis subsp bovis AF2122/97
gccgugcuacccauucggc

SEQ ID NO: 1085603 - RNA, 14 nt, Mycobacterium bovis subsp bovis AF2122/97
gccgugcugggccg

SEQ ID NO: 1085604 - RNA, 17 nt, Mycobacterium bovis subsp bovis AF2122/97
gccgugcugggccgacg

SEQ ID NO: 1085605 - RNA, 18 nt, Mycobacterium bovis subsp bovis AF2122/97
gccgugcugggccgacgg

SEQ ID NO: 1085606 - RNA, 21 nt, Mycobacterium bovis subsp bovis AF2122/97
gccgugcuacccauucggcgg

SEQ ID NO: 1085607 - RNA, 21 nt, Mycobacterium bovis subsp bovis AF2122/97
gccguggauggcccguucgac

SEQ ID NO: 1085608 - RNA, 13 nt, Mycobacterium bovis subsp bovis AF2122/97
gccgucuuggccc

SEQ ID NO: 1085609 - RNA, 21 nt, Mycobacterium bovis subsp bovis AF2122/97
gccgucuucgccgccaccggc

SEQ ID NO: 1085610 - RNA, 15 nt, Mycobacterium bovis subsp bovis AF2122/97
gccgucuuggcccgg

SEQ ID NO: 1085611 - RNA, 22 nt, Mycobacterium bovis subsp bovis AF2122/97
gccgugacccauucucggccgg

SEQ ID NO: 1085612 - RNA, 19 nt, Mycobacterium bovis subsp bovis AF2122/97
gccgugacccucagcaccg

SEQ ID NO: 1085613 - RNA, 22 nt, Mycobacterium bovis subsp bovis AF2122/97
gccgugaccgagccgcgaugcg

SEQ ID NO: 1085614 - RNA, 18 nt, Mycobacterium bovis subsp bovis AF2122/97
gccgucuuugucacgcac

SEQ ID NO: 1085615 - RNA, 22 nt, Mycobacterium bovis subsp bovis AF2122/97
gccgucuuugucacgcaccgcg

SEQ ID NO: 1085616 - RNA, 15 nt, Mycobacterium bovis subsp bovis AF2122/97
gccgugccgugguga

SEQ ID NO: 1085617 - RNA, 17 nt, Mycobacterium bovis subsp bovis AF2122/97
gccgugcgaucgucaac

SEQ ID NO: 1085618 - RNA, 22 nt, Mycobacterium bovis subsp bovis AF2122/97
gccgugcgccacggcuguggcc

SEQ ID NO: 1085619 - RNA, 14 nt, Mycobacterium bovis subsp bovis AF2122/97
gccgugccggugug

SEQ ID NO: 1085620 - RNA, 19 nt, Mycobacterium bovis subsp bovis AF2122/97
gccgugccgguuuggccga

SEQ ID NO: 1085621 - RNA, 14 nt, Mycobacterium bovis subsp bovis AF2122/97
gccgugccgcggcg

SEQ ID NO: 1085622 - RNA, 15 nt, Mycobacterium bovis subsp bovis AF2122/97
gccgugccgcggcga

SEQ ID NO: 1085623 - RNA, 13 nt, Mycobacterium bovis subsp bovis AF2122/97
gccgugccgggcc

SEQ ID NO: 1085624 - RNA, 20 nt, Mycobacterium bovis subsp bovis AF2122/97
gccgugcuuguugcgcgacg

SEQ ID NO: 1085625 - RNA, 12 nt, Mycobacterium bovis subsp bovis AF2122/97
gccguggucgaa

SEQ ID NO: 1085626 - RNA, 19 nt, Mycobacterium bovis subsp bovis AF2122/97
gccgugggugucgguggcc

SEQ ID NO: 1085627 - RNA, 19 nt, Mycobacterium bovis subsp bovis AF2122/97
gccguggugaaaugccgag

SEQ ID NO: 1085628 - RNA, 23 nt, Mycobacterium bovis subsp bovis AF2122/97
gccguugauaaaaaccuggcccg

SEQ ID NO: 1085629 - RNA, 22 nt, Mycobacterium bovis subsp bovis AF2122/97
gccguugaucaagaaggccagc

SEQ ID NO: 1085630 - RNA, 19 nt, Mycobacterium bovis subsp bovis AF2122/97
gccguugaacggcaccagc

SEQ ID NO: 1085631 - RNA, 22 nt, Mycobacterium bovis subsp bovis AF2122/97
gccguggguguuuuugcgggug

SEQ ID NO: 1085632 - RNA, 14 nt, Mycobacterium bovis subsp bovis AF2122/97
gccguugacgccgu

SEQ ID NO: 1085633 - RNA, 15 nt, Mycobacterium bovis subsp bovis AF2122/97
gccguugacgguguc

SEQ ID NO: 1085634 - RNA, 17 nt, Mycobacterium bovis subsp bovis AF2122/97
gccguucucgcccaccc

SEQ ID NO: 1085635 - RNA, 16 nt, Mycobacterium bovis subsp bovis AF2122/97
gccguguacgugcucg

SEQ ID NO: 1085636 - RNA, 17 nt, Mycobacterium bovis subsp bovis AF2122/97
gccguguacgugcucgu

SEQ ID NO: 1085637 - RNA, 17 nt, Mycobacterium bovis subsp bovis AF2122/97
gccgugguggacgaugc

SEQ ID NO: 1085638 - RNA, 16 nt, Mycobacterium bovis subsp bovis AF2122/97
gccguucucgucgagg

SEQ ID NO: 1085639 - RNA, 13 nt, Mycobacterium bovis subsp bovis AF2122/97
gccguugccgccg

SEQ ID NO: 1085640 - RNA, 14 nt, Mycobacterium bovis subsp bovis AF2122/97
gccguugccgccga

SEQ ID NO: 1085641 - RNA, 23 nt, Mycobacterium bovis subsp bovis AF2122/97
gccguugccgccacgggcggcca

SEQ ID NO: 1085642 - RNA, 14 nt, Mycobacterium bovis subsp bovis AF2122/97
gccguugccgccca

SEQ ID NO: 1085643 - RNA, 20 nt, Mycobacterium bovis subsp bovis AF2122/97
gccguugccgcccacgcugc

SEQ ID NO: 1085644 - RNA, 21 nt, Mycobacterium bovis subsp bovis AF2122/97
gccguugcccccguugccgcc

SEQ ID NO: 1085645 - RNA, 12 nt, Mycobacterium bovis subsp bovis AF2122/97
gccguugccaac

SEQ ID NO: 1085646 - RNA, 17 nt, Mycobacterium bovis subsp bovis AF2122/97
gccguugccaagcagcu

SEQ ID NO: 1085647 - RNA, 16 nt, Mycobacterium bovis subsp bovis AF2122/97
gccguugccaccggug

SEQ ID NO: 1085648 - RNA, 17 nt, Mycobacterium bovis subsp bovis AF2122/97
gccguugccaccggugc

SEQ ID NO: 1085649 - RNA, 23 nt, Mycobacterium bovis subsp bovis AF2122/97
gccguugccaccggugccggcga

SEQ ID NO: 1085650 - RNA, 19 nt, Mycobacterium bovis subsp bovis AF2122/97
gccguugauucggccgccg

SEQ ID NO: 1085651 - RNA, 20 nt, Mycobacterium bovis subsp bovis AF2122/97
gccguugauucggccgccga

SEQ ID NO: 1085652 - RNA, 23 nt, Mycobacterium bovis subsp bovis AF2122/97
gccguugauucggccgccgacgu

SEQ ID NO: 1085653 - RNA, 15 nt, Mycobacterium bovis subsp bovis AF2122/97
gccguugccggcgac

SEQ ID NO: 1085654 - RNA, 20 nt, Mycobacterium bovis subsp bovis AF2122/97
gccguugccggcguugccgc

SEQ ID NO: 1085655 - RNA, 20 nt, Mycobacterium bovis subsp bovis AF2122/97
gccguugccgaucagcccgg

SEQ ID NO: 1085656 - RNA, 21 nt, Mycobacterium bovis subsp bovis AF2122/97
gccguugccgaucagcccggc

SEQ ID NO: 1085657 - RNA, 21 nt, Mycobacterium bovis subsp bovis AF2122/97
gccguugccgaucgcuccggc

SEQ ID NO: 1085658 - RNA, 17 nt, Mycobacterium bovis subsp bovis AF2122/97
gccguugccgccgaagc

SEQ ID NO: 1085659 - RNA, 20 nt, Mycobacterium bovis subsp bovis AF2122/97
gccguugccgccgaagccga

SEQ ID NO: 1085660 - RNA, 15 nt, Mycobacterium bovis subsp bovis AF2122/97
gccguugccgccggc

SEQ ID NO: 1085661 - RNA, 16 nt, Mycobacterium bovis subsp bovis AF2122/97
gccguugccgccggcg

SEQ ID NO: 1085662 - RNA, 17 nt, Mycobacterium bovis subsp bovis AF2122/97
gccguugccgccggcgc

SEQ ID NO: 1085663 - RNA, 23 nt, Mycobacterium bovis subsp bovis AF2122/97
gccguugccgccggcgccgccga

SEQ ID NO: 1085664 - RNA, 17 nt, Mycobacterium bovis subsp bovis AF2122/97
gccguugccgccggugc

SEQ ID NO: 1085665 - RNA, 14 nt, Mycobacterium bovis subsp bovis AF2122/97
gccguugccggcca

SEQ ID NO: 1085666 - RNA, 16 nt, Mycobacterium bovis subsp bovis AF2122/97
gccguugcgucugcuc

SEQ ID NO: 1085667 - RNA, 14 nt, Mycobacterium bovis subsp bovis AF2122/97
gccguugccgccgc

SEQ ID NO: 1085668 - RNA, 22 nt, Mycobacterium bovis subsp bovis AF2122/97
gccguugcgccucuuccuggcg

SEQ ID NO: 1085669 - RNA, 16 nt, Mycobacterium bovis subsp bovis AF2122/97
gccguugcgaucgcgu

SEQ ID NO: 1085670 - RNA, 20 nt, Mycobacterium bovis subsp bovis AF2122/97
gccugucgaagauccagcgc

SEQ ID NO: 1085671 - RNA, 17 nt, Mycobacterium bovis subsp bovis AF2122/97
gccuguugcugcccgac

SEQ ID NO: 1085672 - RNA, 15 nt, Mycobacterium bovis subsp bovis AF2122/97
gccugucccgccggc

SEQ ID NO: 1085673 - RNA, 18 nt, Mycobacterium bovis subsp bovis AF2122/97
gccuuacacgccuggcua

SEQ ID NO: 1085674 - RNA, 21 nt, Mycobacterium bovis subsp bovis AF2122/97
gccuuaaccgagccgaccggc

SEQ ID NO: 1085675 - RNA, 21 nt, Mycobacterium bovis subsp bovis AF2122/97
gccuggugcucaacggcgaca

SEQ ID NO: 1085676 - RNA, 13 nt, Mycobacterium bovis subsp bovis AF2122/97
gccugguguccga

SEQ ID NO: 1085677 - RNA, 15 nt, Mycobacterium bovis subsp bovis AF2122/97
gccuguacggcggcu

SEQ ID NO: 1085678 - RNA, 17 nt, Mycobacterium bovis subsp bovis AF2122/97
gccugucaggcggcgga

SEQ ID NO: 1085679 - RNA, 13 nt, Mycobacterium bovis subsp bovis AF2122/97
gccuggucgcgca

SEQ ID NO: 1085680 - RNA, 20 nt, Mycobacterium bovis subsp bovis AF2122/97
gccuggucuuguugcgcagc

SEQ ID NO: 1085681 - RNA, 18 nt, Mycobacterium bovis subsp bovis AF2122/97
gccugggcacggccgucg

SEQ ID NO: 1085682 - RNA, 13 nt, Mycobacterium bovis subsp bovis AF2122/97
gccugggccagcc

SEQ ID NO: 1085683 - RNA, 15 nt, Mycobacterium bovis subsp bovis AF2122/97
gccugggccagccgc

SEQ ID NO: 1085684 - RNA, 21 nt, Mycobacterium bovis subsp bovis AF2122/97
gccugggccagccgcucaccc

SEQ ID NO: 1085685 - RNA, 20 nt, Mycobacterium bovis subsp bovis AF2122/97
gccugggacggcggcagucg

SEQ ID NO: 1085686 - RNA, 13 nt, Mycobacterium bovis subsp bovis AF2122/97
gccugggcgacga

SEQ ID NO: 1085687 - RNA, 13 nt, Mycobacterium bovis subsp bovis AF2122/97
gccugggcuuggc

SEQ ID NO: 1085688 - RNA, 15 nt, Mycobacterium bovis subsp bovis AF2122/97
gccuggggcagccgg

SEQ ID NO: 1085689 - RNA, 22 nt, Mycobacterium bovis subsp bovis AF2122/97
gccuggggcagccgggcgucgc

SEQ ID NO: 1085690 - RNA, 18 nt, Mycobacterium bovis subsp bovis AF2122/97
gccuggggguucuggccg

SEQ ID NO: 1085691 - RNA, 15 nt, Mycobacterium bovis subsp bovis AF2122/97
gccuggguugaccgc

SEQ ID NO: 1085692 - RNA, 16 nt, Mycobacterium bovis subsp bovis AF2122/97
gccuggguugaccgcc

SEQ ID NO: 1085693 - RNA, 22 nt, Mycobacterium bovis subsp bovis AF2122/97
gccugggcggccagcacgucgu

SEQ ID NO: 1085694 - RNA, 17 nt, Mycobacterium bovis subsp bovis AF2122/97
gccugguaccgcggugu

SEQ ID NO: 1085695 - RNA, 15 nt, Mycobacterium bovis subsp bovis AF2122/97
gccuggcgagccagc

SEQ ID NO: 1085696 - RNA, 17 nt, Mycobacterium bovis subsp bovis AF2122/97
gccuggccgggaccgcc

SEQ ID NO: 1085697 - RNA, 18 nt, Mycobacterium bovis subsp bovis AF2122/97
gccuggccgggaccgccc

SEQ ID NO: 1085698 - RNA, 14 nt, Mycobacterium bovis subsp bovis AF2122/97
gccugggacggcgg

SEQ ID NO: 1085699 - RNA, 15 nt, Mycobacterium bovis subsp bovis AF2122/97
gccugggacggcggc

SEQ ID NO: 1085700 - RNA, 16 nt, Mycobacterium bovis subsp bovis AF2122/97
gccuggcggcgccgca

SEQ ID NO: 1085701 - RNA, 23 nt, Mycobacterium bovis subsp bovis AF2122/97
gccuggcaggguggggcgguggc

SEQ ID NO: 1085702 - RNA, 16 nt, Mycobacterium bovis subsp bovis AF2122/97
gccuggcccacgccgc

SEQ ID NO: 1085703 - RNA, 12 nt, Mycobacterium bovis subsp bovis AF2122/97
gccuggccgcca

SEQ ID NO: 1085704 - RNA, 22 nt, Mycobacterium bovis subsp bovis AF2122/97
gccuggccgccagauuggcgcu

SEQ ID NO: 1085705 - RNA, 18 nt, Mycobacterium bovis subsp bovis AF2122/97
gccuggccccggcugucg

SEQ ID NO: 1085706 - RNA, 18 nt, Mycobacterium bovis subsp bovis AF2122/97
gccuggaucagcgcguug

SEQ ID NO: 1085707 - RNA, 16 nt, Mycobacterium bovis subsp bovis AF2122/97
gccuggaaucgcggag

SEQ ID NO: 1085708 - RNA, 21 nt, Mycobacterium bovis subsp bovis AF2122/97
gccugcucgaccaugccgucg

SEQ ID NO: 1085709 - RNA, 15 nt, Mycobacterium bovis subsp bovis AF2122/97
gccugcucgucggcc

SEQ ID NO: 1085710 - RNA, 16 nt, Mycobacterium bovis subsp bovis AF2122/97
gccugcuggccgcggc

SEQ ID NO: 1085711 - RNA, 17 nt, Mycobacterium bovis subsp bovis AF2122/97
gccugcuggccgcggcc

SEQ ID NO: 1085712 - RNA, 19 nt, Mycobacterium bovis subsp bovis AF2122/97
gccugcugguaccgggcuc

SEQ ID NO: 1085713 - RNA, 16 nt, Mycobacterium bovis subsp bovis AF2122/97
gccugcuggucgguga

SEQ ID NO: 1085714 - RNA, 17 nt, Mycobacterium bovis subsp bovis AF2122/97
gccuggaagacggugcg

SEQ ID NO: 1085715 - RNA, 22 nt, Mycobacterium bovis subsp bovis AF2122/97
gccuggaagaucacgcgucgug

SEQ ID NO: 1085716 - RNA, 18 nt, Mycobacterium bovis subsp bovis AF2122/97
gccugcuugucaacccgg

SEQ ID NO: 1085717 - RNA, 16 nt, Mycobacterium bovis subsp bovis AF2122/97
gccugcgccgacccgc

SEQ ID NO: 1085718 - RNA, 13 nt, Mycobacterium bovis subsp bovis AF2122/97
gccugcgcccagc

SEQ ID NO: 1085719 - RNA, 19 nt, Mycobacterium bovis subsp bovis AF2122/97
gccugcgccacccgcggug

SEQ ID NO: 1085720 - RNA, 16 nt, Mycobacterium bovis subsp bovis AF2122/97
gccugcgccgcccgcg

SEQ ID NO: 1085721 - RNA, 18 nt, Mycobacterium bovis subsp bovis AF2122/97
gccugcgccgcccgcgcc

SEQ ID NO: 1085722 - RNA, 14 nt, Mycobacterium bovis subsp bovis AF2122/97
gccugcgcgaugcg

SEQ ID NO: 1085723 - RNA, 13 nt, Mycobacterium bovis subsp bovis AF2122/97
gccugcgccgcgc

SEQ ID NO: 1085724 - RNA, 17 nt, Mycobacterium bovis subsp bovis AF2122/97
gccugcgccuuggucgc

SEQ ID NO: 1085725 - RNA, 23 nt, Mycobacterium bovis subsp bovis AF2122/97
gccugcgccuuggucgccggcgu

SEQ ID NO: 1085726 - RNA, 15 nt, Mycobacterium bovis subsp bovis AF2122/97
gccugcgcgauccgc

SEQ ID NO: 1085727 - RNA, 22 nt, Mycobacterium bovis subsp bovis AF2122/97
gccugcggcaacggcucgucga

SEQ ID NO: 1085728 - RNA, 16 nt, Mycobacterium bovis subsp bovis AF2122/97
gccugcggcaccggcu

SEQ ID NO: 1085729 - RNA, 14 nt, Mycobacterium bovis subsp bovis AF2122/97
gccugcggcggcgu

SEQ ID NO: 1085730 - RNA, 15 nt, Mycobacterium bovis subsp bovis AF2122/97
gccugcggcggucau

SEQ ID NO: 1085731 - RNA, 21 nt, Mycobacterium bovis subsp bovis AF2122/97
gccugcgggaacgcggcggcg

SEQ ID NO: 1085732 - RNA, 22 nt, Mycobacterium bovis subsp bovis AF2122/97
gccugcgggccggcaucgucgg

SEQ ID NO: 1085733 - RNA, 15 nt, Mycobacterium bovis subsp bovis AF2122/97
gccugcgucucgaug

SEQ ID NO: 1085734 - RNA, 15 nt, Mycobacterium bovis subsp bovis AF2122/97
gccugcggucagggc

SEQ ID NO: 1085735 - RNA, 20 nt, Mycobacterium bovis subsp bovis AF2122/97
gccugcgggggacacgucgu

SEQ ID NO: 1085736 - RNA, 15 nt, Mycobacterium bovis subsp bovis AF2122/97
gccugcgggccggca

SEQ ID NO: 1085737 - RNA, 18 nt, Mycobacterium bovis subsp bovis AF2122/97
gccugcuccucggccagc

SEQ ID NO: 1085738 - RNA, 19 nt, Mycobacterium bovis subsp bovis AF2122/97
gccugcuccucggccagcg

SEQ ID NO: 1085739 - RNA, 17 nt, Mycobacterium bovis subsp bovis AF2122/97
gccugcuccaccgucga

SEQ ID NO: 1085740 - RNA, 16 nt, Mycobacterium bovis subsp bovis AF2122/97
gccugcgucucgauga

SEQ ID NO: 1085741 - RNA, 15 nt, Mycobacterium bovis subsp bovis AF2122/97
gccugcccggcccgc

SEQ ID NO: 1085742 - RNA, 20 nt, Mycobacterium bovis subsp bovis AF2122/97
gccugcccggcccgcucagc

SEQ ID NO: 1085743 - RNA, 16 nt, Mycobacterium bovis subsp bovis AF2122/97
gccugccccacccgcg

SEQ ID NO: 1085744 - RNA, 19 nt, Mycobacterium bovis subsp bovis AF2122/97
gccugccccacccgcggcg

SEQ ID NO: 1085745 - RNA, 21 nt, Mycobacterium bovis subsp bovis AF2122/97
gccugcccccgcgcgcacggc

SEQ ID NO: 1085746 - RNA, 15 nt, Mycobacterium bovis subsp bovis AF2122/97
gccugcccccggcgc

SEQ ID NO: 1085747 - RNA, 16 nt, Mycobacterium bovis subsp bovis AF2122/97
gccugcccccggcgcg

SEQ ID NO: 1085748 - RNA, 18 nt, Mycobacterium bovis subsp bovis AF2122/97
gccugcccccggcgcggc

SEQ ID NO: 1085749 - RNA, 17 nt, Mycobacterium bovis subsp bovis AF2122/97
gccugccgaaacgccga

SEQ ID NO: 1085750 - RNA, 17 nt, Mycobacterium bovis subsp bovis AF2122/97
gccugccgacggcauca

SEQ ID NO: 1085751 - RNA, 18 nt, Mycobacterium bovis subsp bovis AF2122/97
gccugccgcucgccggua

SEQ ID NO: 1085752 - RNA, 19 nt, Mycobacterium bovis subsp bovis AF2122/97
gccugccgcuggucgucga

SEQ ID NO: 1085753 - RNA, 20 nt, Mycobacterium bovis subsp bovis AF2122/97
gccugccgaugacgauggcc

SEQ ID NO: 1085754 - RNA, 18 nt, Mycobacterium bovis subsp bovis AF2122/97
gccugccgcacguucggc

SEQ ID NO: 1085755 - RNA, 20 nt, Mycobacterium bovis subsp bovis AF2122/97
gccugccgcacguucggcga

SEQ ID NO: 1085756 - RNA, 16 nt, Mycobacterium bovis subsp bovis AF2122/97
gccugcgcagacucga

SEQ ID NO: 1085757 - RNA, 15 nt, Mycobacterium bovis subsp bovis AF2122/97
gccugcgcacgaccc

SEQ ID NO: 1085758 - RNA, 16 nt, Mycobacterium bovis subsp bovis AF2122/97
gccugcgacagcacgu

SEQ ID NO: 1085759 - RNA, 19 nt, Mycobacterium bovis subsp bovis AF2122/97
gccugcgacagcacgugcc

SEQ ID NO: 1085760 - RNA, 18 nt, Mycobacterium bovis subsp bovis AF2122/97
gccugcgacgagcccacc

SEQ ID NO: 1085761 - RNA, 17 nt, Mycobacterium bovis subsp bovis AF2122/97
gccugccucaccgccgc

SEQ ID NO: 1085762 - RNA, 17 nt, Mycobacterium bovis subsp bovis AF2122/97
gccugcgaaacgcuggc

SEQ ID NO: 1085763 - RNA, 18 nt, Mycobacterium bovis subsp bovis AF2122/97
gccugcgaaacgcuggcc

SEQ ID NO: 1085764 - RNA, 18 nt, Mycobacterium bovis subsp bovis AF2122/97
gccugcgaacacgcgaug

SEQ ID NO: 1085765 - RNA, 15 nt, Mycobacterium bovis subsp bovis AF2122/97
gccugauuguugagc

SEQ ID NO: 1085766 - RNA, 19 nt, Mycobacterium bovis subsp bovis AF2122/97
gccugcaagcuaagcgccu

SEQ ID NO: 1085767 - RNA, 14 nt, Mycobacterium bovis subsp bovis AF2122/97
gccugccaccggcg

SEQ ID NO: 1085768 - RNA, 22 nt, Mycobacterium bovis subsp bovis AF2122/97
gccugcaagacaaagccgucga

SEQ ID NO: 1085769 - RNA, 18 nt, Mycobacterium bovis subsp bovis AF2122/97
gccugcccaccuucgagu

SEQ ID NO: 1085770 - RNA, 17 nt, Mycobacterium bovis subsp bovis AF2122/97
gccugcccagcaccacc

SEQ ID NO: 1085771 - RNA, 22 nt, Mycobacterium bovis subsp bovis AF2122/97
gccugcccaccuucgaguuugg

SEQ ID NO: 1085772 - RNA, 13 nt, Mycobacterium bovis subsp bovis AF2122/97
gccugcccaccuu

SEQ ID NO: 1085773 - RNA, 17 nt, Mycobacterium bovis subsp bovis AF2122/97
gccugccaguccugaug

SEQ ID NO: 1085774 - RNA, 15 nt, Mycobacterium bovis subsp bovis AF2122/97
gccucggcgaugggc

SEQ ID NO: 1085775 - RNA, 12 nt, Mycobacterium bovis subsp bovis AF2122/97
gccucggcgaug

SEQ ID NO: 1085776 - RNA, 15 nt, Mycobacterium bovis subsp bovis AF2122/97
gccucggcgauaccg

SEQ ID NO: 1085777 - RNA, 12 nt, Mycobacterium bovis subsp bovis AF2122/97
gccucggcgacc

SEQ ID NO: 1085778 - RNA, 14 nt, Mycobacterium bovis subsp bovis AF2122/97
gccucggcgaccau

SEQ ID NO: 1085779 - RNA, 18 nt, Mycobacterium bovis subsp bovis AF2122/97
gccucggcgaccaucuga

SEQ ID NO: 1085780 - RNA, 13 nt, Mycobacterium bovis subsp bovis AF2122/97
gccucggcgcugc

SEQ ID NO: 1085781 - RNA, 15 nt, Mycobacterium bovis subsp bovis AF2122/97
gccucggcggccagc

SEQ ID NO: 1085782 - RNA, 21 nt, Mycobacterium bovis subsp bovis AF2122/97
gccucggcggccagcucggcc

SEQ ID NO: 1085783 - RNA, 15 nt, Mycobacterium bovis subsp bovis AF2122/97
gccucggcguaggcg

SEQ ID NO: 1085784 - RNA, 13 nt, Mycobacterium bovis subsp bovis AF2122/97
gccucggcggcgc

SEQ ID NO: 1085785 - RNA, 13 nt, Mycobacterium bovis subsp bovis AF2122/97
gccucggcggcgu

SEQ ID NO: 1085786 - RNA, 15 nt, Mycobacterium bovis subsp bovis AF2122/97
gccucgggaggcagc

SEQ ID NO: 1085787 - RNA, 23 nt, Mycobacterium bovis subsp bovis AF2122/97
gccucgggaggcagcgcgaggcu

SEQ ID NO: 1085788 - RNA, 18 nt, Mycobacterium bovis subsp bovis AF2122/97
gccugaccggcucgccgg

SEQ ID NO: 1085789 - RNA, 19 nt, Mycobacterium bovis subsp bovis AF2122/97
gccugaccggcucgccggc

SEQ ID NO: 1085790 - RNA, 20 nt, Mycobacterium bovis subsp bovis AF2122/97
gccugaccggcucgccggcg

SEQ ID NO: 1085791 - RNA, 16 nt, Mycobacterium bovis subsp bovis AF2122/97
gccugaccggucaccc

SEQ ID NO: 1085792 - RNA, 17 nt, Mycobacterium bovis subsp bovis AF2122/97
gccugacucaucaccga

SEQ ID NO: 1085793 - RNA, 14 nt, Mycobacterium bovis subsp bovis AF2122/97
gccucgggccggcg

SEQ ID NO: 1085794 - RNA, 15 nt, Mycobacterium bovis subsp bovis AF2122/97
gccugaccgccaccg

SEQ ID NO: 1085795 - RNA, 18 nt, Mycobacterium bovis subsp bovis AF2122/97
gccugaccgccaccguca

SEQ ID NO: 1085796 - RNA, 15 nt, Mycobacterium bovis subsp bovis AF2122/97
gccugaccggcucgc

SEQ ID NO: 1085797 - RNA, 16 nt, Mycobacterium bovis subsp bovis AF2122/97
gccugaccggcucgcc

SEQ ID NO: 1085798 - RNA, 17 nt, Mycobacterium bovis subsp bovis AF2122/97
gccugaccggcucgccg

SEQ ID NO: 1085799 - RNA, 21 nt, Mycobacterium bovis subsp bovis AF2122/97
gccucggacaaagccgucgcg

SEQ ID NO: 1085800 - RNA, 17 nt, Mycobacterium bovis subsp bovis AF2122/97
gccucggacacggcagc

SEQ ID NO: 1085801 - RNA, 15 nt, Mycobacterium bovis subsp bovis AF2122/97
gccucggaccagacc

SEQ ID NO: 1085802 - RNA, 19 nt, Mycobacterium bovis subsp bovis AF2122/97
gccucgcugggcucauggc

SEQ ID NO: 1085803 - RNA, 20 nt, Mycobacterium bovis subsp bovis AF2122/97
gccucggacaaagccgucgc

SEQ ID NO: 1085804 - RNA, 18 nt, Mycobacterium bovis subsp bovis AF2122/97
gccucggccagcgucagc

SEQ ID NO: 1085805 - RNA, 19 nt, Mycobacterium bovis subsp bovis AF2122/97
gccucgcggggucugucga

SEQ ID NO: 1085806 - RNA, 15 nt, Mycobacterium bovis subsp bovis AF2122/97
gccucgaccgccagc

SEQ ID NO: 1085807 - RNA, 15 nt, Mycobacterium bovis subsp bovis AF2122/97
gccucgacacccagc

SEQ ID NO: 1085808 - RNA, 22 nt, Mycobacterium bovis subsp bovis AF2122/97
gccucgacacccagccgcagcc

SEQ ID NO: 1085809 - RNA, 18 nt, Mycobacterium bovis subsp bovis AF2122/97
gccucgacagcggcaauc

SEQ ID NO: 1085810 - RNA, 21 nt, Mycobacterium bovis subsp bovis AF2122/97
gccucgaccgccagcccggug

SEQ ID NO: 1085811 - RNA, 12 nt, Mycobacterium bovis subsp bovis AF2122/97
gccucgaccgcg

SEQ ID NO: 1085812 - RNA, 21 nt, Mycobacterium bovis subsp bovis AF2122/97
gccucgaccucuucgggguag

SEQ ID NO: 1085813 - RNA, 22 nt, Mycobacterium bovis subsp bovis AF2122/97
gccucgagguauucgcgcagca

SEQ ID NO: 1085814 - RNA, 15 nt, Mycobacterium bovis subsp bovis AF2122/97
gccucgagacggucg

SEQ ID NO: 1085815 - RNA, 15 nt, Mycobacterium bovis subsp bovis AF2122/97
gccucgaggaccacc

SEQ ID NO: 1085816 - RNA, 15 nt, Mycobacterium bovis subsp bovis AF2122/97
gccucgaucagcgcc

SEQ ID NO: 1085817 - RNA, 18 nt, Mycobacterium bovis subsp bovis AF2122/97
gccucgaucagcgccgga

SEQ ID NO: 1085818 - RNA, 23 nt, Mycobacterium bovis subsp bovis AF2122/97
gccucgauccgcaucaugucgaa

SEQ ID NO: 1085819 - RNA, 23 nt, Mycobacterium bovis subsp bovis AF2122/97
gccguuggcggcgguggccagcg

SEQ ID NO: 1085820 - RNA, 23 nt, Mycobacterium bovis subsp bovis AF2122/97
gccguuggcaaugaccccggcgu

SEQ ID NO: 1085821 - RNA, 23 nt, Mycobacterium bovis subsp bovis AF2122/97
gccguugggcaccguguagcugc

SEQ ID NO: 1085822 - RNA, 20 nt, Mycobacterium bovis subsp bovis AF2122/97
gccguuggccggaucgaaga

SEQ ID NO: 1085823 - RNA, 14 nt, Mycobacterium bovis subsp bovis AF2122/97
gccguuggagccgc

SEQ ID NO: 1085824 - RNA, 23 nt, Mycobacterium bovis subsp bovis AF2122/97
gccguugcgucugcucggcguac

SEQ ID NO: 1085825 - RNA, 20 nt, Mycobacterium bovis subsp bovis AF2122/97
gccguugcuauucgccagcg

SEQ ID NO: 1085826 - RNA, 19 nt, Mycobacterium bovis subsp bovis AF2122/97
gccuaccgugcuggcacca

SEQ ID NO: 1085827 - RNA, 12 nt, Mycobacterium bovis subsp bovis AF2122/97
gccuaccgggcc

SEQ ID NO: 1085828 - RNA, 21 nt, Mycobacterium bovis subsp bovis AF2122/97
aagccacgccggucgcgguca

SEQ ID NO: 1085829 - RNA, 21 nt, Mycobacterium bovis subsp bovis AF2122/97
aagccagcaccuagucgcggc

SEQ ID NO: 1085830 - RNA, 14 nt, Mycobacterium bovis subsp bovis AF2122/97
gccuaccaggcgcg

SEQ ID NO: 1085831 - RNA, 16 nt, Mycobacterium bovis subsp bovis AF2122/97
gccuaccaggcgcggc

SEQ ID NO: 1085832 - RNA, 22 nt, Mycobacterium bovis subsp bovis AF2122/97
aagcccaccgucugcuggccgg

SEQ ID NO: 1085833 - RNA, 14 nt, Mycobacterium bovis subsp bovis AF2122/97
aagccaggcggcaa

SEQ ID NO: 1085834 - RNA, 17 nt, Mycobacterium bovis subsp bovis AF2122/97
gccgcuucggcggucag

SEQ ID NO: 1085835 - RNA, 16 nt, Mycobacterium bovis subsp bovis AF2122/97
gccgcugugauagcgc

SEQ ID NO: 1085836 - RNA, 22 nt, Mycobacterium bovis subsp bovis AF2122/97
gccgcugugauagcgccguaca

SEQ ID NO: 1085837 - RNA, 18 nt, Mycobacterium bovis subsp bovis AF2122/97
gccgcugugggcgagucg

SEQ ID NO: 1085838 - RNA, 20 nt, Mycobacterium bovis subsp bovis AF2122/97
gccgcugugggcgagucggg

SEQ ID NO: 1085839 - RNA, 23 nt, Mycobacterium bovis subsp bovis AF2122/97
gccgcuucaccccacuggcacac

SEQ ID NO: 1085840 - RNA, 17 nt, Mycobacterium bovis subsp bovis AF2122/97
gccgcuggcaaucccgc

SEQ ID NO: 1085841 - RNA, 17 nt, Mycobacterium bovis subsp bovis AF2122/97
gccgcuggucgucgagu

SEQ ID NO: 1085842 - RNA, 21 nt, Mycobacterium bovis subsp bovis AF2122/97
gccgcugguggcgccaucccc

SEQ ID NO: 1085843 - RNA, 14 nt, Mycobacterium bovis subsp bovis AF2122/97
gccgcugggugacc

SEQ ID NO: 1085844 - RNA, 18 nt, Mycobacterium bovis subsp bovis AF2122/97
gccgcugggugaccagga

SEQ ID NO: 1085845 - RNA, 15 nt, Mycobacterium bovis subsp bovis AF2122/97
gccgcugcggcaccg

SEQ ID NO: 1085846 - RNA, 20 nt, Mycobacterium bovis subsp bovis AF2122/97
gccgcuggagaucacgccga

SEQ ID NO: 1085847 - RNA, 18 nt, Mycobacterium bovis subsp bovis AF2122/97
gccgcuggaggcggcgcc

SEQ ID NO: 1085848 - RNA, 20 nt, Mycobacterium bovis subsp bovis AF2122/97
gccgcugccgaagcggccac

SEQ ID NO: 1085849 - RNA, 14 nt, Mycobacterium bovis subsp bovis AF2122/97
gccgcugccgccga

SEQ ID NO: 1085850 - RNA, 22 nt, Mycobacterium bovis subsp bovis AF2122/97
gccgcugccgccgagcuggcgc

SEQ ID NO: 1085851 - RNA, 23 nt, Mycobacterium bovis subsp bovis AF2122/97
gccgcugccgccgagcuggcgcg

SEQ ID NO: 1085852 - RNA, 15 nt, Mycobacterium bovis subsp bovis AF2122/97
gccgcugccgguguc

SEQ ID NO: 1085853 - RNA, 12 nt, Mycobacterium bovis subsp bovis AF2122/97
gccgcugcgccg

SEQ ID NO: 1085854 - RNA, 15 nt, Mycobacterium bovis subsp bovis AF2122/97
gccgcugccgccggu

SEQ ID NO: 1085855 - RNA, 22 nt, Mycobacterium bovis subsp bovis AF2122/97
gccgcugccuuggcgcggcacc

SEQ ID NO: 1085856 - RNA, 23 nt, Mycobacterium bovis subsp bovis AF2122/97
gccgcugccuuggcgcggcaccc

SEQ ID NO: 1085857 - RNA, 13 nt, Mycobacterium bovis subsp bovis AF2122/97
gccgccgcgacgg

SEQ ID NO: 1085858 - RNA, 17 nt, Mycobacterium bovis subsp bovis AF2122/97
gccgccgcgacggcacg

SEQ ID NO: 1085859 - RNA, 17 nt, Mycobacterium bovis subsp bovis AF2122/97
gccgccgcgagcgccgg

SEQ ID NO: 1085860 - RNA, 21 nt, Mycobacterium bovis subsp bovis AF2122/97
gccgccgcgagcgccggccgc

SEQ ID NO: 1085861 - RNA, 14 nt, Mycobacterium bovis subsp bovis AF2122/97
gccgccgcgauggc

SEQ ID NO: 1085862 - RNA, 15 nt, Mycobacterium bovis subsp bovis AF2122/97
gccgccgacgccgcc

SEQ ID NO: 1085863 - RNA, 12 nt, Mycobacterium bovis subsp bovis AF2122/97
gccgccgcgacg

SEQ ID NO: 1085864 - RNA, 13 nt, Mycobacterium bovis subsp bovis AF2122/97
gccgccgcgcacc

SEQ ID NO: 1085865 - RNA, 14 nt, Mycobacterium bovis subsp bovis AF2122/97
gccgccgcgccccg

SEQ ID NO: 1085866 - RNA, 14 nt, Mycobacterium bovis subsp bovis AF2122/97
gccgcugcauccgc

SEQ ID NO: 1085867 - RNA, 12 nt, Mycobacterium bovis subsp bovis AF2122/97
gccgcugcaucc

SEQ ID NO: 1085868 - RNA, 17 nt, Mycobacterium bovis subsp bovis AF2122/97
gccgcugcauccgcagc

SEQ ID NO: 1085869 - RNA, 15 nt, Mycobacterium bovis subsp bovis AF2122/97
gccgcugccagccgu

SEQ ID NO: 1085870 - RNA, 20 nt, Mycobacterium bovis subsp bovis AF2122/97
gccgcugccaugcggguguc

SEQ ID NO: 1085871 - RNA, 13 nt, Mycobacterium bovis subsp bovis AF2122/97
gccgccgcgccgg

SEQ ID NO: 1085872 - RNA, 14 nt, Mycobacterium bovis subsp bovis AF2122/97
gccggaaacgccag

SEQ ID NO: 1085873 - RNA, 20 nt, Mycobacterium bovis subsp bovis AF2122/97
gccgcuuuuggcguaguucc

SEQ ID NO: 1085874 - RNA, 17 nt, Mycobacterium bovis subsp bovis AF2122/97
gccgcuuugcgcgguca

SEQ ID NO: 1085875 - RNA, 14 nt, Mycobacterium bovis subsp bovis AF2122/97
gccggaacgcccgg

SEQ ID NO: 1085876 - RNA, 15 nt, Mycobacterium bovis subsp bovis AF2122/97
gccgcuuggcccggc

SEQ ID NO: 1085877 - RNA, 13 nt, Mycobacterium bovis subsp bovis AF2122/97
gccgcuuggccgc

SEQ ID NO: 1085878 - RNA, 15 nt, Mycobacterium bovis subsp bovis AF2122/97
gccgcuugacgcagc

SEQ ID NO: 1085879 - RNA, 18 nt, Mycobacterium bovis subsp bovis AF2122/97
gccgcuugacgcagcucg

SEQ ID NO: 1085880 - RNA, 19 nt, Mycobacterium bovis subsp bovis AF2122/97
gccgcuuucccggcugggg

SEQ ID NO: 1085881 - RNA, 17 nt, Mycobacterium bovis subsp bovis AF2122/97
gccgcuuucgccggcgc

SEQ ID NO: 1085882 - RNA, 20 nt, Mycobacterium bovis subsp bovis AF2122/97
gccggaauacaccagcgacg

SEQ ID NO: 1085883 - RNA, 17 nt, Mycobacterium bovis subsp bovis AF2122/97
gccggaagauccgggcc

SEQ ID NO: 1085884 - RNA, 20 nt, Mycobacterium bovis subsp bovis AF2122/97
gccggacagcucgcgcucgc

SEQ ID NO: 1085885 - RNA, 18 nt, Mycobacterium bovis subsp bovis AF2122/97
gccggaauacccgcuggc

SEQ ID NO: 1085886 - RNA, 24 nt, Mycobacterium bovis subsp bovis AF2122/97
gccggacaggcuugacugcacacc

SEQ ID NO: 1085887 - RNA, 17 nt, Mycobacterium bovis subsp bovis AF2122/97
gccggacaaccuggggc

SEQ ID NO: 1085888 - RNA, 23 nt, Mycobacterium bovis subsp bovis AF2122/97
gccggaggcuugcaacaccccga

SEQ ID NO: 1085889 - RNA, 15 nt, Mycobacterium bovis subsp bovis AF2122/97
gccggaggcggcgcu

SEQ ID NO: 1085890 - RNA, 18 nt, Mycobacterium bovis subsp bovis AF2122/97
gccggaggcaagcaaccg

SEQ ID NO: 1085891 - RNA, 23 nt, Mycobacterium bovis subsp bovis AF2122/97
gccggaggcaagcaaccggugcg

SEQ ID NO: 1085892 - RNA, 14 nt, Mycobacterium bovis subsp bovis AF2122/97
gccggagccgccgg

SEQ ID NO: 1085893 - RNA, 15 nt, Mycobacterium bovis subsp bovis AF2122/97
gccggagccgccggc

SEQ ID NO: 1085894 - RNA, 15 nt, Mycobacterium bovis subsp bovis AF2122/97
gccggagccggugcc

SEQ ID NO: 1085895 - RNA, 20 nt, Mycobacterium bovis subsp bovis AF2122/97
gccggagaaguucgugagcg

SEQ ID NO: 1085896 - RNA, 15 nt, Mycobacterium bovis subsp bovis AF2122/97
gccggagacacccgc

SEQ ID NO: 1085897 - RNA, 16 nt, Mycobacterium bovis subsp bovis AF2122/97
gccggagacacccgcc

SEQ ID NO: 1085898 - RNA, 17 nt, Mycobacterium bovis subsp bovis AF2122/97
gccggagaucgucgcgu

SEQ ID NO: 1085899 - RNA, 19 nt, Mycobacterium bovis subsp bovis AF2122/97
gccggagaguaggaccucg

SEQ ID NO: 1085900 - RNA, 18 nt, Mycobacterium bovis subsp bovis AF2122/97
gccggagacgucgccgca

SEQ ID NO: 1085901 - RNA, 19 nt, Mycobacterium bovis subsp bovis AF2122/97
gccggagacgucgccgcag

SEQ ID NO: 1085902 - RNA, 16 nt, Mycobacterium bovis subsp bovis AF2122/97
gccggacccaccguca

SEQ ID NO: 1085903 - RNA, 19 nt, Mycobacterium bovis subsp bovis AF2122/97
gccggacccaccgucaccc

SEQ ID NO: 1085904 - RNA, 21 nt, Mycobacterium bovis subsp bovis AF2122/97
gccggacccaccgucaccccc

SEQ ID NO: 1085905 - RNA, 22 nt, Mycobacterium bovis subsp bovis AF2122/97
gccggacccaccgucacccccg

SEQ ID NO: 1085906 - RNA, 12 nt, Mycobacterium bovis subsp bovis AF2122/97
gccggacccggu

SEQ ID NO: 1085907 - RNA, 17 nt, Mycobacterium bovis subsp bovis AF2122/97
gccggacccggucgccg

SEQ ID NO: 1085908 - RNA, 23 nt, Mycobacterium bovis subsp bovis AF2122/97
gccggacccgcccuugccgccga

SEQ ID NO: 1085909 - RNA, 20 nt, Mycobacterium bovis subsp bovis AF2122/97
gccggacccgccggguccgc

SEQ ID NO: 1085910 - RNA, 14 nt, Mycobacterium bovis subsp bovis AF2122/97
gccggacccgucga

SEQ ID NO: 1085911 - RNA, 20 nt, Mycobacterium bovis subsp bovis AF2122/97
gccggaccgcgacggcgccg

SEQ ID NO: 1085912 - RNA, 17 nt, Mycobacterium bovis subsp bovis AF2122/97
gccggaccgcgacggcg

SEQ ID NO: 1085913 - RNA, 16 nt, Mycobacterium bovis subsp bovis AF2122/97
gccggacccgucgagc

SEQ ID NO: 1085914 - RNA, 20 nt, Mycobacterium bovis subsp bovis AF2122/97
gccggacgacaacaggccgu

SEQ ID NO: 1085915 - RNA, 16 nt, Mycobacterium bovis subsp bovis AF2122/97
gccggacuaccgccgg

SEQ ID NO: 1085916 - RNA, 17 nt, Mycobacterium bovis subsp bovis AF2122/97
gccggacuaccgccggc

SEQ ID NO: 1085917 - RNA, 18 nt, Mycobacterium bovis subsp bovis AF2122/97
gccggacuaccgccggcg

SEQ ID NO: 1085918 - RNA, 13 nt, Mycobacterium bovis subsp bovis AF2122/97
gccggcacgcagc

SEQ ID NO: 1085919 - RNA, 22 nt, Mycobacterium bovis subsp bovis AF2122/97
gccggcaccgccagugcccgca

SEQ ID NO: 1085920 - RNA, 14 nt, Mycobacterium bovis subsp bovis AF2122/97
gccggcaccgccgc

SEQ ID NO: 1085921 - RNA, 15 nt, Mycobacterium bovis subsp bovis AF2122/97
gccggcaccgccggc

SEQ ID NO: 1085922 - RNA, 19 nt, Mycobacterium bovis subsp bovis AF2122/97
gccggcaccgccggcgcca

SEQ ID NO: 1085923 - RNA, 20 nt, Mycobacterium bovis subsp bovis AF2122/97
gccggcaccgccggcgccac

SEQ ID NO: 1085924 - RNA, 21 nt, Mycobacterium bovis subsp bovis AF2122/97
gccggcaccgccggcgccacc

SEQ ID NO: 1085925 - RNA, 16 nt, Mycobacterium bovis subsp bovis AF2122/97
gccggcaccgccggug

SEQ ID NO: 1085926 - RNA, 17 nt, Mycobacterium bovis subsp bovis AF2122/97
gccggcaccgacgguag

SEQ ID NO: 1085927 - RNA, 14 nt, Mycobacterium bovis subsp bovis AF2122/97
gccggcaccgcagc

SEQ ID NO: 1085928 - RNA, 21 nt, Mycobacterium bovis subsp bovis AF2122/97
gccggcaccgccagugcccgc

SEQ ID NO: 1085929 - RNA, 18 nt, Mycobacterium bovis subsp bovis AF2122/97
gccggcaccgccgguggc

SEQ ID NO: 1085930 - RNA, 19 nt, Mycobacterium bovis subsp bovis AF2122/97
gccggcaccgccgguggcg

SEQ ID NO: 1085931 - RNA, 14 nt, Mycobacterium bovis subsp bovis AF2122/97
gccggcaccguaga

SEQ ID NO: 1085932 - RNA, 16 nt, Mycobacterium bovis subsp bovis AF2122/97
gccggcacugccgagc

SEQ ID NO: 1085933 - RNA, 17 nt, Mycobacterium bovis subsp bovis AF2122/97
gccggcacugccgagca

SEQ ID NO: 1085934 - RNA, 19 nt, Mycobacterium bovis subsp bovis AF2122/97
gccggcacugccgagcacg

SEQ ID NO: 1085935 - RNA, 14 nt, Mycobacterium bovis subsp bovis AF2122/97
gccggcacgggcgg

SEQ ID NO: 1085936 - RNA, 17 nt, Mycobacterium bovis subsp bovis AF2122/97
gccggcacgggcgggga

SEQ ID NO: 1085937 - RNA, 15 nt, Mycobacterium bovis subsp bovis AF2122/97
gccggcacggugaac

SEQ ID NO: 1085938 - RNA, 18 nt, Mycobacterium bovis subsp bovis AF2122/97
gccggcagcaucggcacc

SEQ ID NO: 1085939 - RNA, 22 nt, Mycobacterium bovis subsp bovis AF2122/97
gccggcagcaucggcaccccgg

SEQ ID NO: 1085940 - RNA, 13 nt, Mycobacterium bovis subsp bovis AF2122/97
gccggcagcagcg

SEQ ID NO: 1085941 - RNA, 14 nt, Mycobacterium bovis subsp bovis AF2122/97
gccggcagcgcccc

SEQ ID NO: 1085942 - RNA, 15 nt, Mycobacterium bovis subsp bovis AF2122/97
gccggcagcggcgcg

SEQ ID NO: 1085943 - RNA, 17 nt, Mycobacterium bovis subsp bovis AF2122/97
gccggcagcguccgaac

SEQ ID NO: 1085944 - RNA, 14 nt, Mycobacterium bovis subsp bovis AF2122/97
gccggcagcggcga

SEQ ID NO: 1085945 - RNA, 16 nt, Mycobacterium bovis subsp bovis AF2122/97
gccggcauacaccgug

SEQ ID NO: 1085946 - RNA, 20 nt, Mycobacterium bovis subsp bovis AF2122/97
gccggcauagaucgggucgu

SEQ ID NO: 1085947 - RNA, 16 nt, Mycobacterium bovis subsp bovis AF2122/97
gccggcauagcggccc

SEQ ID NO: 1085948 - RNA, 18 nt, Mycobacterium bovis subsp bovis AF2122/97
gccggcauagcggcccau

SEQ ID NO: 1085949 - RNA, 16 nt, Mycobacterium bovis subsp bovis AF2122/97
gccggcauaaaccgcg

SEQ ID NO: 1085950 - RNA, 19 nt, Mycobacterium bovis subsp bovis AF2122/97
gccggcagugagucgguga

SEQ ID NO: 1085951 - RNA, 20 nt, Mycobacterium bovis subsp bovis AF2122/97
gccggcaucggucagcgcgg

SEQ ID NO: 1085952 - RNA, 18 nt, Mycobacterium bovis subsp bovis AF2122/97
gccggcaucgcgcaaccg

SEQ ID NO: 1085953 - RNA, 19 nt, Mycobacterium bovis subsp bovis AF2122/97
gccggcaucgcgcaaccgg

SEQ ID NO: 1085954 - RNA, 14 nt, Mycobacterium bovis subsp bovis AF2122/97
gccggcaucgucga

SEQ ID NO: 1085955 - RNA, 17 nt, Mycobacterium bovis subsp bovis AF2122/97
gccggcaucgucgacgc

SEQ ID NO: 1085956 - RNA, 21 nt, Mycobacterium bovis subsp bovis AF2122/97
gccggcaucgucgacgcccga

SEQ ID NO: 1085957 - RNA, 15 nt, Mycobacterium bovis subsp bovis AF2122/97
gccggcaucuccacc

SEQ ID NO: 1085958 - RNA, 20 nt, Mycobacterium bovis subsp bovis AF2122/97
gccggcaucuccaccgucgc

SEQ ID NO: 1085959 - RNA, 22 nt, Mycobacterium bovis subsp bovis AF2122/97
gccggcauggcggcauagccga

SEQ ID NO: 1085960 - RNA, 21 nt, Mycobacterium bovis subsp bovis AF2122/97
gccggccaccaccgcgccguc

SEQ ID NO: 1085961 - RNA, 20 nt, Mycobacterium bovis subsp bovis AF2122/97
gccggccaauggccugcagc

SEQ ID NO: 1085962 - RNA, 12 nt, Mycobacterium bovis subsp bovis AF2122/97
gccggccaacug

SEQ ID NO: 1085963 - RNA, 20 nt, Mycobacterium bovis subsp bovis AF2122/97
gccggccaacugggccgagc

SEQ ID NO: 1085964 - RNA, 16 nt, Mycobacterium bovis subsp bovis AF2122/97
gccggccaccgucacc

SEQ ID NO: 1085965 - RNA, 14 nt, Mycobacterium bovis subsp bovis AF2122/97
gccggccaccucgg

SEQ ID NO: 1085966 - RNA, 23 nt, Mycobacterium bovis subsp bovis AF2122/97
gccggccaccagccgguccagca

SEQ ID NO: 1085967 - RNA, 16 nt, Mycobacterium bovis subsp bovis AF2122/97
gccggccacgaccucu

SEQ ID NO: 1085968 - RNA, 17 nt, Mycobacterium bovis subsp bovis AF2122/97
gccggccacgucgaugu

SEQ ID NO: 1085969 - RNA, 24 nt, Mycobacterium bovis subsp bovis AF2122/97
gccggccacuacggccuggccacc

SEQ ID NO: 1085970 - RNA, 15 nt, Mycobacterium bovis subsp bovis AF2122/97
gccggccacccgcgc

SEQ ID NO: 1085971 - RNA, 22 nt, Mycobacterium bovis subsp bovis AF2122/97
gccggccacccgcgcgaugcug

SEQ ID NO: 1085972 - RNA, 17 nt, Mycobacterium bovis subsp bovis AF2122/97
gccggccacgaccucuu

SEQ ID NO: 1085973 - RNA, 16 nt, Mycobacterium bovis subsp bovis AF2122/97
gccggccagccagcga

SEQ ID NO: 1085974 - RNA, 23 nt, Mycobacterium bovis subsp bovis AF2122/97
gccggccagccagcgauccagcg

SEQ ID NO: 1085975 - RNA, 15 nt, Mycobacterium bovis subsp bovis AF2122/97
gccggccagcgucgc

SEQ ID NO: 1085976 - RNA, 14 nt, Mycobacterium bovis subsp bovis AF2122/97
gccggccagcggcc

SEQ ID NO: 1085977 - RNA, 19 nt, Mycobacterium bovis subsp bovis AF2122/97
gccggaucaggaucgacag

SEQ ID NO: 1085978 - RNA, 14 nt, Mycobacterium bovis subsp bovis AF2122/97
gccggauaggucgg

SEQ ID NO: 1085979 - RNA, 19 nt, Mycobacterium bovis subsp bovis AF2122/97
gccggauaggucgggcaug

SEQ ID NO: 1085980 - RNA, 14 nt, Mycobacterium bovis subsp bovis AF2122/97
gccggauacgggcu

SEQ ID NO: 1085981 - RNA, 18 nt, Mycobacterium bovis subsp bovis AF2122/97
gccggauacgggcugacg

SEQ ID NO: 1085982 - RNA, 16 nt, Mycobacterium bovis subsp bovis AF2122/97
gccggauagcaccggc

SEQ ID NO: 1085983 - RNA, 19 nt, Mycobacterium bovis subsp bovis AF2122/97
gccggauagcaccggcacc

SEQ ID NO: 1085984 - RNA, 15 nt, Mycobacterium bovis subsp bovis AF2122/97
gccggauagcgcagc

SEQ ID NO: 1085985 - RNA, 21 nt, Mycobacterium bovis subsp bovis AF2122/97
gccggaguugucgacggccac

SEQ ID NO: 1085986 - RNA, 23 nt, Mycobacterium bovis subsp bovis AF2122/97
gccggaguugucgacggccaccc

SEQ ID NO: 1085987 - RNA, 22 nt, Mycobacterium bovis subsp bovis AF2122/97
gccggagucgacccugcccagc

SEQ ID NO: 1085988 - RNA, 14 nt, Mycobacterium bovis subsp bovis AF2122/97
gccggagucgacga

SEQ ID NO: 1085989 - RNA, 20 nt, Mycobacterium bovis subsp bovis AF2122/97
gccggaguucugcgaucacg

SEQ ID NO: 1085990 - RNA, 19 nt, Mycobacterium bovis subsp bovis AF2122/97
gccggaguccgucggggac

SEQ ID NO: 1085991 - RNA, 17 nt, Mycobacterium bovis subsp bovis AF2122/97
gccggagucgaucagcu

SEQ ID NO: 1085992 - RNA, 17 nt, Mycobacterium bovis subsp bovis AF2122/97
gccggaucgacguucgg

SEQ ID NO: 1085993 - RNA, 16 nt, Mycobacterium bovis subsp bovis AF2122/97
gccggauccgauccgc

SEQ ID NO: 1085994 - RNA, 18 nt, Mycobacterium bovis subsp bovis AF2122/97
gccggaucgacguucggg

SEQ ID NO: 1085995 - RNA, 18 nt, Mycobacterium bovis subsp bovis AF2122/97
gccggaucgccggugaac

SEQ ID NO: 1085996 - RNA, 16 nt, Mycobacterium bovis subsp bovis AF2122/97
gccggaugacaccgac

SEQ ID NO: 1085997 - RNA, 14 nt, Mycobacterium bovis subsp bovis AF2122/97
gccggaugacgccc

SEQ ID NO: 1085998 - RNA, 19 nt, Mycobacterium bovis subsp bovis AF2122/97
gccggaugacgcccagggc

SEQ ID NO: 1085999 - RNA, 14 nt, Mycobacterium bovis subsp bovis AF2122/97
gccggaugagcgaa

SEQ ID NO: 1086000 - RNA, 16 nt, Mycobacterium bovis subsp bovis AF2122/97
gccggaugagcgaacg

SEQ ID NO: 1086001 - RNA, 16 nt, Mycobacterium bovis subsp bovis AF2122/97
gccggcaagaccgaac

SEQ ID NO: 1086002 - RNA, 15 nt, Mycobacterium bovis subsp bovis AF2122/97
gccggcaacggcgcg

SEQ ID NO: 1086003 - RNA, 23 nt, Mycobacterium bovis subsp bovis AF2122/97
gccggcaacggcgcgccgaccac

SEQ ID NO: 1086004 - RNA, 19 nt, Mycobacterium bovis subsp bovis AF2122/97
gccggcaaccgggaggcca

SEQ ID NO: 1086005 - RNA, 21 nt, Mycobacterium bovis subsp bovis AF2122/97
gccggcaaccgggaggccacc

SEQ ID NO: 1086006 - RNA, 13 nt, Mycobacterium bovis subsp bovis AF2122/97
gccggcaaccuga

SEQ ID NO: 1086007 - RNA, 21 nt, Mycobacterium bovis subsp bovis AF2122/97
gccggcaaccugaauccagac

SEQ ID NO: 1086008 - RNA, 21 nt, Mycobacterium bovis subsp bovis AF2122/97
gccggauucggcugccaccgc

SEQ ID NO: 1086009 - RNA, 19 nt, Mycobacterium bovis subsp bovis AF2122/97
gccggcaacauuggccugu

SEQ ID NO: 1086010 - RNA, 16 nt, Mycobacterium bovis subsp bovis AF2122/97
gccggcaagcagucgg

SEQ ID NO: 1086011 - RNA, 18 nt, Mycobacterium bovis subsp bovis AF2122/97
gccggcaagcggaauucc

SEQ ID NO: 1086012 - RNA, 14 nt, Mycobacterium bovis subsp bovis AF2122/97
gccggcaauaccgc

SEQ ID NO: 1086013 - RNA, 20 nt, Mycobacterium bovis subsp bovis AF2122/97
gccggcaauaccgccagcgc

SEQ ID NO: 1086014 - RNA, 23 nt, Mycobacterium bovis subsp bovis AF2122/97
gccggcaauaccgccagcgccac

SEQ ID NO: 1086015 - RNA, 16 nt, Mycobacterium bovis subsp bovis AF2122/97
gccggcaaccgacucg

SEQ ID NO: 1086016 - RNA, 22 nt, Mycobacterium bovis subsp bovis AF2122/97
gccggcaaggcauucgagcacg

SEQ ID NO: 1086017 - RNA, 15 nt, Mycobacterium bovis subsp bovis AF2122/97
gccggcaaugccgcg

SEQ ID NO: 1086018 - RNA, 18 nt, Mycobacterium bovis subsp bovis AF2122/97
gccggcaaugccgcggcc

SEQ ID NO: 1086019 - RNA, 20 nt, Mycobacterium bovis subsp bovis AF2122/97
gccggcaaugccgcggccag

SEQ ID NO: 1086020 - RNA, 18 nt, Mycobacterium bovis subsp bovis AF2122/97
gccggcacauugaucgac

SEQ ID NO: 1086021 - RNA, 14 nt, Mycobacterium bovis subsp bovis AF2122/97
gccggcacccgucg

SEQ ID NO: 1086022 - RNA, 13 nt, Mycobacterium bovis subsp bovis AF2122/97
gccggcaccgaca

SEQ ID NO: 1086023 - RNA, 17 nt, Mycobacterium bovis subsp bovis AF2122/97
gccggcacccaccagug

SEQ ID NO: 1086024 - RNA, 19 nt, Mycobacterium bovis subsp bovis AF2122/97
gccggcaccccacggccag

SEQ ID NO: 1086025 - RNA, 20 nt, Mycobacterium bovis subsp bovis AF2122/97
gccggcaccccacggccagu

SEQ ID NO: 1086026 - RNA, 23 nt, Mycobacterium bovis subsp bovis AF2122/97
gccggcacccgccgugcccccgg

SEQ ID NO: 1086027 - RNA, 21 nt, Mycobacterium bovis subsp bovis AF2122/97
gccggauuauucgcgguagcc

SEQ ID NO: 1086028 - RNA, 13 nt, Mycobacterium bovis subsp bovis AF2122/97
gccggauucgaug

SEQ ID NO: 1086029 - RNA, 19 nt, Mycobacterium bovis subsp bovis AF2122/97
gccggauucggcugccacc

SEQ ID NO: 1086030 - RNA, 23 nt, Mycobacterium bovis subsp bovis AF2122/97
gccggcaaaggacgucgaccugu

SEQ ID NO: 1086031 - RNA, 15 nt, Mycobacterium bovis subsp bovis AF2122/97
gccggaugucgacga

SEQ ID NO: 1086032 - RNA, 20 nt, Mycobacterium bovis subsp bovis AF2122/97
gccggaugucgacgagcacc

SEQ ID NO: 1086033 - RNA, 18 nt, Mycobacterium bovis subsp bovis AF2122/97
gccggauggguggccagc

SEQ ID NO: 1086034 - RNA, 19 nt, Mycobacterium bovis subsp bovis AF2122/97
gccggauggguggccagca

SEQ ID NO: 1086035 - RNA, 20 nt, Mycobacterium bovis subsp bovis AF2122/97
gccggauggguggccagcaa

SEQ ID NO: 1086036 - RNA, 13 nt, Mycobacterium bovis subsp bovis AF2122/97
gccggcgauggcc

SEQ ID NO: 1086037 - RNA, 20 nt, Mycobacterium bovis subsp bovis AF2122/97
gccggcgauggcccuuccgg

SEQ ID NO: 1086038 - RNA, 19 nt, Mycobacterium bovis subsp bovis AF2122/97
gccggcgauuaccggcacg

SEQ ID NO: 1086039 - RNA, 12 nt, Mycobacterium bovis subsp bovis AF2122/97
gccggcgcacca

SEQ ID NO: 1086040 - RNA, 13 nt, Mycobacterium bovis subsp bovis AF2122/97
gccggcgccaccc

SEQ ID NO: 1086041 - RNA, 23 nt, Mycobacterium bovis subsp bovis AF2122/97
gccggcgccacccccaccgucgc

SEQ ID NO: 1086042 - RNA, 18 nt, Mycobacterium bovis subsp bovis AF2122/97
gccggcgccaccgucacc

SEQ ID NO: 1086043 - RNA, 23 nt, Mycobacterium bovis subsp bovis AF2122/97
gccggcgccaccgucgccguaca

SEQ ID NO: 1086044 - RNA, 23 nt, Mycobacterium bovis subsp bovis AF2122/97
gccggcgauuaccggcacgccgg

SEQ ID NO: 1086045 - RNA, 17 nt, Mycobacterium bovis subsp bovis AF2122/97
gccggcgcccaggccga

SEQ ID NO: 1086046 - RNA, 13 nt, Mycobacterium bovis subsp bovis AF2122/97
gccggcgccagcg

SEQ ID NO: 1086047 - RNA, 17 nt, Mycobacterium bovis subsp bovis AF2122/97
gccggcgccagcgccgc

SEQ ID NO: 1086048 - RNA, 15 nt, Mycobacterium bovis subsp bovis AF2122/97
gccggcgcccgccgc

SEQ ID NO: 1086049 - RNA, 22 nt, Mycobacterium bovis subsp bovis AF2122/97
gccggcgcccgccgcgaacucc

SEQ ID NO: 1086050 - RNA, 17 nt, Mycobacterium bovis subsp bovis AF2122/97
gccggcgcccggggcgg

SEQ ID NO: 1086051 - RNA, 22 nt, Mycobacterium bovis subsp bovis AF2122/97
gccggcgcccaggccgaucagc

SEQ ID NO: 1086052 - RNA, 18 nt, Mycobacterium bovis subsp bovis AF2122/97
gccggcgcccaggccgau

SEQ ID NO: 1086053 - RNA, 19 nt, Mycobacterium bovis subsp bovis AF2122/97
gccggcgccgaacaccucg

SEQ ID NO: 1086054 - RNA, 13 nt, Mycobacterium bovis subsp bovis AF2122/97
gccggcgccgccg

SEQ ID NO: 1086055 - RNA, 14 nt, Mycobacterium bovis subsp bovis AF2122/97
gccggcgccgcccu

SEQ ID NO: 1086056 - RNA, 13 nt, Mycobacterium bovis subsp bovis AF2122/97
gccggcgccgcca

SEQ ID NO: 1086057 - RNA, 15 nt, Mycobacterium bovis subsp bovis AF2122/97
gccggcgccgccagc

SEQ ID NO: 1086058 - RNA, 16 nt, Mycobacterium bovis subsp bovis AF2122/97
gccggcgccgccggcg

SEQ ID NO: 1086059 - RNA, 11 nt, Mycobacterium bovis subsp bovis AF2122/97
gccggcgccgg

SEQ ID NO: 1086060 - RNA, 19 nt, Mycobacterium bovis subsp bovis AF2122/97
gccggcgccgccgucguac

SEQ ID NO: 1086061 - RNA, 17 nt, Mycobacterium bovis subsp bovis AF2122/97
gccggcgccggugccgc

SEQ ID NO: 1086062 - RNA, 16 nt, Mycobacterium bovis subsp bovis AF2122/97
gccggcgcgcagccgg

SEQ ID NO: 1086063 - RNA, 18 nt, Mycobacterium bovis subsp bovis AF2122/97
gccggcgcgcagccgggc

SEQ ID NO: 1086064 - RNA, 19 nt, Mycobacterium bovis subsp bovis AF2122/97
gccggcgcgcagccgggcc

SEQ ID NO: 1086065 - RNA, 14 nt, Mycobacterium bovis subsp bovis AF2122/97
gccggcgcgcagcc

SEQ ID NO: 1086066 - RNA, 20 nt, Mycobacterium bovis subsp bovis AF2122/97
gccggcgcgagccggcucag

SEQ ID NO: 1086067 - RNA, 17 nt, Mycobacterium bovis subsp bovis AF2122/97
gccggcgccuuggucgc

SEQ ID NO: 1086068 - RNA, 20 nt, Mycobacterium bovis subsp bovis AF2122/97
gccggcgccuuggucgccgc

SEQ ID NO: 1086069 - RNA, 15 nt, Mycobacterium bovis subsp bovis AF2122/97
gccggcgcgccgaug

SEQ ID NO: 1086070 - RNA, 14 nt, Mycobacterium bovis subsp bovis AF2122/97
gccggcgcgccgau

SEQ ID NO: 1086071 - RNA, 14 nt, Mycobacterium bovis subsp bovis AF2122/97
gccggcgcgcccca

SEQ ID NO: 1086072 - RNA, 18 nt, Mycobacterium bovis subsp bovis AF2122/97
gccggcgcgccccaccgc

SEQ ID NO: 1086073 - RNA, 16 nt, Mycobacterium bovis subsp bovis AF2122/97
gccggcgcgccgggcg

SEQ ID NO: 1086074 - RNA, 14 nt, Mycobacterium bovis subsp bovis AF2122/97
gccggcgcggcggc

SEQ ID NO: 1086075 - RNA, 14 nt, Mycobacterium bovis subsp bovis AF2122/97
gccggcgcugcccg

SEQ ID NO: 1086076 - RNA, 15 nt, Mycobacterium bovis subsp bovis AF2122/97
gccggcgcugcccgg

SEQ ID NO: 1086077 - RNA, 23 nt, Mycobacterium bovis subsp bovis AF2122/97
gccggcgcguaguaaugcucgac

SEQ ID NO: 1086078 - RNA, 15 nt, Mycobacterium bovis subsp bovis AF2122/97
gccggcgcucgcggc

SEQ ID NO: 1086079 - RNA, 22 nt, Mycobacterium bovis subsp bovis AF2122/97
gccggcgcucgcggcggcgcug

SEQ ID NO: 1086080 - RNA, 23 nt, Mycobacterium bovis subsp bovis AF2122/97
gccggcgcugcugccauugccga

SEQ ID NO: 1086081 - RNA, 19 nt, Mycobacterium bovis subsp bovis AF2122/97
gccggcggaaauggcgucg

SEQ ID NO: 1086082 - RNA, 20 nt, Mycobacterium bovis subsp bovis AF2122/97
gccggcggaaauggcgucgc

SEQ ID NO: 1086083 - RNA, 18 nt, Mycobacterium bovis subsp bovis AF2122/97
gccggcggaagcggcggc

SEQ ID NO: 1086084 - RNA, 14 nt, Mycobacterium bovis subsp bovis AF2122/97
gccggcggacgccc

SEQ ID NO: 1086085 - RNA, 16 nt, Mycobacterium bovis subsp bovis AF2122/97
gccggcggacgcccgg

SEQ ID NO: 1086086 - RNA, 22 nt, Mycobacterium bovis subsp bovis AF2122/97
gccggcggacgcccggcgcacc

SEQ ID NO: 1086087 - RNA, 17 nt, Mycobacterium bovis subsp bovis AF2122/97
gccggcggaucugaucg

SEQ ID NO: 1086088 - RNA, 22 nt, Mycobacterium bovis subsp bovis AF2122/97
gccggcggaucugaucggcgcg

SEQ ID NO: 1086089 - RNA, 23 nt, Mycobacterium bovis subsp bovis AF2122/97
gccggcggcaaagaacagccggc

SEQ ID NO: 1086090 - RNA, 17 nt, Mycobacterium bovis subsp bovis AF2122/97
gccggcggccgcccaga

SEQ ID NO: 1086091 - RNA, 20 nt, Mycobacterium bovis subsp bovis AF2122/97
gccggcggccuugcgggcuc

SEQ ID NO: 1086092 - RNA, 11 nt, Mycobacterium bovis subsp bovis AF2122/97
gccggcggcga

SEQ ID NO: 1086093 - RNA, 18 nt, Mycobacterium bovis subsp bovis AF2122/97
gccggcggcgcccaucgc

SEQ ID NO: 1086094 - RNA, 21 nt, Mycobacterium bovis subsp bovis AF2122/97
gccggcggcgcccaucgcgac

SEQ ID NO: 1086095 - RNA, 13 nt, Mycobacterium bovis subsp bovis AF2122/97
gccggcggcggcc

SEQ ID NO: 1086096 - RNA, 12 nt, Mycobacterium bovis subsp bovis AF2122/97
gccggcggcggg

SEQ ID NO: 1086097 - RNA, 19 nt, Mycobacterium bovis subsp bovis AF2122/97
gccggcggcggcgcucggc

SEQ ID NO: 1086098 - RNA, 21 nt, Mycobacterium bovis subsp bovis AF2122/97
gccggcggcggcgcucggcca

SEQ ID NO: 1086099 - RNA, 17 nt, Mycobacterium bovis subsp bovis AF2122/97
gccggcggcggccgcag

SEQ ID NO: 1086100 - RNA, 15 nt, Mycobacterium bovis subsp bovis AF2122/97
gccggcggcggcgcu

SEQ ID NO: 1086101 - RNA, 12 nt, Mycobacterium bovis subsp bovis AF2122/97
gccggcggcggu

SEQ ID NO: 1086102 - RNA, 15 nt, Mycobacterium bovis subsp bovis AF2122/97
gccggcggcgguacc

SEQ ID NO: 1086103 - RNA, 22 nt, Mycobacterium bovis subsp bovis AF2122/97
gccggcggcgguaccggaaucg

SEQ ID NO: 1086104 - RNA, 20 nt, Mycobacterium bovis subsp bovis AF2122/97
gccggcggcucgggugcgcc

SEQ ID NO: 1086105 - RNA, 12 nt, Mycobacterium bovis subsp bovis AF2122/97
gccggcggcugu

SEQ ID NO: 1086106 - RNA, 18 nt, Mycobacterium bovis subsp bovis AF2122/97
gccggcggcuguggucgc

SEQ ID NO: 1086107 - RNA, 17 nt, Mycobacterium bovis subsp bovis AF2122/97
gccggcgggcgcgggcg

SEQ ID NO: 1086108 - RNA, 21 nt, Mycobacterium bovis subsp bovis AF2122/97
gccggcgggcgcgggcgccgg

SEQ ID NO: 1086109 - RNA, 22 nt, Mycobacterium bovis subsp bovis AF2122/97
gccggcggguggcccccgccgg

SEQ ID NO: 1086110 - RNA, 20 nt, Mycobacterium bovis subsp bovis AF2122/97
gccggcgggcguaccuucga

SEQ ID NO: 1086111 - RNA, 20 nt, Mycobacterium bovis subsp bovis AF2122/97
gccggcgggcucgcccgcua

SEQ ID NO: 1086112 - RNA, 18 nt, Mycobacterium bovis subsp bovis AF2122/97
gccggcggucagcagcgc

SEQ ID NO: 1086113 - RNA, 17 nt, Mycobacterium bovis subsp bovis AF2122/97
gccggcgucggcgccca

SEQ ID NO: 1086114 - RNA, 15 nt, Mycobacterium bovis subsp bovis AF2122/97
gccggcgguggccga

SEQ ID NO: 1086115 - RNA, 19 nt, Mycobacterium bovis subsp bovis AF2122/97
gccggcgguggggccggcg

SEQ ID NO: 1086116 - RNA, 12 nt, Mycobacterium bovis subsp bovis AF2122/97
gccggcgguggc

SEQ ID NO: 1086117 - RNA, 12 nt, Mycobacterium bovis subsp bovis AF2122/97
gccggcggucgg

SEQ ID NO: 1086118 - RNA, 20 nt, Mycobacterium bovis subsp bovis AF2122/97
gccggcggucgggcccggcg

SEQ ID NO: 1086119 - RNA, 21 nt, Mycobacterium bovis subsp bovis AF2122/97
gccggcggucgggcccggcga

SEQ ID NO: 1086120 - RNA, 22 nt, Mycobacterium bovis subsp bovis AF2122/97
gccggcggucgggcccggcgag

SEQ ID NO: 1086121 - RNA, 23 nt, Mycobacterium bovis subsp bovis AF2122/97
gccggcggucgggcccggcgagc

SEQ ID NO: 1086122 - RNA, 21 nt, Mycobacterium bovis subsp bovis AF2122/97
gccggcggugacggcggcaac

SEQ ID NO: 1086123 - RNA, 19 nt, Mycobacterium bovis subsp bovis AF2122/97
gccggcgucggcgcccagc

SEQ ID NO: 1086124 - RNA, 14 nt, Mycobacterium bovis subsp bovis AF2122/97
gccggcgugcgcga

SEQ ID NO: 1086125 - RNA, 15 nt, Mycobacterium bovis subsp bovis AF2122/97
gccggcgugcgcgag

SEQ ID NO: 1086126 - RNA, 16 nt, Mycobacterium bovis subsp bovis AF2122/97
gccggcgugcgcgaga

SEQ ID NO: 1086127 - RNA, 14 nt, Mycobacterium bovis subsp bovis AF2122/97
gccggcgugcggcg

SEQ ID NO: 1086128 - RNA, 15 nt, Mycobacterium bovis subsp bovis AF2122/97
gccggcgugcggcga

SEQ ID NO: 1086129 - RNA, 16 nt, Mycobacterium bovis subsp bovis AF2122/97
gccggcgugcggcgag

SEQ ID NO: 1086130 - RNA, 14 nt, Mycobacterium bovis subsp bovis AF2122/97
gccggcgugucgcg

SEQ ID NO: 1086131 - RNA, 16 nt, Mycobacterium bovis subsp bovis AF2122/97
gccggcuccgccacug

SEQ ID NO: 1086132 - RNA, 14 nt, Mycobacterium bovis subsp bovis AF2122/97
gccggcuccgccgu

SEQ ID NO: 1086133 - RNA, 23 nt, Mycobacterium bovis subsp bovis AF2122/97
gccggcuccgccguugccgccgc

SEQ ID NO: 1086134 - RNA, 14 nt, Mycobacterium bovis subsp bovis AF2122/97
gccggcuccgcagc

SEQ ID NO: 1086135 - RNA, 20 nt, Mycobacterium bovis subsp bovis AF2122/97
gccggcgucggcgcccagcu

SEQ ID NO: 1086136 - RNA, 16 nt, Mycobacterium bovis subsp bovis AF2122/97
gccggcucggcgguac

SEQ ID NO: 1086137 - RNA, 14 nt, Mycobacterium bovis subsp bovis AF2122/97
gccggcucguccgg

SEQ ID NO: 1086138 - RNA, 18 nt, Mycobacterium bovis subsp bovis AF2122/97
gccggcucguccgggcag

SEQ ID NO: 1086139 - RNA, 15 nt, Mycobacterium bovis subsp bovis AF2122/97
gccggcucgucgauc

SEQ ID NO: 1086140 - RNA, 13 nt, Mycobacterium bovis subsp bovis AF2122/97
gccggcugcaucc

SEQ ID NO: 1086141 - RNA, 14 nt, Mycobacterium bovis subsp bovis AF2122/97
gccggcugccgcac

SEQ ID NO: 1086142 - RNA, 15 nt, Mycobacterium bovis subsp bovis AF2122/97
gccggcugcggaggc

SEQ ID NO: 1086143 - RNA, 15 nt, Mycobacterium bovis subsp bovis AF2122/97
gccgggaugccgccg

SEQ ID NO: 1086144 - RNA, 17 nt, Mycobacterium bovis subsp bovis AF2122/97
gccgggauaucgucgac

SEQ ID NO: 1086145 - RNA, 20 nt, Mycobacterium bovis subsp bovis AF2122/97
gccgggaucgccguccagca

SEQ ID NO: 1086146 - RNA, 18 nt, Mycobacterium bovis subsp bovis AF2122/97
gccggcccgacggguauc

SEQ ID NO: 1086147 - RNA, 14 nt, Mycobacterium bovis subsp bovis AF2122/97
gccggcccugcggc

SEQ ID NO: 1086148 - RNA, 14 nt, Mycobacterium bovis subsp bovis AF2122/97
gccggcccugcucg

SEQ ID NO: 1086149 - RNA, 20 nt, Mycobacterium bovis subsp bovis AF2122/97
gccggcccugcucgccgucu

SEQ ID NO: 1086150 - RNA, 15 nt, Mycobacterium bovis subsp bovis AF2122/97
gccggcccgcgggcg

SEQ ID NO: 1086151 - RNA, 14 nt, Mycobacterium bovis subsp bovis AF2122/97
gccggccgaucggc

SEQ ID NO: 1086152 - RNA, 18 nt, Mycobacterium bovis subsp bovis AF2122/97
gccggccgcacaugagcu

SEQ ID NO: 1086153 - RNA, 13 nt, Mycobacterium bovis subsp bovis AF2122/97
gccggccgcacgc

SEQ ID NO: 1086154 - RNA, 22 nt, Mycobacterium bovis subsp bovis AF2122/97
gccggccgcacgccggccagcg

SEQ ID NO: 1086155 - RNA, 12 nt, Mycobacterium bovis subsp bovis AF2122/97
gccggccgccgc

SEQ ID NO: 1086156 - RNA, 14 nt, Mycobacterium bovis subsp bovis AF2122/97
gccggccgccgcgg

SEQ ID NO: 1086157 - RNA, 14 nt, Mycobacterium bovis subsp bovis AF2122/97
gccggccgcgaccg

SEQ ID NO: 1086158 - RNA, 14 nt, Mycobacterium bovis subsp bovis AF2122/97
gccggccgcggcgg

SEQ ID NO: 1086159 - RNA, 16 nt, Mycobacterium bovis subsp bovis AF2122/97
gccggccgcgcuggug

SEQ ID NO: 1086160 - RNA, 14 nt, Mycobacterium bovis subsp bovis AF2122/97
gccggccgcuuggc

SEQ ID NO: 1086161 - RNA, 12 nt, Mycobacterium bovis subsp bovis AF2122/97
gccggccgcggg

SEQ ID NO: 1086162 - RNA, 14 nt, Mycobacterium bovis subsp bovis AF2122/97
gccggccgcgggcg

SEQ ID NO: 1086163 - RNA, 14 nt, Mycobacterium bovis subsp bovis AF2122/97
gccggccgcucacc

SEQ ID NO: 1086164 - RNA, 12 nt, Mycobacterium bovis subsp bovis AF2122/97
gccggccggcgc

SEQ ID NO: 1086165 - RNA, 14 nt, Mycobacterium bovis subsp bovis AF2122/97
gccggccggcgcgg

SEQ ID NO: 1086166 - RNA, 22 nt, Mycobacterium bovis subsp bovis AF2122/97
gccggccggaguccgucgggga

SEQ ID NO: 1086167 - RNA, 14 nt, Mycobacterium bovis subsp bovis AF2122/97
gccggccggcccgg

SEQ ID NO: 1086168 - RNA, 12 nt, Mycobacterium bovis subsp bovis AF2122/97
gccggccggcgg

SEQ ID NO: 1086169 - RNA, 13 nt, Mycobacterium bovis subsp bovis AF2122/97
gccggccggcggg

SEQ ID NO: 1086170 - RNA, 19 nt, Mycobacterium bovis subsp bovis AF2122/97
gccggccgggaaccucgcg

SEQ ID NO: 1086171 - RNA, 20 nt, Mycobacterium bovis subsp bovis AF2122/97
gccggccgggaaccucgcgu

SEQ ID NO: 1086172 - RNA, 17 nt, Mycobacterium bovis subsp bovis AF2122/97
gccggccagcggccauc

SEQ ID NO: 1086173 - RNA, 16 nt, Mycobacterium bovis subsp bovis AF2122/97
gccggccaucgcccgg

SEQ ID NO: 1086174 - RNA, 12 nt, Mycobacterium bovis subsp bovis AF2122/97
gccggccaggug

SEQ ID NO: 1086175 - RNA, 15 nt, Mycobacterium bovis subsp bovis AF2122/97
gccggccaguucggc

SEQ ID NO: 1086176 - RNA, 14 nt, Mycobacterium bovis subsp bovis AF2122/97
gccggccccggggg

SEQ ID NO: 1086177 - RNA, 20 nt, Mycobacterium bovis subsp bovis AF2122/97
gccggccccgggggaagcgc

SEQ ID NO: 1086178 - RNA, 20 nt, Mycobacterium bovis subsp bovis AF2122/97
gccggccccgccgaugccgc

SEQ ID NO: 1086179 - RNA, 14 nt, Mycobacterium bovis subsp bovis AF2122/97
gccggccccgccgg

SEQ ID NO: 1086180 - RNA, 15 nt, Mycobacterium bovis subsp bovis AF2122/97
gccggccccgccggc

SEQ ID NO: 1086181 - RNA, 16 nt, Mycobacterium bovis subsp bovis AF2122/97
gccggccccgccggcg

SEQ ID NO: 1086182 - RNA, 21 nt, Mycobacterium bovis subsp bovis AF2122/97
gccggccccgccggcgccgcc

SEQ ID NO: 1086183 - RNA, 22 nt, Mycobacterium bovis subsp bovis AF2122/97
gccggccccgccggcgccgccc

SEQ ID NO: 1086184 - RNA, 19 nt, Mycobacterium bovis subsp bovis AF2122/97
gccggccccgccgucaccc

SEQ ID NO: 1086185 - RNA, 22 nt, Mycobacterium bovis subsp bovis AF2122/97
gccggccccgccgucaccgccg

SEQ ID NO: 1086186 - RNA, 22 nt, Mycobacterium bovis subsp bovis AF2122/97
gccggccccgccgucgccgccg

SEQ ID NO: 1086187 - RNA, 16 nt, Mycobacterium bovis subsp bovis AF2122/97
gccggccccgccguuu

SEQ ID NO: 1086188 - RNA, 15 nt, Mycobacterium bovis subsp bovis AF2122/97
gccggccccgccagc

SEQ ID NO: 1086189 - RNA, 17 nt, Mycobacterium bovis subsp bovis AF2122/97
gccggccccgccagcgc

SEQ ID NO: 1086190 - RNA, 21 nt, Mycobacterium bovis subsp bovis AF2122/97
gccggccccgccagcgccgcc

SEQ ID NO: 1086191 - RNA, 23 nt, Mycobacterium bovis subsp bovis AF2122/97
gccggccccgccagcgccgccgg

SEQ ID NO: 1086192 - RNA, 20 nt, Mycobacterium bovis subsp bovis AF2122/97
gccggcccaguucugcagga

SEQ ID NO: 1086193 - RNA, 23 nt, Mycobacterium bovis subsp bovis AF2122/97
gccggcccauucaucuugcggca

SEQ ID NO: 1086194 - RNA, 14 nt, Mycobacterium bovis subsp bovis AF2122/97
gccggccccgccga

SEQ ID NO: 1086195 - RNA, 16 nt, Mycobacterium bovis subsp bovis AF2122/97
gccggccccgccgaug

SEQ ID NO: 1086196 - RNA, 21 nt, Mycobacterium bovis subsp bovis AF2122/97
gccggccaugccuucggugcc

SEQ ID NO: 1086197 - RNA, 13 nt, Mycobacterium bovis subsp bovis AF2122/97
gccggccccaccg

SEQ ID NO: 1086198 - RNA, 17 nt, Mycobacterium bovis subsp bovis AF2122/97
gccggccccaccggugc

SEQ ID NO: 1086199 - RNA, 18 nt, Mycobacterium bovis subsp bovis AF2122/97
gccggccccaccggugcc

SEQ ID NO: 1086200 - RNA, 13 nt, Mycobacterium bovis subsp bovis AF2122/97
gccggcgacaaca

SEQ ID NO: 1086201 - RNA, 13 nt, Mycobacterium bovis subsp bovis AF2122/97
gccggcgacaccg

SEQ ID NO: 1086202 - RNA, 20 nt, Mycobacterium bovis subsp bovis AF2122/97
gccggcgacgcuaccgccgg

SEQ ID NO: 1086203 - RNA, 17 nt, Mycobacterium bovis subsp bovis AF2122/97
gccggcgacggcgucac

SEQ ID NO: 1086204 - RNA, 15 nt, Mycobacterium bovis subsp bovis AF2122/97
gccggcgacgggucg

SEQ ID NO: 1086205 - RNA, 21 nt, Mycobacterium bovis subsp bovis AF2122/97
gccggcgacgggucgggcaac

SEQ ID NO: 1086206 - RNA, 17 nt, Mycobacterium bovis subsp bovis AF2122/97
gccggcgagcagacgca

SEQ ID NO: 1086207 - RNA, 19 nt, Mycobacterium bovis subsp bovis AF2122/97
gccggcgagcagacgcaaa

SEQ ID NO: 1086208 - RNA, 18 nt, Mycobacterium bovis subsp bovis AF2122/97
gccggcgagugguccagc

SEQ ID NO: 1086209 - RNA, 17 nt, Mycobacterium bovis subsp bovis AF2122/97
gccggcgagaaacacga

SEQ ID NO: 1086210 - RNA, 22 nt, Mycobacterium bovis subsp bovis AF2122/97
gccggcgacgauauagggcucc

SEQ ID NO: 1086211 - RNA, 17 nt, Mycobacterium bovis subsp bovis AF2122/97
gccggcgagggccacgg

SEQ ID NO: 1086212 - RNA, 19 nt, Mycobacterium bovis subsp bovis AF2122/97
gccggcgaacucgcgccga

SEQ ID NO: 1086213 - RNA, 20 nt, Mycobacterium bovis subsp bovis AF2122/97
gccggcgaagcgugcgccga

SEQ ID NO: 1086214 - RNA, 22 nt, Mycobacterium bovis subsp bovis AF2122/97
gccggcgaagcgugcgccgacu

SEQ ID NO: 1086215 - RNA, 16 nt, Mycobacterium bovis subsp bovis AF2122/97
gccggcgaacugaucg

SEQ ID NO: 1086216 - RNA, 17 nt, Mycobacterium bovis subsp bovis AF2122/97
gccggcgaaggccagca

SEQ ID NO: 1086217 - RNA, 18 nt, Mycobacterium bovis subsp bovis AF2122/97
gccggcgaaccccagcgc

SEQ ID NO: 1086218 - RNA, 12 nt, Mycobacterium bovis subsp bovis AF2122/97
gccggccggugg

SEQ ID NO: 1086219 - RNA, 14 nt, Mycobacterium bovis subsp bovis AF2122/97
gccggccgguggcc

SEQ ID NO: 1086220 - RNA, 16 nt, Mycobacterium bovis subsp bovis AF2122/97
gccggccgucggccgg

SEQ ID NO: 1086221 - RNA, 18 nt, Mycobacterium bovis subsp bovis AF2122/97
gccggccguucgugggca

SEQ ID NO: 1086222 - RNA, 12 nt, Mycobacterium bovis subsp bovis AF2122/97
gccggccgucga

SEQ ID NO: 1086223 - RNA, 13 nt, Mycobacterium bovis subsp bovis AF2122/97
gccggccgucggc

SEQ ID NO: 1086224 - RNA, 17 nt, Mycobacterium bovis subsp bovis AF2122/97
gccggccuccucgacga

SEQ ID NO: 1086225 - RNA, 18 nt, Mycobacterium bovis subsp bovis AF2122/97
gccggccucuggaucacg

SEQ ID NO: 1086226 - RNA, 22 nt, Mycobacterium bovis subsp bovis AF2122/97
gccggccucuggaucacgucga

SEQ ID NO: 1086227 - RNA, 15 nt, Mycobacterium bovis subsp bovis AF2122/97
gccggccucgccgaa

SEQ ID NO: 1086228 - RNA, 17 nt, Mycobacterium bovis subsp bovis AF2122/97
gccggccugcucggcga

SEQ ID NO: 1086229 - RNA, 17 nt, Mycobacterium bovis subsp bovis AF2122/97
gccggccucgccgaagc

SEQ ID NO: 1086230 - RNA, 22 nt, Mycobacterium bovis subsp bovis AF2122/97
gccggccucgccgaagcgggcc

SEQ ID NO: 1086231 - RNA, 12 nt, Mycobacterium bovis subsp bovis AF2122/97
aagcagcagcgg

SEQ ID NO: 1086232 - RNA, 15 nt, Mycobacterium bovis subsp bovis AF2122/97
aagcagcugggcauc

SEQ ID NO: 1086233 - RNA, 14 nt, Mycobacterium bovis subsp bovis AF2122/97
gcguucgccgcccg

SEQ ID NO: 1086234 - RNA, 15 nt, Mycobacterium bovis subsp bovis AF2122/97
gcguucgccgcccgg

SEQ ID NO: 1086235 - RNA, 18 nt, Mycobacterium bovis subsp bovis AF2122/97
gcguucgagagccccgac

SEQ ID NO: 1086236 - RNA, 15 nt, Mycobacterium bovis subsp bovis AF2122/97
gcguucggccgggcc

SEQ ID NO: 1086237 - RNA, 22 nt, Mycobacterium bovis subsp bovis AF2122/97
gcguucggccgacucggucuca

SEQ ID NO: 1086238 - RNA, 21 nt, Mycobacterium bovis subsp bovis AF2122/97
gcguuccuccagcagcgacgg

SEQ ID NO: 1086239 - RNA, 16 nt, Mycobacterium bovis subsp bovis AF2122/97
gcguuccuccagcagc

SEQ ID NO: 1086240 - RNA, 17 nt, Mycobacterium bovis subsp bovis AF2122/97
gcguuccuccagcagcg

SEQ ID NO: 1086241 - RNA, 14 nt, Mycobacterium bovis subsp bovis AF2122/97
gcguucccgccauu

SEQ ID NO: 1086242 - RNA, 20 nt, Mycobacterium bovis subsp bovis AF2122/97
gcguuccgaucggcaaucga

SEQ ID NO: 1086243 - RNA, 16 nt, Mycobacterium bovis subsp bovis AF2122/97
gcguuccaucagggcc

SEQ ID NO: 1086244 - RNA, 16 nt, Mycobacterium bovis subsp bovis AF2122/97
gcguuccaucgccgac

SEQ ID NO: 1086245 - RNA, 18 nt, Mycobacterium bovis subsp bovis AF2122/97
gcgugucugggaccccgc

SEQ ID NO: 1086246 - RNA, 23 nt, Mycobacterium bovis subsp bovis AF2122/97
gcgugucugggaccccgcugcga

SEQ ID NO: 1086247 - RNA, 13 nt, Mycobacterium bovis subsp bovis AF2122/97
gcgugucgcgucg

SEQ ID NO: 1086248 - RNA, 15 nt, Mycobacterium bovis subsp bovis AF2122/97
gcgugucggccggcc

SEQ ID NO: 1086249 - RNA, 16 nt, Mycobacterium bovis subsp bovis AF2122/97
gcguguccgccgaacu

SEQ ID NO: 1086250 - RNA, 17 nt, Mycobacterium bovis subsp bovis AF2122/97
gcguguccgccgaacug

SEQ ID NO: 1086251 - RNA, 16 nt, Mycobacterium bovis subsp bovis AF2122/97
gcguguggagcucgcg

SEQ ID NO: 1086252 - RNA, 17 nt, Mycobacterium bovis subsp bovis AF2122/97
gcguguggagcucgcgg

SEQ ID NO: 1086253 - RNA, 18 nt, Mycobacterium bovis subsp bovis AF2122/97
gcguugcgcugcgcgacg

SEQ ID NO: 1086254 - RNA, 15 nt, Mycobacterium bovis subsp bovis AF2122/97
gcguugccgaaaccc

SEQ ID NO: 1086255 - RNA, 19 nt, Mycobacterium bovis subsp bovis AF2122/97
gcguugccgaaacccgagu

SEQ ID NO: 1086256 - RNA, 17 nt, Mycobacterium bovis subsp bovis AF2122/97
gcguugccgccguugcc

SEQ ID NO: 1086257 - RNA, 22 nt, Mycobacterium bovis subsp bovis AF2122/97
gcguugaucgacaucaccaccg

SEQ ID NO: 1086258 - RNA, 19 nt, Mycobacterium bovis subsp bovis AF2122/97
gcguugcagaccaccagug

SEQ ID NO: 1086259 - RNA, 15 nt, Mycobacterium bovis subsp bovis AF2122/97
gcguugcacagcagc

SEQ ID NO: 1086260 - RNA, 15 nt, Mycobacterium bovis subsp bovis AF2122/97
gcguugaugaccagg

SEQ ID NO: 1086261 - RNA, 22 nt, Mycobacterium bovis subsp bovis AF2122/97
gcguugagcucaauggcuucga

SEQ ID NO: 1086262 - RNA, 16 nt, Mycobacterium bovis subsp bovis AF2122/97
gcguugagcaggugcc

SEQ ID NO: 1086263 - RNA, 21 nt, Mycobacterium bovis subsp bovis AF2122/97
gcguugacggcggggcggcgg

SEQ ID NO: 1086264 - RNA, 22 nt, Mycobacterium bovis subsp bovis AF2122/97
gcguugacggcuucggcagccg

SEQ ID NO: 1086265 - RNA, 19 nt, Mycobacterium bovis subsp bovis AF2122/97
gcguugacgucgagcagcg

SEQ ID NO: 1086266 - RNA, 20 nt, Mycobacterium bovis subsp bovis AF2122/97
gcguucgucguaguccaggc

SEQ ID NO: 1086267 - RNA, 17 nt, Mycobacterium bovis subsp bovis AF2122/97
gcguucuccggcaccgg

SEQ ID NO: 1086268 - RNA, 22 nt, Mycobacterium bovis subsp bovis AF2122/97
gcguugacgaucuccgccaacc

SEQ ID NO: 1086269 - RNA, 23 nt, Mycobacterium bovis subsp bovis AF2122/97
gcguugacgaucuccgccaaccg

SEQ ID NO: 1086270 - RNA, 14 nt, Mycobacterium bovis subsp bovis AF2122/97
gcguugacggcggg

SEQ ID NO: 1086271 - RNA, 18 nt, Mycobacterium bovis subsp bovis AF2122/97
gcguugaccgcggucugc

SEQ ID NO: 1086272 - RNA, 16 nt, Mycobacterium bovis subsp bovis AF2122/97
gcguugaaggcgccgg

SEQ ID NO: 1086273 - RNA, 13 nt, Mycobacterium bovis subsp bovis AF2122/97
gcguugaccgcau

SEQ ID NO: 1086274 - RNA, 21 nt, Mycobacterium bovis subsp bovis AF2122/97
gcguucucgauugucgccgcg

SEQ ID NO: 1086275 - RNA, 22 nt, Mycobacterium bovis subsp bovis AF2122/97
gcguucucgauugucgccgcgc

SEQ ID NO: 1086276 - RNA, 13 nt, Mycobacterium bovis subsp bovis AF2122/97
gcguugaccagca

SEQ ID NO: 1086277 - RNA, 20 nt, Mycobacterium bovis subsp bovis AF2122/97
gcguugaccaucacgcccug

SEQ ID NO: 1086278 - RNA, 20 nt, Mycobacterium bovis subsp bovis AF2122/97
gcuaacgaagccagaucagc

SEQ ID NO: 1086279 - RNA, 22 nt, Mycobacterium bovis subsp bovis AF2122/97
gcuaacgaagccagaucagccg

SEQ ID NO: 1086280 - RNA, 17 nt, Mycobacterium bovis subsp bovis AF2122/97
gcuaacuccccagacau

SEQ ID NO: 1086281 - RNA, 22 nt, Mycobacterium bovis subsp bovis AF2122/97
gcuaacuggacuggggcgccac

SEQ ID NO: 1086282 - RNA, 21 nt, Mycobacterium bovis subsp bovis AF2122/97
gcuaagccuucggugucgccg

SEQ ID NO: 1086283 - RNA, 15 nt, Mycobacterium bovis subsp bovis AF2122/97
gcuaauagcucgccg

SEQ ID NO: 1086284 - RNA, 14 nt, Mycobacterium bovis subsp bovis AF2122/97
gcguuugcuggcgg

SEQ ID NO: 1086285 - RNA, 13 nt, Mycobacterium bovis subsp bovis AF2122/97
gcguuugaugcgg

SEQ ID NO: 1086286 - RNA, 21 nt, Mycobacterium bovis subsp bovis AF2122/97
gcuaacagauuguccggccgg

SEQ ID NO: 1086287 - RNA, 19 nt, Mycobacterium bovis subsp bovis AF2122/97
gcguuggacaauucgacga

SEQ ID NO: 1086288 - RNA, 21 nt, Mycobacterium bovis subsp bovis AF2122/97
gcguuggccacacagucacgg

SEQ ID NO: 1086289 - RNA, 16 nt, Mycobacterium bovis subsp bovis AF2122/97
gcguuggcgacgaaga

SEQ ID NO: 1086290 - RNA, 16 nt, Mycobacterium bovis subsp bovis AF2122/97
gcguuggcgccaccag

SEQ ID NO: 1086291 - RNA, 17 nt, Mycobacterium bovis subsp bovis AF2122/97
gcguugcuggucgccgu

SEQ ID NO: 1086292 - RNA, 20 nt, Mycobacterium bovis subsp bovis AF2122/97
gcguugcuggucgccgucga

SEQ ID NO: 1086293 - RNA, 17 nt, Mycobacterium bovis subsp bovis AF2122/97
gcguugcugcagcagcg

SEQ ID NO: 1086294 - RNA, 18 nt, Mycobacterium bovis subsp bovis AF2122/97
gcguugcugcagcagcgc

SEQ ID NO: 1086295 - RNA, 17 nt, Mycobacterium bovis subsp bovis AF2122/97
gcguuggcgggcugaaa

SEQ ID NO: 1086296 - RNA, 13 nt, Mycobacterium bovis subsp bovis AF2122/97
gcguuggcggcga

SEQ ID NO: 1086297 - RNA, 21 nt, Mycobacterium bovis subsp bovis AF2122/97
gcguugggaucccagcgcagc

SEQ ID NO: 1086298 - RNA, 16 nt, Mycobacterium bovis subsp bovis AF2122/97
gcguugggaucgcgca

SEQ ID NO: 1086299 - RNA, 22 nt, Mycobacterium bovis subsp bovis AF2122/97
gcguugggaucgcgcagcgccg

SEQ ID NO: 1086300 - RNA, 22 nt, Mycobacterium bovis subsp bovis AF2122/97
gcguugggguuggcauguggac

SEQ ID NO: 1086301 - RNA, 21 nt, Mycobacterium bovis subsp bovis AF2122/97
gcguugggcgggauggccgcc

SEQ ID NO: 1086302 - RNA, 14 nt, Mycobacterium bovis subsp bovis AF2122/97
gcguuggggcucgu

SEQ ID NO: 1086303 - RNA, 16 nt, Mycobacterium bovis subsp bovis AF2122/97
gcguuggugcagucgg

SEQ ID NO: 1086304 - RNA, 22 nt, Mycobacterium bovis subsp bovis AF2122/97
gcguuguaguccugcgggccgu

SEQ ID NO: 1086305 - RNA, 15 nt, Mycobacterium bovis subsp bovis AF2122/97
gcguuguagcggucc

SEQ ID NO: 1086306 - RNA, 18 nt, Mycobacterium bovis subsp bovis AF2122/97
gcguuguagcgguccagc

SEQ ID NO: 1086307 - RNA, 21 nt, Mycobacterium bovis subsp bovis AF2122/97
gcguuuagucuccggcgucgg

SEQ ID NO: 1086308 - RNA, 19 nt, Mycobacterium bovis subsp bovis AF2122/97
gcguuuauaccucgccgcc

SEQ ID NO: 1086309 - RNA, 17 nt, Mycobacterium bovis subsp bovis AF2122/97
gcguuucgucgaccgcg

SEQ ID NO: 1086310 - RNA, 16 nt, Mycobacterium bovis subsp bovis AF2122/97
gcguuucacgaaaccc

SEQ ID NO: 1086311 - RNA, 21 nt, Mycobacterium bovis subsp bovis AF2122/97
gcguugucgguuggcagccac

SEQ ID NO: 1086312 - RNA, 16 nt, Mycobacterium bovis subsp bovis AF2122/97
gcguugucgacgaagg

SEQ ID NO: 1086313 - RNA, 20 nt, Mycobacterium bovis subsp bovis AF2122/97
gcguugugaccgccgaugcc

SEQ ID NO: 1086314 - RNA, 17 nt, Mycobacterium bovis subsp bovis AF2122/97
gcguugugcccgccggc

SEQ ID NO: 1086315 - RNA, 19 nt, Mycobacterium bovis subsp bovis AF2122/97
gcguugugcccgccggccc

SEQ ID NO: 1086316 - RNA, 15 nt, Mycobacterium bovis subsp bovis AF2122/97
gcguuguccgcggcc

SEQ ID NO: 1086317 - RNA, 12 nt, Mycobacterium bovis subsp bovis AF2122/97
gcguuguccacc

SEQ ID NO: 1086318 - RNA, 14 nt, Mycobacterium bovis subsp bovis AF2122/97
gcguuguccaccau

SEQ ID NO: 1086319 - RNA, 19 nt, Mycobacterium bovis subsp bovis AF2122/97
gcguuguuaucgaagcccg

SEQ ID NO: 1086320 - RNA, 20 nt, Mycobacterium bovis subsp bovis AF2122/97
gcucaccccggucgaggucg

SEQ ID NO: 1086321 - RNA, 18 nt, Mycobacterium bovis subsp bovis AF2122/97
gcucaccgaaacgaugcg

SEQ ID NO: 1086322 - RNA, 17 nt, Mycobacterium bovis subsp bovis AF2122/97
gcucaccgacaugacgc

SEQ ID NO: 1086323 - RNA, 18 nt, Mycobacterium bovis subsp bovis AF2122/97
gcucacccgucgucaagu

SEQ ID NO: 1086324 - RNA, 15 nt, Mycobacterium bovis subsp bovis AF2122/97
gcucacccugcucga

SEQ ID NO: 1086325 - RNA, 13 nt, Mycobacterium bovis subsp bovis AF2122/97
gcucaccgagccg

SEQ ID NO: 1086326 - RNA, 16 nt, Mycobacterium bovis subsp bovis AF2122/97
gcucaccgcacaccug

SEQ ID NO: 1086327 - RNA, 20 nt, Mycobacterium bovis subsp bovis AF2122/97
gcucaccaaggucggcgauc

SEQ ID NO: 1086328 - RNA, 22 nt, Mycobacterium bovis subsp bovis AF2122/97
gcucacauucaacagauccgac

SEQ ID NO: 1086329 - RNA, 18 nt, Mycobacterium bovis subsp bovis AF2122/97
gcucaccaaggucggcga

SEQ ID NO: 1086330 - RNA, 19 nt, Mycobacterium bovis subsp bovis AF2122/97
gcucaccaaggucggcgau

SEQ ID NO: 1086331 - RNA, 17 nt, Mycobacterium bovis subsp bovis AF2122/97
gcucacauacagcaggc

SEQ ID NO: 1086332 - RNA, 13 nt, Mycobacterium bovis subsp bovis AF2122/97
gcucacaugcccg

SEQ ID NO: 1086333 - RNA, 17 nt, Mycobacterium bovis subsp bovis AF2122/97
gcucacaugcccgcacc

SEQ ID NO: 1086334 - RNA, 18 nt, Mycobacterium bovis subsp bovis AF2122/97
gcucacagcacagcgcag

SEQ ID NO: 1086335 - RNA, 13 nt, Mycobacterium bovis subsp bovis AF2122/97
gcucaccaggcga

SEQ ID NO: 1086336 - RNA, 18 nt, Mycobacterium bovis subsp bovis AF2122/97
gcucaccaggcgagccgg

SEQ ID NO: 1086337 - RNA, 20 nt, Mycobacterium bovis subsp bovis AF2122/97
gcucaccaggcgagccggcg

SEQ ID NO: 1086338 - RNA, 23 nt, Mycobacterium bovis subsp bovis AF2122/97
gcucaccaggcgagccggcgcgc

SEQ ID NO: 1086339 - RNA, 13 nt, Mycobacterium bovis subsp bovis AF2122/97
gcucaccaccgac

SEQ ID NO: 1086340 - RNA, 19 nt, Mycobacterium bovis subsp bovis AF2122/97
gcucaccaccgaccucgac

SEQ ID NO: 1086341 - RNA, 12 nt, Mycobacterium bovis subsp bovis AF2122/97
gcucaccagcuc

SEQ ID NO: 1086342 - RNA, 13 nt, Mycobacterium bovis subsp bovis AF2122/97
gcucaccagcucc

SEQ ID NO: 1086343 - RNA, 15 nt, Mycobacterium bovis subsp bovis AF2122/97
gcucaaccagcagac

SEQ ID NO: 1086344 - RNA, 23 nt, Mycobacterium bovis subsp bovis AF2122/97
gcucaaccagcagacgccguagc

SEQ ID NO: 1086345 - RNA, 18 nt, Mycobacterium bovis subsp bovis AF2122/97
gcucaacggcgacaucgg

SEQ ID NO: 1086346 - RNA, 18 nt, Mycobacterium bovis subsp bovis AF2122/97
gcucaaccucuggcggcg

SEQ ID NO: 1086347 - RNA, 22 nt, Mycobacterium bovis subsp bovis AF2122/97
gcucaacggaaccgauaccucg

SEQ ID NO: 1086348 - RNA, 21 nt, Mycobacterium bovis subsp bovis AF2122/97
gcucaaugcggucaacgacag

SEQ ID NO: 1086349 - RNA, 22 nt, Mycobacterium bovis subsp bovis AF2122/97
gcucaaugaucgcggcggcgau

SEQ ID NO: 1086350 - RNA, 16 nt, Mycobacterium bovis subsp bovis AF2122/97
gcucaaugugccgccg

SEQ ID NO: 1086351 - RNA, 17 nt, Mycobacterium bovis subsp bovis AF2122/97
gcucaaugugccgccgg

SEQ ID NO: 1086352 - RNA, 15 nt, Mycobacterium bovis subsp bovis AF2122/97
gcucacaagccgugc

SEQ ID NO: 1086353 - RNA, 14 nt, Mycobacterium bovis subsp bovis AF2122/97
gcuauuccgcggca

SEQ ID NO: 1086354 - RNA, 21 nt, Mycobacterium bovis subsp bovis AF2122/97
gcuauuccuacagccucgacg

SEQ ID NO: 1086355 - RNA, 15 nt, Mycobacterium bovis subsp bovis AF2122/97
gcuauucggcggcau

SEQ ID NO: 1086356 - RNA, 23 nt, Mycobacterium bovis subsp bovis AF2122/97
gcuauggugccggugauggccga

SEQ ID NO: 1086357 - RNA, 16 nt, Mycobacterium bovis subsp bovis AF2122/97
gcuauggcgccgcggc

SEQ ID NO: 1086358 - RNA, 15 nt, Mycobacterium bovis subsp bovis AF2122/97
gcuauggcggcuucg

SEQ ID NO: 1086359 - RNA, 23 nt, Mycobacterium bovis subsp bovis AF2122/97
gcuaugcgccgcaugccaccgag

SEQ ID NO: 1086360 - RNA, 17 nt, Mycobacterium bovis subsp bovis AF2122/97
gcuaucaugaccaccga

SEQ ID NO: 1086361 - RNA, 16 nt, Mycobacterium bovis subsp bovis AF2122/97
gcuauccgagugaucg

SEQ ID NO: 1086362 - RNA, 14 nt, Mycobacterium bovis subsp bovis AF2122/97
gcuaucgcagaacg

SEQ ID NO: 1086363 - RNA, 15 nt, Mycobacterium bovis subsp bovis AF2122/97
gcuaucgugcgccga

SEQ ID NO: 1086364 - RNA, 15 nt, Mycobacterium bovis subsp bovis AF2122/97
gcuaugaccugcgaa

SEQ ID NO: 1086365 - RNA, 20 nt, Mycobacterium bovis subsp bovis AF2122/97
gcuaucgaggaggcggucga

SEQ ID NO: 1086366 - RNA, 16 nt, Mycobacterium bovis subsp bovis AF2122/97
gcuaugaugccgccgg

SEQ ID NO: 1086367 - RNA, 13 nt, Mycobacterium bovis subsp bovis AF2122/97
gcuaccuccgcca

SEQ ID NO: 1086368 - RNA, 15 nt, Mycobacterium bovis subsp bovis AF2122/97
gcuaccuccgccacc

SEQ ID NO: 1086369 - RNA, 23 nt, Mycobacterium bovis subsp bovis AF2122/97
gcuaccggcgugucacgucgcag

SEQ ID NO: 1086370 - RNA, 21 nt, Mycobacterium bovis subsp bovis AF2122/97
gcuaccggcuuggcgggaccg

SEQ ID NO: 1086371 - RNA, 17 nt, Mycobacterium bovis subsp bovis AF2122/97
gcuaccuaacccgcgcc

SEQ ID NO: 1086372 - RNA, 18 nt, Mycobacterium bovis subsp bovis AF2122/97
gcuaccuaacccgcgccg

SEQ ID NO: 1086373 - RNA, 20 nt, Mycobacterium bovis subsp bovis AF2122/97
gcuaccuaacccgcgccggc

SEQ ID NO: 1086374 - RNA, 13 nt, Mycobacterium bovis subsp bovis AF2122/97
gcuacgacggucc

SEQ ID NO: 1086375 - RNA, 14 nt, Mycobacterium bovis subsp bovis AF2122/97
gcuacgcgaucagc

SEQ ID NO: 1086376 - RNA, 15 nt, Mycobacterium bovis subsp bovis AF2122/97
gcuacgcgcgcccga

SEQ ID NO: 1086377 - RNA, 21 nt, Mycobacterium bovis subsp bovis AF2122/97
gcuacgcgcgcucgcucaccg

SEQ ID NO: 1086378 - RNA, 20 nt, Mycobacterium bovis subsp bovis AF2122/97
gcuacgccggcccgaggcgg

SEQ ID NO: 1086379 - RNA, 22 nt, Mycobacterium bovis subsp bovis AF2122/97
gcuacgccccacugccgugccg

SEQ ID NO: 1086380 - RNA, 13 nt, Mycobacterium bovis subsp bovis AF2122/97
gcuaccgcgcucc

SEQ ID NO: 1086381 - RNA, 18 nt, Mycobacterium bovis subsp bovis AF2122/97
gcuaccgcgcucccggcg

SEQ ID NO: 1086382 - RNA, 19 nt, Mycobacterium bovis subsp bovis AF2122/97
gcuaccgcaggugccaccu

SEQ ID NO: 1086383 - RNA, 11 nt, Mycobacterium bovis subsp bovis AF2122/97
gcuaccggcgc

SEQ ID NO: 1086384 - RNA, 13 nt, Mycobacterium bovis subsp bovis AF2122/97
gcuaccggcgccg

SEQ ID NO: 1086385 - RNA, 15 nt, Mycobacterium bovis subsp bovis AF2122/97
gcuaccgcaggugcc

SEQ ID NO: 1086386 - RNA, 18 nt, Mycobacterium bovis subsp bovis AF2122/97
gcuaccgcaggugccacc

SEQ ID NO: 1086387 - RNA, 18 nt, Mycobacterium bovis subsp bovis AF2122/97
gcuacccggacagggcgg

SEQ ID NO: 1086388 - RNA, 21 nt, Mycobacterium bovis subsp bovis AF2122/97
gcuacccggacagggcggcga

SEQ ID NO: 1086389 - RNA, 12 nt, Mycobacterium bovis subsp bovis AF2122/97
gcuacccgggcc

SEQ ID NO: 1086390 - RNA, 13 nt, Mycobacterium bovis subsp bovis AF2122/97
gcuaccgcccgcg

SEQ ID NO: 1086391 - RNA, 14 nt, Mycobacterium bovis subsp bovis AF2122/97
gcuaccgcccgcgc

SEQ ID NO: 1086392 - RNA, 15 nt, Mycobacterium bovis subsp bovis AF2122/97
gcuaccgcccgcgcc

SEQ ID NO: 1086393 - RNA, 22 nt, Mycobacterium bovis subsp bovis AF2122/97
gcuaccgcccgcgccaccggca

SEQ ID NO: 1086394 - RNA, 12 nt, Mycobacterium bovis subsp bovis AF2122/97
gcuaccgccgac

SEQ ID NO: 1086395 - RNA, 19 nt, Mycobacterium bovis subsp bovis AF2122/97
gcuaccgccgaccggaccg

SEQ ID NO: 1086396 - RNA, 12 nt, Mycobacterium bovis subsp bovis AF2122/97
gcuaccgccggg

SEQ ID NO: 1086397 - RNA, 13 nt, Mycobacterium bovis subsp bovis AF2122/97
gcuaccgccgggg

SEQ ID NO: 1086398 - RNA, 20 nt, Mycobacterium bovis subsp bovis AF2122/97
gcuacacccguagaccuucg

SEQ ID NO: 1086399 - RNA, 23 nt, Mycobacterium bovis subsp bovis AF2122/97
gcuacaucagaaucaggcucgcc

SEQ ID NO: 1086400 - RNA, 17 nt, Mycobacterium bovis subsp bovis AF2122/97
gcuacagcuugcguagc

SEQ ID NO: 1086401 - RNA, 20 nt, Mycobacterium bovis subsp bovis AF2122/97
gcuaauccagcagcaccgac

SEQ ID NO: 1086402 - RNA, 18 nt, Mycobacterium bovis subsp bovis AF2122/97
gcuaauugcggccgccgg

SEQ ID NO: 1086403 - RNA, 23 nt, Mycobacterium bovis subsp bovis AF2122/97
gcuacccauucggcggcgguggc

SEQ ID NO: 1086404 - RNA, 13 nt, Mycobacterium bovis subsp bovis AF2122/97
gcuaccccgcaga

SEQ ID NO: 1086405 - RNA, 16 nt, Mycobacterium bovis subsp bovis AF2122/97
gcuaccccagccggca

SEQ ID NO: 1086406 - RNA, 16 nt, Mycobacterium bovis subsp bovis AF2122/97
gcuacccccgauggcg

SEQ ID NO: 1086407 - RNA, 20 nt, Mycobacterium bovis subsp bovis AF2122/97
gcuacccccgauggcgucgc

SEQ ID NO: 1086408 - RNA, 15 nt, Mycobacterium bovis subsp bovis AF2122/97
gcuaccagcucacgg

SEQ ID NO: 1086409 - RNA, 16 nt, Mycobacterium bovis subsp bovis AF2122/97
gcuacaucggcggcgu

SEQ ID NO: 1086410 - RNA, 16 nt, Mycobacterium bovis subsp bovis AF2122/97
gcuaccagagccgcga

SEQ ID NO: 1086411 - RNA, 17 nt, Mycobacterium bovis subsp bovis AF2122/97
gcuaggagaucagcacc

SEQ ID NO: 1086412 - RNA, 19 nt, Mycobacterium bovis subsp bovis AF2122/97
gcuaggacggcgcgagccg

SEQ ID NO: 1086413 - RNA, 23 nt, Mycobacterium bovis subsp bovis AF2122/97
gcuaggacggcugccgucagccg

SEQ ID NO: 1086414 - RNA, 16 nt, Mycobacterium bovis subsp bovis AF2122/97
gcuaggaccaccagcg

SEQ ID NO: 1086415 - RNA, 17 nt, Mycobacterium bovis subsp bovis AF2122/97
gcuaggccaagccgcgg

SEQ ID NO: 1086416 - RNA, 13 nt, Mycobacterium bovis subsp bovis AF2122/97
gcuaggccaccgg

SEQ ID NO: 1086417 - RNA, 18 nt, Mycobacterium bovis subsp bovis AF2122/97
gcuaggccaccggcgacc

SEQ ID NO: 1086418 - RNA, 18 nt, Mycobacterium bovis subsp bovis AF2122/97
gcuagcgccgcgcuugcg

SEQ ID NO: 1086419 - RNA, 22 nt, Mycobacterium bovis subsp bovis AF2122/97
gcuagcgcuauaggccgcaugc

SEQ ID NO: 1086420 - RNA, 18 nt, Mycobacterium bovis subsp bovis AF2122/97
gcuagcgcuugcgacccc

SEQ ID NO: 1086421 - RNA, 20 nt, Mycobacterium bovis subsp bovis AF2122/97
gcuagcgcuugcgaccccgg

SEQ ID NO: 1086422 - RNA, 16 nt, Mycobacterium bovis subsp bovis AF2122/97
gcuagcggauucagcg

SEQ ID NO: 1086423 - RNA, 20 nt, Mycobacterium bovis subsp bovis AF2122/97
gcuagcggauucagcgucgc

SEQ ID NO: 1086424 - RNA, 21 nt, Mycobacterium bovis subsp bovis AF2122/97
gcuagguccgaacuugacgaa

SEQ ID NO: 1086425 - RNA, 16 nt, Mycobacterium bovis subsp bovis AF2122/97
gcuaggugacgccgcc

SEQ ID NO: 1086426 - RNA, 17 nt, Mycobacterium bovis subsp bovis AF2122/97
gcuaggugacgccgcca

SEQ ID NO: 1086427 - RNA, 22 nt, Mycobacterium bovis subsp bovis AF2122/97
gcuaggugacgccgccagcacc

SEQ ID NO: 1086428 - RNA, 19 nt, Mycobacterium bovis subsp bovis AF2122/97
gcuaggugcaacaggcgcg

SEQ ID NO: 1086429 - RNA, 14 nt, Mycobacterium bovis subsp bovis AF2122/97
gcuaggccggccgg

SEQ ID NO: 1086430 - RNA, 17 nt, Mycobacterium bovis subsp bovis AF2122/97
gcuagggcagcagcccg

SEQ ID NO: 1086431 - RNA, 19 nt, Mycobacterium bovis subsp bovis AF2122/97
gcuagggcagcagcccggg

SEQ ID NO: 1086432 - RNA, 23 nt, Mycobacterium bovis subsp bovis AF2122/97
gcuaggccaccggcgaccgacgg

SEQ ID NO: 1086433 - RNA, 22 nt, Mycobacterium bovis subsp bovis AF2122/97
gcuagugcaaaauugcuuggcc

SEQ ID NO: 1086434 - RNA, 19 nt, Mycobacterium bovis subsp bovis AF2122/97
gcuagugcgggccgugacc

SEQ ID NO: 1086435 - RNA, 15 nt, Mycobacterium bovis subsp bovis AF2122/97
gcuacgggccgcggu

SEQ ID NO: 1086436 - RNA, 22 nt, Mycobacterium bovis subsp bovis AF2122/97
gcuacggggcggucgagccacc

SEQ ID NO: 1086437 - RNA, 17 nt, Mycobacterium bovis subsp bovis AF2122/97
gcuacguuacgccgaga

SEQ ID NO: 1086438 - RNA, 20 nt, Mycobacterium bovis subsp bovis AF2122/97
gcuacggcgacacgccagcc

SEQ ID NO: 1086439 - RNA, 12 nt, Mycobacterium bovis subsp bovis AF2122/97
gcuacggcgucc

SEQ ID NO: 1086440 - RNA, 19 nt, Mycobacterium bovis subsp bovis AF2122/97
gcuagccagggaucagccg

SEQ ID NO: 1086441 - RNA, 16 nt, Mycobacterium bovis subsp bovis AF2122/97
gcuagccagucggcca

SEQ ID NO: 1086442 - RNA, 14 nt, Mycobacterium bovis subsp bovis AF2122/97
gcuagcccggcagc

SEQ ID NO: 1086443 - RNA, 20 nt, Mycobacterium bovis subsp bovis AF2122/97
gcuagccaccaggcggucag

SEQ ID NO: 1086444 - RNA, 19 nt, Mycobacterium bovis subsp bovis AF2122/97
gcuagccgacagcucaucg

SEQ ID NO: 1086445 - RNA, 18 nt, Mycobacterium bovis subsp bovis AF2122/97
gcuagccgggcgcgccgg

SEQ ID NO: 1086446 - RNA, 21 nt, Mycobacterium bovis subsp bovis AF2122/97
gcuagccgggcgcgccggcca

SEQ ID NO: 1086447 - RNA, 13 nt, Mycobacterium bovis subsp bovis AF2122/97
gcuacugcgacca

SEQ ID NO: 1086448 - RNA, 17 nt, Mycobacterium bovis subsp bovis AF2122/97
gcuacucacggugaucg

SEQ ID NO: 1086449 - RNA, 19 nt, Mycobacterium bovis subsp bovis AF2122/97
gcuagaucccaguccgaug

SEQ ID NO: 1086450 - RNA, 17 nt, Mycobacterium bovis subsp bovis AF2122/97
gcuagcagcagcccgac

SEQ ID NO: 1086451 - RNA, 19 nt, Mycobacterium bovis subsp bovis AF2122/97
gcuagacccgucaccgccg

SEQ ID NO: 1086452 - RNA, 13 nt, Mycobacterium bovis subsp bovis AF2122/97
gcggucgacagcg

SEQ ID NO: 1086453 - RNA, 14 nt, Mycobacterium bovis subsp bovis AF2122/97
gcggucgacguguu

SEQ ID NO: 1086454 - RNA, 15 nt, Mycobacterium bovis subsp bovis AF2122/97
gcgguccucgagccg

SEQ ID NO: 1086455 - RNA, 19 nt, Mycobacterium bovis subsp bovis AF2122/97
gcgguccggcuucggcgaa

SEQ ID NO: 1086456 - RNA, 12 nt, Mycobacterium bovis subsp bovis AF2122/97
gcggucgacguu

SEQ ID NO: 1086457 - RNA, 19 nt, Mycobacterium bovis subsp bovis AF2122/97
gcguagcgaccucgccgcg

SEQ ID NO: 1086458 - RNA, 22 nt, Mycobacterium bovis subsp bovis AF2122/97
gcggucgaggguaccaggcgcc

SEQ ID NO: 1086459 - RNA, 18 nt, Mycobacterium bovis subsp bovis AF2122/97
gcggucgaguccacagcg

SEQ ID NO: 1086460 - RNA, 12 nt, Mycobacterium bovis subsp bovis AF2122/97
gcggucgaucac

SEQ ID NO: 1086461 - RNA, 13 nt, Mycobacterium bovis subsp bovis AF2122/97
gcggucgaucaca

SEQ ID NO: 1086462 - RNA, 14 nt, Mycobacterium bovis subsp bovis AF2122/97
gcggucgagcucgu

SEQ ID NO: 1086463 - RNA, 16 nt, Mycobacterium bovis subsp bovis AF2122/97
gcggucgaucacacgg

SEQ ID NO: 1086464 - RNA, 21 nt, Mycobacterium bovis subsp bovis AF2122/97
gcggucgaucaggccguguac

SEQ ID NO: 1086465 - RNA, 21 nt, Mycobacterium bovis subsp bovis AF2122/97
gcguagcgggggagcgaacgg

SEQ ID NO: 1086466 - RNA, 14 nt, Mycobacterium bovis subsp bovis AF2122/97
gcguagcggcgaua

SEQ ID NO: 1086467 - RNA, 19 nt, Mycobacterium bovis subsp bovis AF2122/97
gcguaggcccaacgacggc

SEQ ID NO: 1086468 - RNA, 22 nt, Mycobacterium bovis subsp bovis AF2122/97
gcguaggcccaacgacggcaac

SEQ ID NO: 1086469 - RNA, 20 nt, Mycobacterium bovis subsp bovis AF2122/97
gcguaggccuugcucagccg

SEQ ID NO: 1086470 - RNA, 15 nt, Mycobacterium bovis subsp bovis AF2122/97
gcguaggcgauggcg

SEQ ID NO: 1086471 - RNA, 18 nt, Mycobacterium bovis subsp bovis AF2122/97
gcguaggcgauggcggcg

SEQ ID NO: 1086472 - RNA, 17 nt, Mycobacterium bovis subsp bovis AF2122/97
gcguagggcuguccgac

SEQ ID NO: 1086473 - RNA, 22 nt, Mycobacterium bovis subsp bovis AF2122/97
gcguaucgcgucugggugcagg

SEQ ID NO: 1086474 - RNA, 22 nt, Mycobacterium bovis subsp bovis AF2122/97
gcguaucgggcccccuggaucg

SEQ ID NO: 1086475 - RNA, 18 nt, Mycobacterium bovis subsp bovis AF2122/97
gcguauccuugcgacguu

SEQ ID NO: 1086476 - RNA, 18 nt, Mycobacterium bovis subsp bovis AF2122/97
gcguauuggacgcugccg

SEQ ID NO: 1086477 - RNA, 22 nt, Mycobacterium bovis subsp bovis AF2122/97
gcguaugccaggacuggcaccg

SEQ ID NO: 1086478 - RNA, 17 nt, Mycobacterium bovis subsp bovis AF2122/97
gcgucaaccacggccgc

SEQ ID NO: 1086479 - RNA, 19 nt, Mycobacterium bovis subsp bovis AF2122/97
gcgucaaccacggccgccg

SEQ ID NO: 1086480 - RNA, 20 nt, Mycobacterium bovis subsp bovis AF2122/97
gcgucaccggaggccgccgc

SEQ ID NO: 1086481 - RNA, 21 nt, Mycobacterium bovis subsp bovis AF2122/97
gcgucaccggaggccgccgcg

SEQ ID NO: 1086482 - RNA, 22 nt, Mycobacterium bovis subsp bovis AF2122/97
gcgucaccggaggccgccgcgc

SEQ ID NO: 1086483 - RNA, 15 nt, Mycobacterium bovis subsp bovis AF2122/97
gcgucacgagccaag

SEQ ID NO: 1086484 - RNA, 21 nt, Mycobacterium bovis subsp bovis AF2122/97
gcgucaccucaccgaacggca

SEQ ID NO: 1086485 - RNA, 20 nt, Mycobacterium bovis subsp bovis AF2122/97
gcgucacggugcguucgugc

SEQ ID NO: 1086486 - RNA, 15 nt, Mycobacterium bovis subsp bovis AF2122/97
gcgucaggugcgcga

SEQ ID NO: 1086487 - RNA, 19 nt, Mycobacterium bovis subsp bovis AF2122/97
gcgucagauccggccguug

SEQ ID NO: 1086488 - RNA, 14 nt, Mycobacterium bovis subsp bovis AF2122/97
gcgucagcagcaac

SEQ ID NO: 1086489 - RNA, 23 nt, Mycobacterium bovis subsp bovis AF2122/97
gcguccaaccaaggacgaacgcg

SEQ ID NO: 1086490 - RNA, 12 nt, Mycobacterium bovis subsp bovis AF2122/97
gcguccaccacg

SEQ ID NO: 1086491 - RNA, 23 nt, Mycobacterium bovis subsp bovis AF2122/97
gcguccacccacgaucagcagcg

SEQ ID NO: 1086492 - RNA, 16 nt, Mycobacterium bovis subsp bovis AF2122/97
gcguccaccacgcaaa

SEQ ID NO: 1086493 - RNA, 14 nt, Mycobacterium bovis subsp bovis AF2122/97
gcguccaccggacg

SEQ ID NO: 1086494 - RNA, 17 nt, Mycobacterium bovis subsp bovis AF2122/97
gcgucaugaacgaucgg

SEQ ID NO: 1086495 - RNA, 16 nt, Mycobacterium bovis subsp bovis AF2122/97
gcgucaugaugucgac

SEQ ID NO: 1086496 - RNA, 21 nt, Mycobacterium bovis subsp bovis AF2122/97
gcgucaugaugucgacaucga

SEQ ID NO: 1086497 - RNA, 17 nt, Mycobacterium bovis subsp bovis AF2122/97
gcgucaucaggucgucg

SEQ ID NO: 1086498 - RNA, 15 nt, Mycobacterium bovis subsp bovis AF2122/97
gcgucaucaggucgu

SEQ ID NO: 1086499 - RNA, 21 nt, Mycobacterium bovis subsp bovis AF2122/97
gcgucaucaccgguacugcga

SEQ ID NO: 1086500 - RNA, 13 nt, Mycobacterium bovis subsp bovis AF2122/97
gcgucaucaccgg

SEQ ID NO: 1086501 - RNA, 21 nt, Mycobacterium bovis subsp bovis AF2122/97
gcgucgaacugggcgcccgcg

SEQ ID NO: 1086502 - RNA, 18 nt, Mycobacterium bovis subsp bovis AF2122/97
gcgucgaagaccgccucc

SEQ ID NO: 1086503 - RNA, 20 nt, Mycobacterium bovis subsp bovis AF2122/97
gcgucgaacacgucgggaug

SEQ ID NO: 1086504 - RNA, 16 nt, Mycobacterium bovis subsp bovis AF2122/97
gcgucgaaccagucga

SEQ ID NO: 1086505 - RNA, 14 nt, Mycobacterium bovis subsp bovis AF2122/97
gcgucgaagccggg

SEQ ID NO: 1086506 - RNA, 18 nt, Mycobacterium bovis subsp bovis AF2122/97
gcgucgagcgacccccag

SEQ ID NO: 1086507 - RNA, 23 nt, Mycobacterium bovis subsp bovis AF2122/97
gcgucgagcgacccccagcgccc

SEQ ID NO: 1086508 - RNA, 15 nt, Mycobacterium bovis subsp bovis AF2122/97
gcgucgagcgccggc

SEQ ID NO: 1086509 - RNA, 13 nt, Mycobacterium bovis subsp bovis AF2122/97
gcguccgggcagc

SEQ ID NO: 1086510 - RNA, 16 nt, Mycobacterium bovis subsp bovis AF2122/97
gcguccgggcagccgc

SEQ ID NO: 1086511 - RNA, 20 nt, Mycobacterium bovis subsp bovis AF2122/97
gcguccgggcucgcgcucga

SEQ ID NO: 1086512 - RNA, 20 nt, Mycobacterium bovis subsp bovis AF2122/97
gcguccggaaccaaccucgg

SEQ ID NO: 1086513 - RNA, 13 nt, Mycobacterium bovis subsp bovis AF2122/97
gcguccuggugag

SEQ ID NO: 1086514 - RNA, 22 nt, Mycobacterium bovis subsp bovis AF2122/97
gcguccuucuuguuggucccga

SEQ ID NO: 1086515 - RNA, 23 nt, Mycobacterium bovis subsp bovis AF2122/97
gcgucgaaaagccgugcaccagc

SEQ ID NO: 1086516 - RNA, 13 nt, Mycobacterium bovis subsp bovis AF2122/97
gcguccgcccagc

SEQ ID NO: 1086517 - RNA, 17 nt, Mycobacterium bovis subsp bovis AF2122/97
gcguccgcccagccgca

SEQ ID NO: 1086518 - RNA, 16 nt, Mycobacterium bovis subsp bovis AF2122/97
gcguccgccgaacacc

SEQ ID NO: 1086519 - RNA, 14 nt, Mycobacterium bovis subsp bovis AF2122/97
gcguccgccggcga

SEQ ID NO: 1086520 - RNA, 14 nt, Mycobacterium bovis subsp bovis AF2122/97
gcguccgcgaucug

SEQ ID NO: 1086521 - RNA, 13 nt, Mycobacterium bovis subsp bovis AF2122/97
gcguccgcgcguu

SEQ ID NO: 1086522 - RNA, 13 nt, Mycobacterium bovis subsp bovis AF2122/97
gcguccagcagcg

SEQ ID NO: 1086523 - RNA, 22 nt, Mycobacterium bovis subsp bovis AF2122/97
gcguccagcgccugcgcccagc

SEQ ID NO: 1086524 - RNA, 20 nt, Mycobacterium bovis subsp bovis AF2122/97
gcguccagcaaaugcggcgc

SEQ ID NO: 1086525 - RNA, 21 nt, Mycobacterium bovis subsp bovis AF2122/97
gcguccaccugcuccgcuguc

SEQ ID NO: 1086526 - RNA, 15 nt, Mycobacterium bovis subsp bovis AF2122/97
gcguccacgggaucu

SEQ ID NO: 1086527 - RNA, 12 nt, Mycobacterium bovis subsp bovis AF2122/97
gcgucgccgccg

SEQ ID NO: 1086528 - RNA, 14 nt, Mycobacterium bovis subsp bovis AF2122/97
gcgucgaucaccug

SEQ ID NO: 1086529 - RNA, 19 nt, Mycobacterium bovis subsp bovis AF2122/97
gcgucgaugcgggccauca

SEQ ID NO: 1086530 - RNA, 12 nt, Mycobacterium bovis subsp bovis AF2122/97
gcgucgccgagg

SEQ ID NO: 1086531 - RNA, 12 nt, Mycobacterium bovis subsp bovis AF2122/97
gcgucgaugcgg

SEQ ID NO: 1086532 - RNA, 18 nt, Mycobacterium bovis subsp bovis AF2122/97
gcgucgaugccggcugcc

SEQ ID NO: 1086533 - RNA, 17 nt, Mycobacterium bovis subsp bovis AF2122/97
gcgucgagugccgccac

SEQ ID NO: 1086534 - RNA, 18 nt, Mycobacterium bovis subsp bovis AF2122/97
gcgucgagugccgccacc

SEQ ID NO: 1086535 - RNA, 21 nt, Mycobacterium bovis subsp bovis AF2122/97
gcgucgagugccgccaccgcc

SEQ ID NO: 1086536 - RNA, 20 nt, Mycobacterium bovis subsp bovis AF2122/97
gcgucgagcucguccucguc

SEQ ID NO: 1086537 - RNA, 20 nt, Mycobacterium bovis subsp bovis AF2122/97
gcgucgaucagggccccacc

SEQ ID NO: 1086538 - RNA, 23 nt, Mycobacterium bovis subsp bovis AF2122/97
gcgucgaugagguucaucgccgg

SEQ ID NO: 1086539 - RNA, 16 nt, Mycobacterium bovis subsp bovis AF2122/97
gcgucgaucguuccgc

SEQ ID NO: 1086540 - RNA, 14 nt, Mycobacterium bovis subsp bovis AF2122/97
gcgucgccggcacc

SEQ ID NO: 1086541 - RNA, 15 nt, Mycobacterium bovis subsp bovis AF2122/97
gcgucgccggcaccg

SEQ ID NO: 1086542 - RNA, 13 nt, Mycobacterium bovis subsp bovis AF2122/97
gcgucgccgccgg

SEQ ID NO: 1086543 - RNA, 15 nt, Mycobacterium bovis subsp bovis AF2122/97
gcgucgcuggccagg

SEQ ID NO: 1086544 - RNA, 21 nt, Mycobacterium bovis subsp bovis AF2122/97
gcgucggccacccgguccacc

SEQ ID NO: 1086545 - RNA, 20 nt, Mycobacterium bovis subsp bovis AF2122/97
gcgucggccaggaucaaccg

SEQ ID NO: 1086546 - RNA, 16 nt, Mycobacterium bovis subsp bovis AF2122/97
gcgucggacuccgaga

SEQ ID NO: 1086547 - RNA, 17 nt, Mycobacterium bovis subsp bovis AF2122/97
gcgucgcuucggcaccg

SEQ ID NO: 1086548 - RNA, 15 nt, Mycobacterium bovis subsp bovis AF2122/97
gcgucggaaauucca

SEQ ID NO: 1086549 - RNA, 16 nt, Mycobacterium bovis subsp bovis AF2122/97
gcgucggacaugccga

SEQ ID NO: 1086550 - RNA, 20 nt, Mycobacterium bovis subsp bovis AF2122/97
gcgucggaauacaacagcug

SEQ ID NO: 1086551 - RNA, 13 nt, Mycobacterium bovis subsp bovis AF2122/97
gcgugacccgccg

SEQ ID NO: 1086552 - RNA, 16 nt, Mycobacterium bovis subsp bovis AF2122/97
gcgugacccgccggcg

SEQ ID NO: 1086553 - RNA, 17 nt, Mycobacterium bovis subsp bovis AF2122/97
gcgugacccgccggcga

SEQ ID NO: 1086554 - RNA, 18 nt, Mycobacterium bovis subsp bovis AF2122/97
gcgugacccgccggcgac

SEQ ID NO: 1086555 - RNA, 19 nt, Mycobacterium bovis subsp bovis AF2122/97
gcgugaagucacggcggcu

SEQ ID NO: 1086556 - RNA, 17 nt, Mycobacterium bovis subsp bovis AF2122/97
gcgugacagggcggcaa

SEQ ID NO: 1086557 - RNA, 21 nt, Mycobacterium bovis subsp bovis AF2122/97
aagcugugccuucgccucguu

SEQ ID NO: 1086558 - RNA, 19 nt, Mycobacterium bovis subsp bovis AF2122/97
aagcuucgggaaccagaug

SEQ ID NO: 1086559 - RNA, 16 nt, Mycobacterium bovis subsp bovis AF2122/97
aagcuugggcgaucgu

SEQ ID NO: 1086560 - RNA, 13 nt, Mycobacterium bovis subsp bovis AF2122/97
gcgugaccaccgc

SEQ ID NO: 1086561 - RNA, 16 nt, Mycobacterium bovis subsp bovis AF2122/97
gcgugaccaccgccga

SEQ ID NO: 1086562 - RNA, 14 nt, Mycobacterium bovis subsp bovis AF2122/97
gcgugacagggcgg

SEQ ID NO: 1086563 - RNA, 14 nt, Mycobacterium bovis subsp bovis AF2122/97
gcgugaccagggcc

SEQ ID NO: 1086564 - RNA, 23 nt, Mycobacterium bovis subsp bovis AF2122/97
gcgugaccagucgcggcguucgg

SEQ ID NO: 1086565 - RNA, 17 nt, Mycobacterium bovis subsp bovis AF2122/97
gcgugaccaccgccgac

SEQ ID NO: 1086566 - RNA, 18 nt, Mycobacterium bovis subsp bovis AF2122/97
gcgugaccaccgccgaca

SEQ ID NO: 1086567 - RNA, 22 nt, Mycobacterium bovis subsp bovis AF2122/97
gcgugaccacugaaccguucga

SEQ ID NO: 1086568 - RNA, 17 nt, Mycobacterium bovis subsp bovis AF2122/97
gcgucugcucaccagcg

SEQ ID NO: 1086569 - RNA, 20 nt, Mycobacterium bovis subsp bovis AF2122/97
gcgucugcucaccagcgguc

SEQ ID NO: 1086570 - RNA, 14 nt, Mycobacterium bovis subsp bovis AF2122/97
gcgucugcucgcca

SEQ ID NO: 1086571 - RNA, 16 nt, Mycobacterium bovis subsp bovis AF2122/97
gcgucugcucgccagc

SEQ ID NO: 1086572 - RNA, 17 nt, Mycobacterium bovis subsp bovis AF2122/97
gcgucugcucgccagcc

SEQ ID NO: 1086573 - RNA, 16 nt, Mycobacterium bovis subsp bovis AF2122/97
gcgugaaccuggcgac

SEQ ID NO: 1086574 - RNA, 18 nt, Mycobacterium bovis subsp bovis AF2122/97
gcgugaaccuggcgacgc

SEQ ID NO: 1086575 - RNA, 20 nt, Mycobacterium bovis subsp bovis AF2122/97
gcgucucggaggcgaccacg

SEQ ID NO: 1086576 - RNA, 14 nt, Mycobacterium bovis subsp bovis AF2122/97
gcgucucgccggga

SEQ ID NO: 1086577 - RNA, 18 nt, Mycobacterium bovis subsp bovis AF2122/97
gcgucugacaucgucgac

SEQ ID NO: 1086578 - RNA, 13 nt, Mycobacterium bovis subsp bovis AF2122/97
gcgucggcgacgc

SEQ ID NO: 1086579 - RNA, 12 nt, Mycobacterium bovis subsp bovis AF2122/97
gcgucggcgaau

SEQ ID NO: 1086580 - RNA, 21 nt, Mycobacterium bovis subsp bovis AF2122/97
gcgucggcgaacagacgcaaa

SEQ ID NO: 1086581 - RNA, 12 nt, Mycobacterium bovis subsp bovis AF2122/97
gcgucggcccgg

SEQ ID NO: 1086582 - RNA, 15 nt, Mycobacterium bovis subsp bovis AF2122/97
gcgucggcccggugc

SEQ ID NO: 1086583 - RNA, 16 nt, Mycobacterium bovis subsp bovis AF2122/97
gcgucggcccggugcu

SEQ ID NO: 1086584 - RNA, 23 nt, Mycobacterium bovis subsp bovis AF2122/97
gcgucggcgaugaacagcgacgc

SEQ ID NO: 1086585 - RNA, 14 nt, Mycobacterium bovis subsp bovis AF2122/97
gcgucggcgcccag

SEQ ID NO: 1086586 - RNA, 15 nt, Mycobacterium bovis subsp bovis AF2122/97
gcgucggcgcccagc

SEQ ID NO: 1086587 - RNA, 19 nt, Mycobacterium bovis subsp bovis AF2122/97
gcgucgucgaguuggccau

SEQ ID NO: 1086588 - RNA, 15 nt, Mycobacterium bovis subsp bovis AF2122/97
gcgucgucggcggcg

SEQ ID NO: 1086589 - RNA, 16 nt, Mycobacterium bovis subsp bovis AF2122/97
gcgucgucggcggcga

SEQ ID NO: 1086590 - RNA, 14 nt, Mycobacterium bovis subsp bovis AF2122/97
gcgucgucgcgcug

SEQ ID NO: 1086591 - RNA, 22 nt, Mycobacterium bovis subsp bovis AF2122/97
gcgucgucgguaaugccgggcc

SEQ ID NO: 1086592 - RNA, 14 nt, Mycobacterium bovis subsp bovis AF2122/97
gcgucguugaggaa

SEQ ID NO: 1086593 - RNA, 24 nt, Mycobacterium bovis subsp bovis AF2122/97
gcgucgugcgcggccggcacgacc

SEQ ID NO: 1086594 - RNA, 23 nt, Mycobacterium bovis subsp bovis AF2122/97
gcgucguugaggaagcccgaugc

SEQ ID NO: 1086595 - RNA, 20 nt, Mycobacterium bovis subsp bovis AF2122/97
gcgucguugcucggucucgu

SEQ ID NO: 1086596 - RNA, 19 nt, Mycobacterium bovis subsp bovis AF2122/97
gcgucguugucgucgccgg

SEQ ID NO: 1086597 - RNA, 23 nt, Mycobacterium bovis subsp bovis AF2122/97
gcgucguugucgucgccggcggc

SEQ ID NO: 1086598 - RNA, 17 nt, Mycobacterium bovis subsp bovis AF2122/97
gcgucguuugggugcgc

SEQ ID NO: 1086599 - RNA, 16 nt, Mycobacterium bovis subsp bovis AF2122/97
gcgucuaccaaccggu

SEQ ID NO: 1086600 - RNA, 15 nt, Mycobacterium bovis subsp bovis AF2122/97
gcgucgucuugaccg

SEQ ID NO: 1086601 - RNA, 20 nt, Mycobacterium bovis subsp bovis AF2122/97
gcgucguggcuuccgguggu

SEQ ID NO: 1086602 - RNA, 23 nt, Mycobacterium bovis subsp bovis AF2122/97
gcgucguggcuuccggugguguc

SEQ ID NO: 1086603 - RNA, 21 nt, Mycobacterium bovis subsp bovis AF2122/97
gcgucguggggaccggcaggc

SEQ ID NO: 1086604 - RNA, 20 nt, Mycobacterium bovis subsp bovis AF2122/97
gcgucgugcgauucacacuc

SEQ ID NO: 1086605 - RNA, 22 nt, Mycobacterium bovis subsp bovis AF2122/97
gcgucguggucggcgaccccga

SEQ ID NO: 1086606 - RNA, 18 nt, Mycobacterium bovis subsp bovis AF2122/97
gcguggcggggccgcgcc

SEQ ID NO: 1086607 - RNA, 23 nt, Mycobacterium bovis subsp bovis AF2122/97
gcguggucaccccuucgccagcg

SEQ ID NO: 1086608 - RNA, 23 nt, Mycobacterium bovis subsp bovis AF2122/97
gcguggucggcaaagcgcucgua

SEQ ID NO: 1086609 - RNA, 15 nt, Mycobacterium bovis subsp bovis AF2122/97
gcguggucgccccga

SEQ ID NO: 1086610 - RNA, 18 nt, Mycobacterium bovis subsp bovis AF2122/97
gcguggucgggaacccgg

SEQ ID NO: 1086611 - RNA, 18 nt, Mycobacterium bovis subsp bovis AF2122/97
gcguggucucggucagcc

SEQ ID NO: 1086612 - RNA, 12 nt, Mycobacterium bovis subsp bovis AF2122/97
gcguggugcuga

SEQ ID NO: 1086613 - RNA, 14 nt, Mycobacterium bovis subsp bovis AF2122/97
gcguggugagcagu

SEQ ID NO: 1086614 - RNA, 15 nt, Mycobacterium bovis subsp bovis AF2122/97
gcgugguguccaccg

SEQ ID NO: 1086615 - RNA, 19 nt, Mycobacterium bovis subsp bovis AF2122/97
gcguguagccugcggcggu

SEQ ID NO: 1086616 - RNA, 23 nt, Mycobacterium bovis subsp bovis AF2122/97
gcgugguuccggcgugcagcacc

SEQ ID NO: 1086617 - RNA, 19 nt, Mycobacterium bovis subsp bovis AF2122/97
gcguguaaccccaggcgcu

SEQ ID NO: 1086618 - RNA, 23 nt, Mycobacterium bovis subsp bovis AF2122/97
gcguguaaccccaggcgcugccg

SEQ ID NO: 1086619 - RNA, 14 nt, Mycobacterium bovis subsp bovis AF2122/97
gcguggcgccggcc

SEQ ID NO: 1086620 - RNA, 21 nt, Mycobacterium bovis subsp bovis AF2122/97
gcguggccgccggcgcuggcg

SEQ ID NO: 1086621 - RNA, 19 nt, Mycobacterium bovis subsp bovis AF2122/97
gcguggcgcaccaccgccc

SEQ ID NO: 1086622 - RNA, 21 nt, Mycobacterium bovis subsp bovis AF2122/97
gcguggcgaaccaggggucgc

SEQ ID NO: 1086623 - RNA, 15 nt, Mycobacterium bovis subsp bovis AF2122/97
gcguggcgcaccacc

SEQ ID NO: 1086624 - RNA, 16 nt, Mycobacterium bovis subsp bovis AF2122/97
gcguggcgcaccaccg

SEQ ID NO: 1086625 - RNA, 12 nt, Mycobacterium bovis subsp bovis AF2122/97
gcgugcgcgucg

SEQ ID NO: 1086626 - RNA, 13 nt, Mycobacterium bovis subsp bovis AF2122/97
gcgugcgcuggcu

SEQ ID NO: 1086627 - RNA, 13 nt, Mycobacterium bovis subsp bovis AF2122/97
gcgugcgcuggug

SEQ ID NO: 1086628 - RNA, 20 nt, Mycobacterium bovis subsp bovis AF2122/97
gcgugcgcugguggcggcga

SEQ ID NO: 1086629 - RNA, 19 nt, Mycobacterium bovis subsp bovis AF2122/97
gcgugcggacugacgucga

SEQ ID NO: 1086630 - RNA, 14 nt, Mycobacterium bovis subsp bovis AF2122/97
gcgugcccgccacc

SEQ ID NO: 1086631 - RNA, 13 nt, Mycobacterium bovis subsp bovis AF2122/97
gcgugcccgccac

SEQ ID NO: 1086632 - RNA, 17 nt, Mycobacterium bovis subsp bovis AF2122/97
gcgugccgaacagggag

SEQ ID NO: 1086633 - RNA, 22 nt, Mycobacterium bovis subsp bovis AF2122/97
gcgugccgcaaccggcgaucgg

SEQ ID NO: 1086634 - RNA, 15 nt, Mycobacterium bovis subsp bovis AF2122/97
gcgugccgccgcaga

SEQ ID NO: 1086635 - RNA, 22 nt, Mycobacterium bovis subsp bovis AF2122/97
gcgugcgacgauaucgggagcg

SEQ ID NO: 1086636 - RNA, 21 nt, Mycobacterium bovis subsp bovis AF2122/97
gcgugccggggauaucacgac

SEQ ID NO: 1086637 - RNA, 15 nt, Mycobacterium bovis subsp bovis AF2122/97
gcgugccgaccagca

SEQ ID NO: 1086638 - RNA, 16 nt, Mycobacterium bovis subsp bovis AF2122/97
gcgugcgauucugcgu

SEQ ID NO: 1086639 - RNA, 12 nt, Mycobacterium bovis subsp bovis AF2122/97
gcgugcgcacgg

SEQ ID NO: 1086640 - RNA, 18 nt, Mycobacterium bovis subsp bovis AF2122/97
gcgugcgcacggcgccga

SEQ ID NO: 1086641 - RNA, 20 nt, Mycobacterium bovis subsp bovis AF2122/97
gcgugcaggcugucaauccg

SEQ ID NO: 1086642 - RNA, 20 nt, Mycobacterium bovis subsp bovis AF2122/97
gcgugcauaggccgcgucga

SEQ ID NO: 1086643 - RNA, 17 nt, Mycobacterium bovis subsp bovis AF2122/97
gcgugcaucgccugcgc

SEQ ID NO: 1086644 - RNA, 12 nt, Mycobacterium bovis subsp bovis AF2122/97
gcgugcaucgcg

SEQ ID NO: 1086645 - RNA, 13 nt, Mycobacterium bovis subsp bovis AF2122/97
gcgugccagcgcc

SEQ ID NO: 1086646 - RNA, 12 nt, Mycobacterium bovis subsp bovis AF2122/97
gcgugccagcgc

SEQ ID NO: 1086647 - RNA, 23 nt, Mycobacterium bovis subsp bovis AF2122/97
gcgugcaucgcgauuccggcggc

SEQ ID NO: 1086648 - RNA, 13 nt, Mycobacterium bovis subsp bovis AF2122/97
gcgugcagcggcg

SEQ ID NO: 1086649 - RNA, 16 nt, Mycobacterium bovis subsp bovis AF2122/97
gcgugcagcggcgccg

SEQ ID NO: 1086650 - RNA, 18 nt, Mycobacterium bovis subsp bovis AF2122/97
gcgugcagcggcgccgcc

SEQ ID NO: 1086651 - RNA, 19 nt, Mycobacterium bovis subsp bovis AF2122/97
gcgugcagcggcgccgcca

SEQ ID NO: 1086652 - RNA, 17 nt, Mycobacterium bovis subsp bovis AF2122/97
gcgugcagcggcgggcg

SEQ ID NO: 1086653 - RNA, 14 nt, Mycobacterium bovis subsp bovis AF2122/97
gcugcggccagcgc

SEQ ID NO: 1086654 - RNA, 21 nt, Mycobacterium bovis subsp bovis AF2122/97
gcugcggccagcgcggcgcgc

SEQ ID NO: 1086655 - RNA, 13 nt, Mycobacterium bovis subsp bovis AF2122/97
gcugcggcccaca

SEQ ID NO: 1086656 - RNA, 16 nt, Mycobacterium bovis subsp bovis AF2122/97
gcugcggcccacacca

SEQ ID NO: 1086657 - RNA, 20 nt, Mycobacterium bovis subsp bovis AF2122/97
gcugcggcccacaccagcgc

SEQ ID NO: 1086658 - RNA, 18 nt, Mycobacterium bovis subsp bovis AF2122/97
gcugcggauccaccacgc

SEQ ID NO: 1086659 - RNA, 19 nt, Mycobacterium bovis subsp bovis AF2122/97
gcugcggauuaagucggcg

SEQ ID NO: 1086660 - RNA, 17 nt, Mycobacterium bovis subsp bovis AF2122/97
gcugcggcaacgagguc

SEQ ID NO: 1086661 - RNA, 18 nt, Mycobacterium bovis subsp bovis AF2122/97
gcugcggcaacgaggucu

SEQ ID NO: 1086662 - RNA, 12 nt, Mycobacterium bovis subsp bovis AF2122/97
gcugcgcuggua

SEQ ID NO: 1086663 - RNA, 20 nt, Mycobacterium bovis subsp bovis AF2122/97
gcugcggacaagucggcacc

SEQ ID NO: 1086664 - RNA, 18 nt, Mycobacterium bovis subsp bovis AF2122/97
gcugcggauacagccgcc

SEQ ID NO: 1086665 - RNA, 22 nt, Mycobacterium bovis subsp bovis AF2122/97
gcugcggauacagccgccgccg

SEQ ID NO: 1086666 - RNA, 17 nt, Mycobacterium bovis subsp bovis AF2122/97
gcugcgcuacccagcgc

SEQ ID NO: 1086667 - RNA, 17 nt, Mycobacterium bovis subsp bovis AF2122/97
gcugcgcaucgccacca

SEQ ID NO: 1086668 - RNA, 19 nt, Mycobacterium bovis subsp bovis AF2122/97
gcugcgcaucgccaccauc

SEQ ID NO: 1086669 - RNA, 16 nt, Mycobacterium bovis subsp bovis AF2122/97
gcugcgcaccgccgcg

SEQ ID NO: 1086670 - RNA, 17 nt, Mycobacterium bovis subsp bovis AF2122/97
gcugcgcaccgccgcgc

SEQ ID NO: 1086671 - RNA, 17 nt, Mycobacterium bovis subsp bovis AF2122/97
gcugcgcagcgcaacau

SEQ ID NO: 1086672 - RNA, 15 nt, Mycobacterium bovis subsp bovis AF2122/97
gcugcgaucaccccc

SEQ ID NO: 1086673 - RNA, 15 nt, Mycobacterium bovis subsp bovis AF2122/97
gcugcgaucgccgcg

SEQ ID NO: 1086674 - RNA, 19 nt, Mycobacterium bovis subsp bovis AF2122/97
gcugcgagaucgcggcgac

SEQ ID NO: 1086675 - RNA, 23 nt, Mycobacterium bovis subsp bovis AF2122/97
gcugcgagaucgcggcgacccgg

SEQ ID NO: 1086676 - RNA, 17 nt, Mycobacterium bovis subsp bovis AF2122/97
gcugcgcaauagcgaca

SEQ ID NO: 1086677 - RNA, 22 nt, Mycobacterium bovis subsp bovis AF2122/97
gcugcgcaauagcgacagcagc

SEQ ID NO: 1086678 - RNA, 20 nt, Mycobacterium bovis subsp bovis AF2122/97
gcugcgacaggacgucggcg

SEQ ID NO: 1086679 - RNA, 14 nt, Mycobacterium bovis subsp bovis AF2122/97
gcugcgacgaugcc

SEQ ID NO: 1086680 - RNA, 15 nt, Mycobacterium bovis subsp bovis AF2122/97
gcugcgacgaugccg

SEQ ID NO: 1086681 - RNA, 16 nt, Mycobacterium bovis subsp bovis AF2122/97
gcugcgaagccgagca

SEQ ID NO: 1086682 - RNA, 21 nt, Mycobacterium bovis subsp bovis AF2122/97
gcugccuuggcgcggcacccg

SEQ ID NO: 1086683 - RNA, 18 nt, Mycobacterium bovis subsp bovis AF2122/97
gcugccuugggaccgcgc

SEQ ID NO: 1086684 - RNA, 19 nt, Mycobacterium bovis subsp bovis AF2122/97
gcugccuucggcgagcggu

SEQ ID NO: 1086685 - RNA, 17 nt, Mycobacterium bovis subsp bovis AF2122/97
gcugccuuggcgcggca

SEQ ID NO: 1086686 - RNA, 14 nt, Mycobacterium bovis subsp bovis AF2122/97
gcugccgucggaga

SEQ ID NO: 1086687 - RNA, 22 nt, Mycobacterium bovis subsp bovis AF2122/97
gcugccgucggagaccagcucg

SEQ ID NO: 1086688 - RNA, 16 nt, Mycobacterium bovis subsp bovis AF2122/97
gcugccgucggugccg

SEQ ID NO: 1086689 - RNA, 15 nt, Mycobacterium bovis subsp bovis AF2122/97
gcugccgucuccugg

SEQ ID NO: 1086690 - RNA, 16 nt, Mycobacterium bovis subsp bovis AF2122/97
gcugccguggcggcag

SEQ ID NO: 1086691 - RNA, 16 nt, Mycobacterium bovis subsp bovis AF2122/97
gcugccguuggggugg

SEQ ID NO: 1086692 - RNA, 18 nt, Mycobacterium bovis subsp bovis AF2122/97
gcugccucccuuccgcgc

SEQ ID NO: 1086693 - RNA, 13 nt, Mycobacterium bovis subsp bovis AF2122/97
gcugccugccgcg

SEQ ID NO: 1086694 - RNA, 12 nt, Mycobacterium bovis subsp bovis AF2122/97
gcugccggugua

SEQ ID NO: 1086695 - RNA, 12 nt, Mycobacterium bovis subsp bovis AF2122/97
gcugccgguguc

SEQ ID NO: 1086696 - RNA, 17 nt, Mycobacterium bovis subsp bovis AF2122/97
gcugccggugugcggcg

SEQ ID NO: 1086697 - RNA, 20 nt, Mycobacterium bovis subsp bovis AF2122/97
gcugccggugugcggcguac

SEQ ID NO: 1086698 - RNA, 16 nt, Mycobacterium bovis subsp bovis AF2122/97
gcugcccgccagcgcc

SEQ ID NO: 1086699 - RNA, 18 nt, Mycobacterium bovis subsp bovis AF2122/97
gcugcccgccagcgccgc

SEQ ID NO: 1086700 - RNA, 20 nt, Mycobacterium bovis subsp bovis AF2122/97
gcugcccgccagcgccgccg

SEQ ID NO: 1086701 - RNA, 18 nt, Mycobacterium bovis subsp bovis AF2122/97
gcugccgucagcugaccg

SEQ ID NO: 1086702 - RNA, 23 nt, Mycobacterium bovis subsp bovis AF2122/97
gcugccgguguuguaggccgggc

SEQ ID NO: 1086703 - RNA, 20 nt, Mycobacterium bovis subsp bovis AF2122/97
gcugccguauccaggcgugc

SEQ ID NO: 1086704 - RNA, 22 nt, Mycobacterium bovis subsp bovis AF2122/97
gcugccguauccaggcgugcau

SEQ ID NO: 1086705 - RNA, 18 nt, Mycobacterium bovis subsp bovis AF2122/97
gcugcccgcgcggccaau

SEQ ID NO: 1086706 - RNA, 14 nt, Mycobacterium bovis subsp bovis AF2122/97
gcugcccgccgccc

SEQ ID NO: 1086707 - RNA, 14 nt, Mycobacterium bovis subsp bovis AF2122/97
gcugcccgaguucg

SEQ ID NO: 1086708 - RNA, 14 nt, Mycobacterium bovis subsp bovis AF2122/97
gcugcccgccagcg

SEQ ID NO: 1086709 - RNA, 15 nt, Mycobacterium bovis subsp bovis AF2122/97
gcugcccgccagcgc

SEQ ID NO: 1086710 - RNA, 12 nt, Mycobacterium bovis subsp bovis AF2122/97
gcugcccgacgu

SEQ ID NO: 1086711 - RNA, 15 nt, Mycobacterium bovis subsp bovis AF2122/97
gcugcccgagaucgc

SEQ ID NO: 1086712 - RNA, 16 nt, Mycobacterium bovis subsp bovis AF2122/97
gcugcaccuggcgcag

SEQ ID NO: 1086713 - RNA, 13 nt, Mycobacterium bovis subsp bovis AF2122/97
gcugcacgcucgu

SEQ ID NO: 1086714 - RNA, 14 nt, Mycobacterium bovis subsp bovis AF2122/97
gcugcacgcucguu

SEQ ID NO: 1086715 - RNA, 13 nt, Mycobacterium bovis subsp bovis AF2122/97
gcugcacgcugcg

SEQ ID NO: 1086716 - RNA, 17 nt, Mycobacterium bovis subsp bovis AF2122/97
gcugcacggaaucgcau

SEQ ID NO: 1086717 - RNA, 20 nt, Mycobacterium bovis subsp bovis AF2122/97
gcugcagugacucgaucacc

SEQ ID NO: 1086718 - RNA, 15 nt, Mycobacterium bovis subsp bovis AF2122/97
gcugcagugccgcac

SEQ ID NO: 1086719 - RNA, 22 nt, Mycobacterium bovis subsp bovis AF2122/97
gcugcagucagcuccgcgcagc

SEQ ID NO: 1086720 - RNA, 18 nt, Mycobacterium bovis subsp bovis AF2122/97
gcugcagugacucgauca

SEQ ID NO: 1086721 - RNA, 21 nt, Mycobacterium bovis subsp bovis AF2122/97
gcugccaccgcgguggcggcg

SEQ ID NO: 1086722 - RNA, 18 nt, Mycobacterium bovis subsp bovis AF2122/97
gcugccaccggccggcgc

SEQ ID NO: 1086723 - RNA, 22 nt, Mycobacterium bovis subsp bovis AF2122/97
gcugccacuagcauugucgccg

SEQ ID NO: 1086724 - RNA, 20 nt, Mycobacterium bovis subsp bovis AF2122/97
gcugccagaucggucggcca

SEQ ID NO: 1086725 - RNA, 16 nt, Mycobacterium bovis subsp bovis AF2122/97
gcugccagccgaagcc

SEQ ID NO: 1086726 - RNA, 18 nt, Mycobacterium bovis subsp bovis AF2122/97
gcugccagcgccgccgcc

SEQ ID NO: 1086727 - RNA, 17 nt, Mycobacterium bovis subsp bovis AF2122/97
gcugcauacaaccccgc

SEQ ID NO: 1086728 - RNA, 21 nt, Mycobacterium bovis subsp bovis AF2122/97
gcugcauacaaccccgcgcug

SEQ ID NO: 1086729 - RNA, 16 nt, Mycobacterium bovis subsp bovis AF2122/97
gcugcagugccgcacc

SEQ ID NO: 1086730 - RNA, 19 nt, Mycobacterium bovis subsp bovis AF2122/97
gcugccagugccgcccacc

SEQ ID NO: 1086731 - RNA, 17 nt, Mycobacterium bovis subsp bovis AF2122/97
gcugccagggugcgccg

SEQ ID NO: 1086732 - RNA, 17 nt, Mycobacterium bovis subsp bovis AF2122/97
gcugccagccgaagccg

SEQ ID NO: 1086733 - RNA, 17 nt, Mycobacterium bovis subsp bovis AF2122/97
gcugccaucccgauccc

SEQ ID NO: 1086734 - RNA, 18 nt, Mycobacterium bovis subsp bovis AF2122/97
gcugccaucccgaucccg

SEQ ID NO: 1086735 - RNA, 14 nt, Mycobacterium bovis subsp bovis AF2122/97
gcugccaggccgcu

SEQ ID NO: 1086736 - RNA, 19 nt, Mycobacterium bovis subsp bovis AF2122/97
gcugccaucggcaccagcg

SEQ ID NO: 1086737 - RNA, 22 nt, Mycobacterium bovis subsp bovis AF2122/97
gcugccccgccaccucgccggc

SEQ ID NO: 1086738 - RNA, 23 nt, Mycobacterium bovis subsp bovis AF2122/97
gcugccccgccaccucgccggcc

SEQ ID NO: 1086739 - RNA, 15 nt, Mycobacterium bovis subsp bovis AF2122/97
gcugccccuccgggc

SEQ ID NO: 1086740 - RNA, 18 nt, Mycobacterium bovis subsp bovis AF2122/97
gcugacggccauggacgc

SEQ ID NO: 1086741 - RNA, 16 nt, Mycobacterium bovis subsp bovis AF2122/97
gcugacggccugcaac

SEQ ID NO: 1086742 - RNA, 19 nt, Mycobacterium bovis subsp bovis AF2122/97
gcugacgcccuccuggcgg

SEQ ID NO: 1086743 - RNA, 22 nt, Mycobacterium bovis subsp bovis AF2122/97
gcugacgcccuccuggcgggug

SEQ ID NO: 1086744 - RNA, 13 nt, Mycobacterium bovis subsp bovis AF2122/97
gcugacgccgagc

SEQ ID NO: 1086745 - RNA, 20 nt, Mycobacterium bovis subsp bovis AF2122/97
gcugacgcugcucuggacgg

SEQ ID NO: 1086746 - RNA, 13 nt, Mycobacterium bovis subsp bovis AF2122/97
gcugacggcgcaa

SEQ ID NO: 1086747 - RNA, 21 nt, Mycobacterium bovis subsp bovis AF2122/97
gcugaugccgucuuugucacg

SEQ ID NO: 1086748 - RNA, 12 nt, Mycobacterium bovis subsp bovis AF2122/97
gcugaugccguc

SEQ ID NO: 1086749 - RNA, 18 nt, Mycobacterium bovis subsp bovis AF2122/97
gcugaugcccuugcggaa

SEQ ID NO: 1086750 - RNA, 16 nt, Mycobacterium bovis subsp bovis AF2122/97
gcugacuagggucacc

SEQ ID NO: 1086751 - RNA, 17 nt, Mycobacterium bovis subsp bovis AF2122/97
gcugacuagggucaccg

SEQ ID NO: 1086752 - RNA, 18 nt, Mycobacterium bovis subsp bovis AF2122/97
gcugacuccugcggcacc

SEQ ID NO: 1086753 - RNA, 20 nt, Mycobacterium bovis subsp bovis AF2122/97
gcugacuccugcggcaccgc

SEQ ID NO: 1086754 - RNA, 18 nt, Mycobacterium bovis subsp bovis AF2122/97
gcugacuagggucaccga

SEQ ID NO: 1086755 - RNA, 15 nt, Mycobacterium bovis subsp bovis AF2122/97
gcugaugccuggucg

SEQ ID NO: 1086756 - RNA, 16 nt, Mycobacterium bovis subsp bovis AF2122/97
gcugauggacggugcg

SEQ ID NO: 1086757 - RNA, 17 nt, Mycobacterium bovis subsp bovis AF2122/97
gcugauggugccgaacc

SEQ ID NO: 1086758 - RNA, 18 nt, Mycobacterium bovis subsp bovis AF2122/97
gcugauggugcugcggcg

SEQ ID NO: 1086759 - RNA, 21 nt, Mycobacterium bovis subsp bovis AF2122/97
gcugauggugcugcggcgucc

SEQ ID NO: 1086760 - RNA, 13 nt, Mycobacterium bovis subsp bovis AF2122/97
gcugaugucgccg

SEQ ID NO: 1086761 - RNA, 22 nt, Mycobacterium bovis subsp bovis AF2122/97
gcugaugucgccggugucgacg

SEQ ID NO: 1086762 - RNA, 23 nt, Mycobacterium bovis subsp bovis AF2122/97
gcugaugucgccggugucgacgg

SEQ ID NO: 1086763 - RNA, 20 nt, Mycobacterium bovis subsp bovis AF2122/97
gcugauuaccgacaccgugu

SEQ ID NO: 1086764 - RNA, 17 nt, Mycobacterium bovis subsp bovis AF2122/97
gcugcaccuccgacggc

SEQ ID NO: 1086765 - RNA, 13 nt, Mycobacterium bovis subsp bovis AF2122/97
gcugcaacaucga

SEQ ID NO: 1086766 - RNA, 13 nt, Mycobacterium bovis subsp bovis AF2122/97
gcugcaccggcuu

SEQ ID NO: 1086767 - RNA, 19 nt, Mycobacterium bovis subsp bovis AF2122/97
gcugcaccguuuccggcgc

SEQ ID NO: 1086768 - RNA, 23 nt, Mycobacterium bovis subsp bovis AF2122/97
gcugauuguguuccaccagcgcc

SEQ ID NO: 1086769 - RNA, 14 nt, Mycobacterium bovis subsp bovis AF2122/97
gcuggcaggauacc

SEQ ID NO: 1086770 - RNA, 16 nt, Mycobacterium bovis subsp bovis AF2122/97
gcuggcaggauaccga

SEQ ID NO: 1086771 - RNA, 17 nt, Mycobacterium bovis subsp bovis AF2122/97
gcuggcaggccgggcac

SEQ ID NO: 1086772 - RNA, 16 nt, Mycobacterium bovis subsp bovis AF2122/97
gcuggcauaggaucgc

SEQ ID NO: 1086773 - RNA, 19 nt, Mycobacterium bovis subsp bovis AF2122/97
gcuggcauaggaucgcgcc

SEQ ID NO: 1086774 - RNA, 19 nt, Mycobacterium bovis subsp bovis AF2122/97
gcuggcaaucccgcggucg

SEQ ID NO: 1086775 - RNA, 20 nt, Mycobacterium bovis subsp bovis AF2122/97
gcuggcaaucccgcggucga

SEQ ID NO: 1086776 - RNA, 14 nt, Mycobacterium bovis subsp bovis AF2122/97
gcuggcaccagcac

SEQ ID NO: 1086777 - RNA, 18 nt, Mycobacterium bovis subsp bovis AF2122/97
gcuggcaccagcacacuc

SEQ ID NO: 1086778 - RNA, 17 nt, Mycobacterium bovis subsp bovis AF2122/97
gcuggcaacgccgcgcc

SEQ ID NO: 1086779 - RNA, 18 nt, Mycobacterium bovis subsp bovis AF2122/97
gcuggcaccucccgggcg

SEQ ID NO: 1086780 - RNA, 24 nt, Mycobacterium bovis subsp bovis AF2122/97
gcuggcacacuguuacuccgacgg

SEQ ID NO: 1086781 - RNA, 16 nt, Mycobacterium bovis subsp bovis AF2122/97
gcuggcagacucgagg

SEQ ID NO: 1086782 - RNA, 12 nt, Mycobacterium bovis subsp bovis AF2122/97
gcuggccagccc

SEQ ID NO: 1086783 - RNA, 18 nt, Mycobacterium bovis subsp bovis AF2122/97
gcuggccagcacaccguc

SEQ ID NO: 1086784 - RNA, 20 nt, Mycobacterium bovis subsp bovis AF2122/97
gcuggccagcacaccgucga

SEQ ID NO: 1086785 - RNA, 15 nt, Mycobacterium bovis subsp bovis AF2122/97
gcuggccagcgcgcu

SEQ ID NO: 1086786 - RNA, 20 nt, Mycobacterium bovis subsp bovis AF2122/97
gcuggccagguugccgucgg

SEQ ID NO: 1086787 - RNA, 19 nt, Mycobacterium bovis subsp bovis AF2122/97
gcuggccagcacgcccgcg

SEQ ID NO: 1086788 - RNA, 20 nt, Mycobacterium bovis subsp bovis AF2122/97
gcuggccagcacgcccucga

SEQ ID NO: 1086789 - RNA, 12 nt, Mycobacterium bovis subsp bovis AF2122/97
gcuggccagcac

SEQ ID NO: 1086790 - RNA, 12 nt, Mycobacterium bovis subsp bovis AF2122/97
gcuggccaccgc

SEQ ID NO: 1086791 - RNA, 17 nt, Mycobacterium bovis subsp bovis AF2122/97
gcuggcgagcagacgcg

SEQ ID NO: 1086792 - RNA, 17 nt, Mycobacterium bovis subsp bovis AF2122/97
gcuggcgaccuggucgc

SEQ ID NO: 1086793 - RNA, 20 nt, Mycobacterium bovis subsp bovis AF2122/97
gcuggcccgccagaacggcg

SEQ ID NO: 1086794 - RNA, 21 nt, Mycobacterium bovis subsp bovis AF2122/97
gcuggcccggcuacgacggcg

SEQ ID NO: 1086795 - RNA, 16 nt, Mycobacterium bovis subsp bovis AF2122/97
gcuggcccgcaugccg

SEQ ID NO: 1086796 - RNA, 18 nt, Mycobacterium bovis subsp bovis AF2122/97
gcuggcccgcaugccggc

SEQ ID NO: 1086797 - RNA, 20 nt, Mycobacterium bovis subsp bovis AF2122/97
gcuggccgauguaguccggc

SEQ ID NO: 1086798 - RNA, 16 nt, Mycobacterium bovis subsp bovis AF2122/97
gcuggccgacucgagg

SEQ ID NO: 1086799 - RNA, 14 nt, Mycobacterium bovis subsp bovis AF2122/97
gcuggccgccaccg

SEQ ID NO: 1086800 - RNA, 19 nt, Mycobacterium bovis subsp bovis AF2122/97
gcuggccgccaccgcacgc

SEQ ID NO: 1086801 - RNA, 15 nt, Mycobacterium bovis subsp bovis AF2122/97
gcuggccgcgaggua

SEQ ID NO: 1086802 - RNA, 14 nt, Mycobacterium bovis subsp bovis AF2122/97
gcuggccgcgaucg

SEQ ID NO: 1086803 - RNA, 14 nt, Mycobacterium bovis subsp bovis AF2122/97
gcuggccgccuccg

SEQ ID NO: 1086804 - RNA, 20 nt, Mycobacterium bovis subsp bovis AF2122/97
gcuggccgccuccgcggcau

SEQ ID NO: 1086805 - RNA, 16 nt, Mycobacterium bovis subsp bovis AF2122/97
gcuggccgcggcuggu

SEQ ID NO: 1086806 - RNA, 21 nt, Mycobacterium bovis subsp bovis AF2122/97
gcuggccgggugcgugcgcgu

SEQ ID NO: 1086807 - RNA, 14 nt, Mycobacterium bovis subsp bovis AF2122/97
gcuggccgucgaag

SEQ ID NO: 1086808 - RNA, 21 nt, Mycobacterium bovis subsp bovis AF2122/97
gcuggccguaacgcggaucgg

SEQ ID NO: 1086809 - RNA, 18 nt, Mycobacterium bovis subsp bovis AF2122/97
gcuggccgucagcgucgg

SEQ ID NO: 1086810 - RNA, 21 nt, Mycobacterium bovis subsp bovis AF2122/97
gcugcuucuucggacagcagc

SEQ ID NO: 1086811 - RNA, 14 nt, Mycobacterium bovis subsp bovis AF2122/97
gcugcuugcgcccg

SEQ ID NO: 1086812 - RNA, 19 nt, Mycobacterium bovis subsp bovis AF2122/97
gcugcuuggcggucugcgc

SEQ ID NO: 1086813 - RNA, 17 nt, Mycobacterium bovis subsp bovis AF2122/97
gcugcuugucgaggcgc

SEQ ID NO: 1086814 - RNA, 23 nt, Mycobacterium bovis subsp bovis AF2122/97
gcugcuuuaaccgcgucaucacc

SEQ ID NO: 1086815 - RNA, 23 nt, Mycobacterium bovis subsp bovis AF2122/97
gcugcuguugguauuagggccgg

SEQ ID NO: 1086816 - RNA, 16 nt, Mycobacterium bovis subsp bovis AF2122/97
gcugcugaacaccggu

SEQ ID NO: 1086817 - RNA, 19 nt, Mycobacterium bovis subsp bovis AF2122/97
gcugcggcgugccgggugg

SEQ ID NO: 1086818 - RNA, 16 nt, Mycobacterium bovis subsp bovis AF2122/97
gcugcggcuuucagcg

SEQ ID NO: 1086819 - RNA, 15 nt, Mycobacterium bovis subsp bovis AF2122/97
gcugcugccgauaca

SEQ ID NO: 1086820 - RNA, 17 nt, Mycobacterium bovis subsp bovis AF2122/97
gcugcugccgcaccggu

SEQ ID NO: 1086821 - RNA, 15 nt, Mycobacterium bovis subsp bovis AF2122/97
gcugcugcgcggugc

SEQ ID NO: 1086822 - RNA, 14 nt, Mycobacterium bovis subsp bovis AF2122/97
gcuggaggcggcgc

SEQ ID NO: 1086823 - RNA, 19 nt, Mycobacterium bovis subsp bovis AF2122/97
gcuggaggcuccuggucgc

SEQ ID NO: 1086824 - RNA, 16 nt, Mycobacterium bovis subsp bovis AF2122/97
gcuggaggccaccacc

SEQ ID NO: 1086825 - RNA, 15 nt, Mycobacterium bovis subsp bovis AF2122/97
gcuggacuccgguca

SEQ ID NO: 1086826 - RNA, 14 nt, Mycobacterium bovis subsp bovis AF2122/97
gcuggaucaacccg

SEQ ID NO: 1086827 - RNA, 18 nt, Mycobacterium bovis subsp bovis AF2122/97
gcuggaugugggcgcucg

SEQ ID NO: 1086828 - RNA, 14 nt, Mycobacterium bovis subsp bovis AF2122/97
gcuggacggcgggc

SEQ ID NO: 1086829 - RNA, 15 nt, Mycobacterium bovis subsp bovis AF2122/97
gcuggacggcgggcc

SEQ ID NO: 1086830 - RNA, 22 nt, Mycobacterium bovis subsp bovis AF2122/97
gcuggacggcgggccgcgcggc

SEQ ID NO: 1086831 - RNA, 23 nt, Mycobacterium bovis subsp bovis AF2122/97
gcuggacggcgggccgcgcggcg

SEQ ID NO: 1086832 - RNA, 19 nt, Mycobacterium bovis subsp bovis AF2122/97
gcuggaccuccgacgugcc

SEQ ID NO: 1086833 - RNA, 22 nt, Mycobacterium bovis subsp bovis AF2122/97
gcuggaccugaugagcucaccg

SEQ ID NO: 1086834 - RNA, 16 nt, Mycobacterium bovis subsp bovis AF2122/97
gcuggaccacucgccg

SEQ ID NO: 1086835 - RNA, 19 nt, Mycobacterium bovis subsp bovis AF2122/97
gcuggacaacggcggucug

SEQ ID NO: 1086836 - RNA, 20 nt, Mycobacterium bovis subsp bovis AF2122/97
gcuggacaguuacgcuggca

SEQ ID NO: 1086837 - RNA, 19 nt, Mycobacterium bovis subsp bovis AF2122/97
gcucacgggcgaucgugcg

SEQ ID NO: 1086838 - RNA, 13 nt, Mycobacterium bovis subsp bovis AF2122/97
gcucacuacccgc

SEQ ID NO: 1086839 - RNA, 14 nt, Mycobacterium bovis subsp bovis AF2122/97
gcucacuggugacc

SEQ ID NO: 1086840 - RNA, 17 nt, Mycobacterium bovis subsp bovis AF2122/97
gcucacuucacgccgcc

SEQ ID NO: 1086841 - RNA, 19 nt, Mycobacterium bovis subsp bovis AF2122/97
gcucagaacccuccgcacc

SEQ ID NO: 1086842 - RNA, 15 nt, Mycobacterium bovis subsp bovis AF2122/97
gcucacgguuagacg

SEQ ID NO: 1086843 - RNA, 20 nt, Mycobacterium bovis subsp bovis AF2122/97
gcucacgguggccgcaucga

SEQ ID NO: 1086844 - RNA, 16 nt, Mycobacterium bovis subsp bovis AF2122/97
gcucacggacgcuggg

SEQ ID NO: 1086845 - RNA, 22 nt, Mycobacterium bovis subsp bovis AF2122/97
gcucacggacgcugggcgguag

SEQ ID NO: 1086846 - RNA, 12 nt, Mycobacterium bovis subsp bovis AF2122/97
gcucaccggcgc

SEQ ID NO: 1086847 - RNA, 12 nt, Mycobacterium bovis subsp bovis AF2122/97
gcucaccgucga

SEQ ID NO: 1086848 - RNA, 16 nt, Mycobacterium bovis subsp bovis AF2122/97
gcucaccgucgaggua

SEQ ID NO: 1086849 - RNA, 21 nt, Mycobacterium bovis subsp bovis AF2122/97
gcucaccuuuggccgcgaccg

SEQ ID NO: 1086850 - RNA, 18 nt, Mycobacterium bovis subsp bovis AF2122/97
gcucaccggcgucguagg

SEQ ID NO: 1086851 - RNA, 15 nt, Mycobacterium bovis subsp bovis AF2122/97
gcucacgaucacccg

SEQ ID NO: 1086852 - RNA, 19 nt, Mycobacterium bovis subsp bovis AF2122/97
gcucacgaccggccaacgc

SEQ ID NO: 1086853 - RNA, 21 nt, Mycobacterium bovis subsp bovis AF2122/97
gcuccgaugcaucggugcagc

SEQ ID NO: 1086854 - RNA, 14 nt, Mycobacterium bovis subsp bovis AF2122/97
gcuccgaugccgac

SEQ ID NO: 1086855 - RNA, 18 nt, Mycobacterium bovis subsp bovis AF2122/97
gcuccgaugccgacggcg

SEQ ID NO: 1086856 - RNA, 21 nt, Mycobacterium bovis subsp bovis AF2122/97
gcuccgcagcgaagaccagcg

SEQ ID NO: 1086857 - RNA, 17 nt, Mycobacterium bovis subsp bovis AF2122/97
gcuccgaugugccgauu

SEQ ID NO: 1086858 - RNA, 24 nt, Mycobacterium bovis subsp bovis AF2122/97
gcuccgauuccgaacuggucgacg

SEQ ID NO: 1086859 - RNA, 17 nt, Mycobacterium bovis subsp bovis AF2122/97
gcuccgccacuggcgcc

SEQ ID NO: 1086860 - RNA, 16 nt, Mycobacterium bovis subsp bovis AF2122/97
gcuccgccgucgccgc

SEQ ID NO: 1086861 - RNA, 18 nt, Mycobacterium bovis subsp bovis AF2122/97
gcuccgccgccgacggau

SEQ ID NO: 1086862 - RNA, 22 nt, Mycobacterium bovis subsp bovis AF2122/97
gcuccgccagaauugccggcga

SEQ ID NO: 1086863 - RNA, 13 nt, Mycobacterium bovis subsp bovis AF2122/97
gcuccgccgccga

SEQ ID NO: 1086864 - RNA, 21 nt, Mycobacterium bovis subsp bovis AF2122/97
gcuccgccgucgccgccggcg

SEQ ID NO: 1086865 - RNA, 22 nt, Mycobacterium bovis subsp bovis AF2122/97
gcuccgccgucgccgccggcgc

SEQ ID NO: 1086866 - RNA, 15 nt, Mycobacterium bovis subsp bovis AF2122/97
gcuccgccguugccg

SEQ ID NO: 1086867 - RNA, 23 nt, Mycobacterium bovis subsp bovis AF2122/97
gcuccgccugccgcuggucgucg

SEQ ID NO: 1086868 - RNA, 17 nt, Mycobacterium bovis subsp bovis AF2122/97
gcuccgguuggcgcggg

SEQ ID NO: 1086869 - RNA, 21 nt, Mycobacterium bovis subsp bovis AF2122/97
gcuccguaaacgaggucgccg

SEQ ID NO: 1086870 - RNA, 14 nt, Mycobacterium bovis subsp bovis AF2122/97
gcuccuccgguauc

SEQ ID NO: 1086871 - RNA, 18 nt, Mycobacterium bovis subsp bovis AF2122/97
gcuccuccgguaucggcg

SEQ ID NO: 1086872 - RNA, 15 nt, Mycobacterium bovis subsp bovis AF2122/97
gcuccucgcgagucg

SEQ ID NO: 1086873 - RNA, 18 nt, Mycobacterium bovis subsp bovis AF2122/97
gcuccucgcgagucggcg

SEQ ID NO: 1086874 - RNA, 19 nt, Mycobacterium bovis subsp bovis AF2122/97
gcuccucgcgagucggcgg

SEQ ID NO: 1086875 - RNA, 17 nt, Mycobacterium bovis subsp bovis AF2122/97
gcuccuccccggcccgc

SEQ ID NO: 1086876 - RNA, 20 nt, Mycobacterium bovis subsp bovis AF2122/97
gcuccuccccggcccgcuca

SEQ ID NO: 1086877 - RNA, 12 nt, Mycobacterium bovis subsp bovis AF2122/97
gcuccuccggca

SEQ ID NO: 1086878 - RNA, 18 nt, Mycobacterium bovis subsp bovis AF2122/97
gcuccuccggcaccaacg

SEQ ID NO: 1086879 - RNA, 15 nt, Mycobacterium bovis subsp bovis AF2122/97
gcuccucggccagcg

SEQ ID NO: 1086880 - RNA, 17 nt, Mycobacterium bovis subsp bovis AF2122/97
gcuccucgcgcucgccg

SEQ ID NO: 1086881 - RNA, 17 nt, Mycobacterium bovis subsp bovis AF2122/97
gcuccucgugcucggcc

SEQ ID NO: 1086882 - RNA, 20 nt, Mycobacterium bovis subsp bovis AF2122/97
gcuccucgugcucggccaga

SEQ ID NO: 1086883 - RNA, 20 nt, Mycobacterium bovis subsp bovis AF2122/97
gcuccgugguugccgaagcc

SEQ ID NO: 1086884 - RNA, 17 nt, Mycobacterium bovis subsp bovis AF2122/97
gcuccguuguccagcgc

SEQ ID NO: 1086885 - RNA, 21 nt, Mycobacterium bovis subsp bovis AF2122/97
gcuccguuguccagcgcgacg

SEQ ID NO: 1086886 - RNA, 19 nt, Mycobacterium bovis subsp bovis AF2122/97
gcuccucauagagcggcac

SEQ ID NO: 1086887 - RNA, 20 nt, Mycobacterium bovis subsp bovis AF2122/97
gcuccucagccaccgcgguc

SEQ ID NO: 1086888 - RNA, 21 nt, Mycobacterium bovis subsp bovis AF2122/97
gcuccucagccaccgcgguca

SEQ ID NO: 1086889 - RNA, 20 nt, Mycobacterium bovis subsp bovis AF2122/97
gcuccuauggcaagcggccg

SEQ ID NO: 1086890 - RNA, 15 nt, Mycobacterium bovis subsp bovis AF2122/97
gcuccugcaugccgg

SEQ ID NO: 1086891 - RNA, 23 nt, Mycobacterium bovis subsp bovis AF2122/97
gcucgaccugaggcaccucggcc

SEQ ID NO: 1086892 - RNA, 18 nt, Mycobacterium bovis subsp bovis AF2122/97
gcuccucgcgggcggcgu

SEQ ID NO: 1086893 - RNA, 14 nt, Mycobacterium bovis subsp bovis AF2122/97
gcuccucgcgguag

SEQ ID NO: 1086894 - RNA, 20 nt, Mycobacterium bovis subsp bovis AF2122/97
gcucgacggcuccgauuccg

SEQ ID NO: 1086895 - RNA, 21 nt, Mycobacterium bovis subsp bovis AF2122/97
gcucgacgaugcggucaacgc

SEQ ID NO: 1086896 - RNA, 20 nt, Mycobacterium bovis subsp bovis AF2122/97
gcucgacguacagcgcggcg

SEQ ID NO: 1086897 - RNA, 20 nt, Mycobacterium bovis subsp bovis AF2122/97
gcucgacguauuggcgcagc

SEQ ID NO: 1086898 - RNA, 15 nt, Mycobacterium bovis subsp bovis AF2122/97
gcucgacugccaccg

SEQ ID NO: 1086899 - RNA, 16 nt, Mycobacterium bovis subsp bovis AF2122/97
gcucgagagcaugguc

SEQ ID NO: 1086900 - RNA, 23 nt, Mycobacterium bovis subsp bovis AF2122/97
gcucgauaucguuggcgaccacc

SEQ ID NO: 1086901 - RNA, 12 nt, Mycobacterium bovis subsp bovis AF2122/97
gcucgccggcac

SEQ ID NO: 1086902 - RNA, 14 nt, Mycobacterium bovis subsp bovis AF2122/97
gcucgccggccaac

SEQ ID NO: 1086903 - RNA, 23 nt, Mycobacterium bovis subsp bovis AF2122/97
gcucgccgccauuaggcgcggug

SEQ ID NO: 1086904 - RNA, 13 nt, Mycobacterium bovis subsp bovis AF2122/97
gcucgccggccgg

SEQ ID NO: 1086905 - RNA, 15 nt, Mycobacterium bovis subsp bovis AF2122/97
gcucgccggcgaccg

SEQ ID NO: 1086906 - RNA, 13 nt, Mycobacterium bovis subsp bovis AF2122/97
gcucgccggcgcg

SEQ ID NO: 1086907 - RNA, 20 nt, Mycobacterium bovis subsp bovis AF2122/97
gcucgccggcgcgcaccccg

SEQ ID NO: 1086908 - RNA, 17 nt, Mycobacterium bovis subsp bovis AF2122/97
gcucgccggcgcgcacc

SEQ ID NO: 1086909 - RNA, 13 nt, Mycobacterium bovis subsp bovis AF2122/97
gcucgccggguca

SEQ ID NO: 1086910 - RNA, 21 nt, Mycobacterium bovis subsp bovis AF2122/97
gcucgccgggucagcccggcg

SEQ ID NO: 1086911 - RNA, 22 nt, Mycobacterium bovis subsp bovis AF2122/97
gcucgccgggucagcccggcgc

SEQ ID NO: 1086912 - RNA, 16 nt, Mycobacterium bovis subsp bovis AF2122/97
gcucgccggcucggcg

SEQ ID NO: 1086913 - RNA, 20 nt, Mycobacterium bovis subsp bovis AF2122/97
gcucgccggcucggcgguac

SEQ ID NO: 1086914 - RNA, 14 nt, Mycobacterium bovis subsp bovis AF2122/97
gcucgccggugucc

SEQ ID NO: 1086915 - RNA, 18 nt, Mycobacterium bovis subsp bovis AF2122/97
gcucgccguaagcaccag

SEQ ID NO: 1086916 - RNA, 12 nt, Mycobacterium bovis subsp bovis AF2122/97
gcucgccggcgg

SEQ ID NO: 1086917 - RNA, 21 nt, Mycobacterium bovis subsp bovis AF2122/97
gcucgccgguaggcggccagc

SEQ ID NO: 1086918 - RNA, 14 nt, Mycobacterium bovis subsp bovis AF2122/97
gcucgaucagccgg

SEQ ID NO: 1086919 - RNA, 19 nt, Mycobacterium bovis subsp bovis AF2122/97
gcucgauccacugccgcgc

SEQ ID NO: 1086920 - RNA, 20 nt, Mycobacterium bovis subsp bovis AF2122/97
gcucgaucggcagccagggc

SEQ ID NO: 1086921 - RNA, 16 nt, Mycobacterium bovis subsp bovis AF2122/97
gcucgaucugucgcgc

SEQ ID NO: 1086922 - RNA, 23 nt, Mycobacterium bovis subsp bovis AF2122/97
gcucgaucugucgcgccgguggu

SEQ ID NO: 1086923 - RNA, 15 nt, Mycobacterium bovis subsp bovis AF2122/97
gcucgccgacccgcc

SEQ ID NO: 1086924 - RNA, 14 nt, Mycobacterium bovis subsp bovis AF2122/97
gcucgccgagcucg

SEQ ID NO: 1086925 - RNA, 20 nt, Mycobacterium bovis subsp bovis AF2122/97
gcucgccgagcugugcgcag

SEQ ID NO: 1086926 - RNA, 11 nt, Mycobacterium bovis subsp bovis AF2122/97
gcucgccgagg

SEQ ID NO: 1086927 - RNA, 15 nt, Mycobacterium bovis subsp bovis AF2122/97
gcucgcgcucgaugg

SEQ ID NO: 1086928 - RNA, 17 nt, Mycobacterium bovis subsp bovis AF2122/97
gcucgcgcucgauggcg

SEQ ID NO: 1086929 - RNA, 13 nt, Mycobacterium bovis subsp bovis AF2122/97
gcucgcgcucgcu

SEQ ID NO: 1086930 - RNA, 14 nt, Mycobacterium bovis subsp bovis AF2122/97
gcucgcgccgguga

SEQ ID NO: 1086931 - RNA, 15 nt, Mycobacterium bovis subsp bovis AF2122/97
gcucgcgcgcugggc

SEQ ID NO: 1086932 - RNA, 16 nt, Mycobacterium bovis subsp bovis AF2122/97
gcucgcgcgcugggcg

SEQ ID NO: 1086933 - RNA, 16 nt, Mycobacterium bovis subsp bovis AF2122/97
gcucgcucaccggcug

SEQ ID NO: 1086934 - RNA, 21 nt, Mycobacterium bovis subsp bovis AF2122/97
gcucgcucaccggcuggugcc

SEQ ID NO: 1086935 - RNA, 16 nt, Mycobacterium bovis subsp bovis AF2122/97
gcucgcucaccggcgc

SEQ ID NO: 1086936 - RNA, 15 nt, Mycobacterium bovis subsp bovis AF2122/97
gcucgcucaccggcu

SEQ ID NO: 1086937 - RNA, 20 nt, Mycobacterium bovis subsp bovis AF2122/97
gcucgcgcgguagucgucgc

SEQ ID NO: 1086938 - RNA, 22 nt, Mycobacterium bovis subsp bovis AF2122/97
gcucgcgcucguuagcggcggg

SEQ ID NO: 1086939 - RNA, 17 nt, Mycobacterium bovis subsp bovis AF2122/97
gcucgcguggccgccgg

SEQ ID NO: 1086940 - RNA, 21 nt, Mycobacterium bovis subsp bovis AF2122/97
gcucgcguggccgccggcgcu

SEQ ID NO: 1086941 - RNA, 12 nt, Mycobacterium bovis subsp bovis AF2122/97
gcucggccagca

SEQ ID NO: 1086942 - RNA, 13 nt, Mycobacterium bovis subsp bovis AF2122/97
gcucggccagcac

SEQ ID NO: 1086943 - RNA, 15 nt, Mycobacterium bovis subsp bovis AF2122/97
gcucggccagcacgc

SEQ ID NO: 1086944 - RNA, 21 nt, Mycobacterium bovis subsp bovis AF2122/97
gcucggccagcacgccgccgg

SEQ ID NO: 1086945 - RNA, 17 nt, Mycobacterium bovis subsp bovis AF2122/97
gcucggccaggcuggcc

SEQ ID NO: 1086946 - RNA, 23 nt, Mycobacterium bovis subsp bovis AF2122/97
gcucggccaggcuggccaacuug

SEQ ID NO: 1086947 - RNA, 19 nt, Mycobacterium bovis subsp bovis AF2122/97
gcucggccagaaagaucgg

SEQ ID NO: 1086948 - RNA, 15 nt, Mycobacterium bovis subsp bovis AF2122/97
gcucgcuggcgcuga

SEQ ID NO: 1086949 - RNA, 17 nt, Mycobacterium bovis subsp bovis AF2122/97
gcucgcuggcgcugaug

SEQ ID NO: 1086950 - RNA, 21 nt, Mycobacterium bovis subsp bovis AF2122/97
gcucgcuggcgcugaugcugg

SEQ ID NO: 1086951 - RNA, 20 nt, Mycobacterium bovis subsp bovis AF2122/97
gcucgcugaugcaucccaac

SEQ ID NO: 1086952 - RNA, 12 nt, Mycobacterium bovis subsp bovis AF2122/97
gcucgcugacgg

SEQ ID NO: 1086953 - RNA, 22 nt, Mycobacterium bovis subsp bovis AF2122/97
gcucgcugauaguggcgcgcgg

SEQ ID NO: 1086954 - RNA, 15 nt, Mycobacterium bovis subsp bovis AF2122/97
gcucgcugcaccagc

SEQ ID NO: 1086955 - RNA, 16 nt, Mycobacterium bovis subsp bovis AF2122/97
gcucgcucugcgcggc

SEQ ID NO: 1086956 - RNA, 16 nt, Mycobacterium bovis subsp bovis AF2122/97
gcucgucuuggcggcg

SEQ ID NO: 1086957 - RNA, 18 nt, Mycobacterium bovis subsp bovis AF2122/97
gcucgucuuggcggcggu

SEQ ID NO: 1086958 - RNA, 19 nt, Mycobacterium bovis subsp bovis AF2122/97
gcucgucuuggcggcggug

SEQ ID NO: 1086959 - RNA, 20 nt, Mycobacterium bovis subsp bovis AF2122/97
gcucgucuugggccgggaug

SEQ ID NO: 1086960 - RNA, 12 nt, Mycobacterium bovis subsp bovis AF2122/97
gcucgucguaca

SEQ ID NO: 1086961 - RNA, 14 nt, Mycobacterium bovis subsp bovis AF2122/97
gcucgucgucaccg

SEQ ID NO: 1086962 - RNA, 14 nt, Mycobacterium bovis subsp bovis AF2122/97
gcucgucguccggc

SEQ ID NO: 1086963 - RNA, 15 nt, Mycobacterium bovis subsp bovis AF2122/97
gcucgucggcgccgg

SEQ ID NO: 1086964 - RNA, 17 nt, Mycobacterium bovis subsp bovis AF2122/97
gcucgucggcgccggcg

SEQ ID NO: 1086965 - RNA, 18 nt, Mycobacterium bovis subsp bovis AF2122/97
gcucgucggcgccggcgg

SEQ ID NO: 1086966 - RNA, 19 nt, Mycobacterium bovis subsp bovis AF2122/97
gcucgucggcgccggcggc

SEQ ID NO: 1086967 - RNA, 20 nt, Mycobacterium bovis subsp bovis AF2122/97
gcucgucggucaccgaaugc

SEQ ID NO: 1086968 - RNA, 14 nt, Mycobacterium bovis subsp bovis AF2122/97
gcucgucggcgaug

SEQ ID NO: 1086969 - RNA, 13 nt, Mycobacterium bovis subsp bovis AF2122/97
gcucgucggcgcc

SEQ ID NO: 1086970 - RNA, 15 nt, Mycobacterium bovis subsp bovis AF2122/97
gcucgucggccaccg

SEQ ID NO: 1086971 - RNA, 19 nt, Mycobacterium bovis subsp bovis AF2122/97
gcucgucgagcgcgucggu

SEQ ID NO: 1086972 - RNA, 21 nt, Mycobacterium bovis subsp bovis AF2122/97
gcucgucgaaguagccgacgu

SEQ ID NO: 1086973 - RNA, 16 nt, Mycobacterium bovis subsp bovis AF2122/97
gcucgucgagccgacc

SEQ ID NO: 1086974 - RNA, 18 nt, Mycobacterium bovis subsp bovis AF2122/97
gcucgucgagccgaccgc

SEQ ID NO: 1086975 - RNA, 18 nt, Mycobacterium bovis subsp bovis AF2122/97
gcucgucgaguggaucac

SEQ ID NO: 1086976 - RNA, 15 nt, Mycobacterium bovis subsp bovis AF2122/97
gcucgucgauccccg

SEQ ID NO: 1086977 - RNA, 23 nt, Mycobacterium bovis subsp bovis AF2122/97
gcucgucgaugucgacgucgcgu

SEQ ID NO: 1086978 - RNA, 14 nt, Mycobacterium bovis subsp bovis AF2122/97
gcucgucgagcaug

SEQ ID NO: 1086979 - RNA, 22 nt, Mycobacterium bovis subsp bovis AF2122/97
gcucguccucgucuucgucggu

SEQ ID NO: 1086980 - RNA, 23 nt, Mycobacterium bovis subsp bovis AF2122/97
gcucguccgggcagaugaugccg

SEQ ID NO: 1086981 - RNA, 19 nt, Mycobacterium bovis subsp bovis AF2122/97
gcucguccggugcgauccc

SEQ ID NO: 1086982 - RNA, 19 nt, Mycobacterium bovis subsp bovis AF2122/97
gcucguccaccccgauccg

SEQ ID NO: 1086983 - RNA, 23 nt, Mycobacterium bovis subsp bovis AF2122/97
gcucguccaccccgauccgccac

SEQ ID NO: 1086984 - RNA, 14 nt, Mycobacterium bovis subsp bovis AF2122/97
gcucguccagcaac

SEQ ID NO: 1086985 - RNA, 15 nt, Mycobacterium bovis subsp bovis AF2122/97
gcucgguggcgccgg

SEQ ID NO: 1086986 - RNA, 13 nt, Mycobacterium bovis subsp bovis AF2122/97
gcucgguggcgga

SEQ ID NO: 1086987 - RNA, 18 nt, Mycobacterium bovis subsp bovis AF2122/97
gcucgguggcggacggcg

SEQ ID NO: 1086988 - RNA, 16 nt, Mycobacterium bovis subsp bovis AF2122/97
gcucggguggccagcg

SEQ ID NO: 1086989 - RNA, 20 nt, Mycobacterium bovis subsp bovis AF2122/97
gcucggugaugcccagcgcc

SEQ ID NO: 1086990 - RNA, 16 nt, Mycobacterium bovis subsp bovis AF2122/97
gcucggugcacggcgc

SEQ ID NO: 1086991 - RNA, 15 nt, Mycobacterium bovis subsp bovis AF2122/97
gcucggugcgccaga

SEQ ID NO: 1086992 - RNA, 11 nt, Mycobacterium bovis subsp bovis AF2122/97
gcucggugcgc

SEQ ID NO: 1086993 - RNA, 22 nt, Mycobacterium bovis subsp bovis AF2122/97
gcucguagcggcggcgcccggc

SEQ ID NO: 1086994 - RNA, 19 nt, Mycobacterium bovis subsp bovis AF2122/97
gcucgucagguuccgcgac

SEQ ID NO: 1086995 - RNA, 20 nt, Mycobacterium bovis subsp bovis AF2122/97
gcucgucauccauccgggcc

SEQ ID NO: 1086996 - RNA, 12 nt, Mycobacterium bovis subsp bovis AF2122/97
gcucggcccagc

SEQ ID NO: 1086997 - RNA, 18 nt, Mycobacterium bovis subsp bovis AF2122/97
gcucggccccgccgccgg

SEQ ID NO: 1086998 - RNA, 16 nt, Mycobacterium bovis subsp bovis AF2122/97
gcucggcgaccgucgg

SEQ ID NO: 1086999 - RNA, 20 nt, Mycobacterium bovis subsp bovis AF2122/97
gcucggccauagcgccgcgc

SEQ ID NO: 1087000 - RNA, 21 nt, Mycobacterium bovis subsp bovis AF2122/97
gcucggccauagcgccgcgcc

SEQ ID NO: 1087001 - RNA, 21 nt, Mycobacterium bovis subsp bovis AF2122/97
gcucggccaucagaaccuccu

SEQ ID NO: 1087002 - RNA, 15 nt, Mycobacterium bovis subsp bovis AF2122/97
gcucggccauagcgc

SEQ ID NO: 1087003 - RNA, 12 nt, Mycobacterium bovis subsp bovis AF2122/97
gcucggcgagcg

SEQ ID NO: 1087004 - RNA, 14 nt, Mycobacterium bovis subsp bovis AF2122/97
gcucggcgagcuca

SEQ ID NO: 1087005 - RNA, 17 nt, Mycobacterium bovis subsp bovis AF2122/97
gcucggcgccguuuggc

SEQ ID NO: 1087006 - RNA, 18 nt, Mycobacterium bovis subsp bovis AF2122/97
gcucggcgaugcugagcc

SEQ ID NO: 1087007 - RNA, 20 nt, Mycobacterium bovis subsp bovis AF2122/97
gcucggcgaugcugagccgg

SEQ ID NO: 1087008 - RNA, 22 nt, Mycobacterium bovis subsp bovis AF2122/97
gcucggcgcgguggggcgcgcc

SEQ ID NO: 1087009 - RNA, 14 nt, Mycobacterium bovis subsp bovis AF2122/97
gcucggcgcgccgg

SEQ ID NO: 1087010 - RNA, 16 nt, Mycobacterium bovis subsp bovis AF2122/97
gcucggcgaguucggc

SEQ ID NO: 1087011 - RNA, 21 nt, Mycobacterium bovis subsp bovis AF2122/97
gcucgggcgcgaggacgcuga

SEQ ID NO: 1087012 - RNA, 14 nt, Mycobacterium bovis subsp bovis AF2122/97
gcucgggcgcacgg

SEQ ID NO: 1087013 - RNA, 16 nt, Mycobacterium bovis subsp bovis AF2122/97
gcucggucagcgucag

SEQ ID NO: 1087014 - RNA, 22 nt, Mycobacterium bovis subsp bovis AF2122/97
gcucgguccagccgguccagac

SEQ ID NO: 1087015 - RNA, 17 nt, Mycobacterium bovis subsp bovis AF2122/97
gcucgguccccgcagcu

SEQ ID NO: 1087016 - RNA, 14 nt, Mycobacterium bovis subsp bovis AF2122/97
gcucggucuccacc

SEQ ID NO: 1087017 - RNA, 13 nt, Mycobacterium bovis subsp bovis AF2122/97
gcucggucgaugc

SEQ ID NO: 1087018 - RNA, 15 nt, Mycobacterium bovis subsp bovis AF2122/97
gcucggucgccaccg

SEQ ID NO: 1087019 - RNA, 18 nt, Mycobacterium bovis subsp bovis AF2122/97
gcucggucgccaccgccg

SEQ ID NO: 1087020 - RNA, 15 nt, Mycobacterium bovis subsp bovis AF2122/97
gcucggucucgucgc

SEQ ID NO: 1087021 - RNA, 21 nt, Mycobacterium bovis subsp bovis AF2122/97
gcucggugacaagcggcccgc

SEQ ID NO: 1087022 - RNA, 18 nt, Mycobacterium bovis subsp bovis AF2122/97
gcucggucuccaccaccg

SEQ ID NO: 1087023 - RNA, 20 nt, Mycobacterium bovis subsp bovis AF2122/97
gcucggucuccaccaccgac

SEQ ID NO: 1087024 - RNA, 15 nt, Mycobacterium bovis subsp bovis AF2122/97
gcucgggggcgccgg

SEQ ID NO: 1087025 - RNA, 18 nt, Mycobacterium bovis subsp bovis AF2122/97
gcucgggggcgccggcgc

SEQ ID NO: 1087026 - RNA, 20 nt, Mycobacterium bovis subsp bovis AF2122/97
gcucgggguugcucgcgauc

SEQ ID NO: 1087027 - RNA, 15 nt, Mycobacterium bovis subsp bovis AF2122/97
gcucgggucaucuug

SEQ ID NO: 1087028 - RNA, 16 nt, Mycobacterium bovis subsp bovis AF2122/97
gcucggucaccacggc

SEQ ID NO: 1087029 - RNA, 23 nt, Mycobacterium bovis subsp bovis AF2122/97
gcugaccggaucugacggcgccg

SEQ ID NO: 1087030 - RNA, 13 nt, Mycobacterium bovis subsp bovis AF2122/97
gcugaccgggcag

SEQ ID NO: 1087031 - RNA, 22 nt, Mycobacterium bovis subsp bovis AF2122/97
gcugaccggggcgcccggccag

SEQ ID NO: 1087032 - RNA, 13 nt, Mycobacterium bovis subsp bovis AF2122/97
gcugaccguggcg

SEQ ID NO: 1087033 - RNA, 16 nt, Mycobacterium bovis subsp bovis AF2122/97
gcugaccguggcgccg

SEQ ID NO: 1087034 - RNA, 17 nt, Mycobacterium bovis subsp bovis AF2122/97
gcugaccguggcgccgg

SEQ ID NO: 1087035 - RNA, 22 nt, Mycobacterium bovis subsp bovis AF2122/97
gcugaccguggcgccggucgcc

SEQ ID NO: 1087036 - RNA, 21 nt, Mycobacterium bovis subsp bovis AF2122/97
gcugacgaacgcugucgugcu

SEQ ID NO: 1087037 - RNA, 22 nt, Mycobacterium bovis subsp bovis AF2122/97
gcugaccuucucacgcaccaug

SEQ ID NO: 1087038 - RNA, 19 nt, Mycobacterium bovis subsp bovis AF2122/97
gcugaccuuguugaccacc

SEQ ID NO: 1087039 - RNA, 18 nt, Mycobacterium bovis subsp bovis AF2122/97
gcugaccucccacccccg

SEQ ID NO: 1087040 - RNA, 19 nt, Mycobacterium bovis subsp bovis AF2122/97
gcugacgaugcggucgacg

SEQ ID NO: 1087041 - RNA, 20 nt, Mycobacterium bovis subsp bovis AF2122/97
gcugacgaugcggucgacgg

SEQ ID NO: 1087042 - RNA, 12 nt, Mycobacterium bovis subsp bovis AF2122/97
gcugacgaccaa

SEQ ID NO: 1087043 - RNA, 15 nt, Mycobacterium bovis subsp bovis AF2122/97
gcugacgaccaacca

SEQ ID NO: 1087044 - RNA, 22 nt, Mycobacterium bovis subsp bovis AF2122/97
gcugacgacgagggccagcagc

SEQ ID NO: 1087045 - RNA, 15 nt, Mycobacterium bovis subsp bovis AF2122/97
gcugacgagccggug

SEQ ID NO: 1087046 - RNA, 18 nt, Mycobacterium bovis subsp bovis AF2122/97
gcugacgagccgguggcg

SEQ ID NO: 1087047 - RNA, 18 nt, Mycobacterium bovis subsp bovis AF2122/97
gcugaagcuguaggcgac

SEQ ID NO: 1087048 - RNA, 15 nt, Mycobacterium bovis subsp bovis AF2122/97
gcugaagcccauggc

SEQ ID NO: 1087049 - RNA, 20 nt, Mycobacterium bovis subsp bovis AF2122/97
gcugaccgaauggccgccgc

SEQ ID NO: 1087050 - RNA, 12 nt, Mycobacterium bovis subsp bovis AF2122/97
gcugaccgaccc

SEQ ID NO: 1087051 - RNA, 23 nt, Mycobacterium bovis subsp bovis AF2122/97
gcugaccgagcugauccgggugg

SEQ ID NO: 1087052 - RNA, 24 nt, Mycobacterium bovis subsp bovis AF2122/97
gcugaccgcuaccagcugggcgac

SEQ ID NO: 1087053 - RNA, 17 nt, Mycobacterium bovis subsp bovis AF2122/97
gcugaccgccagcggcc

SEQ ID NO: 1087054 - RNA, 13 nt, Mycobacterium bovis subsp bovis AF2122/97
gcugaccgcgccg

SEQ ID NO: 1087055 - RNA, 16 nt, Mycobacterium bovis subsp bovis AF2122/97
gcugaagaacgcgucg

SEQ ID NO: 1087056 - RNA, 23 nt, Mycobacterium bovis subsp bovis AF2122/97
gcugaacugguuggugacguaga

SEQ ID NO: 1087057 - RNA, 16 nt, Mycobacterium bovis subsp bovis AF2122/97
gcugaacuccgccgcg

SEQ ID NO: 1087058 - RNA, 16 nt, Mycobacterium bovis subsp bovis AF2122/97
gcugaacggcagccga

SEQ ID NO: 1087059 - RNA, 18 nt, Mycobacterium bovis subsp bovis AF2122/97
gcucugcgccacagcagc

SEQ ID NO: 1087060 - RNA, 16 nt, Mycobacterium bovis subsp bovis AF2122/97
gcucguggcgacggcg

SEQ ID NO: 1087061 - RNA, 21 nt, Mycobacterium bovis subsp bovis AF2122/97
gcucguggcgacggcgucgau

SEQ ID NO: 1087062 - RNA, 19 nt, Mycobacterium bovis subsp bovis AF2122/97
gcucgucgugagucacccg

SEQ ID NO: 1087063 - RNA, 22 nt, Mycobacterium bovis subsp bovis AF2122/97
gcucgugcgcuuggucgaccgc

SEQ ID NO: 1087064 - RNA, 18 nt, Mycobacterium bovis subsp bovis AF2122/97
gcucugcgcggcuucguc

SEQ ID NO: 1087065 - RNA, 22 nt, Mycobacterium bovis subsp bovis AF2122/97
gcucugcggccacgccgaugcg

SEQ ID NO: 1087066 - RNA, 14 nt, Mycobacterium bovis subsp bovis AF2122/97
gcucuggacgguca

SEQ ID NO: 1087067 - RNA, 14 nt, Mycobacterium bovis subsp bovis AF2122/97
gcucuucgcagcgg

SEQ ID NO: 1087068 - RNA, 22 nt, Mycobacterium bovis subsp bovis AF2122/97
gcucuucggcaccaccgcgacc

SEQ ID NO: 1087069 - RNA, 15 nt, Mycobacterium bovis subsp bovis AF2122/97
gcugaacggcagccg

SEQ ID NO: 1087070 - RNA, 20 nt, Mycobacterium bovis subsp bovis AF2122/97
gcucgucgucgauccagccc

SEQ ID NO: 1087071 - RNA, 14 nt, Mycobacterium bovis subsp bovis AF2122/97
gcucugugucgccg

SEQ ID NO: 1087072 - RNA, 17 nt, Mycobacterium bovis subsp bovis AF2122/97
gcucugugucgccgauc

SEQ ID NO: 1087073 - RNA, 15 nt, Mycobacterium bovis subsp bovis AF2122/97
gcucuguagcgucgc

SEQ ID NO: 1087074 - RNA, 22 nt, Mycobacterium bovis subsp bovis AF2122/97
gcgcugggauguucgaucagcg

SEQ ID NO: 1087075 - RNA, 22 nt, Mycobacterium bovis subsp bovis AF2122/97
gcgcuggcugacaccgauccgg

SEQ ID NO: 1087076 - RNA, 21 nt, Mycobacterium bovis subsp bovis AF2122/97
gcgcugggcgcgcucaucgac

SEQ ID NO: 1087077 - RNA, 15 nt, Mycobacterium bovis subsp bovis AF2122/97
gcgcugggcccgagc

SEQ ID NO: 1087078 - RNA, 17 nt, Mycobacterium bovis subsp bovis AF2122/97
gcgcugggcccgagcgc

SEQ ID NO: 1087079 - RNA, 12 nt, Mycobacterium bovis subsp bovis AF2122/97
gcgcuggcgucg

SEQ ID NO: 1087080 - RNA, 15 nt, Mycobacterium bovis subsp bovis AF2122/97
gcgcuggcggcgcag

SEQ ID NO: 1087081 - RNA, 18 nt, Mycobacterium bovis subsp bovis AF2122/97
gcgcuggcgggcgaucgc

SEQ ID NO: 1087082 - RNA, 19 nt, Mycobacterium bovis subsp bovis AF2122/97
gcgcuggcgggcgaucgcg

SEQ ID NO: 1087083 - RNA, 17 nt, Mycobacterium bovis subsp bovis AF2122/97
gcgcuggcgggcggcgu

SEQ ID NO: 1087084 - RNA, 13 nt, Mycobacterium bovis subsp bovis AF2122/97
gcgcuggcgccgg

SEQ ID NO: 1087085 - RNA, 14 nt, Mycobacterium bovis subsp bovis AF2122/97
gcgcuggcgccggc

SEQ ID NO: 1087086 - RNA, 21 nt, Mycobacterium bovis subsp bovis AF2122/97
gcgcuggcgcccuugccggcg

SEQ ID NO: 1087087 - RNA, 16 nt, Mycobacterium bovis subsp bovis AF2122/97
gcgcuggcgccgccgg

SEQ ID NO: 1087088 - RNA, 17 nt, Mycobacterium bovis subsp bovis AF2122/97
gcgcuggcgccgccggu

SEQ ID NO: 1087089 - RNA, 18 nt, Mycobacterium bovis subsp bovis AF2122/97
gcgcuggcgccgccggug

SEQ ID NO: 1087090 - RNA, 20 nt, Mycobacterium bovis subsp bovis AF2122/97
gcgcuggucggagaccagcg

SEQ ID NO: 1087091 - RNA, 20 nt, Mycobacterium bovis subsp bovis AF2122/97
gcgcuggugcgccacgccac

SEQ ID NO: 1087092 - RNA, 23 nt, Mycobacterium bovis subsp bovis AF2122/97
gcgcuggugcgccacgccaccgc

SEQ ID NO: 1087093 - RNA, 16 nt, Mycobacterium bovis subsp bovis AF2122/97
gcgcuggugcgcccau

SEQ ID NO: 1087094 - RNA, 16 nt, Mycobacterium bovis subsp bovis AF2122/97
gcgcugguggcggcga

SEQ ID NO: 1087095 - RNA, 16 nt, Mycobacterium bovis subsp bovis AF2122/97
gcgcugggguccgcgu

SEQ ID NO: 1087096 - RNA, 15 nt, Mycobacterium bovis subsp bovis AF2122/97
gcgcugggucguguc

SEQ ID NO: 1087097 - RNA, 17 nt, Mycobacterium bovis subsp bovis AF2122/97
gcgcuggucgcgguggc

SEQ ID NO: 1087098 - RNA, 21 nt, Mycobacterium bovis subsp bovis AF2122/97
gcgcuugaagguucgaucgcg

SEQ ID NO: 1087099 - RNA, 20 nt, Mycobacterium bovis subsp bovis AF2122/97
gcgcuugaccccgccgaacg

SEQ ID NO: 1087100 - RNA, 22 nt, Mycobacterium bovis subsp bovis AF2122/97
gcgcuugaaacugauccacguc

SEQ ID NO: 1087101 - RNA, 21 nt, Mycobacterium bovis subsp bovis AF2122/97
gcgcuucgucgccgaacagcg

SEQ ID NO: 1087102 - RNA, 21 nt, Mycobacterium bovis subsp bovis AF2122/97
gcgcuucgucggccggcaccc

SEQ ID NO: 1087103 - RNA, 21 nt, Mycobacterium bovis subsp bovis AF2122/97
gcgcuucugcuacccgagccg

SEQ ID NO: 1087104 - RNA, 17 nt, Mycobacterium bovis subsp bovis AF2122/97
gcgcuguugcuggcgcc

SEQ ID NO: 1087105 - RNA, 18 nt, Mycobacterium bovis subsp bovis AF2122/97
gcgcuucacgggccgucc

SEQ ID NO: 1087106 - RNA, 17 nt, Mycobacterium bovis subsp bovis AF2122/97
gcgcuucacagccacca

SEQ ID NO: 1087107 - RNA, 20 nt, Mycobacterium bovis subsp bovis AF2122/97
gcgcuucacagccaccagcc

SEQ ID NO: 1087108 - RNA, 16 nt, Mycobacterium bovis subsp bovis AF2122/97
gcgcuuccaucgccac

SEQ ID NO: 1087109 - RNA, 17 nt, Mycobacterium bovis subsp bovis AF2122/97
gcgcuucgccacaccau

SEQ ID NO: 1087110 - RNA, 21 nt, Mycobacterium bovis subsp bovis AF2122/97
gcgcuguagggcacugaaccg

SEQ ID NO: 1087111 - RNA, 23 nt, Mycobacterium bovis subsp bovis AF2122/97
gcgcuguccacgaugacgucgac

SEQ ID NO: 1087112 - RNA, 13 nt, Mycobacterium bovis subsp bovis AF2122/97
gcgcugucgcccu

SEQ ID NO: 1087113 - RNA, 20 nt, Mycobacterium bovis subsp bovis AF2122/97
gcgcugucgcccucgaucgc

SEQ ID NO: 1087114 - RNA, 18 nt, Mycobacterium bovis subsp bovis AF2122/97
gcgcugucuugcuagcgc

SEQ ID NO: 1087115 - RNA, 16 nt, Mycobacterium bovis subsp bovis AF2122/97
gcgcuguggcgggaga

SEQ ID NO: 1087116 - RNA, 22 nt, Mycobacterium bovis subsp bovis AF2122/97
gcgcuguggcgggagaucgucg

SEQ ID NO: 1087117 - RNA, 16 nt, Mycobacterium bovis subsp bovis AF2122/97
gcgcuguugcuggcgc

SEQ ID NO: 1087118 - RNA, 19 nt, Mycobacterium bovis subsp bovis AF2122/97
gcgcuguugccaucgacgc

SEQ ID NO: 1087119 - RNA, 16 nt, Mycobacterium bovis subsp bovis AF2122/97
gcgcuguugccaucga

SEQ ID NO: 1087120 - RNA, 20 nt, Mycobacterium bovis subsp bovis AF2122/97
gcgcuugauccacccgacga

SEQ ID NO: 1087121 - RNA, 14 nt, Mycobacterium bovis subsp bovis AF2122/97
gcgcuugaugccgg

SEQ ID NO: 1087122 - RNA, 15 nt, Mycobacterium bovis subsp bovis AF2122/97
gcgcuugcgaucgcc

SEQ ID NO: 1087123 - RNA, 16 nt, Mycobacterium bovis subsp bovis AF2122/97
gcgcuugcgaucgccg

SEQ ID NO: 1087124 - RNA, 14 nt, Mycobacterium bovis subsp bovis AF2122/97
gcgcuugcgaucgg

SEQ ID NO: 1087125 - RNA, 15 nt, Mycobacterium bovis subsp bovis AF2122/97
gcgcuugcgaucggc

SEQ ID NO: 1087126 - RNA, 23 nt, Mycobacterium bovis subsp bovis AF2122/97
gcgcuugcgaucggcacuuagcc

SEQ ID NO: 1087127 - RNA, 16 nt, Mycobacterium bovis subsp bovis AF2122/97
gcgcuuggagcggguc

SEQ ID NO: 1087128 - RNA, 14 nt, Mycobacterium bovis subsp bovis AF2122/97
gcgcuugcggccgc

SEQ ID NO: 1087129 - RNA, 15 nt, Mycobacterium bovis subsp bovis AF2122/97
gcgcuugcggccgcg

SEQ ID NO: 1087130 - RNA, 13 nt, Mycobacterium bovis subsp bovis AF2122/97
gcggaaacaagca

SEQ ID NO: 1087131 - RNA, 18 nt, Mycobacterium bovis subsp bovis AF2122/97
gcggaaaccaucgccagc

SEQ ID NO: 1087132 - RNA, 12 nt, Mycobacterium bovis subsp bovis AF2122/97
gcggaaaaucgg

SEQ ID NO: 1087133 - RNA, 15 nt, Mycobacterium bovis subsp bovis AF2122/97
gcggaaaaucggcug

SEQ ID NO: 1087134 - RNA, 22 nt, Mycobacterium bovis subsp bovis AF2122/97
gcggaaacccggccgccgagac

SEQ ID NO: 1087135 - RNA, 22 nt, Mycobacterium bovis subsp bovis AF2122/97
gcggaaaacccagaucggcgac

SEQ ID NO: 1087136 - RNA, 20 nt, Mycobacterium bovis subsp bovis AF2122/97
gcgcuuugaugccgaugucg

SEQ ID NO: 1087137 - RNA, 21 nt, Mycobacterium bovis subsp bovis AF2122/97
gcggaagaagugcacugcgaa

SEQ ID NO: 1087138 - RNA, 22 nt, Mycobacterium bovis subsp bovis AF2122/97
gcggaagaagugcacugcgaac

SEQ ID NO: 1087139 - RNA, 18 nt, Mycobacterium bovis subsp bovis AF2122/97
gcggaacgcgucgccgac

SEQ ID NO: 1087140 - RNA, 19 nt, Mycobacterium bovis subsp bovis AF2122/97
gcggaacgcgucgccgacg

SEQ ID NO: 1087141 - RNA, 17 nt, Mycobacterium bovis subsp bovis AF2122/97
gcggaacgcgucgccga

SEQ ID NO: 1087142 - RNA, 14 nt, Mycobacterium bovis subsp bovis AF2122/97
gcggaacgccgagc

SEQ ID NO: 1087143 - RNA, 17 nt, Mycobacterium bovis subsp bovis AF2122/97
gcggaacgccgagcacg

SEQ ID NO: 1087144 - RNA, 19 nt, Mycobacterium bovis subsp bovis AF2122/97
gcggaaccugcucggccgu

SEQ ID NO: 1087145 - RNA, 19 nt, Mycobacterium bovis subsp bovis AF2122/97
gcggaaccgagggccguca

SEQ ID NO: 1087146 - RNA, 14 nt, Mycobacterium bovis subsp bovis AF2122/97
gcggaacccagcac

SEQ ID NO: 1087147 - RNA, 20 nt, Mycobacterium bovis subsp bovis AF2122/97
gcggaacagcuucgcgcagc

SEQ ID NO: 1087148 - RNA, 21 nt, Mycobacterium bovis subsp bovis AF2122/97
gcggaacagcuucgcgcagcc

SEQ ID NO: 1087149 - RNA, 19 nt, Mycobacterium bovis subsp bovis AF2122/97
gcggaacaccaccaggcug

SEQ ID NO: 1087150 - RNA, 17 nt, Mycobacterium bovis subsp bovis AF2122/97
gcggaacaccgcccggc

SEQ ID NO: 1087151 - RNA, 18 nt, Mycobacterium bovis subsp bovis AF2122/97
gcggaaauggcgucgccg

SEQ ID NO: 1087152 - RNA, 13 nt, Mycobacterium bovis subsp bovis AF2122/97
gcggaacgggcag

SEQ ID NO: 1087153 - RNA, 14 nt, Mycobacterium bovis subsp bovis AF2122/97
gcggaaggcgucga

SEQ ID NO: 1087154 - RNA, 16 nt, Mycobacterium bovis subsp bovis AF2122/97
gcggaaggcgucgaac

SEQ ID NO: 1087155 - RNA, 16 nt, Mycobacterium bovis subsp bovis AF2122/97
gcggaaggacggcagc

SEQ ID NO: 1087156 - RNA, 15 nt, Mycobacterium bovis subsp bovis AF2122/97
gcggaagcggcggcc

SEQ ID NO: 1087157 - RNA, 17 nt, Mycobacterium bovis subsp bovis AF2122/97
gcggaagcggcggcccu

SEQ ID NO: 1087158 - RNA, 13 nt, Mycobacterium bovis subsp bovis AF2122/97
gcggaaucgcgac

SEQ ID NO: 1087159 - RNA, 14 nt, Mycobacterium bovis subsp bovis AF2122/97
gcggaaucgcgaca

SEQ ID NO: 1087160 - RNA, 22 nt, Mycobacterium bovis subsp bovis AF2122/97
gcggaauccgaacgcgauccgg

SEQ ID NO: 1087161 - RNA, 17 nt, Mycobacterium bovis subsp bovis AF2122/97
gcggaaucagcacccca

SEQ ID NO: 1087162 - RNA, 21 nt, Mycobacterium bovis subsp bovis AF2122/97
gcgcugaaucaccccggcggc

SEQ ID NO: 1087163 - RNA, 20 nt, Mycobacterium bovis subsp bovis AF2122/97
gcgcugacgacccuccgcac

SEQ ID NO: 1087164 - RNA, 20 nt, Mycobacterium bovis subsp bovis AF2122/97
gcgcugagccguagugucgg

SEQ ID NO: 1087165 - RNA, 16 nt, Mycobacterium bovis subsp bovis AF2122/97
gcgcugagcacgcgga

SEQ ID NO: 1087166 - RNA, 21 nt, Mycobacterium bovis subsp bovis AF2122/97
gcgcugagcacgcggaucgcg

SEQ ID NO: 1087167 - RNA, 18 nt, Mycobacterium bovis subsp bovis AF2122/97
gcgcugaaggccgguagc

SEQ ID NO: 1087168 - RNA, 21 nt, Mycobacterium bovis subsp bovis AF2122/97
gcgcugaagccgacgauccac

SEQ ID NO: 1087169 - RNA, 17 nt, Mycobacterium bovis subsp bovis AF2122/97
gcgcugaaaugccgucg

SEQ ID NO: 1087170 - RNA, 16 nt, Mycobacterium bovis subsp bovis AF2122/97
gcgcugaacgcgagca

SEQ ID NO: 1087171 - RNA, 18 nt, Mycobacterium bovis subsp bovis AF2122/97
gcgcugaacuagggucgg

SEQ ID NO: 1087172 - RNA, 22 nt, Mycobacterium bovis subsp bovis AF2122/97
gcgcugaagaucaacaggcguc

SEQ ID NO: 1087173 - RNA, 16 nt, Mycobacterium bovis subsp bovis AF2122/97
gcgcugaagccgacga

SEQ ID NO: 1087174 - RNA, 18 nt, Mycobacterium bovis subsp bovis AF2122/97
gcgcucggucuccaccac

SEQ ID NO: 1087175 - RNA, 17 nt, Mycobacterium bovis subsp bovis AF2122/97
gcgcucggcgaucugcg

SEQ ID NO: 1087176 - RNA, 13 nt, Mycobacterium bovis subsp bovis AF2122/97
gcgcucggcgagc

SEQ ID NO: 1087177 - RNA, 16 nt, Mycobacterium bovis subsp bovis AF2122/97
gcgcucggcgagcaac

SEQ ID NO: 1087178 - RNA, 16 nt, Mycobacterium bovis subsp bovis AF2122/97
gcgcucgugauguuga

SEQ ID NO: 1087179 - RNA, 16 nt, Mycobacterium bovis subsp bovis AF2122/97
gcgcucguggucgacg

SEQ ID NO: 1087180 - RNA, 20 nt, Mycobacterium bovis subsp bovis AF2122/97
gcgcucggucuccaccaccg

SEQ ID NO: 1087181 - RNA, 14 nt, Mycobacterium bovis subsp bovis AF2122/97
gcgcucgucgcggc

SEQ ID NO: 1087182 - RNA, 14 nt, Mycobacterium bovis subsp bovis AF2122/97
gcgcgcacgccacc

SEQ ID NO: 1087183 - RNA, 15 nt, Mycobacterium bovis subsp bovis AF2122/97
gcgcgcacggcgucg

SEQ ID NO: 1087184 - RNA, 18 nt, Mycobacterium bovis subsp bovis AF2122/97
gcgcgcagaucguccacc

SEQ ID NO: 1087185 - RNA, 13 nt, Mycobacterium bovis subsp bovis AF2122/97
gcgcgcagccggg

SEQ ID NO: 1087186 - RNA, 15 nt, Mycobacterium bovis subsp bovis AF2122/97
gcgcgcagcgauucg

SEQ ID NO: 1087187 - RNA, 15 nt, Mycobacterium bovis subsp bovis AF2122/97
gcgcgcagcugacgu

SEQ ID NO: 1087188 - RNA, 21 nt, Mycobacterium bovis subsp bovis AF2122/97
gcgcgcagaugagcgcggcga

SEQ ID NO: 1087189 - RNA, 17 nt, Mycobacterium bovis subsp bovis AF2122/97
gcgcucgcgcgguaguc

SEQ ID NO: 1087190 - RNA, 14 nt, Mycobacterium bovis subsp bovis AF2122/97
gcgcucgcggcggc

SEQ ID NO: 1087191 - RNA, 16 nt, Mycobacterium bovis subsp bovis AF2122/97
gcgcucgcggcggcgc

SEQ ID NO: 1087192 - RNA, 14 nt, Mycobacterium bovis subsp bovis AF2122/97
gcgcucgcgguagc

SEQ ID NO: 1087193 - RNA, 18 nt, Mycobacterium bovis subsp bovis AF2122/97
gcgcucgcgguagcgccg

SEQ ID NO: 1087194 - RNA, 16 nt, Mycobacterium bovis subsp bovis AF2122/97
gcgcucggcagccggc

SEQ ID NO: 1087195 - RNA, 18 nt, Mycobacterium bovis subsp bovis AF2122/97
gcgcucgcucaccggcgc

SEQ ID NO: 1087196 - RNA, 20 nt, Mycobacterium bovis subsp bovis AF2122/97
gcgcgcauauccgcaggccc

SEQ ID NO: 1087197 - RNA, 21 nt, Mycobacterium bovis subsp bovis AF2122/97
gcgcgcauauccgcaggcccg

SEQ ID NO: 1087198 - RNA, 15 nt, Mycobacterium bovis subsp bovis AF2122/97
gcgcgcaggccgccg

SEQ ID NO: 1087199 - RNA, 18 nt, Mycobacterium bovis subsp bovis AF2122/97
gcgcgcaggccgccgcca

SEQ ID NO: 1087200 - RNA, 13 nt, Mycobacterium bovis subsp bovis AF2122/97
gcgcgcaggugcu

SEQ ID NO: 1087201 - RNA, 21 nt, Mycobacterium bovis subsp bovis AF2122/97
gcgcuggcccgccaggucccc

SEQ ID NO: 1087202 - RNA, 16 nt, Mycobacterium bovis subsp bovis AF2122/97
gcgcuggccagcccgg

SEQ ID NO: 1087203 - RNA, 17 nt, Mycobacterium bovis subsp bovis AF2122/97
gcgcuggccagcccggu

SEQ ID NO: 1087204 - RNA, 14 nt, Mycobacterium bovis subsp bovis AF2122/97
gcgcuggccagcag

SEQ ID NO: 1087205 - RNA, 16 nt, Mycobacterium bovis subsp bovis AF2122/97
gcgcuggccagcaggg

SEQ ID NO: 1087206 - RNA, 17 nt, Mycobacterium bovis subsp bovis AF2122/97
gcgcuggaggcuccugg

SEQ ID NO: 1087207 - RNA, 21 nt, Mycobacterium bovis subsp bovis AF2122/97
gcgcuggaggcuccuggucgc

SEQ ID NO: 1087208 - RNA, 22 nt, Mycobacterium bovis subsp bovis AF2122/97
gcgcuggaugugggcgcucgca

SEQ ID NO: 1087209 - RNA, 22 nt, Mycobacterium bovis subsp bovis AF2122/97
gcgcugcucugagcuuggucgc

SEQ ID NO: 1087210 - RNA, 16 nt, Mycobacterium bovis subsp bovis AF2122/97
gcgcugcucacgcagc

SEQ ID NO: 1087211 - RNA, 20 nt, Mycobacterium bovis subsp bovis AF2122/97
gcgcugcucacgcagcagug

SEQ ID NO: 1087212 - RNA, 19 nt, Mycobacterium bovis subsp bovis AF2122/97
gcgcugcgggaaccccagc

SEQ ID NO: 1087213 - RNA, 21 nt, Mycobacterium bovis subsp bovis AF2122/97
gcgcugcggcccacaccagcg

SEQ ID NO: 1087214 - RNA, 15 nt, Mycobacterium bovis subsp bovis AF2122/97
gcgcugcuggcagac

SEQ ID NO: 1087215 - RNA, 13 nt, Mycobacterium bovis subsp bovis AF2122/97
gcgcuggacggcg

SEQ ID NO: 1087216 - RNA, 20 nt, Mycobacterium bovis subsp bovis AF2122/97
gcgcuggacggcgggccgcg

SEQ ID NO: 1087217 - RNA, 21 nt, Mycobacterium bovis subsp bovis AF2122/97
gcgcuggaggacccgcuacga

SEQ ID NO: 1087218 - RNA, 23 nt, Mycobacterium bovis subsp bovis AF2122/97
gcgcugccgccguuuccugcguc

SEQ ID NO: 1087219 - RNA, 21 nt, Mycobacterium bovis subsp bovis AF2122/97
gcgcugccaguucuuggcgac

SEQ ID NO: 1087220 - RNA, 17 nt, Mycobacterium bovis subsp bovis AF2122/97
gcgcugccgacuccucg

SEQ ID NO: 1087221 - RNA, 19 nt, Mycobacterium bovis subsp bovis AF2122/97
gcgcugccaccgcgguggc

SEQ ID NO: 1087222 - RNA, 14 nt, Mycobacterium bovis subsp bovis AF2122/97
gcgcugcgcaccgc

SEQ ID NO: 1087223 - RNA, 18 nt, Mycobacterium bovis subsp bovis AF2122/97
gcgcugcgcaccgccgcg

SEQ ID NO: 1087224 - RNA, 21 nt, Mycobacterium bovis subsp bovis AF2122/97
gcgcugcgcaccgccgcgcga

SEQ ID NO: 1087225 - RNA, 17 nt, Mycobacterium bovis subsp bovis AF2122/97
gcgcugcagcugaaucg

SEQ ID NO: 1087226 - RNA, 14 nt, Mycobacterium bovis subsp bovis AF2122/97
gcgcugccaccgcg

SEQ ID NO: 1087227 - RNA, 23 nt, Mycobacterium bovis subsp bovis AF2122/97
gcgcugccaaacuaacggcagcc

SEQ ID NO: 1087228 - RNA, 21 nt, Mycobacterium bovis subsp bovis AF2122/97
gcgcugcaccguagugaacgg

SEQ ID NO: 1087229 - RNA, 20 nt, Mycobacterium bovis subsp bovis AF2122/97
gcgcugcagcacggcuucgc

SEQ ID NO: 1087230 - RNA, 15 nt, Mycobacterium bovis subsp bovis AF2122/97
gcgcugaugcgcugg

SEQ ID NO: 1087231 - RNA, 17 nt, Mycobacterium bovis subsp bovis AF2122/97
gcgcugaugcuggccau

SEQ ID NO: 1087232 - RNA, 18 nt, Mycobacterium bovis subsp bovis AF2122/97
gcgcugaugcuggccaug

SEQ ID NO: 1087233 - RNA, 19 nt, Mycobacterium bovis subsp bovis AF2122/97
gcgcugauggugcugcggc

SEQ ID NO: 1087234 - RNA, 17 nt, Mycobacterium bovis subsp bovis AF2122/97
gcggacgcccggcgcac

SEQ ID NO: 1087235 - RNA, 15 nt, Mycobacterium bovis subsp bovis AF2122/97
gcggacgccgcgccg

SEQ ID NO: 1087236 - RNA, 22 nt, Mycobacterium bovis subsp bovis AF2122/97
gcggacgccgcgccggcgggcg

SEQ ID NO: 1087237 - RNA, 23 nt, Mycobacterium bovis subsp bovis AF2122/97
gcggacggaauucgguuggcucg

SEQ ID NO: 1087238 - RNA, 11 nt, Mycobacterium bovis subsp bovis AF2122/97
gcggacggcgu

SEQ ID NO: 1087239 - RNA, 13 nt, Mycobacterium bovis subsp bovis AF2122/97
gcggacggcgucg

SEQ ID NO: 1087240 - RNA, 14 nt, Mycobacterium bovis subsp bovis AF2122/97
gcggacggcgucga

SEQ ID NO: 1087241 - RNA, 23 nt, Mycobacterium bovis subsp bovis AF2122/97
gcggacggcguuuccuucgacga

SEQ ID NO: 1087242 - RNA, 20 nt, Mycobacterium bovis subsp bovis AF2122/97
gcggacucgggcaggcccca

SEQ ID NO: 1087243 - RNA, 23 nt, Mycobacterium bovis subsp bovis AF2122/97
gcggacugagagauggucgggcg

SEQ ID NO: 1087244 - RNA, 18 nt, Mycobacterium bovis subsp bovis AF2122/97
gcggacuggcauccgccc

SEQ ID NO: 1087245 - RNA, 19 nt, Mycobacterium bovis subsp bovis AF2122/97
gcggacuggcauccgcccc

SEQ ID NO: 1087246 - RNA, 14 nt, Mycobacterium bovis subsp bovis AF2122/97
gcggacuucgccgc

SEQ ID NO: 1087247 - RNA, 23 nt, Mycobacterium bovis subsp bovis AF2122/97
gcggacggugcggucagauucgg

SEQ ID NO: 1087248 - RNA, 14 nt, Mycobacterium bovis subsp bovis AF2122/97
gcggacgucgcccc

SEQ ID NO: 1087249 - RNA, 13 nt, Mycobacterium bovis subsp bovis AF2122/97
gcggacgugccgg

SEQ ID NO: 1087250 - RNA, 15 nt, Mycobacterium bovis subsp bovis AF2122/97
gcggacucacgaggc

SEQ ID NO: 1087251 - RNA, 19 nt, Mycobacterium bovis subsp bovis AF2122/97
gcggacucgagucugcgca

SEQ ID NO: 1087252 - RNA, 19 nt, Mycobacterium bovis subsp bovis AF2122/97
gcggagcacuucgucgaac

SEQ ID NO: 1087253 - RNA, 15 nt, Mycobacterium bovis subsp bovis AF2122/97
gcggagccacucggc

SEQ ID NO: 1087254 - RNA, 15 nt, Mycobacterium bovis subsp bovis AF2122/97
gcggagccgaugacc

SEQ ID NO: 1087255 - RNA, 15 nt, Mycobacterium bovis subsp bovis AF2122/97
gcggagccgccgcug

SEQ ID NO: 1087256 - RNA, 22 nt, Mycobacterium bovis subsp bovis AF2122/97
gcggagagccugcucgcagcgg

SEQ ID NO: 1087257 - RNA, 13 nt, Mycobacterium bovis subsp bovis AF2122/97
gcggagaaggcgc

SEQ ID NO: 1087258 - RNA, 16 nt, Mycobacterium bovis subsp bovis AF2122/97
gcggagaaggcgcggg

SEQ ID NO: 1087259 - RNA, 18 nt, Mycobacterium bovis subsp bovis AF2122/97
gcggagaaggcgcgggcg

SEQ ID NO: 1087260 - RNA, 21 nt, Mycobacterium bovis subsp bovis AF2122/97
gcggacuucguuccgugccga

SEQ ID NO: 1087261 - RNA, 14 nt, Mycobacterium bovis subsp bovis AF2122/97
gcggagauaccgga

SEQ ID NO: 1087262 - RNA, 17 nt, Mycobacterium bovis subsp bovis AF2122/97
gcggagcgugagccaug

SEQ ID NO: 1087263 - RNA, 17 nt, Mycobacterium bovis subsp bovis AF2122/97
gcggagcucacgccggg

SEQ ID NO: 1087264 - RNA, 18 nt, Mycobacterium bovis subsp bovis AF2122/97
gcggagcucacgccgggu

SEQ ID NO: 1087265 - RNA, 19 nt, Mycobacterium bovis subsp bovis AF2122/97
gcggaguccgucgacaccg

SEQ ID NO: 1087266 - RNA, 16 nt, Mycobacterium bovis subsp bovis AF2122/97
gcggaguacuccagcc

SEQ ID NO: 1087267 - RNA, 20 nt, Mycobacterium bovis subsp bovis AF2122/97
gcggaguacuccagccgcaa

SEQ ID NO: 1087268 - RNA, 16 nt, Mycobacterium bovis subsp bovis AF2122/97
gcggaguagccgcagc

SEQ ID NO: 1087269 - RNA, 20 nt, Mycobacterium bovis subsp bovis AF2122/97
gcggacacgaucgcgucggc

SEQ ID NO: 1087270 - RNA, 12 nt, Mycobacterium bovis subsp bovis AF2122/97
gcggaauggcgc

SEQ ID NO: 1087271 - RNA, 19 nt, Mycobacterium bovis subsp bovis AF2122/97
gcggacaccucgggcgccc

SEQ ID NO: 1087272 - RNA, 22 nt, Mycobacterium bovis subsp bovis AF2122/97
gcggacacgaucgcgucggcua

SEQ ID NO: 1087273 - RNA, 23 nt, Mycobacterium bovis subsp bovis AF2122/97
gcggacacgaucgcgucggcuac

SEQ ID NO: 1087274 - RNA, 15 nt, Mycobacterium bovis subsp bovis AF2122/97
gcggacaagucggca

SEQ ID NO: 1087275 - RNA, 16 nt, Mycobacterium bovis subsp bovis AF2122/97
gcggacaagucggcac

SEQ ID NO: 1087276 - RNA, 16 nt, Mycobacterium bovis subsp bovis AF2122/97
gcggacaccgcggcga

SEQ ID NO: 1087277 - RNA, 18 nt, Mycobacterium bovis subsp bovis AF2122/97
gcggacaccgcggcgauc

SEQ ID NO: 1087278 - RNA, 15 nt, Mycobacterium bovis subsp bovis AF2122/97
gcggacagcucgcgg

SEQ ID NO: 1087279 - RNA, 13 nt, Mycobacterium bovis subsp bovis AF2122/97
gcggacagcucgc

SEQ ID NO: 1087280 - RNA, 23 nt, Mycobacterium bovis subsp bovis AF2122/97
gcggacacugcgaaggaccagag

SEQ ID NO: 1087281 - RNA, 13 nt, Mycobacterium bovis subsp bovis AF2122/97
gcggacacugcga

SEQ ID NO: 1087282 - RNA, 17 nt, Mycobacterium bovis subsp bovis AF2122/97
gcggacaugcaccucga

SEQ ID NO: 1087283 - RNA, 20 nt, Mycobacterium bovis subsp bovis AF2122/97
gcggacauccgggccgagcg

SEQ ID NO: 1087284 - RNA, 16 nt, Mycobacterium bovis subsp bovis AF2122/97
gcggaccacaccguca

SEQ ID NO: 1087285 - RNA, 18 nt, Mycobacterium bovis subsp bovis AF2122/97
gcggacauccgggccgag

SEQ ID NO: 1087286 - RNA, 17 nt, Mycobacterium bovis subsp bovis AF2122/97
gcggacagcucgcggua

SEQ ID NO: 1087287 - RNA, 14 nt, Mycobacterium bovis subsp bovis AF2122/97
gcggaccaccgcuc

SEQ ID NO: 1087288 - RNA, 16 nt, Mycobacterium bovis subsp bovis AF2122/97
gcggaccaccgcucgc

SEQ ID NO: 1087289 - RNA, 20 nt, Mycobacterium bovis subsp bovis AF2122/97
gcggaccagagugguggcga

SEQ ID NO: 1087290 - RNA, 17 nt, Mycobacterium bovis subsp bovis AF2122/97
gcggacccagcacccga

SEQ ID NO: 1087291 - RNA, 15 nt, Mycobacterium bovis subsp bovis AF2122/97
gcggacccgcagcug

SEQ ID NO: 1087292 - RNA, 12 nt, Mycobacterium bovis subsp bovis AF2122/97
gcggaccguccg

SEQ ID NO: 1087293 - RNA, 19 nt, Mycobacterium bovis subsp bovis AF2122/97
gcggaccucgaagcccagc

SEQ ID NO: 1087294 - RNA, 12 nt, Mycobacterium bovis subsp bovis AF2122/97
gcggaccucggc

SEQ ID NO: 1087295 - RNA, 14 nt, Mycobacterium bovis subsp bovis AF2122/97
gcggaccucggcga

SEQ ID NO: 1087296 - RNA, 13 nt, Mycobacterium bovis subsp bovis AF2122/97
gcggaccugcgag

SEQ ID NO: 1087297 - RNA, 13 nt, Mycobacterium bovis subsp bovis AF2122/97
gcggacgaccuug

SEQ ID NO: 1087298 - RNA, 14 nt, Mycobacterium bovis subsp bovis AF2122/97
gcggaccguccgac

SEQ ID NO: 1087299 - RNA, 21 nt, Mycobacterium bovis subsp bovis AF2122/97
gcggaccugcgagaucggaug

SEQ ID NO: 1087300 - RNA, 15 nt, Mycobacterium bovis subsp bovis AF2122/97
gcggaccugcgccgg

SEQ ID NO: 1087301 - RNA, 13 nt, Mycobacterium bovis subsp bovis AF2122/97
gcggaccggcgcg

SEQ ID NO: 1087302 - RNA, 16 nt, Mycobacterium bovis subsp bovis AF2122/97
gcggacccgcucgcgg

SEQ ID NO: 1087303 - RNA, 14 nt, Mycobacterium bovis subsp bovis AF2122/97
gcggacccgcucgc

SEQ ID NO: 1087304 - RNA, 22 nt, Mycobacterium bovis subsp bovis AF2122/97
gcggaccgaugacgaucggcgg

SEQ ID NO: 1087305 - RNA, 20 nt, Mycobacterium bovis subsp bovis AF2122/97
gcggaccgauugucggcaac

SEQ ID NO: 1087306 - RNA, 16 nt, Mycobacterium bovis subsp bovis AF2122/97
gcggacccggugaccc

SEQ ID NO: 1087307 - RNA, 14 nt, Mycobacterium bovis subsp bovis AF2122/97
gcggacccgucggc

SEQ ID NO: 1087308 - RNA, 16 nt, Mycobacterium bovis subsp bovis AF2122/97
gcggacccgucggcgu

SEQ ID NO: 1087309 - RNA, 18 nt, Mycobacterium bovis subsp bovis AF2122/97
gcggacccgucggcgugg

SEQ ID NO: 1087310 - RNA, 16 nt, Mycobacterium bovis subsp bovis AF2122/97
gcggacccucgccgaa

SEQ ID NO: 1087311 - RNA, 16 nt, Mycobacterium bovis subsp bovis AF2122/97
gcggacccgaccgucg

SEQ ID NO: 1087312 - RNA, 20 nt, Mycobacterium bovis subsp bovis AF2122/97
gcggacccgcagcugcggau

SEQ ID NO: 1087313 - RNA, 21 nt, Mycobacterium bovis subsp bovis AF2122/97
gcggacccgcagcugcggauc

SEQ ID NO: 1087314 - RNA, 20 nt, Mycobacterium bovis subsp bovis AF2122/97
gcggacccgcgcgucgccca

SEQ ID NO: 1087315 - RNA, 18 nt, Mycobacterium bovis subsp bovis AF2122/97
gcggaucucaucgggcca

SEQ ID NO: 1087316 - RNA, 17 nt, Mycobacterium bovis subsp bovis AF2122/97
gcggaucguggcgcccg

SEQ ID NO: 1087317 - RNA, 16 nt, Mycobacterium bovis subsp bovis AF2122/97
gcggaucgucguuguc

SEQ ID NO: 1087318 - RNA, 17 nt, Mycobacterium bovis subsp bovis AF2122/97
gcggaucugcagcacgc

SEQ ID NO: 1087319 - RNA, 16 nt, Mycobacterium bovis subsp bovis AF2122/97
gcggaucugggcggcc

SEQ ID NO: 1087320 - RNA, 16 nt, Mycobacterium bovis subsp bovis AF2122/97
gcggaucugguccagu

SEQ ID NO: 1087321 - RNA, 23 nt, Mycobacterium bovis subsp bovis AF2122/97
gcggaucuucucgguaccaccgg

SEQ ID NO: 1087322 - RNA, 18 nt, Mycobacterium bovis subsp bovis AF2122/97
gcggaucugaucggcgcg

SEQ ID NO: 1087323 - RNA, 17 nt, Mycobacterium bovis subsp bovis AF2122/97
gcggaucgcggucagcg

SEQ ID NO: 1087324 - RNA, 20 nt, Mycobacterium bovis subsp bovis AF2122/97
gcggaucgcgcugaucagcc

SEQ ID NO: 1087325 - RNA, 16 nt, Mycobacterium bovis subsp bovis AF2122/97
gcggaucgcgcugcgg

SEQ ID NO: 1087326 - RNA, 22 nt, Mycobacterium bovis subsp bovis AF2122/97
gcggaucgccggggacgccgcg

SEQ ID NO: 1087327 - RNA, 12 nt, Mycobacterium bovis subsp bovis AF2122/97
gcggaucggcgg

SEQ ID NO: 1087328 - RNA, 17 nt, Mycobacterium bovis subsp bovis AF2122/97
gcggaucggacaacacg

SEQ ID NO: 1087329 - RNA, 16 nt, Mycobacterium bovis subsp bovis AF2122/97
gcggaucgggcacccc

SEQ ID NO: 1087330 - RNA, 18 nt, Mycobacterium bovis subsp bovis AF2122/97
gcggaucgggcaccccga

SEQ ID NO: 1087331 - RNA, 14 nt, Mycobacterium bovis subsp bovis AF2122/97
gcggaugcgcggcg

SEQ ID NO: 1087332 - RNA, 14 nt, Mycobacterium bovis subsp bovis AF2122/97
gcggauggcgucga

SEQ ID NO: 1087333 - RNA, 22 nt, Mycobacterium bovis subsp bovis AF2122/97
gcggaugcucaggucaccggcc

SEQ ID NO: 1087334 - RNA, 19 nt, Mycobacterium bovis subsp bovis AF2122/97
gcggaugcuguugacccgu

SEQ ID NO: 1087335 - RNA, 18 nt, Mycobacterium bovis subsp bovis AF2122/97
gcggauuaagucggcggc

SEQ ID NO: 1087336 - RNA, 14 nt, Mycobacterium bovis subsp bovis AF2122/97
gcggauguccccga

SEQ ID NO: 1087337 - RNA, 18 nt, Mycobacterium bovis subsp bovis AF2122/97
gcggaucagaggacccgu

SEQ ID NO: 1087338 - RNA, 21 nt, Mycobacterium bovis subsp bovis AF2122/97
gcggauccagaaacugcucgg

SEQ ID NO: 1087339 - RNA, 18 nt, Mycobacterium bovis subsp bovis AF2122/97
gcggaucgacuucgacga

SEQ ID NO: 1087340 - RNA, 16 nt, Mycobacterium bovis subsp bovis AF2122/97
gcggaucccgaggcgc

SEQ ID NO: 1087341 - RNA, 16 nt, Mycobacterium bovis subsp bovis AF2122/97
gcggaucccgccggug

SEQ ID NO: 1087342 - RNA, 12 nt, Mycobacterium bovis subsp bovis AF2122/97
gcggaucaagcg

SEQ ID NO: 1087343 - RNA, 16 nt, Mycobacterium bovis subsp bovis AF2122/97
gcggaucaagcgcaca

SEQ ID NO: 1087344 - RNA, 19 nt, Mycobacterium bovis subsp bovis AF2122/97
gcggaucaccaucgccgcc

SEQ ID NO: 1087345 - RNA, 21 nt, Mycobacterium bovis subsp bovis AF2122/97
gcggaucaccaucgccgccgc

SEQ ID NO: 1087346 - RNA, 18 nt, Mycobacterium bovis subsp bovis AF2122/97
gcggaucauuccgacgaa

SEQ ID NO: 1087347 - RNA, 19 nt, Mycobacterium bovis subsp bovis AF2122/97
gcggaucauuccgacgaac

SEQ ID NO: 1087348 - RNA, 21 nt, Mycobacterium bovis subsp bovis AF2122/97
gcggauccaccacgcuggccu

SEQ ID NO: 1087349 - RNA, 23 nt, Mycobacterium bovis subsp bovis AF2122/97
gcggaucauccuucgccggcgcc

SEQ ID NO: 1087350 - RNA, 19 nt, Mycobacterium bovis subsp bovis AF2122/97
gcggauagcuguugaccgu

SEQ ID NO: 1087351 - RNA, 18 nt, Mycobacterium bovis subsp bovis AF2122/97
gcggauaggccgcgcggc

SEQ ID NO: 1087352 - RNA, 21 nt, Mycobacterium bovis subsp bovis AF2122/97
gcggauagaugacgggcucgu

SEQ ID NO: 1087353 - RNA, 21 nt, Mycobacterium bovis subsp bovis AF2122/97
gcggauacagccgccgccggc

SEQ ID NO: 1087354 - RNA, 23 nt, Mycobacterium bovis subsp bovis AF2122/97
gcggauauuccuuuaacgcaggc

SEQ ID NO: 1087355 - RNA, 15 nt, Mycobacterium bovis subsp bovis AF2122/97
gcggauagcggcaaa

SEQ ID NO: 1087356 - RNA, 15 nt, Mycobacterium bovis subsp bovis AF2122/97
gcggauaucuugcgc

SEQ ID NO: 1087357 - RNA, 23 nt, Mycobacterium bovis subsp bovis AF2122/97
gcggauaucuugcgcauguccau

SEQ ID NO: 1087358 - RNA, 19 nt, Mycobacterium bovis subsp bovis AF2122/97
gcggagugcauguccgacc

SEQ ID NO: 1087359 - RNA, 17 nt, Mycobacterium bovis subsp bovis AF2122/97
gcggagugcccagggcc

SEQ ID NO: 1087360 - RNA, 20 nt, Mycobacterium bovis subsp bovis AF2122/97
gcggagugcccagggccgag

SEQ ID NO: 1087361 - RNA, 17 nt, Mycobacterium bovis subsp bovis AF2122/97
gcggagucgcgcagggc

SEQ ID NO: 1087362 - RNA, 22 nt, Mycobacterium bovis subsp bovis AF2122/97
gcggaguucgcugacggccaug

SEQ ID NO: 1087363 - RNA, 20 nt, Mycobacterium bovis subsp bovis AF2122/97
gcggcaaacacugcggccug

SEQ ID NO: 1087364 - RNA, 14 nt, Mycobacterium bovis subsp bovis AF2122/97
gcggauuucgccgu

SEQ ID NO: 1087365 - RNA, 18 nt, Mycobacterium bovis subsp bovis AF2122/97
gcggauucggcgcugcgg

SEQ ID NO: 1087366 - RNA, 21 nt, Mycobacterium bovis subsp bovis AF2122/97
gcggauuccggcaucgguucg

SEQ ID NO: 1087367 - RNA, 19 nt, Mycobacterium bovis subsp bovis AF2122/97
gcggauucacgcaccggcg

SEQ ID NO: 1087368 - RNA, 20 nt, Mycobacterium bovis subsp bovis AF2122/97
gcggauuaagucggcggccu

SEQ ID NO: 1087369 - RNA, 23 nt, Mycobacterium bovis subsp bovis AF2122/97
gcggcaaggguggggccggcggu

SEQ ID NO: 1087370 - RNA, 18 nt, Mycobacterium bovis subsp bovis AF2122/97
gcggcaaggguggugacg

SEQ ID NO: 1087371 - RNA, 22 nt, Mycobacterium bovis subsp bovis AF2122/97
aagccgacgauccacggcgaug

SEQ ID NO: 1087372 - RNA, 15 nt, Mycobacterium bovis subsp bovis AF2122/97
gcggcaaggucaacg

SEQ ID NO: 1087373 - RNA, 16 nt, Mycobacterium bovis subsp bovis AF2122/97
gcggcaaggucaacgg

SEQ ID NO: 1087374 - RNA, 21 nt, Mycobacterium bovis subsp bovis AF2122/97
gcggcaagcucguccggugcg

SEQ ID NO: 1087375 - RNA, 21 nt, Mycobacterium bovis subsp bovis AF2122/97
gcggcaacuccggucaacacc

SEQ ID NO: 1087376 - RNA, 16 nt, Mycobacterium bovis subsp bovis AF2122/97
gcggcaacgggggcgc

SEQ ID NO: 1087377 - RNA, 20 nt, Mycobacterium bovis subsp bovis AF2122/97
gcggcaacgggggcgccgga

SEQ ID NO: 1087378 - RNA, 14 nt, Mycobacterium bovis subsp bovis AF2122/97
gcggcaacgguggc

SEQ ID NO: 1087379 - RNA, 14 nt, Mycobacterium bovis subsp bovis AF2122/97
gcggcaacggcgga

SEQ ID NO: 1087380 - RNA, 22 nt, Mycobacterium bovis subsp bovis AF2122/97
gcggcaacggcggaucggcggc

SEQ ID NO: 1087381 - RNA, 19 nt, Mycobacterium bovis subsp bovis AF2122/97
gcggcaacggcggcaucgg

SEQ ID NO: 1087382 - RNA, 16 nt, Mycobacterium bovis subsp bovis AF2122/97
gcggcaacggcggcga

SEQ ID NO: 1087383 - RNA, 19 nt, Mycobacterium bovis subsp bovis AF2122/97
gcggcaacggcggcgacgg

SEQ ID NO: 1087384 - RNA, 19 nt, Mycobacterium bovis subsp bovis AF2122/97
gcggcaacgcggucugcuc

SEQ ID NO: 1087385 - RNA, 22 nt, Mycobacterium bovis subsp bovis AF2122/97
gcggcaaccgucgaaaaaucga

SEQ ID NO: 1087386 - RNA, 20 nt, Mycobacterium bovis subsp bovis AF2122/97
gcggcaacgcggucugcucc

SEQ ID NO: 1087387 - RNA, 14 nt, Mycobacterium bovis subsp bovis AF2122/97
gcggcaaccgccgc

SEQ ID NO: 1087388 - RNA, 16 nt, Mycobacterium bovis subsp bovis AF2122/97
gcggcaaccgccgcca

SEQ ID NO: 1087389 - RNA, 14 nt, Mycobacterium bovis subsp bovis AF2122/97
gcggcaaccgucga

SEQ ID NO: 1087390 - RNA, 16 nt, Mycobacterium bovis subsp bovis AF2122/97
gcggcaacaaagucgc

SEQ ID NO: 1087391 - RNA, 20 nt, Mycobacterium bovis subsp bovis AF2122/97
gcggcaaaguuggccgcccg

SEQ ID NO: 1087392 - RNA, 22 nt, Mycobacterium bovis subsp bovis AF2122/97
gcggcaaaguuggccgcccgaa

SEQ ID NO: 1087393 - RNA, 16 nt, Mycobacterium bovis subsp bovis AF2122/97
aagccggcugcauccu

SEQ ID NO: 1087394 - RNA, 21 nt, Mycobacterium bovis subsp bovis AF2122/97
aagccggcugcauccuccucg

SEQ ID NO: 1087395 - RNA, 21 nt, Mycobacterium bovis subsp bovis AF2122/97
aagccggcgcccgccgcgaac

SEQ ID NO: 1087396 - RNA, 20 nt, Mycobacterium bovis subsp bovis AF2122/97
aagccggcgcggcggcgucg

SEQ ID NO: 1087397 - RNA, 15 nt, Mycobacterium bovis subsp bovis AF2122/97
aagccgggucucggu

SEQ ID NO: 1087398 - RNA, 20 nt, Mycobacterium bovis subsp bovis AF2122/97
aagccgcugauguacccggc

SEQ ID NO: 1087399 - RNA, 12 nt, Mycobacterium bovis subsp bovis AF2122/97
aagccgccgggu

SEQ ID NO: 1087400 - RNA, 17 nt, Mycobacterium bovis subsp bovis AF2122/97
aagccgccggaguuggu

SEQ ID NO: 1087401 - RNA, 24 nt, Mycobacterium bovis subsp bovis AF2122/97
aagccgcgcaucugucgcgcggca

SEQ ID NO: 1087402 - RNA, 23 nt, Mycobacterium bovis subsp bovis AF2122/97
aagccgcggcuaggccagcacgg

SEQ ID NO: 1087403 - RNA, 16 nt, Mycobacterium bovis subsp bovis AF2122/97
aagccgcgucgcgaug

SEQ ID NO: 1087404 - RNA, 18 nt, Mycobacterium bovis subsp bovis AF2122/97
aagccgagcccgucgauc

SEQ ID NO: 1087405 - RNA, 17 nt, Mycobacterium bovis subsp bovis AF2122/97
gcggcacacccaucacc

SEQ ID NO: 1087406 - RNA, 24 nt, Mycobacterium bovis subsp bovis AF2122/97
gcggcacacccaucaccgccagcc

SEQ ID NO: 1087407 - RNA, 15 nt, Mycobacterium bovis subsp bovis AF2122/97
gcggcaauggccagc

SEQ ID NO: 1087408 - RNA, 16 nt, Mycobacterium bovis subsp bovis AF2122/97
gcggcaauggccagca

SEQ ID NO: 1087409 - RNA, 17 nt, Mycobacterium bovis subsp bovis AF2122/97
gcggcaauggccagcac

SEQ ID NO: 1087410 - RNA, 20 nt, Mycobacterium bovis subsp bovis AF2122/97
gcggcaauugcgguucgaac

SEQ ID NO: 1087411 - RNA, 18 nt, Mycobacterium bovis subsp bovis AF2122/97
aagccguucugucccggc

SEQ ID NO: 1087412 - RNA, 13 nt, Mycobacterium bovis subsp bovis AF2122/97
aagccguggccgg

SEQ ID NO: 1087413 - RNA, 21 nt, Mycobacterium bovis subsp bovis AF2122/97
aagccgucgcgacgucggccg

SEQ ID NO: 1087414 - RNA, 18 nt, Mycobacterium bovis subsp bovis AF2122/97
aagccucguggugagauc

SEQ ID NO: 1087415 - RNA, 14 nt, Mycobacterium bovis subsp bovis AF2122/97
gcggcaggugcggc

SEQ ID NO: 1087416 - RNA, 17 nt, Mycobacterium bovis subsp bovis AF2122/97
gcggcaggugcggcggc

SEQ ID NO: 1087417 - RNA, 19 nt, Mycobacterium bovis subsp bovis AF2122/97
gcggcaggugcggcggcau

SEQ ID NO: 1087418 - RNA, 17 nt, Mycobacterium bovis subsp bovis AF2122/97
gcggcagguucggcgac

SEQ ID NO: 1087419 - RNA, 23 nt, Mycobacterium bovis subsp bovis AF2122/97
gcggcagucgcgguaccaucacc

SEQ ID NO: 1087420 - RNA, 14 nt, Mycobacterium bovis subsp bovis AF2122/97
gcggcaucgcgggc

SEQ ID NO: 1087421 - RNA, 15 nt, Mycobacterium bovis subsp bovis AF2122/97
gcggcaucgcgggcg

SEQ ID NO: 1087422 - RNA, 15 nt, Mycobacterium bovis subsp bovis AF2122/97
gcggcaucggccagc

SEQ ID NO: 1087423 - RNA, 16 nt, Mycobacterium bovis subsp bovis AF2122/97
gcggcaucggccagcc

SEQ ID NO: 1087424 - RNA, 13 nt, Mycobacterium bovis subsp bovis AF2122/97
gcggcaucggcgg

SEQ ID NO: 1087425 - RNA, 16 nt, Mycobacterium bovis subsp bovis AF2122/97
gcggcaucggcggcaa

SEQ ID NO: 1087426 - RNA, 20 nt, Mycobacterium bovis subsp bovis AF2122/97
gcggcaucggcggcaagggu

SEQ ID NO: 1087427 - RNA, 17 nt, Mycobacterium bovis subsp bovis AF2122/97
gcggcaucgggguuggu

SEQ ID NO: 1087428 - RNA, 13 nt, Mycobacterium bovis subsp bovis AF2122/97
gcggcaucggugg

SEQ ID NO: 1087429 - RNA, 13 nt, Mycobacterium bovis subsp bovis AF2122/97
gcggcaucggcca

SEQ ID NO: 1087430 - RNA, 18 nt, Mycobacterium bovis subsp bovis AF2122/97
gcggcaucucgcaccgcg

SEQ ID NO: 1087431 - RNA, 20 nt, Mycobacterium bovis subsp bovis AF2122/97
gcggcaucucgcaccgcgcc

SEQ ID NO: 1087432 - RNA, 21 nt, Mycobacterium bovis subsp bovis AF2122/97
gcggcaucucgcaccgcgccg

SEQ ID NO: 1087433 - RNA, 17 nt, Mycobacterium bovis subsp bovis AF2122/97
gcggcagcgaggcucgc

SEQ ID NO: 1087434 - RNA, 23 nt, Mycobacterium bovis subsp bovis AF2122/97
gcggcagccuggccucgccauug

SEQ ID NO: 1087435 - RNA, 15 nt, Mycobacterium bovis subsp bovis AF2122/97
gcggcagccggcgga

SEQ ID NO: 1087436 - RNA, 19 nt, Mycobacterium bovis subsp bovis AF2122/97
aagccuuaccccgcagcuc

SEQ ID NO: 1087437 - RNA, 15 nt, Mycobacterium bovis subsp bovis AF2122/97
aagccuugccgucga

SEQ ID NO: 1087438 - RNA, 21 nt, Mycobacterium bovis subsp bovis AF2122/97
aagccuucggugucgccgaac

SEQ ID NO: 1087439 - RNA, 22 nt, Mycobacterium bovis subsp bovis AF2122/97
gcggcagcggguuugccgggcg

SEQ ID NO: 1087440 - RNA, 16 nt, Mycobacterium bovis subsp bovis AF2122/97
gcggcagcggugcugg

SEQ ID NO: 1087441 - RNA, 21 nt, Mycobacterium bovis subsp bovis AF2122/97
gcggcagcgguuuuaggcagc

SEQ ID NO: 1087442 - RNA, 16 nt, Mycobacterium bovis subsp bovis AF2122/97
gcggcagcggcgucgu

SEQ ID NO: 1087443 - RNA, 14 nt, Mycobacterium bovis subsp bovis AF2122/97
gcggcagcggcgau

SEQ ID NO: 1087444 - RNA, 17 nt, Mycobacterium bovis subsp bovis AF2122/97
gcggcagcggcgaucag

SEQ ID NO: 1087445 - RNA, 15 nt, Mycobacterium bovis subsp bovis AF2122/97
gcggcagcggcgccg

SEQ ID NO: 1087446 - RNA, 18 nt, Mycobacterium bovis subsp bovis AF2122/97
gcggcagcggcgccgccu

SEQ ID NO: 1087447 - RNA, 14 nt, Mycobacterium bovis subsp bovis AF2122/97
gcggcagcggcggu

SEQ ID NO: 1087448 - RNA, 21 nt, Mycobacterium bovis subsp bovis AF2122/97
gcggcagcguugacggucagc

SEQ ID NO: 1087449 - RNA, 12 nt, Mycobacterium bovis subsp bovis AF2122/97
gcggcagcccgc

SEQ ID NO: 1087450 - RNA, 15 nt, Mycobacterium bovis subsp bovis AF2122/97
gcggcagggcggugc

SEQ ID NO: 1087451 - RNA, 13 nt, Mycobacterium bovis subsp bovis AF2122/97
gcggcaccgccga

SEQ ID NO: 1087452 - RNA, 14 nt, Mycobacterium bovis subsp bovis AF2122/97
gcggcaccgccccg

SEQ ID NO: 1087453 - RNA, 20 nt, Mycobacterium bovis subsp bovis AF2122/97
gcggcaccgccccgccaacc

SEQ ID NO: 1087454 - RNA, 17 nt, Mycobacterium bovis subsp bovis AF2122/97
gcggcaccgauggcgca

SEQ ID NO: 1087455 - RNA, 20 nt, Mycobacterium bovis subsp bovis AF2122/97
gcggcaccgauggcgcaccg

SEQ ID NO: 1087456 - RNA, 21 nt, Mycobacterium bovis subsp bovis AF2122/97
gcggcaccgauggcgcaccgg

SEQ ID NO: 1087457 - RNA, 15 nt, Mycobacterium bovis subsp bovis AF2122/97
gcggcaccggcucag

SEQ ID NO: 1087458 - RNA, 19 nt, Mycobacterium bovis subsp bovis AF2122/97
gcggcaccgcuucaggcgc

SEQ ID NO: 1087459 - RNA, 13 nt, Mycobacterium bovis subsp bovis AF2122/97
gcggcaccgcuga

SEQ ID NO: 1087460 - RNA, 16 nt, Mycobacterium bovis subsp bovis AF2122/97
gcggcaccgcggccag

SEQ ID NO: 1087461 - RNA, 16 nt, Mycobacterium bovis subsp bovis AF2122/97
gcggcacccggucggc

SEQ ID NO: 1087462 - RNA, 13 nt, Mycobacterium bovis subsp bovis AF2122/97
gcggcacccaacc

SEQ ID NO: 1087463 - RNA, 24 nt, Mycobacterium bovis subsp bovis AF2122/97
gcggcacccaaccaggccgcgaca

SEQ ID NO: 1087464 - RNA, 14 nt, Mycobacterium bovis subsp bovis AF2122/97
gcggcaccagcacc

SEQ ID NO: 1087465 - RNA, 19 nt, Mycobacterium bovis subsp bovis AF2122/97
gcggcaccagcaccgucgg

SEQ ID NO: 1087466 - RNA, 20 nt, Mycobacterium bovis subsp bovis AF2122/97
gcggcacccagucggcgccg

SEQ ID NO: 1087467 - RNA, 22 nt, Mycobacterium bovis subsp bovis AF2122/97
gcggcacccagucggcgccgcc

SEQ ID NO: 1087468 - RNA, 21 nt, Mycobacterium bovis subsp bovis AF2122/97
gcggcacaucaugggcgcugc

SEQ ID NO: 1087469 - RNA, 19 nt, Mycobacterium bovis subsp bovis AF2122/97
gcggcacgaucaaccgggu

SEQ ID NO: 1087470 - RNA, 19 nt, Mycobacterium bovis subsp bovis AF2122/97
gcggcacgcaaugucggca

SEQ ID NO: 1087471 - RNA, 14 nt, Mycobacterium bovis subsp bovis AF2122/97
gcggcacgcacgcg

SEQ ID NO: 1087472 - RNA, 22 nt, Mycobacterium bovis subsp bovis AF2122/97
gcggcagcacccacaucagccg

SEQ ID NO: 1087473 - RNA, 13 nt, Mycobacterium bovis subsp bovis AF2122/97
gcggcagcacccg

SEQ ID NO: 1087474 - RNA, 22 nt, Mycobacterium bovis subsp bovis AF2122/97
gcggcagcauauccgccggcga

SEQ ID NO: 1087475 - RNA, 20 nt, Mycobacterium bovis subsp bovis AF2122/97
gcgggcguugcugauggugc

SEQ ID NO: 1087476 - RNA, 15 nt, Mycobacterium bovis subsp bovis AF2122/97
gcgggcuaaugcgac

SEQ ID NO: 1087477 - RNA, 15 nt, Mycobacterium bovis subsp bovis AF2122/97
gcgggcuaggcggcg

SEQ ID NO: 1087478 - RNA, 16 nt, Mycobacterium bovis subsp bovis AF2122/97
gcgggcuaggcggcgu

SEQ ID NO: 1087479 - RNA, 16 nt, Mycobacterium bovis subsp bovis AF2122/97
gcgggcgucccgcaua

SEQ ID NO: 1087480 - RNA, 18 nt, Mycobacterium bovis subsp bovis AF2122/97
gcgggcgugccgaccagc

SEQ ID NO: 1087481 - RNA, 16 nt, Mycobacterium bovis subsp bovis AF2122/97
gcgggcgugcuacacc

SEQ ID NO: 1087482 - RNA, 18 nt, Mycobacterium bovis subsp bovis AF2122/97
gcgggcgugcuacacccg

SEQ ID NO: 1087483 - RNA, 17 nt, Mycobacterium bovis subsp bovis AF2122/97
gcgggcggugcacaccg

SEQ ID NO: 1087484 - RNA, 23 nt, Mycobacterium bovis subsp bovis AF2122/97
gcgggcggugcacaccgucgcac

SEQ ID NO: 1087485 - RNA, 18 nt, Mycobacterium bovis subsp bovis AF2122/97
gcgggcugauuucgugcg

SEQ ID NO: 1087486 - RNA, 21 nt, Mycobacterium bovis subsp bovis AF2122/97
gcgggcucguguccgccguca

SEQ ID NO: 1087487 - RNA, 23 nt, Mycobacterium bovis subsp bovis AF2122/97
gcgggcugaaacauccccgagcu

SEQ ID NO: 1087488 - RNA, 23 nt, Mycobacterium bovis subsp bovis AF2122/97
gcgggcucgcuucaggcaccgga

SEQ ID NO: 1087489 - RNA, 20 nt, Mycobacterium bovis subsp bovis AF2122/97
gcgggcucuacucgcggccg

SEQ ID NO: 1087490 - RNA, 23 nt, Mycobacterium bovis subsp bovis AF2122/97
gcgggcucuacucgcggccggcg

SEQ ID NO: 1087491 - RNA, 13 nt, Mycobacterium bovis subsp bovis AF2122/97
gcgggcucucggc

SEQ ID NO: 1087492 - RNA, 21 nt, Mycobacterium bovis subsp bovis AF2122/97
gcgggcucgcuucaggcaccg

SEQ ID NO: 1087493 - RNA, 17 nt, Mycobacterium bovis subsp bovis AF2122/97
gcgggcuccccggcaac

SEQ ID NO: 1087494 - RNA, 18 nt, Mycobacterium bovis subsp bovis AF2122/97
gcggggaucacaccccag

SEQ ID NO: 1087495 - RNA, 13 nt, Mycobacterium bovis subsp bovis AF2122/97
gcggggaucagcg

SEQ ID NO: 1087496 - RNA, 15 nt, Mycobacterium bovis subsp bovis AF2122/97
gcggggaaucaccca

SEQ ID NO: 1087497 - RNA, 14 nt, Mycobacterium bovis subsp bovis AF2122/97
gcggggaucagcga

SEQ ID NO: 1087498 - RNA, 17 nt, Mycobacterium bovis subsp bovis AF2122/97
gcggggaucgcuggccg

SEQ ID NO: 1087499 - RNA, 20 nt, Mycobacterium bovis subsp bovis AF2122/97
gcggggaucgcuggccgcga

SEQ ID NO: 1087500 - RNA, 21 nt, Mycobacterium bovis subsp bovis AF2122/97
gcggggauguuuuuggccgcg

SEQ ID NO: 1087501 - RNA, 20 nt, Mycobacterium bovis subsp bovis AF2122/97
gcggggauuggugcccagcg

SEQ ID NO: 1087502 - RNA, 16 nt, Mycobacterium bovis subsp bovis AF2122/97
gcggggacggcggcaa

SEQ ID NO: 1087503 - RNA, 15 nt, Mycobacterium bovis subsp bovis AF2122/97
gcgggcuugccguug

SEQ ID NO: 1087504 - RNA, 18 nt, Mycobacterium bovis subsp bovis AF2122/97
gcgggcuuugagcgcccg

SEQ ID NO: 1087505 - RNA, 21 nt, Mycobacterium bovis subsp bovis AF2122/97
gcggggaaaccggccagccga

SEQ ID NO: 1087506 - RNA, 23 nt, Mycobacterium bovis subsp bovis AF2122/97
gcgggcugcgcuacccagcgcgu

SEQ ID NO: 1087507 - RNA, 20 nt, Mycobacterium bovis subsp bovis AF2122/97
gcgggcugugaacagcgcgu

SEQ ID NO: 1087508 - RNA, 15 nt, Mycobacterium bovis subsp bovis AF2122/97
gcgggcuugagcgcc

SEQ ID NO: 1087509 - RNA, 17 nt, Mycobacterium bovis subsp bovis AF2122/97
gcgggcuugagcgccga

SEQ ID NO: 1087510 - RNA, 22 nt, Mycobacterium bovis subsp bovis AF2122/97
gcgggcuugagcgccgaugugg

SEQ ID NO: 1087511 - RNA, 14 nt, Mycobacterium bovis subsp bovis AF2122/97
gcgggcuugccguc

SEQ ID NO: 1087512 - RNA, 22 nt, Mycobacterium bovis subsp bovis AF2122/97
gcgggcuugccgucuucgccgc

SEQ ID NO: 1087513 - RNA, 17 nt, Mycobacterium bovis subsp bovis AF2122/97
gcgggcuuggcgucgac

SEQ ID NO: 1087514 - RNA, 23 nt, Mycobacterium bovis subsp bovis AF2122/97
gcgggcuuggggucccgccgggu

SEQ ID NO: 1087515 - RNA, 16 nt, Mycobacterium bovis subsp bovis AF2122/97
gcgggcggaucgccgg

SEQ ID NO: 1087516 - RNA, 13 nt, Mycobacterium bovis subsp bovis AF2122/97
gcgggcggcaccg

SEQ ID NO: 1087517 - RNA, 14 nt, Mycobacterium bovis subsp bovis AF2122/97
gcgggcgccccacc

SEQ ID NO: 1087518 - RNA, 16 nt, Mycobacterium bovis subsp bovis AF2122/97
gcgggcgauggcgagc

SEQ ID NO: 1087519 - RNA, 14 nt, Mycobacterium bovis subsp bovis AF2122/97
gcgggcgcaccagg

SEQ ID NO: 1087520 - RNA, 13 nt, Mycobacterium bovis subsp bovis AF2122/97
gcgggccaggccc

SEQ ID NO: 1087521 - RNA, 17 nt, Mycobacterium bovis subsp bovis AF2122/97
gcgggccaggcccucga

SEQ ID NO: 1087522 - RNA, 15 nt, Mycobacterium bovis subsp bovis AF2122/97
gcgggcccgaugagg

SEQ ID NO: 1087523 - RNA, 18 nt, Mycobacterium bovis subsp bovis AF2122/97
gcgggcccgcgcggcggu

SEQ ID NO: 1087524 - RNA, 21 nt, Mycobacterium bovis subsp bovis AF2122/97
gcgggcgagaacccacgcaug

SEQ ID NO: 1087525 - RNA, 16 nt, Mycobacterium bovis subsp bovis AF2122/97
gcgggcccacgcccaa

SEQ ID NO: 1087526 - RNA, 22 nt, Mycobacterium bovis subsp bovis AF2122/97
gcgggcgacaucgagaucgccg

SEQ ID NO: 1087527 - RNA, 14 nt, Mycobacterium bovis subsp bovis AF2122/97
gcgggcgaccaccg

SEQ ID NO: 1087528 - RNA, 16 nt, Mycobacterium bovis subsp bovis AF2122/97
gcgggcgaccaccgcg

SEQ ID NO: 1087529 - RNA, 16 nt, Mycobacterium bovis subsp bovis AF2122/97
gcgggcgaugagcgcg

SEQ ID NO: 1087530 - RNA, 20 nt, Mycobacterium bovis subsp bovis AF2122/97
gcgggcgaugagcgcgaucu

SEQ ID NO: 1087531 - RNA, 20 nt, Mycobacterium bovis subsp bovis AF2122/97
gcgggcgaucgcggcgagca

SEQ ID NO: 1087532 - RNA, 14 nt, Mycobacterium bovis subsp bovis AF2122/97
gcgggcgaucggca

SEQ ID NO: 1087533 - RNA, 22 nt, Mycobacterium bovis subsp bovis AF2122/97
gcggcuaggccagcacggcgac

SEQ ID NO: 1087534 - RNA, 17 nt, Mycobacterium bovis subsp bovis AF2122/97
gcggcuauggcgccgcg

SEQ ID NO: 1087535 - RNA, 18 nt, Mycobacterium bovis subsp bovis AF2122/97
gcggcuauggcgccgcgg

SEQ ID NO: 1087536 - RNA, 13 nt, Mycobacterium bovis subsp bovis AF2122/97
gcggcucaccgcg

SEQ ID NO: 1087537 - RNA, 14 nt, Mycobacterium bovis subsp bovis AF2122/97
gcggcucacgaccg

SEQ ID NO: 1087538 - RNA, 22 nt, Mycobacterium bovis subsp bovis AF2122/97
aagcugcucgucggcgccggcg

SEQ ID NO: 1087539 - RNA, 20 nt, Mycobacterium bovis subsp bovis AF2122/97
gcggcguugugaccgccgau

SEQ ID NO: 1087540 - RNA, 18 nt, Mycobacterium bovis subsp bovis AF2122/97
gcggcguuguggcgugug

SEQ ID NO: 1087541 - RNA, 19 nt, Mycobacterium bovis subsp bovis AF2122/97
gcggcguugugaccgccga

SEQ ID NO: 1087542 - RNA, 18 nt, Mycobacterium bovis subsp bovis AF2122/97
gcggcuucguggcggcgc

SEQ ID NO: 1087543 - RNA, 19 nt, Mycobacterium bovis subsp bovis AF2122/97
gcggcuucguggcggcgcg

SEQ ID NO: 1087544 - RNA, 18 nt, Mycobacterium bovis subsp bovis AF2122/97
gcggcuugaacagcugau

SEQ ID NO: 1087545 - RNA, 12 nt, Mycobacterium bovis subsp bovis AF2122/97
gcggcuuggccg

SEQ ID NO: 1087546 - RNA, 18 nt, Mycobacterium bovis subsp bovis AF2122/97
gcggcuuggccgccccgg

SEQ ID NO: 1087547 - RNA, 21 nt, Mycobacterium bovis subsp bovis AF2122/97
gcggcuuggccuagccgcggc

SEQ ID NO: 1087548 - RNA, 21 nt, Mycobacterium bovis subsp bovis AF2122/97
gcggcuuugacgcccggcacc

SEQ ID NO: 1087549 - RNA, 17 nt, Mycobacterium bovis subsp bovis AF2122/97
gcggcuuuggccgccgu

SEQ ID NO: 1087550 - RNA, 15 nt, Mycobacterium bovis subsp bovis AF2122/97
gcggcuugggcuugc

SEQ ID NO: 1087551 - RNA, 15 nt, Mycobacterium bovis subsp bovis AF2122/97
gcggcuugucgcccc

SEQ ID NO: 1087552 - RNA, 15 nt, Mycobacterium bovis subsp bovis AF2122/97
gcggcuuucagcgcu

SEQ ID NO: 1087553 - RNA, 15 nt, Mycobacterium bovis subsp bovis AF2122/97
gcgggaucgguggcg

SEQ ID NO: 1087554 - RNA, 20 nt, Mycobacterium bovis subsp bovis AF2122/97
gcgggaucgguggcggcacg

SEQ ID NO: 1087555 - RNA, 21 nt, Mycobacterium bovis subsp bovis AF2122/97
gcgggagguacccccagcacc

SEQ ID NO: 1087556 - RNA, 14 nt, Mycobacterium bovis subsp bovis AF2122/97
gcgggagucgucga

SEQ ID NO: 1087557 - RNA, 16 nt, Mycobacterium bovis subsp bovis AF2122/97
gcgggcaccuccgcgu

SEQ ID NO: 1087558 - RNA, 17 nt, Mycobacterium bovis subsp bovis AF2122/97
gcgggauccaggcccag

SEQ ID NO: 1087559 - RNA, 18 nt, Mycobacterium bovis subsp bovis AF2122/97
gcgggauccaggcccagc

SEQ ID NO: 1087560 - RNA, 19 nt, Mycobacterium bovis subsp bovis AF2122/97
gcgggcacgcccucgucga

SEQ ID NO: 1087561 - RNA, 15 nt, Mycobacterium bovis subsp bovis AF2122/97
gcgggcacgccgccg

SEQ ID NO: 1087562 - RNA, 17 nt, Mycobacterium bovis subsp bovis AF2122/97
gcgggcagcuguucggc

SEQ ID NO: 1087563 - RNA, 15 nt, Mycobacterium bovis subsp bovis AF2122/97
gcgggcagcaggcga

SEQ ID NO: 1087564 - RNA, 20 nt, Mycobacterium bovis subsp bovis AF2122/97
gcgggcagcaggcgaugcgc

SEQ ID NO: 1087565 - RNA, 16 nt, Mycobacterium bovis subsp bovis AF2122/97
gcgggcacucagcagg

SEQ ID NO: 1087566 - RNA, 12 nt, Mycobacterium bovis subsp bovis AF2122/97
gcgggcagccgc

SEQ ID NO: 1087567 - RNA, 21 nt, Mycobacterium bovis subsp bovis AF2122/97
gcgggcagccgcccgccagga

SEQ ID NO: 1087568 - RNA, 23 nt, Mycobacterium bovis subsp bovis AF2122/97
gcgggcaguagcuguggcccgcg

SEQ ID NO: 1087569 - RNA, 15 nt, Mycobacterium bovis subsp bovis AF2122/97
gcgggcaguggcagc

SEQ ID NO: 1087570 - RNA, 17 nt, Mycobacterium bovis subsp bovis AF2122/97
gcgggcaguggcagccc

SEQ ID NO: 1087571 - RNA, 21 nt, Mycobacterium bovis subsp bovis AF2122/97
gcgggacgggggcuguccacc

SEQ ID NO: 1087572 - RNA, 17 nt, Mycobacterium bovis subsp bovis AF2122/97
gcgggacgucgucguug

SEQ ID NO: 1087573 - RNA, 18 nt, Mycobacterium bovis subsp bovis AF2122/97
gcgggacgucgucguuga

SEQ ID NO: 1087574 - RNA, 15 nt, Mycobacterium bovis subsp bovis AF2122/97
gcgggacucggcgag

SEQ ID NO: 1087575 - RNA, 17 nt, Mycobacterium bovis subsp bovis AF2122/97
gcgggacugcagcgcgg

SEQ ID NO: 1087576 - RNA, 19 nt, Mycobacterium bovis subsp bovis AF2122/97
gcgggacugcggaagccac

SEQ ID NO: 1087577 - RNA, 21 nt, Mycobacterium bovis subsp bovis AF2122/97
gcgggagaaaacggcggcgcc

SEQ ID NO: 1087578 - RNA, 19 nt, Mycobacterium bovis subsp bovis AF2122/97
gcgggagcggaauggcgcc

SEQ ID NO: 1087579 - RNA, 14 nt, Mycobacterium bovis subsp bovis AF2122/97
gcgggagaucgucg

SEQ ID NO: 1087580 - RNA, 19 nt, Mycobacterium bovis subsp bovis AF2122/97
gcgggagguacccccagca

SEQ ID NO: 1087581 - RNA, 21 nt, Mycobacterium bovis subsp bovis AF2122/97
gcgggaccgagaacugcucga

SEQ ID NO: 1087582 - RNA, 13 nt, Mycobacterium bovis subsp bovis AF2122/97
gcgggacgccccg

SEQ ID NO: 1087583 - RNA, 13 nt, Mycobacterium bovis subsp bovis AF2122/97
gcgggacgccgaa

SEQ ID NO: 1087584 - RNA, 14 nt, Mycobacterium bovis subsp bovis AF2122/97
gcgggacacgucgc

SEQ ID NO: 1087585 - RNA, 17 nt, Mycobacterium bovis subsp bovis AF2122/97
gcgggacaacagcaugg

SEQ ID NO: 1087586 - RNA, 18 nt, Mycobacterium bovis subsp bovis AF2122/97
gcgggacagauggcggcc

SEQ ID NO: 1087587 - RNA, 20 nt, Mycobacterium bovis subsp bovis AF2122/97
gcgggacagauggcggccga

SEQ ID NO: 1087588 - RNA, 14 nt, Mycobacterium bovis subsp bovis AF2122/97
gcggggugugcggu

SEQ ID NO: 1087589 - RNA, 17 nt, Mycobacterium bovis subsp bovis AF2122/97
gcgggguggaauucauc

SEQ ID NO: 1087590 - RNA, 15 nt, Mycobacterium bovis subsp bovis AF2122/97
gcgggguggcggcgc

SEQ ID NO: 1087591 - RNA, 18 nt, Mycobacterium bovis subsp bovis AF2122/97
gcgggguugaucaccgac

SEQ ID NO: 1087592 - RNA, 22 nt, Mycobacterium bovis subsp bovis AF2122/97
gcgggguugaucaccgacaccg

SEQ ID NO: 1087593 - RNA, 21 nt, Mycobacterium bovis subsp bovis AF2122/97
gcgggggaguaguggugggcg

SEQ ID NO: 1087594 - RNA, 13 nt, Mycobacterium bovis subsp bovis AF2122/97
gcgggggugggcg

SEQ ID NO: 1087595 - RNA, 16 nt, Mycobacterium bovis subsp bovis AF2122/97
gcgggguaggcccagc

SEQ ID NO: 1087596 - RNA, 18 nt, Mycobacterium bovis subsp bovis AF2122/97
gcggguaggugacgacgu

SEQ ID NO: 1087597 - RNA, 23 nt, Mycobacterium bovis subsp bovis AF2122/97
gcggguagauguucacgccgccg

SEQ ID NO: 1087598 - RNA, 15 nt, Mycobacterium bovis subsp bovis AF2122/97
gcgggguuggccgug

SEQ ID NO: 1087599 - RNA, 16 nt, Mycobacterium bovis subsp bovis AF2122/97
gcggguaagacgucgg

SEQ ID NO: 1087600 - RNA, 17 nt, Mycobacterium bovis subsp bovis AF2122/97
gcggggcucaaccccgu

SEQ ID NO: 1087601 - RNA, 16 nt, Mycobacterium bovis subsp bovis AF2122/97
gcgggggaccccgcca

SEQ ID NO: 1087602 - RNA, 20 nt, Mycobacterium bovis subsp bovis AF2122/97
gcgggggaccccgccagccg

SEQ ID NO: 1087603 - RNA, 16 nt, Mycobacterium bovis subsp bovis AF2122/97
gcgggggaccgcccga

SEQ ID NO: 1087604 - RNA, 13 nt, Mycobacterium bovis subsp bovis AF2122/97
gcgggggcggcgg

SEQ ID NO: 1087605 - RNA, 21 nt, Mycobacterium bovis subsp bovis AF2122/97
gcgggggaucucgagccgcgg

SEQ ID NO: 1087606 - RNA, 12 nt, Mycobacterium bovis subsp bovis AF2122/97
gcgggggcggcg

SEQ ID NO: 1087607 - RNA, 15 nt, Mycobacterium bovis subsp bovis AF2122/97
gcgggggagcgaacg

SEQ ID NO: 1087608 - RNA, 18 nt, Mycobacterium bovis subsp bovis AF2122/97
gcgggggagcgaacggcg

SEQ ID NO: 1087609 - RNA, 22 nt, Mycobacterium bovis subsp bovis AF2122/97
gcggggcgaaguggaucuggcg

SEQ ID NO: 1087610 - RNA, 21 nt, Mycobacterium bovis subsp bovis AF2122/97
gcggggcggacucacgaggca

SEQ ID NO: 1087611 - RNA, 14 nt, Mycobacterium bovis subsp bovis AF2122/97
gcggggccgccgcg

SEQ ID NO: 1087612 - RNA, 16 nt, Mycobacterium bovis subsp bovis AF2122/97
gcggggccgccgcggc

SEQ ID NO: 1087613 - RNA, 15 nt, Mycobacterium bovis subsp bovis AF2122/97
gcggggccggcggcu

SEQ ID NO: 1087614 - RNA, 16 nt, Mycobacterium bovis subsp bovis AF2122/97
gcggggccggcggcuc

SEQ ID NO: 1087615 - RNA, 21 nt, Mycobacterium bovis subsp bovis AF2122/97
gcggggauguccgcggccacc

SEQ ID NO: 1087616 - RNA, 15 nt, Mycobacterium bovis subsp bovis AF2122/97
gcggggcagcgggcc

SEQ ID NO: 1087617 - RNA, 12 nt, Mycobacterium bovis subsp bovis AF2122/97
gcggggcccaca

SEQ ID NO: 1087618 - RNA, 15 nt, Mycobacterium bovis subsp bovis AF2122/97
gcggggcccacacgg

SEQ ID NO: 1087619 - RNA, 12 nt, Mycobacterium bovis subsp bovis AF2122/97
gcgggucagccu

SEQ ID NO: 1087620 - RNA, 13 nt, Mycobacterium bovis subsp bovis AF2122/97
gcgggucagcgcc

SEQ ID NO: 1087621 - RNA, 15 nt, Mycobacterium bovis subsp bovis AF2122/97
gcgggucagcgccga

SEQ ID NO: 1087622 - RNA, 16 nt, Mycobacterium bovis subsp bovis AF2122/97
gcgggucagcugacgg

SEQ ID NO: 1087623 - RNA, 19 nt, Mycobacterium bovis subsp bovis AF2122/97
gcgggucagcugacgggcc

SEQ ID NO: 1087624 - RNA, 16 nt, Mycobacterium bovis subsp bovis AF2122/97
gcgggucccgccacca

SEQ ID NO: 1087625 - RNA, 21 nt, Mycobacterium bovis subsp bovis AF2122/97
gcggguccagccaccgacccc

SEQ ID NO: 1087626 - RNA, 13 nt, Mycobacterium bovis subsp bovis AF2122/97
gcgggucggcgac

SEQ ID NO: 1087627 - RNA, 14 nt, Mycobacterium bovis subsp bovis AF2122/97
gcgggucgccgcca

SEQ ID NO: 1087628 - RNA, 21 nt, Mycobacterium bovis subsp bovis AF2122/97
gcggguccucgcggagccguc

SEQ ID NO: 1087629 - RNA, 12 nt, Mycobacterium bovis subsp bovis AF2122/97
gcgggucggcgg

SEQ ID NO: 1087630 - RNA, 15 nt, Mycobacterium bovis subsp bovis AF2122/97
gcgggucguccggcg

SEQ ID NO: 1087631 - RNA, 21 nt, Mycobacterium bovis subsp bovis AF2122/97
gcgggucggucgguaacggcg

SEQ ID NO: 1087632 - RNA, 14 nt, Mycobacterium bovis subsp bovis AF2122/97
gcgggugaugcagu

SEQ ID NO: 1087633 - RNA, 16 nt, Mycobacterium bovis subsp bovis AF2122/97
gcgggugaucuccacc

SEQ ID NO: 1087634 - RNA, 23 nt, Mycobacterium bovis subsp bovis AF2122/97
gcgggugauggaugggucgaccg

SEQ ID NO: 1087635 - RNA, 21 nt, Mycobacterium bovis subsp bovis AF2122/97
gcgggugaugacgccgucggc

SEQ ID NO: 1087636 - RNA, 21 nt, Mycobacterium bovis subsp bovis AF2122/97
gcgggugaggucauagccguu

SEQ ID NO: 1087637 - RNA, 18 nt, Mycobacterium bovis subsp bovis AF2122/97
gcgggugaaucgacaccg

SEQ ID NO: 1087638 - RNA, 17 nt, Mycobacterium bovis subsp bovis AF2122/97
gcgggugcggacaccga

SEQ ID NO: 1087639 - RNA, 14 nt, Mycobacterium bovis subsp bovis AF2122/97
gcgggugcggcaau

SEQ ID NO: 1087640 - RNA, 15 nt, Mycobacterium bovis subsp bovis AF2122/97
gcgggugauguucgu

SEQ ID NO: 1087641 - RNA, 15 nt, Mycobacterium bovis subsp bovis AF2122/97
gcgggucgugccagc

SEQ ID NO: 1087642 - RNA, 20 nt, Mycobacterium bovis subsp bovis AF2122/97
gcgggucucgccgaccuugg

SEQ ID NO: 1087643 - RNA, 20 nt, Mycobacterium bovis subsp bovis AF2122/97
gcgggugaccaacacccccc

SEQ ID NO: 1087644 - RNA, 19 nt, Mycobacterium bovis subsp bovis AF2122/97
gcgggugaccaggcggcgc

SEQ ID NO: 1087645 - RNA, 18 nt, Mycobacterium bovis subsp bovis AF2122/97
gcgggucucgccgaccuu

SEQ ID NO: 1087646 - RNA, 13 nt, Mycobacterium bovis subsp bovis AF2122/97
gcgguccaccggc

SEQ ID NO: 1087647 - RNA, 15 nt, Mycobacterium bovis subsp bovis AF2122/97
gcgguccaccggccc

SEQ ID NO: 1087648 - RNA, 21 nt, Mycobacterium bovis subsp bovis AF2122/97
gcgguccaccggcccucgcca

SEQ ID NO: 1087649 - RNA, 14 nt, Mycobacterium bovis subsp bovis AF2122/97
gcgguccgcugcca

SEQ ID NO: 1087650 - RNA, 21 nt, Mycobacterium bovis subsp bovis AF2122/97
gcgguccggaaauuccggcgc

SEQ ID NO: 1087651 - RNA, 18 nt, Mycobacterium bovis subsp bovis AF2122/97
gcgguccggaugcgcaac

SEQ ID NO: 1087652 - RNA, 14 nt, Mycobacterium bovis subsp bovis AF2122/97
gcggucauggcgac

SEQ ID NO: 1087653 - RNA, 15 nt, Mycobacterium bovis subsp bovis AF2122/97
gcggucauggcgacg

SEQ ID NO: 1087654 - RNA, 13 nt, Mycobacterium bovis subsp bovis AF2122/97
gcggucaugggcg

SEQ ID NO: 1087655 - RNA, 23 nt, Mycobacterium bovis subsp bovis AF2122/97
gcgguccaacagcgccaguagca

SEQ ID NO: 1087656 - RNA, 14 nt, Mycobacterium bovis subsp bovis AF2122/97
gcggucaacgacag

SEQ ID NO: 1087657 - RNA, 16 nt, Mycobacterium bovis subsp bovis AF2122/97
gcggucaacgcugacg

SEQ ID NO: 1087658 - RNA, 20 nt, Mycobacterium bovis subsp bovis AF2122/97
gcggucaauguggcgcuucg

SEQ ID NO: 1087659 - RNA, 15 nt, Mycobacterium bovis subsp bovis AF2122/97
gcggucaucgccucg

SEQ ID NO: 1087660 - RNA, 15 nt, Mycobacterium bovis subsp bovis AF2122/97
gcggucaucggcgcc

SEQ ID NO: 1087661 - RNA, 17 nt, Mycobacterium bovis subsp bovis AF2122/97
gcggucaucggcgccaa

SEQ ID NO: 1087662 - RNA, 15 nt, Mycobacterium bovis subsp bovis AF2122/97
gcgguaucggucgac

SEQ ID NO: 1087663 - RNA, 17 nt, Mycobacterium bovis subsp bovis AF2122/97
gcgguaucggucagcca

SEQ ID NO: 1087664 - RNA, 13 nt, Mycobacterium bovis subsp bovis AF2122/97
gcgguaucggucg

SEQ ID NO: 1087665 - RNA, 16 nt, Mycobacterium bovis subsp bovis AF2122/97
gcgguagccgagcucg

SEQ ID NO: 1087666 - RNA, 22 nt, Mycobacterium bovis subsp bovis AF2122/97
gcgguaucccccagccgcggcg

SEQ ID NO: 1087667 - RNA, 17 nt, Mycobacterium bovis subsp bovis AF2122/97
gcgguaucggcauaccc

SEQ ID NO: 1087668 - RNA, 15 nt, Mycobacterium bovis subsp bovis AF2122/97
gcgguaucggucagc

SEQ ID NO: 1087669 - RNA, 19 nt, Mycobacterium bovis subsp bovis AF2122/97
gcgguauuugaacgcccgc

SEQ ID NO: 1087670 - RNA, 19 nt, Mycobacterium bovis subsp bovis AF2122/97
gcgguaugcucgcuggcgc

SEQ ID NO: 1087671 - RNA, 17 nt, Mycobacterium bovis subsp bovis AF2122/97
gcgguagccgaccagcg

SEQ ID NO: 1087672 - RNA, 20 nt, Mycobacterium bovis subsp bovis AF2122/97
gcgguagcagccgcugagcg

SEQ ID NO: 1087673 - RNA, 23 nt, Mycobacterium bovis subsp bovis AF2122/97
gcgguagccgaccagcgcuagcg

SEQ ID NO: 1087674 - RNA, 23 nt, Mycobacterium bovis subsp bovis AF2122/97
gcgguagccgaccgaccgcacga

SEQ ID NO: 1087675 - RNA, 14 nt, Mycobacterium bovis subsp bovis AF2122/97
gcgguagccgacga

SEQ ID NO: 1087676 - RNA, 18 nt, Mycobacterium bovis subsp bovis AF2122/97
gcgguagccgacgacacg

SEQ ID NO: 1087677 - RNA, 17 nt, Mycobacterium bovis subsp bovis AF2122/97
gcgguagccgagcucgu

SEQ ID NO: 1087678 - RNA, 14 nt, Mycobacterium bovis subsp bovis AF2122/97
gcgguacugcgcag

SEQ ID NO: 1087679 - RNA, 14 nt, Mycobacterium bovis subsp bovis AF2122/97
gcgguacgccgguc

SEQ ID NO: 1087680 - RNA, 20 nt, Mycobacterium bovis subsp bovis AF2122/97
gcgguacgccggucggugcg

SEQ ID NO: 1087681 - RNA, 17 nt, Mycobacterium bovis subsp bovis AF2122/97
gcggguuuuccagccuu

SEQ ID NO: 1087682 - RNA, 19 nt, Mycobacterium bovis subsp bovis AF2122/97
gcggguuucgcucgcaccg

SEQ ID NO: 1087683 - RNA, 18 nt, Mycobacterium bovis subsp bovis AF2122/97
gcggguuugaucuccacc

SEQ ID NO: 1087684 - RNA, 20 nt, Mycobacterium bovis subsp bovis AF2122/97
gcggguuugaucuccaccuu

SEQ ID NO: 1087685 - RNA, 21 nt, Mycobacterium bovis subsp bovis AF2122/97
gcggguuugcccauccccggu

SEQ ID NO: 1087686 - RNA, 22 nt, Mycobacterium bovis subsp bovis AF2122/97
gcggguuugccgggcgcuggac

SEQ ID NO: 1087687 - RNA, 17 nt, Mycobacterium bovis subsp bovis AF2122/97
gcggguuugcgguaguc

SEQ ID NO: 1087688 - RNA, 18 nt, Mycobacterium bovis subsp bovis AF2122/97
gcgguaccuagccgcaga

SEQ ID NO: 1087689 - RNA, 14 nt, Mycobacterium bovis subsp bovis AF2122/97
gcggguugggugug

SEQ ID NO: 1087690 - RNA, 17 nt, Mycobacterium bovis subsp bovis AF2122/97
gcgguaccgcucgggcg

SEQ ID NO: 1087691 - RNA, 18 nt, Mycobacterium bovis subsp bovis AF2122/97
gcgguaccgcucgggcgc

SEQ ID NO: 1087692 - RNA, 15 nt, Mycobacterium bovis subsp bovis AF2122/97
gcggguugcgcggcu

SEQ ID NO: 1087693 - RNA, 17 nt, Mycobacterium bovis subsp bovis AF2122/97
gcggguugcggucaccg

SEQ ID NO: 1087694 - RNA, 23 nt, Mycobacterium bovis subsp bovis AF2122/97
gcggguugucuuucacaugcgcc

SEQ ID NO: 1087695 - RNA, 16 nt, Mycobacterium bovis subsp bovis AF2122/97
gcggguuguggcaccc

SEQ ID NO: 1087696 - RNA, 18 nt, Mycobacterium bovis subsp bovis AF2122/97
gcggguuguggcacccgg

SEQ ID NO: 1087697 - RNA, 15 nt, Mycobacterium bovis subsp bovis AF2122/97
gcggguugggaccga

SEQ ID NO: 1087698 - RNA, 13 nt, Mycobacterium bovis subsp bovis AF2122/97
gcggguggccggg

SEQ ID NO: 1087699 - RNA, 21 nt, Mycobacterium bovis subsp bovis AF2122/97
gcggguggaaguacuucgcgg

SEQ ID NO: 1087700 - RNA, 18 nt, Mycobacterium bovis subsp bovis AF2122/97
gcgggugcuggucaacag

SEQ ID NO: 1087701 - RNA, 22 nt, Mycobacterium bovis subsp bovis AF2122/97
gcggguggugaaguagucggcg

SEQ ID NO: 1087702 - RNA, 17 nt, Mycobacterium bovis subsp bovis AF2122/97
gcggguggugccggcgg

SEQ ID NO: 1087703 - RNA, 18 nt, Mycobacterium bovis subsp bovis AF2122/97
gcggguggugccggcgga

SEQ ID NO: 1087704 - RNA, 17 nt, Mycobacterium bovis subsp bovis AF2122/97
gcggguguggcuacgac

SEQ ID NO: 1087705 - RNA, 17 nt, Mycobacterium bovis subsp bovis AF2122/97
gcggguguuccacacca

SEQ ID NO: 1087706 - RNA, 23 nt, Mycobacterium bovis subsp bovis AF2122/97
gcggguguuccacaccaggccga

SEQ ID NO: 1087707 - RNA, 16 nt, Mycobacterium bovis subsp bovis AF2122/97
gcggguucacuuccgg

SEQ ID NO: 1087708 - RNA, 18 nt, Mycobacterium bovis subsp bovis AF2122/97
gcggguucaacgcgcgca

SEQ ID NO: 1087709 - RNA, 20 nt, Mycobacterium bovis subsp bovis AF2122/97
gcggguucaacgcgcgcacg

SEQ ID NO: 1087710 - RNA, 21 nt, Mycobacterium bovis subsp bovis AF2122/97
gcggguucacugccggccaac

SEQ ID NO: 1087711 - RNA, 15 nt, Mycobacterium bovis subsp bovis AF2122/97
gcggguucgacguug

SEQ ID NO: 1087712 - RNA, 20 nt, Mycobacterium bovis subsp bovis AF2122/97
gcggguucgacguugaucgc

SEQ ID NO: 1087713 - RNA, 21 nt, Mycobacterium bovis subsp bovis AF2122/97
gcggguucgacguugaucgcc

SEQ ID NO: 1087714 - RNA, 23 nt, Mycobacterium bovis subsp bovis AF2122/97
gcggccgggcuccccaagucgac

SEQ ID NO: 1087715 - RNA, 15 nt, Mycobacterium bovis subsp bovis AF2122/97
gcggccgggguggug

SEQ ID NO: 1087716 - RNA, 20 nt, Mycobacterium bovis subsp bovis AF2122/97
gcggccgguacacguccagu

SEQ ID NO: 1087717 - RNA, 14 nt, Mycobacterium bovis subsp bovis AF2122/97
gcggccggguucgc

SEQ ID NO: 1087718 - RNA, 17 nt, Mycobacterium bovis subsp bovis AF2122/97
gcggccggguucgcguc

SEQ ID NO: 1087719 - RNA, 12 nt, Mycobacterium bovis subsp bovis AF2122/97
gcggccgucgcg

SEQ ID NO: 1087720 - RNA, 16 nt, Mycobacterium bovis subsp bovis AF2122/97
gcggccucgaccucuu

SEQ ID NO: 1087721 - RNA, 17 nt, Mycobacterium bovis subsp bovis AF2122/97
gcggccucgccggcgcg

SEQ ID NO: 1087722 - RNA, 17 nt, Mycobacterium bovis subsp bovis AF2122/97
gcggccgcuccaccucg

SEQ ID NO: 1087723 - RNA, 12 nt, Mycobacterium bovis subsp bovis AF2122/97
gcggccgccggg

SEQ ID NO: 1087724 - RNA, 13 nt, Mycobacterium bovis subsp bovis AF2122/97
gcggccgccggga

SEQ ID NO: 1087725 - RNA, 13 nt, Mycobacterium bovis subsp bovis AF2122/97
gcggccgcugggc

SEQ ID NO: 1087726 - RNA, 11 nt, Mycobacterium bovis subsp bovis AF2122/97
gcggccgccgg

SEQ ID NO: 1087727 - RNA, 20 nt, Mycobacterium bovis subsp bovis AF2122/97
gcggccggauguugaccggc

SEQ ID NO: 1087728 - RNA, 13 nt, Mycobacterium bovis subsp bovis AF2122/97
gcggccggcacgg

SEQ ID NO: 1087729 - RNA, 21 nt, Mycobacterium bovis subsp bovis AF2122/97
gcggccaacggcuccgggcgc

SEQ ID NO: 1087730 - RNA, 19 nt, Mycobacterium bovis subsp bovis AF2122/97
gcggccgcagccagcaagu

SEQ ID NO: 1087731 - RNA, 17 nt, Mycobacterium bovis subsp bovis AF2122/97
gcggcauuuucgaggua

SEQ ID NO: 1087732 - RNA, 15 nt, Mycobacterium bovis subsp bovis AF2122/97
gcggccgccaucagc

SEQ ID NO: 1087733 - RNA, 12 nt, Mycobacterium bovis subsp bovis AF2122/97
gcggccgccgag

SEQ ID NO: 1087734 - RNA, 22 nt, Mycobacterium bovis subsp bovis AF2122/97
gcggccgcaaucaugucagcgc

SEQ ID NO: 1087735 - RNA, 12 nt, Mycobacterium bovis subsp bovis AF2122/97
gcggccgccgca

SEQ ID NO: 1087736 - RNA, 15 nt, Mycobacterium bovis subsp bovis AF2122/97
gcggcauggcaggcg

SEQ ID NO: 1087737 - RNA, 22 nt, Mycobacterium bovis subsp bovis AF2122/97
gcggcauggcauggcgaacacg

SEQ ID NO: 1087738 - RNA, 20 nt, Mycobacterium bovis subsp bovis AF2122/97
gcggcaugauuuuucgcagu

SEQ ID NO: 1087739 - RNA, 23 nt, Mycobacterium bovis subsp bovis AF2122/97
gcggcaugcaaugcuggcggcgc

SEQ ID NO: 1087740 - RNA, 20 nt, Mycobacterium bovis subsp bovis AF2122/97
gcggcaugcagaucucacgg

SEQ ID NO: 1087741 - RNA, 13 nt, Mycobacterium bovis subsp bovis AF2122/97
gcggccaacgaac

SEQ ID NO: 1087742 - RNA, 17 nt, Mycobacterium bovis subsp bovis AF2122/97
gcggccaacgacgaccc

SEQ ID NO: 1087743 - RNA, 17 nt, Mycobacterium bovis subsp bovis AF2122/97
gcggccaacagcacccg

SEQ ID NO: 1087744 - RNA, 22 nt, Mycobacterium bovis subsp bovis AF2122/97
gcggccaacccauuucgucagc

SEQ ID NO: 1087745 - RNA, 23 nt, Mycobacterium bovis subsp bovis AF2122/97
gcggcaugggucgugcaggcgac

SEQ ID NO: 1087746 - RNA, 22 nt, Mycobacterium bovis subsp bovis AF2122/97
gcggcauugguaccggcuucgu

SEQ ID NO: 1087747 - RNA, 20 nt, Mycobacterium bovis subsp bovis AF2122/97
gcggcauucucgagcacccg

SEQ ID NO: 1087748 - RNA, 23 nt, Mycobacterium bovis subsp bovis AF2122/97
gcggcauuaccaacgcggugacg

SEQ ID NO: 1087749 - RNA, 22 nt, Mycobacterium bovis subsp bovis AF2122/97
gcggcgaaccagcgcgucucgu

SEQ ID NO: 1087750 - RNA, 14 nt, Mycobacterium bovis subsp bovis AF2122/97
gcggcgaaccagcg

SEQ ID NO: 1087751 - RNA, 16 nt, Mycobacterium bovis subsp bovis AF2122/97
gcggcgaacaucaccg

SEQ ID NO: 1087752 - RNA, 18 nt, Mycobacterium bovis subsp bovis AF2122/97
gcggcgaacaucaccguc

SEQ ID NO: 1087753 - RNA, 12 nt, Mycobacterium bovis subsp bovis AF2122/97
gcggcgaacucu

SEQ ID NO: 1087754 - RNA, 18 nt, Mycobacterium bovis subsp bovis AF2122/97
gcggccguaacggcgaaa

SEQ ID NO: 1087755 - RNA, 13 nt, Mycobacterium bovis subsp bovis AF2122/97
gcggccucgucga

SEQ ID NO: 1087756 - RNA, 15 nt, Mycobacterium bovis subsp bovis AF2122/97
gcggccucgucgagu

SEQ ID NO: 1087757 - RNA, 17 nt, Mycobacterium bovis subsp bovis AF2122/97
gcggccugcagguuggu

SEQ ID NO: 1087758 - RNA, 21 nt, Mycobacterium bovis subsp bovis AF2122/97
gcggccugcccgccguuacgg

SEQ ID NO: 1087759 - RNA, 12 nt, Mycobacterium bovis subsp bovis AF2122/97
gcggcgaccacc

SEQ ID NO: 1087760 - RNA, 12 nt, Mycobacterium bovis subsp bovis AF2122/97
gcggcgacacgc

SEQ ID NO: 1087761 - RNA, 14 nt, Mycobacterium bovis subsp bovis AF2122/97
gcggcgaccagauu

SEQ ID NO: 1087762 - RNA, 23 nt, Mycobacterium bovis subsp bovis AF2122/97
gcggcgacccgccuguaccggcg

SEQ ID NO: 1087763 - RNA, 21 nt, Mycobacterium bovis subsp bovis AF2122/97
gcggcgacauccacaccgcgg

SEQ ID NO: 1087764 - RNA, 19 nt, Mycobacterium bovis subsp bovis AF2122/97
gcggcgaccauaagcucgu

SEQ ID NO: 1087765 - RNA, 22 nt, Mycobacterium bovis subsp bovis AF2122/97
gcggcgaccauauucagcucgg

SEQ ID NO: 1087766 - RNA, 15 nt, Mycobacterium bovis subsp bovis AF2122/97
gcggcgaccgucaac

SEQ ID NO: 1087767 - RNA, 14 nt, Mycobacterium bovis subsp bovis AF2122/97
gcggcgacccgguc

SEQ ID NO: 1087768 - RNA, 16 nt, Mycobacterium bovis subsp bovis AF2122/97
gcggcgaccgcauccg

SEQ ID NO: 1087769 - RNA, 22 nt, Mycobacterium bovis subsp bovis AF2122/97
gcggcgaccgcauccggucucg

SEQ ID NO: 1087770 - RNA, 14 nt, Mycobacterium bovis subsp bovis AF2122/97
gcggcgagcaccac

SEQ ID NO: 1087771 - RNA, 15 nt, Mycobacterium bovis subsp bovis AF2122/97
gcggcgagcaccacc

SEQ ID NO: 1087772 - RNA, 18 nt, Mycobacterium bovis subsp bovis AF2122/97
gcggcgagcaccacccca

SEQ ID NO: 1087773 - RNA, 21 nt, Mycobacterium bovis subsp bovis AF2122/97
gcggcgagcaccaccccagcg

SEQ ID NO: 1087774 - RNA, 12 nt, Mycobacterium bovis subsp bovis AF2122/97
gcggcgagcgcg

SEQ ID NO: 1087775 - RNA, 21 nt, Mycobacterium bovis subsp bovis AF2122/97
gcggcgaggaaauugcgcaaa

SEQ ID NO: 1087776 - RNA, 15 nt, Mycobacterium bovis subsp bovis AF2122/97
gcggcgaggacgcgc

SEQ ID NO: 1087777 - RNA, 18 nt, Mycobacterium bovis subsp bovis AF2122/97
gcggcgagcuccgaugcc

SEQ ID NO: 1087778 - RNA, 16 nt, Mycobacterium bovis subsp bovis AF2122/97
gcggcgaggcgaguca

SEQ ID NO: 1087779 - RNA, 19 nt, Mycobacterium bovis subsp bovis AF2122/97
gcggcgauacccaucgauc

SEQ ID NO: 1087780 - RNA, 20 nt, Mycobacterium bovis subsp bovis AF2122/97
gcggcgauacccaucgaucg

SEQ ID NO: 1087781 - RNA, 17 nt, Mycobacterium bovis subsp bovis AF2122/97
gcggcgauaccgguugc

SEQ ID NO: 1087782 - RNA, 15 nt, Mycobacterium bovis subsp bovis AF2122/97
gcggcgaucgcuccg

SEQ ID NO: 1087783 - RNA, 12 nt, Mycobacterium bovis subsp bovis AF2122/97
gcggcgaguugg

SEQ ID NO: 1087784 - RNA, 21 nt, Mycobacterium bovis subsp bovis AF2122/97
gcggcgauccggucgggggcg

SEQ ID NO: 1087785 - RNA, 15 nt, Mycobacterium bovis subsp bovis AF2122/97
gcggcgaugauggcg

SEQ ID NO: 1087786 - RNA, 22 nt, Mycobacterium bovis subsp bovis AF2122/97
gcggcgcgguuucggcgucacc

SEQ ID NO: 1087787 - RNA, 12 nt, Mycobacterium bovis subsp bovis AF2122/97
gcggcgcgggug

SEQ ID NO: 1087788 - RNA, 18 nt, Mycobacterium bovis subsp bovis AF2122/97
gcggcgcgggugcggauc

SEQ ID NO: 1087789 - RNA, 23 nt, Mycobacterium bovis subsp bovis AF2122/97
gcggcgcggucgaagcuggcacg

SEQ ID NO: 1087790 - RNA, 13 nt, Mycobacterium bovis subsp bovis AF2122/97
gcggcgcugggac

SEQ ID NO: 1087791 - RNA, 16 nt, Mycobacterium bovis subsp bovis AF2122/97
gcggcgcuggcgggca

SEQ ID NO: 1087792 - RNA, 14 nt, Mycobacterium bovis subsp bovis AF2122/97
gcggcgcuggcguc

SEQ ID NO: 1087793 - RNA, 23 nt, Mycobacterium bovis subsp bovis AF2122/97
gcggcggaaggacggcagccacc

SEQ ID NO: 1087794 - RNA, 19 nt, Mycobacterium bovis subsp bovis AF2122/97
gcggcggaaggcgucgaac

SEQ ID NO: 1087795 - RNA, 17 nt, Mycobacterium bovis subsp bovis AF2122/97
gcggcggacccgcucgc

SEQ ID NO: 1087796 - RNA, 14 nt, Mycobacterium bovis subsp bovis AF2122/97
gcggcgcgcccgga

SEQ ID NO: 1087797 - RNA, 16 nt, Mycobacterium bovis subsp bovis AF2122/97
gcggcgcggccgcagc

SEQ ID NO: 1087798 - RNA, 12 nt, Mycobacterium bovis subsp bovis AF2122/97
gcggcgcggccg

SEQ ID NO: 1087799 - RNA, 12 nt, Mycobacterium bovis subsp bovis AF2122/97
gcggcgaugggc

SEQ ID NO: 1087800 - RNA, 18 nt, Mycobacterium bovis subsp bovis AF2122/97
gcggcgcauuccggcgcc

SEQ ID NO: 1087801 - RNA, 13 nt, Mycobacterium bovis subsp bovis AF2122/97
gcggcgccgccac

SEQ ID NO: 1087802 - RNA, 12 nt, Mycobacterium bovis subsp bovis AF2122/97
gcggcgccgcca

SEQ ID NO: 1087803 - RNA, 19 nt, Mycobacterium bovis subsp bovis AF2122/97
gcggcgcccuggccgcccu

SEQ ID NO: 1087804 - RNA, 22 nt, Mycobacterium bovis subsp bovis AF2122/97
gcggcgccgcagaucaccgcca

SEQ ID NO: 1087805 - RNA, 20 nt, Mycobacterium bovis subsp bovis AF2122/97
gcggcgccgccaucaacaag

SEQ ID NO: 1087806 - RNA, 12 nt, Mycobacterium bovis subsp bovis AF2122/97
gcggcgccgccc

SEQ ID NO: 1087807 - RNA, 15 nt, Mycobacterium bovis subsp bovis AF2122/97
gcggcgccgcccaac

SEQ ID NO: 1087808 - RNA, 14 nt, Mycobacterium bovis subsp bovis AF2122/97
gcggcgccgccacg

SEQ ID NO: 1087809 - RNA, 12 nt, Mycobacterium bovis subsp bovis AF2122/97
gcggcgccgccu

SEQ ID NO: 1087810 - RNA, 15 nt, Mycobacterium bovis subsp bovis AF2122/97
gcggcgccgccugga

SEQ ID NO: 1087811 - RNA, 13 nt, Mycobacterium bovis subsp bovis AF2122/97
gcggcgcgaucgu

SEQ ID NO: 1087812 - RNA, 21 nt, Mycobacterium bovis subsp bovis AF2122/97
gcggcgcaggucgcgcaguug

SEQ ID NO: 1087813 - RNA, 18 nt, Mycobacterium bovis subsp bovis AF2122/97
gcggcgcagcaccgucgg

SEQ ID NO: 1087814 - RNA, 15 nt, Mycobacterium bovis subsp bovis AF2122/97
gcggcgcagcgacgc

SEQ ID NO: 1087815 - RNA, 15 nt, Mycobacterium bovis subsp bovis AF2122/97
gcggcgcaagcccac

SEQ ID NO: 1087816 - RNA, 16 nt, Mycobacterium bovis subsp bovis AF2122/97
gcggcgcacaacccgu

SEQ ID NO: 1087817 - RNA, 13 nt, Mycobacterium bovis subsp bovis AF2122/97
gcggcggccacgg

SEQ ID NO: 1087818 - RNA, 14 nt, Mycobacterium bovis subsp bovis AF2122/97
gcggcggaccgucc

SEQ ID NO: 1087819 - RNA, 20 nt, Mycobacterium bovis subsp bovis AF2122/97
gcggcggacaugcaccucga

SEQ ID NO: 1087820 - RNA, 14 nt, Mycobacterium bovis subsp bovis AF2122/97
gcggcggacccgcu

SEQ ID NO: 1087821 - RNA, 16 nt, Mycobacterium bovis subsp bovis AF2122/97
gcggcggaccguccga

SEQ ID NO: 1087822 - RNA, 21 nt, Mycobacterium bovis subsp bovis AF2122/97
gcggcggaccguccgacggcg

SEQ ID NO: 1087823 - RNA, 21 nt, Mycobacterium bovis subsp bovis AF2122/97
gcggcggcccuaaacaccgcg

SEQ ID NO: 1087824 - RNA, 13 nt, Mycobacterium bovis subsp bovis AF2122/97
gcggcggccagga

SEQ ID NO: 1087825 - RNA, 13 nt, Mycobacterium bovis subsp bovis AF2122/97
gcggcggccagcc

SEQ ID NO: 1087826 - RNA, 14 nt, Mycobacterium bovis subsp bovis AF2122/97
gcggcggccagcgc

SEQ ID NO: 1087827 - RNA, 14 nt, Mycobacterium bovis subsp bovis AF2122/97
gcggcggccgcggc

SEQ ID NO: 1087828 - RNA, 13 nt, Mycobacterium bovis subsp bovis AF2122/97
gcggcggcccgca

SEQ ID NO: 1087829 - RNA, 14 nt, Mycobacterium bovis subsp bovis AF2122/97
gcggcggcccgcag

SEQ ID NO: 1087830 - RNA, 22 nt, Mycobacterium bovis subsp bovis AF2122/97
gcggcggcccuaaacaccgcga

SEQ ID NO: 1087831 - RNA, 15 nt, Mycobacterium bovis subsp bovis AF2122/97
gcggcggcgucggga

SEQ ID NO: 1087832 - RNA, 14 nt, Mycobacterium bovis subsp bovis AF2122/97
gcggcgggcccgau

SEQ ID NO: 1087833 - RNA, 17 nt, Mycobacterium bovis subsp bovis AF2122/97
gcggcggucggcugggc

SEQ ID NO: 1087834 - RNA, 18 nt, Mycobacterium bovis subsp bovis AF2122/97
gcggcggucggcugggcg

SEQ ID NO: 1087835 - RNA, 17 nt, Mycobacterium bovis subsp bovis AF2122/97
gcggcggucucgucaac

SEQ ID NO: 1087836 - RNA, 23 nt, Mycobacterium bovis subsp bovis AF2122/97
gcggcggucccugaagccagcgc

SEQ ID NO: 1087837 - RNA, 15 nt, Mycobacterium bovis subsp bovis AF2122/97
gcggcggccuggcac

SEQ ID NO: 1087838 - RNA, 16 nt, Mycobacterium bovis subsp bovis AF2122/97
gcggcggucaugggcg

SEQ ID NO: 1087839 - RNA, 16 nt, Mycobacterium bovis subsp bovis AF2122/97
gcggcggucgagcgaa

SEQ ID NO: 1087840 - RNA, 21 nt, Mycobacterium bovis subsp bovis AF2122/97
gcggcggugccacgaucggcg

SEQ ID NO: 1087841 - RNA, 19 nt, Mycobacterium bovis subsp bovis AF2122/97
gcggcgucgagcaccucca

SEQ ID NO: 1087842 - RNA, 22 nt, Mycobacterium bovis subsp bovis AF2122/97
gcggcgucgaugagguucaucg

SEQ ID NO: 1087843 - RNA, 13 nt, Mycobacterium bovis subsp bovis AF2122/97
gcggcgucgucga

SEQ ID NO: 1087844 - RNA, 13 nt, Mycobacterium bovis subsp bovis AF2122/97
gcggcgucgcggu

SEQ ID NO: 1087845 - RNA, 15 nt, Mycobacterium bovis subsp bovis AF2122/97
gcggcgucgcgguug

SEQ ID NO: 1087846 - RNA, 12 nt, Mycobacterium bovis subsp bovis AF2122/97
gcggcgucggga

SEQ ID NO: 1087847 - RNA, 14 nt, Mycobacterium bovis subsp bovis AF2122/97
aagcugaccgccag

SEQ ID NO: 1087848 - RNA, 20 nt, Mycobacterium bovis subsp bovis AF2122/97
aagcucguagagcaccgcau

SEQ ID NO: 1087849 - RNA, 21 nt, Mycobacterium bovis subsp bovis AF2122/97
aagcucgacaacugcccgaug

SEQ ID NO: 1087850 - RNA, 19 nt, Mycobacterium bovis subsp bovis AF2122/97
aagcuccaguagucggccg

SEQ ID NO: 1087851 - RNA, 18 nt, Mycobacterium bovis subsp bovis AF2122/97
gccaacagaugccaccca

SEQ ID NO: 1087852 - RNA, 12 nt, Mycobacterium bovis subsp bovis AF2122/97
gccaacaccuca

SEQ ID NO: 1087853 - RNA, 17 nt, Mycobacterium bovis subsp bovis AF2122/97
gccaacagggcgccgac

SEQ ID NO: 1087854 - RNA, 15 nt, Mycobacterium bovis subsp bovis AF2122/97
gccaacagucgcagc

SEQ ID NO: 1087855 - RNA, 14 nt, Mycobacterium bovis subsp bovis AF2122/97
gccaaccagcccgg

SEQ ID NO: 1087856 - RNA, 15 nt, Mycobacterium bovis subsp bovis AF2122/97
gccaaccagcccggc

SEQ ID NO: 1087857 - RNA, 16 nt, Mycobacterium bovis subsp bovis AF2122/97
gccaaccagcccggcc

SEQ ID NO: 1087858 - RNA, 20 nt, Mycobacterium bovis subsp bovis AF2122/97
gccaaccagcccggccgccg

SEQ ID NO: 1087859 - RNA, 22 nt, Mycobacterium bovis subsp bovis AF2122/97
gccaaccagcccggccgccgag

SEQ ID NO: 1087860 - RNA, 14 nt, Mycobacterium bovis subsp bovis AF2122/97
gccaacagucgcag

SEQ ID NO: 1087861 - RNA, 21 nt, Mycobacterium bovis subsp bovis AF2122/97
gccaacauccgguggugcucg

SEQ ID NO: 1087862 - RNA, 19 nt, Mycobacterium bovis subsp bovis AF2122/97
gccaacaucuccgcgucgg

SEQ ID NO: 1087863 - RNA, 19 nt, Mycobacterium bovis subsp bovis AF2122/97
gccaacaacuucucgucga

SEQ ID NO: 1087864 - RNA, 21 nt, Mycobacterium bovis subsp bovis AF2122/97
gccaacaacuucucgucgaac

SEQ ID NO: 1087865 - RNA, 15 nt, Mycobacterium bovis subsp bovis AF2122/97
gccaacaacaucagc

SEQ ID NO: 1087866 - RNA, 17 nt, Mycobacterium bovis subsp bovis AF2122/97
gccaacaccgccagcau

SEQ ID NO: 1087867 - RNA, 15 nt, Mycobacterium bovis subsp bovis AF2122/97
gccaacaccggcauc

SEQ ID NO: 1087868 - RNA, 16 nt, Mycobacterium bovis subsp bovis AF2122/97
gccaacaccggcaucg

SEQ ID NO: 1087869 - RNA, 16 nt, Mycobacterium bovis subsp bovis AF2122/97
gccaacaccggcgauc

SEQ ID NO: 1087870 - RNA, 15 nt, Mycobacterium bovis subsp bovis AF2122/97
gccaaaggacgacac

SEQ ID NO: 1087871 - RNA, 15 nt, Mycobacterium bovis subsp bovis AF2122/97
gccaaagcccgacau

SEQ ID NO: 1087872 - RNA, 14 nt, Mycobacterium bovis subsp bovis AF2122/97
gccaaacuaacggc

SEQ ID NO: 1087873 - RNA, 23 nt, Mycobacterium bovis subsp bovis AF2122/97
gccaaaauccgcccaccggucgc

SEQ ID NO: 1087874 - RNA, 15 nt, Mycobacterium bovis subsp bovis AF2122/97
gccaaaacgagcaga

SEQ ID NO: 1087875 - RNA, 20 nt, Mycobacterium bovis subsp bovis AF2122/97
gccaaaaacgccccggcgcg

SEQ ID NO: 1087876 - RNA, 23 nt, Mycobacterium bovis subsp bovis AF2122/97
gccaaaaacgccccggcgcggcc

SEQ ID NO: 1087877 - RNA, 20 nt, Mycobacterium bovis subsp bovis AF2122/97
gccaaacccaugucggcgcg

SEQ ID NO: 1087878 - RNA, 23 nt, Mycobacterium bovis subsp bovis AF2122/97
gccaaacccaugucggcgcgccg

SEQ ID NO: 1087879 - RNA, 15 nt, Mycobacterium bovis subsp bovis AF2122/97
gccaaacccggcggg

SEQ ID NO: 1087880 - RNA, 16 nt, Mycobacterium bovis subsp bovis AF2122/97
gccaaaagggcggcag

SEQ ID NO: 1087881 - RNA, 22 nt, Mycobacterium bovis subsp bovis AF2122/97
gccaaaccuggguuugcacggc

SEQ ID NO: 1087882 - RNA, 14 nt, Mycobacterium bovis subsp bovis AF2122/97
gccaaacgccgccc

SEQ ID NO: 1087883 - RNA, 20 nt, Mycobacterium bovis subsp bovis AF2122/97
gcauuucguggcacgggucg

SEQ ID NO: 1087884 - RNA, 23 nt, Mycobacterium bovis subsp bovis AF2122/97
gcauuucguggcgcgccgcaucg

SEQ ID NO: 1087885 - RNA, 21 nt, Mycobacterium bovis subsp bovis AF2122/97
gcauuggccugaugcagggcc

SEQ ID NO: 1087886 - RNA, 16 nt, Mycobacterium bovis subsp bovis AF2122/97
gcauugguaccggcuu

SEQ ID NO: 1087887 - RNA, 14 nt, Mycobacterium bovis subsp bovis AF2122/97
gcauucggcgagcc

SEQ ID NO: 1087888 - RNA, 17 nt, Mycobacterium bovis subsp bovis AF2122/97
gcauucggcgagccgcg

SEQ ID NO: 1087889 - RNA, 18 nt, Mycobacterium bovis subsp bovis AF2122/97
gcauucggcgagccgcgc

SEQ ID NO: 1087890 - RNA, 18 nt, Mycobacterium bovis subsp bovis AF2122/97
gcauucgccgggcggcau

SEQ ID NO: 1087891 - RNA, 15 nt, Mycobacterium bovis subsp bovis AF2122/97
gcauugacccgacga

SEQ ID NO: 1087892 - RNA, 21 nt, Mycobacterium bovis subsp bovis AF2122/97
gcauugagcuggcgcccgggu

SEQ ID NO: 1087893 - RNA, 14 nt, Mycobacterium bovis subsp bovis AF2122/97
gcauucucccggua

SEQ ID NO: 1087894 - RNA, 18 nt, Mycobacterium bovis subsp bovis AF2122/97
gcauugccgacgcgcggc

SEQ ID NO: 1087895 - RNA, 18 nt, Mycobacterium bovis subsp bovis AF2122/97
gcauugaguucggccacc

SEQ ID NO: 1087896 - RNA, 19 nt, Mycobacterium bovis subsp bovis AF2122/97
gcauugccgccagcccagc

SEQ ID NO: 1087897 - RNA, 13 nt, Mycobacterium bovis subsp bovis AF2122/97
gcauuggcggugc

SEQ ID NO: 1087898 - RNA, 12 nt, Mycobacterium bovis subsp bovis AF2122/97
gccaaccgcggc

SEQ ID NO: 1087899 - RNA, 13 nt, Mycobacterium bovis subsp bovis AF2122/97
gccaaccgcggcg

SEQ ID NO: 1087900 - RNA, 19 nt, Mycobacterium bovis subsp bovis AF2122/97
gccaaccgcgugcgucagc

SEQ ID NO: 1087901 - RNA, 12 nt, Mycobacterium bovis subsp bovis AF2122/97
gccaaccggcgc

SEQ ID NO: 1087902 - RNA, 18 nt, Mycobacterium bovis subsp bovis AF2122/97
gccaacccgggccgccag

SEQ ID NO: 1087903 - RNA, 16 nt, Mycobacterium bovis subsp bovis AF2122/97
gccaaccgguucgucg

SEQ ID NO: 1087904 - RNA, 21 nt, Mycobacterium bovis subsp bovis AF2122/97
gccaaccgguucgucgaacgg

SEQ ID NO: 1087905 - RNA, 21 nt, Mycobacterium bovis subsp bovis AF2122/97
gccaacccaauugggacgcgc

SEQ ID NO: 1087906 - RNA, 22 nt, Mycobacterium bovis subsp bovis AF2122/97
gccaacccaauugggacgcgcg

SEQ ID NO: 1087907 - RNA, 15 nt, Mycobacterium bovis subsp bovis AF2122/97
gccaacccugcggcg

SEQ ID NO: 1087908 - RNA, 18 nt, Mycobacterium bovis subsp bovis AF2122/97
gccaacccaucccgaucc

SEQ ID NO: 1087909 - RNA, 12 nt, Mycobacterium bovis subsp bovis AF2122/97
gccaacgaugau

SEQ ID NO: 1087910 - RNA, 22 nt, Mycobacterium bovis subsp bovis AF2122/97
gccaacgaaccgcucagcgcag

SEQ ID NO: 1087911 - RNA, 20 nt, Mycobacterium bovis subsp bovis AF2122/97
gccaacgaacgugccccggc

SEQ ID NO: 1087912 - RNA, 14 nt, Mycobacterium bovis subsp bovis AF2122/97
gccaacgacggccg

SEQ ID NO: 1087913 - RNA, 21 nt, Mycobacterium bovis subsp bovis AF2122/97
gccaaccguccggggccgcgg

SEQ ID NO: 1087914 - RNA, 19 nt, Mycobacterium bovis subsp bovis AF2122/97
gccaaccugaagccagcgc

SEQ ID NO: 1087915 - RNA, 21 nt, Mycobacterium bovis subsp bovis AF2122/97
gccaaccugaagccagcgcag

SEQ ID NO: 1087916 - RNA, 18 nt, Mycobacterium bovis subsp bovis AF2122/97
gccaacgaaccgcucagc

SEQ ID NO: 1087917 - RNA, 20 nt, Mycobacterium bovis subsp bovis AF2122/97
gccaacgaaccgcucagcgc

SEQ ID NO: 1087918 - RNA, 14 nt, Mycobacterium bovis subsp bovis AF2122/97
gccaacgccagcac

SEQ ID NO: 1087919 - RNA, 15 nt, Mycobacterium bovis subsp bovis AF2122/97
gccaacgccagcacc

SEQ ID NO: 1087920 - RNA, 16 nt, Mycobacterium bovis subsp bovis AF2122/97
gccaacgccagcacca

SEQ ID NO: 1087921 - RNA, 18 nt, Mycobacterium bovis subsp bovis AF2122/97
gccaacgccagcaccagc

SEQ ID NO: 1087922 - RNA, 19 nt, Mycobacterium bovis subsp bovis AF2122/97
gccaacgccagcaccagcg

SEQ ID NO: 1087923 - RNA, 15 nt, Mycobacterium bovis subsp bovis AF2122/97
gccaacgccagcggg

SEQ ID NO: 1087924 - RNA, 22 nt, Mycobacterium bovis subsp bovis AF2122/97
gccaacgccagcggguccccgg

SEQ ID NO: 1087925 - RNA, 22 nt, Mycobacterium bovis subsp bovis AF2122/97
gccaacgggaacaacggcguaa

SEQ ID NO: 1087926 - RNA, 17 nt, Mycobacterium bovis subsp bovis AF2122/97
gccaacgcgucccgccg

SEQ ID NO: 1087927 - RNA, 22 nt, Mycobacterium bovis subsp bovis AF2122/97
gccaacgcgucccgccgcaccg

SEQ ID NO: 1087928 - RNA, 21 nt, Mycobacterium bovis subsp bovis AF2122/97
gccaacggcgcugccgggauc

SEQ ID NO: 1087929 - RNA, 13 nt, Mycobacterium bovis subsp bovis AF2122/97
gccaacggcaccc

SEQ ID NO: 1087930 - RNA, 22 nt, Mycobacterium bovis subsp bovis AF2122/97
gccaacggcacccugcggcacc

SEQ ID NO: 1087931 - RNA, 21 nt, Mycobacterium bovis subsp bovis AF2122/97
gccaacgcgcagagcguuccg

SEQ ID NO: 1087932 - RNA, 11 nt, Mycobacterium bovis subsp bovis AF2122/97
gccaacgccgg

SEQ ID NO: 1087933 - RNA, 16 nt, Mycobacterium bovis subsp bovis AF2122/97
gccaagcagcugggca

SEQ ID NO: 1087934 - RNA, 20 nt, Mycobacterium bovis subsp bovis AF2122/97
gccaagcagcugggcaucac

SEQ ID NO: 1087935 - RNA, 20 nt, Mycobacterium bovis subsp bovis AF2122/97
gccaacguugcgccagcggu

SEQ ID NO: 1087936 - RNA, 15 nt, Mycobacterium bovis subsp bovis AF2122/97
gccaacucaggccgg

SEQ ID NO: 1087937 - RNA, 14 nt, Mycobacterium bovis subsp bovis AF2122/97
gccaagcaggcggg

SEQ ID NO: 1087938 - RNA, 14 nt, Mycobacterium bovis subsp bovis AF2122/97
gccaagccgcggcu

SEQ ID NO: 1087939 - RNA, 13 nt, Mycobacterium bovis subsp bovis AF2122/97
gccaagccggcga

SEQ ID NO: 1087940 - RNA, 21 nt, Mycobacterium bovis subsp bovis AF2122/97
gccaagcgagcggucgacgug

SEQ ID NO: 1087941 - RNA, 15 nt, Mycobacterium bovis subsp bovis AF2122/97
gccaagcgacucgcc

SEQ ID NO: 1087942 - RNA, 19 nt, Mycobacterium bovis subsp bovis AF2122/97
gccaagcgacucgccggcg

SEQ ID NO: 1087943 - RNA, 22 nt, Mycobacterium bovis subsp bovis AF2122/97
gccaagcgacucgccggcgaau

SEQ ID NO: 1087944 - RNA, 13 nt, Mycobacterium bovis subsp bovis AF2122/97
gccacacaggcgu

SEQ ID NO: 1087945 - RNA, 22 nt, Mycobacterium bovis subsp bovis AF2122/97
gccacacaggcguccaucgcca

SEQ ID NO: 1087946 - RNA, 21 nt, Mycobacterium bovis subsp bovis AF2122/97
gccacaccaacgucgaugucc

SEQ ID NO: 1087947 - RNA, 14 nt, Mycobacterium bovis subsp bovis AF2122/97
gccacaccgccgcc

SEQ ID NO: 1087948 - RNA, 15 nt, Mycobacterium bovis subsp bovis AF2122/97
gccacaccgccgcca

SEQ ID NO: 1087949 - RNA, 23 nt, Mycobacterium bovis subsp bovis AF2122/97
gccacaccgccgccaagcucggc

SEQ ID NO: 1087950 - RNA, 18 nt, Mycobacterium bovis subsp bovis AF2122/97
gccacaccgucacgccac

SEQ ID NO: 1087951 - RNA, 22 nt, Mycobacterium bovis subsp bovis AF2122/97
gccacaccgucacgccaccgca

SEQ ID NO: 1087952 - RNA, 19 nt, Mycobacterium bovis subsp bovis AF2122/97
gccacaccuuggccgccgg

SEQ ID NO: 1087953 - RNA, 20 nt, Mycobacterium bovis subsp bovis AF2122/97
gccacaccuuggccgccggc

SEQ ID NO: 1087954 - RNA, 17 nt, Mycobacterium bovis subsp bovis AF2122/97
gccacacggggccgcca

SEQ ID NO: 1087955 - RNA, 16 nt, Mycobacterium bovis subsp bovis AF2122/97
gccacacucccgcgcc

SEQ ID NO: 1087956 - RNA, 19 nt, Mycobacterium bovis subsp bovis AF2122/97
gccaaugcccuuggccagc

SEQ ID NO: 1087957 - RNA, 16 nt, Mycobacterium bovis subsp bovis AF2122/97
gccaaucgccgucagc

SEQ ID NO: 1087958 - RNA, 20 nt, Mycobacterium bovis subsp bovis AF2122/97
gccaaugauucggcacgccg

SEQ ID NO: 1087959 - RNA, 21 nt, Mycobacterium bovis subsp bovis AF2122/97
gccaaugauucggcacgccgg

SEQ ID NO: 1087960 - RNA, 14 nt, Mycobacterium bovis subsp bovis AF2122/97
gccaaugccguuga

SEQ ID NO: 1087961 - RNA, 16 nt, Mycobacterium bovis subsp bovis AF2122/97
gccacaaugcggccgu

SEQ ID NO: 1087962 - RNA, 16 nt, Mycobacterium bovis subsp bovis AF2122/97
gccaagcucggcccag

SEQ ID NO: 1087963 - RNA, 21 nt, Mycobacterium bovis subsp bovis AF2122/97
gccaagcucggcccagcgcgc

SEQ ID NO: 1087964 - RNA, 12 nt, Mycobacterium bovis subsp bovis AF2122/97
gccaagcgcgcg

SEQ ID NO: 1087965 - RNA, 18 nt, Mycobacterium bovis subsp bovis AF2122/97
gccaaggaggccaucauc

SEQ ID NO: 1087966 - RNA, 19 nt, Mycobacterium bovis subsp bovis AF2122/97
gccaauacgugauguagcu

SEQ ID NO: 1087967 - RNA, 17 nt, Mycobacterium bovis subsp bovis AF2122/97
gccaaucagcccgccgg

SEQ ID NO: 1087968 - RNA, 18 nt, Mycobacterium bovis subsp bovis AF2122/97
gccaaucagcccgccgga

SEQ ID NO: 1087969 - RNA, 14 nt, Mycobacterium bovis subsp bovis AF2122/97
gccaauccggcggc

SEQ ID NO: 1087970 - RNA, 16 nt, Mycobacterium bovis subsp bovis AF2122/97
gccaauccggcggcga

SEQ ID NO: 1087971 - RNA, 17 nt, Mycobacterium bovis subsp bovis AF2122/97
gccaauccggcggcgac

SEQ ID NO: 1087972 - RNA, 20 nt, Mycobacterium bovis subsp bovis AF2122/97
gccaaucgaguagcugaccg

SEQ ID NO: 1087973 - RNA, 21 nt, Mycobacterium bovis subsp bovis AF2122/97
gccaaucgaguagcugaccga

SEQ ID NO: 1087974 - RNA, 13 nt, Mycobacterium bovis subsp bovis AF2122/97
gccaaucgcacug

SEQ ID NO: 1087975 - RNA, 13 nt, Mycobacterium bovis subsp bovis AF2122/97
gccaauccggggc

SEQ ID NO: 1087976 - RNA, 19 nt, Mycobacterium bovis subsp bovis AF2122/97
gcaugagcguucagcacgg

SEQ ID NO: 1087977 - RNA, 15 nt, Mycobacterium bovis subsp bovis AF2122/97
gcaugagggcaucga

SEQ ID NO: 1087978 - RNA, 15 nt, Mycobacterium bovis subsp bovis AF2122/97
gcaugauccgcucgu

SEQ ID NO: 1087979 - RNA, 20 nt, Mycobacterium bovis subsp bovis AF2122/97
gcaugauccccguugaccca

SEQ ID NO: 1087980 - RNA, 15 nt, Mycobacterium bovis subsp bovis AF2122/97
gcaugauccgcuggg

SEQ ID NO: 1087981 - RNA, 14 nt, Mycobacterium bovis subsp bovis AF2122/97
gcaugaagucccgg

SEQ ID NO: 1087982 - RNA, 13 nt, Mycobacterium bovis subsp bovis AF2122/97
gcaugacgccggc

SEQ ID NO: 1087983 - RNA, 15 nt, Mycobacterium bovis subsp bovis AF2122/97
gcaugacgccggcgg

SEQ ID NO: 1087984 - RNA, 14 nt, Mycobacterium bovis subsp bovis AF2122/97
gcaugaccgcugcc

SEQ ID NO: 1087985 - RNA, 19 nt, Mycobacterium bovis subsp bovis AF2122/97
gcaugaccgcugccgacgc

SEQ ID NO: 1087986 - RNA, 20 nt, Mycobacterium bovis subsp bovis AF2122/97
gcaugaacgcaaccgagggc

SEQ ID NO: 1087987 - RNA, 21 nt, Mycobacterium bovis subsp bovis AF2122/97
gcaucuucgcgcagccgccgc

SEQ ID NO: 1087988 - RNA, 18 nt, Mycobacterium bovis subsp bovis AF2122/97
gcaucugcgggucggcau

SEQ ID NO: 1087989 - RNA, 12 nt, Mycobacterium bovis subsp bovis AF2122/97
gcaucugcucgg

SEQ ID NO: 1087990 - RNA, 17 nt, Mycobacterium bovis subsp bovis AF2122/97
gcaucugaugacggugu

SEQ ID NO: 1087991 - RNA, 22 nt, Mycobacterium bovis subsp bovis AF2122/97
gcaucuggggguagccgccggc

SEQ ID NO: 1087992 - RNA, 21 nt, Mycobacterium bovis subsp bovis AF2122/97
gcaucugugagauaccgacgc

SEQ ID NO: 1087993 - RNA, 12 nt, Mycobacterium bovis subsp bovis AF2122/97
gcaugccggcgu

SEQ ID NO: 1087994 - RNA, 19 nt, Mycobacterium bovis subsp bovis AF2122/97
gcaugccggcgugcggcga

SEQ ID NO: 1087995 - RNA, 20 nt, Mycobacterium bovis subsp bovis AF2122/97
gcaugccggcuagcucggcg

SEQ ID NO: 1087996 - RNA, 19 nt, Mycobacterium bovis subsp bovis AF2122/97
gcaugccguugcgaucgcg

SEQ ID NO: 1087997 - RNA, 13 nt, Mycobacterium bovis subsp bovis AF2122/97
gcaugccuucggc

SEQ ID NO: 1087998 - RNA, 19 nt, Mycobacterium bovis subsp bovis AF2122/97
gcaugcgacagaugccggg

SEQ ID NO: 1087999 - RNA, 15 nt, Mycobacterium bovis subsp bovis AF2122/97
gcaugcgacgucagg

SEQ ID NO: 1088000 - RNA, 22 nt, Mycobacterium bovis subsp bovis AF2122/97
gcaugcgcagaaacgccgagcg

SEQ ID NO: 1088001 - RNA, 17 nt, Mycobacterium bovis subsp bovis AF2122/97
gcaugcgcgcgccggug

SEQ ID NO: 1088002 - RNA, 18 nt, Mycobacterium bovis subsp bovis AF2122/97
gcaugcgcgcgccggugc

SEQ ID NO: 1088003 - RNA, 14 nt, Mycobacterium bovis subsp bovis AF2122/97
gcaugcgugacccg

SEQ ID NO: 1088004 - RNA, 22 nt, Mycobacterium bovis subsp bovis AF2122/97
gcaugcgugccggcagcggugg

SEQ ID NO: 1088005 - RNA, 12 nt, Mycobacterium bovis subsp bovis AF2122/97
gcaugcgcuccg

SEQ ID NO: 1088006 - RNA, 21 nt, Mycobacterium bovis subsp bovis AF2122/97
gcaugcgcuccggcgcgacgc

SEQ ID NO: 1088007 - RNA, 20 nt, Mycobacterium bovis subsp bovis AF2122/97
gcaugcccgcggugaccacc

SEQ ID NO: 1088008 - RNA, 21 nt, Mycobacterium bovis subsp bovis AF2122/97
gcaugccgccaugcgcaccag

SEQ ID NO: 1088009 - RNA, 16 nt, Mycobacterium bovis subsp bovis AF2122/97
gcaugcccuggaccag

SEQ ID NO: 1088010 - RNA, 12 nt, Mycobacterium bovis subsp bovis AF2122/97
gcaugccgcggc

SEQ ID NO: 1088011 - RNA, 16 nt, Mycobacterium bovis subsp bovis AF2122/97
gcaugcuggcgaucgc

SEQ ID NO: 1088012 - RNA, 17 nt, Mycobacterium bovis subsp bovis AF2122/97
gcaugcuggcgaucgcg

SEQ ID NO: 1088013 - RNA, 18 nt, Mycobacterium bovis subsp bovis AF2122/97
gcaugcuggcgaucgcga

SEQ ID NO: 1088014 - RNA, 22 nt, Mycobacterium bovis subsp bovis AF2122/97
gcaugcguaugcccacgaaccg

SEQ ID NO: 1088015 - RNA, 23 nt, Mycobacterium bovis subsp bovis AF2122/97
gcaugcucaccgaaacgaugcgg

SEQ ID NO: 1088016 - RNA, 21 nt, Mycobacterium bovis subsp bovis AF2122/97
gcaugcucacgaucugcgcgu

SEQ ID NO: 1088017 - RNA, 15 nt, Mycobacterium bovis subsp bovis AF2122/97
gcaugcucgaucgcg

SEQ ID NO: 1088018 - RNA, 21 nt, Mycobacterium bovis subsp bovis AF2122/97
gcaugcuugaaacccaggccg

SEQ ID NO: 1088019 - RNA, 21 nt, Mycobacterium bovis subsp bovis AF2122/97
gcauggcgaacacgucggcca

SEQ ID NO: 1088020 - RNA, 15 nt, Mycobacterium bovis subsp bovis AF2122/97
gcauggcgccguugc

SEQ ID NO: 1088021 - RNA, 23 nt, Mycobacterium bovis subsp bovis AF2122/97
gcaugggcuaccgagauugggcu

SEQ ID NO: 1088022 - RNA, 14 nt, Mycobacterium bovis subsp bovis AF2122/97
gcaugggacaucca

SEQ ID NO: 1088023 - RNA, 20 nt, Mycobacterium bovis subsp bovis AF2122/97
gcaugguccacagccggcgg

SEQ ID NO: 1088024 - RNA, 13 nt, Mycobacterium bovis subsp bovis AF2122/97
gcauggucgacga

SEQ ID NO: 1088025 - RNA, 23 nt, Mycobacterium bovis subsp bovis AF2122/97
gcauggucgacgaacaccccggg

SEQ ID NO: 1088026 - RNA, 17 nt, Mycobacterium bovis subsp bovis AF2122/97
gcauggucaggcggccg

SEQ ID NO: 1088027 - RNA, 13 nt, Mycobacterium bovis subsp bovis AF2122/97
gcaugguccagca

SEQ ID NO: 1088028 - RNA, 22 nt, Mycobacterium bovis subsp bovis AF2122/97
gcaugguccagcacaucggcga

SEQ ID NO: 1088029 - RNA, 15 nt, Mycobacterium bovis subsp bovis AF2122/97
gcauggugcggcggc

SEQ ID NO: 1088030 - RNA, 16 nt, Mycobacterium bovis subsp bovis AF2122/97
gcauggugcggcggcg

SEQ ID NO: 1088031 - RNA, 23 nt, Mycobacterium bovis subsp bovis AF2122/97
gcaugggccggcgccgcaccaag

SEQ ID NO: 1088032 - RNA, 15 nt, Mycobacterium bovis subsp bovis AF2122/97
gcauggugggugccg

SEQ ID NO: 1088033 - RNA, 21 nt, Mycobacterium bovis subsp bovis AF2122/97
gcaugucgccgaacgccacca

SEQ ID NO: 1088034 - RNA, 17 nt, Mycobacterium bovis subsp bovis AF2122/97
gcaugucgauccggcgc

SEQ ID NO: 1088035 - RNA, 17 nt, Mycobacterium bovis subsp bovis AF2122/97
gcaugucgggccgcucg

SEQ ID NO: 1088036 - RNA, 20 nt, Mycobacterium bovis subsp bovis AF2122/97
gcauguucagcccgaacucg

SEQ ID NO: 1088037 - RNA, 15 nt, Mycobacterium bovis subsp bovis AF2122/97
gcauguggccgccgu

SEQ ID NO: 1088038 - RNA, 17 nt, Mycobacterium bovis subsp bovis AF2122/97
gcauguggccgccgucg

SEQ ID NO: 1088039 - RNA, 20 nt, Mycobacterium bovis subsp bovis AF2122/97
gcaugucucgggcgcgggug

SEQ ID NO: 1088040 - RNA, 22 nt, Mycobacterium bovis subsp bovis AF2122/97
gcaugugacaucgggccgccga

SEQ ID NO: 1088041 - RNA, 13 nt, Mycobacterium bovis subsp bovis AF2122/97
gcauuccggugug

SEQ ID NO: 1088042 - RNA, 16 nt, Mycobacterium bovis subsp bovis AF2122/97
gcauuaggccgggguc

SEQ ID NO: 1088043 - RNA, 23 nt, Mycobacterium bovis subsp bovis AF2122/97
gcauuaggccggggucgaacgcg

SEQ ID NO: 1088044 - RNA, 18 nt, Mycobacterium bovis subsp bovis AF2122/97
gcauguugcaggcgcagc

SEQ ID NO: 1088045 - RNA, 20 nt, Mycobacterium bovis subsp bovis AF2122/97
gcagcgccuaccagcaccgg

SEQ ID NO: 1088046 - RNA, 23 nt, Mycobacterium bovis subsp bovis AF2122/97
gcagcgccuaccagcaccgggau

SEQ ID NO: 1088047 - RNA, 17 nt, Mycobacterium bovis subsp bovis AF2122/97
gcagcgccucgauccgc

SEQ ID NO: 1088048 - RNA, 17 nt, Mycobacterium bovis subsp bovis AF2122/97
gcagcgccugcggcagc

SEQ ID NO: 1088049 - RNA, 15 nt, Mycobacterium bovis subsp bovis AF2122/97
gcagcgcgaacacca

SEQ ID NO: 1088050 - RNA, 13 nt, Mycobacterium bovis subsp bovis AF2122/97
gcagcgcccccgg

SEQ ID NO: 1088051 - RNA, 18 nt, Mycobacterium bovis subsp bovis AF2122/97
gcagcgcgaaggucagcg

SEQ ID NO: 1088052 - RNA, 18 nt, Mycobacterium bovis subsp bovis AF2122/97
gcagugcaggcggccgcc

SEQ ID NO: 1088053 - RNA, 16 nt, Mycobacterium bovis subsp bovis AF2122/97
gcagugcagcgauccc

SEQ ID NO: 1088054 - RNA, 17 nt, Mycobacterium bovis subsp bovis AF2122/97
gcagugcacccgggccg

SEQ ID NO: 1088055 - RNA, 22 nt, Mycobacterium bovis subsp bovis AF2122/97
gcagugcacccgggccgccucg

SEQ ID NO: 1088056 - RNA, 16 nt, Mycobacterium bovis subsp bovis AF2122/97
gcagugcaccgcgucg

SEQ ID NO: 1088057 - RNA, 13 nt, Mycobacterium bovis subsp bovis AF2122/97
gcagugccguguc

SEQ ID NO: 1088058 - RNA, 17 nt, Mycobacterium bovis subsp bovis AF2122/97
gcagugccguguccagc

SEQ ID NO: 1088059 - RNA, 15 nt, Mycobacterium bovis subsp bovis AF2122/97
gcagugccucggcga

SEQ ID NO: 1088060 - RNA, 16 nt, Mycobacterium bovis subsp bovis AF2122/97
gcagugccucggcgau

SEQ ID NO: 1088061 - RNA, 20 nt, Mycobacterium bovis subsp bovis AF2122/97
gcagugcgcggcgucgucga

SEQ ID NO: 1088062 - RNA, 21 nt, Mycobacterium bovis subsp bovis AF2122/97
gcagugcgaaaaucgcgcgcg

SEQ ID NO: 1088063 - RNA, 14 nt, Mycobacterium bovis subsp bovis AF2122/97
gcagugcgacccgg

SEQ ID NO: 1088064 - RNA, 22 nt, Mycobacterium bovis subsp bovis AF2122/97
gcagugcgcgaguaagcgaaca

SEQ ID NO: 1088065 - RNA, 12 nt, Mycobacterium bovis subsp bovis AF2122/97
gcaguggccaga

SEQ ID NO: 1088066 - RNA, 20 nt, Mycobacterium bovis subsp bovis AF2122/97
gcaguucaacgaggccgacg

SEQ ID NO: 1088067 - RNA, 21 nt, Mycobacterium bovis subsp bovis AF2122/97
gcaguucaacgaggccgacga

SEQ ID NO: 1088068 - RNA, 23 nt, Mycobacterium bovis subsp bovis AF2122/97
gcagugggggugguaccggcggc

SEQ ID NO: 1088069 - RNA, 16 nt, Mycobacterium bovis subsp bovis AF2122/97
gcaguggccgccgggc

SEQ ID NO: 1088070 - RNA, 22 nt, Mycobacterium bovis subsp bovis AF2122/97
gcaguggcguuacgcucggcga

SEQ ID NO: 1088071 - RNA, 17 nt, Mycobacterium bovis subsp bovis AF2122/97
gcaguucgccgcgcagc

SEQ ID NO: 1088072 - RNA, 19 nt, Mycobacterium bovis subsp bovis AF2122/97
gcaguuccuugagacgccg

SEQ ID NO: 1088073 - RNA, 13 nt, Mycobacterium bovis subsp bovis AF2122/97
gcaguucggcgau

SEQ ID NO: 1088074 - RNA, 19 nt, Mycobacterium bovis subsp bovis AF2122/97
gcaguugaacucgaccacc

SEQ ID NO: 1088075 - RNA, 15 nt, Mycobacterium bovis subsp bovis AF2122/97
gcaguucggucgucu

SEQ ID NO: 1088076 - RNA, 21 nt, Mycobacterium bovis subsp bovis AF2122/97
gcaguugauccugcaguacgg

SEQ ID NO: 1088077 - RNA, 18 nt, Mycobacterium bovis subsp bovis AF2122/97
gcaguuggcaccagccgg

SEQ ID NO: 1088078 - RNA, 15 nt, Mycobacterium bovis subsp bovis AF2122/97
gcaguuggccgagcg

SEQ ID NO: 1088079 - RNA, 23 nt, Mycobacterium bovis subsp bovis AF2122/97
gcaguuguucgaguucggccgcg

SEQ ID NO: 1088080 - RNA, 14 nt, Mycobacterium bovis subsp bovis AF2122/97
gcaguuuggcggca

SEQ ID NO: 1088081 - RNA, 16 nt, Mycobacterium bovis subsp bovis AF2122/97
gcaguuuggcggcagg

SEQ ID NO: 1088082 - RNA, 15 nt, Mycobacterium bovis subsp bovis AF2122/97
gcaguuuggcggcgc

SEQ ID NO: 1088083 - RNA, 16 nt, Mycobacterium bovis subsp bovis AF2122/97
gcaguuuggcggcgcg

SEQ ID NO: 1088084 - RNA, 16 nt, Mycobacterium bovis subsp bovis AF2122/97
gcaguuggcaccagcc

SEQ ID NO: 1088085 - RNA, 17 nt, Mycobacterium bovis subsp bovis AF2122/97
gcaguuccgcggggccg

SEQ ID NO: 1088086 - RNA, 14 nt, Mycobacterium bovis subsp bovis AF2122/97
gcauaagcccccgc

SEQ ID NO: 1088087 - RNA, 23 nt, Mycobacterium bovis subsp bovis AF2122/97
gcauaagcccccgcacgcucgcc

SEQ ID NO: 1088088 - RNA, 12 nt, Mycobacterium bovis subsp bovis AF2122/97
gcauaacgaucc

SEQ ID NO: 1088089 - RNA, 21 nt, Mycobacterium bovis subsp bovis AF2122/97
gcauaacgaucccgugauccg

SEQ ID NO: 1088090 - RNA, 15 nt, Mycobacterium bovis subsp bovis AF2122/97
gcauaagcccccgac

SEQ ID NO: 1088091 - RNA, 24 nt, Mycobacterium bovis subsp bovis AF2122/97
gcauaagcccccgacacgccgugc

SEQ ID NO: 1088092 - RNA, 17 nt, Mycobacterium bovis subsp bovis AF2122/97
gcaguuggucgcggucc

SEQ ID NO: 1088093 - RNA, 14 nt, Mycobacterium bovis subsp bovis AF2122/97
gcaucaccgccgcg

SEQ ID NO: 1088094 - RNA, 18 nt, Mycobacterium bovis subsp bovis AF2122/97
gcaucaccgccgcggccg

SEQ ID NO: 1088095 - RNA, 22 nt, Mycobacterium bovis subsp bovis AF2122/97
gcaucaccgccgcggccgccgu

SEQ ID NO: 1088096 - RNA, 14 nt, Mycobacterium bovis subsp bovis AF2122/97
gcaucaccuggcgu

SEQ ID NO: 1088097 - RNA, 23 nt, Mycobacterium bovis subsp bovis AF2122/97
gcaucaccuggcgugucgccgcc

SEQ ID NO: 1088098 - RNA, 13 nt, Mycobacterium bovis subsp bovis AF2122/97
gcaucagcggcgc

SEQ ID NO: 1088099 - RNA, 22 nt, Mycobacterium bovis subsp bovis AF2122/97
gcaucagcuuuugcaccggacc

SEQ ID NO: 1088100 - RNA, 20 nt, Mycobacterium bovis subsp bovis AF2122/97
gcaucagauucgcgcuggcc

SEQ ID NO: 1088101 - RNA, 15 nt, Mycobacterium bovis subsp bovis AF2122/97
gcaucagcagagccc

SEQ ID NO: 1088102 - RNA, 15 nt, Mycobacterium bovis subsp bovis AF2122/97
gcaucagcccggcgc

SEQ ID NO: 1088103 - RNA, 12 nt, Mycobacterium bovis subsp bovis AF2122/97
gcaucaacaccg

SEQ ID NO: 1088104 - RNA, 15 nt, Mycobacterium bovis subsp bovis AF2122/97
gcaucaacaccggcu

SEQ ID NO: 1088105 - RNA, 16 nt, Mycobacterium bovis subsp bovis AF2122/97
gcauauccgccggcga

SEQ ID NO: 1088106 - RNA, 14 nt, Mycobacterium bovis subsp bovis AF2122/97
gcaucaccgacgcg

SEQ ID NO: 1088107 - RNA, 15 nt, Mycobacterium bovis subsp bovis AF2122/97
gcaucaccacccgac

SEQ ID NO: 1088108 - RNA, 17 nt, Mycobacterium bovis subsp bovis AF2122/97
gcaucaccacccgaccg

SEQ ID NO: 1088109 - RNA, 19 nt, Mycobacterium bovis subsp bovis AF2122/97
gcaucaccacccgaccgcc

SEQ ID NO: 1088110 - RNA, 22 nt, Mycobacterium bovis subsp bovis AF2122/97
gcaucaccacccgaccgccauc

SEQ ID NO: 1088111 - RNA, 14 nt, Mycobacterium bovis subsp bovis AF2122/97
gcaucaacgcgggc

SEQ ID NO: 1088112 - RNA, 17 nt, Mycobacterium bovis subsp bovis AF2122/97
gcauaacccgcaccggg

SEQ ID NO: 1088113 - RNA, 17 nt, Mycobacterium bovis subsp bovis AF2122/97
gcauacauccaggcugu

SEQ ID NO: 1088114 - RNA, 21 nt, Mycobacterium bovis subsp bovis AF2122/97
gcauacaaccccgcgcuguag

SEQ ID NO: 1088115 - RNA, 18 nt, Mycobacterium bovis subsp bovis AF2122/97
gcauacaccgugacguug

SEQ ID NO: 1088116 - RNA, 14 nt, Mycobacterium bovis subsp bovis AF2122/97
gcauagugcggcug

SEQ ID NO: 1088117 - RNA, 20 nt, Mycobacterium bovis subsp bovis AF2122/97
gcauaucgauucgggcgucg

SEQ ID NO: 1088118 - RNA, 21 nt, Mycobacterium bovis subsp bovis AF2122/97
gcauaucgauucgggcgucgg

SEQ ID NO: 1088119 - RNA, 21 nt, Mycobacterium bovis subsp bovis AF2122/97
gcauagcucagaccggcgccg

SEQ ID NO: 1088120 - RNA, 21 nt, Mycobacterium bovis subsp bovis AF2122/97
gcauaggcggccaucgacgac

SEQ ID NO: 1088121 - RNA, 17 nt, Mycobacterium bovis subsp bovis AF2122/97
gcauaggcuuccggcgc

SEQ ID NO: 1088122 - RNA, 23 nt, Mycobacterium bovis subsp bovis AF2122/97
gcauaggcuuccggcgcgaccgg

SEQ ID NO: 1088123 - RNA, 15 nt, Mycobacterium bovis subsp bovis AF2122/97
gcauagaucgggucg

SEQ ID NO: 1088124 - RNA, 18 nt, Mycobacterium bovis subsp bovis AF2122/97
gcaucaguuugacgccga

SEQ ID NO: 1088125 - RNA, 19 nt, Mycobacterium bovis subsp bovis AF2122/97
gcaucaguuugacgccgau

SEQ ID NO: 1088126 - RNA, 17 nt, Mycobacterium bovis subsp bovis AF2122/97
gcaucauagacagggcc

SEQ ID NO: 1088127 - RNA, 14 nt, Mycobacterium bovis subsp bovis AF2122/97
gcaucaucgcccac

SEQ ID NO: 1088128 - RNA, 18 nt, Mycobacterium bovis subsp bovis AF2122/97
gcaucaucgcccaccgca

SEQ ID NO: 1088129 - RNA, 20 nt, Mycobacterium bovis subsp bovis AF2122/97
gcaucaugggagucgucgug

SEQ ID NO: 1088130 - RNA, 19 nt, Mycobacterium bovis subsp bovis AF2122/97
gcauccacugcggcgcugg

SEQ ID NO: 1088131 - RNA, 21 nt, Mycobacterium bovis subsp bovis AF2122/97
gcauccagaaguaggcgaccg

SEQ ID NO: 1088132 - RNA, 15 nt, Mycobacterium bovis subsp bovis AF2122/97
gcauccacugcggcg

SEQ ID NO: 1088133 - RNA, 13 nt, Mycobacterium bovis subsp bovis AF2122/97
gcauccgcgacgg

SEQ ID NO: 1088134 - RNA, 16 nt, Mycobacterium bovis subsp bovis AF2122/97
gcauccgcgacggcgc

SEQ ID NO: 1088135 - RNA, 19 nt, Mycobacterium bovis subsp bovis AF2122/97
gcauccccgguacgucgag

SEQ ID NO: 1088136 - RNA, 12 nt, Mycobacterium bovis subsp bovis AF2122/97
gcauccgcagca

SEQ ID NO: 1088137 - RNA, 16 nt, Mycobacterium bovis subsp bovis AF2122/97
gcauccgcccgagccg

SEQ ID NO: 1088138 - RNA, 13 nt, Mycobacterium bovis subsp bovis AF2122/97
gcauccagcgcgc

SEQ ID NO: 1088139 - RNA, 23 nt, Mycobacterium bovis subsp bovis AF2122/97
gcauccagcgcgcgcugagccgu

SEQ ID NO: 1088140 - RNA, 17 nt, Mycobacterium bovis subsp bovis AF2122/97
gcauccaggcugucgcg

SEQ ID NO: 1088141 - RNA, 22 nt, Mycobacterium bovis subsp bovis AF2122/97
gcaucccggaacgccgccagcg

SEQ ID NO: 1088142 - RNA, 16 nt, Mycobacterium bovis subsp bovis AF2122/97
gcaucccgguccagcc

SEQ ID NO: 1088143 - RNA, 14 nt, Mycobacterium bovis subsp bovis AF2122/97
gcauccagcugcug

SEQ ID NO: 1088144 - RNA, 20 nt, Mycobacterium bovis subsp bovis AF2122/97
gcauccuugccaaucgccgu

SEQ ID NO: 1088145 - RNA, 18 nt, Mycobacterium bovis subsp bovis AF2122/97
gcaucgaagugcggcccg

SEQ ID NO: 1088146 - RNA, 19 nt, Mycobacterium bovis subsp bovis AF2122/97
gcaucgaagugcggcccgg

SEQ ID NO: 1088147 - RNA, 16 nt, Mycobacterium bovis subsp bovis AF2122/97
gcauccuccucgucga

SEQ ID NO: 1088148 - RNA, 17 nt, Mycobacterium bovis subsp bovis AF2122/97
gcauccuccucgucgac

SEQ ID NO: 1088149 - RNA, 18 nt, Mycobacterium bovis subsp bovis AF2122/97
gcauccgguucgccgccg

SEQ ID NO: 1088150 - RNA, 15 nt, Mycobacterium bovis subsp bovis AF2122/97
gcaucgaucaccgcu

SEQ ID NO: 1088151 - RNA, 14 nt, Mycobacterium bovis subsp bovis AF2122/97
gcaucgauucgaug

SEQ ID NO: 1088152 - RNA, 22 nt, Mycobacterium bovis subsp bovis AF2122/97
gcaucgauucgauguccucgac

SEQ ID NO: 1088153 - RNA, 18 nt, Mycobacterium bovis subsp bovis AF2122/97
gcaucgcacgggccacca

SEQ ID NO: 1088154 - RNA, 21 nt, Mycobacterium bovis subsp bovis AF2122/97
gcaucgcacgggccaccagcg

SEQ ID NO: 1088155 - RNA, 20 nt, Mycobacterium bovis subsp bovis AF2122/97
gcaucgaguucggcccgcaa

SEQ ID NO: 1088156 - RNA, 18 nt, Mycobacterium bovis subsp bovis AF2122/97
gcaucgauaauggccgag

SEQ ID NO: 1088157 - RNA, 13 nt, Mycobacterium bovis subsp bovis AF2122/97
gcaucgagcagcc

SEQ ID NO: 1088158 - RNA, 16 nt, Mycobacterium bovis subsp bovis AF2122/97
gcaucgagcagcccgg

SEQ ID NO: 1088159 - RNA, 21 nt, Mycobacterium bovis subsp bovis AF2122/97
gcaucgagcaguggccgccgg

SEQ ID NO: 1088160 - RNA, 15 nt, Mycobacterium bovis subsp bovis AF2122/97
gcaucgagacgagcc

SEQ ID NO: 1088161 - RNA, 18 nt, Mycobacterium bovis subsp bovis AF2122/97
gcaucgacgugcgcggca

SEQ ID NO: 1088162 - RNA, 15 nt, Mycobacterium bovis subsp bovis AF2122/97
gcaucgacucacgga

SEQ ID NO: 1088163 - RNA, 19 nt, Mycobacterium bovis subsp bovis AF2122/97
gcaucgacugccagcgccg

SEQ ID NO: 1088164 - RNA, 21 nt, Mycobacterium bovis subsp bovis AF2122/97
gcaucgacugccagcgccgcg

SEQ ID NO: 1088165 - RNA, 17 nt, Mycobacterium bovis subsp bovis AF2122/97
gcaucggccagcagcga

SEQ ID NO: 1088166 - RNA, 13 nt, Mycobacterium bovis subsp bovis AF2122/97
gcaucggcgacga

SEQ ID NO: 1088167 - RNA, 12 nt, Mycobacterium bovis subsp bovis AF2122/97
gcaucggcgaac

SEQ ID NO: 1088168 - RNA, 13 nt, Mycobacterium bovis subsp bovis AF2122/97
gcaucggccccca

SEQ ID NO: 1088169 - RNA, 18 nt, Mycobacterium bovis subsp bovis AF2122/97
gcaucggagauacgggcc

SEQ ID NO: 1088170 - RNA, 18 nt, Mycobacterium bovis subsp bovis AF2122/97
gcaucggcagccccugcc

SEQ ID NO: 1088171 - RNA, 20 nt, Mycobacterium bovis subsp bovis AF2122/97
gcaucggcagccccugccga

SEQ ID NO: 1088172 - RNA, 16 nt, Mycobacterium bovis subsp bovis AF2122/97
gcaucgccgucaacgc

SEQ ID NO: 1088173 - RNA, 13 nt, Mycobacterium bovis subsp bovis AF2122/97
gcaucggccaaca

SEQ ID NO: 1088174 - RNA, 17 nt, Mycobacterium bovis subsp bovis AF2122/97
gcaucggccaacaccac

SEQ ID NO: 1088175 - RNA, 16 nt, Mycobacterium bovis subsp bovis AF2122/97
gcaucgcgggcggcgc

SEQ ID NO: 1088176 - RNA, 18 nt, Mycobacterium bovis subsp bovis AF2122/97
gcaucgcgggcggcgcug

SEQ ID NO: 1088177 - RNA, 13 nt, Mycobacterium bovis subsp bovis AF2122/97
gcaucgcgguggu

SEQ ID NO: 1088178 - RNA, 15 nt, Mycobacterium bovis subsp bovis AF2122/97
gcaucgcggcggcgc

SEQ ID NO: 1088179 - RNA, 14 nt, Mycobacterium bovis subsp bovis AF2122/97
gcaucgcggcaucg

SEQ ID NO: 1088180 - RNA, 15 nt, Mycobacterium bovis subsp bovis AF2122/97
gcaucgcgcgcggcu

SEQ ID NO: 1088181 - RNA, 13 nt, Mycobacterium bovis subsp bovis AF2122/97
gcaucgcgcgcgg

SEQ ID NO: 1088182 - RNA, 21 nt, Mycobacterium bovis subsp bovis AF2122/97
gcaucgcgaacucgggcaaug

SEQ ID NO: 1088183 - RNA, 20 nt, Mycobacterium bovis subsp bovis AF2122/97
gcaucgcgaauauagcggcg

SEQ ID NO: 1088184 - RNA, 16 nt, Mycobacterium bovis subsp bovis AF2122/97
gcaucgccgcgaucag

SEQ ID NO: 1088185 - RNA, 15 nt, Mycobacterium bovis subsp bovis AF2122/97
gcaucgccgcuggcc

SEQ ID NO: 1088186 - RNA, 18 nt, Mycobacterium bovis subsp bovis AF2122/97
gcaucgccggcacgguga

SEQ ID NO: 1088187 - RNA, 15 nt, Mycobacterium bovis subsp bovis AF2122/97
gcaucgccgcgggug

SEQ ID NO: 1088188 - RNA, 20 nt, Mycobacterium bovis subsp bovis AF2122/97
gcaucgccuccaggcgccac

SEQ ID NO: 1088189 - RNA, 18 nt, Mycobacterium bovis subsp bovis AF2122/97
gcaucgccuccucgacgu

SEQ ID NO: 1088190 - RNA, 13 nt, Mycobacterium bovis subsp bovis AF2122/97
gcaucgccgucaa

SEQ ID NO: 1088191 - RNA, 22 nt, Mycobacterium bovis subsp bovis AF2122/97
gcaucgccuccucgacgucggc

SEQ ID NO: 1088192 - RNA, 22 nt, Mycobacterium bovis subsp bovis AF2122/97
gcaucgccugcgccuuggucgc

SEQ ID NO: 1088193 - RNA, 23 nt, Mycobacterium bovis subsp bovis AF2122/97
gcaucgcccaacaacgcuucggc

SEQ ID NO: 1088194 - RNA, 19 nt, Mycobacterium bovis subsp bovis AF2122/97
gcaucgccacagucgucga

SEQ ID NO: 1088195 - RNA, 15 nt, Mycobacterium bovis subsp bovis AF2122/97
gcaucgccaccaccg

SEQ ID NO: 1088196 - RNA, 17 nt, Mycobacterium bovis subsp bovis AF2122/97
gcaucgccaccaccgga

SEQ ID NO: 1088197 - RNA, 20 nt, Mycobacterium bovis subsp bovis AF2122/97
gcaucgccaccaucaccgcc

SEQ ID NO: 1088198 - RNA, 21 nt, Mycobacterium bovis subsp bovis AF2122/97
gcaucgccaccaucaccgccu

SEQ ID NO: 1088199 - RNA, 12 nt, Mycobacterium bovis subsp bovis AF2122/97
gcaucggcggca

SEQ ID NO: 1088200 - RNA, 13 nt, Mycobacterium bovis subsp bovis AF2122/97
gcaucggcggcaa

SEQ ID NO: 1088201 - RNA, 14 nt, Mycobacterium bovis subsp bovis AF2122/97
gcaucggcggcaac

SEQ ID NO: 1088202 - RNA, 15 nt, Mycobacterium bovis subsp bovis AF2122/97
gcaucggcggcgucu

SEQ ID NO: 1088203 - RNA, 15 nt, Mycobacterium bovis subsp bovis AF2122/97
gcaucggcggugaac

SEQ ID NO: 1088204 - RNA, 20 nt, Mycobacterium bovis subsp bovis AF2122/97
gcaucgggcgagcucgucga

SEQ ID NO: 1088205 - RNA, 18 nt, Mycobacterium bovis subsp bovis AF2122/97
gcaucgguggggcgccgg

SEQ ID NO: 1088206 - RNA, 20 nt, Mycobacterium bovis subsp bovis AF2122/97
gcaucggugccacggcaccg

SEQ ID NO: 1088207 - RNA, 21 nt, Mycobacterium bovis subsp bovis AF2122/97
gcaucggugcgguucgcugcg

SEQ ID NO: 1088208 - RNA, 12 nt, Mycobacterium bovis subsp bovis AF2122/97
gcaucguccacg

SEQ ID NO: 1088209 - RNA, 18 nt, Mycobacterium bovis subsp bovis AF2122/97
gcaucggucaccgcggca

SEQ ID NO: 1088210 - RNA, 18 nt, Mycobacterium bovis subsp bovis AF2122/97
gcaucggugcagcccgcc

SEQ ID NO: 1088211 - RNA, 21 nt, Mycobacterium bovis subsp bovis AF2122/97
gcaucggucagcgcggcaagc

SEQ ID NO: 1088212 - RNA, 17 nt, Mycobacterium bovis subsp bovis AF2122/97
gcaucggucccacugcc

SEQ ID NO: 1088213 - RNA, 21 nt, Mycobacterium bovis subsp bovis AF2122/97
gcaucgggcuugcgcagcagc

SEQ ID NO: 1088214 - RNA, 15 nt, Mycobacterium bovis subsp bovis AF2122/97
gcaucggucacaccg

SEQ ID NO: 1088215 - RNA, 18 nt, Mycobacterium bovis subsp bovis AF2122/97
gcaucggguggcgaggca

SEQ ID NO: 1088216 - RNA, 20 nt, Mycobacterium bovis subsp bovis AF2122/97
gcaucggguggcgaggcagc

SEQ ID NO: 1088217 - RNA, 17 nt, Mycobacterium bovis subsp bovis AF2122/97
gcaucuccaccgucgcc

SEQ ID NO: 1088218 - RNA, 21 nt, Mycobacterium bovis subsp bovis AF2122/97
gcaucuccgucggccaggcca

SEQ ID NO: 1088219 - RNA, 22 nt, Mycobacterium bovis subsp bovis AF2122/97
gcaucuccaccgucgccgccgg

SEQ ID NO: 1088220 - RNA, 23 nt, Mycobacterium bovis subsp bovis AF2122/97
gcaucuccaccgucgccgccggu

SEQ ID NO: 1088221 - RNA, 19 nt, Mycobacterium bovis subsp bovis AF2122/97
gcaucucgacaucggccag

SEQ ID NO: 1088222 - RNA, 14 nt, Mycobacterium bovis subsp bovis AF2122/97
gcaucucgcaccgc

SEQ ID NO: 1088223 - RNA, 14 nt, Mycobacterium bovis subsp bovis AF2122/97
gcaucucgucgucg

SEQ ID NO: 1088224 - RNA, 12 nt, Mycobacterium bovis subsp bovis AF2122/97
gcaucucggcgg

SEQ ID NO: 1088225 - RNA, 22 nt, Mycobacterium bovis subsp bovis AF2122/97
gcaucgucgggucaaugcuggc

SEQ ID NO: 1088226 - RNA, 15 nt, Mycobacterium bovis subsp bovis AF2122/97
gcaucgucgccgagc

SEQ ID NO: 1088227 - RNA, 23 nt, Mycobacterium bovis subsp bovis AF2122/97
gcaucguuuucgccgaucccggc

SEQ ID NO: 1088228 - RNA, 20 nt, Mycobacterium bovis subsp bovis AF2122/97
gccagccacuccucggugug

SEQ ID NO: 1088229 - RNA, 12 nt, Mycobacterium bovis subsp bovis AF2122/97
gccagccaccga

SEQ ID NO: 1088230 - RNA, 13 nt, Mycobacterium bovis subsp bovis AF2122/97
gccagccaccggg

SEQ ID NO: 1088231 - RNA, 15 nt, Mycobacterium bovis subsp bovis AF2122/97
gccagccaccacauc

SEQ ID NO: 1088232 - RNA, 17 nt, Mycobacterium bovis subsp bovis AF2122/97
gccagccacagccgacc

SEQ ID NO: 1088233 - RNA, 22 nt, Mycobacterium bovis subsp bovis AF2122/97
gccagcauugaagaagcccgaa

SEQ ID NO: 1088234 - RNA, 18 nt, Mycobacterium bovis subsp bovis AF2122/97
gccagccccgcgcccacc

SEQ ID NO: 1088235 - RNA, 22 nt, Mycobacterium bovis subsp bovis AF2122/97
gccagccccauugccgucgcgg

SEQ ID NO: 1088236 - RNA, 22 nt, Mycobacterium bovis subsp bovis AF2122/97
gccagccauggcagcgccgcag

SEQ ID NO: 1088237 - RNA, 23 nt, Mycobacterium bovis subsp bovis AF2122/97
gccagccauggcagcgccgcagc

SEQ ID NO: 1088238 - RNA, 19 nt, Mycobacterium bovis subsp bovis AF2122/97
gccagcccacucgucgaac

SEQ ID NO: 1088239 - RNA, 16 nt, Mycobacterium bovis subsp bovis AF2122/97
gccagcccggcgugca

SEQ ID NO: 1088240 - RNA, 13 nt, Mycobacterium bovis subsp bovis AF2122/97
gccagcccggcgu

SEQ ID NO: 1088241 - RNA, 14 nt, Mycobacterium bovis subsp bovis AF2122/97
gccagcccguccgg

SEQ ID NO: 1088242 - RNA, 17 nt, Mycobacterium bovis subsp bovis AF2122/97
gccagcgcucaccggcg

SEQ ID NO: 1088243 - RNA, 19 nt, Mycobacterium bovis subsp bovis AF2122/97
gccagcgcucaccggcguc

SEQ ID NO: 1088244 - RNA, 21 nt, Mycobacterium bovis subsp bovis AF2122/97
gccagcgcucaccggcgucgu

SEQ ID NO: 1088245 - RNA, 16 nt, Mycobacterium bovis subsp bovis AF2122/97
gccagcgcugcugccg

SEQ ID NO: 1088246 - RNA, 19 nt, Mycobacterium bovis subsp bovis AF2122/97
gccagcggcaauggccagc

SEQ ID NO: 1088247 - RNA, 12 nt, Mycobacterium bovis subsp bovis AF2122/97
gccagcggcaca

SEQ ID NO: 1088248 - RNA, 16 nt, Mycobacterium bovis subsp bovis AF2122/97
gccagcggcacaccca

SEQ ID NO: 1088249 - RNA, 19 nt, Mycobacterium bovis subsp bovis AF2122/97
gccagcggcacacccauca

SEQ ID NO: 1088250 - RNA, 14 nt, Mycobacterium bovis subsp bovis AF2122/97
gccagcggagcagc

SEQ ID NO: 1088251 - RNA, 13 nt, Mycobacterium bovis subsp bovis AF2122/97
gccagcgccaccg

SEQ ID NO: 1088252 - RNA, 14 nt, Mycobacterium bovis subsp bovis AF2122/97
gccagcgccaccgu

SEQ ID NO: 1088253 - RNA, 16 nt, Mycobacterium bovis subsp bovis AF2122/97
gccagcgccaccguua

SEQ ID NO: 1088254 - RNA, 20 nt, Mycobacterium bovis subsp bovis AF2122/97
gccagcgcaccgccgaugug

SEQ ID NO: 1088255 - RNA, 18 nt, Mycobacterium bovis subsp bovis AF2122/97
gccagccggccgcgaccg

SEQ ID NO: 1088256 - RNA, 23 nt, Mycobacterium bovis subsp bovis AF2122/97
gccagcgagcauaccgccgcugc

SEQ ID NO: 1088257 - RNA, 22 nt, Mycobacterium bovis subsp bovis AF2122/97
gccagccggucgaugccgaugc

SEQ ID NO: 1088258 - RNA, 19 nt, Mycobacterium bovis subsp bovis AF2122/97
gccagcagcggcgagccaa

SEQ ID NO: 1088259 - RNA, 14 nt, Mycobacterium bovis subsp bovis AF2122/97
gccagcagcgcggg

SEQ ID NO: 1088260 - RNA, 20 nt, Mycobacterium bovis subsp bovis AF2122/97
gccagcaggggacgggcggc

SEQ ID NO: 1088261 - RNA, 18 nt, Mycobacterium bovis subsp bovis AF2122/97
gccagcagguuggucacc

SEQ ID NO: 1088262 - RNA, 16 nt, Mycobacterium bovis subsp bovis AF2122/97
gccagcacgccgccgg

SEQ ID NO: 1088263 - RNA, 17 nt, Mycobacterium bovis subsp bovis AF2122/97
gccagcacgccgccggc

SEQ ID NO: 1088264 - RNA, 15 nt, Mycobacterium bovis subsp bovis AF2122/97
gccagcagccguuca

SEQ ID NO: 1088265 - RNA, 17 nt, Mycobacterium bovis subsp bovis AF2122/97
gccagcagccgcgacgc

SEQ ID NO: 1088266 - RNA, 21 nt, Mycobacterium bovis subsp bovis AF2122/97
gccagcagccacccgacaacg

SEQ ID NO: 1088267 - RNA, 20 nt, Mycobacterium bovis subsp bovis AF2122/97
gccagcaccacggccagcgg

SEQ ID NO: 1088268 - RNA, 14 nt, Mycobacterium bovis subsp bovis AF2122/97
gccagcaccacggc

SEQ ID NO: 1088269 - RNA, 14 nt, Mycobacterium bovis subsp bovis AF2122/97
gccagcaccaccgg

SEQ ID NO: 1088270 - RNA, 15 nt, Mycobacterium bovis subsp bovis AF2122/97
gccagcaccaccggc

SEQ ID NO: 1088271 - RNA, 12 nt, Mycobacterium bovis subsp bovis AF2122/97
gccagcaccagc

SEQ ID NO: 1088272 - RNA, 16 nt, Mycobacterium bovis subsp bovis AF2122/97
gccagcaccacgucga

SEQ ID NO: 1088273 - RNA, 17 nt, Mycobacterium bovis subsp bovis AF2122/97
gccagcaccacgucgac

SEQ ID NO: 1088274 - RNA, 19 nt, Mycobacterium bovis subsp bovis AF2122/97
gccagcaccacgucgacga

SEQ ID NO: 1088275 - RNA, 18 nt, Mycobacterium bovis subsp bovis AF2122/97
gccagaucgccgggcuug

SEQ ID NO: 1088276 - RNA, 16 nt, Mycobacterium bovis subsp bovis AF2122/97
gccagauccgucagcu

SEQ ID NO: 1088277 - RNA, 19 nt, Mycobacterium bovis subsp bovis AF2122/97
gccagaucucgcgcgcggc

SEQ ID NO: 1088278 - RNA, 22 nt, Mycobacterium bovis subsp bovis AF2122/97
gccagaucucgcgcgcggcgac

SEQ ID NO: 1088279 - RNA, 21 nt, Mycobacterium bovis subsp bovis AF2122/97
gccagaucuccccgaccgcgc

SEQ ID NO: 1088280 - RNA, 23 nt, Mycobacterium bovis subsp bovis AF2122/97
gccagaucucgcgcgcggcgacg

SEQ ID NO: 1088281 - RNA, 17 nt, Mycobacterium bovis subsp bovis AF2122/97
gccagaugaugccaccc

SEQ ID NO: 1088282 - RNA, 17 nt, Mycobacterium bovis subsp bovis AF2122/97
gccagaucaccgucgac

SEQ ID NO: 1088283 - RNA, 16 nt, Mycobacterium bovis subsp bovis AF2122/97
gccagaucagcaccga

SEQ ID NO: 1088284 - RNA, 17 nt, Mycobacterium bovis subsp bovis AF2122/97
gccagaucagcaccgac

SEQ ID NO: 1088285 - RNA, 17 nt, Mycobacterium bovis subsp bovis AF2122/97
gccagaucagccgccgc

SEQ ID NO: 1088286 - RNA, 20 nt, Mycobacterium bovis subsp bovis AF2122/97
gccagauagguccgaucaug

SEQ ID NO: 1088287 - RNA, 21 nt, Mycobacterium bovis subsp bovis AF2122/97
gccacgaacugaucgaccgcc

SEQ ID NO: 1088288 - RNA, 19 nt, Mycobacterium bovis subsp bovis AF2122/97
gccacgaacccucagccgc

SEQ ID NO: 1088289 - RNA, 21 nt, Mycobacterium bovis subsp bovis AF2122/97
gccacgaacgcuuccagcgug

SEQ ID NO: 1088290 - RNA, 16 nt, Mycobacterium bovis subsp bovis AF2122/97
gccacgaauccgauca

SEQ ID NO: 1088291 - RNA, 15 nt, Mycobacterium bovis subsp bovis AF2122/97
gccacgaccgccgau

SEQ ID NO: 1088292 - RNA, 18 nt, Mycobacterium bovis subsp bovis AF2122/97
gccacgaccucgggaucg

SEQ ID NO: 1088293 - RNA, 22 nt, Mycobacterium bovis subsp bovis AF2122/97
gccacgaccucgggaucggcgg

SEQ ID NO: 1088294 - RNA, 22 nt, Mycobacterium bovis subsp bovis AF2122/97
gccaccucccagggcucggcgg

SEQ ID NO: 1088295 - RNA, 21 nt, Mycobacterium bovis subsp bovis AF2122/97
gccaccuccgaggccgccauc

SEQ ID NO: 1088296 - RNA, 17 nt, Mycobacterium bovis subsp bovis AF2122/97
gccaccguugccgaacc

SEQ ID NO: 1088297 - RNA, 19 nt, Mycobacterium bovis subsp bovis AF2122/97
gccaccguugccgaaccac

SEQ ID NO: 1088298 - RNA, 15 nt, Mycobacterium bovis subsp bovis AF2122/97
gccaccguugccgcc

SEQ ID NO: 1088299 - RNA, 17 nt, Mycobacterium bovis subsp bovis AF2122/97
gccaccguugccgccgu

SEQ ID NO: 1088300 - RNA, 17 nt, Mycobacterium bovis subsp bovis AF2122/97
gccaccguugggccgac

SEQ ID NO: 1088301 - RNA, 18 nt, Mycobacterium bovis subsp bovis AF2122/97
gccaccguugggccgacu

SEQ ID NO: 1088302 - RNA, 13 nt, Mycobacterium bovis subsp bovis AF2122/97
gccaccgucgccg

SEQ ID NO: 1088303 - RNA, 23 nt, Mycobacterium bovis subsp bovis AF2122/97
gccaccgugucacgcgaccaccg

SEQ ID NO: 1088304 - RNA, 15 nt, Mycobacterium bovis subsp bovis AF2122/97
gccaccucgccggcc

SEQ ID NO: 1088305 - RNA, 21 nt, Mycobacterium bovis subsp bovis AF2122/97
gccaccucgccggccgucagc

SEQ ID NO: 1088306 - RNA, 23 nt, Mycobacterium bovis subsp bovis AF2122/97
gccaccucgccggccgucagcac

SEQ ID NO: 1088307 - RNA, 22 nt, Mycobacterium bovis subsp bovis AF2122/97
gccaccuuggcguugaccagca

SEQ ID NO: 1088308 - RNA, 18 nt, Mycobacterium bovis subsp bovis AF2122/97
gccaccucgacggugacg

SEQ ID NO: 1088309 - RNA, 22 nt, Mycobacterium bovis subsp bovis AF2122/97
gccaccucgacggugacgacca

SEQ ID NO: 1088310 - RNA, 23 nt, Mycobacterium bovis subsp bovis AF2122/97
gccaccuuggucuucgccgucgg

SEQ ID NO: 1088311 - RNA, 22 nt, Mycobacterium bovis subsp bovis AF2122/97
gccacaucguucaugaucggca

SEQ ID NO: 1088312 - RNA, 14 nt, Mycobacterium bovis subsp bovis AF2122/97
gccacaugccacag

SEQ ID NO: 1088313 - RNA, 21 nt, Mycobacterium bovis subsp bovis AF2122/97
gccacauguugucgacggucg

SEQ ID NO: 1088314 - RNA, 17 nt, Mycobacterium bovis subsp bovis AF2122/97
gccacauuucaccaccg

SEQ ID NO: 1088315 - RNA, 22 nt, Mycobacterium bovis subsp bovis AF2122/97
gccacauuucaccaccguggcc

SEQ ID NO: 1088316 - RNA, 16 nt, Mycobacterium bovis subsp bovis AF2122/97
gccaccaaaccccaau

SEQ ID NO: 1088317 - RNA, 12 nt, Mycobacterium bovis subsp bovis AF2122/97
gccaccaaacgc

SEQ ID NO: 1088318 - RNA, 17 nt, Mycobacterium bovis subsp bovis AF2122/97
gccaccgucgccguaca

SEQ ID NO: 1088319 - RNA, 16 nt, Mycobacterium bovis subsp bovis AF2122/97
gccaccgucgcggcgg

SEQ ID NO: 1088320 - RNA, 20 nt, Mycobacterium bovis subsp bovis AF2122/97
gccaccgucgcugcccgcgc

SEQ ID NO: 1088321 - RNA, 22 nt, Mycobacterium bovis subsp bovis AF2122/97
gccaccgucgcugcccgcgcgg

SEQ ID NO: 1088322 - RNA, 23 nt, Mycobacterium bovis subsp bovis AF2122/97
gccaccgucgcugcccgcgcggc

SEQ ID NO: 1088323 - RNA, 12 nt, Mycobacterium bovis subsp bovis AF2122/97
gccaccgucgcc

SEQ ID NO: 1088324 - RNA, 13 nt, Mycobacterium bovis subsp bovis AF2122/97
gccaccgucaugg

SEQ ID NO: 1088325 - RNA, 15 nt, Mycobacterium bovis subsp bovis AF2122/97
gccaccgucauggcg

SEQ ID NO: 1088326 - RNA, 13 nt, Mycobacterium bovis subsp bovis AF2122/97
gccacaggugacc

SEQ ID NO: 1088327 - RNA, 16 nt, Mycobacterium bovis subsp bovis AF2122/97
gccacauacaccggcc

SEQ ID NO: 1088328 - RNA, 18 nt, Mycobacterium bovis subsp bovis AF2122/97
gccacauacaggcccgcc

SEQ ID NO: 1088329 - RNA, 21 nt, Mycobacterium bovis subsp bovis AF2122/97
gccacauacaggcccgccagc

SEQ ID NO: 1088330 - RNA, 20 nt, Mycobacterium bovis subsp bovis AF2122/97
gccacaucguucaugaucgg

SEQ ID NO: 1088331 - RNA, 15 nt, Mycobacterium bovis subsp bovis AF2122/97
gccacaucgccagca

SEQ ID NO: 1088332 - RNA, 16 nt, Mycobacterium bovis subsp bovis AF2122/97
gccacaucgccagcag

SEQ ID NO: 1088333 - RNA, 18 nt, Mycobacterium bovis subsp bovis AF2122/97
gccacgaccgccgauacu

SEQ ID NO: 1088334 - RNA, 16 nt, Mycobacterium bovis subsp bovis AF2122/97
gccacgcacaauacgg

SEQ ID NO: 1088335 - RNA, 15 nt, Mycobacterium bovis subsp bovis AF2122/97
gccacgcaccgggug

SEQ ID NO: 1088336 - RNA, 17 nt, Mycobacterium bovis subsp bovis AF2122/97
gccacgaugcgcacacc

SEQ ID NO: 1088337 - RNA, 21 nt, Mycobacterium bovis subsp bovis AF2122/97
gccacgcaaaguucgucacca

SEQ ID NO: 1088338 - RNA, 13 nt, Mycobacterium bovis subsp bovis AF2122/97
gccacgccaccgc

SEQ ID NO: 1088339 - RNA, 14 nt, Mycobacterium bovis subsp bovis AF2122/97
gccacgccacgucc

SEQ ID NO: 1088340 - RNA, 17 nt, Mycobacterium bovis subsp bovis AF2122/97
gccacgccacguccaac

SEQ ID NO: 1088341 - RNA, 14 nt, Mycobacterium bovis subsp bovis AF2122/97
gccacgaucggcgg

SEQ ID NO: 1088342 - RNA, 14 nt, Mycobacterium bovis subsp bovis AF2122/97
gccacgauccgcgg

SEQ ID NO: 1088343 - RNA, 12 nt, Mycobacterium bovis subsp bovis AF2122/97
gccacgauccgc

SEQ ID NO: 1088344 - RNA, 20 nt, Mycobacterium bovis subsp bovis AF2122/97
gccacgacgaacaccagcgc

SEQ ID NO: 1088345 - RNA, 24 nt, Mycobacterium bovis subsp bovis AF2122/97
gccacgacgacuggacaggucgcc

SEQ ID NO: 1088346 - RNA, 19 nt, Mycobacterium bovis subsp bovis AF2122/97
gccacgacgaacaccagcg

SEQ ID NO: 1088347 - RNA, 18 nt, Mycobacterium bovis subsp bovis AF2122/97
gccacgagcaacgggcga

SEQ ID NO: 1088348 - RNA, 18 nt, Mycobacterium bovis subsp bovis AF2122/97
gccacggaucgcggcggc

SEQ ID NO: 1088349 - RNA, 12 nt, Mycobacterium bovis subsp bovis AF2122/97
gccacggcaccg

SEQ ID NO: 1088350 - RNA, 22 nt, Mycobacterium bovis subsp bovis AF2122/97
gccacgccgaugauggacacca

SEQ ID NO: 1088351 - RNA, 18 nt, Mycobacterium bovis subsp bovis AF2122/97
gccacgccgaugcggugc

SEQ ID NO: 1088352 - RNA, 14 nt, Mycobacterium bovis subsp bovis AF2122/97
gccacgccgaggcg

SEQ ID NO: 1088353 - RNA, 12 nt, Mycobacterium bovis subsp bovis AF2122/97
gccacgcccagc

SEQ ID NO: 1088354 - RNA, 16 nt, Mycobacterium bovis subsp bovis AF2122/97
gccacggcaucggcca

SEQ ID NO: 1088355 - RNA, 17 nt, Mycobacterium bovis subsp bovis AF2122/97
gccacggcaucggccac

SEQ ID NO: 1088356 - RNA, 15 nt, Mycobacterium bovis subsp bovis AF2122/97
gccacggcauucgac

SEQ ID NO: 1088357 - RNA, 15 nt, Mycobacterium bovis subsp bovis AF2122/97
gccacgccagccagg

SEQ ID NO: 1088358 - RNA, 16 nt, Mycobacterium bovis subsp bovis AF2122/97
gccacgccagcgucga

SEQ ID NO: 1088359 - RNA, 18 nt, Mycobacterium bovis subsp bovis AF2122/97
gccacgccagcucgccgg

SEQ ID NO: 1088360 - RNA, 17 nt, Mycobacterium bovis subsp bovis AF2122/97
gccacgccagcucgccg

SEQ ID NO: 1088361 - RNA, 16 nt, Mycobacterium bovis subsp bovis AF2122/97
gccagaacggcgucga

SEQ ID NO: 1088362 - RNA, 21 nt, Mycobacterium bovis subsp bovis AF2122/97
gccagaagaccuggcggugcc

SEQ ID NO: 1088363 - RNA, 16 nt, Mycobacterium bovis subsp bovis AF2122/97
gccagaaugccgaacg

SEQ ID NO: 1088364 - RNA, 16 nt, Mycobacterium bovis subsp bovis AF2122/97
gccagaaugggcggca

SEQ ID NO: 1088365 - RNA, 13 nt, Mycobacterium bovis subsp bovis AF2122/97
gccagaccagggc

SEQ ID NO: 1088366 - RNA, 22 nt, Mycobacterium bovis subsp bovis AF2122/97
gccagaccagggcagcggccag

SEQ ID NO: 1088367 - RNA, 18 nt, Mycobacterium bovis subsp bovis AF2122/97
gccagacccaccaccgca

SEQ ID NO: 1088368 - RNA, 14 nt, Mycobacterium bovis subsp bovis AF2122/97
gccacugccguugc

SEQ ID NO: 1088369 - RNA, 15 nt, Mycobacterium bovis subsp bovis AF2122/97
gccagagguggauca

SEQ ID NO: 1088370 - RNA, 13 nt, Mycobacterium bovis subsp bovis AF2122/97
gccagacucgcgg

SEQ ID NO: 1088371 - RNA, 16 nt, Mycobacterium bovis subsp bovis AF2122/97
gccagacucgcggucg

SEQ ID NO: 1088372 - RNA, 17 nt, Mycobacterium bovis subsp bovis AF2122/97
gccagacucgcggucga

SEQ ID NO: 1088373 - RNA, 16 nt, Mycobacterium bovis subsp bovis AF2122/97
gccacggcugaccggg

SEQ ID NO: 1088374 - RNA, 18 nt, Mycobacterium bovis subsp bovis AF2122/97
gccacggcugaccggggu

SEQ ID NO: 1088375 - RNA, 18 nt, Mycobacterium bovis subsp bovis AF2122/97
gccacggcuucgccgcgg

SEQ ID NO: 1088376 - RNA, 21 nt, Mycobacterium bovis subsp bovis AF2122/97
gccacggcuuugcggcgcgac

SEQ ID NO: 1088377 - RNA, 14 nt, Mycobacterium bovis subsp bovis AF2122/97
gccacggcuguggc

SEQ ID NO: 1088378 - RNA, 17 nt, Mycobacterium bovis subsp bovis AF2122/97
gccacggcuguggccgc

SEQ ID NO: 1088379 - RNA, 18 nt, Mycobacterium bovis subsp bovis AF2122/97
gccacggguagcugccgc

SEQ ID NO: 1088380 - RNA, 21 nt, Mycobacterium bovis subsp bovis AF2122/97
gccacggguagcugccgcggc

SEQ ID NO: 1088381 - RNA, 12 nt, Mycobacterium bovis subsp bovis AF2122/97
gccacgggugac

SEQ ID NO: 1088382 - RNA, 21 nt, Mycobacterium bovis subsp bovis AF2122/97
gccacgggugacucgggcacg

SEQ ID NO: 1088383 - RNA, 15 nt, Mycobacterium bovis subsp bovis AF2122/97
gccacgggcggccac

SEQ ID NO: 1088384 - RNA, 16 nt, Mycobacterium bovis subsp bovis AF2122/97
gccacgggcggccacc

SEQ ID NO: 1088385 - RNA, 15 nt, Mycobacterium bovis subsp bovis AF2122/97
gccacgguccggccc

SEQ ID NO: 1088386 - RNA, 18 nt, Mycobacterium bovis subsp bovis AF2122/97
gccacgguggagcgcgcc

SEQ ID NO: 1088387 - RNA, 15 nt, Mycobacterium bovis subsp bovis AF2122/97
gccacgguggcgcaa

SEQ ID NO: 1088388 - RNA, 14 nt, Mycobacterium bovis subsp bovis AF2122/97
gccacucgcccgcu

SEQ ID NO: 1088389 - RNA, 21 nt, Mycobacterium bovis subsp bovis AF2122/97
gccacucgggacuucccgcga

SEQ ID NO: 1088390 - RNA, 22 nt, Mycobacterium bovis subsp bovis AF2122/97
gccacucgccacucagcccgac

SEQ ID NO: 1088391 - RNA, 13 nt, Mycobacterium bovis subsp bovis AF2122/97
gccacucgcccga

SEQ ID NO: 1088392 - RNA, 16 nt, Mycobacterium bovis subsp bovis AF2122/97
gccacucggcccggca

SEQ ID NO: 1088393 - RNA, 14 nt, Mycobacterium bovis subsp bovis AF2122/97
gccacugaccgcga

SEQ ID NO: 1088394 - RNA, 22 nt, Mycobacterium bovis subsp bovis AF2122/97
gccacugaccgcgaucgccgac

SEQ ID NO: 1088395 - RNA, 22 nt, Mycobacterium bovis subsp bovis AF2122/97
gccacugaaccguagcgcccac

SEQ ID NO: 1088396 - RNA, 13 nt, Mycobacterium bovis subsp bovis AF2122/97
gccacugaccgcg

SEQ ID NO: 1088397 - RNA, 18 nt, Mycobacterium bovis subsp bovis AF2122/97
gccacugccggugggcgu

SEQ ID NO: 1088398 - RNA, 16 nt, Mycobacterium bovis subsp bovis AF2122/97
gccacugcuuccggaa

SEQ ID NO: 1088399 - RNA, 17 nt, Mycobacterium bovis subsp bovis AF2122/97
gccagaaacccggcgac

SEQ ID NO: 1088400 - RNA, 22 nt, Mycobacterium bovis subsp bovis AF2122/97
gccagaaacucgaagcgguguu

SEQ ID NO: 1088401 - RNA, 22 nt, Mycobacterium bovis subsp bovis AF2122/97
gccagaaagaucgguugaucug

SEQ ID NO: 1088402 - RNA, 16 nt, Mycobacterium bovis subsp bovis AF2122/97
gccaggacgacgccga

SEQ ID NO: 1088403 - RNA, 17 nt, Mycobacterium bovis subsp bovis AF2122/97
gccaggacuggcaccgc

SEQ ID NO: 1088404 - RNA, 15 nt, Mycobacterium bovis subsp bovis AF2122/97
gccaggagcgcggcc

SEQ ID NO: 1088405 - RNA, 24 nt, Mycobacterium bovis subsp bovis AF2122/97
gccaggagcgcggcccgccucggc

SEQ ID NO: 1088406 - RNA, 16 nt, Mycobacterium bovis subsp bovis AF2122/97
gccaggagcgugucgg

SEQ ID NO: 1088407 - RNA, 16 nt, Mycobacterium bovis subsp bovis AF2122/97
gccagcgucucaaggc

SEQ ID NO: 1088408 - RNA, 17 nt, Mycobacterium bovis subsp bovis AF2122/97
gccaggaaucccucggc

SEQ ID NO: 1088409 - RNA, 17 nt, Mycobacterium bovis subsp bovis AF2122/97
gccaggacaacgcaccg

SEQ ID NO: 1088410 - RNA, 15 nt, Mycobacterium bovis subsp bovis AF2122/97
gccaggaccgcgccg

SEQ ID NO: 1088411 - RNA, 17 nt, Mycobacterium bovis subsp bovis AF2122/97
gccaggaagcgguggcc

SEQ ID NO: 1088412 - RNA, 20 nt, Mycobacterium bovis subsp bovis AF2122/97
gccagcggccauccggcggc

SEQ ID NO: 1088413 - RNA, 21 nt, Mycobacterium bovis subsp bovis AF2122/97
gccagcggccauccggcggcg

SEQ ID NO: 1088414 - RNA, 17 nt, Mycobacterium bovis subsp bovis AF2122/97
gccagcggcccgucacc

SEQ ID NO: 1088415 - RNA, 13 nt, Mycobacterium bovis subsp bovis AF2122/97
gccagcggccggg

SEQ ID NO: 1088416 - RNA, 14 nt, Mycobacterium bovis subsp bovis AF2122/97
gccagcggccgggc

SEQ ID NO: 1088417 - RNA, 18 nt, Mycobacterium bovis subsp bovis AF2122/97
gccagcgucaacagcgug

SEQ ID NO: 1088418 - RNA, 19 nt, Mycobacterium bovis subsp bovis AF2122/97
gccagcgguggaccaccgg

SEQ ID NO: 1088419 - RNA, 21 nt, Mycobacterium bovis subsp bovis AF2122/97
gccagcgucgcaaggcccgca

SEQ ID NO: 1088420 - RNA, 19 nt, Mycobacterium bovis subsp bovis AF2122/97
gccagcguccauggucgcg

SEQ ID NO: 1088421 - RNA, 15 nt, Mycobacterium bovis subsp bovis AF2122/97
gccagcgucgacaca

SEQ ID NO: 1088422 - RNA, 14 nt, Mycobacterium bovis subsp bovis AF2122/97
gccaggccacgggc

SEQ ID NO: 1088423 - RNA, 13 nt, Mycobacterium bovis subsp bovis AF2122/97
gccaggcccucga

SEQ ID NO: 1088424 - RNA, 14 nt, Mycobacterium bovis subsp bovis AF2122/97
gccaggcccggcuu

SEQ ID NO: 1088425 - RNA, 16 nt, Mycobacterium bovis subsp bovis AF2122/97
gccaggcgaagucgac

SEQ ID NO: 1088426 - RNA, 15 nt, Mycobacterium bovis subsp bovis AF2122/97
gccaggcgcuuggcc

SEQ ID NO: 1088427 - RNA, 16 nt, Mycobacterium bovis subsp bovis AF2122/97
gccaggcgcuuggccg

SEQ ID NO: 1088428 - RNA, 13 nt, Mycobacterium bovis subsp bovis AF2122/97
gccaggcgcgacg

SEQ ID NO: 1088429 - RNA, 12 nt, Mycobacterium bovis subsp bovis AF2122/97
gccaggcggcaa

SEQ ID NO: 1088430 - RNA, 15 nt, Mycobacterium bovis subsp bovis AF2122/97
gccagugccagcguc

SEQ ID NO: 1088431 - RNA, 18 nt, Mycobacterium bovis subsp bovis AF2122/97
gccagugccagcguccgu

SEQ ID NO: 1088432 - RNA, 15 nt, Mycobacterium bovis subsp bovis AF2122/97
gccagugcccgcacu

SEQ ID NO: 1088433 - RNA, 15 nt, Mycobacterium bovis subsp bovis AF2122/97
gccagugucagcacg

SEQ ID NO: 1088434 - RNA, 15 nt, Mycobacterium bovis subsp bovis AF2122/97
gccagugggccgacg

SEQ ID NO: 1088435 - RNA, 17 nt, Mycobacterium bovis subsp bovis AF2122/97
gccaguggccaccauca

SEQ ID NO: 1088436 - RNA, 16 nt, Mycobacterium bovis subsp bovis AF2122/97
gccagugcgcagcccg

SEQ ID NO: 1088437 - RNA, 13 nt, Mycobacterium bovis subsp bovis AF2122/97
gccagugcgcgcg

SEQ ID NO: 1088438 - RNA, 14 nt, Mycobacterium bovis subsp bovis AF2122/97
gccaguccgcagcg

SEQ ID NO: 1088439 - RNA, 18 nt, Mycobacterium bovis subsp bovis AF2122/97
gccaguccgcagcgucca

SEQ ID NO: 1088440 - RNA, 16 nt, Mycobacterium bovis subsp bovis AF2122/97
gccagugaacgcgcgu

SEQ ID NO: 1088441 - RNA, 17 nt, Mycobacterium bovis subsp bovis AF2122/97
gccagugaacgcgcgug

SEQ ID NO: 1088442 - RNA, 19 nt, Mycobacterium bovis subsp bovis AF2122/97
gccaguccggacggcagcc

SEQ ID NO: 1088443 - RNA, 15 nt, Mycobacterium bovis subsp bovis AF2122/97
gccagucccggcgca

SEQ ID NO: 1088444 - RNA, 21 nt, Mycobacterium bovis subsp bovis AF2122/97
gccagucccucgccaaccagu

SEQ ID NO: 1088445 - RNA, 17 nt, Mycobacterium bovis subsp bovis AF2122/97
gccaguccgaucgccga

SEQ ID NO: 1088446 - RNA, 13 nt, Mycobacterium bovis subsp bovis AF2122/97
gccaguccgcagc

SEQ ID NO: 1088447 - RNA, 21 nt, Mycobacterium bovis subsp bovis AF2122/97
gccaguccagcgcgccaccca

SEQ ID NO: 1088448 - RNA, 23 nt, Mycobacterium bovis subsp bovis AF2122/97
gccaguccagcgcgccacccagc

SEQ ID NO: 1088449 - RNA, 14 nt, Mycobacterium bovis subsp bovis AF2122/97
gccagucccccgcu

SEQ ID NO: 1088450 - RNA, 16 nt, Mycobacterium bovis subsp bovis AF2122/97
gccagucccccgcucg

SEQ ID NO: 1088451 - RNA, 16 nt, Mycobacterium bovis subsp bovis AF2122/97
gccaguucggcggccg

SEQ ID NO: 1088452 - RNA, 19 nt, Mycobacterium bovis subsp bovis AF2122/97
gccaguucggcggccgccg

SEQ ID NO: 1088453 - RNA, 21 nt, Mycobacterium bovis subsp bovis AF2122/97
gccaguucggcggccgccgcg

SEQ ID NO: 1088454 - RNA, 20 nt, Mycobacterium bovis subsp bovis AF2122/97
gccaguucggcgucguccgc

SEQ ID NO: 1088455 - RNA, 17 nt, Mycobacterium bovis subsp bovis AF2122/97
gccaguucuaccaccuu

SEQ ID NO: 1088456 - RNA, 17 nt, Mycobacterium bovis subsp bovis AF2122/97
gccaguguggugcggcg

SEQ ID NO: 1088457 - RNA, 19 nt, Mycobacterium bovis subsp bovis AF2122/97
gccaguguugcaguggcga

SEQ ID NO: 1088458 - RNA, 20 nt, Mycobacterium bovis subsp bovis AF2122/97
gccaguguugcaguggcgac

SEQ ID NO: 1088459 - RNA, 22 nt, Mycobacterium bovis subsp bovis AF2122/97
gccaguguugcaguggcgacga

SEQ ID NO: 1088460 - RNA, 19 nt, Mycobacterium bovis subsp bovis AF2122/97
gccaguguugcgcugcggc

SEQ ID NO: 1088461 - RNA, 16 nt, Mycobacterium bovis subsp bovis AF2122/97
gccaguuacguuguac

SEQ ID NO: 1088462 - RNA, 15 nt, Mycobacterium bovis subsp bovis AF2122/97
gccaguuccggugac

SEQ ID NO: 1088463 - RNA, 16 nt, Mycobacterium bovis subsp bovis AF2122/97
gccaguaugcggugcc

SEQ ID NO: 1088464 - RNA, 14 nt, Mycobacterium bovis subsp bovis AF2122/97
gccaguauggccgc

SEQ ID NO: 1088465 - RNA, 16 nt, Mycobacterium bovis subsp bovis AF2122/97
gccaguauggccgcca

SEQ ID NO: 1088466 - RNA, 21 nt, Mycobacterium bovis subsp bovis AF2122/97
gccaguauggccgccaccgcg

SEQ ID NO: 1088467 - RNA, 20 nt, Mycobacterium bovis subsp bovis AF2122/97
gccaggugucgucgaucgcg

SEQ ID NO: 1088468 - RNA, 21 nt, Mycobacterium bovis subsp bovis AF2122/97
gccaggugucgucgaucgcgg

SEQ ID NO: 1088469 - RNA, 15 nt, Mycobacterium bovis subsp bovis AF2122/97
gccaggugcagcacc

SEQ ID NO: 1088470 - RNA, 16 nt, Mycobacterium bovis subsp bovis AF2122/97
gccaggugcagcacca

SEQ ID NO: 1088471 - RNA, 21 nt, Mycobacterium bovis subsp bovis AF2122/97
gccaggugcagggugagcacg

SEQ ID NO: 1088472 - RNA, 16 nt, Mycobacterium bovis subsp bovis AF2122/97
gccaggugcccaagca

SEQ ID NO: 1088473 - RNA, 13 nt, Mycobacterium bovis subsp bovis AF2122/97
gccagguggccgc

SEQ ID NO: 1088474 - RNA, 16 nt, Mycobacterium bovis subsp bovis AF2122/97
gccagguggccgcauc

SEQ ID NO: 1088475 - RNA, 18 nt, Mycobacterium bovis subsp bovis AF2122/97
gccagguggccgcaucgc

SEQ ID NO: 1088476 - RNA, 21 nt, Mycobacterium bovis subsp bovis AF2122/97
gccagguaauugccgaccgcc

SEQ ID NO: 1088477 - RNA, 19 nt, Mycobacterium bovis subsp bovis AF2122/97
gccagggugcccucggccg

SEQ ID NO: 1088478 - RNA, 15 nt, Mycobacterium bovis subsp bovis AF2122/97
gccagggugcgccgg

SEQ ID NO: 1088479 - RNA, 19 nt, Mycobacterium bovis subsp bovis AF2122/97
gccagggucccgccgccug

SEQ ID NO: 1088480 - RNA, 15 nt, Mycobacterium bovis subsp bovis AF2122/97
gccagggucagcucg

SEQ ID NO: 1088481 - RNA, 16 nt, Mycobacterium bovis subsp bovis AF2122/97
gccagggucagcucgg

SEQ ID NO: 1088482 - RNA, 14 nt, Mycobacterium bovis subsp bovis AF2122/97
gccaucaccccggc

SEQ ID NO: 1088483 - RNA, 20 nt, Mycobacterium bovis subsp bovis AF2122/97
gccaucaacaaggggcagca

SEQ ID NO: 1088484 - RNA, 15 nt, Mycobacterium bovis subsp bovis AF2122/97
gccaucacgaccagg

SEQ ID NO: 1088485 - RNA, 12 nt, Mycobacterium bovis subsp bovis AF2122/97
gccaucacgcgc

SEQ ID NO: 1088486 - RNA, 16 nt, Mycobacterium bovis subsp bovis AF2122/97
gccaucaagcgauccg

SEQ ID NO: 1088487 - RNA, 18 nt, Mycobacterium bovis subsp bovis AF2122/97
gccaucccgcguucgaga

SEQ ID NO: 1088488 - RNA, 18 nt, Mycobacterium bovis subsp bovis AF2122/97
gccauccgauggcccggc

SEQ ID NO: 1088489 - RNA, 20 nt, Mycobacterium bovis subsp bovis AF2122/97
gccauccccggagcgauccg

SEQ ID NO: 1088490 - RNA, 13 nt, Mycobacterium bovis subsp bovis AF2122/97
gccaucccgaucc

SEQ ID NO: 1088491 - RNA, 17 nt, Mycobacterium bovis subsp bovis AF2122/97
gccauccccgccggcgc

SEQ ID NO: 1088492 - RNA, 18 nt, Mycobacterium bovis subsp bovis AF2122/97
gccauccccgccggcgcc

SEQ ID NO: 1088493 - RNA, 21 nt, Mycobacterium bovis subsp bovis AF2122/97
gccaucccgccgcccgcaucg

SEQ ID NO: 1088494 - RNA, 22 nt, Mycobacterium bovis subsp bovis AF2122/97
gccauccaugauggccgucagc

SEQ ID NO: 1088495 - RNA, 15 nt, Mycobacterium bovis subsp bovis AF2122/97
gccaucauggccgug

SEQ ID NO: 1088496 - RNA, 17 nt, Mycobacterium bovis subsp bovis AF2122/97
gccaucauggcggcccg

SEQ ID NO: 1088497 - RNA, 17 nt, Mycobacterium bovis subsp bovis AF2122/97
gccaucaugagcgaccg

SEQ ID NO: 1088498 - RNA, 16 nt, Mycobacterium bovis subsp bovis AF2122/97
gccaucagcccggcgc

SEQ ID NO: 1088499 - RNA, 14 nt, Mycobacterium bovis subsp bovis AF2122/97
gccaucaucgacgg

SEQ ID NO: 1088500 - RNA, 14 nt, Mycobacterium bovis subsp bovis AF2122/97
gccauagcccgagc

SEQ ID NO: 1088501 - RNA, 13 nt, Mycobacterium bovis subsp bovis AF2122/97
gccauagcgccgc

SEQ ID NO: 1088502 - RNA, 14 nt, Mycobacterium bovis subsp bovis AF2122/97
gccauagcgccgcg

SEQ ID NO: 1088503 - RNA, 14 nt, Mycobacterium bovis subsp bovis AF2122/97
gccauacgucgccu

SEQ ID NO: 1088504 - RNA, 14 nt, Mycobacterium bovis subsp bovis AF2122/97
gccauacuggcggu

SEQ ID NO: 1088505 - RNA, 15 nt, Mycobacterium bovis subsp bovis AF2122/97
gccauaccggcuggc

SEQ ID NO: 1088506 - RNA, 13 nt, Mycobacterium bovis subsp bovis AF2122/97
gccauaccucggc

SEQ ID NO: 1088507 - RNA, 17 nt, Mycobacterium bovis subsp bovis AF2122/97
gccauaccgcaauuggc

SEQ ID NO: 1088508 - RNA, 20 nt, Mycobacterium bovis subsp bovis AF2122/97
gccauaauucgcccgcucgc

SEQ ID NO: 1088509 - RNA, 20 nt, Mycobacterium bovis subsp bovis AF2122/97
gccauagccgcgacccgcgc

SEQ ID NO: 1088510 - RNA, 22 nt, Mycobacterium bovis subsp bovis AF2122/97
gccauagugaggccgaccagca

SEQ ID NO: 1088511 - RNA, 17 nt, Mycobacterium bovis subsp bovis AF2122/97
gccauaggcccacggca

SEQ ID NO: 1088512 - RNA, 19 nt, Mycobacterium bovis subsp bovis AF2122/97
gccauaggcccacggcagc

SEQ ID NO: 1088513 - RNA, 23 nt, Mycobacterium bovis subsp bovis AF2122/97
gccauaggcccacggcagcgccg

SEQ ID NO: 1088514 - RNA, 22 nt, Mycobacterium bovis subsp bovis AF2122/97
gccaguuuggcgcuuuggcguu

SEQ ID NO: 1088515 - RNA, 15 nt, Mycobacterium bovis subsp bovis AF2122/97
gccaguucuuggcga

SEQ ID NO: 1088516 - RNA, 23 nt, Mycobacterium bovis subsp bovis AF2122/97
gccauaaaugcgcguucgaccuc

SEQ ID NO: 1088517 - RNA, 16 nt, Mycobacterium bovis subsp bovis AF2122/97
gccauaacaccgggua

SEQ ID NO: 1088518 - RNA, 23 nt, Mycobacterium bovis subsp bovis AF2122/97
gccaucgaccguccgggucacca

SEQ ID NO: 1088519 - RNA, 22 nt, Mycobacterium bovis subsp bovis AF2122/97
gccaucgacgacacguugacga

SEQ ID NO: 1088520 - RNA, 20 nt, Mycobacterium bovis subsp bovis AF2122/97
gccaucgaguccaccaccug

SEQ ID NO: 1088521 - RNA, 14 nt, Mycobacterium bovis subsp bovis AF2122/97
gccaucgacgccgc

SEQ ID NO: 1088522 - RNA, 15 nt, Mycobacterium bovis subsp bovis AF2122/97
gccauccgugaaucg

SEQ ID NO: 1088523 - RNA, 18 nt, Mycobacterium bovis subsp bovis AF2122/97
gccauccggcggcggcca

SEQ ID NO: 1088524 - RNA, 14 nt, Mycobacterium bovis subsp bovis AF2122/97
gccauccucgagcu

SEQ ID NO: 1088525 - RNA, 22 nt, Mycobacterium bovis subsp bovis AF2122/97
gccauccucgagcugcuggcgc

SEQ ID NO: 1088526 - RNA, 17 nt, Mycobacterium bovis subsp bovis AF2122/97
gccaucguccagcagga

SEQ ID NO: 1088527 - RNA, 18 nt, Mycobacterium bovis subsp bovis AF2122/97
gccaucggugcgcacggc

SEQ ID NO: 1088528 - RNA, 17 nt, Mycobacterium bovis subsp bovis AF2122/97
gccaucgguugacccgg

SEQ ID NO: 1088529 - RNA, 22 nt, Mycobacterium bovis subsp bovis AF2122/97
gccaucgcggcguugugaccgc

SEQ ID NO: 1088530 - RNA, 15 nt, Mycobacterium bovis subsp bovis AF2122/97
gccaucggcaccagc

SEQ ID NO: 1088531 - RNA, 16 nt, Mycobacterium bovis subsp bovis AF2122/97
gccaucggcaccagcg

SEQ ID NO: 1088532 - RNA, 13 nt, Mycobacterium bovis subsp bovis AF2122/97
gccaucgccgccg

SEQ ID NO: 1088533 - RNA, 14 nt, Mycobacterium bovis subsp bovis AF2122/97
gccaucgccgccgg

SEQ ID NO: 1088534 - RNA, 13 nt, Mycobacterium bovis subsp bovis AF2122/97
gccaucgcggaac

SEQ ID NO: 1088535 - RNA, 19 nt, Mycobacterium bovis subsp bovis AF2122/97
gccaucgcgcggaccagag

SEQ ID NO: 1088536 - RNA, 21 nt, Mycobacterium bovis subsp bovis AF2122/97
gccaucgaucgagcaggccgc

SEQ ID NO: 1088537 - RNA, 19 nt, Mycobacterium bovis subsp bovis AF2122/97
gccaucgaugcggugaauc

SEQ ID NO: 1088538 - RNA, 19 nt, Mycobacterium bovis subsp bovis AF2122/97
gccaucgucgcgccgcgug

SEQ ID NO: 1088539 - RNA, 22 nt, Mycobacterium bovis subsp bovis AF2122/97
gccaucuugaguuccgcggguu

SEQ ID NO: 1088540 - RNA, 17 nt, Mycobacterium bovis subsp bovis AF2122/97
gccaucucgucgauguc

SEQ ID NO: 1088541 - RNA, 12 nt, Mycobacterium bovis subsp bovis AF2122/97
gccaucugcucg

SEQ ID NO: 1088542 - RNA, 17 nt, Mycobacterium bovis subsp bovis AF2122/97
gccaucugauccggugc

SEQ ID NO: 1088543 - RNA, 19 nt, Mycobacterium bovis subsp bovis AF2122/97
gccaucgugguuuggaccg

SEQ ID NO: 1088544 - RNA, 22 nt, Mycobacterium bovis subsp bovis AF2122/97
gccaucguccagcaggacggug

SEQ ID NO: 1088545 - RNA, 22 nt, Mycobacterium bovis subsp bovis AF2122/97
gccaucuacaucgucgagcgcg

SEQ ID NO: 1088546 - RNA, 13 nt, Mycobacterium bovis subsp bovis AF2122/97
gccaugccgcucg

SEQ ID NO: 1088547 - RNA, 18 nt, Mycobacterium bovis subsp bovis AF2122/97
gccaugccgcucggcaac

SEQ ID NO: 1088548 - RNA, 18 nt, Mycobacterium bovis subsp bovis AF2122/97
gccaugcccgcacgcucg

SEQ ID NO: 1088549 - RNA, 21 nt, Mycobacterium bovis subsp bovis AF2122/97
gccaugcccgcacgcucggcg

SEQ ID NO: 1088550 - RNA, 16 nt, Mycobacterium bovis subsp bovis AF2122/97
aagaaugugggcgacg

SEQ ID NO: 1088551 - RNA, 14 nt, Mycobacterium bovis subsp bovis AF2122/97
aagaaucagcagca

SEQ ID NO: 1088552 - RNA, 13 nt, Mycobacterium bovis subsp bovis AF2122/97
aagaauaugccga

SEQ ID NO: 1088553 - RNA, 23 nt, Mycobacterium bovis subsp bovis AF2122/97
gccaugagguaggucgccgccgc

SEQ ID NO: 1088554 - RNA, 21 nt, Mycobacterium bovis subsp bovis AF2122/97
gccaugagcgcgcccaaccug

SEQ ID NO: 1088555 - RNA, 23 nt, Mycobacterium bovis subsp bovis AF2122/97
gccaugagcgcgcccaaccuggg

SEQ ID NO: 1088556 - RNA, 21 nt, Mycobacterium bovis subsp bovis AF2122/97
gccgcaggugggcguuggcga

SEQ ID NO: 1088557 - RNA, 16 nt, Mycobacterium bovis subsp bovis AF2122/97
gccgcagugcgcgagu

SEQ ID NO: 1088558 - RNA, 13 nt, Mycobacterium bovis subsp bovis AF2122/97
gccgcaggugggc

SEQ ID NO: 1088559 - RNA, 20 nt, Mycobacterium bovis subsp bovis AF2122/97
gccgcaggugggcguuggcg

SEQ ID NO: 1088560 - RNA, 11 nt, Mycobacterium bovis subsp bovis AF2122/97
gccgcagccgc

SEQ ID NO: 1088561 - RNA, 15 nt, Mycobacterium bovis subsp bovis AF2122/97
gccgcagccgcaggc

SEQ ID NO: 1088562 - RNA, 15 nt, Mycobacterium bovis subsp bovis AF2122/97
gccgcagccacgucu

SEQ ID NO: 1088563 - RNA, 12 nt, Mycobacterium bovis subsp bovis AF2122/97
gccgcagccagc

SEQ ID NO: 1088564 - RNA, 14 nt, Mycobacterium bovis subsp bovis AF2122/97
gccgcagccagcaa

SEQ ID NO: 1088565 - RNA, 16 nt, Mycobacterium bovis subsp bovis AF2122/97
gccgcagccagcggua

SEQ ID NO: 1088566 - RNA, 19 nt, Mycobacterium bovis subsp bovis AF2122/97
gccgccaaccgcaggccga

SEQ ID NO: 1088567 - RNA, 24 nt, Mycobacterium bovis subsp bovis AF2122/97
gccgccaaccgcaggccgaagacg

SEQ ID NO: 1088568 - RNA, 22 nt, Mycobacterium bovis subsp bovis AF2122/97
gccgccaaccguucccggcaga

SEQ ID NO: 1088569 - RNA, 16 nt, Mycobacterium bovis subsp bovis AF2122/97
gccgcauaaaacucgc

SEQ ID NO: 1088570 - RNA, 21 nt, Mycobacterium bovis subsp bovis AF2122/97
gccgcauucgugacgaguucg

SEQ ID NO: 1088571 - RNA, 23 nt, Mycobacterium bovis subsp bovis AF2122/97
gccgcauaucacccggagaccga

SEQ ID NO: 1088572 - RNA, 20 nt, Mycobacterium bovis subsp bovis AF2122/97
gccgcauauugcggcgccgu

SEQ ID NO: 1088573 - RNA, 21 nt, Mycobacterium bovis subsp bovis AF2122/97
gccgcauaggccccgccagcg

SEQ ID NO: 1088574 - RNA, 23 nt, Mycobacterium bovis subsp bovis AF2122/97
gccgcauaggccccgccagcgcc

SEQ ID NO: 1088575 - RNA, 19 nt, Mycobacterium bovis subsp bovis AF2122/97
gccgcauacacgagguagc

SEQ ID NO: 1088576 - RNA, 21 nt, Mycobacterium bovis subsp bovis AF2122/97
gccgcauggugggugccggcg

SEQ ID NO: 1088577 - RNA, 15 nt, Mycobacterium bovis subsp bovis AF2122/97
gccgcauccagccgu

SEQ ID NO: 1088578 - RNA, 17 nt, Mycobacterium bovis subsp bovis AF2122/97
gccgcauccagccgugc

SEQ ID NO: 1088579 - RNA, 15 nt, Mycobacterium bovis subsp bovis AF2122/97
gccgcaugccacggc

SEQ ID NO: 1088580 - RNA, 13 nt, Mycobacterium bovis subsp bovis AF2122/97
gccgcaugcgcuc

SEQ ID NO: 1088581 - RNA, 17 nt, Mycobacterium bovis subsp bovis AF2122/97
gccgcaugcgcuccggc

SEQ ID NO: 1088582 - RNA, 19 nt, Mycobacterium bovis subsp bovis AF2122/97
gccgcaugcgcuccggcgc

SEQ ID NO: 1088583 - RNA, 20 nt, Mycobacterium bovis subsp bovis AF2122/97
gccgcaugcgcuccggcgcg

SEQ ID NO: 1088584 - RNA, 22 nt, Mycobacterium bovis subsp bovis AF2122/97
gccgcaugcgcuccggcgcgac

SEQ ID NO: 1088585 - RNA, 18 nt, Mycobacterium bovis subsp bovis AF2122/97
gccgccaacuucaccacc

SEQ ID NO: 1088586 - RNA, 13 nt, Mycobacterium bovis subsp bovis AF2122/97
gccgccaagcucg

SEQ ID NO: 1088587 - RNA, 17 nt, Mycobacterium bovis subsp bovis AF2122/97
gccgccaacuccagcac

SEQ ID NO: 1088588 - RNA, 21 nt, Mycobacterium bovis subsp bovis AF2122/97
gccgccaacuccagcacccgc

SEQ ID NO: 1088589 - RNA, 11 nt, Mycobacterium bovis subsp bovis AF2122/97
gccgccaccac

SEQ ID NO: 1088590 - RNA, 14 nt, Mycobacterium bovis subsp bovis AF2122/97
gccgccaccaccca

SEQ ID NO: 1088591 - RNA, 14 nt, Mycobacterium bovis subsp bovis AF2122/97
gccgccaccaccgg

SEQ ID NO: 1088592 - RNA, 15 nt, Mycobacterium bovis subsp bovis AF2122/97
gccgccacaccgccg

SEQ ID NO: 1088593 - RNA, 16 nt, Mycobacterium bovis subsp bovis AF2122/97
gccgccacaccgccgc

SEQ ID NO: 1088594 - RNA, 15 nt, Mycobacterium bovis subsp bovis AF2122/97
gccgccacagcaccc

SEQ ID NO: 1088595 - RNA, 16 nt, Mycobacterium bovis subsp bovis AF2122/97
gccgccaccaccggcg

SEQ ID NO: 1088596 - RNA, 18 nt, Mycobacterium bovis subsp bovis AF2122/97
gccgccaccaccggcgcc

SEQ ID NO: 1088597 - RNA, 19 nt, Mycobacterium bovis subsp bovis AF2122/97
gccgccaccaccggcgccu

SEQ ID NO: 1088598 - RNA, 15 nt, Mycobacterium bovis subsp bovis AF2122/97
gccgccagcaccacc

SEQ ID NO: 1088599 - RNA, 14 nt, Mycobacterium bovis subsp bovis AF2122/97
gccgccagcaccac

SEQ ID NO: 1088600 - RNA, 14 nt, Mycobacterium bovis subsp bovis AF2122/97
gccgccagccggcg

SEQ ID NO: 1088601 - RNA, 17 nt, Mycobacterium bovis subsp bovis AF2122/97
gccgccagcgcacgaua

SEQ ID NO: 1088602 - RNA, 12 nt, Mycobacterium bovis subsp bovis AF2122/97
gccgccagccug

SEQ ID NO: 1088603 - RNA, 15 nt, Mycobacterium bovis subsp bovis AF2122/97
gccgccagcgccgcc

SEQ ID NO: 1088604 - RNA, 17 nt, Mycobacterium bovis subsp bovis AF2122/97
gccgccagcgccgccgg

SEQ ID NO: 1088605 - RNA, 18 nt, Mycobacterium bovis subsp bovis AF2122/97
gccgccagccccacccgc

SEQ ID NO: 1088606 - RNA, 15 nt, Mycobacterium bovis subsp bovis AF2122/97
gccgccagccccagc

SEQ ID NO: 1088607 - RNA, 16 nt, Mycobacterium bovis subsp bovis AF2122/97
gccgccagccccagcg

SEQ ID NO: 1088608 - RNA, 13 nt, Mycobacterium bovis subsp bovis AF2122/97
gccgccagcccgu

SEQ ID NO: 1088609 - RNA, 16 nt, Mycobacterium bovis subsp bovis AF2122/97
gccgccagcugcgcag

SEQ ID NO: 1088610 - RNA, 21 nt, Mycobacterium bovis subsp bovis AF2122/97
gccgccagcgcgccgaucacg

SEQ ID NO: 1088611 - RNA, 16 nt, Mycobacterium bovis subsp bovis AF2122/97
gccgccagcgcggugu

SEQ ID NO: 1088612 - RNA, 13 nt, Mycobacterium bovis subsp bovis AF2122/97
gccgccagcggcg

SEQ ID NO: 1088613 - RNA, 21 nt, Mycobacterium bovis subsp bovis AF2122/97
gccgcacacgcgugcaccaua

SEQ ID NO: 1088614 - RNA, 20 nt, Mycobacterium bovis subsp bovis AF2122/97
gccgcacacucucggugaac

SEQ ID NO: 1088615 - RNA, 14 nt, Mycobacterium bovis subsp bovis AF2122/97
gccgcacacgcgug

SEQ ID NO: 1088616 - RNA, 17 nt, Mycobacterium bovis subsp bovis AF2122/97
gccgcacaugagcugga

SEQ ID NO: 1088617 - RNA, 14 nt, Mycobacterium bovis subsp bovis AF2122/97
gccgcacagcacca

SEQ ID NO: 1088618 - RNA, 23 nt, Mycobacterium bovis subsp bovis AF2122/97
gccgcacagcaugauccgcucgu

SEQ ID NO: 1088619 - RNA, 20 nt, Mycobacterium bovis subsp bovis AF2122/97
gccgcacauugguguccacc

SEQ ID NO: 1088620 - RNA, 23 nt, Mycobacterium bovis subsp bovis AF2122/97
gccgcacauugguguccaccacc

SEQ ID NO: 1088621 - RNA, 20 nt, Mycobacterium bovis subsp bovis AF2122/97
gccgcaccaagcagcgacca

SEQ ID NO: 1088622 - RNA, 18 nt, Mycobacterium bovis subsp bovis AF2122/97
gccgcacccgaucgacgg

SEQ ID NO: 1088623 - RNA, 18 nt, Mycobacterium bovis subsp bovis AF2122/97
gccgcaccagaucgucgg

SEQ ID NO: 1088624 - RNA, 17 nt, Mycobacterium bovis subsp bovis AF2122/97
gccgcaccccgcccgac

SEQ ID NO: 1088625 - RNA, 13 nt, Mycobacterium bovis subsp bovis AF2122/97
gccgcacccgaaa

SEQ ID NO: 1088626 - RNA, 16 nt, Mycobacterium bovis subsp bovis AF2122/97
gccgcaccaguggcgc

SEQ ID NO: 1088627 - RNA, 19 nt, Mycobacterium bovis subsp bovis AF2122/97
gccgcaccaguggcgccca

SEQ ID NO: 1088628 - RNA, 19 nt, Mycobacterium bovis subsp bovis AF2122/97
gccgcacccagaccgccga

SEQ ID NO: 1088629 - RNA, 22 nt, Mycobacterium bovis subsp bovis AF2122/97
gccgcaccaagcagcgaccagc

SEQ ID NO: 1088630 - RNA, 16 nt, Mycobacterium bovis subsp bovis AF2122/97
gccgcaccaaggccgc

SEQ ID NO: 1088631 - RNA, 15 nt, Mycobacterium bovis subsp bovis AF2122/97
gccgcagaucaccgc

SEQ ID NO: 1088632 - RNA, 18 nt, Mycobacterium bovis subsp bovis AF2122/97
gccgcagaugcaccugcg

SEQ ID NO: 1088633 - RNA, 15 nt, Mycobacterium bovis subsp bovis AF2122/97
gccgcagacgccgac

SEQ ID NO: 1088634 - RNA, 16 nt, Mycobacterium bovis subsp bovis AF2122/97
gccgcagagcaccgcg

SEQ ID NO: 1088635 - RNA, 19 nt, Mycobacterium bovis subsp bovis AF2122/97
gccgcagaaucccaacucc

SEQ ID NO: 1088636 - RNA, 15 nt, Mycobacterium bovis subsp bovis AF2122/97
gccgcacccgggacg

SEQ ID NO: 1088637 - RNA, 14 nt, Mycobacterium bovis subsp bovis AF2122/97
gccgcacccguugc

SEQ ID NO: 1088638 - RNA, 14 nt, Mycobacterium bovis subsp bovis AF2122/97
gccgcaccgccacc

SEQ ID NO: 1088639 - RNA, 12 nt, Mycobacterium bovis subsp bovis AF2122/97
gccgcaccgccg

SEQ ID NO: 1088640 - RNA, 13 nt, Mycobacterium bovis subsp bovis AF2122/97
gccgcaccgccgc

SEQ ID NO: 1088641 - RNA, 16 nt, Mycobacterium bovis subsp bovis AF2122/97
gccgcagcaccucggu

SEQ ID NO: 1088642 - RNA, 21 nt, Mycobacterium bovis subsp bovis AF2122/97
gccgcagcaccucggucccgu

SEQ ID NO: 1088643 - RNA, 20 nt, Mycobacterium bovis subsp bovis AF2122/97
gccgcagcaccucgucgauc

SEQ ID NO: 1088644 - RNA, 14 nt, Mycobacterium bovis subsp bovis AF2122/97
gccgcacccccucc

SEQ ID NO: 1088645 - RNA, 14 nt, Mycobacterium bovis subsp bovis AF2122/97
gccgcagcaucccc

SEQ ID NO: 1088646 - RNA, 18 nt, Mycobacterium bovis subsp bovis AF2122/97
gccgcagcauccccgcag

SEQ ID NO: 1088647 - RNA, 19 nt, Mycobacterium bovis subsp bovis AF2122/97
gccgcagcaggugcaucgc

SEQ ID NO: 1088648 - RNA, 15 nt, Mycobacterium bovis subsp bovis AF2122/97
gccgauuggccugcc

SEQ ID NO: 1088649 - RNA, 18 nt, Mycobacterium bovis subsp bovis AF2122/97
gccgauugcguucaucau

SEQ ID NO: 1088650 - RNA, 18 nt, Mycobacterium bovis subsp bovis AF2122/97
gccgaucugcucgccgag

SEQ ID NO: 1088651 - RNA, 22 nt, Mycobacterium bovis subsp bovis AF2122/97
gccgauuuugggaucgugccgg

SEQ ID NO: 1088652 - RNA, 17 nt, Mycobacterium bovis subsp bovis AF2122/97
gccgcaaacgcggcguc

SEQ ID NO: 1088653 - RNA, 19 nt, Mycobacterium bovis subsp bovis AF2122/97
gccgcaaugacgucgucgg

SEQ ID NO: 1088654 - RNA, 22 nt, Mycobacterium bovis subsp bovis AF2122/97
gccgcaaugacgucgucggcca

SEQ ID NO: 1088655 - RNA, 20 nt, Mycobacterium bovis subsp bovis AF2122/97
gccgcaaugcguugaccgau

SEQ ID NO: 1088656 - RNA, 19 nt, Mycobacterium bovis subsp bovis AF2122/97
gccgcaaucaugucagcgc

SEQ ID NO: 1088657 - RNA, 18 nt, Mycobacterium bovis subsp bovis AF2122/97
gccgcaacaccccccguc

SEQ ID NO: 1088658 - RNA, 22 nt, Mycobacterium bovis subsp bovis AF2122/97
gccgcaacaugggugaugcaac

SEQ ID NO: 1088659 - RNA, 22 nt, Mycobacterium bovis subsp bovis AF2122/97
gccgcaaucagacggcgaguag

SEQ ID NO: 1088660 - RNA, 15 nt, Mycobacterium bovis subsp bovis AF2122/97
gccgaucccggcgag

SEQ ID NO: 1088661 - RNA, 19 nt, Mycobacterium bovis subsp bovis AF2122/97
gccgaucccggcgagcacc

SEQ ID NO: 1088662 - RNA, 22 nt, Mycobacterium bovis subsp bovis AF2122/97
gccgaucgggcucacucgccga

SEQ ID NO: 1088663 - RNA, 19 nt, Mycobacterium bovis subsp bovis AF2122/97
gccgaucgggcuucggcca

SEQ ID NO: 1088664 - RNA, 20 nt, Mycobacterium bovis subsp bovis AF2122/97
gccgaucgggcuucggccag

SEQ ID NO: 1088665 - RNA, 21 nt, Mycobacterium bovis subsp bovis AF2122/97
gccgauccagcaggccgucga

SEQ ID NO: 1088666 - RNA, 22 nt, Mycobacterium bovis subsp bovis AF2122/97
gccgaucgggguggucgcaccg

SEQ ID NO: 1088667 - RNA, 16 nt, Mycobacterium bovis subsp bovis AF2122/97
gccgaucugcugcagc

SEQ ID NO: 1088668 - RNA, 17 nt, Mycobacterium bovis subsp bovis AF2122/97
gccgaucugcugcagcg

SEQ ID NO: 1088669 - RNA, 18 nt, Mycobacterium bovis subsp bovis AF2122/97
gccgaucucuccggcggc

SEQ ID NO: 1088670 - RNA, 20 nt, Mycobacterium bovis subsp bovis AF2122/97
gccgaucucuccggcggcga

SEQ ID NO: 1088671 - RNA, 15 nt, Mycobacterium bovis subsp bovis AF2122/97
gccgaucccggcggu

SEQ ID NO: 1088672 - RNA, 22 nt, Mycobacterium bovis subsp bovis AF2122/97
gccgaucucuccggcggcgaag

SEQ ID NO: 1088673 - RNA, 23 nt, Mycobacterium bovis subsp bovis AF2122/97
gccgauuccgcgcguccgucggc

SEQ ID NO: 1088674 - RNA, 16 nt, Mycobacterium bovis subsp bovis AF2122/97
gccgaucucgcccagc

SEQ ID NO: 1088675 - RNA, 19 nt, Mycobacterium bovis subsp bovis AF2122/97
gccgaucucgcccagcgag

SEQ ID NO: 1088676 - RNA, 18 nt, Mycobacterium bovis subsp bovis AF2122/97
gccgaucgucucggccac

SEQ ID NO: 1088677 - RNA, 17 nt, Mycobacterium bovis subsp bovis AF2122/97
gccgcccgcgcccccgg

SEQ ID NO: 1088678 - RNA, 18 nt, Mycobacterium bovis subsp bovis AF2122/97
gccgcccgcgccgccgcc

SEQ ID NO: 1088679 - RNA, 18 nt, Mycobacterium bovis subsp bovis AF2122/97
gccgcccgcgccgccgcu

SEQ ID NO: 1088680 - RNA, 17 nt, Mycobacterium bovis subsp bovis AF2122/97
gccgcccgcgccgccgg

SEQ ID NO: 1088681 - RNA, 15 nt, Mycobacterium bovis subsp bovis AF2122/97
gccgcccgcgccucc

SEQ ID NO: 1088682 - RNA, 13 nt, Mycobacterium bovis subsp bovis AF2122/97
gccgcccgcuccg

SEQ ID NO: 1088683 - RNA, 16 nt, Mycobacterium bovis subsp bovis AF2122/97
gccgcccgcuccgccg

SEQ ID NO: 1088684 - RNA, 21 nt, Mycobacterium bovis subsp bovis AF2122/97
gccgcccgcucgaugucgguc

SEQ ID NO: 1088685 - RNA, 15 nt, Mycobacterium bovis subsp bovis AF2122/97
gccgcccgcaucgcg

SEQ ID NO: 1088686 - RNA, 13 nt, Mycobacterium bovis subsp bovis AF2122/97
gccgcccggcgag

SEQ ID NO: 1088687 - RNA, 14 nt, Mycobacterium bovis subsp bovis AF2122/97
gccgcccggcgagc

SEQ ID NO: 1088688 - RNA, 19 nt, Mycobacterium bovis subsp bovis AF2122/97
gccgcccuugccgccggcc

SEQ ID NO: 1088689 - RNA, 22 nt, Mycobacterium bovis subsp bovis AF2122/97
gccgcccuucaucuugccgcga

SEQ ID NO: 1088690 - RNA, 22 nt, Mycobacterium bovis subsp bovis AF2122/97
gccgcccuugauguccgcgacg

SEQ ID NO: 1088691 - RNA, 14 nt, Mycobacterium bovis subsp bovis AF2122/97
gccgcccuugccgc

SEQ ID NO: 1088692 - RNA, 14 nt, Mycobacterium bovis subsp bovis AF2122/97
gccgcccuggccgc

SEQ ID NO: 1088693 - RNA, 16 nt, Mycobacterium bovis subsp bovis AF2122/97
gccgcccuggccgccg

SEQ ID NO: 1088694 - RNA, 17 nt, Mycobacterium bovis subsp bovis AF2122/97
gccgcccuggccgccgg

SEQ ID NO: 1088695 - RNA, 19 nt, Mycobacterium bovis subsp bovis AF2122/97
gccgcccuggacgucggcg

SEQ ID NO: 1088696 - RNA, 20 nt, Mycobacterium bovis subsp bovis AF2122/97
gccgcccuggacgucggcga

SEQ ID NO: 1088697 - RNA, 17 nt, Mycobacterium bovis subsp bovis AF2122/97
gccgcccucaccgccug

SEQ ID NO: 1088698 - RNA, 21 nt, Mycobacterium bovis subsp bovis AF2122/97
gccgcccggcgagcagggcgu

SEQ ID NO: 1088699 - RNA, 18 nt, Mycobacterium bovis subsp bovis AF2122/97
gccgcccguaaaccgaua

SEQ ID NO: 1088700 - RNA, 16 nt, Mycobacterium bovis subsp bovis AF2122/97
gccgcccucgggauug

SEQ ID NO: 1088701 - RNA, 21 nt, Mycobacterium bovis subsp bovis AF2122/97
gccgcccucucacggcgguag

SEQ ID NO: 1088702 - RNA, 15 nt, Mycobacterium bovis subsp bovis AF2122/97
gccgcccuccgacgg

SEQ ID NO: 1088703 - RNA, 15 nt, Mycobacterium bovis subsp bovis AF2122/97
gccgccgacaccacc

SEQ ID NO: 1088704 - RNA, 14 nt, Mycobacterium bovis subsp bovis AF2122/97
gccgccgacaccac

SEQ ID NO: 1088705 - RNA, 16 nt, Mycobacterium bovis subsp bovis AF2122/97
gccgccgaagccgcgc

SEQ ID NO: 1088706 - RNA, 19 nt, Mycobacterium bovis subsp bovis AF2122/97
gccgccgaauuggcggaac

SEQ ID NO: 1088707 - RNA, 15 nt, Mycobacterium bovis subsp bovis AF2122/97
gccgccgaauccgac

SEQ ID NO: 1088708 - RNA, 24 nt, Mycobacterium bovis subsp bovis AF2122/97
gccgccgaacacaccgagcgcgcc

SEQ ID NO: 1088709 - RNA, 13 nt, Mycobacterium bovis subsp bovis AF2122/97
gccgccgacgaag

SEQ ID NO: 1088710 - RNA, 12 nt, Mycobacterium bovis subsp bovis AF2122/97
gccgccgacucg

SEQ ID NO: 1088711 - RNA, 13 nt, Mycobacterium bovis subsp bovis AF2122/97
gccgccgacgccg

SEQ ID NO: 1088712 - RNA, 17 nt, Mycobacterium bovis subsp bovis AF2122/97
gccgccgacgccgccgg

SEQ ID NO: 1088713 - RNA, 21 nt, Mycobacterium bovis subsp bovis AF2122/97
gccgccgacgccgccggcacc

SEQ ID NO: 1088714 - RNA, 22 nt, Mycobacterium bovis subsp bovis AF2122/97
gccgccgacgccgccggcgcca

SEQ ID NO: 1088715 - RNA, 13 nt, Mycobacterium bovis subsp bovis AF2122/97
gccgccgagcucg

SEQ ID NO: 1088716 - RNA, 15 nt, Mycobacterium bovis subsp bovis AF2122/97
gccgccgagcggacc

SEQ ID NO: 1088717 - RNA, 18 nt, Mycobacterium bovis subsp bovis AF2122/97
gccgccgagcggaccacc

SEQ ID NO: 1088718 - RNA, 20 nt, Mycobacterium bovis subsp bovis AF2122/97
gccgccgacuuccgcgucgc

SEQ ID NO: 1088719 - RNA, 19 nt, Mycobacterium bovis subsp bovis AF2122/97
gccgccgacuugauuucga

SEQ ID NO: 1088720 - RNA, 14 nt, Mycobacterium bovis subsp bovis AF2122/97
gccgccgccaccac

SEQ ID NO: 1088721 - RNA, 17 nt, Mycobacterium bovis subsp bovis AF2122/97
gccgccgccaccaccca

SEQ ID NO: 1088722 - RNA, 13 nt, Mycobacterium bovis subsp bovis AF2122/97
gccgccccggcgc

SEQ ID NO: 1088723 - RNA, 14 nt, Mycobacterium bovis subsp bovis AF2122/97
gccgccccggccgc

SEQ ID NO: 1088724 - RNA, 14 nt, Mycobacterium bovis subsp bovis AF2122/97
gccgccccgcucgg

SEQ ID NO: 1088725 - RNA, 22 nt, Mycobacterium bovis subsp bovis AF2122/97
gccgcccccguuuacggcccgg

SEQ ID NO: 1088726 - RNA, 15 nt, Mycobacterium bovis subsp bovis AF2122/97
gccgcccccgugggg

SEQ ID NO: 1088727 - RNA, 15 nt, Mycobacterium bovis subsp bovis AF2122/97
gccgcccccgccggc

SEQ ID NO: 1088728 - RNA, 17 nt, Mycobacterium bovis subsp bovis AF2122/97
gccgcccccgccggccg

SEQ ID NO: 1088729 - RNA, 19 nt, Mycobacterium bovis subsp bovis AF2122/97
gccgcccccgccggccgcg

SEQ ID NO: 1088730 - RNA, 20 nt, Mycobacterium bovis subsp bovis AF2122/97
gccgcccccgccggccgcgc

SEQ ID NO: 1088731 - RNA, 15 nt, Mycobacterium bovis subsp bovis AF2122/97
gccgcccgagccggu

SEQ ID NO: 1088732 - RNA, 15 nt, Mycobacterium bovis subsp bovis AF2122/97
gccgccccggcgcug

SEQ ID NO: 1088733 - RNA, 16 nt, Mycobacterium bovis subsp bovis AF2122/97
gccgccccggcgcugg

SEQ ID NO: 1088734 - RNA, 16 nt, Mycobacterium bovis subsp bovis AF2122/97
gccgcccgagccggug

SEQ ID NO: 1088735 - RNA, 13 nt, Mycobacterium bovis subsp bovis AF2122/97
gccgcccaucacc

SEQ ID NO: 1088736 - RNA, 20 nt, Mycobacterium bovis subsp bovis AF2122/97
gccgccccugcgcggccacc

SEQ ID NO: 1088737 - RNA, 14 nt, Mycobacterium bovis subsp bovis AF2122/97
gccgcccgcaucgc

SEQ ID NO: 1088738 - RNA, 15 nt, Mycobacterium bovis subsp bovis AF2122/97
gccgcccgcgccacc

SEQ ID NO: 1088739 - RNA, 14 nt, Mycobacterium bovis subsp bovis AF2122/97
gccgcccgcccacc

SEQ ID NO: 1088740 - RNA, 15 nt, Mycobacterium bovis subsp bovis AF2122/97
gccgcccacggggcg

SEQ ID NO: 1088741 - RNA, 14 nt, Mycobacterium bovis subsp bovis AF2122/97
gccgcccaucaccc

SEQ ID NO: 1088742 - RNA, 22 nt, Mycobacterium bovis subsp bovis AF2122/97
gccgcccagcguugucgggugg

SEQ ID NO: 1088743 - RNA, 20 nt, Mycobacterium bovis subsp bovis AF2122/97
gccgcccaggagcaccucga

SEQ ID NO: 1088744 - RNA, 17 nt, Mycobacterium bovis subsp bovis AF2122/97
gccgcccagaccgccga

SEQ ID NO: 1088745 - RNA, 19 nt, Mycobacterium bovis subsp bovis AF2122/97
gccgcccagaccgccgacg

SEQ ID NO: 1088746 - RNA, 17 nt, Mycobacterium bovis subsp bovis AF2122/97
gccgccaguccgaucgc

SEQ ID NO: 1088747 - RNA, 16 nt, Mycobacterium bovis subsp bovis AF2122/97
gccgccaguccggacg

SEQ ID NO: 1088748 - RNA, 21 nt, Mycobacterium bovis subsp bovis AF2122/97
gccgccaguccggacggcagc

SEQ ID NO: 1088749 - RNA, 22 nt, Mycobacterium bovis subsp bovis AF2122/97
gccgccagggcccuagccggcg

SEQ ID NO: 1088750 - RNA, 23 nt, Mycobacterium bovis subsp bovis AF2122/97
gccgccaggaaucccucggccgc

SEQ ID NO: 1088751 - RNA, 17 nt, Mycobacterium bovis subsp bovis AF2122/97
gccgccaggcgcuuggc

SEQ ID NO: 1088752 - RNA, 20 nt, Mycobacterium bovis subsp bovis AF2122/97
gccgccaggcgcuuggccgg

SEQ ID NO: 1088753 - RNA, 13 nt, Mycobacterium bovis subsp bovis AF2122/97
gccgccaggcggc

SEQ ID NO: 1088754 - RNA, 15 nt, Mycobacterium bovis subsp bovis AF2122/97
gccgccaggcggccg

SEQ ID NO: 1088755 - RNA, 16 nt, Mycobacterium bovis subsp bovis AF2122/97
gccgccaggcggccgg

SEQ ID NO: 1088756 - RNA, 18 nt, Mycobacterium bovis subsp bovis AF2122/97
gccgccagguguucgccg

SEQ ID NO: 1088757 - RNA, 17 nt, Mycobacterium bovis subsp bovis AF2122/97
gccgccagguccgccgg

SEQ ID NO: 1088758 - RNA, 15 nt, Mycobacterium bovis subsp bovis AF2122/97
gccgccaguucggcg

SEQ ID NO: 1088759 - RNA, 19 nt, Mycobacterium bovis subsp bovis AF2122/97
gccgccaucagccgcugcg

SEQ ID NO: 1088760 - RNA, 20 nt, Mycobacterium bovis subsp bovis AF2122/97
gccgccaucagccgcugcgu

SEQ ID NO: 1088761 - RNA, 20 nt, Mycobacterium bovis subsp bovis AF2122/97
gccgccaucaucgcuuggcc

SEQ ID NO: 1088762 - RNA, 18 nt, Mycobacterium bovis subsp bovis AF2122/97
gccgccauccccuggcca

SEQ ID NO: 1088763 - RNA, 15 nt, Mycobacterium bovis subsp bovis AF2122/97
gccgccaucgccgau

SEQ ID NO: 1088764 - RNA, 16 nt, Mycobacterium bovis subsp bovis AF2122/97
gccgccaucgccgaug

SEQ ID NO: 1088765 - RNA, 15 nt, Mycobacterium bovis subsp bovis AF2122/97
gccgccaucgccgcc

SEQ ID NO: 1088766 - RNA, 17 nt, Mycobacterium bovis subsp bovis AF2122/97
gccgcccaacgcgagcu

SEQ ID NO: 1088767 - RNA, 17 nt, Mycobacterium bovis subsp bovis AF2122/97
gccgcccaagccgccgg

SEQ ID NO: 1088768 - RNA, 17 nt, Mycobacterium bovis subsp bovis AF2122/97
gccgccauugccgccgg

SEQ ID NO: 1088769 - RNA, 18 nt, Mycobacterium bovis subsp bovis AF2122/97
gccgccauugccgccggu

SEQ ID NO: 1088770 - RNA, 23 nt, Mycobacterium bovis subsp bovis AF2122/97
gccgccauuggacagcgcgagau

SEQ ID NO: 1088771 - RNA, 17 nt, Mycobacterium bovis subsp bovis AF2122/97
gccgccauuccagccgg

SEQ ID NO: 1088772 - RNA, 14 nt, Mycobacterium bovis subsp bovis AF2122/97
gccgccaugcgcac

SEQ ID NO: 1088773 - RNA, 13 nt, Mycobacterium bovis subsp bovis AF2122/97
gccgcccaccaca

SEQ ID NO: 1088774 - RNA, 19 nt, Mycobacterium bovis subsp bovis AF2122/97
gccgaggucgaaccgccgg

SEQ ID NO: 1088775 - RNA, 22 nt, Mycobacterium bovis subsp bovis AF2122/97
gccgaggucgcccgugucguac

SEQ ID NO: 1088776 - RNA, 15 nt, Mycobacterium bovis subsp bovis AF2122/97
gccgaggucgaaccg

SEQ ID NO: 1088777 - RNA, 18 nt, Mycobacterium bovis subsp bovis AF2122/97
gccgagguaacgcagcgg

SEQ ID NO: 1088778 - RNA, 19 nt, Mycobacterium bovis subsp bovis AF2122/97
gccgagguagauggcgaac

SEQ ID NO: 1088779 - RNA, 19 nt, Mycobacterium bovis subsp bovis AF2122/97
gccgagcuucagcgcgcug

SEQ ID NO: 1088780 - RNA, 21 nt, Mycobacterium bovis subsp bovis AF2122/97
gccgagcugguuggcgccgaa

SEQ ID NO: 1088781 - RNA, 19 nt, Mycobacterium bovis subsp bovis AF2122/97
gccgagcugugcgcagaca

SEQ ID NO: 1088782 - RNA, 23 nt, Mycobacterium bovis subsp bovis AF2122/97
gccgagcucguugcuggcggcca

SEQ ID NO: 1088783 - RNA, 20 nt, Mycobacterium bovis subsp bovis AF2122/97
gccgagcuagaucacggagc

SEQ ID NO: 1088784 - RNA, 21 nt, Mycobacterium bovis subsp bovis AF2122/97
gccgagcuagaucacggagcu

SEQ ID NO: 1088785 - RNA, 21 nt, Mycobacterium bovis subsp bovis AF2122/97
gccgagcucacuucacgccgc

SEQ ID NO: 1088786 - RNA, 21 nt, Mycobacterium bovis subsp bovis AF2122/97
gccgagcuggcaacgccgcgc

SEQ ID NO: 1088787 - RNA, 15 nt, Mycobacterium bovis subsp bovis AF2122/97
gccgagcuggcgacc

SEQ ID NO: 1088788 - RNA, 16 nt, Mycobacterium bovis subsp bovis AF2122/97
gccgagcuggcgcgcg

SEQ ID NO: 1088789 - RNA, 21 nt, Mycobacterium bovis subsp bovis AF2122/97
gccgagcugguaaacgggugg

SEQ ID NO: 1088790 - RNA, 20 nt, Mycobacterium bovis subsp bovis AF2122/97
gccgagcugguugacggcga

SEQ ID NO: 1088791 - RNA, 21 nt, Mycobacterium bovis subsp bovis AF2122/97
gccgagcugguugacggcgaa

SEQ ID NO: 1088792 - RNA, 16 nt, Mycobacterium bovis subsp bovis AF2122/97
gccgagcucggucacc

SEQ ID NO: 1088793 - RNA, 22 nt, Mycobacterium bovis subsp bovis AF2122/97
gccgagcugguugacggcgaag

SEQ ID NO: 1088794 - RNA, 14 nt, Mycobacterium bovis subsp bovis AF2122/97
gccgagggcgccgg

SEQ ID NO: 1088795 - RNA, 20 nt, Mycobacterium bovis subsp bovis AF2122/97
gccgauacagcacauccagc

SEQ ID NO: 1088796 - RNA, 21 nt, Mycobacterium bovis subsp bovis AF2122/97
gccgauacagcacauccagcc

SEQ ID NO: 1088797 - RNA, 13 nt, Mycobacterium bovis subsp bovis AF2122/97
gccgauacaggcc

SEQ ID NO: 1088798 - RNA, 17 nt, Mycobacterium bovis subsp bovis AF2122/97
gccgauacaggccacgc

SEQ ID NO: 1088799 - RNA, 17 nt, Mycobacterium bovis subsp bovis AF2122/97
gccgaguuccugcacgg

SEQ ID NO: 1088800 - RNA, 23 nt, Mycobacterium bovis subsp bovis AF2122/97
gccgaggucgguucggccggagc

SEQ ID NO: 1088801 - RNA, 13 nt, Mycobacterium bovis subsp bovis AF2122/97
gccgaggucguau

SEQ ID NO: 1088802 - RNA, 15 nt, Mycobacterium bovis subsp bovis AF2122/97
gccgaggucguaugc

SEQ ID NO: 1088803 - RNA, 22 nt, Mycobacterium bovis subsp bovis AF2122/97
gccgagcucggucaccacggcg

SEQ ID NO: 1088804 - RNA, 20 nt, Mycobacterium bovis subsp bovis AF2122/97
gccgagugcccagcgaugcg

SEQ ID NO: 1088805 - RNA, 22 nt, Mycobacterium bovis subsp bovis AF2122/97
gccgagugcccagcgaugcgcu

SEQ ID NO: 1088806 - RNA, 16 nt, Mycobacterium bovis subsp bovis AF2122/97
gccgaucagcguggcg

SEQ ID NO: 1088807 - RNA, 22 nt, Mycobacterium bovis subsp bovis AF2122/97
gccgaucagcguggcgcccgug

SEQ ID NO: 1088808 - RNA, 16 nt, Mycobacterium bovis subsp bovis AF2122/97
gccgaucaucaccggc

SEQ ID NO: 1088809 - RNA, 19 nt, Mycobacterium bovis subsp bovis AF2122/97
gccgaucaucaccggcaua

SEQ ID NO: 1088810 - RNA, 14 nt, Mycobacterium bovis subsp bovis AF2122/97
gccgauccagcagg

SEQ ID NO: 1088811 - RNA, 18 nt, Mycobacterium bovis subsp bovis AF2122/97
gccgauccagcaggccgu

SEQ ID NO: 1088812 - RNA, 16 nt, Mycobacterium bovis subsp bovis AF2122/97
gccgaucccaccggcu

SEQ ID NO: 1088813 - RNA, 16 nt, Mycobacterium bovis subsp bovis AF2122/97
gccgaucagcgcggcg

SEQ ID NO: 1088814 - RNA, 15 nt, Mycobacterium bovis subsp bovis AF2122/97
gccgaucaguccggc

SEQ ID NO: 1088815 - RNA, 17 nt, Mycobacterium bovis subsp bovis AF2122/97
gccgaucaacagcaccg

SEQ ID NO: 1088816 - RNA, 23 nt, Mycobacterium bovis subsp bovis AF2122/97
gccgaucacgggcuaccggcagc

SEQ ID NO: 1088817 - RNA, 13 nt, Mycobacterium bovis subsp bovis AF2122/97
gccgaucacgcug

SEQ ID NO: 1088818 - RNA, 13 nt, Mycobacterium bovis subsp bovis AF2122/97
gccgaucacggca

SEQ ID NO: 1088819 - RNA, 15 nt, Mycobacterium bovis subsp bovis AF2122/97
gccgauaucggugac

SEQ ID NO: 1088820 - RNA, 21 nt, Mycobacterium bovis subsp bovis AF2122/97
gccgauaucggugaccguggc

SEQ ID NO: 1088821 - RNA, 17 nt, Mycobacterium bovis subsp bovis AF2122/97
gccgauauuggcaucgu

SEQ ID NO: 1088822 - RNA, 14 nt, Mycobacterium bovis subsp bovis AF2122/97
gccgauagcaccgg

SEQ ID NO: 1088823 - RNA, 15 nt, Mycobacterium bovis subsp bovis AF2122/97
gccgauagcaccgga

SEQ ID NO: 1088824 - RNA, 15 nt, Mycobacterium bovis subsp bovis AF2122/97
gccgauagcgcggca

SEQ ID NO: 1088825 - RNA, 20 nt, Mycobacterium bovis subsp bovis AF2122/97
gccgauagcgcggcaccagc

SEQ ID NO: 1088826 - RNA, 20 nt, Mycobacterium bovis subsp bovis AF2122/97
gccgauacgugaggucccgg

SEQ ID NO: 1088827 - RNA, 23 nt, Mycobacterium bovis subsp bovis AF2122/97
gccgauacgugaggucccggcug

SEQ ID NO: 1088828 - RNA, 19 nt, Mycobacterium bovis subsp bovis AF2122/97
gccgauacuucaucggcac

SEQ ID NO: 1088829 - RNA, 15 nt, Mycobacterium bovis subsp bovis AF2122/97
gccgauaccgccggc

SEQ ID NO: 1088830 - RNA, 16 nt, Mycobacterium bovis subsp bovis AF2122/97
gccgauaccgccggcc

SEQ ID NO: 1088831 - RNA, 23 nt, Mycobacterium bovis subsp bovis AF2122/97
gccgauacuucaucggcacaggc

SEQ ID NO: 1088832 - RNA, 23 nt, Mycobacterium bovis subsp bovis AF2122/97
gccgauagaacuagaucgucguc

SEQ ID NO: 1088833 - RNA, 15 nt, Mycobacterium bovis subsp bovis AF2122/97
gccgauaccggcggc

SEQ ID NO: 1088834 - RNA, 17 nt, Mycobacterium bovis subsp bovis AF2122/97
gccgauaccggcggcga

SEQ ID NO: 1088835 - RNA, 18 nt, Mycobacterium bovis subsp bovis AF2122/97
gccgauaccggcggcgag

SEQ ID NO: 1088836 - RNA, 19 nt, Mycobacterium bovis subsp bovis AF2122/97
gccgauaccggcggcgagc

SEQ ID NO: 1088837 - RNA, 14 nt, Mycobacterium bovis subsp bovis AF2122/97
gccgauacccagcg

SEQ ID NO: 1088838 - RNA, 22 nt, Mycobacterium bovis subsp bovis AF2122/97
gccgauacccagcgggucgcgg

SEQ ID NO: 1088839 - RNA, 17 nt, Mycobacterium bovis subsp bovis AF2122/97
gccgacuuggugacccc

SEQ ID NO: 1088840 - RNA, 23 nt, Mycobacterium bovis subsp bovis AF2122/97
gccgacuucgucaaccaccagga

SEQ ID NO: 1088841 - RNA, 21 nt, Mycobacterium bovis subsp bovis AF2122/97
gccgacuuguacgcaucgccg

SEQ ID NO: 1088842 - RNA, 21 nt, Mycobacterium bovis subsp bovis AF2122/97
gccgacuugauuucgaucgcg

SEQ ID NO: 1088843 - RNA, 22 nt, Mycobacterium bovis subsp bovis AF2122/97
gccgacuugauuucgaucgcgg

SEQ ID NO: 1088844 - RNA, 20 nt, Mycobacterium bovis subsp bovis AF2122/97
gccgacuuccgcgucgccgg

SEQ ID NO: 1088845 - RNA, 20 nt, Mycobacterium bovis subsp bovis AF2122/97
gccgagaagugggcgguacc

SEQ ID NO: 1088846 - RNA, 13 nt, Mycobacterium bovis subsp bovis AF2122/97
gccgagaacaccg

SEQ ID NO: 1088847 - RNA, 18 nt, Mycobacterium bovis subsp bovis AF2122/97
gccgagaacgauguccgc

SEQ ID NO: 1088848 - RNA, 16 nt, Mycobacterium bovis subsp bovis AF2122/97
gccgagaacaccggcc

SEQ ID NO: 1088849 - RNA, 14 nt, Mycobacterium bovis subsp bovis AF2122/97
gccgagaaccagcg

SEQ ID NO: 1088850 - RNA, 15 nt, Mycobacterium bovis subsp bovis AF2122/97
gccgagaaccagcga

SEQ ID NO: 1088851 - RNA, 19 nt, Mycobacterium bovis subsp bovis AF2122/97
gccgagagcaccgcucggu

SEQ ID NO: 1088852 - RNA, 13 nt, Mycobacterium bovis subsp bovis AF2122/97
gccgagagcagcc

SEQ ID NO: 1088853 - RNA, 14 nt, Mycobacterium bovis subsp bovis AF2122/97
gccgagagcagcca

SEQ ID NO: 1088854 - RNA, 16 nt, Mycobacterium bovis subsp bovis AF2122/97
gccgagagcagccagc

SEQ ID NO: 1088855 - RNA, 22 nt, Mycobacterium bovis subsp bovis AF2122/97
gccgagagcagccagccaccga

SEQ ID NO: 1088856 - RNA, 23 nt, Mycobacterium bovis subsp bovis AF2122/97
gccgagaauuccccagccgcauc

SEQ ID NO: 1088857 - RNA, 15 nt, Mycobacterium bovis subsp bovis AF2122/97
gccgagaucccagcg

SEQ ID NO: 1088858 - RNA, 15 nt, Mycobacterium bovis subsp bovis AF2122/97
gccgagaucgacauc

SEQ ID NO: 1088859 - RNA, 21 nt, Mycobacterium bovis subsp bovis AF2122/97
gccgagaucgacaucguuggc

SEQ ID NO: 1088860 - RNA, 22 nt, Mycobacterium bovis subsp bovis AF2122/97
gccgagaucgacaucguuggcc

SEQ ID NO: 1088861 - RNA, 15 nt, Mycobacterium bovis subsp bovis AF2122/97
gccgagaccgccgcu

SEQ ID NO: 1088862 - RNA, 20 nt, Mycobacterium bovis subsp bovis AF2122/97
gccgagaccgccgcugccgc

SEQ ID NO: 1088863 - RNA, 24 nt, Mycobacterium bovis subsp bovis AF2122/97
gccgagaacgauguccgcgcgaac

SEQ ID NO: 1088864 - RNA, 19 nt, Mycobacterium bovis subsp bovis AF2122/97
gccgagaccacgcgcgucg

SEQ ID NO: 1088865 - RNA, 21 nt, Mycobacterium bovis subsp bovis AF2122/97
gccgagaccacgcgcgucggu

SEQ ID NO: 1088866 - RNA, 22 nt, Mycobacterium bovis subsp bovis AF2122/97
gccgagaccgcguggucggcga

SEQ ID NO: 1088867 - RNA, 12 nt, Mycobacterium bovis subsp bovis AF2122/97
gccgagacgacc

SEQ ID NO: 1088868 - RNA, 12 nt, Mycobacterium bovis subsp bovis AF2122/97
gccgagagcacc

SEQ ID NO: 1088869 - RNA, 23 nt, Mycobacterium bovis subsp bovis AF2122/97
gccgacgucgacgccggccagcg

SEQ ID NO: 1088870 - RNA, 12 nt, Mycobacterium bovis subsp bovis AF2122/97
gccgacgucggc

SEQ ID NO: 1088871 - RNA, 21 nt, Mycobacterium bovis subsp bovis AF2122/97
gccgacgucgacgccggccag

SEQ ID NO: 1088872 - RNA, 18 nt, Mycobacterium bovis subsp bovis AF2122/97
gccgacguauagaccagg

SEQ ID NO: 1088873 - RNA, 14 nt, Mycobacterium bovis subsp bovis AF2122/97
gccgacgugcggcg

SEQ ID NO: 1088874 - RNA, 15 nt, Mycobacterium bovis subsp bovis AF2122/97
gccgacgugcggcgg

SEQ ID NO: 1088875 - RNA, 16 nt, Mycobacterium bovis subsp bovis AF2122/97
gccgacgugcggcggc

SEQ ID NO: 1088876 - RNA, 18 nt, Mycobacterium bovis subsp bovis AF2122/97
gccgacgugcggcggccu

SEQ ID NO: 1088877 - RNA, 22 nt, Mycobacterium bovis subsp bovis AF2122/97
gccgacgucugguuggcuggcg

SEQ ID NO: 1088878 - RNA, 21 nt, Mycobacterium bovis subsp bovis AF2122/97
gccgacgugacaacugcgccg

SEQ ID NO: 1088879 - RNA, 12 nt, Mycobacterium bovis subsp bovis AF2122/97
gccgacgugacc

SEQ ID NO: 1088880 - RNA, 16 nt, Mycobacterium bovis subsp bovis AF2122/97
gccgacuccccgccgg

SEQ ID NO: 1088881 - RNA, 17 nt, Mycobacterium bovis subsp bovis AF2122/97
gccgacucaucggccgc

SEQ ID NO: 1088882 - RNA, 16 nt, Mycobacterium bovis subsp bovis AF2122/97
gccgacgucuaggcca

SEQ ID NO: 1088883 - RNA, 22 nt, Mycobacterium bovis subsp bovis AF2122/97
gccgacucaucggccgcggucg

SEQ ID NO: 1088884 - RNA, 15 nt, Mycobacterium bovis subsp bovis AF2122/97
gccgacucggcaccg

SEQ ID NO: 1088885 - RNA, 19 nt, Mycobacterium bovis subsp bovis AF2122/97
gccgacucggcaccgcggc

SEQ ID NO: 1088886 - RNA, 17 nt, Mycobacterium bovis subsp bovis AF2122/97
gccgacugggcgcgacc

SEQ ID NO: 1088887 - RNA, 18 nt, Mycobacterium bovis subsp bovis AF2122/97
gccgacugggcgcgaccc

SEQ ID NO: 1088888 - RNA, 23 nt, Mycobacterium bovis subsp bovis AF2122/97
gccgacugugaaucugacgacgc

SEQ ID NO: 1088889 - RNA, 14 nt, Mycobacterium bovis subsp bovis AF2122/97
gccgacuaucggcc

SEQ ID NO: 1088890 - RNA, 18 nt, Mycobacterium bovis subsp bovis AF2122/97
gccgacuaucggccgccg

SEQ ID NO: 1088891 - RNA, 20 nt, Mycobacterium bovis subsp bovis AF2122/97
gccgacuaucggccgccgga

SEQ ID NO: 1088892 - RNA, 22 nt, Mycobacterium bovis subsp bovis AF2122/97
gccgacuacgaagacguucgga

SEQ ID NO: 1088893 - RNA, 18 nt, Mycobacterium bovis subsp bovis AF2122/97
gccgacguugaagccgcc

SEQ ID NO: 1088894 - RNA, 22 nt, Mycobacterium bovis subsp bovis AF2122/97
gccgacguugaagccgccggag

SEQ ID NO: 1088895 - RNA, 18 nt, Mycobacterium bovis subsp bovis AF2122/97
gccgacucaggucggugc

SEQ ID NO: 1088896 - RNA, 19 nt, Mycobacterium bovis subsp bovis AF2122/97
gccgacucaggucggugcg

SEQ ID NO: 1088897 - RNA, 16 nt, Mycobacterium bovis subsp bovis AF2122/97
gccgacucaucggccg

SEQ ID NO: 1088898 - RNA, 16 nt, Mycobacterium bovis subsp bovis AF2122/97
gccgagaugccggcga

SEQ ID NO: 1088899 - RNA, 22 nt, Mycobacterium bovis subsp bovis AF2122/97
gccgagcaaacauccacccgcg

SEQ ID NO: 1088900 - RNA, 17 nt, Mycobacterium bovis subsp bovis AF2122/97
gccgagcaacaccgucg

SEQ ID NO: 1088901 - RNA, 18 nt, Mycobacterium bovis subsp bovis AF2122/97
gccgagcagggccggcac

SEQ ID NO: 1088902 - RNA, 18 nt, Mycobacterium bovis subsp bovis AF2122/97
gccgagcaggucggcaau

SEQ ID NO: 1088903 - RNA, 18 nt, Mycobacterium bovis subsp bovis AF2122/97
gccgagcacacgucggga

SEQ ID NO: 1088904 - RNA, 22 nt, Mycobacterium bovis subsp bovis AF2122/97
gccgagaugcuggucggcgaug

SEQ ID NO: 1088905 - RNA, 14 nt, Mycobacterium bovis subsp bovis AF2122/97
gccgagcccgccgg

SEQ ID NO: 1088906 - RNA, 16 nt, Mycobacterium bovis subsp bovis AF2122/97
gccgagccagcacccg

SEQ ID NO: 1088907 - RNA, 15 nt, Mycobacterium bovis subsp bovis AF2122/97
gccgagccagcuccg

SEQ ID NO: 1088908 - RNA, 13 nt, Mycobacterium bovis subsp bovis AF2122/97
gccgagccgacau

SEQ ID NO: 1088909 - RNA, 19 nt, Mycobacterium bovis subsp bovis AF2122/97
gccgagcccgggccguacg

SEQ ID NO: 1088910 - RNA, 20 nt, Mycobacterium bovis subsp bovis AF2122/97
gccgagcgcaaggucgacgg

SEQ ID NO: 1088911 - RNA, 17 nt, Mycobacterium bovis subsp bovis AF2122/97
gccgagcgcaccacggc

SEQ ID NO: 1088912 - RNA, 12 nt, Mycobacterium bovis subsp bovis AF2122/97
gccgagcgcacu

SEQ ID NO: 1088913 - RNA, 22 nt, Mycobacterium bovis subsp bovis AF2122/97
gccgagcgugaagucacggcgg

SEQ ID NO: 1088914 - RNA, 13 nt, Mycobacterium bovis subsp bovis AF2122/97
gccgagcguggcc

SEQ ID NO: 1088915 - RNA, 23 nt, Mycobacterium bovis subsp bovis AF2122/97
gccgagcguggccaauccggcgg

SEQ ID NO: 1088916 - RNA, 20 nt, Mycobacterium bovis subsp bovis AF2122/97
gccgagcgcaacucccagca

SEQ ID NO: 1088917 - RNA, 15 nt, Mycobacterium bovis subsp bovis AF2122/97
gccgagcgaccgucc

SEQ ID NO: 1088918 - RNA, 15 nt, Mycobacterium bovis subsp bovis AF2122/97
gccgagccgcccgcc

SEQ ID NO: 1088919 - RNA, 19 nt, Mycobacterium bovis subsp bovis AF2122/97
gcccucaugucgggcaacu

SEQ ID NO: 1088920 - RNA, 16 nt, Mycobacterium bovis subsp bovis AF2122/97
gcccucccgggcccgc

SEQ ID NO: 1088921 - RNA, 20 nt, Mycobacterium bovis subsp bovis AF2122/97
gcccucccgggcccgcuggg

SEQ ID NO: 1088922 - RNA, 14 nt, Mycobacterium bovis subsp bovis AF2122/97
gcccuccgagcaca

SEQ ID NO: 1088923 - RNA, 20 nt, Mycobacterium bovis subsp bovis AF2122/97
gcccucaguucacguucggc

SEQ ID NO: 1088924 - RNA, 23 nt, Mycobacterium bovis subsp bovis AF2122/97
gcccucaguucacguucggcgac

SEQ ID NO: 1088925 - RNA, 21 nt, Mycobacterium bovis subsp bovis AF2122/97
gcccucauagauacagucgac

SEQ ID NO: 1088926 - RNA, 20 nt, Mycobacterium bovis subsp bovis AF2122/97
gcccucaguucacgcucgac

SEQ ID NO: 1088927 - RNA, 23 nt, Mycobacterium bovis subsp bovis AF2122/97
gcccucaccgccugugccgccgg

SEQ ID NO: 1088928 - RNA, 15 nt, Mycobacterium bovis subsp bovis AF2122/97
gcccucagccgcggc

SEQ ID NO: 1088929 - RNA, 15 nt, Mycobacterium bovis subsp bovis AF2122/97
gccgaaacagcaccc

SEQ ID NO: 1088930 - RNA, 18 nt, Mycobacterium bovis subsp bovis AF2122/97
gccgaaacauugcccgug

SEQ ID NO: 1088931 - RNA, 12 nt, Mycobacterium bovis subsp bovis AF2122/97
gccgaaacccga

SEQ ID NO: 1088932 - RNA, 16 nt, Mycobacterium bovis subsp bovis AF2122/97
gcccuccaccgguguu

SEQ ID NO: 1088933 - RNA, 16 nt, Mycobacterium bovis subsp bovis AF2122/97
gccgaaaccgggacaa

SEQ ID NO: 1088934 - RNA, 18 nt, Mycobacterium bovis subsp bovis AF2122/97
gccgaaacucaccagcac

SEQ ID NO: 1088935 - RNA, 21 nt, Mycobacterium bovis subsp bovis AF2122/97
gccgaaagagccagcggcacu

SEQ ID NO: 1088936 - RNA, 23 nt, Mycobacterium bovis subsp bovis AF2122/97
gccgaaaucacugaggcugcggg

SEQ ID NO: 1088937 - RNA, 21 nt, Mycobacterium bovis subsp bovis AF2122/97
gccgaaagccuugccgucgag

SEQ ID NO: 1088938 - RNA, 20 nt, Mycobacterium bovis subsp bovis AF2122/97
gccgaaagccuugccgucga

SEQ ID NO: 1088939 - RNA, 14 nt, Mycobacterium bovis subsp bovis AF2122/97
gccgaaacgccgac

SEQ ID NO: 1088940 - RNA, 18 nt, Mycobacterium bovis subsp bovis AF2122/97
gccgaaccagcgaugggu

SEQ ID NO: 1088941 - RNA, 19 nt, Mycobacterium bovis subsp bovis AF2122/97
gccgaaagccaggcggcaa

SEQ ID NO: 1088942 - RNA, 19 nt, Mycobacterium bovis subsp bovis AF2122/97
gccgaacaguucggcgagc

SEQ ID NO: 1088943 - RNA, 22 nt, Mycobacterium bovis subsp bovis AF2122/97
gccgaacaguucggcgagcaca

SEQ ID NO: 1088944 - RNA, 22 nt, Mycobacterium bovis subsp bovis AF2122/97
gccgaacaauuucugcagccca

SEQ ID NO: 1088945 - RNA, 15 nt, Mycobacterium bovis subsp bovis AF2122/97
gccgaacacaccgag

SEQ ID NO: 1088946 - RNA, 18 nt, Mycobacterium bovis subsp bovis AF2122/97
gccgaacacaccgggcgg

SEQ ID NO: 1088947 - RNA, 21 nt, Mycobacterium bovis subsp bovis AF2122/97
gccgaacacaccgggcgggcu

SEQ ID NO: 1088948 - RNA, 22 nt, Mycobacterium bovis subsp bovis AF2122/97
gccgaaaucaguugcgcuccaa

SEQ ID NO: 1088949 - RNA, 13 nt, Mycobacterium bovis subsp bovis AF2122/97
gccgaaaucggcc

SEQ ID NO: 1088950 - RNA, 17 nt, Mycobacterium bovis subsp bovis AF2122/97
gccgaaccguucggcga

SEQ ID NO: 1088951 - RNA, 18 nt, Mycobacterium bovis subsp bovis AF2122/97
gccgaaccguucggcgac

SEQ ID NO: 1088952 - RNA, 20 nt, Mycobacterium bovis subsp bovis AF2122/97
gccgaacgaggaaccgucga

SEQ ID NO: 1088953 - RNA, 20 nt, Mycobacterium bovis subsp bovis AF2122/97
gccgaacgacggguccgggc

SEQ ID NO: 1088954 - RNA, 21 nt, Mycobacterium bovis subsp bovis AF2122/97
gccgaacgacggguccgggcc

SEQ ID NO: 1088955 - RNA, 15 nt, Mycobacterium bovis subsp bovis AF2122/97
gccgaaccggcacca

SEQ ID NO: 1088956 - RNA, 18 nt, Mycobacterium bovis subsp bovis AF2122/97
gccgaaccggcaccagcg

SEQ ID NO: 1088957 - RNA, 13 nt, Mycobacterium bovis subsp bovis AF2122/97
gccgaaccggcgc

SEQ ID NO: 1088958 - RNA, 15 nt, Mycobacterium bovis subsp bovis AF2122/97
gccgaaccggcgcau

SEQ ID NO: 1088959 - RNA, 17 nt, Mycobacterium bovis subsp bovis AF2122/97
gccgaacccggcggacg

SEQ ID NO: 1088960 - RNA, 15 nt, Mycobacterium bovis subsp bovis AF2122/97
gccgaacccgguguu

SEQ ID NO: 1088961 - RNA, 21 nt, Mycobacterium bovis subsp bovis AF2122/97
gccgaacccgguguugagcga

SEQ ID NO: 1088962 - RNA, 21 nt, Mycobacterium bovis subsp bovis AF2122/97
gccgaaccacgcgcccgcacc

SEQ ID NO: 1088963 - RNA, 15 nt, Mycobacterium bovis subsp bovis AF2122/97
gccgaacccaccacg

SEQ ID NO: 1088964 - RNA, 12 nt, Mycobacterium bovis subsp bovis AF2122/97
gccgaacgccag

SEQ ID NO: 1088965 - RNA, 20 nt, Mycobacterium bovis subsp bovis AF2122/97
gccgaacgccagaccgccga

SEQ ID NO: 1088966 - RNA, 18 nt, Mycobacterium bovis subsp bovis AF2122/97
gccgaacgccucgccggc

SEQ ID NO: 1088967 - RNA, 21 nt, Mycobacterium bovis subsp bovis AF2122/97
gccgaacgccucugcgaucag

SEQ ID NO: 1088968 - RNA, 18 nt, Mycobacterium bovis subsp bovis AF2122/97
gccgaacgggucggcgac

SEQ ID NO: 1088969 - RNA, 19 nt, Mycobacterium bovis subsp bovis AF2122/97
gccgaacguggcucggcgg

SEQ ID NO: 1088970 - RNA, 19 nt, Mycobacterium bovis subsp bovis AF2122/97
gccgaacuaccgacgcacc

SEQ ID NO: 1088971 - RNA, 20 nt, Mycobacterium bovis subsp bovis AF2122/97
gccgaacgucgcggccagca

SEQ ID NO: 1088972 - RNA, 20 nt, Mycobacterium bovis subsp bovis AF2122/97
gccgaacgugaacucacggc

SEQ ID NO: 1088973 - RNA, 20 nt, Mycobacterium bovis subsp bovis AF2122/97
gccgaacgugcaaccauggc

SEQ ID NO: 1088974 - RNA, 19 nt, Mycobacterium bovis subsp bovis AF2122/97
gccgaagcccgaucggcgg

SEQ ID NO: 1088975 - RNA, 19 nt, Mycobacterium bovis subsp bovis AF2122/97
gccgaagcccccgacguug

SEQ ID NO: 1088976 - RNA, 17 nt, Mycobacterium bovis subsp bovis AF2122/97
gccgaagcagaacagua

SEQ ID NO: 1088977 - RNA, 13 nt, Mycobacterium bovis subsp bovis AF2122/97
gccgaagccgaag

SEQ ID NO: 1088978 - RNA, 16 nt, Mycobacterium bovis subsp bovis AF2122/97
gccgaagccgaagggg

SEQ ID NO: 1088979 - RNA, 14 nt, Mycobacterium bovis subsp bovis AF2122/97
gccgaagccgacga

SEQ ID NO: 1088980 - RNA, 16 nt, Mycobacterium bovis subsp bovis AF2122/97
gccgaagccgacgaac

SEQ ID NO: 1088981 - RNA, 18 nt, Mycobacterium bovis subsp bovis AF2122/97
gccgaauccguccgacga

SEQ ID NO: 1088982 - RNA, 20 nt, Mycobacterium bovis subsp bovis AF2122/97
gccgaaugccaccucgacgc

SEQ ID NO: 1088983 - RNA, 22 nt, Mycobacterium bovis subsp bovis AF2122/97
gccgaaugccaccucgacgcac

SEQ ID NO: 1088984 - RNA, 21 nt, Mycobacterium bovis subsp bovis AF2122/97
gccgaauucauccgggcucgc

SEQ ID NO: 1088985 - RNA, 22 nt, Mycobacterium bovis subsp bovis AF2122/97
gccgaauucauccgggcucgca

SEQ ID NO: 1088986 - RNA, 20 nt, Mycobacterium bovis subsp bovis AF2122/97
gccgacaacgacgucgccga

SEQ ID NO: 1088987 - RNA, 13 nt, Mycobacterium bovis subsp bovis AF2122/97
gccgaaucggcag

SEQ ID NO: 1088988 - RNA, 15 nt, Mycobacterium bovis subsp bovis AF2122/97
gccgacaaccccgcc

SEQ ID NO: 1088989 - RNA, 13 nt, Mycobacterium bovis subsp bovis AF2122/97
gccgacaacccgg

SEQ ID NO: 1088990 - RNA, 15 nt, Mycobacterium bovis subsp bovis AF2122/97
gccgacaacccggcc

SEQ ID NO: 1088991 - RNA, 15 nt, Mycobacterium bovis subsp bovis AF2122/97
gccgaagcggccacc

SEQ ID NO: 1088992 - RNA, 16 nt, Mycobacterium bovis subsp bovis AF2122/97
gccgaagcggccaccg

SEQ ID NO: 1088993 - RNA, 22 nt, Mycobacterium bovis subsp bovis AF2122/97
gccgaagcggccaccgccgccg

SEQ ID NO: 1088994 - RNA, 16 nt, Mycobacterium bovis subsp bovis AF2122/97
gccgaagccggagaua

SEQ ID NO: 1088995 - RNA, 16 nt, Mycobacterium bovis subsp bovis AF2122/97
gccgaagcgaugccgu

SEQ ID NO: 1088996 - RNA, 13 nt, Mycobacterium bovis subsp bovis AF2122/97
gccgaagcgccgc

SEQ ID NO: 1088997 - RNA, 16 nt, Mycobacterium bovis subsp bovis AF2122/97
gccgaagcgcccguug

SEQ ID NO: 1088998 - RNA, 13 nt, Mycobacterium bovis subsp bovis AF2122/97
gccgaccgguggc

SEQ ID NO: 1088999 - RNA, 18 nt, Mycobacterium bovis subsp bovis AF2122/97
gccgaccgguggcaccgg

SEQ ID NO: 1089000 - RNA, 20 nt, Mycobacterium bovis subsp bovis AF2122/97
gccgaccgguggcaccggcg

SEQ ID NO: 1089001 - RNA, 22 nt, Mycobacterium bovis subsp bovis AF2122/97
gccgaccgguuggguagcaccg

SEQ ID NO: 1089002 - RNA, 22 nt, Mycobacterium bovis subsp bovis AF2122/97
gccgacccuacuuccucgacga

SEQ ID NO: 1089003 - RNA, 20 nt, Mycobacterium bovis subsp bovis AF2122/97
gccgacccuagauaugcacc

SEQ ID NO: 1089004 - RNA, 16 nt, Mycobacterium bovis subsp bovis AF2122/97
gccgaccgacgucgcc

SEQ ID NO: 1089005 - RNA, 17 nt, Mycobacterium bovis subsp bovis AF2122/97
gccgaccgaccgcacga

SEQ ID NO: 1089006 - RNA, 22 nt, Mycobacterium bovis subsp bovis AF2122/97
gccgaccgaccgcacgaccagc

SEQ ID NO: 1089007 - RNA, 19 nt, Mycobacterium bovis subsp bovis AF2122/97
gccgaccgaaucagcacgg

SEQ ID NO: 1089008 - RNA, 20 nt, Mycobacterium bovis subsp bovis AF2122/97
gccgaccgauacaccgacgg

SEQ ID NO: 1089009 - RNA, 16 nt, Mycobacterium bovis subsp bovis AF2122/97
gccgaccgauggcuca

SEQ ID NO: 1089010 - RNA, 17 nt, Mycobacterium bovis subsp bovis AF2122/97
gccgaccgacaccacca

SEQ ID NO: 1089011 - RNA, 20 nt, Mycobacterium bovis subsp bovis AF2122/97
gccgaccgacaccaccaggu

SEQ ID NO: 1089012 - RNA, 23 nt, Mycobacterium bovis subsp bovis AF2122/97
gccgaccgguuggguagcaccga

SEQ ID NO: 1089013 - RNA, 16 nt, Mycobacterium bovis subsp bovis AF2122/97
gccgaccguaccgauc

SEQ ID NO: 1089014 - RNA, 15 nt, Mycobacterium bovis subsp bovis AF2122/97
gccgaccucggcaac

SEQ ID NO: 1089015 - RNA, 23 nt, Mycobacterium bovis subsp bovis AF2122/97
gccgaccguuucuccgccgccca

SEQ ID NO: 1089016 - RNA, 15 nt, Mycobacterium bovis subsp bovis AF2122/97
gccgaccuagucacc

SEQ ID NO: 1089017 - RNA, 22 nt, Mycobacterium bovis subsp bovis AF2122/97
gccgaccuagucaccuugaccg

SEQ ID NO: 1089018 - RNA, 14 nt, Mycobacterium bovis subsp bovis AF2122/97
gccgaccucacggc

SEQ ID NO: 1089019 - RNA, 14 nt, Mycobacterium bovis subsp bovis AF2122/97
gccgaccaccgccg

SEQ ID NO: 1089020 - RNA, 15 nt, Mycobacterium bovis subsp bovis AF2122/97
gccgaccaccgccgg

SEQ ID NO: 1089021 - RNA, 16 nt, Mycobacterium bovis subsp bovis AF2122/97
gccgaccagcacaccg

SEQ ID NO: 1089022 - RNA, 20 nt, Mycobacterium bovis subsp bovis AF2122/97
gccgaccacucgagcgcuca

SEQ ID NO: 1089023 - RNA, 12 nt, Mycobacterium bovis subsp bovis AF2122/97
gccgaccagcgc

SEQ ID NO: 1089024 - RNA, 17 nt, Mycobacterium bovis subsp bovis AF2122/97
gccgacccgcgcgccgg

SEQ ID NO: 1089025 - RNA, 19 nt, Mycobacterium bovis subsp bovis AF2122/97
gccgacccgcgcgccggcg

SEQ ID NO: 1089026 - RNA, 20 nt, Mycobacterium bovis subsp bovis AF2122/97
gccgacccgcgcgccggcga

SEQ ID NO: 1089027 - RNA, 22 nt, Mycobacterium bovis subsp bovis AF2122/97
gccgacccgcgcgccggcgacc

SEQ ID NO: 1089028 - RNA, 18 nt, Mycobacterium bovis subsp bovis AF2122/97
gccgacccguaccagccc

SEQ ID NO: 1089029 - RNA, 14 nt, Mycobacterium bovis subsp bovis AF2122/97
gccgacccgggggc

SEQ ID NO: 1089030 - RNA, 22 nt, Mycobacterium bovis subsp bovis AF2122/97
gccgacccgggggcgcccggga

SEQ ID NO: 1089031 - RNA, 22 nt, Mycobacterium bovis subsp bovis AF2122/97
gccgaccagcgcgcugcgcgac

SEQ ID NO: 1089032 - RNA, 21 nt, Mycobacterium bovis subsp bovis AF2122/97
gccgacccgccgcgcccggcg

SEQ ID NO: 1089033 - RNA, 22 nt, Mycobacterium bovis subsp bovis AF2122/97
gccgacccgccgcgcccggcgc

SEQ ID NO: 1089034 - RNA, 16 nt, Mycobacterium bovis subsp bovis AF2122/97
gccgacccgccgcgga

SEQ ID NO: 1089035 - RNA, 12 nt, Mycobacterium bovis subsp bovis AF2122/97
gccgaccagcau

SEQ ID NO: 1089036 - RNA, 15 nt, Mycobacterium bovis subsp bovis AF2122/97
gccgaccagcacccg

SEQ ID NO: 1089037 - RNA, 21 nt, Mycobacterium bovis subsp bovis AF2122/97
gccgaccagcacccgcucggc

SEQ ID NO: 1089038 - RNA, 23 nt, Mycobacterium bovis subsp bovis AF2122/97
gccgacgaucgacgccgccaccc

SEQ ID NO: 1089039 - RNA, 23 nt, Mycobacterium bovis subsp bovis AF2122/97
gccgaccugcuggaucucggugg

SEQ ID NO: 1089040 - RNA, 21 nt, Mycobacterium bovis subsp bovis AF2122/97
gccgacccgggcgagcgcggc

SEQ ID NO: 1089041 - RNA, 21 nt, Mycobacterium bovis subsp bovis AF2122/97
gccgaccucaucggcaccguc

SEQ ID NO: 1089042 - RNA, 15 nt, Mycobacterium bovis subsp bovis AF2122/97
gccgaccugcgcgac

SEQ ID NO: 1089043 - RNA, 13 nt, Mycobacterium bovis subsp bovis AF2122/97
gccgacgaugacg

SEQ ID NO: 1089044 - RNA, 20 nt, Mycobacterium bovis subsp bovis AF2122/97
gccgacgauuaccagcggca

SEQ ID NO: 1089045 - RNA, 22 nt, Mycobacterium bovis subsp bovis AF2122/97
gccgacgauuaccagcggcacc

SEQ ID NO: 1089046 - RNA, 18 nt, Mycobacterium bovis subsp bovis AF2122/97
gccgacgccccgaucggc

SEQ ID NO: 1089047 - RNA, 21 nt, Mycobacterium bovis subsp bovis AF2122/97
gccgacgccagaacguggcca

SEQ ID NO: 1089048 - RNA, 18 nt, Mycobacterium bovis subsp bovis AF2122/97
gccgacgccaacgccagc

SEQ ID NO: 1089049 - RNA, 15 nt, Mycobacterium bovis subsp bovis AF2122/97
gccgacgcccgacga

SEQ ID NO: 1089050 - RNA, 18 nt, Mycobacterium bovis subsp bovis AF2122/97
gccgacggugggcgaggu

SEQ ID NO: 1089051 - RNA, 23 nt, Mycobacterium bovis subsp bovis AF2122/97
gccgacggugaugggggagccgg

SEQ ID NO: 1089052 - RNA, 12 nt, Mycobacterium bovis subsp bovis AF2122/97
gccgacgcggcg

SEQ ID NO: 1089053 - RNA, 18 nt, Mycobacterium bovis subsp bovis AF2122/97
gccgacguacaggacggu

SEQ ID NO: 1089054 - RNA, 18 nt, Mycobacterium bovis subsp bovis AF2122/97
gccgacgggugcgcggag

SEQ ID NO: 1089055 - RNA, 20 nt, Mycobacterium bovis subsp bovis AF2122/97
gccgacggguuggcuaccca

SEQ ID NO: 1089056 - RNA, 14 nt, Mycobacterium bovis subsp bovis AF2122/97
gccgacgcgcggcc

SEQ ID NO: 1089057 - RNA, 16 nt, Mycobacterium bovis subsp bovis AF2122/97
gccgacgcgcggccag

SEQ ID NO: 1089058 - RNA, 17 nt, Mycobacterium bovis subsp bovis AF2122/97
gccgacgcgcggccagc

SEQ ID NO: 1089059 - RNA, 20 nt, Mycobacterium bovis subsp bovis AF2122/97
gccgacgccuuccagcccga

SEQ ID NO: 1089060 - RNA, 16 nt, Mycobacterium bovis subsp bovis AF2122/97
aagaugaccucggcga

SEQ ID NO: 1089061 - RNA, 14 nt, Mycobacterium bovis subsp bovis AF2122/97
aagaugaccugauc

SEQ ID NO: 1089062 - RNA, 12 nt, Mycobacterium bovis subsp bovis AF2122/97
gcccgucggcgc

SEQ ID NO: 1089063 - RNA, 16 nt, Mycobacterium bovis subsp bovis AF2122/97
gcccgucggcgccgaa

SEQ ID NO: 1089064 - RNA, 17 nt, Mycobacterium bovis subsp bovis AF2122/97
gcccgucggcgccgaac

SEQ ID NO: 1089065 - RNA, 13 nt, Mycobacterium bovis subsp bovis AF2122/97
gcccgucgucggc

SEQ ID NO: 1089066 - RNA, 16 nt, Mycobacterium bovis subsp bovis AF2122/97
gcccgucgucggcaac

SEQ ID NO: 1089067 - RNA, 23 nt, Mycobacterium bovis subsp bovis AF2122/97
gcccgucggugguguuccagguc

SEQ ID NO: 1089068 - RNA, 15 nt, Mycobacterium bovis subsp bovis AF2122/97
gcccgucgucgucga

SEQ ID NO: 1089069 - RNA, 22 nt, Mycobacterium bovis subsp bovis AF2122/97
gcccgucgucgucgacacggug

SEQ ID NO: 1089070 - RNA, 17 nt, Mycobacterium bovis subsp bovis AF2122/97
gcccgucgucgugcacg

SEQ ID NO: 1089071 - RNA, 17 nt, Mycobacterium bovis subsp bovis AF2122/97
gcccgucuccagcacca

SEQ ID NO: 1089072 - RNA, 20 nt, Mycobacterium bovis subsp bovis AF2122/97
gcccgucgaaccagagguca

SEQ ID NO: 1089073 - RNA, 23 nt, Mycobacterium bovis subsp bovis AF2122/97
gcccgucggauggaaggcggcca

SEQ ID NO: 1089074 - RNA, 20 nt, Mycobacterium bovis subsp bovis AF2122/97
gcccgucggacauaccgcga

SEQ ID NO: 1089075 - RNA, 15 nt, Mycobacterium bovis subsp bovis AF2122/97
gcccgucgcggccgg

SEQ ID NO: 1089076 - RNA, 22 nt, Mycobacterium bovis subsp bovis AF2122/97
gcccgucgcugggaggcgcggu

SEQ ID NO: 1089077 - RNA, 17 nt, Mycobacterium bovis subsp bovis AF2122/97
gcccguccggcccccga

SEQ ID NO: 1089078 - RNA, 15 nt, Mycobacterium bovis subsp bovis AF2122/97
gcccguccgcgcgcc

SEQ ID NO: 1089079 - RNA, 17 nt, Mycobacterium bovis subsp bovis AF2122/97
gcccguccgcgcgccga

SEQ ID NO: 1089080 - RNA, 17 nt, Mycobacterium bovis subsp bovis AF2122/97
gcccgucccgcucgagc

SEQ ID NO: 1089081 - RNA, 11 nt, Mycobacterium bovis subsp bovis AF2122/97
gcccgucgcca

SEQ ID NO: 1089082 - RNA, 13 nt, Mycobacterium bovis subsp bovis AF2122/97
gcccguccucguc

SEQ ID NO: 1089083 - RNA, 15 nt, Mycobacterium bovis subsp bovis AF2122/97
gcccguccucgucgg

SEQ ID NO: 1089084 - RNA, 22 nt, Mycobacterium bovis subsp bovis AF2122/97
gcccguccucgucggugugcca

SEQ ID NO: 1089085 - RNA, 20 nt, Mycobacterium bovis subsp bovis AF2122/97
gcccgucagcggacaguucg

SEQ ID NO: 1089086 - RNA, 19 nt, Mycobacterium bovis subsp bovis AF2122/97
gcccguauaaccggccaug

SEQ ID NO: 1089087 - RNA, 13 nt, Mycobacterium bovis subsp bovis AF2122/97
gcccguaucggcu

SEQ ID NO: 1089088 - RNA, 19 nt, Mycobacterium bovis subsp bovis AF2122/97
gcccgucacgcccgcgaac

SEQ ID NO: 1089089 - RNA, 14 nt, Mycobacterium bovis subsp bovis AF2122/97
gcccgucaucgcgu

SEQ ID NO: 1089090 - RNA, 21 nt, Mycobacterium bovis subsp bovis AF2122/97
gcccgucauacucgacaccga

SEQ ID NO: 1089091 - RNA, 16 nt, Mycobacterium bovis subsp bovis AF2122/97
gcccgugaucaccacg

SEQ ID NO: 1089092 - RNA, 14 nt, Mycobacterium bovis subsp bovis AF2122/97
gcccgugccgcccu

SEQ ID NO: 1089093 - RNA, 17 nt, Mycobacterium bovis subsp bovis AF2122/97
gcccgugccgucgcccu

SEQ ID NO: 1089094 - RNA, 15 nt, Mycobacterium bovis subsp bovis AF2122/97
gcccgugccuggccg

SEQ ID NO: 1089095 - RNA, 18 nt, Mycobacterium bovis subsp bovis AF2122/97
gcccgugccuggccggug

SEQ ID NO: 1089096 - RNA, 17 nt, Mycobacterium bovis subsp bovis AF2122/97
gcccgugcggcucgccg

SEQ ID NO: 1089097 - RNA, 18 nt, Mycobacterium bovis subsp bovis AF2122/97
gcccgugcggcucgccgg

SEQ ID NO: 1089098 - RNA, 19 nt, Mycobacterium bovis subsp bovis AF2122/97
gcccgugcggcucgccggc

SEQ ID NO: 1089099 - RNA, 13 nt, Mycobacterium bovis subsp bovis AF2122/97
gcccgugcgaugc

SEQ ID NO: 1089100 - RNA, 18 nt, Mycobacterium bovis subsp bovis AF2122/97
gcccgugcgaugcacaac

SEQ ID NO: 1089101 - RNA, 17 nt, Mycobacterium bovis subsp bovis AF2122/97
gcccguucaugcggcgg

SEQ ID NO: 1089102 - RNA, 20 nt, Mycobacterium bovis subsp bovis AF2122/97
gcccguucaugcggcggcgc

SEQ ID NO: 1089103 - RNA, 22 nt, Mycobacterium bovis subsp bovis AF2122/97
gcccguucaugcggcggcgcuc

SEQ ID NO: 1089104 - RNA, 21 nt, Mycobacterium bovis subsp bovis AF2122/97
gcccguggugauggucgugau

SEQ ID NO: 1089105 - RNA, 21 nt, Mycobacterium bovis subsp bovis AF2122/97
gcccguugcaggacgcccaca

SEQ ID NO: 1089106 - RNA, 18 nt, Mycobacterium bovis subsp bovis AF2122/97
gcccguucugcccaggca

SEQ ID NO: 1089107 - RNA, 15 nt, Mycobacterium bovis subsp bovis AF2122/97
gcccguugaccugcg

SEQ ID NO: 1089108 - RNA, 23 nt, Mycobacterium bovis subsp bovis AF2122/97
gcccguguugaagaagcccgagu

SEQ ID NO: 1089109 - RNA, 23 nt, Mycobacterium bovis subsp bovis AF2122/97
gcccguucgaaguucucggugcg

SEQ ID NO: 1089110 - RNA, 21 nt, Mycobacterium bovis subsp bovis AF2122/97
gcccguuuccucagcugcucg

SEQ ID NO: 1089111 - RNA, 16 nt, Mycobacterium bovis subsp bovis AF2122/97
gcccguuugccgguuc

SEQ ID NO: 1089112 - RNA, 20 nt, Mycobacterium bovis subsp bovis AF2122/97
gcccguuugccgguucggcg

SEQ ID NO: 1089113 - RNA, 23 nt, Mycobacterium bovis subsp bovis AF2122/97
gcccguuugccgguucggcgauc

SEQ ID NO: 1089114 - RNA, 16 nt, Mycobacterium bovis subsp bovis AF2122/97
gcccguugguagccgg

SEQ ID NO: 1089115 - RNA, 20 nt, Mycobacterium bovis subsp bovis AF2122/97
gcccguugguagccggugac

SEQ ID NO: 1089116 - RNA, 23 nt, Mycobacterium bovis subsp bovis AF2122/97
gcccguuguccagaacggcgauc

SEQ ID NO: 1089117 - RNA, 17 nt, Mycobacterium bovis subsp bovis AF2122/97
gcccguugucgaccgaa

SEQ ID NO: 1089118 - RNA, 15 nt, Mycobacterium bovis subsp bovis AF2122/97
gcccuagccggcgcg

SEQ ID NO: 1089119 - RNA, 17 nt, Mycobacterium bovis subsp bovis AF2122/97
gcccuagccggcgcgcc

SEQ ID NO: 1089120 - RNA, 23 nt, Mycobacterium bovis subsp bovis AF2122/97
gcccuagcgcaugucgauccggc

SEQ ID NO: 1089121 - RNA, 16 nt, Mycobacterium bovis subsp bovis AF2122/97
gcccucaacgaucgcg

SEQ ID NO: 1089122 - RNA, 15 nt, Mycobacterium bovis subsp bovis AF2122/97
gcccucaacggcggc

SEQ ID NO: 1089123 - RNA, 17 nt, Mycobacterium bovis subsp bovis AF2122/97
gcccucaacggcggcaa

SEQ ID NO: 1089124 - RNA, 18 nt, Mycobacterium bovis subsp bovis AF2122/97
gcccucacaacgauugcg

SEQ ID NO: 1089125 - RNA, 20 nt, Mycobacterium bovis subsp bovis AF2122/97
gcccgggcagcaccagcgcc

SEQ ID NO: 1089126 - RNA, 21 nt, Mycobacterium bovis subsp bovis AF2122/97
gcccgggacaaguucgguagc

SEQ ID NO: 1089127 - RNA, 18 nt, Mycobacterium bovis subsp bovis AF2122/97
gcccgggaucggggcacc

SEQ ID NO: 1089128 - RNA, 21 nt, Mycobacterium bovis subsp bovis AF2122/97
gcccgggaucggggcaccgug

SEQ ID NO: 1089129 - RNA, 21 nt, Mycobacterium bovis subsp bovis AF2122/97
gcccggcuuuugucacaggcg

SEQ ID NO: 1089130 - RNA, 23 nt, Mycobacterium bovis subsp bovis AF2122/97
gcccggcuuuugucacaggcgac

SEQ ID NO: 1089131 - RNA, 22 nt, Mycobacterium bovis subsp bovis AF2122/97
gcccgggauaguuuucggccgc

SEQ ID NO: 1089132 - RNA, 22 nt, Mycobacterium bovis subsp bovis AF2122/97
gcccgggaaauagauucccggc

SEQ ID NO: 1089133 - RNA, 14 nt, Mycobacterium bovis subsp bovis AF2122/97
gcccgggccaccgg

SEQ ID NO: 1089134 - RNA, 22 nt, Mycobacterium bovis subsp bovis AF2122/97
gcccgggccugaaccacgcguu

SEQ ID NO: 1089135 - RNA, 18 nt, Mycobacterium bovis subsp bovis AF2122/97
gcccgggcggaacgccgg

SEQ ID NO: 1089136 - RNA, 22 nt, Mycobacterium bovis subsp bovis AF2122/97
gcccgggcgggagucgucgagc

SEQ ID NO: 1089137 - RNA, 19 nt, Mycobacterium bovis subsp bovis AF2122/97
gcccgggcggaacgccggc

SEQ ID NO: 1089138 - RNA, 14 nt, Mycobacterium bovis subsp bovis AF2122/97
gcccgggcggccag

SEQ ID NO: 1089139 - RNA, 14 nt, Mycobacterium bovis subsp bovis AF2122/97
gcccgggcggucga

SEQ ID NO: 1089140 - RNA, 16 nt, Mycobacterium bovis subsp bovis AF2122/97
gcccgggcgucaagcc

SEQ ID NO: 1089141 - RNA, 13 nt, Mycobacterium bovis subsp bovis AF2122/97
gcccgggcucggc

SEQ ID NO: 1089142 - RNA, 14 nt, Mycobacterium bovis subsp bovis AF2122/97
gcccgggcucggcg

SEQ ID NO: 1089143 - RNA, 15 nt, Mycobacterium bovis subsp bovis AF2122/97
gcccgggcgugggca

SEQ ID NO: 1089144 - RNA, 20 nt, Mycobacterium bovis subsp bovis AF2122/97
gcccgggcguugggaucgcg

SEQ ID NO: 1089145 - RNA, 16 nt, Mycobacterium bovis subsp bovis AF2122/97
gcccggggcgcacagc

SEQ ID NO: 1089146 - RNA, 19 nt, Mycobacterium bovis subsp bovis AF2122/97
gcccggggagacgagcaca

SEQ ID NO: 1089147 - RNA, 14 nt, Mycobacterium bovis subsp bovis AF2122/97
gcccgggguccauc

SEQ ID NO: 1089148 - RNA, 15 nt, Mycobacterium bovis subsp bovis AF2122/97
gcccgggucggccgg

SEQ ID NO: 1089149 - RNA, 16 nt, Mycobacterium bovis subsp bovis AF2122/97
gcccgggucggccggg

SEQ ID NO: 1089150 - RNA, 18 nt, Mycobacterium bovis subsp bovis AF2122/97
gcccgggucggccggguu

SEQ ID NO: 1089151 - RNA, 22 nt, Mycobacterium bovis subsp bovis AF2122/97
gcccgggguguucgucgaccau

SEQ ID NO: 1089152 - RNA, 20 nt, Mycobacterium bovis subsp bovis AF2122/97
gcccgggucuccggcgcacc

SEQ ID NO: 1089153 - RNA, 20 nt, Mycobacterium bovis subsp bovis AF2122/97
gcccgggugaaacgauggcg

SEQ ID NO: 1089154 - RNA, 21 nt, Mycobacterium bovis subsp bovis AF2122/97
gcccgggugaaacgauggcga

SEQ ID NO: 1089155 - RNA, 15 nt, Mycobacterium bovis subsp bovis AF2122/97
gcccggguugaccgc

SEQ ID NO: 1089156 - RNA, 15 nt, Mycobacterium bovis subsp bovis AF2122/97
gcccggguuggccga

SEQ ID NO: 1089157 - RNA, 18 nt, Mycobacterium bovis subsp bovis AF2122/97
gcccggguuggccgaaca

SEQ ID NO: 1089158 - RNA, 17 nt, Mycobacterium bovis subsp bovis AF2122/97
gcccggucuacgccacc

SEQ ID NO: 1089159 - RNA, 15 nt, Mycobacterium bovis subsp bovis AF2122/97
gcccggucgagccag

SEQ ID NO: 1089160 - RNA, 21 nt, Mycobacterium bovis subsp bovis AF2122/97
gcccggucgagccagcggagc

SEQ ID NO: 1089161 - RNA, 24 nt, Mycobacterium bovis subsp bovis AF2122/97
gcccggugagcuuagcgcaugggc

SEQ ID NO: 1089162 - RNA, 16 nt, Mycobacterium bovis subsp bovis AF2122/97
gcccggucuugggcgc

SEQ ID NO: 1089163 - RNA, 21 nt, Mycobacterium bovis subsp bovis AF2122/97
gcccgguaucgucccggcgac

SEQ ID NO: 1089164 - RNA, 13 nt, Mycobacterium bovis subsp bovis AF2122/97
gcccgguacgccg

SEQ ID NO: 1089165 - RNA, 21 nt, Mycobacterium bovis subsp bovis AF2122/97
gcccgguccgccauuggcgcc

SEQ ID NO: 1089166 - RNA, 13 nt, Mycobacterium bovis subsp bovis AF2122/97
gcccgguccgccg

SEQ ID NO: 1089167 - RNA, 14 nt, Mycobacterium bovis subsp bovis AF2122/97
gcccgguccgccgc

SEQ ID NO: 1089168 - RNA, 16 nt, Mycobacterium bovis subsp bovis AF2122/97
gcccggucacgcugug

SEQ ID NO: 1089169 - RNA, 22 nt, Mycobacterium bovis subsp bovis AF2122/97
gcccgguaucgucccggcgacc

SEQ ID NO: 1089170 - RNA, 23 nt, Mycobacterium bovis subsp bovis AF2122/97
gcccgguguguauucgccgacgu

SEQ ID NO: 1089171 - RNA, 18 nt, Mycobacterium bovis subsp bovis AF2122/97
gcccgguucagcgcuggc

SEQ ID NO: 1089172 - RNA, 18 nt, Mycobacterium bovis subsp bovis AF2122/97
gcccggugcuaaccgacg

SEQ ID NO: 1089173 - RNA, 15 nt, Mycobacterium bovis subsp bovis AF2122/97
gcccggucgcugauc

SEQ ID NO: 1089174 - RNA, 20 nt, Mycobacterium bovis subsp bovis AF2122/97
gcccggucgggcgcggggcg

SEQ ID NO: 1089175 - RNA, 21 nt, Mycobacterium bovis subsp bovis AF2122/97
gcccguagcgucgaucacguc

SEQ ID NO: 1089176 - RNA, 17 nt, Mycobacterium bovis subsp bovis AF2122/97
gcccguagcugcgcagc

SEQ ID NO: 1089177 - RNA, 19 nt, Mycobacterium bovis subsp bovis AF2122/97
gcccguagcacaccggugg

SEQ ID NO: 1089178 - RNA, 19 nt, Mycobacterium bovis subsp bovis AF2122/97
gcccguagcgucgaucacg

SEQ ID NO: 1089179 - RNA, 18 nt, Mycobacterium bovis subsp bovis AF2122/97
gcccguagacgccgagca

SEQ ID NO: 1089180 - RNA, 15 nt, Mycobacterium bovis subsp bovis AF2122/97
gcccguagcguccgc

SEQ ID NO: 1089181 - RNA, 21 nt, Mycobacterium bovis subsp bovis AF2122/97
gcccgguuguggaaccacggc

SEQ ID NO: 1089182 - RNA, 16 nt, Mycobacterium bovis subsp bovis AF2122/97
gcccggcgcggccgca

SEQ ID NO: 1089183 - RNA, 13 nt, Mycobacterium bovis subsp bovis AF2122/97
gcccggcggcagc

SEQ ID NO: 1089184 - RNA, 11 nt, Mycobacterium bovis subsp bovis AF2122/97
gcccggcggcc

SEQ ID NO: 1089185 - RNA, 21 nt, Mycobacterium bovis subsp bovis AF2122/97
gcccggcggccaacgacgacc

SEQ ID NO: 1089186 - RNA, 13 nt, Mycobacterium bovis subsp bovis AF2122/97
gcccggcggccaa

SEQ ID NO: 1089187 - RNA, 13 nt, Mycobacterium bovis subsp bovis AF2122/97
gcccggcggcggu

SEQ ID NO: 1089188 - RNA, 18 nt, Mycobacterium bovis subsp bovis AF2122/97
gcccggcuccuccccggc

SEQ ID NO: 1089189 - RNA, 22 nt, Mycobacterium bovis subsp bovis AF2122/97
gcccggcguggcuucacccaac

SEQ ID NO: 1089190 - RNA, 12 nt, Mycobacterium bovis subsp bovis AF2122/97
gcccggcucggu

SEQ ID NO: 1089191 - RNA, 17 nt, Mycobacterium bovis subsp bovis AF2122/97
gcccggcucggugcgcc

SEQ ID NO: 1089192 - RNA, 19 nt, Mycobacterium bovis subsp bovis AF2122/97
gcccggcuaggagaucagc

SEQ ID NO: 1089193 - RNA, 19 nt, Mycobacterium bovis subsp bovis AF2122/97
gcccggcuacgacggcgcc

SEQ ID NO: 1089194 - RNA, 21 nt, Mycobacterium bovis subsp bovis AF2122/97
gcccggcuacgacggcgccau

SEQ ID NO: 1089195 - RNA, 15 nt, Mycobacterium bovis subsp bovis AF2122/97
gcccggcucacagca

SEQ ID NO: 1089196 - RNA, 18 nt, Mycobacterium bovis subsp bovis AF2122/97
gcccggcucacagcacag

SEQ ID NO: 1089197 - RNA, 21 nt, Mycobacterium bovis subsp bovis AF2122/97
gcccggcguuguugaccagca

SEQ ID NO: 1089198 - RNA, 23 nt, Mycobacterium bovis subsp bovis AF2122/97
gcccggcguuguugaccagcacg

SEQ ID NO: 1089199 - RNA, 23 nt, Mycobacterium bovis subsp bovis AF2122/97
gcccggcgagcagacgcauaagc

SEQ ID NO: 1089200 - RNA, 15 nt, Mycobacterium bovis subsp bovis AF2122/97
gcccggcgacgaccc

SEQ ID NO: 1089201 - RNA, 17 nt, Mycobacterium bovis subsp bovis AF2122/97
gcccggcgacgacccgg

SEQ ID NO: 1089202 - RNA, 22 nt, Mycobacterium bovis subsp bovis AF2122/97
gcccggcgaauacgaccgucgc

SEQ ID NO: 1089203 - RNA, 13 nt, Mycobacterium bovis subsp bovis AF2122/97
gcccggcgcaagc

SEQ ID NO: 1089204 - RNA, 12 nt, Mycobacterium bovis subsp bovis AF2122/97
gcccggcgagcu

SEQ ID NO: 1089205 - RNA, 20 nt, Mycobacterium bovis subsp bovis AF2122/97
gcccggcgagcuaacacccg

SEQ ID NO: 1089206 - RNA, 22 nt, Mycobacterium bovis subsp bovis AF2122/97
gcccggcgagcagggcgucgac

SEQ ID NO: 1089207 - RNA, 15 nt, Mycobacterium bovis subsp bovis AF2122/97
gcccggcgagcaggg

SEQ ID NO: 1089208 - RNA, 13 nt, Mycobacterium bovis subsp bovis AF2122/97
gcccggcgcacca

SEQ ID NO: 1089209 - RNA, 16 nt, Mycobacterium bovis subsp bovis AF2122/97
gcccggcgcaccaucg

SEQ ID NO: 1089210 - RNA, 12 nt, Mycobacterium bovis subsp bovis AF2122/97
gcccggcgcgaa

SEQ ID NO: 1089211 - RNA, 15 nt, Mycobacterium bovis subsp bovis AF2122/97
gcccggccccgcggc

SEQ ID NO: 1089212 - RNA, 18 nt, Mycobacterium bovis subsp bovis AF2122/97
gcccggccccgcggccag

SEQ ID NO: 1089213 - RNA, 19 nt, Mycobacterium bovis subsp bovis AF2122/97
gcccggccccgcggccagc

SEQ ID NO: 1089214 - RNA, 21 nt, Mycobacterium bovis subsp bovis AF2122/97
gcccggccccgcggccagcac

SEQ ID NO: 1089215 - RNA, 15 nt, Mycobacterium bovis subsp bovis AF2122/97
gcccggcccggcucg

SEQ ID NO: 1089216 - RNA, 15 nt, Mycobacterium bovis subsp bovis AF2122/97
gcccggcccgccacc

SEQ ID NO: 1089217 - RNA, 16 nt, Mycobacterium bovis subsp bovis AF2122/97
gcccggcccgccaccc

SEQ ID NO: 1089218 - RNA, 22 nt, Mycobacterium bovis subsp bovis AF2122/97
gcccggcccgcucagccguccg

SEQ ID NO: 1089219 - RNA, 13 nt, Mycobacterium bovis subsp bovis AF2122/97
gcccggccgccag

SEQ ID NO: 1089220 - RNA, 17 nt, Mycobacterium bovis subsp bovis AF2122/97
gcccggcccgggucagc

SEQ ID NO: 1089221 - RNA, 19 nt, Mycobacterium bovis subsp bovis AF2122/97
gcccggccgccagcgcgcc

SEQ ID NO: 1089222 - RNA, 12 nt, Mycobacterium bovis subsp bovis AF2122/97
gcccggccgccg

SEQ ID NO: 1089223 - RNA, 14 nt, Mycobacterium bovis subsp bovis AF2122/97
gcccggccgccgag

SEQ ID NO: 1089224 - RNA, 15 nt, Mycobacterium bovis subsp bovis AF2122/97
gcccggccgccgagg

SEQ ID NO: 1089225 - RNA, 14 nt, Mycobacterium bovis subsp bovis AF2122/97
gcccggccggacgg

SEQ ID NO: 1089226 - RNA, 13 nt, Mycobacterium bovis subsp bovis AF2122/97
gcccggccucggc

SEQ ID NO: 1089227 - RNA, 18 nt, Mycobacterium bovis subsp bovis AF2122/97
gcccggccucggcgagca

SEQ ID NO: 1089228 - RNA, 20 nt, Mycobacterium bovis subsp bovis AF2122/97
gcccggcgaaagcuugggcg

SEQ ID NO: 1089229 - RNA, 23 nt, Mycobacterium bovis subsp bovis AF2122/97
gcccggcgaaagcuugggcgauc

SEQ ID NO: 1089230 - RNA, 18 nt, Mycobacterium bovis subsp bovis AF2122/97
gcccggccuugccgccgg

SEQ ID NO: 1089231 - RNA, 19 nt, Mycobacterium bovis subsp bovis AF2122/97
gcccggccuugccgccggc

SEQ ID NO: 1089232 - RNA, 23 nt, Mycobacterium bovis subsp bovis AF2122/97
gcccggccuugccgccggccccg

SEQ ID NO: 1089233 - RNA, 20 nt, Mycobacterium bovis subsp bovis AF2122/97
gcccggccuugccgccggcg

SEQ ID NO: 1089234 - RNA, 22 nt, Mycobacterium bovis subsp bovis AF2122/97
gcccggccuugccgccggcgcc

SEQ ID NO: 1089235 - RNA, 19 nt, Mycobacterium bovis subsp bovis AF2122/97
gcccgccugaccgccaccg

SEQ ID NO: 1089236 - RNA, 13 nt, Mycobacterium bovis subsp bovis AF2122/97
gcccgcgccacca

SEQ ID NO: 1089237 - RNA, 19 nt, Mycobacterium bovis subsp bovis AF2122/97
gcccgcgcagcacugcggc

SEQ ID NO: 1089238 - RNA, 14 nt, Mycobacterium bovis subsp bovis AF2122/97
gcccgcgcagcggu

SEQ ID NO: 1089239 - RNA, 14 nt, Mycobacterium bovis subsp bovis AF2122/97
gcccgcgccaccga

SEQ ID NO: 1089240 - RNA, 16 nt, Mycobacterium bovis subsp bovis AF2122/97
gcccgcgccaccagca

SEQ ID NO: 1089241 - RNA, 20 nt, Mycobacterium bovis subsp bovis AF2122/97
gcccgcgcccccggugccgu

SEQ ID NO: 1089242 - RNA, 18 nt, Mycobacterium bovis subsp bovis AF2122/97
gcccgcgccgccgccacc

SEQ ID NO: 1089243 - RNA, 19 nt, Mycobacterium bovis subsp bovis AF2122/97
gcccgcgccgccgccacca

SEQ ID NO: 1089244 - RNA, 18 nt, Mycobacterium bovis subsp bovis AF2122/97
gcccgcgccgccgcuacc

SEQ ID NO: 1089245 - RNA, 13 nt, Mycobacterium bovis subsp bovis AF2122/97
gcccgcgccgccg

SEQ ID NO: 1089246 - RNA, 15 nt, Mycobacterium bovis subsp bovis AF2122/97
gcccgcugccgucgg

SEQ ID NO: 1089247 - RNA, 16 nt, Mycobacterium bovis subsp bovis AF2122/97
gcccgcugcggcggcu

SEQ ID NO: 1089248 - RNA, 22 nt, Mycobacterium bovis subsp bovis AF2122/97
gcccgcgcagcgguccgccgcc

SEQ ID NO: 1089249 - RNA, 19 nt, Mycobacterium bovis subsp bovis AF2122/97
gcccgcuucagcacggugu

SEQ ID NO: 1089250 - RNA, 21 nt, Mycobacterium bovis subsp bovis AF2122/97
gcccgcuucagcacgguguac

SEQ ID NO: 1089251 - RNA, 17 nt, Mycobacterium bovis subsp bovis AF2122/97
gcccgcuguaccuccag

SEQ ID NO: 1089252 - RNA, 20 nt, Mycobacterium bovis subsp bovis AF2122/97
gcccgcugcgggaguucggg

SEQ ID NO: 1089253 - RNA, 15 nt, Mycobacterium bovis subsp bovis AF2122/97
gcccgcugggcucgc

SEQ ID NO: 1089254 - RNA, 16 nt, Mycobacterium bovis subsp bovis AF2122/97
gcccgcugggcucgcu

SEQ ID NO: 1089255 - RNA, 14 nt, Mycobacterium bovis subsp bovis AF2122/97
gcccggacgauggc

SEQ ID NO: 1089256 - RNA, 17 nt, Mycobacterium bovis subsp bovis AF2122/97
gcccggaauguagucca

SEQ ID NO: 1089257 - RNA, 18 nt, Mycobacterium bovis subsp bovis AF2122/97
gcccggccagccgcacgg

SEQ ID NO: 1089258 - RNA, 20 nt, Mycobacterium bovis subsp bovis AF2122/97
gcccggccaggucgacaccg

SEQ ID NO: 1089259 - RNA, 18 nt, Mycobacterium bovis subsp bovis AF2122/97
gcccggccaagccggcga

SEQ ID NO: 1089260 - RNA, 18 nt, Mycobacterium bovis subsp bovis AF2122/97
gcccggccaaccaccaac

SEQ ID NO: 1089261 - RNA, 13 nt, Mycobacterium bovis subsp bovis AF2122/97
gcccggcacggug

SEQ ID NO: 1089262 - RNA, 14 nt, Mycobacterium bovis subsp bovis AF2122/97
gcccggcaucgcga

SEQ ID NO: 1089263 - RNA, 17 nt, Mycobacterium bovis subsp bovis AF2122/97
gcccggcaucgcgaucg

SEQ ID NO: 1089264 - RNA, 22 nt, Mycobacterium bovis subsp bovis AF2122/97
gcccggcaguucgcggccaucg

SEQ ID NO: 1089265 - RNA, 13 nt, Mycobacterium bovis subsp bovis AF2122/97
gcccggcagcacg

SEQ ID NO: 1089266 - RNA, 19 nt, Mycobacterium bovis subsp bovis AF2122/97
gcccggacaugcgggcagc

SEQ ID NO: 1089267 - RNA, 15 nt, Mycobacterium bovis subsp bovis AF2122/97
gcccggacgauggcg

SEQ ID NO: 1089268 - RNA, 18 nt, Mycobacterium bovis subsp bovis AF2122/97
gcccggacgauggcgucg

SEQ ID NO: 1089269 - RNA, 20 nt, Mycobacterium bovis subsp bovis AF2122/97
gcccggacgauggcgucggc

SEQ ID NO: 1089270 - RNA, 12 nt, Mycobacterium bovis subsp bovis AF2122/97
gcccggacgcgc

SEQ ID NO: 1089271 - RNA, 14 nt, Mycobacterium bovis subsp bovis AF2122/97
gcccggacgucggc

SEQ ID NO: 1089272 - RNA, 15 nt, Mycobacterium bovis subsp bovis AF2122/97
gcccggacgucggcg

SEQ ID NO: 1089273 - RNA, 18 nt, Mycobacterium bovis subsp bovis AF2122/97
gcccggacgucggcggcc

SEQ ID NO: 1089274 - RNA, 14 nt, Mycobacterium bovis subsp bovis AF2122/97
gcccggaugcgaug

SEQ ID NO: 1089275 - RNA, 14 nt, Mycobacterium bovis subsp bovis AF2122/97
gcccgccgcgaacu

SEQ ID NO: 1089276 - RNA, 14 nt, Mycobacterium bovis subsp bovis AF2122/97
gcccgccgcgacca

SEQ ID NO: 1089277 - RNA, 13 nt, Mycobacterium bovis subsp bovis AF2122/97
gcccgccggaccc

SEQ ID NO: 1089278 - RNA, 16 nt, Mycobacterium bovis subsp bovis AF2122/97
gcccgccggacccgcc

SEQ ID NO: 1089279 - RNA, 18 nt, Mycobacterium bovis subsp bovis AF2122/97
gcccgccggacccgccgg

SEQ ID NO: 1089280 - RNA, 17 nt, Mycobacterium bovis subsp bovis AF2122/97
gcccgccguuacggagg

SEQ ID NO: 1089281 - RNA, 22 nt, Mycobacterium bovis subsp bovis AF2122/97
gcccgccuaaucggccugccgg

SEQ ID NO: 1089282 - RNA, 20 nt, Mycobacterium bovis subsp bovis AF2122/97
gcccgccucgaccgccagcc

SEQ ID NO: 1089283 - RNA, 15 nt, Mycobacterium bovis subsp bovis AF2122/97
gcccgccucgaccgc

SEQ ID NO: 1089284 - RNA, 14 nt, Mycobacterium bovis subsp bovis AF2122/97
gcccgccgaacgug

SEQ ID NO: 1089285 - RNA, 22 nt, Mycobacterium bovis subsp bovis AF2122/97
gcccgcccuggcaacgacacgc

SEQ ID NO: 1089286 - RNA, 14 nt, Mycobacterium bovis subsp bovis AF2122/97
gcccgccgaucggg

SEQ ID NO: 1089287 - RNA, 13 nt, Mycobacterium bovis subsp bovis AF2122/97
gcccgccagcgau

SEQ ID NO: 1089288 - RNA, 18 nt, Mycobacterium bovis subsp bovis AF2122/97
gcccgcccgagccgcugc

SEQ ID NO: 1089289 - RNA, 14 nt, Mycobacterium bovis subsp bovis AF2122/97
gcccgcccggacgc

SEQ ID NO: 1089290 - RNA, 22 nt, Mycobacterium bovis subsp bovis AF2122/97
gcccgcccgucuuccagccagg

SEQ ID NO: 1089291 - RNA, 22 nt, Mycobacterium bovis subsp bovis AF2122/97
gcccgcacguuggcggccagcg

SEQ ID NO: 1089292 - RNA, 23 nt, Mycobacterium bovis subsp bovis AF2122/97
gcccgcacucggcgguuccggcg

SEQ ID NO: 1089293 - RNA, 16 nt, Mycobacterium bovis subsp bovis AF2122/97
gcccgcagcccgccgg

SEQ ID NO: 1089294 - RNA, 21 nt, Mycobacterium bovis subsp bovis AF2122/97
gcccgccacaacggcggcgca

SEQ ID NO: 1089295 - RNA, 15 nt, Mycobacterium bovis subsp bovis AF2122/97
gcccgccacgcucgg

SEQ ID NO: 1089296 - RNA, 13 nt, Mycobacterium bovis subsp bovis AF2122/97
gcccgccaccggc

SEQ ID NO: 1089297 - RNA, 14 nt, Mycobacterium bovis subsp bovis AF2122/97
gcccgccaccggcg

SEQ ID NO: 1089298 - RNA, 15 nt, Mycobacterium bovis subsp bovis AF2122/97
gcccgccaccggcgc

SEQ ID NO: 1089299 - RNA, 16 nt, Mycobacterium bovis subsp bovis AF2122/97
gcccgccaccggcgcg

SEQ ID NO: 1089300 - RNA, 20 nt, Mycobacterium bovis subsp bovis AF2122/97
gcccgccagaacggcgucga

SEQ ID NO: 1089301 - RNA, 18 nt, Mycobacterium bovis subsp bovis AF2122/97
gcccgccagcccagcacg

SEQ ID NO: 1089302 - RNA, 16 nt, Mycobacterium bovis subsp bovis AF2122/97
gcccgccagcagggcc

SEQ ID NO: 1089303 - RNA, 17 nt, Mycobacterium bovis subsp bovis AF2122/97
gcccgagcggcugagcc

SEQ ID NO: 1089304 - RNA, 17 nt, Mycobacterium bovis subsp bovis AF2122/97
gcccgagcucaccgcac

SEQ ID NO: 1089305 - RNA, 12 nt, Mycobacterium bovis subsp bovis AF2122/97
gcccgagcucga

SEQ ID NO: 1089306 - RNA, 13 nt, Mycobacterium bovis subsp bovis AF2122/97
gcccgcaccagcu

SEQ ID NO: 1089307 - RNA, 14 nt, Mycobacterium bovis subsp bovis AF2122/97
gcccgcacccauga

SEQ ID NO: 1089308 - RNA, 15 nt, Mycobacterium bovis subsp bovis AF2122/97
gcccgaggcgagacg

SEQ ID NO: 1089309 - RNA, 15 nt, Mycobacterium bovis subsp bovis AF2122/97
gcccgcaccgucgcu

SEQ ID NO: 1089310 - RNA, 19 nt, Mycobacterium bovis subsp bovis AF2122/97
gcccgcacgaaccggucga

SEQ ID NO: 1089311 - RNA, 16 nt, Mycobacterium bovis subsp bovis AF2122/97
gcccgcacgcucggcg

SEQ ID NO: 1089312 - RNA, 21 nt, Mycobacterium bovis subsp bovis AF2122/97
gcccgacuguagaaaacccgu

SEQ ID NO: 1089313 - RNA, 16 nt, Mycobacterium bovis subsp bovis AF2122/97
gcccgacuugacggcg

SEQ ID NO: 1089314 - RNA, 17 nt, Mycobacterium bovis subsp bovis AF2122/97
gcccgagaccgggcaac

SEQ ID NO: 1089315 - RNA, 19 nt, Mycobacterium bovis subsp bovis AF2122/97
gcccgagacgguguugccu

SEQ ID NO: 1089316 - RNA, 14 nt, Mycobacterium bovis subsp bovis AF2122/97
gcccgagcccagcg

SEQ ID NO: 1089317 - RNA, 19 nt, Mycobacterium bovis subsp bovis AF2122/97
gcccgagcgcgcgcuguug

SEQ ID NO: 1089318 - RNA, 19 nt, Mycobacterium bovis subsp bovis AF2122/97
gcccgagcccagcgccucc

SEQ ID NO: 1089319 - RNA, 15 nt, Mycobacterium bovis subsp bovis AF2122/97
gcccgagccgcugcg

SEQ ID NO: 1089320 - RNA, 22 nt, Mycobacterium bovis subsp bovis AF2122/97
gcccgacagcagguugccgaag

SEQ ID NO: 1089321 - RNA, 18 nt, Mycobacterium bovis subsp bovis AF2122/97
gcccgacaguggucccgg

SEQ ID NO: 1089322 - RNA, 15 nt, Mycobacterium bovis subsp bovis AF2122/97
gcccgacacggcggc

SEQ ID NO: 1089323 - RNA, 17 nt, Mycobacterium bovis subsp bovis AF2122/97
gcccgacagauggucac

SEQ ID NO: 1089324 - RNA, 13 nt, Mycobacterium bovis subsp bovis AF2122/97
gcccgacaccguc

SEQ ID NO: 1089325 - RNA, 17 nt, Mycobacterium bovis subsp bovis AF2122/97
gcccgacaccguccagc

SEQ ID NO: 1089326 - RNA, 12 nt, Mycobacterium bovis subsp bovis AF2122/97
gcccgacacccg

SEQ ID NO: 1089327 - RNA, 17 nt, Mycobacterium bovis subsp bovis AF2122/97
gcccgaaucucgccccc

SEQ ID NO: 1089328 - RNA, 17 nt, Mycobacterium bovis subsp bovis AF2122/97
gcccgaaugcgacgucg

SEQ ID NO: 1089329 - RNA, 21 nt, Mycobacterium bovis subsp bovis AF2122/97
gcccgaaugcggugaguccgc

SEQ ID NO: 1089330 - RNA, 21 nt, Mycobacterium bovis subsp bovis AF2122/97
gcccgaaggcggcuccaccgg

SEQ ID NO: 1089331 - RNA, 14 nt, Mycobacterium bovis subsp bovis AF2122/97
gcccgaccgggaac

SEQ ID NO: 1089332 - RNA, 16 nt, Mycobacterium bovis subsp bovis AF2122/97
gcccgacccggccgau

SEQ ID NO: 1089333 - RNA, 16 nt, Mycobacterium bovis subsp bovis AF2122/97
gcccgaccgguccagc

SEQ ID NO: 1089334 - RNA, 17 nt, Mycobacterium bovis subsp bovis AF2122/97
gcccgacaugaauccac

SEQ ID NO: 1089335 - RNA, 19 nt, Mycobacterium bovis subsp bovis AF2122/97
gcccgacccaucaccagcg

SEQ ID NO: 1089336 - RNA, 18 nt, Mycobacterium bovis subsp bovis AF2122/97
gcccgacaccguccagca

SEQ ID NO: 1089337 - RNA, 15 nt, Mycobacterium bovis subsp bovis AF2122/97
gcccgacccgccgac

SEQ ID NO: 1089338 - RNA, 21 nt, Mycobacterium bovis subsp bovis AF2122/97
gcccgacccaucaccagcggc

SEQ ID NO: 1089339 - RNA, 20 nt, Mycobacterium bovis subsp bovis AF2122/97
gcccgacggaguucgacguc

SEQ ID NO: 1089340 - RNA, 21 nt, Mycobacterium bovis subsp bovis AF2122/97
gcccgacggaguucgacgucg

SEQ ID NO: 1089341 - RNA, 17 nt, Mycobacterium bovis subsp bovis AF2122/97
gcccgacgcguggcauc

SEQ ID NO: 1089342 - RNA, 17 nt, Mycobacterium bovis subsp bovis AF2122/97
gcccgacggcgcccagc

SEQ ID NO: 1089343 - RNA, 15 nt, Mycobacterium bovis subsp bovis AF2122/97
gcccgacucggccgu

SEQ ID NO: 1089344 - RNA, 16 nt, Mycobacterium bovis subsp bovis AF2122/97
gcccgacucggccgug

SEQ ID NO: 1089345 - RNA, 19 nt, Mycobacterium bovis subsp bovis AF2122/97
gcccgacugaacgucaccg

SEQ ID NO: 1089346 - RNA, 14 nt, Mycobacterium bovis subsp bovis AF2122/97
gcccgacuggucac

SEQ ID NO: 1089347 - RNA, 21 nt, Mycobacterium bovis subsp bovis AF2122/97
gcccgacuggucacugcccug

SEQ ID NO: 1089348 - RNA, 16 nt, Mycobacterium bovis subsp bovis AF2122/97
gcccgacguugccgaa

SEQ ID NO: 1089349 - RNA, 17 nt, Mycobacterium bovis subsp bovis AF2122/97
gcccgacguugccgaag

SEQ ID NO: 1089350 - RNA, 21 nt, Mycobacterium bovis subsp bovis AF2122/97
gcccgacguugccgaagccgg

SEQ ID NO: 1089351 - RNA, 14 nt, Mycobacterium bovis subsp bovis AF2122/97
gcccgacgccagcu

SEQ ID NO: 1089352 - RNA, 17 nt, Mycobacterium bovis subsp bovis AF2122/97
gcccgacgaugcgggcg

SEQ ID NO: 1089353 - RNA, 20 nt, Mycobacterium bovis subsp bovis AF2122/97
gcccgacgaugcgggcgauc

SEQ ID NO: 1089354 - RNA, 15 nt, Mycobacterium bovis subsp bovis AF2122/97
gcccgacgcgaagcu

SEQ ID NO: 1089355 - RNA, 14 nt, Mycobacterium bovis subsp bovis AF2122/97
gcccgacgacgggg

SEQ ID NO: 1089356 - RNA, 21 nt, Mycobacterium bovis subsp bovis AF2122/97
gcccgacgagauugccgggcc

SEQ ID NO: 1089357 - RNA, 19 nt, Mycobacterium bovis subsp bovis AF2122/97
gcccgacgaggaugucgau

SEQ ID NO: 1089358 - RNA, 13 nt, Mycobacterium bovis subsp bovis AF2122/97
gcccgacgaccau

SEQ ID NO: 1089359 - RNA, 22 nt, Mycobacterium bovis subsp bovis AF2122/97
gcccgaaccaccaccggcaaca

SEQ ID NO: 1089360 - RNA, 15 nt, Mycobacterium bovis subsp bovis AF2122/97
gcccgaaccaccgcg

SEQ ID NO: 1089361 - RNA, 21 nt, Mycobacterium bovis subsp bovis AF2122/97
gcccgaaaugccgggcccgac

SEQ ID NO: 1089362 - RNA, 14 nt, Mycobacterium bovis subsp bovis AF2122/97
gcccgaaccaccac

SEQ ID NO: 1089363 - RNA, 18 nt, Mycobacterium bovis subsp bovis AF2122/97
gcccgaaccaccaccggc

SEQ ID NO: 1089364 - RNA, 21 nt, Mycobacterium bovis subsp bovis AF2122/97
gcccgaaccaccaccggcaac

SEQ ID NO: 1089365 - RNA, 16 nt, Mycobacterium bovis subsp bovis AF2122/97
gcccgaacucguuggc

SEQ ID NO: 1089366 - RNA, 14 nt, Mycobacterium bovis subsp bovis AF2122/97
gcccgaagccgggc

SEQ ID NO: 1089367 - RNA, 15 nt, Mycobacterium bovis subsp bovis AF2122/97
gcccgaagccgggcc

SEQ ID NO: 1089368 - RNA, 16 nt, Mycobacterium bovis subsp bovis AF2122/97
gcccgaacgaggcgcc

SEQ ID NO: 1089369 - RNA, 19 nt, Mycobacterium bovis subsp bovis AF2122/97
gcccgaacgaggcgcccag

SEQ ID NO: 1089370 - RNA, 21 nt, Mycobacterium bovis subsp bovis AF2122/97
gcccgaacgaggcgcccagcg

SEQ ID NO: 1089371 - RNA, 22 nt, Mycobacterium bovis subsp bovis AF2122/97
gcccgaacgaggcgcccagcga

SEQ ID NO: 1089372 - RNA, 23 nt, Mycobacterium bovis subsp bovis AF2122/97
gcccgaacgaggcgcccagcgac

SEQ ID NO: 1089373 - RNA, 23 nt, Mycobacterium bovis subsp bovis AF2122/97
gccccuucgcagcauguggccgc

SEQ ID NO: 1089374 - RNA, 14 nt, Mycobacterium bovis subsp bovis AF2122/97
gccccggccgcugg

SEQ ID NO: 1089375 - RNA, 19 nt, Mycobacterium bovis subsp bovis AF2122/97
gccccuucgcgagcagacg

SEQ ID NO: 1089376 - RNA, 16 nt, Mycobacterium bovis subsp bovis AF2122/97
gccccuuggcgccacc

SEQ ID NO: 1089377 - RNA, 15 nt, Mycobacterium bovis subsp bovis AF2122/97
gccccgcuggucgac

SEQ ID NO: 1089378 - RNA, 16 nt, Mycobacterium bovis subsp bovis AF2122/97
gccccggcccgaucgg

SEQ ID NO: 1089379 - RNA, 17 nt, Mycobacterium bovis subsp bovis AF2122/97
gccccggcccgaucggc

SEQ ID NO: 1089380 - RNA, 22 nt, Mycobacterium bovis subsp bovis AF2122/97
gccccggauagcgucuggcgac

SEQ ID NO: 1089381 - RNA, 18 nt, Mycobacterium bovis subsp bovis AF2122/97
aagagguuggcggccucg

SEQ ID NO: 1089382 - RNA, 17 nt, Mycobacterium bovis subsp bovis AF2122/97
gcccagggcgaucugcg

SEQ ID NO: 1089383 - RNA, 15 nt, Mycobacterium bovis subsp bovis AF2122/97
gcccagggcgucggc

SEQ ID NO: 1089384 - RNA, 21 nt, Mycobacterium bovis subsp bovis AF2122/97
gcccaggguguccgucgaacc

SEQ ID NO: 1089385 - RNA, 18 nt, Mycobacterium bovis subsp bovis AF2122/97
gcccaggucaacgacguu

SEQ ID NO: 1089386 - RNA, 18 nt, Mycobacterium bovis subsp bovis AF2122/97
gcccaggucgaugcgggc

SEQ ID NO: 1089387 - RNA, 15 nt, Mycobacterium bovis subsp bovis AF2122/97
gcccagguccgcgug

SEQ ID NO: 1089388 - RNA, 18 nt, Mycobacterium bovis subsp bovis AF2122/97
gcccaggugacgcccgcu

SEQ ID NO: 1089389 - RNA, 15 nt, Mycobacterium bovis subsp bovis AF2122/97
gcccaggugggccga

SEQ ID NO: 1089390 - RNA, 18 nt, Mycobacterium bovis subsp bovis AF2122/97
gcccagguugauccagug

SEQ ID NO: 1089391 - RNA, 15 nt, Mycobacterium bovis subsp bovis AF2122/97
gcccagguugccaac

SEQ ID NO: 1089392 - RNA, 14 nt, Mycobacterium bovis subsp bovis AF2122/97
gcccagucgccgcg

SEQ ID NO: 1089393 - RNA, 15 nt, Mycobacterium bovis subsp bovis AF2122/97
gcccaguagaucgcg

SEQ ID NO: 1089394 - RNA, 19 nt, Mycobacterium bovis subsp bovis AF2122/97
gcccaugaugcucgaugau

SEQ ID NO: 1089395 - RNA, 17 nt, Mycobacterium bovis subsp bovis AF2122/97
gcccaugcuucggagac

SEQ ID NO: 1089396 - RNA, 21 nt, Mycobacterium bovis subsp bovis AF2122/97
gcccaugcuucggagaccgcc

SEQ ID NO: 1089397 - RNA, 14 nt, Mycobacterium bovis subsp bovis AF2122/97
gcccauggacccau

SEQ ID NO: 1089398 - RNA, 16 nt, Mycobacterium bovis subsp bovis AF2122/97
gcccaugaccggccgc

SEQ ID NO: 1089399 - RNA, 21 nt, Mycobacterium bovis subsp bovis AF2122/97
gcccaugaccggccgccaacu

SEQ ID NO: 1089400 - RNA, 13 nt, Mycobacterium bovis subsp bovis AF2122/97
gcccagugcgcaa

SEQ ID NO: 1089401 - RNA, 18 nt, Mycobacterium bovis subsp bovis AF2122/97
gcccagugaaucggaccg

SEQ ID NO: 1089402 - RNA, 16 nt, Mycobacterium bovis subsp bovis AF2122/97
gcccaguuccgcugcg

SEQ ID NO: 1089403 - RNA, 13 nt, Mycobacterium bovis subsp bovis AF2122/97
gcccaggccgauc

SEQ ID NO: 1089404 - RNA, 15 nt, Mycobacterium bovis subsp bovis AF2122/97
gcccaggccgaucag

SEQ ID NO: 1089405 - RNA, 16 nt, Mycobacterium bovis subsp bovis AF2122/97
gccauguccaccagcg

SEQ ID NO: 1089406 - RNA, 16 nt, Mycobacterium bovis subsp bovis AF2122/97
gccauggcggcgccgg

SEQ ID NO: 1089407 - RNA, 18 nt, Mycobacterium bovis subsp bovis AF2122/97
gccauggcggcgccggug

SEQ ID NO: 1089408 - RNA, 20 nt, Mycobacterium bovis subsp bovis AF2122/97
gccauggcggcgccgguggu

SEQ ID NO: 1089409 - RNA, 17 nt, Mycobacterium bovis subsp bovis AF2122/97
gccaugguggcgccgac

SEQ ID NO: 1089410 - RNA, 18 nt, Mycobacterium bovis subsp bovis AF2122/97
gccauggucgcugcguag

SEQ ID NO: 1089411 - RNA, 21 nt, Mycobacterium bovis subsp bovis AF2122/97
gccaugggaaccgacauccca

SEQ ID NO: 1089412 - RNA, 20 nt, Mycobacterium bovis subsp bovis AF2122/97
gcccaugauggccgcggcuc

SEQ ID NO: 1089413 - RNA, 16 nt, Mycobacterium bovis subsp bovis AF2122/97
gcccauggcagcccgu

SEQ ID NO: 1089414 - RNA, 15 nt, Mycobacterium bovis subsp bovis AF2122/97
gcccauggcgucgaa
